United States Patent 6,833,447 (MYXOCOCCUS XANTHUS GENOME SEQUENCES AND USES THEREOF) - sequence listing, part 3

SEQ ID NO: 1135 - DNA, 14464 bp, Myxococcus xanthus
gcagggactgcgtcaggacgtagagcttcacctggccgtcatcgaggttcgccgccagccgtgcgcttaacgcggcccggtccttctccgcctcggcgtccagcgtctccagcatccgcgcgcgcagcgcgaagtccaccggccgccggttgtccgggtccaccagagacaaatcccacagctcgcagccctggtaggtgtccacccacgccgggtgaggccatcttcagcagcaactgccccagcgcgttgtactggcccgcgcgctcgatggagcgcttgaagtcccgcacgtccgccaggaaggagcccgtcaccttcgagtcgaagcaggcgtccacgtagcgcgccaccgcgtcgtcataggcgctgtcggggttggtccacgaggtgcggaccttggcctccttgatggccttgcccatgtactcgcgcacccggcgctggaagtccgccagctcctccgcggagtgggcgtcgcccatgggccacgcccccaccaccgtctggaagaagaggtacatgtcattggccgtgggcgccggaccggacggcagttgggacaccgccttctccgtctggcgggcccacttcttcacccgcttgcgccactcctccggcacctcggtcagcacgttgatgcgcgcgcgcacgtcctcgctgcgcttggtgtcgtgggtgctggaggtgagctggctggacggccaccgctccgcgcgctcctggttgcgcaggtggaaggtgttggcgtggacgccgaagcgctccggctcgccgcccacctcgttgaggctcgccaggcggttgtagatgtagaagacggtgtcctccaggcccttggccatgacgggccccgtcacctgttgcagcttcatggcgaagcgcagcatttccgcccgctctcgcccgtccgcgtgctccgggtagcggcgcaggaggatgtcgcgcaggaagtcgaagatggacgcgttggtggtggcgttgcgctccttggcgcgctggatggtccactcgatgtactgcacgtcgcgcccgtccagctccgggcgccagccgtccacgtaggtgcggtagacggggaacagggcgatgaactccaccagcgcccgccgcagcgagttgagcgtgaagtcgcgcgtgcgccggttcatctccgagatgccgttgagcgcgtgcgccagcacgttgatttcgctggccatggacacgcgcatgatgagcagcttcttctggtagacgagctcggcgaagtccgtctgccctcccacgaagcgctcgtacgtctccgtcagcgccttctccgcgtccggctggacgaacacgccgctcaccgcgttggcgtagcggtagcccgtggtgccgtgcacggcccaggattcgggcatgcgctcacggccgccctgaatcttctccaccaccacgtacagcgccttgcgcagccggctgtccggctgctgcgtcacctccgcgcgccagcgctcgcgcagcgtggactccaccgccggccagcgcgtgtcatcctccgcatgcgtctggagaaacagagcgtgggcccgctccacgaagtacgcctcctgcaggtccaggaagtaggcggtcgggtcgaagaggccgtccgggtggtcgatgcgcagccccgtgacgagcccctcgcgcagccagcggaagatgagcgcgtgcgcctcctggaagacgtccgggtcctcttcccgcagcgcggccaggccgttgatgtcgaagaagcgccggtaattgatttcctcgcccgccacccgccagtgcgccaaccggtagctgcacgccgccagcaccgagtccagcaggtcatatgagcgcgggttgcccggctctccattgaagacgcggacgttgtcctcgatgtaggccagcatctccgggaactccgccgtcaccgcggccagccggcgcttgatgacctccttctcccggtggcgctccaccaccttcggccgctccacctccgtgcgcgagggcaggtagtcgatggcggtgaggatggacaggaactccagcatgccggggtgctcctcccccagccgcgactccagccgctccaggccatggcggaggatgcgggagtactgacgcggcgccaccggtaacaggtggtcgtagtaatggaggaagaaggcgccgtcgcggaaggacagcttcagctcccctcgctccaggacgatgccgtactggtcccccagaatcggcagcaacaccctgtcccgcagctcctccttcaccggcgaccagtcgatgtcgaagaacttcgcgtagacggaggacgggccgttctccagcacgtcgaaccacagacggttgtcccgctcgatgcccatgtggttgggcaccacgtccagcacctgccccatgccctgctcacgcagcgccgcgcagagcgccgcgtgcgattcgggcgtcccgacttcgggattcaactgttggtggtccacgcagtcgtagccgtgcgtgcttccaggcgtggccttcagatagggcgaggcataaaggtcactcacccccaggcgggccaggtacggcaccacctgccgcgcgtcctcgaaggtgaagccctggtggaactgcactcggtacgtggacaggggcgtgtggggacgcgcatccagctccgcctggacgcgtgcgtagagcccttcggccagggcctccgccgtcatcgtggcgccacccaccccattcgaggcggccccctcttcttccaaggcgtcgagcaacatgtagcgcagaggtaggccgcccgcgcgccgaccgccagcacgcagaaacgcgtccgccctctatccaacgctccgcgccgacacgccaacccctggaaatgcaaagggcccgccgcttgtcgcggcgagccccgagtacggccaccgggaggccccggccaatgctcagctcagctgcttgttcaccagcgccgtcatctcgaacatggtgacgctcttcttgccaccaaagatgggcttgagcttgtcgtcggcgttgatctgccgcttgttcttcgcgtcctgcaggccctgcttcttgatgtaggcccagagcttcttgacaacctcggtgcgcggcagcggcttcgcgccgacgatctcagcgagcgcggcagacggcgtcatctccttcatgaacgacgcgttcggcgtgcgcttcttcgcagcgggagccttcttcgcggcgggagccttcttcgcagcagctttcttggcggccattcgtcttgagtctcctcccctccgaaggggacgttgtacggctttgcttatgtgaagcgagagccgttgcggcgtagaagtagcacgcccaagcccgaaaaacagccctctcctgcgtttttccctctgagcgcccctctacgaacgcggctagagcccgagaatcagcctccggagcgctcggccccctcgcgcgccttcacttcggaacgcgtccggagcccgaaaatcagcctccggaacgttatcttccctcgggaaaccccttatcggcgtggatcactcccggaagcggccaccggattctccttgcggtcgtggtgtgtttttttggatgaaaccccaacatgagagccctcatcaccggtgcaggcggcttcctgggaatgtggttggccaaggccctggccgcgcggggagacagcgtcacatgcctgttgcgcccgggaggagatgcctcggggctcgcggggttgacctacacgcgggtggagggcgacctgacggtgccctccacgctctcggccgcggtggcgggccaggacgtcgtcttccacctggcgggcgctcgccgcggcgcgacacgcgacgacttcatgcgcgtcaacgcggagggcacccgccacctgtgcgaggccatggtggccgcgggccaccgcccccggctggtgctcacgggctcgctggccgcctgcggtccgtccacgcccacccggccgcatgtggaggaagacgccttccatccccacgaatggtatggggagagcaaggcggaggcggagcgcatcgccttctcctatggagaccggctgcccgtcacggtgtcccggccgccgcgcattctggggcccggggacagggagaaccttcccttcttcaagatggctcagcgcggcatccggctggagctgtccggcggccctcgcccgttgaccatggtggatgtggaggacgtggtgcacatcctcttgttgcaggccacccacccggcggccatcggtgaggccttcttatgcgcgggccccggcgagcccctctccttggagaaggtgcaggacctgggcgcgcaggccctgggactgacgccccgcaccgtgcgcgtgtcccccgcgctactgcgggccatgaccacggcgacggacggcgtgtcccaactgacgggccgcaagctggccctgagccggaagatggcgaagcaactgttggcgcctgcctggacgtgctccggggccaaggccgagcggctgctcggctttcacccccagcgcgacctggcggactccatccgtcgcagcgtgcagtggtaccgggagcagggctggctgtagccccttctcccccgagccgccgggaggcacgccaaactcccggcatcattgacctcccccccctcgaagtgtcaggaagcccgcagccccatgtcctcgaaagctgccttcttcgatgtcgacgggacgctcgtgaagacgaacgtcgtccacgtctacgcgtactacgcgatgaaccgcggctccgtcctgggcatcgcggggcggaccctgagcaccgccctcagcgtgccgctcttcggtgtcatggacgcggtggaccgcaagacgttcaacgagttcttctaccgctactacgcgggcctgagcgaagaccgcctggtcaccatcgccgaggacatgttcgaggacgtgctgcagcccgccctcttcgagcagacgcaggacctcatcgaccaggctcgccgcagcggctgcaagattgtcctcgtcacgggcgcgctggacttcaccatgcgcccgctggcgcgccacctgggcgccgacgacatgatcgccaacaagatgcagttcgtgggcggcaaggcgaccggcaaggtgattccgcccatcatcgaaggcgcgaacaaggcgaacgccatccgcgcctactgcaccaaggaaggcctgtcgctggacaagtgccacggctactccgacagcgcctctgactacgcgatgctcgcggtggtgggccgtcccaccgcggtgaacccggacctgcggctgcgctccatcgcgcgcgcctacaactggcccatcctcgacctcaagtaagagcccccacgccatgcgcccgttcaagacgctccagaagctgtacgacgaggaaagccaggtcgtcatcaccgagaagggcagccccccgcgcgtgctgttccacggtgagaacttcctgcaggaagaccttccggtcggcacgcgcgtcatcttcccgcgcccgcccctggccggcgtgcccaacgtcaaggccgccatccgctacgccatcaacaacccggagggcatggagccgctgcacgcgctcctcaagccgggcatgcgcctgacgtgcgtcatcgacgacatcagcgtgccgctgccgcccatggtcacgccggacgtgcggcagaccatcctggaaatcgtcctggagctggccgccgacagcggcgtggacgacgtgcacctcatcatcgccaacgccctgcaccgccggatgacggaaggcgagatgaagcgcatggtgggcgagaagatcttcgacgcctactacccggaccgctactacaaccacgacgccgaggacccggacgggatggtcgcgctggagcgcacgtcccacggtgaagaggtgtcggtgaaccgccgcgtggcggagagcgacctcatcgtctacgtgaacgtgaacttcgtgcccatgaacggcgggcacaagtccatgggcaccggcgtgtccaactacgcgtcgctgcggcaccaccacaacccgaagaccatccgcgcctccgacagctatatggagccgaagacgagcgcgctctacaagagcaacgagcgcatcgggcgcaacatcgacaagcacctgaaggtcttccacatcgagacggcgctgaacaaccgcatgttcggcggccccaccgacttcctggcgaagaaggaagaggactacacggaggcggaccggctgaagttccaggccatgcgcttcgcgctgtccaagctgccgcgcgcggcggcgcgcaaggtgctcaactccgtccccgcgccctacgacgtcacgggcgtctacgccggagccacggagcccacgcacgcgaagacgctggagacgagctacaagcagtacgtggtgccggtggagggacagagcgacatcgtcatcttccccatcccgttcatctccccgtacagcgtcaactccatcctcaacccgctgctggtgcaggtgatggggctgggctacttctacaacctgaaccgcggtgtgccgctggtgaagaagggcggcgtgctcatcctgctgcacccggcctacgacgagttcgacccggagcaccaccccagctacatcgagttcttccaccggctgctgccggagacgcgcgactccatgaagctggagcacaagtacgagcgcgagttcgcggagaaccccagctacgtgcacctgtaccgcaagggcaacgcctaccacggcgtgcaccccttctacatgtggtactggggcgagaatggccgccagcacgtaggcaaggtcattgtcgcgggcgcggagaacaaccatgtccccgccctgatgggctgggaccgcaccgacacgctcaccgaggccattgaagaggctcgcgggttcatgggccgctcggccaccatcagcctgctgcgcatcgcgcccacggtgatggtggatgtgaagtgaggacgcccatggccgcccttcccgagctgaacgtcacccagaccttcaccggcaagcgcctgctcttcgcgggcgccaccggcttcgtgggcaaggtgacgctgtccatgctgctgacccgctacgggcaggacctggacaaggtgtacgtgctggtccgcaagggcagcgccgcgtccgccgagcgccgcttcttcgacaaggtcgccaccagtgagcccttccagccgctgcgagacagcctgggggatgaaggcgcgctggccttcatccgccagaaggtggaggtgctggacggcgacatcaccgacccgtggatgggcctggaagagccccaggtggaggcgctcaccggcaaggtgcacgcgttcatcaactgcgccggtctggtgtccttcaacccgtcgctggaggtgggcctcaacgtcaacacccacggcctgaagttcgccgcggcgctggcggtgcgctggtccgtcccgctgattcacatgtccacggccttcgtggccggcaaccgcagcgggctcgtcttcgaggacgaggaggttcgcggctacttccccaagcgggaggagatggacggccgcgacttcagcctggagcaggaactgcaggacgcggcgcgcatcgtcgcgcggctgcgcgagcaggccgaggaccgggccctcacgtccaccttccgcaagaaggcgttggaccggctggaggaagaaggccgcgaccccaacgacgagaagacgctgcggctggcggtgggccgtgagcgcaagctgtggctcagcggcgagctggtgcgcgccggcatggagcgcgccgcccactggggctggcccaacacgtacacgtacaccaagtccctgggcgagcaggtgctcgcggccacgccgggcctgcgctactccatcgtccggccctccatcgtggagagcgcgcggcacttccccttccccggctggaacgagggcttcaccacctccgcgcccctggccttcgcgggcatcaagggccccggcggcatccccgcgggcgagaacaccatcctggacatcatcccggtggaccaggtggcgggcgccaccatcggcatcaccgcgcatgccatggacgtggaggagcggcgcatctaccagctcgcctccggcgatatgaatcccttctacgccggccgctccgtggagctggtgggcctgtaccggcggcgctactaccgcaaccgcgagtccggcaacgcgctgatgaacaagctgcgctcgcgcgtcgagccgcagccggtcagcaagaaggagttcgagctgttcagcgcgcccatgctgtcgcgcggcgcgcgcttcctgaagaaggccatcgacgaggtgcgtcccgcgtggggcgccccggccgtccaggccatgctggacaaggcgaaggtgtcgctggacgaggtggacgacaacgcccagggcatcatcgccctgacggagctgttcctccccttcctctacgagaaccgctacgtcttccgctgcgacaacacccgctccgtgtatgcgcgcatggcgcacgcggaccggctgaaggtgccctgggacccggagcacatcgactggcgcgagtacttcctggggacacacctccctggcctggagaagtgggtgttcccgggcatggagtcggagcgcgagaagcgcaccgtcatccccgcgcaccgcgacctgctggagttgatggaagccacggtgcatgcgtaccggcaccgcgtggccttccgcatggtggcgggcgagaaggaggagcgcttcacctacggcgaggtgcaccgctatgccgcgcgcgtgggcagcttcctgctggccgcgggcatcaagcacggcgaccgcgtgctgctggtgtcggagaaccggcccgagtggggcatcagctacttcggcatcctgcgcgcgggcgccaccgtcgttccggtggacccgggcttgagcgaggcggagctcgtcaacatcgcccgccgggcggacgcgcgcgcgtgcctcgtctccgaggacgcggcccgggacttccccggcctcttcgccgcgctgggtgacggcgtcaccgtggccagcctcgcggaggcgatgacaggcgacccggcgcacccggaccgcatcgggccagtgcgcaggtccgccgcggcggatgacctggccagcatcatcttcacctccggcaccacgggcacgcccaagggcgtcatgctcacccaccggaacttcgccgcgctggtggcgaagctggcggggaccttcgacatcggcgtgggcgacggcgtgctgtccgtcctgccgctgcaccacaccttcgagttcgccgccggcttcctcaccccgttctggcgcggggcggaaatcacctacatcgacgagctgacgtcggaccggctgggcgaggtgttcgagacgggccgcatcaccgccatggtgggcgtgccggcgctgtggcagctcttgcatcgcaagattacgcaggagttcgccagccgccctcagttcatcgaacaggcgctcaaggcgctgatggccacccacggcgagctgcgcaaccgcaacaacatcaacctgggcaagctgctgttctggccggtgcaccgcaagttcggcgggcgtatcaaggtcatcgtgtcgggcggctcggcgctgccggacgacgtgcacaaggccttccacgagctgggcttcaacatcacggagggctacggcctgacggaggccgcgccggtgctggcggtgacgaagcccggcaacaagcgccagcccggtacggtgggccgcgcgctgcccggcatcgagctgcgcatcctcaatccggacaacgacgggttgggtgaagtgctggccaagggccccaacgtcatgcccggctacttcggcgaccgcgaggccaccgaggcggtgctcaaggacggctggctccacacgggcgacctgggacgtctggacgcggagggccacctgtacctggtgggccgcgcgaaggacgtcatcatcgaccacaacgggaagaacatctacccggacgagttggaggagctgtaccaggaccacacgcacatcaaggagctgtccatcgtcggcctgcccgacgacgcgggcggtgagaaggtggcgtgcctgtgcgtgcccgactacgcggaccgcccacgcgaggaagtgcgccgcgagttggaggagcacttccgcaaggtgagcgcgggcatgcccttctaccggcgcgtgaaggtgctgcgcctgtgggacggcgagctgccccgcaccgccaagcgcagcgtgaagcgcaagcaggtggtggaggagctcaagcgccaggagcgcatggcggccagcgccagcaaggcgcgcgagaaggcggccaaccccaccacgggtggcatcgcggactggctcttcccgctcatcgcggacgtcagccaccggccggtgtccgacgtgcgtccggacgcgctgctcagcggggacctcggcttcgactcgctgatgctcaccgagctgtcctccgcgctggaggccgccggcgtgccgctgcccgcagtggaggacctgacgcaggtgcagacagtggaggacctgcgcaaggtggtggcgtcctccggcaagcgccccacggtggagacgcgcgcgaaggagatctccaaggagaacgagcgcgcggaaaaggtggagattccggggcccgacgtggtggcggacgtgggccgtcagctcttgtccttcgggcagaaggtgctctacggcggcgtgttcgacgtgaaggtgacgggcaagtccttcatcccgcagaaccgcaacttcctcgtcatcgccaaccactccagccacctggacgcgggcctggtccgcgtggcgctgggtgaccagggcgagcgactggtgtccctggcggcgcgcgactacttcttcaacacgccgctcaagcgcgcctggttcgagaacttcaccaacctgatccccattgaacggcagggctcgctgcgcgagtcgctgcggatggcgggcgaggcgctgcgtcagggcttcaacgtcctcatcttcccggagggcacgcgctccaccaccggtgagctgatggagttcaagtccacgctgggctacctggcgctcaccttcaacatggacgtgctgccgctgtacatcggcggcgccttcgacgcgctgcccaagggcagcgtgctgcccaagacgaagacgcccctgcgggtgaacatcggtccggcgctgggccacgcggacctgcgcacgcgggtgcagggcatggcgcgctcggagggataccgctacgtcacgcgcatcgccgaggactccatgcgggcgctgcgcgacggccgggtgctgaacctggagcgcgtggacctgcctccggccggggccagtccccgcgcgtccacgtccacggaagggaaggactcgtgaagctgctggtgacgggaggcacgggctttctgggcacgcacctggtgcccaggctggtggcggcgggccacgaggtgcggctcatcggccgctcgcggccttcgggcgccccctacgcgggcacggagtacgtccccggtgacttgaagaaccgggacgcggtgcgccgcgcgctggagggcgtggacgccgtctaccacctggcggggctcgtctccttccagccgaaggacgcgcggaagatgttcgagctgcacgtggacagcacgcgcgagctgctgcgggacgtgcgcgaggccggcgtgaagcgcgtggtgctggcctccacctccggcaccatcgcggtgtcgaaggaggcgcacgtccgcgacgagagcgccgactacccgattacggtggtgggccagtggccctactacctgtcgaaaatctacgaggagaagctggcgctcgcatactgccgcaagcacgagattcccctggtggtgctcaaccccagcctgctgatggggcccggggatgaccggctgtcctccacatggacggtggtgaagttcctcaaccgcgagattccggccatgccgggcggcggcatctccttcgtggacgcgcgcgacgcggcggacgccttcgtccaggcgctcacccggggcgaggtgtacggccgtcacctcatgggggtgaatctgtccatgaaggacttcttccagcggctggagcgcctgtcgggcgtgcccgcgccgaagctgaagctcccctccaaggtcaacgtgctcggcgggaagctgctggagcgctgggccaaggtgcgcggcaccacgccgacgctggacccgcaggaaatcgacatcggcgagcactggttctggctggacgcatccaaggcggaggccgagctcggcttccgcgcgcgcgacatccaggagacgctctccgagacggtgcagcacatctacgggaagatgccgccccagagcctgcctggcaccaagggccggctggcggagctgcgcgagaacacctgagcgaagctcgcggcgggagcttccgggcaccggactcccgcccctgacctggccgcggggagcgcaccgcagcccggcgtcgcgccgcgaccggagccatccgggcgacgccgcccggcggcaccgcgccaggcgcttcacctcacccctagcgcggcggcacacccaccgtgcgcagggcgttgtccaccaggcgcgcggcccagggctccgcgcggtggctccacacccaggccgcgccgaggaaggcgcagcccaggagcacgagcaccaaccgcgcgaggaaggacggacccgcttcgcttgcgctggcggccacgacctagcccaccacgcggttgcggcccgacttcttcgccttgtacaggttggcgtccgccaccttgatgaagtgcgtgggctccagcatgtccgacgtctgctcggccacgccaatggagatggtgacggggatttccttgtcgtcgtagacgaaggacttgccctcgatgagccggcgaatcttctccgcgaacaggcgcgccttgtccgggccgtcctccgggaggacgacggcgaactcctcgccgccgtagcgggcgaagcactgctcgcggcgcaccaggcgcttgatggactgggccaactcccgcagcacgtagtccccggcgaggtggccgtggacgtcgttgatctgcttgaagtggtcgatgtcgaacatcatcagcgtgagggtgcgctgatagcgggtcgaccggcccatctccttctcgaggtactccaggaagtacctcttgttgttgatgccggtgagaccgtccgcgatggtcagcgtgtagatggtctcgtggtactgggtctcgatgttgtcgccatcgaggaacttgaagatggagcctccgaccttgaccaggtctccgctgcgcagcggagaggcctgaagcacttcctggtcattgaggaaggtaccgttggtggagcccaggtcttcaacgagcatcttccccccacgccccagaatccgggcgtggcggcgggacacgttgtccaggtccacgacgatgtggttgtgctgatcccgcccaatggtgagttcggcatcctcgatgaggtacttcttgccgagctcggggccatgaatctgcacgagacaacactccgtgctgcggtgggcatgcacgttgagcgttgagatcttggtgacgcgggtttcgtcgccggccatcggaaacgaggctagcacgatagcctcggcagacgccatgcaacgcagcgggggccggttcttcggccctttgcggcgcttctcccacatgccacccgggagcggccgccgggctaggcccggcaacccgaggcgtcgggacgtccagcgccggtcaggacacctgaacaggcggttcggcattcaacgatggctggcaggcgggcacacgtgcccttgccggccccccagggacgactaacgtccggaacacctatgtccaaagtcctggcgatgattctggctggaggcgctggcacgcgcctggagcccctgacgcgcgagcgcgcgaagcccgctgtccccttcggcgggcgctaccgcatcatcgatttcgttctctcgaacttcgccaactccggtgtgtaccggatgaaggtcttgacgcagtacaagagcgactcgctcaacaaccacctgtcccgcgcgtggcggatgacggcgttcctgggccactacgtggaagccgtccccgcgcagatgcggacggggctggactggtacaagggcagcgcggacgccatctaccagaacctcaacatcatcaccgacgaggagccggactacatcttcgtcttcggcgcggaccacgtgtaccggatggacacgcgccagatgctggacttccactgcacgaagaaggcggcgtgcacggtggccgcgattcccgtccccatcgagcagggccgcgagttcggcatcatcgacgtggggccggacgggcggatgcggcagttcctggagaagcccaaggacccgccgcccatgccgggcaacccgaagatgtgcctggcctccatgggcaactacctcttctccaccgacgtgctggtg

SEQ ID NO: 1136 - DNA, 16047 bp, Myxococcus xanthus
agggcgcgctgccatagcgagcagcaccgcgcgtccaaggcaatcacacgtcgagacaggtgggagtgtctcctcctggcggagtcgatgcaggcgagcaggcttccgttaccgcctcgtgaacatctggcgcggctcgggtgtcccaacgttatgcatttcagggtgcacttccgtgcacgccacgccgacattgacgctcagggacttcccctggccgtcacgaatctctaacctcaccctcccggactgcgttgggtgctcgcctcggacccatccaggacctccacgcagtgccctcgcaaggagtccccgcatgtcgttctccggaatgctccccctcccgttcgccaccgtggacatcgcacccgtgggagagcagctgatcgccgtgggcggcctcgtggtcgccgggctgggggcgctctgggccgcctggacgcggccgtccgcgcagccggtgcccattcccgtgcgcggcggctcgtcgcgccgcaacccgcgtcgctgaagcaccgcgaagggcgcgaaggcggggtgagtccccgcccgcgcccctgaaagcagcaccccgcctcagcgcttgaaggccagggagagggcgaagtcgcccgcggcgtccgtccaccactcggccagcgtgagtcccgcggccgacagctcggatgccacctgctgctggtggaacttgcagctcacctccgtgcgcaacacctccccttcggcgaagtccacctgcttgcgcagcgtggacaaccacaccgactgcgcgcgccgggacaccaggcgcatctcaatccaggcgttcttctcgtcgaagggcgcgaagtgctcgaaggcgtccgggtcgaagttccctcccagctcgcggttgagcaccttgagcacgttgcggttgaactcggccgtcacgcccgcgctgtcgttgtaggcggcgtacagccgctcgcggtccttgatgaggtcggtgcccaggagcagcccgtctcccggctgcagcccggcggagagctgcctcaggaagagcgcgcgctgcgccggcttcaggttgccgatggtgccgcccagaaaggccaccagccgccggccgccgttggggagctggcccaggtggcgctcgaagtcgcccaccaccgcgtgcacggtgatgcccgggtactcgcgcgccaggcccgacgccgcgcgccgcaggaaggcctcgctcacgtcgaaggggacgaagcgcgccagccggcccgcctcctccagcgcgtccaggagcaggcgcgtcttctcgctggtgccgctgcccagctcgatgagcgtgtccgcgccgctcaagcgggcgatgtcaccggcgtgggccagcaggatttcccgctcgcgccgcgtcgggtagtactccggcagccgggtgatgtcgtcgaagagctggctgccacgctcgtcgtagagccacttgggagacagctccttgggcgtgccgcacaggccctggagcgcctcttcccggagggcgcgcttcgcgtcgcccggtttcacgtaaacgtccacctggactcccggcgtgtgctgcgcgtcttcgcccggagtcgccaccgtcggtaccgtcgtcacccgcatcgcctcacctcacctcgcgttccgtgcacagcggaagccggcgaaaatctgccggcggttggggaagtcccaattgcggaagccgttgcgcattgcgaccggtgcgctggcccacgcgcctcctcggagaaccttgtaggactcgccgaagaacacctcggagtactcggggtacgggaaggcgctgaagcccgcgtacgggcggaagtcgctcgcggtccattcccacacgtcgcccagcagtccccagacgccgtcctggctgacgccttgtgggtagctgcccaccggcgccgggccccacgtgcttccgtccaggttggcgcgggcccgggtgggcggcgtgtcgccccaggggtactcgcgggggcggccgtcactgccgcgcgcggccttctcccactcggcctcggtgggcagccgcttgccggcccagcgtgcgtaggcgtccgcctcgtaccagcacacgtgctgcaccggctcgtccttgggcagcggctccacctggccgaagcgccgccgcagccaggtgtggttgccctggggaagccagaagcccgggtacttgagcccttctgcctggatgacctcccagcccttggggtgccaccagcgcgggtcctcgtagccacccgcctccacgaagacgaggtagtcgccgttggtgacggggtgcgcgtccatcaggaacggagcgacgtgctgggagaacgtgggccgctcgttgtcgtaggcccacggtgacgtgctgcccagccgcgcctcgccgccggggatgaagacctccgcctgcggcacggcgccgggccggggccgcgggcgcgccgagggcacgtggtactccggcgacgtcatgagctgcagcgtggcggccagcgtctccgcgtgctgctgttcgtgctgcgccaccatgccgaagacgtagccgcccgccagcagcggcgcggtgctgtcctcggggagccggtgcaggtgctcgcgcaccgcctcacgcacgcgccgcgcgtaggcgaaggcggcctcgggtggcagcagcggcagctcggcgcgcgtggagcgcgggtgccggaaggcgtcatagatggcgtcgaacgccgggtcggtgatggccggcgcccccagcgcccggagcagccactgctcctcgtagttggccacgtgcgccacgtcccagatgagcggcgacatgagcggggaatgctgacggcgcagctcgtcctcgggcagcccgccgagcatcgccagcacgcgcgcgcgcgccgtctccagctcggtccaggcacgggacttccagggcggatgggccccgccttcctctcgcgggtgactccgttcctcggccatttggaacatcacccgtccaaggtagggaggcgcccggcgcggaggtaagcccccgcctcaccggcgcccgagcggctcgtgaaggagcgcacgttgcccgcgcgcccccaacgccttgtctctacgccgggcgtggagcctcgtcctgggctcaaccgggaaatcctccaggaaggttgaagctcaaacactatacccggccctgagcggatccgctcagggctcgttggggacgcgggcgaggccgagcagggtgagcgtgcgtgagcgttcgtcccacgcgtactccagctccagcccgtgctgcggcacgacatgccgcgccaccaggccgttggccgcttggggctcgcgcagggccgggtcgcccaggcgctccagcacctgctggagtgcatggaaggtctccgccgtcatgcggcccacctcccgccacgcttggggtgcgtaatgcacgcggtgagggccctgtcgttggcggagctgcggcatatcccggtggtccttcgtcctttccgggatgctccgtatgccaacggcgtgcccaccctccgtcgcttggattttcaacaagctggggcaggtgcggggtgacccgggctgcaggagttacaggctggcgacagcggaggcagaagaaaggacaggctcgaagtcccgggagtcactgtttgacggcctttcggggccgcctggccaggtcccatccgggggtgcgtgacgcgaatgtcccggcagcggggcgcggcttggaaatgcgaggccggcccggtggccgaccagggaggcggcgtcgcggacctccgccgcgtcgtggctgcccgcctgtgccgggcatgcccaggttgaacgcagggccgagcatgcggcgggcccaggcaaggaggaaggatggctcggcggaggtacactccctggtccgccaccaacggcctgctctttggcatggccgcgggcgtggtgctggcattggcggaggtggtgctggcggtggcgtcgggggacaacccgatgcatccggtgcggatgtccgccggggtgctcctggggccgtccgccttcacggccgcggtctccgacagcacggccctgctgctgggcatgggcgtccacctgatgatttcggcggtggtggggctcttctactccgtgctggatgcgttcctgccgccagacgggcgcagccgctgggagttccaggccgcggtggggatgctctacggcatcttcgtgtggctggtgaacttccagttcatcgggcgtggctcgtatccgtggttcctggacgtgccgcagttcccccagattgtggtgcacgccttcttcctgggactgccgctggcgtcgctgttcaccgccgcggagcgtcgccggctgctgctggatgcggcggagagcacccccgctcgctgagactcgcgagcgctttgaaaaaacgcggaaggtatggtgaaagtacccgaccttgagggttagctgggccggcccttcttccgtggactgatacacgcatggacacagaactggcgagcatgctgggggccgcgtcgaggcccgcccgggtgcggatggggctgacgcaggcggatgtcgccgagcgcattggcatggcgtcggaggtatacgggcggttggagcgcggccacatgctgcccagcgtccagaacctgcgccggctgtgcatggtgctgaatgtgcctcctcacgaactgctgggcctgggcgagggcttcaccgccccgccgccggtgaaggagaaggccgccgcgaagaatcgcgaggaggacacgccggagatgcggcggctgatgcgcaacctgcgcaagctgacggcggtgcagttgaagctgatgaacctgatcgcctcggcgatgcagcacaagaagaagtagcctacggctggttccgcgtgacgaaggggaacgtctggatggcgaagttccccgccgggtcatccatccacacctccacggtgtgctcgccgtccaccagctcgcgcgtgtccagctccgccgaccaggtgccgtccggctggagcgtggcggcccggatgccggagccatcccgcgtgaaggccacccaccgcacgccgctcaccgcgtccgtcacccgcgcggtgatgtgaatcacgccgctgtacgtctgccccggcaccggcagcagcagtgaggccaccggcgcggcgtcgtcgtagcgcaccgtgcgcgacagcgtggcgcgcatgcccgtctcgctcgtcacgtcgatggtgaacgcgttgtccccgggcaccaggtccagcgtcgcctgcacgccgccgccaccccggggcagcgtgtacgtccgccccgtggacagcgtcaccgtggtggcggacgcggagtacacgccgatgtcgtagggcatcgcgttccccggctgcggcccgacgagccacccatccggcaggcccgtggacacccacggtgcctccgcgtccacccacaccgtcagcatctgctccgtgacgtggcctaccgaatccgtggctcggaccaggatgaggttctcccccggccacaggtccacccggtgcgtcacgtccccgccgcccgcgggcacgtccgtcacctgcacccagttggtctccacgcgcaccggcgaccagtcacgcaccaccatccgcacatccacgctgtaggaacgcagggccgcgccgttggccggtgagaggaaggtgagctccggcgcggtgttgtccaccatgaccacggcttcctcgctggcgatgccgccgaacgagtcggtggccaccagccggatgacgttgggcccgtccatcagcggcagcaccgtgtccacgtagccgccgctggggtcgggggccaccgggtggctgacgccctggatgacgaaggtggctgagtcgatttccgcgcccgccgccagcggagtgacgaagccgcacacctccagcgtcagcgcgtccgtgaagcccggcagtccgcacagcgtcaccgacggcgcggggaagggggacgggtgcacctccaccgcgaacgacgcggagctgcccagccggttctcccgcgcgggcgccagcgtcacgcctgaatacaccgcgcgcaggtcccggacgcccacctcgctccaggtggaggcgcgcggacgccacacgaaggagtagacgccgtccccgtccgcgtcgttgtccgcgcccaccgtgacacccgccacggagaacgtcaccacgcccatgccggggcctcgtgcctcccagccgcggtcatccaccacgcgcgcggacagggtgttgttcagcgccaccgtgagctgtccgtccacgggcgaaagcagcgtggtggtggtgggcacgccgtcggtgggcggcggcgggttggtgtaggtggtgacgcgcaccgagcccttcactccctccgcttcctgggaggccgccaccaccatgacgtccgaggtgagcgacggctccagcccctccggcgcggtgatggtgagcgtgagggtggcctcggtgtccggtgccagctccagcgtggtgcggctcagcgtcgccgtccaaccggtgagcccgccctgggtgctcagccggtagctgtccgtccggtagccgtggttgcgcaccgtgacggggtaggtgacggactggatgcgtggcaaatcatgctcgaagggccggcgcgacccgccgctcacagtgacgcccacgctgtagtcgccgaagcacgccagccccagcgaggcgaaggtggtggggatgtccggatagcgcgtgtccgcgccccagctcccgttcaccgcctgccgcgccttgagccactccagcgcttctgacatgcgcccgtccgcgccgggcttccggcccgcgaggcacagcgcgtacagggagatgccggtggcgaactcgtccggcacgtcgccttccagcgagccccagcccggtgcgcctccgcccgcgcgcgtggacagaagccgcgtggccatggtgtccagggcctgggtgttcaccgcgttggcgccggggccggcggccttgagtcccaccatggcccacgccacctggtgcgtgtagcgctggccgtcggtggccgggccgtccgtccagtcattcatgtgcgcgcgcacgtagtcggccgctcggtccagcgcggcctggtactgcgaggccttggccgggtccacgcgctgccgggcctgggcaatggccgtcatcatccgcgcggtgacgccgacgtggccgtagcccaccgggtagaaggggaagtcctcgcgccagcggccggtggcctcctgccgcgtcagcgcccagtccgcggcgagcaccaacgcgtccgagtaccgcgtgcccaggtgtgcgtcgtagcccgcgagcccgaaggcggagtagctcgtcttcgcgttgggatagaagatgccctcgtggaaccacgagccgtccgcgcgttgttcggagacgagccgcccggcgatgaactccaggttctcccggttggtgcgcccgttgtacgtgagcgcgtccaggtcgtagccggtggtgcgcgcgttcgcgaggccgaacatcgccgcgccgtggcggtgacacgacgtgcagccgaaacgcaccgaccagttcgccgcgtccgcgctgaggtagttgatggcgcgctgcgcggactcggcgttggtggccgcgcgtgcgggcccggcgagcagcaggcccgtcagcgcgacgaggaagaacgtgacgcgcgcgagcgcggcgcgcggcaaggcaggagaagcggcgtgtgagggcatggggggctcgctcgaaggataccgctctgggtattcatgcaagcaaagcgcccgaggaagtgagcgcatgcctgtcgtggaggcatgacagccatcatcttcacgtgagggtcgcgccccaccccgaggccacttcgccccgaggcaatcgagacacatgcgcaatccatgttcatcgcgctgacgcgccgcgtgtgcggctcccgcgcgattgacatgacacgccagacattcgctggatgccgtgctggcggtgaatcacacgcattcacgcgacaggcattgcctggcgtcatcgcggtgcttcgtcggggcggcgcgcgtcgcctgggggcggtgcttcgtttccagggacgggcgtttccggcgacagttgtggcaaggggcagcgttttaacaggggccacgcgcggtacatggcccggcgctcttcctgggtgagggggcgggcgggggctggggtgacatcagggacttcgggcggtggtcggcggagcaggacgacgctcagcaccaggcacagcatgcctatgagcacgatgctccatgcgcgcgccggtccgtgcagcatccgtctgtcttccacaccgcgttcctcagaaggtcccctgcttcaacacgtcctgcttggagattgtgcccagcaggcgccgctctccgtccacgacggggagccgctccagggaggtctccgtgaagcggacggcgacctcgctcagggacagtcccggggtaatcgggcgcacgcgcatgtccatcacgtccgcggcgatggtggcgtgcagctgtgagtggtccggcagatgccccttcaactggtcgagcaccagcgcgccccggtaccggcccgcctcatcagtgacgtagaggtcctggcccaggggctgctccagtaggaacgcgagcacctgctggagcggcgctgacggaggtacgcgctggtgcacgggcttgagcagcgcgcgggcgccttcctggcgcagccagtgcggcacggtggcggggacgcgcacgttgcggcggttgagcacggaggtgtacagcgactccggctccaggcgctggctgacgaccgcggacaccaccgcgctgagcatcagcggcagcaccagcgggtagtcgccggtgagctcgaagatgaggagcaccgcggacaccgacgcgtgcgtggtgcccgccagcaccgcgcccatgcccagcagcgcgtaggcgccgctgggcgcgccgccgggcagcacccattcggcgagcatgccaaaggcgccgcccagcagtccgccgtagaagagggatggggtgaagagtccgccgggcacgccggcgccggcgcaggtggcggtgagggccagcttcgccagcggaagcagcagcaggtgggccagggagagcttgccgagcagcgccccgttcaccgcgtcatagccgttgcccagaagctgcggcagccacactgccgtcacgcccaccaccgtcatggacatcaggggtaggaagggcgccagccacgcggcggccctgtccaacaggtccgacatgacgttgatgccgcgcacgtagaaggcggacgcgacgcccagcaccacgcccagcagcatggccagcactagctcgcgcgggtgcagcagcgtgtagtggggaatcacgaaactggggtggtccgcgatgaggccgcgtgacacgagcgtcgccaccacgcacgagacgacgatggggccgaacagctccagcgcgaagctgcccagcagcacctccaggccgaagagggccgcgccaatggggacgttgtacgcggaggccatgcccgcggacgcgccgcaggccaccagcaggcgggcctggccggggcccagccgcagccagcgggccagcgacgaaccactggccgcgccggtggacagcagcgcgccctcgcggcccagcggcgcgcccatcgccacggcgaggatggagaccagcccccgcagcagcgcgcgcggcagcgacaggcggccggacttcacccagatggattcgatgatgcccgcggtgccgtggccccgcatgggccggccgacgatgagcgtcagcagcgtcaccagcgcgccgccgagaatcgggatgagcacccggcgccacgtgggggccgccgcgacgccggccaggaagtcctcgcccgcgctgcgccagaagagctgctgggtgaagcgcagcaccttgagtagcgccaccgcgcccaaccccgcgatgagccccaccgcgacgacgagcagccagaagcgctgctccgggccggtgaggcgccccatcagcgcccggacggatccgccccgcccgtgggcgccgtccatgccgggagggccgttggctgcgtgtcgggcacccacgcggatccaagttaggcgctgctttcgggcgggaagggccgggggccccgggctggccgtcacccggccgtgggacggggccccgcgccgcctcgcgccgacctgggaacggcttgcgtccggggccgtatgcctgatggggaggggcgggcaggcggctcctgattggcgcggcgcttgccctcctgaaactgaaacaggtggcaggtgtccgctcgagggctgccgccgggggcggggcgtccgtgcaccgggccgttggtgcgccgcctaccgcgaggagcgccaggcggcgtgcatcgtagggctggcgggccgccgcggcctcgcacgtgttggccgcggcgctccacgtcgccggagcccacccaggatgtcagggtgggccctgcgctcaccgcgtcagttgctgacgacgatgttgaagctctgcacggcgaagttgcccacgccgtcgttcatccacaggtcgatggtgtgcgcgccgttcaccatctcccgcgtgtcgaactgcgccgtccacgtcccatccgactgctgggtgcccacgcggatgccggacatgtcgcggctgaagcccacgttcgtcaccgggccgaagttgtcggtgacgcgtgcgcgcacggtgatggtgccgctgacggtgctgcccgcggtggggctgagcagcgtggccgtgggggcctgcacgtcgtagttcacccggcgcacgaggttggccgtcatgcccgtctcgctgatgacggagatgcccagcgtgttgacgcccggggccagcgtcaccgacgtctgaatctggccgccgccgcgaggcaggtggaagggctcccctccgttgacgcgcaccgtggtggcggagaccgtctgcacgttgatggcgtactggaaggtgccgttgggcagcgggccgtagatttggccgtccgcgaagttggtgctcaccacgggcgtgcccgcgtccacccacaggtacagcagcttctcggtgacgttgccggcgctgtcggtggcgcgcaccaggatgacctggttgccgtagctgacgttcaccgggtgctccacggtgccgttgccgaactccaggagcgagctgttcacccactgcgtctccacgcgcacgggcgtctggtcctgcacggacgagcgcaccgtcaccaccggcgtgttcaccgcggcgttctccgcgggcgacaggatggtgaggatgggggccacccggtccaccgtgaggttgacctgcttggtggtgacgccgccgaagctgtctcgcgcggtcatctggatgatgttggggccttcttccagggtgatggaggtgtggatgaggccgccgttgcccggcgtgaggacgatgggcgcgccgccgttgatgatgaacgcggcgtaggtgatgacggcgcccggcgcgcgcggcgtggcgtagccccagatgtccagcgccgtctcccgcgtgaaggccggcgggttgccgatggtgaccatgggcgtcaggtgggggaacgggtcgatgatgagggtgctcgacgccgtgctgcccagcaggttggccagcggggcctgccgctccacgccggagtacaccgcgcggtagtcctgcgctccggtgatggtccaactgtccaccgcgggcacccagttgaaggcgtagatgccgtcgccatccgcgtccacgtccgcgcccacgggcacgcccgcgacgtagaaggtgacgacgccatgggccgggcccgggacgatggcgcccccgttcgtcacgcgcgccgacagcagggtgccgttgccaacggtgacgcgggcgttggccgcgggcgtcacgatggtggtgacggtgggcaggcccgtcacgggcggcaggggcggggtgtatgccgccacgcgcgcggagccagtgacgccgggcgcgccgccggacgaagcgatgagcgtcaccgcggaggtgagcgcgggcagcagccggggcggcgcattgacggtgacggtgacggtgccttcgccacccgcgggcaggaagagggtgacggggctcacggacgcggtccacccgggcaggccgccctgggtgctcagcgtgtacgtgtccgcctgatagccgtggttcttcacggtgaaggtgaacatggcctgctgcggcgacgggttgtcgatgctcagttcctgccgctccgcgccgacgacggagacgcgcacgctgaagtcaccgaagcacgacaggcccagggccgcgaaggtggtggggatgtcgaaggtggccgagccggtgcgccagctgccgtccggcgactgccgcgtcttcatccactcaatcgcgttgcgcaggcgcgggtcggtggcgggctcacggcccgcgaggcacagcgcgtagatggcgctgccggtggcgaagtcgttggactcctcgttgggcaggttgccccagcccgcgttgccgggggacgtgcgggtgatgagccgctcggccagggtgttgatggcgccggtgttgacgtcgttgaggccggggcccgcggccttgaggcccagcaccgtccaggccacctggaaggtgtagggcatgccgttgccgggcgcgctggtgtcgttgttgttgaggttggcgcgcaggtacgcggcggcgcggtccagcgcggcctggtacgtggcggcgcgcgcggggtccacgcgctgcttcgcctgggccatgcccgtcatgatgcgcgcggtggtggacacgctgccgtggtccacggggaagtgcgcgtggtcgctcggccaccggccgctgggctcctgcgtggtcagcgcccagttggccgcgttcaccagcgcgttgctgtactgggtggagacgttctcgtcgtagcccgccaggccgaagacggagaaggacgtcttctcgtagcggaacgcggtgccctcgtgaatccacgagccgttggcgagctggtcattgcggatgcgctgggccagcagctccaggttggccaggttggtgcgcccgttaccgacgaccgcgttcatgtcgtagccgttggcgcgcgcgctcgacaggccgtacaccaccgcgccctgacggtggcaggccacgcagttgttctcctgcgtccagtgcaccacgtccgcgctgaggaagttgatggcccgctgcgtggactgggtgttcgtctgcgtctgcgcggctgagggaagggcgacgacgagcgggacgagcgccaccagccgcagcaagagcgcggggaggtggcgccaggagggacgccgggggacgtgagccatctgaggtctccgaagagaggcgggtgccgggattggcacctcgcgcgacctccgggaggagcgctccagacgcacgacggcagcgctgggcgagcgctctctccgcgcttcacccagagtggctgttgcggctttgagagcatcccccccggactgcgcggttgaaggaatactcctgtgttgttggaactgtccagtcctgcaggtttcgaatgagtcacaagatgtacggggtagggaggacccactgggtcatccgtttccgatgatgtcgaaggactgtccgagccctcgcgccagagcggcgtcgtagagggcgcgagcgagggccacgtcctggagcgcgaggccggtggagtcgaaaacggtgatttcggtcgcgcgggtgcggccgggcttcttgccggagacgacttcacccagggtcccggcgatttgctcggggcggaggaggccgtcatgccgcggcacgttgacctcgccggagtggagggcctgctcggtgtcgtcgatgaagacgcggccttcggtgagcaggcgcgcatccagctcctgcttgccgggggcgtccgcgcccatggcgttgatgtggactccgggctggaaccactcgcgcttcaccacggggatgcgagcgggggtggcggtgcagacgatgtcggcgccgcaggcttcctgggtgctgacgatgcggccgcccttctcggcctggagcgccttggcggcggcctcggaggtgtcggcgagcaggagctccaggttgtcgccgaagagggcgcggtgcgagtcgatgagcacgcgggcctgcacgccgcagccgacgaggcccagggtgcgcggctgcttcttcgcgaggaacttggaggccacgccgcccgcggcgccggtgcgccaggcggtgagcagggtgccgtcgaggatggccagcggggaggcggtgtccgggtcgctgaggatgtagagcgcgcggacggtgggcaggccgtgcttctccgggttgcgcggatgggcgttgacccacttcacgccagcggcgccgtcgaggaacgcgggcatggcgcggaagtcgccgtcgtaggagggcagggacaggtacaccttgggcggcatcagcgactcgccgaggccgtgggcacggaaggcccgctcgacggcggtgaggccgagctcgacggtgtacaggctgcggaggtccttcgcgctgaggatgagggtgggcattgcggcgctacatagcgctccctaatccggctgcgcatccacccactccgccaggatgtccgcgtggcaggggccgggcttgcaccagcagcccaggcgtttgccacgcaacatcagcacggcggcgcggtggtccgcgtcatgccgggtgcgcagccccaggtaccagcggaacgcgtcgaaggcgtcttcgtccggccccatgcggcgcagggcttcctggcggatgcgttcctgctccgcctccggaagcgtccccagccacggcgcgaagtaggtgcgcagcatggcgcctggagtgcgcacgcctccgggcttgaaggggttgccgaagcggccgggcaccgggttgagcgggctcggcttcgcataggcgcggaaggcccggcccacgtacacgtcgaagccgtcgtggacatggaccgccgtggtgcgcgtcacggtcatcggcgtggcctcgcggacgctacttcttgcgcttcttgcccgcggcgggtgcgacgacgggctccgggggcttctccgcggcggccttcagcgtgtcgcgctcctcctgcaccttcgcgagctgcccttccagctcgctgacgcgctccttcaacgtcgcgttctccccgcgcagcgtgtccgcgtccttgcgcagcgtgttcgcctccacgcgcgcccgcgtcagttcgcgcgacgacgtgcaacccacggcgaggggaaccaccgccagcgacaccaccgtcatccatgccttcatgtgattcagctcctggacgcccgggcccaaggccttgagcccagtcggcccggcgtcgtggcgcggagcgtaggcatggagcctgcgtcacaggaagccgcgtcaattggttgtatctccaacgacactgtcgcggacctcgtgaatccagacgtgctccaggccccaggtgaagagcagccgatgcttggagaggacggtgaagcccggggcctccaccggccgagtcacggtgatgacgcgcgtgccggggcggcaggtgcggaagcgctccaccagccgggcccgcgtccgcggcgtcagcgccgtccagttggtgaagacatgcgtggcatcctggaggtccgcgcgggtcgcgtcgcccacgatgagctgcgcgcctgccttctccacggactttcgggccaggtccacgtggtgctgcatcaactccacgccgcgagcctccgcgcccagccagcgcgcggccagcagcgtgcggccccgccccgcgcccaggtccaccagccgcgagccacggcccagcccggccttccagaagagccacacccctgtgtgcactggcatctcgccgtacatcagttccttgaaaatctgcccgctcgtctggaggactcgcgtcgtttcgaacgagcgcttcaggcggtagggcgagacgcgcacctcgcgcagccacaggcccaggtagggcggaagcagccggggcctgctcagcagcaccaggacgtcgaagagccgggtgaacagctcaatgaacacgatgctgat

SEQ ID NO: 1137 - DNA, 15132 bp, Myxococcus xanthus
gtgctctaaagcatcgccgcgtcgtggagtatcgcgattgacgctcggggatggcgggggtgtcatgcgccccggccacctctacccgtcgcccggtgtcccttccgggctgggagcctcatgtcctcctttcgcatgacgtccaagctgcttggcgcgctgctgttgtccgcgagcacgcttcacgcggcaccctcctgggccgccgcgcccgcctccacgcccgtcgccgtgcccaacgggaacttcgagattgcgggcggctccggctcgctccccgccttctggaagtcccgagggcaggggaaggcatccggcagcgccgcggcgaaggtggagggcactcgcggcctggccatcgagaacccggtgggcggcgccgagacaacggtggaatccgaggcgatgaagctccaggtgggccagctctatcggctcagcgcctgggtgcgcacgcgaggcgtccagacggacccgcaggcgcgctaccccacggcgcatggcgcctgcctgtcgatgaagagcttccccttcaccaactgctcacccgcgcccgcagcggaagcgggaggccgcgcgtcggtgctcttcttcgccacccagtcctcggaccgggtgcagctccacctgggccgcaacggcaaggccacgggcaccgcctggttcgacgacgtccgcatcgagaaggtggacgacatcaccgcctacattccgctggagtcggtgcgctgggccggcaagggcttccgctatgacgagggcgggtggatctacgtccacatcgagggcgagccctacgagcggggccaccagttcggccagctggtgccgcaggaaatcgtccgctacatggagaagctcggcatcgagaaggacaggacggacgcctccaaggggtggaaccaccagcggctgctcgcggacgcgctcttcctgcgcaagtacgacgcggagttcctggaggagatgaagggcatcgcggacggcgccaacaaggcgggcgcgaagttcaaggaccgcgagctggacctgctggacatcgtcacgctcaactccgccgtggacgcggggcagctcgccgaggcgaaccgggccacgggcacgccgctcaccggccgcaccttcctcaaggcggaagaggacgcggagcgggcggggaagggggaccactgctcctccttcgtggccaccaaatccgccaccccggatggccgcgccatcatgggacagattttcatgtggggcggctacacgggcgtgcactgggacgtggtgctggacgtgaagcccaccaagggccaccgcttcgtgatgcagaccttcccgggtggcattcacagcggctcggactggtacgtcaatgccgccggcattgtcattggcgagacgacggtggggcagtcgccgttcgacatgaatggcccgccccagagcaaccgcatccgcaagggccgcgcagtacgcgtcgtccatcgacgacgtcgcccgcatcatgaaggacggcaacaacgggcctctacaccaacgactggacgttggcggacacgaagacggatgagggcgcgtgcctgctgctggggacgaagaagacgcgcctgtggcgcaccggcggcaaggggcaggccggggacaccccgggcaatctcaaggacttcatctgggccaacaacaacaaccgggatttggaggtgcgcaaggagtacgtgcccaacccggacaacgctccggtggacctgtccttcaacacctggaaccgcgacatcgccttctgggagtactacgcaaagtacggcaagaagggcttcgacctggacaccgccatccggatgatggcctccagccccatcaaccggccccacgcgtgtgatggcaaggtcaccacgtcggagatggcccagaagctgatgttcctggcccactacggcaagacgacgctgcgcgagaagatggtgggcggccggtggattcccgacctgcctggcgccacgccgcacctgtcgttgggctacacggccttcagccccgtcttcgtcgcggagaagctgggggccgcgcgcaaggggtggacgcctcccacggagccggccgcgctgaagcgcgacgtgtcgaaggtgaaggacgcgctcgtcttcggcaggcccctgctgtgggccaacaccatgttcccggcgacggacggagagaactggctggtcagcggcaccgccgcgtattggaagctgctcaaggacctgccggcggacggagactcgtccgacaaggccttcgagtaccagcgcaacgccctggccgacctcaacgcgcgctacctcttcaccacctcgcgcgaggcggacgtggtgccagcctccgcgaagacggactacggccgctacggcgcctacatgctgccgcgcatcaagggcaccttcctgctgcaccagctccggttgctgctgggcaacgcccacttctccaaggcgatgaacgccctgcatggccgctacgccaacaagaacgtcaccaccgcggacttcaagcgcgcggtgctggaggccaccggcagggacgtgggcctcttcgtgtcgcagtgggtggagcagaccggactgccgcagccgcgcatccgcaccagcgccgcgcaggtgaaggacggctacgaggtgacgctgaaggtggagcagcccggctcgcgcccctggcacttcgttgcgatggtggaggtgcgcaccgcgaagggcgccacgctggagcgcgtggaggtgaagggcctcaacgagacgttcaccttccgcacggcggagccacccgtccgcgtggtgttcaacgccggcaatgacatcccggtgccgcgggagcagcaccagacgctgtcgaaccagctcgacgcctgggagaagctgctcctggtgcacggcacggcgcgccagacggagtccatgcgcacgctggcgctgggctaccgggaggtgctggccgacgcgttcgtggagtacctgatgcccatcaagccggacgccgaggtgacggacgcggagctggcggaccgggacctggtgctcttcggcggcgcggaggacaacgcgctgctggcgcggctggcgaccgagaagaagctccccgtggagctggggcggcgctacttccgctggcagggcaagacgtacggccgcccggatgatggcctggccgtcgcgctgccgaatccgtggaacccgaagcggtcgatgtacctgttcgtgtccaacagtggacttcagctctggcacatgacgcgcgcctaccagcgcggcctgccgggctgggccctgtaccggggcgccgaggtgagcgccaagggcttccacgacgtggacgcgctggcccaggacgtcgcggtgacgcccgccgccccgcccgccgcgccagcgcccacgcctgtaccggcgccggtgctgggccagccgcagcgctagcgcacgctgcgagggggccccaccgcgcgaaaggtgcgggtggggcccgctccatggaataggggacgggcccgggtgtttttcctgcctgcccggagggacgacgaccctccgcgtctggcagcattcgccgcccctcatttcctcacggagccgcattgagccccctgaagaccttctcccgccgtgcctggacccgcagcgccttgggcaccctgctcctcaccggctgtgccaccacgcagcagccgaccccctccgatgacgcgcctgcttcggccgtgcccgccgtccaggccgcttccacggaagccgtgcgttcgctgggcgtggagctgaagcacctggaccgcgatgtccggccgcaggacgacttctacgccttcgtcaacggcaactggctgaagacgacgtccatccccgcggaccgcgcgcgctacggcaccttcatcgagctggcggacaaggccgagctggccatgcgcgccatcatcgaggagtccgccgcggcgaaggagcgccaccccggctccaccgcgcagaaggtgggtgacctctacaacagcttcatggacacccagcacatcgagtcgctgggcctgaagccggtgagcgacgaactggagcgcgtgaaggccgtgaagcgctcggacgcgctgccggagctgttcgcgacgctgctgcgcgaaggcgtgccggtgccgttcggcatcttcgtgggccaggaccagaagcaggccacgcggtacaccgtctacgccacgcagttgggcctgggccttccggaccgggactactacaccaagcaggagccgcgcttcgtcgaggtccgcgccgcgtacgtggcctacatcgagaagctgctcacgctggccggtgagaagaacgcgaagaaggccgcccaggacgtgatggcgttcgagacggcgctggccgcgaagcagtgggaccgggcacgcaaccgcgaccgcgagaagacgtacaaccccaagacggtcgcggagctggacgcgctgaccccgggcttctcctggggccgcttcctcaaggcgtccggtgcggaggccacgccctccgtcatcgtccgtcagccggactacctggagtccctgggcgggttgctgaagtccacgccgctgccggtcatcaagcagtacctggcgctgaaggtgctggacacccgcgcgccgctgctcagcagcgccttcgagcaggcgcacttcgagttccgcggcaagacgctccagggcttggaggagaaccgcccgcgttggaagcgcggcgtggcccaggtgaacgaggtcgtcggcgaggccgtgggccagctctacgtggagcgccacttcagccccgactccaagaagcgcatgcaggagctggtggccaacctgcgtgaggccttccgcaagggcatcgacggactggactggatgagccccgccaccaaggcgcaggcccaggccaagctggagaagttcggcgtgaagattggctacccggacaagtggcgggattactcgtcgttggacatcgtcgccggtgatctggtgggcaacgtccgccggggcgagctgttcgatcaccagcgcgcggtgggcaagctgggcaagcccatcgaccgcgaggagtggggcatgacgccgcagacggtgaatgcctactacagctccacgatgaacgagattgtcttcccggccgccatcctccagccgccgttcttcaatccggaggcggacgacgcgacgaactacggcgccatcggcggcgtcatcggccacgagttcagccacggcttcgacgaccagggcagccgctccgacggcgacggcaacctgcgtgactggtggacgcccgaggacaagtcgggcttcgagcagcgcaccaacatgctggtgaatcagtacaacggcttcagcccgctggatgccatgaacgtcaacggcaagctcacgctgggcgagaacatcggcgacctgagcggcctcaccgtggcgtaccaggcctacaagctgtccacccagggcaagatgccgcccgtcatcgacggcttctccggcgaccagcgcttcttcctgggctgggggcagatctggcgtggcgtgtaccgggacgatgccatgcggcagatgctgctgaccgacccccactcgccgccgcagtaccgcgtcaacggcgtggtgcggaacatgccggagttctacgaggccttcggcgtgaagcagggggacgccaactggctgccgcccgagcagcgcgtcaagatctggtagccccgcggtacgggccggtggacagcggccacgggctgtctaggctggaggcgtgaacgctctcgccgtccggctcgtctgtggcctgctgttctccgtgttggtgttgggggccatcgtgaagccccctgacaacttcagtcaggggctgggaatgctgctccctgccaccatgctgttgggcgtggccctcagggggccacggcgctccatcatcccgaagcgccgcgcctccgccacggcggctcccaaggtcggggagccgcctcgtccctgagcgtcaggggcgggtggctcccgttcaggccttcttcgccgccgacggcttgttgatgttggcgaagaagtcgttgcccttgtcgtccacgacgatgaaggccgggaagtccaccacttcaatcttccacacggcctccatgcccagctcggcgtactcgagcacctccaccttggtgatgcagtccttggccagccgcgccgccgggccgccgatggagcccagatagaagccaccgtgcttcttgcaggcctcggtgacggcgggggagcggttgcccttggccagcatcacgaagctgccgcccgcggcctggaactggtccacgtacgcgtccatgcggccggccgtcgtcgggccgaaggagcccgaggcatagccttccggcgtcttcgccgggcccgcgtagtagaccatgtagtccttgaggtactggggcatgccgttgccggcgtccagcacctccttgatcttcgcgtgggcgatgtcgcgcgccaccaccagggggccgctgagcgacaggcgcgtcttgatggggtagcgcgacagctccgcgcgaatctcgctcatggggcggttgaggtcgatcttcaccacctcgccgcccagctccccgtccgtcgtctccggcaggtacttcgccgggtcggcctccaactgctccaggaagatgccgtcctgggtgattttccccaggatctgccggtccgccgagcacgacaccgcgatggccaccgggcaggacgcgccgtggcggggcaggcggatgacgcgcacgtcgtggcagaagtacttgccgccgaactgcgcgccaatgccggtgcgctgcgtgagcttgaggatctcctgctccagcgccacgtcgcggaagccgcgacccagcttgttgccctcggtggggagcgaatccaggtagcgggcggaggcgtacttggccgtcttcagcgcgtattcggcggaggtgccgccaatgacgatggccaggtggtacggcggacaggccgcggtgcccagcgagcggatcttcgcgtccacgaagttcagcaggctctgcgggttgagcagcgccttcgtctcctggaacaggtagctcttgttggcggagccgccgcccttcgccatgaagaggaacttgtaggcgtcaccgtccgtcgcgtagagctcgatctgcgcgggcaggttgttgccggtgttgacctccttgtacatgtccagcggcgccatctgcgagtagcgcaggttcgacgtctggtacgtctcgaacacgccgcgggagatggcctcctcgtcattgccaccggtgatgacgtactggcccttcttgcccatgacgatggcggtgcccgtgtcctggcaggagggcagcacgccgccggcggcgatgttggcgttcttcagcagctccagcgccacgaagcggtcgttggatgacgcctcggggtcctcgaggatgtgggagagctgcttcaggtgcccggggcgcagcaggtgcgcgatgtcgcgcatggcctcgcgggtgagcagggtgagcgcctcgggcgcgacctggaggaaggtgcggccgccggcttcgaaggtggagacgtggtccttggagagcagccggtacggcgtctcgtccttgcccagcggcagcatgtcctggaactggaagtcggtcatacccgtaggcgtagcgctgatgcggccctcgtgggtagctggaactcgcggcgcgagaaaacctcccagcatgggagctacaagtcccttcactccagatacagcctgatacatggacaggggagggaaggtggccgagggttggctggtcgtcagcctgggtggcggacaactcgcggagccgccaggttgtgcgatgctgtgagcccccgtggccgccatctccgttcaagttccccttctggttttcatggccctgctcgccacctccgcgcgtgcggcggagccgtccgccgtggagcagcgggcgcgcgaggacctggaccgtcagctccaggagatggtgaagacgccgccgccggagatcgtcatctccttcgagggccttcccggagcgggcacgtcgcgcggctacaagctggtggaggcggacttcctcgtcaacggccagcccctggccatccccggcctggacaagctcaacggccctgggctgcaccggctcgcggtgctcacggtggaggagggctcctacacgctcgtctcgcacgtcacctacgccaacgaatcctggaacctcttcagcgaggagagcggcttcctctggaagctgacggcgtcggtgacggtgcaggtgcagcgtggcctgcgggcgcgggtgcgggtgctgcccgccatcaaccccaccgcgccggacccccggctgaagctgaagctgtcccatgacgtgaaggcggagatgacggccgccatggcggacgtggccattcccgacgtgccggatgcgggtgcgcccgtggccgcggtggcgcaggctcccgcgaagccgaccccgccccccgtgacggcccccatctcgccgacgccgcccgttgccacgcccgtgaagacggtggaggcgccagagcaagggccggtggctcccgcgaagctgctgctgaaggtgctcgcggggaagcggcccgccgcggccaccgtgtacgtgaagtccgccaccggggcgccgcagcgggtgatggtggaccgcaaggcgcgcaagccggtggaggtcatgttgccgcccggggagtaccggctggacgtcctgtcccagggctacctggcgcagacgcgaaaggtgacgctctcccgggaggcggtgcccacggtgtccttcaccctggcgaaggcgccggtgtcgaagtcccagaaggtccgcctgaagaaggaggtcgtggagctgccgcgcatgccgcgcttcgcggagaagcaggccgcgccacgcaacggaacgaccgcgggactggccctgctgatggacatgttcgtgcgggacgagaagctccggctccgcattgaaggccacaccgacaaccgcgaacgccccgcggcggccgcccgcaagacgctgtccgaagcccgcgccgcagccgtggccaaggccctggtcgacgcgggactggacgcgtcgcgcatcgaaaccgtgggcctgggcgacacgcggcccaaggcgccgaacctgctgcctcgcgggcgcgagctgaaccgccgcgtggagttcgtgctggtgcgcaaggagtagggggctgaatagaaccacggtgcatgcgtctgtcctcatgaacacgacggcgggccctgagctcacgaggacgcaccccatgaaccgcatcgcatccgcgctggtcgcagcccttctcctcactggcagtgcgcaggcccagggttacggtccccgtcccacgcgcgtggagcggagcgagctgcgcgatgaccgccgcgacctggaggacctgcggaacctgctggcccgcttcgacgccgcgtggagcagccggagcgaacggcagatggcgaacgtggaggtcagtctgcgcaagctccttcgtgccgaactggcggagagcgagcgggagctgtccaaggacagggcgcagtcgcggcggacccggcgggatgcgcgcgtggcccagtggggcggcccccgggcagccatgtggggccgtgcctccgcggccgaagcccggaacgacctgcgcgccgagcacgccgcgctgcggacccggaaggccatcgcccgcgagctcgacgaaatcgagggactgcggcagcccggggccttgaactacaagcgcacgctcatcctggagctcatccaggtggcggagcgggaactgaaccagacccggcgggaagtccgtgacgaccggcgtacccccggccggcgccattgagcgcccgccgcgaggccccggccgccaggtccggcggcggggctactccgccttctttggcgcggtggcggagcccaccacgcggtgcaccgggtacagcgcacccgtggtgatggcgccggcgaggaactgccagctgcagaagccgtcattccagcaggtacacggcgagcgtgccggcgcgctgggccgtgggcacgtagagcgtccccgcggggaactcgcgtgtggtgcgctccggggccaccgtgaggaccgtctcgaagcgcaccggcttgggcttctgagcgcctccacgtcgggagacttgccccgcgcgatgatgtccgcctgcgtctcgtcggtgatggcgcggtaggcggcggcggtcgggccgcgtcgcggaagagctccagcagccacgcgcgcatcaccgcgcagcggcgcgggaagtcgatgtagctgtacgtctccagcagcacgtccagccggccgagcaggccccggtagtggctgccaaagcgcggcagcgccgggtacgtgtgccagcccgagcgcgggtcgccttcgtccttgtagttgccgtaccagaagctgtcgaagccatggcggccctgcacggccttggcgacgcgctccaacatgccccggttgtaggcgcgcagcttggagaagagcggctcgttcgaatgggacgtgtcgaacgtcaggtcgaaggcgtggatgctgccgtccgtggtgtggcagtcgatgaagacatggggccaccaggtctggtgcagcgcggccatggcgcgcgtctccggggcttcctgcttcgtgctgtcgcggttgaggttccagccttcgcccgtgtcgcccaggcgcgtcaagtcccgccgcgccgctggaaaagagtgagcccgagcagggtgtcctcctgcccgggctcgggttgctgccatggatgagacccgcacgtttaagttcctgcctgcggttgagacctcgggtcctgcgattgaacgaccgccgcgcaaggggaaatggagcggcgggctggaattgcaccagcatcacgagggagggggcgggaacggttgatcgggcctgcgacagcgaatgctgagtctggagtgagaatttgagtttggggtgcttcgcgcgctcgtgatgccgcctgcctctaccgtgattgggctaccccgccgcaggtggtgctgaatggcgggggcagggctcgaacctgcactgggggacggccggagaacgctcggcgtgaggctgctgctgagtttgagtctggactccaaaaggtctgcggccgtgagtctagccgaacaggtagccgaggagggcctcgccggccttcatttcctccacctcgacggcgttcgcctcttcgcgggcgaacttgacggcctgctgcaatttctccacgcgctccagcaggtcattcatgcgcgtggcggggagcgcccccgagaacttcaccgtcttccagtaaccgacgacgatgtcctcgtaatagacctccacctgggccgggtgcttctcggtggcctcggacttcacgtggttgcggggaaccttcttcgtcttcgccgtctgcacgggctcggtggcccacaggccctgcgccgggtcgggaacccacgactccgacgggtccagcgtgggcagtttcttcacgaaggtgtgaaggtccaccaactgcttctccaggaagagcagatacgtggcgggaacacccttgagcaggaccctgccatccacgcgcacgtccgccttcgcgtgacagttggtgaggtccttggtggcggtgacgtcgaagagccgggtgagaatctcttgcgtcttcttgaggacgtcttgcgttcgtacctgcacgcgggtggattcgggggggaagcgctcaccctcctcgtcgcggggctgatacgtgcgggagatgccgctgagcaactgcggcttctggaggtcgtgatgggcctgggtcagctcttgctgggagcggttcttgacgcccttctcgacggcgatgatctggttcagcttcggcatgacggtacttccgatttttctgaagagtgggttgtcgccctcgacgcagcatggcgtcttgccctgacgtgcaatgtgggattctggcctgtagggggaattcaagcgggggcagctaggcgccgggagtacgccccatccgcagccggcccggtgagccggacgcccgggcctcgtccgtcgcagtgtgtgcgtccatgggggtgagccctcatgcatgacgtcagcacagcgccgcgcccggaaggtcgcgcggaaggagacacgcgtcatgacggagcaagaggcctatgtgaagcagatggatgcggagaagcggaggctcgacgcccggattgccgaaacggaggcgcaggcagacgtccgccaggcgagcgatgagctcaaggacatgtccggcattcgccgcgtcttcgacacgtttcgcatcaagctggatgagctgagcaagcggcagacgcagaacttcgagcagggcaaggccgaactccggaagtcctacgacgacaccaatcaggccgtcatcgagatggatgccaagatggcgcttgtccgtgccggctacgagcgcaagcgtgaggcggagcttcgagcgcttggcgcgcaggtagatggttgggaggcgtccgtcgcgcagtcccgggccgaggactcacggctcacgcggcaggaactccagttcatccggcgctcactccaggacacggagtccgcgctgcgccgattgatgagcagccatggtgagaactggtcgaagctgaagaaggacttcgaggactcgtggcgagagctgcgggagcgctccgacaagattcggaggggcgcggacgtgcagccgtcctctcatgcctgaacctggagggtacgaggtccggaccgggtgaggtccggcctcgcgccggggattgcggacgctgcgtcagaacgcgcggttcaccgcgtagccgcatcaccccaggactgcgccagcttgcgcgtgggttcctggaaacaaagttctgcctgtgtcttaggttttcctgcgaacgtactcccaagcttcgatgagcctgcgcgtttcttcctgcgccagggcctgcagcttggggccgagctgcgcgaccttgtccggatgatactgggccaccagtgacaagtaggctcgccgtgcatccgcgagcggagtgccgggcgtgattcccagcacctcccaggcagaagccaccggctccggttcaggcgcgcgaggcgcttcggtacgaggctccggttcaggctcaggctccgcgtctggcgtgtcgtccgcgtcgtcggcgtcctcggcggtgtcctcggcctccgcttcttcctcctcctcggggggctcggcgggaggcgcgggccggtcgaagcccacgccgcaggtggtgcacaggagccgctcctggggctcgccggaggccgagggaaccacgcgtgtgtcgaagcagtccccacacacgatgttgcggcacgactcgcagcgcgcggcggagggagcgtcgtccaggtcctggccgcaccggaggcagtcgtctggcaggggggcttcttcgccacaccgcacgcagtgggcccacgcgcggtccaagcggtgctcgcactcggtgcactccaggtcgccaccgctcgcgggctcccagtgcttcgtttctccgcaccacgggcagtagggcatcagccacgccagcttcccggtgcagtcatccgcgtcgcagtcgaactcgagccggtagccctgggccacgggctcgggcgcgttggcttcgtcgaaggactcgccacatgcccagcagtgattgaagagcgggtgcgagggtgcctcgcacgccacgcagacggggttgccgtgctcggccctccattcgacttcgtcgccgcagccagggcagaagcccatggcctgcgtgacgtccgggtgctggcaggatgacctcgccgcgtgggcggcccgctcgcgttgtccaggcggggcggggaacggaggcttgatgcctcgctccgtcaggtgctcccaccagcaggcgcggcagacgcggccccgggccttccggttctcgtggccgggcgccaccgggcgttgccggaagtcaccggcctccaggacctgcgtgctcaggcacacctggcagaccgtgtcgccgcaaacctcgcagcttcccgcgaggcggcggacgcccaggcccaggatgccggcggtcagcacctccctgcagcacgggcaggctcgcatggacttctctcgcgggatggccgggccgggatagggctcgggttgcgggtgggccccacgcatgccccatccggccggccaggtccagcgcgctcgctcacagccctgttcggcaaacccagggaaaataggacggcggcggggtggaggaaaagccgggggtagtggctttcgaagccgcgtggacgcgcttaatccaggctatatccagggtttgggacgtcttcgcgacgcgcccgtgccctctacaccaggacgaaccacgtggccggaagcagcctcctcaccctgattgatgacattgccagcctgctggacgacatcgcggcgatgacgaaggtcgcgacccgaaagaccgctggtgtgcttggggatgacctcgccctcaatgcccagcaggtctccggcgtcagcgccgaccgcgaactgcccgtcgtctgggccgtcgccaagggctcgatggtcaacaaggcgattctggtgcccgcggcgctggccatcagcgcgctggcgccctgggccatcatcccgctgctgatgctgggtggcgccttcctgtgcttcgagggcttcgagaaggtggcccagaagttcctgcacggcaaggaggagcaggcggcgcagaagcaggagcgcgtcaatgcagtggcggacccgtcggtggacctggtcgccatggagaaggacaagataaagggcgcgatccgcaccgacttcatcttgtccgccgaaatcgtcgtcatttcgctcggaacgctcaccgccgcgtccttcgggatgcaggttgccgtgctgacgggcatcgcactcctcatgacggtgggcgtgtacggcctggtcgcgggcatcgtgaagctcgacgacgcgggcctctacctgatgaaggcggagggcggggtcaagcggagcctgggccggggcatcctggccaccgcgccatatctgatgaaggggctcggcatcgtgggcacggccgccatgttcatggtgggcggcggcatcctcacgcacggcataggtagag

SEQ ID NO: 1138 - DNA, 17592 bp, Myxococcus xanthus
tgcccgtcctcctccgcgtcggagcggtgcccgtagccatcctcgaagtcgatgcgcaggtcctccaccggctcgcgctccagcttggccaccacgcgcgcgtagacgcgctgggcgaagcggccgcgctggggcagtcccagcccgtgggccagcacgggcgcatccggtgcgtacgtcttgagcgtgttcagcgcgatgccgcccagcttccgggccgtctccgcccggaagaggtgcgcgccgccgtacaccacgtgcaccggctgccgttgggtcgagtcccccgggtaggcgcgctcgaaccccgcgttggcttgccgcagggcctcccgcacacccgagaggctcgcttctgtcagcgtcgtcttcacggctggcgcttcagccacgcggagacctcgggcatgcagcgctcacgcagcgccacatcctgggacagccgctccagtgtctgcgccgtggcctgctgcgcctcggggatgggctgggccttgagcagggcctgcatctgctccaggtgctcgcgcgtgcgcagcatgcccatggcctcgacgatgcggcgcagcagcatgggggcgccgccggtgcgggccaccacgtccttccattgcgtgcgcatctgcgcccaccacgcgtcgcggccgacgcggttgcccagcagccccgccacgaagctggccacgtcctgcgtcttcaccgtgtccgtgtagagcagcccgcgcgcgcgcgcggtgagttcgggggcctcgaaggcggtgagcgccatgaggtagcggcgctgcgtggcagggtcgggctcggacggaatcttctggaggaaggtgtcgaagagcgccgcgtcgcccgcgcgcgccaccatgcccaccgcggcgtccagcaggttgggctccagcgcgtctcgctgtccctggagcatgcgctccacgcggggccgggcctcggcgagcgcgtcctggctgcgcgccaggccacccaccgcgcgcaccagcgacgcgcgccgcagcttcacccggtccgcctcgttcggcgcggactgccagcccagcttcttcagccctggccccagcagcttctccacccacgcgcggaagcggacctggtcctcgccgtccgccagccggccttcgatgtaggccagccggcccaccagctcgtccaggacggagtcgtcctcctcgtcaccgaagcggcccgcaaggtccagcaggtccgccaccgacgcctggcccgcgcgcaccagcgcccactggtccgccagcagggcggtgcgctcggagggggccagcgacttcaggttcgtcgccagcttctccaggcccggcttgtcgtaggcgacccggtagaagccggtggagcccgcgttggccgtcagccacttcaccgcgccttcgccctccagcttcaccgtggcctgggcgtcccgcagcagcacgcgctgctcgcgcacgccggtgctgtcctcgtagcgcagcaccaccggcaccggccacacctcagcgctctgcacaccgggctcgctgtagtagcgccgctgcgacagcgacagcccgcgcccgtccagcgtcgccgtcaccaacgggaagccgctctggcccacccacgcggtggccagctcctccaccggctgcttcgcggcgtcgcccagcgcgttccacaagtcttccttcactgcgttggcgcgcgcgtgcttgcgcatgtactggcggatgccctcgcggaaggggccttccccgaggaagccctcaatcatccgcagcaccgcgccgcccttctcgtacgtaatcgcgtcgaagctctcaccggcctcgcccgcgttgcgcacctcgccgtggatggggtgcgtggacttgagcgcgtccagatgcagcgcgctggcgcggtgcgcgtcgaagtccagccacatgcgccactcggggcgccactggtccacaatcttgaaggccatccacgtggcgaacgcctcgttgagccacaggtcgtcccaccacaccatggtgacccagttgccgaaccactggtgcgccagttcgtgcgtcaccacctccgccacgcgcttcttcaccgacagcggcgcggtggccgggtccagcagcagcgccacctcgcggtaggtaatcaggccggcgttctccatggcgccggcctcgaagtcggggatgcccacctggtccagcttggtgaaggcatacggcagcccgaagtagtcctggagcctgggcagcaccgccagcgccacgtcctggccgaagcgcgtcaggtgcgccttctccggcagcgcccaggtccgcaccggcacgccctgcacgtcctgcgcgtccgtgcccaccagcgggcccaccaccagggcgatgaggtagctgctgagcacctccgtctcctggaacgtcaccgcgcgcaggttgccctcctgcgtgtccttcaccaccgggccgttgcccagcacggtgagccccgtcgggacgcggacggtgagggcccagcgcgccttgaaggcgggctcgtcgaagcaggggaagagtcggcgcgcgtcggcggcctcgaactgggtggccgccaccttgcccgcctggtacaggccgcgcagcccttccgtgaagcgccccgtccacgcgacgtccagcgacgcggcgcccgtgggcagcgcttcatcgaagcggagcaccaccgtctcgctcgcctgcgcgggctggatggaggccggcttgcgctgctggccaccggcgcggaacgtcacgtcgctcagcgccagggcgatgccgtgcaggatgatttcgttcgacggcgccgccacgtccaggtcgatggtctgctggccggagaaggacttcgcgtccaggtccagggtcagcgtggccgcgtagcggcggggacggatggaggtcggcaggcggaagttcttgtcttcggtcggatgcgccatagggatgcggaatctagcctccgcgccgccgcctgcctggacttatgtcaggggtgtccgcagtcacacccttcctggccccggaacgccggggccgggccgggcggggcaccaactggtggaagaggctggattcccgctggaagaagccttccgtgtggaaggacgcgggcagctccagcagaagaaagtccaggtggtgacacagctcgtgcaacagggtgcgcaagtaggtgcggaaggccaccactcgcgcgtgcttcgcggtccgcatccacagttggatgcgagggcgacggccccgctccagggtgtacatgccgtgcagctcgccggtggtggaggaggggcggacctccagtacctccacccgcggcgcgaacaggtccagccgctcgcaaagggcgtcgctcagccgggcggtggcgtgctcggtttccggttgccggcccgtggccagggcttcgcgcagcgcggccaccaggggctccagtgtccgcggctcgcggagccggagcgcgctcaccgaatcactcatccggtagacgcgctgctgggcgggcgtgaggttgtcgtagtaggcgaaggtcacgggcgagtcggtccagccggaagcttcccacccgcgccctccactggctacaggccgccggcctccagtgcgccgcccagcccggggaagggcttggtgagcagggcctggaagacgatgtcctccaggcgaatctgcgccgggagctggggcagggtgaggccggagcggaccaccgtgttgctgacgatgacccagacgcgccgccggccgatggcgttcttgagcgccggcgcgtcgatgcgcaggggcgtgcgcgagtccggctggaaggtccgctccgcgaggatttccgccgccgtgtcgtagtaggccggccggttgaagttcgtgtagagccgcgggttgtccggcgtggcggtccccgtgagtgacaggcgcgcggacgtgcgcagggtgagcgtgggggaggggttgaccaccacgagggtggcggagacttcgttgacgatgatgtccaggtcctgcgtgttgacggactcctccggcaggtcgagcgccacctccgcgtagacgggctccagcagcgaggtgacgggcaccacctggtcgaagggctcggtctggatggcaatctccgccgagcacgcggacagcagcagcacgcagggaagcagtaaagcgcgcatcatcatcggaagctccaggacaggtcgacgacggggaggacgggcaggctctctcccggcagggccgggtcgctcatgtccacgtaggtggcgcccacgcccaggccaaagtgctcgccgccgtagcggatgcccgccgcggcgcgcagggtggagccgcccttcacgcgcacgcccgcctcgcccaccacggaccagtggcccgcgaagttgaaggccagcgcgccggtgaaggacagatagtcggacgtgtagaggccgtagcgcgcctcgccctgcaccagcacggggcccagcgaaaggccgtagacgccatagaaggacgggccggacagctcgggctcgaagcgctggagcgccggtgtgtccgcccccgacgtcacgacgtccgaatagacggaggcgcccacgaagtgcgtgtagcgcgcgcccagcacgacgcggtggggactggcggccatcgcccagcgcaggcccacgttgggcgccagcaaggcgttggcatacatcgacgtgtccacggccagcccggcgaacagcggaagcgccgtgcgctggaggcccagcaccggcgcgtcgatgacctccgccgcgtcggtcgtcagcaggcgcgcggtgttggttcgcacgccgccgtcatcgtcttcattggcggaagccagacagggggacaacaggaccgcgagcgcacaggccgcgagcgaaggaggtttcaatccacgggctccggaaggagggagtgctccgcacgttaggctgactttcctccgggccgattgcctgcctggtctgatgtgctgcaacagccatctggcgcgtgcttgtggtcggcgaagaccttgctctcatcacgcctgctcatgcgagccgtgtgagggagcgcggcgcaggtccggacagacggtgttctcgtttgcggtccacagggtggggcgcataccttctgcctcacgtggatggacgttccccagagcagcccccggccggcccggagccacgcgagcgggtgctggcgttgctgcgccggtatggttggaacgccacctcgttccaggtgctccagcccggcttccagtactggttcgacccggcgggcgatgcgtgcgtggcgtacgtggacacgggcggtgcctgggttgcggccggggcgcccattgccgcgccggagcggctggcttcggtggcggagggcttccgagtggccgcgcgagcagtggaccggcgcgtgtgcttcttcgccaccgagccgcgcttcgtggagctggcccccatggcgtcgctgcccatcggcgagcagcccgtctgggacccggtccactgggacgacgtggtgcggggcagtcgcagcctgcgcgagcagctgcgccgtgcccgcgcgcgaggcgtgaaggtccgcgaggtgcccgtcacggagctgggggacccgttgcatcccacgcggcgagcggtggagctgctgaaggcacgctggctggcgtcccgtcgcatggcgcccatgggcttcctggtccagcttcgtcctcatgccttcgcgagcgagcggtacgccttcgtcgcggaggtggagggcgaggtggtgggcttcctgtcggtgtcgcccgtgtatgcccgcgaaggctggttcctccaggacctgctccgggacccgaaggcgcccaatggcaccgcggaggcgctggtggacgcggccatgcgcgaggcggccgccaccgggcggtgctacgtgacgctgggactggcgccgctcgcggggccggtgcggccatggctgcgactggcgcgggcgtgcggccggccgctcttcgatttcgaggggctgcgcaccttcaaggggaagttccgccccgacgcctgggtgcccatccatctgtcctatcccgagccgcggggcgggctggcgacggtgtacgacgcgctgcgggccttcgcgcagggcggcctgttgcgcttcggcatcgccacgctgcttcggcgcccgcgcctgctggtgcacgcgctcgccgtgctcctcgttccatggaccgcgctgctggcgctgccctccactgcgcgctggttcccgtccgttcaggtgcagtgggcgtgggtggtgttcgacgtgggcctacggtgggactcttctcgttggtgcggcgttggcgggacgccctggccacggtgatgggcgggctgacggcggcggacgcgtgtctgacgttcgtccaggccgtcgcctacaacgtgccgcttgcccggagcccgctggacggggccctcatcgccctggccgtgctcgcgccagcgacggcgtccgggttgctcttcagctcccgcgacctgcgcctgcctgggcgctagccgtcagatgtacgcgccgctgtcgggcatctcatcctccgtggggacggtggcgccatggccggggtggaggaacacctcaccatggtccacccgcgccaccaggtggaagctcaccatgaagtcgcggctgggtggccagccctgctccagctcgaagtgcgtgtctccgatatgcaccaccgtgcccagcctccgcccgtgttcgtccctcacggccatgccctcgcgcagctctcctgggtcccacatgacgccctcctttcgcgaaagatgcacgcgcccgggatgttcggcagcccacgcaaggtgtctgccattgctccattgatggacattccggcgaacacaatctggaccgcggcgcgggaatagcggtggtttcgggaaagaactgacccccagccctgcgtctcgattcctcgcggcgtgcaacgtggttggtggggaggggagaccatgcgcccgccgtctggcgttgcactgtcgctcgccgtcctgctgttcgcccaagccgggcaggcccagaccgccgcgaaggaagcggcgcctccgcccgccgacctgccaccgggcgtgtccgcggcgctgtggaagctgtccgtcccagccagcctcgcgcccacgccggagcgggtgctgctgggcgagaagctcttatgacgcccaggccattggcggcacggtgggcatctcctgtaacatgtgccacccagacgcgtccaacacgcatccggagacgtatccgaagtaccaggtgcagttgggccgcgtggcgctgctgcgcgacatgatcaactggtgcatcgagaacccggcgcgcggcaggccgctggcggatggtgacccgcggatgcgcgccatggaggcgtacatctacgccaagcgcaagggcgtgaagctggactccgggaagaagtaggcccgctcagcgccccaggtccggcacggcgtcacgcttccgctggaagagccgccgaggctcccacagcgggcgcgtggcctggacgacggaaggctggcccagcagcaccgtgagcagcgcccccgctcccagcgcgagggcgacgcccacgggcccctggaggaacgcgtacgcgcccacgtgctcggcggctcgcacgacgaagccgtgcaggaggaagggcgccaggctccgtccgcccagccgcgtgagcgtgctttcctgacgcgggctgagcgtgaagagtgcccatgtcagcgccagtgcaccgcagaagagggccgcgcgcgccgccatgcccgtgagtgctgtggcaccgagcaccgcgtagccgctgctcccgtagagccactgcggcgcgggcgcgggcagtgctcccatggccaccgccccgacgcatgcgcccaggcccacggccagggacgccgcgagcacgaggcgccagccccgggtgtttcgaggggccagcagccactcccttcgcgtcaggtgaccggcgacgaagcaaggcaggaacacgaacgtccgcgacaggccgaacaggtagcccacccagggcagcaggcccgcgacgagcgccagcgccacggcccacatcagcggcttgggcaggcggaggagcaggggcagcatcagccgccagcacccgaggctcagcaggaaccacagcagccagtacggctgcaccagccagtgggaactccagccccggccgagcacccacgcgtcgaaagcgacgtacagcacttggaacacagccagcggcgcgagctgcccccaggcgatggcgctcagtgcgcggggcccgctgtccgcgcgggacaggtgcccggagaggaacgcgaaggcggggatgtggaacaggtacaggccggagtagagcgccttcgcgagcggctcccggccgagcaggggctcgagcgcatgccccatcaccaccagggtgatgaggatgcctcgcacgttctcgaacagcgggatgcggccagcggtcgtcacaacctcagtagagaagcccaactcgaggctgaatgggaggggggcgctccgtttcggcacacgcaccccgctcgcccgggcgcgtgtgtcaggcaagcacgcggaccggcgatgcaagtgtcctggagcgagcagcggcgctcccgggcgctactcggggccctggaaccccccggcccggaacgtgaggaccagcgtgtcccggtggccggtgtctccctgtggttggatgggcgtgctctcgtgaatcacgcgcgcatcatccagcagaagcgcggaccagggctccgtcagcgtgaagcgcaggccgttggggccgtcggcttcgaagacgcgcgtctcaccgcccttgatgccctcgcggcccacgagcagcaccgccacgaagtccacgccgtcccggtgcgcgccctcgggggtgggccggccgataccgtcggtggtgtcgatgcggaactggtgggcctcgacgtaccaggggcgctcgcccttgagctgggagcagcacgcggcgatgcctcgaatcagccccgcccacaccggctgggacacgatgtcgggctgcacgggctcgaaccagcgctccatgccgccgtgaagcgcgttgtattccaccggctgccagtgcgcgcggtgaggcacctgtgtcaatgcgtcgccgtccacgatgaagcaggagtgccgtcgtgagcggtagcggccaccatcccggaggaagccatccagcggcagctcgttccaggacggccgcagtgcgtccagcgcgggcgagtcgatgcccgcgagctcgcagaggccgtcgcgggtgagcacggcgtagccatgctcgcggagggccgtggggacttcggacgtgggggtgacggggggctggaagctcatgggcgtcggactcagtgagacgggcccgcggaagcggggaggggctgggagaagagagccggaggcgcgcgcttcaaggcctcgcggaagtcgctgtcccgggtggggacgcacacggtgaagccatccaccacgccgcaggtgacgcggtcgcccaggcgctggaagagcggcagcgtggggctacctcccgccgcgaggaaccaccgcactccgagcgccgcgcccacccagggccagagccgctcccccttgtcgctgggtcctgtcatcaccacctgcttccactcctgaggtcaccacgcgcggagccggccgttccgggggcgtatgtggcgggacccatactcccttgcaggccatcaccgccagtcccgatgcgatgcgcgcacgacgggcgctcgcggccccgccagcacggccgccgtggcacaggcgttagggtcgggggaatgagcggcggctcggcctgttggggggccacctcgggcatcgggagatgaggacatgagaagggcgtacgtggcgtcgttgctgaccgggctgttgacctcctccgtggcgacggccgaggccccaccccaggaccccttcctgtggctcgaggaggtccagggcgagaaggcactcgaatgggttcgcgcgcagaacgcgcggacgctcgcggtgttggagaaggacccgcgcttcgagaccttccacgcccaggcgctggagctgctcacctccaccgaccgcattccctcgcccggcttccgggctggcggtgtggacaacttctggcaggaccgcggcaacccccgaggcatctggcggcacacctcgctggacggctacacgcgcgcccagacaccgtgggagacggtgctggacgtggacgcgctggcgaaggccgagaaggccaactggatttggaagggcagcaactgcctgcctcccgcggaccagcgctgcctcgtctccctgtccaacggaggcaaggacgccgtcgagctgcgcgagttcgacgccgccgcgaagcacttcgtggaaggcggtttccgggtcccggagggcaagctgtccgcgtcctggctggactcggacacgctgctggtggggcgcgactggggcggggacacgctcacggagtcgggctatcccttcgtgctcaaacgttggacgcgtggcacgccgctgacggaggcgcaggaagccttccggggtgagcgcaccgacgtctccgcgtcgcccttcctgttgcggaacgccgacggcgcgttgcaggcggtgctggtcaaccgcgcggtgaccttcttcgagtcggagtactacctgctgggagacgcggcgcccgtgcggctcccgtttccccggaagtcctccctccaggccttcgtggacgggcaggtcgtcttcacgattgaagaggactggggccgcttcaagcagggcgcgctgctggcatacccgttggccgcgctgaaggcagacccggcgaaggcgaagcccacgctgctcttccagccgggagcgcggcaggccatcgaatcggtggcggcgacgcggggccaggtgctggtgagcctctatgaggacgtgaagggcgcgctggatgtctacacgccggggaagaaccgttggagccgcaagcggctggccctgccgaagaacgcctcggtcgccatcaccgcgacgtcgtcatcgcatgaccgcttcttcgtgaagtcccagggcttcctcgcgccgacgtcgctgtggctggcggatgcgaaggcgggcacggtgaagaaggtgaagtcgctgcccgcgcgcttcgatgcctcgaagctccaggtggaccagtcctgggcgaagtcgaaggacggcacccggattccgtacttcctggtgcggccgaaggcgcggaagctcgacggcacgctgccgacgctggtgtatggctatggcggcttccaggtgtccaagccgcccgtctacctgccggaggagggcaagttgtggatggagcgcggaggggcctacgtcgtcgccaacatccggggcggaggcgagttcggtccgcgctggcaccaggcggccctgcgggagcaccgccagcgcgcgttcgacgacttcgcggcggtgatggaagacctggtgcggaggaaggtcagctccccgcgccacctgggcatctacggccgctccaacggcggtgtcctcaccagcgtggcgatgacgcagcgcccggacctgttcaacgcggccgtcatcgaaagcccgctcatcgacatgatgcgctaccacctgctgccagcgggcgcgtcgtgggtgggggagttcggcaacccggaggtgcccggggatgcggcgttcatctcgaagtactccgcctaccagaacctccgcgagggcgtgcgctaccccgcgccgtacatcaccacgaacacgaaggatgaccgcgtgcatccgggtcacgcgcgcaagttcgcggcgcgcctggaggccatggggctgccgtacctgtattacgagaacaccgacggcgggcactccaacgactcggacccgatgctcaacgcgcgccggtgggcgctgcaccacgtctacttgtcgcggcagttgatggactgaacgcctgggggcatgcggccgggcaggcccatgctgtcacgaacgtccggaacccctggtcttcaccacgctacattcccgcgtcatggaaaacgtccctgacgccgtggaaccgaagcttggtgctggcgacggaaggggtggcgcacatggacaaggaccatgtgtggcacatggagacgctcgcccgggtgtgccaggcggacgcgacgttgctggtggcgacgccgttccgggtggtggcgctggaggatgaagccgcggtagcggagggcgtgcgctggtgggaggaactcacggcgcgaggaggcgagggcatggtggtcaagccgctcgacttcgcggtgcgtgggcgcaaggggctgctccagccggccatcaagtcacgaggtccggagtacctgcgcatcatctacggcccggagtacaccgcgcccgcgaacctggagcggctgcggcagcggggtctgtccacgaagcgctccctggcgctgcgcgagttcgcgctcggggtcgaaggcctggagcggttcgcgcgaggcgagccgctgcgccgcgtgcacgagtgtgtctttggcgtcctcgccctggagagtgagccggtggacccacggctttgatgtaggctcggggggcgggagcgccaggcgcccaatggagggatgtggatgaacttctacgaagcgtcgtccccattcctctggtgggagtccaacctgtggtgggtgctcgcgctggcgatgtccgctgggctgggcgtgtggtgctggctgctgtgggggccgcgccaggcgggagatgtcctgcgggtggcgcctgcgtctggcgttggtcgtctcccgcgggtgttggattccgtcgcgtgggccgtgatggcggctgccttcatgggccccatggcgttcgtcacatcctggctggtggcgaccgactcgctcgttcctcactgtgaggtggtggcggggcaatcgtcgttctcattcttcatccggtggccttggttcggattggccctggtggcgctcgtgggcggcattgcctatgcgcgccggtctcagtcgcccagggatgcacgggacgtgctcctgacccggctcccgccagatatctgcaaggaagtctgagaggtgctgtcccgcgtgcgggacaagcctgcgaggactcgagcgtgccggcttggtgtcgcgcaccgtcacgccgaccgtgcctccgtgcgtggactccgcgttgacggcgctgggcgaggaacggatggagcccatcgccatgctggcgacctgggcgctgcgccgccgggaggcggtgaagcaggcccacgccgcgtatgacgctcgcgaggagcctcctgcgccgcgcgagccgcgctgaagtccgtggcggtgcgcccctcaggggcgctgctgggccagcatccaggcgaacaccttgggctctttgtagacccggtcccagatgtagtgattgccatcgtggaagagggtgaagagcacgggcttcaccggcccggcgcccgtggtgtcggtgttcgtctgtccatcaatccattcccactgcccgctcccgggccggaagaacgccgtcgctgtacgcgccggggagggataggtatccatgacgccaccggtgccgcccatggcgtgtcccaggtgcgtgaaccagccggcggtcgcggtgtagaagatgtcgttgtcgagcaggccgtgtgagccccagatggggaggttcgcctgaaccatcttcagggcatccgcggcgctagaaccgtagcctccgttgcagacggggatggcggcggcgagcttcgaggggaagagcgatgcgtagttgaacgtccccgcgccgcccatgctgaggcccgtcaggtagacgcgcttcctgtctgtcttgaacgtcgccaggatgtgctcgaagaaggggtccaggttgtattgggcttcgtaggcgctccagaatcccgacgtgctcgtctgcggagagaccaggatgaagggatagtccttcccctcctgatcgatgtacgcctgaggcccgtgcgcacggaccttcttgagctggttgacgcctccgtctccctgctcgcccatcccgtggaggaagaagacgacgggccagttcgagccttcgtcgtaaccgggcggcaggtacacgacatagccgtagccgcccggcgtcgagggtgacttgtagacctcctgcgtggtgccacggcccgtgggcgcgggtgtcacctggaccttcattctgtcgctggcggtagcgccgtcgtcgtcggttaccgtcagctcgaactcgtagagcccctgcaccagcccggacgccgtcgcggagagcgtcgtggcgcccgtcagggtcgcggtattgggaccggacacctgggtccattgccgcgccacgactgttccgtcgctgtccgtcgcggtgcccgtgagggtcgcggcattcgtgggcagcatcaccgtctggtccgctccggcggagaccgtgggcggaaggttggcgggcggctcacccgtcacgggggcgccgtagatgacgacttcattcatgcccgcatagcgggtcctcgaaaggtggaggtaccgcgttcgctgggtgacgggcacgacccaccaggcttgccaccgggtcagggtgatgttcgtcacgggcgtccaggcacccggctcaccggcagcgaaggagacgctgccgctgtcgaaggtgtcgaagacgccaatctccgtgatgtcatacagcgcgcccaggtcgatgatgagacccatggggtacgcggaatcgtcgaagatgacgtcaccccaggttgtcacgggcgcggcgcccgttcccgcgcgagggtctccaatgagcgcctgctcatcgaagaggttctggtacggacccgcgacgggacgaacgccgtcgggctgcaccatggacgcggtcagggtcagcttgctgctcgtgaggagcggcgccgtcgcggtggcgtcgccggaagggtccacggcttcgggactgccacacccggcaatcattgcgagcgcgaagagtgcctttttgatgcggtcatgaatatgcatgaaaaatccaatggtggctgtgagtagaaatcggtagccggagcaatggtagtgtcatagtggaaatcttggaatagtcgtatatctctgttttgggcgcgtgggtctggctccgcgctttgaggggggactcatccccgcagggccaggaggcatggcggcaccatcacccgccccatgcgggcaaggggagaggcagccccggcgtgcgctggtgcttggcgaaggcgctcgccagtattcccaagcgcatgcgaacgaacctcgtgggtgccgcgtttctcttgtggatgggttgtgattcctctccgttgccccctgggcccgatgacacgccgtccctgcaccaggtgacgcgtgtggaggccatccggggtgtcgagctggaggtgctcgactatggcggcaagggcccggcgctcatgttcctcgcgggcatgggcagcacggcccacatcttcgacgaactggcgctcgagttccgggacacgcaccacgtttacgcgctcacccgccgtggctacggcgcctcggattggcccgacaccagctatgacaccgccacgctggccatggatgtcctggggacgctggacacgctggggctgtcgaaagcgtcgttcgcgggccactccctggcgggggatgacctgacgtggctggcgctccaccaccccgagcgcgtggaggcactcgtctacctggacgccaccgacagccggggcgagattgccgcgttcctggagggtgagcagttgccgccgctgccgttctccgtgctcgacggccttccttcacggcaggcggtagcggagcggctggcgcaggatttgggcggagggcttcccgcacacgaagttgaacaggcgtatgtgttcgacgccgcgacaggggcctacctgcgcgagcgccgccatcctggtgccacggagcagtccgtccggggcgcggccatcatggacctcgggcgcgtgcaggggcccgtgttgtccctgtcggatgggcagggcttcgcgggttgggtagaggccctggtggcggccgagtcgctgccgctggagttccgggagaaagcccgcgacttcctgcccgacatccagcagcacgagacggccctggaggactcgctgcggcgtcatcctggctggagacacctgcaactggaaggcgcggggcactacatctggctgacgaaccgggcggaggtggtgacgcggatgcgcgacttcttcgccgccaccgccgcgccgtagcatgcccccgccagcgttgtctgtccgagccacatgcccggacagacagccgcggagaacggctcagctccgctgcgcgtagtactccacgatgaagggttcgttcacgtccacggggatttcctcccgctccggcaggcgcacgtagcgcagcccttcgccctcacccagcacctggacgtaggcgggcacggaccgcgatttcatccggctgaaggactcctgcaccacggcgagcttctggtgtgccgcgtggaagcggacttcgctgccaggcttgacgcggaagctcgggatgtccgctcgcttgccgtccacatgaaggtatccgtggcgcacgaactggcgggcctggcggatgctggtggccaggccggcgcgaagcaccagtgagtccaaccggctctccagcagttgcagcagcaccgtgccggtgttgcccggcgcccggctcgcttcctggaagaccgcgcggcactgcttctccatcaggccgtagtacagcttcagcttctgcttctctcgcagacggcgcgcgaagtcgctcacgctggtgcgcgcggtggcaccgtgctggccagggggatagggccggcgcagcaccgggtccttgtccgggtccttcgcggtgatgcgcgaaagcggaatccccagccgacgacacatctttccccgcggtcccaagtcgcgtgccacgtgttcctccgaccatctcccggtgtctgaagtggagatgaagttgataatcagtatcaatttcaatagctccaggtcgggccggcggtcaagtccggaattcgaagtggggacgcgggcggcgggctggacggcgctgctcaggtgccgcgcggcgccgcctcccggcggaagatggcgcctgcgagcaccgccacgatggtgacgccggcgtaggccaccagtccggcggccaccatggcgaacaacgcggagagccccgcatcgagccgcgcggcgacgaaccacccgacgcccgcgctgatgaccaggcgcgaggtgcccgccaggaagggccacagcacgtggcccgcgccctgtgcggcgaacgcgagcacgaagcccaggcccagcagtccgtagaacggcgccacgatgcgcaggtagtccaggcccggcgccacgacggccggctcacggctgaaggcatggagccagacttcaggcgccagggccgcggccagtccaatggctcccgccgccacgaagcccagcccgccgcccaaccaggcgatgcgccgggcgcgctcgtgctgtcccgcacccacgttggtgcccaccagcgtcagcacggccgtgcccaggccgaagagaatcgggatgatgaggtagtccaggcgtgac

SEQ ID NO: 1139 - DNA, 15789 bp, Myxococcus xanthus
  unsure (1)..(15789): unsure at all n locations
gagagccccaccgacgaggtcaatgagatggaggccgccctggccgccactcacggcgacaccggccccctgggcgagccttcccgcccggtaggcacgcagacgaccggcgcggcctaatccgcgccccagccgtcctcaaagcgttcgctgaaagacaaccgccgctcccagagctttctctggggcggcggttttcctttgtttatggctaatcgcgttatgggctcgtcgttggcttgacgcttatggcgcgctgcgttagctgttgaacgttgtagtgacgcacctggttaccgcccggtgaaagccgggataggggaggacggtatggccacgacgaagaccgagaccgaggcgacgcagaacgaagttcagagctccgaggccgctgcgaagagcggactggcgcagaatgtggagagctttctgaaggcccagatttcccaggcgcagaagcgcatcgaggagctggaaggcgaagcgggcaaggtcgtgaagaccttggagtcccgtgggcaggaggccgccaaggaggcccaggcgctgtgggcgaagttccaggccggtgagctgctgacggacccccgcgtgcaggagctgagcaagcgcgccaacgaggccagcaccgagctgagccggcgcgtggacgccgcgggcaccgagctgcgcaagcgctttgacggtatccagacgcgcgtcgtcgaggccgtgggcgtggccagccaggcgcagctgaaggacctcaacaaggagctggcgaagctgtcccgcaaggtggactcgctgctgaagcccgtccgtcgggtgaacggcgcgaagcccgcgagcagccccgcgtcctcgccgcgcgcctgaagttccgccgaatcccgacaggcagtgtgacctctccctttctcggagtacgaaagagaagggggaggcacatcgccgtcgttcccttcacgtcgggggtgtgcttatttcggccgttccccgaccggttcgggcctgaacgtctggcctgtacacctcccggagagaccccatggacaacaagcccgaggccccccgagagaagcactccgtgacggagacgttcgagcgtctctggagccaggccctgctggcggtgaacacggccgaggaagaagcttcacgggccgtgcagcgcgtggccgcggtggcgggttggagccaggacgaggtgaagcgccaggcccgggaattcagcgagcggctggcgggccaccgcaaggacctggagcacaacgtggaagagcgggtgcgccagaccctgacgaagatgaagctgccccgccgcgaggagctggcggcgtttggaacccggctggacaagctggccgagcgcatccaggccctggagcaccggaagtgaaagctcccgccccttcgggcgggaggtctttcggtacgcggctcttcgaacgtctccacgccttcagttcgggttgttcccggctcccgctgctcgcgggggcggcgctcgtcgtgtcggcgcggctggtgccgttgctggaggaacggccggtgcagcccgtcgtcccgggcgtcgtggcggcggaggtcatctcccccgaggcgtcgctcatcgacgcggtgctggcgcgccgggccccggacctgggcttgacgctgcgtcggcagctcatccaggccatcgccgaggaggccgggcggctcgcgtatgatccgctgctgatcctggccatcatcgacgtggagtcggacttcacggaagatgcggtgtccgtgaagggcgcgcgcgggttgatgcagatcaaacccagcacgctgcacttcctggcggagaaggaaggactgcgcttgtcccgcgaggaggtgaccgcggacaccgcgctctgcgtgcggctgggcatccgttatctgcgctcgttacaggagcgcttcggtggggacctggacctggcgctgatggcctacaacgccggtcccacccgcatccgcaacgccatcaagcagggcgaattggagcgcttccggcgctatccgcgcgcggtccgccgggacttccggcgcttccgtgagggccacgggctgggcggtgactgggccttggcgcagcgcgaggtgcctcccgagcccatgccctgagtgggtggggtgaatctccgggcaactgggacgctccaacggggtgtatgcgcgccttgttccgtcccgccgggtgcgctaagcgttccaagtgcccgggactgttggagattctcaggagtgacccgcatgaagaaccccctgttccccagtgccgcgctcgccgccaccctggccctggccccgttcggggcgcacgcaggctccgtcttcctcaacggcgtcaagattgacggcgtcaccaaccagaagttcgagaaggccaccgtccgcatcgacgaggccggcaacgtgcacatcgacgcgccgggctacgcggcccgcgtgacggcggtgacgcctccggcccccgccgcgtcgccccaggcaccggcgcccgcctccccggggccggcggccccctccgcgaaggagcctcccgcggcgcagcaggcgcctggcgcgcctacggcccccgggcgcctcacccagcgctactggctggtgacggagcagacggtgccggggatgacggggtacgacatcgacgtgttcatcaattccacgtggctgcgcaagctgcgaggcaacgaggaccaggtggtggtggacatcacccgcaacctgcggccgggggcgaacaaggtgacgttcatcgcccggaagggaaacgccggggacgcgcgcagcagttcgcctgcccacgtgtttcgggtcattattggcgagggcaacgagggcggcgggaacgtgatgatcgacaatcccatccttcgcttccagaagacggcggcggacacgcaggatgcgacacaggagttcaccctcaccacgcgctgacgggtgcggggcttcgggtaacggagacaaccgtgttcaacctcgacgagcgctaccgcgggctgcccgccacgcgggaacaaatcctggcgctgcatacctccctcaacgcgccgcacgtggccattccgggcaagcaggccggtccggcgcaggcctttgtcgtgggcctccggggagggcaggggaccgcggccgtcttcgtgtacctgtacctggcggaggccgcggactgcgcggtgtacctgtccggccggcgcaacgtgtcagcggatgagtaccgcgacgacgagggggacgcgctggccttcgtggagtcgctcgggttcatgatggacgacgccaactggcgcgcgatggcccccgagcagcaggacgagcagctcaagacgttgccggtgttcttcaaggacccgacgctcgtgcccgctgtggtggcgcgcgccgaggagaagaagaacgtcaccaccaccctgggccgcttcctggccgccttctgagtcaccgccccctcaccctcgtcgagagccgctccccatgttccgcctttccaccgcgtcctgttcgctcgcgctgctgctggtgtcctccggttgctcccacacgcccacggagaaggagaagcggagcgccgagattcactacgacctgncgttgcaggcccagcaggccggcgagctccaggatgcgctgcgcgagctgcaggtgtcgctgaagaacgacccggactaccccgacgcgaacaacgccatgggcatcctgctgcacctggcgtttcgccgtcccgacgaggccgtcaagcactacaccaaggcactggaggttcgccccgacttctccgaggcgcgcaccaacctcgccaacgtgcacctggaccagggccgctacgacgacgccatcaagctctatgagctggtcctcaatgacatgctctacccgacgcccttcatcgcccagggaaacctggggtgggcgtactacaagaagggcgagccggaccgcgcggtggagagcatcaaggccgcggtgacgaccaaccccaacttctgtttgggctacaagaacctggggctcatctacgacgagacggggcgcacctccgaggcgtgccgccagttcacgcactaccgcgagaattgcccggacgtggcggaagcgtacatgcgtgagggcgtctgccaggcgaagctggggcaggtcgatgcggcgaaggcagccttcgccacctgtgagaccaaggcgaaagctggtgaacaggtgctgaaggatgactgccggaggctgctggaaaagctctagcgcgttgggtatctggggacccgtggaccacgtcgatttcggcaaatacctgagccagcagcgagagctccgagggctctcgcgtgacgacgtcgcgcgggagaccaagattcctcccacgctcatcaccgcgctcgaggccggtcaggtggaacggctgccctcgcgcatcttcgtggtgaactacatccgcgcgtacgcgcaggtcatcggcatgtctccggaagaggccgtgctgcgctacgaggaggtggacaagtccgtcccggcgccatctcccgtgcagttggagcaggagcggcgcaagcgggcctacgtggggctgtccgtgctgctggcggccctgctcctgggcgtgtacctgttcctggtgctgagcggaaagcttcccaatccgctcgcgcgttgaagcatctccatggagcgatacgacgacgacgcgctcgtgctgtcctcggtggactatggcgagtccgaccggctcgtcaccttgctgacgcgcgagcatgggaagctgacggccttcgccgcgggcgcacgcaagagcaagcggcgcttcgccggcgcgctggagccgttcatgcggcttcgcgtgcacatcgtggagacgcgcggcagcacggtgcggctggacggcacagacatcgtcgcgggcttctatgcggcgcgcgaggacctgtccctgattgcccgggccttgtacgcggtggagctgtgccgcgagctgacgcgggaccatgagccgcagccggagctgtttgccctgctggagtcgtacctgacgcgactggatgcgaaggaggccgggcccacgtcgctcttggctttcgagctgtccgcgctggcgcacgcggggttgatgcctcggtttgattcgtgctcgctgtgtggcggcgctccgggcgagcggcctcgtttcgaccaggcccatggcggcgcggtgtgtgagccgtgtggagtccgtgctcgcgagtccgtggcggtgccggtggcgctgctgtcgggcctgcgcgcgctccaggaaggggcgcgcacgccgctcccgccggagctgcgcgcgcgtgctcgcggcctgctcaacgtcttcattgcccatcacctgggtcgccgcctcaagagcgtggacttcatggcccaggtgggcctggattgacgaagttcggaagcgaggggctcatgccgccgctggatgtcgtgtgctttggcgagacgttggtggacttcctcccggcggctccagggcaccgcgtgcgcgacgtgcccgcgtggcatccgtgccctggtggctcgccggcgaatgtcgcggtggggctggcccggttggggctgcgtccagccatgctgggcgtggtgggcgcggatgagttcgggcacttccttcgcgagcgattggcggcggaaggcgtggacgtgagtcacctgcgccagacggcggaggctcgcaccgggctggtgttcatctccctggatgggaagggcgagcgcagcttcaccttcttccggacacgctccgctgagttcctgctgggacaggcggatgtcgacgcggcgttcctgtcgggggcgaaggcagtgcactgtggttccaactcgctccagtggccggaggcgcaggaggccgcggtgcggatgctggggctggcgcgcgacgcgggcctcatcgtgagttgtgaccccaacttgcggctgcacgcgtgggaggacacgtctctcctgaagggcctgctggcgcggatgctgccgctgtgcaccgtggtgaagctctccgaggaggagattggcttcgtcacggggacggaggtgccccacgaagcgctgacgcgactggccgcgatgggcgtgccgctgcccgtggtgacgctgggcgagcgtggcgcgctgctgcagtggaagggggagtgcatccacgtcgcggcgccgcaggcgcgcgtcgtcgacaccaccggtgctggcgatggtttcgtcgcgggcctgcttcaggggctggtgcgctggtacggcggcgctggggggctgcgtgatgcaaccggtgaggagttggtgacgctggccacgttcgcgtgtgaggtcggggcccgtgtcgtggagaagctcggtgcggtggatgggcttccccgggcggaagtgctggctcacgtcatgccgtcgcgtccggacagctctcgcgcatagtgctgtgacggtggtgtcgtcgcgtccgacgaacaatcttctgttgtcgtgcgcacggtttgacgcgggcgcttgcttggtgcccgcgctcctcgttgacggtacctgggagaagtcgctcagggcgccaggggcgtgagcagttcgtaatcgaagcgctcgtacggcggggtcacaggctgtcgacgctggccgtatcgctccagcacgtaggcggcaggggctgagcgcctgccttccgactgaagccaattcgccagccggccgtaggccgcgttgatggcgtccgccgtgccctgcaccggtgtcatggcgtagtcgcgcgcgggaatcgtgagggccttcaggccttctgggaccccgtcgaggactcggacctcggtggtggcccagtactggtagacggggtcatcgcccggttgctcgtggtcgctgcccggcacgcagccatggaacacgtcgcggtcgaccactccgggcagttcgtccagacgagagaggtgctccagccacgccagcgggacgcggtggctcagttcgctgcgccggccgaccaccttgatgcccaccagcttgatttcatctcgggagacgatggaaacgttcatggtttccgaaccctccaccttgaagctggttcaacctcagaaggaactcgagcgccgcggcatccccgtgctgacgagtggttacgttcgcacactcgacgtggcggacgggcaacttctgggcgaggtgggctttcgcatcaaatcccgcaggaggctgcctcccgggagccggcggcaggagatggcgccgaccctgttcgcgacgctggagtgtgccgtccgtgatgaccaggccgcgcatcgcgtgttccgcttcctggccgaattgggattccgtcccgatgggcttcacctggagcgctatctgcccggtgtcgccgaccggtacctcctgatgctgggcgtgcagcgcctgcgtcccgtggtggcgaacggggaagggggctcgtccccgatggcctcggaatgaaaagatggaacggcccatgtctcagcccgtcccccaagctgcctccgaggaagtgacaccggcgcaggcaccgctgacgctgctgcgaatcccaggggattcccccgaggccctggacaccttctggctgcgcgaggtctttcagggggaccgggtgccacagctcaccctgcgggcggtgctgctcggaagtggcattggtgccatcacctgcgcgaccaacctctacgcgggcctgaagatggccgtggcctttcccgtggccatcaccgccgcgttgctcgcgcacacggcacacggagcgatgcggcgcgtggcgccgggcgtcgcgggtgctccgctttcgccgctggagacgtgctctgcgcaggccgtggcttcgtccgcgggctatgcgacgggcggcgccctggtatccgttcagggcgcgtggttgctcacgacgggcagtcatccccccgcgtgggcgttgctcgcgtggaccttcctcctgtccgcgctgggcgtgctcttcgcggtgcccctcaagcgcaagctggtggaccatgagcagcttccgttcgccacgggcacggccgcggcggcgaccatccgtgctcttcacaccacgggcgcgtcgtcccgtccgcggctgtcgatgctgggcctgggcggaggtatcgccgcgctcgtcaccctggtgcgggatgggctgggccgccttccctacgtgtttcctttccccggaacgctgagcgggatgtcgctggagcgcctgggctttggcttcgagatgagtctgcttccgctgggcgcgggcgcgctgctgggactgcggctcacggcgtcctggttcctgggcgcgctgctcattcacggagtcgtggcaccgcgcgtgttcgcttcggggctgctgcttccagatggagacttcctcgcctggagtctctggcccggaacggcggcgctcaccaccgcgtcgttgttgcacttcgcgctggagggccgcgtcctggggcgcgcattgaagggactcttcaaacgtccctccgtggcgccccatccggtggacgcacttcaggtgccgggacgctggctgttggcgggcctggtcgtgttgacgcccgccacgctcgccgtggccaaggtgggctttggcgttccgctgccacacgccgcgctcgcggtggcgttgtcattcgtgctgtgtctcatcgcctgccgcgtcacgggggagacggatgtcacgcccgtgggcccgctggggcaggtgacgcagatgacctatggcgtgctgctgccgcgcaacgtggaggcgaacctcgccaccgcgggcatcaccgtcaacgcggcgtcgtccgcggcggacctcctcagtgacgcgaagacgggacacctgttgggggcccatccccgccgcgtgttcctggcgcagctcgtgggttgcgcggtgggggccgccgcggtggtgccgctgttcttcctgttggtgccggaccgttcggcgctggggggcgagcgcttccccgcacccgccgccacggtcaccgccagcatcgcccaggtgctggcttcgggcttctcggggttggagccgggcacgcgcgcggcgctcggttgggccgcgctcgccgccgctgtcctcacgctgacggagcgactgcttcccgaacgggtgcgacactgggtgccctcgcctctgggcatgggcctggcctgtctgttgccggcgtccacggcgctggggttcttcctgggcggggtggcggcggccttggcccgcagggcgaatccaggggtgcaggaggggcgggtggtgacgctggccgccggcctcattgcaggcgaagggttgatgggggttgtcatcgtcctgagccaggcgctctggtaacgttcgtttcaccccatgcgctgtccggtctgccaccgccgtctcgccctcggcgcggtgtgtcctgtgcatggccagcgcgcttcgtcgcctggccctgacgccgagccctttccgctcccggacgtgccaggtttgagccccgcggccttgctgggctcgggcggcttctcacacgtcttcaccgcctaccgcgaggaggatggccgtgaggttgcgctcaaggtgggacggccgcctcaccgtgaccgcttcgtccgggaggccgccgcgcttcgccgcatcggcgcgccgacgacgcccacgcttcaccactcgggggttgtccgagggcggccgttcctcgtcatggagcggctgcatggccagacgctcgcagcgtggatggaggcgttgccgggctcgggcgcggcgtccgtgccccgcgtgcgcgaattgctcaggggtctctgcgccgccttggagcgcgtccatgccgcgggcgtggcccatcgcgacctcaagccggagaacatcttcctgcgtgagggtggggcgctcagcctgctggacctcgggctcgcgcgcttcctggacgcacctgaagacggagagagcccggagcccgagggcttgacgctcgtggggcagcggctgggcacgccgtattacatggcacctgagcagtgcctggacgcgcgcgaggccggcgccgccgcggatgtctacgcgctgggcgttctcctgtacgagttgctcactggcgcgccgccgttcatcggcggcgccgaggagattcgccacgggcacgtcagccttcgccccgcccgggtgtcggagcgcgcacccgtgccgacggcgctcgacgcggtgctgtcgcggtgtctggcgaaggcgccctccgaacgtttctcgcgggcttcggatgtgctcgccgctttcgatgccgcgtgtacccagtccctgtccatggctccgccagagggcgcgcccgccgcggtgcccacgtcgtccgggcctggggccggcgagcgctgggtcgcgttgctgggcgtccgcgcggacattccggtcgatgtgcttcggctgaccttcgagcctcagggcggcacgctcgcgcgcgtccacgcacggggctatctggtcgcgttctccgagtccctgtccgccgaggccaaccttcgcgcaggcgcactggtggcgcgcaagctgatggaggagggcaaggccgccaccgtcctacacctgtcgcggctgcacgttcttccgggcgccacgaccacgcgggtcgcagggcctgccttggaatccgcaggagactggtggccggaagacctctccctgggagaagcgcgcgtcactgcctccgccgcggccaggttggggccgggcgccatggagcactcgcccgatggcgcacgcctgcgattgcacgacgggggcgcggccacgtcctccgcggatgcaccgcccctgtcgggccgcgatgccgtcctggcggcgctggaggccgaggcgtcacgctgcatcgaggagggtgtcccagggctgtgcgtcctcacgggggacgtggggcacggcacgtcccgcgtcctggaggcactgtccacccggctggaggccgcggggcggtgtcttgtggtgcggctccgcgcgtccgctccggacgccgcgtcctcggagtcgctgctggacgcgctgcgagccaccgccgagccggcccgtgttgtccaggccccaacgcttccactcgcggatgcgcgacacgcagccgcgcgctgcctcgcagagggactccagcggcaggcccaggcggcccctcgagtgttgctcgtcgacgacgcgcacctggcggaccccaccagcctggatgcactggaggtcgccaccttggcgggtgtgcgtgcgccactttgggtctgtgtcgccgcgaggcccgcgttgctcgggttgagaccgcacctgggcgagcgcagcgcccgcgtcgcgcgaatcgcactgccgccgttgacgcccgaggcgagccgttccctgttgctgcatctgctgcgccccgccgagcacgtccccgagccggtgctcgcgcggttggaacagctggcgcagggcgtccccttgtcgttggtggaactcgcgggtgcgctgcgggccgcgggggccctgcgggcgtctccaggaggcgggtggtacatcgcgccggacgcgttgctggacgtctccgtgacgccgctcttcgaacgactcgccgcgcgggcgttggccgggctccccgcggcacaccgagtcctggcgcggctttgcgcggtgctgggcacggaagtggaggtgtcccgcgtggatgccgccctgcgacacctggagccgagcgatgagatggcgcgcgtgacgtcgctcgacgcgggggctggactccagcggctggcgcgctcggggctgttgcggcccacggctccgggccacttcgccttccgtcaccccttgctgcgcgaggcgctggaggcgttgctgccggcgccctcacggcgcgtcctccacgccgcggcgctgcgtgccacgccccgggacgggatggccgagcgccgtcgctgggcccaccatgccgcggcctgtggtgctcatgcggaggccatcaccgcgttcctctcgctcgcggagtccgcgcgccgtgcgcacctgtccgtcgaggcggagcagcactacacgcgcgcgctcgcgttgttgccggagggagacgtggagcgccgtgccctggcgttgtcggggcgtgggcgcgtccgtcaccggcttcagcgcttccgggaggggctggcggacctgggcgcggcgcgggcactggccgtggcccgcggtgaccaggcccagcaggtggagttactgctggaggaagccaccgcccgcgactggatggaggacgtggagggctcgtcggcctgtacacgtgaggctctggaacgcatcgagcggctggatgatcctcgcctggccctgcgctgctcgctggcccgaggccggctccacgtccggctgggggagtggggcgccgccgtgcgcgttcttaccggggtggtggaaggcgcggagcgggtgcatgaccacgagacgctcgtggtgtcgctggcgctgctgggctcggcgctcacgttcctggaccggaccgacgaagccgcgacccgcttcgacatggcactgctgcgctgtgagcaggccggggacgcgctgcaccgggccgctacgctcatcaaccgtgtgctgctgtggttgcgcctggggaatgtggctcggatggaagaggacctgcgccgcgcgatggtgctgggccgggagctgggccatgcgcaagtggagcgctggtccaccttcaacctcgccgaggtgctctacatgcaaggccgactggaggaggcgctgccgctggcccggcgtgttcacgaactgggcgtgcgtttcttccgtgagcaccctgtcccggtggatgcgttgctgctcgcgcgcatggccgccgcgctgggcgacctggaggaggcgacgcggcagctccggtggattgacgcccactgtccgcccgaatcgctgccgcccaccgccgtcatgcggaggctggtggagctacaggtccaggacgcacggggcggcggctcggcgcgggaggcgtggctggccctggcggacgacgcggacaccctggcttcggcggatgagaaggcggagattctcctccaggccgcccggggcgcgctccaggcgggacgtaccgacgaggcgcgcacctgggtggtccgggccgagcgcgcggtggaggagggcgctcccctgtggcgagcccgcctggagtccctgcgggttgcccttttcgacgtgtagcgagaaatgtcactgtccggcggcagtgtgacgtgaagcgctacgcgaatgctgcgtggagatctgctctcatggcaccgcatacaacctcccaggctggctcggcacatgcttgctgggaggcagcactccttccttccgtcgttcttggaggacgtctcatggcccttggttcgcctcgcctgttggcggtttcctcgctcgtgtttttcgccctgtcgggctgcggaaccgggcctcatgaagaggagacgcccacggtagggacgcaggcgtcggagattcgcatcgccaactcgctcacgacgcaggcgctggtgctcaacgccatctccaccaacgccgactccaaccagttgctggggacctcggcgcttgggcagttgttccaccccacgcagggcgacgagaacacgcgccgacggctgcatgaccccaatgcgcagcggttcatggagtacgtggtgggctgcgcgctgacggtcgaccaggagattgcctattacgacccgcgggagcccagtcccggcgtccggaaatggcttggacaggcggggctctgcccggattgggacgactccccgccgagccggagctgcctggagcgtgtctccgcctgtgtactggcgcgcaacaacgcggagggacggcgcgtggagctgtccatgcgcggcgagcaccagttctacgcgtcgggccccaacatctacacgctggatgcgaagacgcgcccggccgcgcacgtccccatcacgggcaatgcgctggccagcttcggggactgtggcctgggcgaatcaggcgagcagcgtgactgcggttggacgccggatggcattggccgctgcacgccttccacgaccgtcgtggtgggagcggggggggccgctgtcctgcgcggggctgtctcccatcgtgggctccagtgtgaatgggcccaccgtcctgcgggtgtgcgagggcatcgcggggtgtgaccatctcgacgcgcgcaacctgggcgaggcgacagggagctgcgcgggggcgcccgccgtgccagtggtctccttcacctgcccggccgggggccactacagcgtgatgaccgcgccggcttcaagcacgaccgtggaatggctggcgaacgtcgaggcgtatccggactccgcgtccacctatggcctgtccgagcagcaggtctattccgtgcgcgagggcgcattctacggaaacatcttcctgccgaacgagctgggggcggaggtggacgtcgtggcactcggggatggggacaagaagcggtacgtggtggtgggtgccgacgtcatcgtgcgcggctccatctaccggaagatgttctcctgctacgacccggcctggtcgagcggggcggcgtacgcggtgaaccgcgtctgcgcgctgccctcgtcgggctccaactgtgccgcgcgcgtgacggggccctgcttcacatccctcagtccgcccgtggccggtaagtgcgagatcctggatgggcccctcacgccgagggatggcgactacgaggcgtgccacgacgatgacgacgtgctgtggaatcagtcggtgaccacctacctccatgccccgtgcgacacagtggcgaaggagatgcgcacccagtcctgcgggcgttcatcggggcccgtcaagccgctgcctacgggggaggagctgccctttcccttccctcggaagaagtaggccttctgccgcatggcgtcgggtgacgaagaggccctctatggcgaggagctgggcgtcggcgccctggtatcggactggctggtggagcaggtccattaccgggggcctgtctccacgctctaccgtgcccgacatgtccgcacgggtgcgctcgcggcgctgaaggtcctgctcccgcagccctcggacgtcgccctgcggcgcttccgtcgggaggcggagacgctccagcggttgagacatccgcacatcgtcgacgtgcttggctacggcacgctcgcggacgggcggcccttcatcgcgatggagtggttggaggggagggacctcgcggcggagctggcttcgcgcgggccgctgtcgccaggagaggcgctggaggtgctggagcaggtgggcggcgcgctgcgcaccgcgcaccaggccggtgtcgtgcaccgggacttgaaggcgcagaacgtggtgcgcttgagcacgggcagtggagcgccgcgcgtgaagctggtggacttcggcgtggcgaaggggctgacgccggatgcgccgggcgcgtccacgctcacgctgacgggcgtctccctgggcacgccgttgtccatggcgcccgagcagattcgcggcgagccgcccgacgcccgcacggacctgtacgcgatgggcgtgctgctcttccaactcgtcaccgggcagccgcccttccagggggccacccggcatgaggtggaggacctgcacctgaatgcgccgcctcctcggcccagtgagcgcgccccggtgcctgccgcactggatgccgtggtgctgcgcancatggggaagcggcgcgaggaccgatacccggacatcgatgcctggctcgacgcgctccggcgcgcggtgaagggcagtcccacggaggaccagcccacgctcgccgtggcgctgtacgcggaagcccg

SEQ ID NO: 1140 - DNA, 15499 bp, Myxococcus xanthus
gccgcgcacgtggcggaggacatccgcacgcgggacgtgcgcttcaccagcatgcccggggcggaccgtcacgcggtggtggcctgggcgcgcgccgccgcgcaggcgctgcgccgactggacctgcgctgcctggacgcggcgctgcgccgcatcgaaccgatgctgccagagggggagtcatgaacgccgaagccgtgcaacccgagtggagacgcgacgaggtgagcgcgtactacgaggcgaagacggagcggctgctccaacgctatgggcccggcccacgcgtgcactatcactccgggctggtggacgtggtgccgccgcccggcgcgtcctcggaggtgctgcgcgacacggtccattccgcgcaggaagcgctgctgatggagctggcgcgcgccgtgggccgcttcccggacggcggcgaggtggtggacgtcggctgtggcctgggcggcggcgcgctctactgggccaccgagcatcaggcgcacgtgacggccgtgacgaacgtgccctcgcatgtcgcgctggtgcgcggcttcgcggaggccgcgggcgtgagcgcgcgcgtgcgccccatcctctgtgacgccctctccgtgccgggccgcgcggccttcgacgcggtggtggcggtggagagcgcctgctacctgccgcgcgccgagtggttccgccgcacgcggacgctgctgaagccaggcggcgtgctggccatcgccgactgcttcctctgccgtccggagctggcccctggctttgaccggtattggcgcacgcgcatcggctcgctcgatgagtacctgtccgccgcgcacgccgcggggttggagctggaggtccgcgacgacgtgtcctcacgcgtggtgggcttctggtcgctgacactggaattgatggtgcatgagcgcgcttcggcacaccccacccagcatcccctgcgtgcgctcgctcaggccggccgcggcgaatccagccgcgagcacctgcgcctgcagcaggcgttgatggacggcggtctggagtacgggctgctcgtgctccggcgggtggactgaggactcgccccacctcttgattgaagcgggcccctggccgcccggccggagcatgggcggacatgtgcaacggtcgggggggcggggtgcaacacgcgagggtcgcctccagccttgggccagtcgctactcagggaggaaacgcgatgcaggctttcaatcggtggatggtgctcggtgcggtggcggtggcgatgtccattacaggatgcagggaacagaaccgtgagcaccaagggacgacgaccaccccgggcatggagggcaccggcggtagcggccagggcaccaagccgcaccctagcggcggcaccggcggcaccggcggctccggccacgagatgcaaggctacgacgccggcacgggcggctccggccacgagatgcaaggctacgacgccggcatgggcggctccgggatgatgaacgaccacaacaccaaggacaccgggacgcacagccccgaaggtcagcagtagcccgcctgctcgcgacccgccgcgagcaagcaacccacggggtccgggatgctcccgggccccgctccgcttctgggccttcggctctgtcctacccgtcacacccgttctggcggcgagtcgacgccacccgggcacaaagggaggggttgctgtcggccagcgaccgtgcgtccgggccggaatgtcgggtcacccgcccgcatcgggtacgttgtgcggcgcgccatgcccttcaagttcgttcatgccgccgacctgcacctggacacgcctttccggggcgtcgcgacccaggggccgctcctgggacgcttccaggattcgacgttccgagcgctcacgcgcatcacggaggtgtgcctgcgagaacgggtggccttcctgctgctcgccggagacctcttcgatgtgaaggaccgctcggtgcgcgcgcggctggcgctgcggcgcgagttgggccggctggacgctgcgggcatctccaccttcatcgtccacggcaaccatgacccgctgagcggagacaccggcgcgctggggcttccgccgtcggtgaaggtgttcggcccggactgggaagaagtggaggtgaagcgcgagggccggagactgtgccgcgtgcagggcatctcctatccggacgtggaggtgcgcgacgacctctccgcgcgcttccgccgcaccggggatggcttcagcgtgggactgctgcacgccaacctgggccgcgcggagggccacgccaactacgcgccctgcaccaccgcgggtctgggctcgcgcgggctggattactgggcgctgggccacgtccacacgcgcgccgagcacatgctccccggcggcggcgtggcggtgtaccccggcaacccgcagggccggcacgcgaacgaaaccggcccgcgcggttgcatgttggtggaggtggaggacggcggcatgcggcggcgcttcatccccgtggacggggtgcgctggcacaagctggaggttccgctgtccggcgtcagcacgctggacggactgctggccacggtgatggagggcgtggaggctcgctgcgcgcccgagctggacggccacgcggtgcgactcaccctcaccggaagaggtccgctgcaccgcgagctggcccgtcccggcgcgctggcacagttggaggtggacctgcgcgaacagctcgcgaggagtcacccaccagtgctgttggagtcgctgcgggacagcagccggccggaggtggacctggaggcggtgtgcgcggcgggcggcttcgcgcgcacgctgctggacgaggtgggcttcctcgcggaggacccggcggcgctggcgcggttgtgggaagaggaggccatgggcgcgctgagccagcggctgaagcggctgggcgtggacgcgctggaggcgcctcgcgcggagtgggtggtgcaggccgggctgcacggcgtggagtcgctgcatgaggaggagacgtcatgaagccggggctgcgcatcgacgcgctgcgcgtgctcggcttcggccgcttctccggcctcacgcgcgacctggggccgggactgcacctgctgtacggccccaacgaggcggggaagagcacgctgctggccttcctgcgcagcatgctgttcggcttcgagaagcgcgggcaaccggagcgctacgagccggcccacggcggcgcgttcggcggcgagctgacgttgaccacccacgcgggaccgctgctggtgcgccgcatcgcgagccggcgctcgtcggagggcgagctgtcggtgcgcgacgcggaggggaaggagctctcgaaggagtcgctggagagcgcgctggcccacgtgtcgcgcgagctgttcttcgacgtgttcgccttccgcctggatgagctggccggcttcgagcggctcaccgaacagcgaggcgcctccgaggccctggtggccgccagcatgcgcggcgcgcgccgactgccggaggtcatggaccaactccgcaagcgcatcgagaaaatctacaagccgaacggcgtgactccctcgctgaacgtgacgctgaaggccctggaggacgtccaggtccggctgcgacaggagggagaccggcccgcgcgctacttcgcggagaaggagcggctgggcgcgctggtggaggagcaacggacgctcgaagcggcgctgctggagacggggaccggactggagcggctgacgcgactggaggcggcgctcggggacgtggcggcgctggcacaggcgcgcgccgagctggcgacgctgcccgcgctggagaccttccccgaggcaggtgagtcgcggctcgaggacggcctgcaccggcgtcggagctatcgcgcggaaggcgctcggctggcggagcggctggccacggtggaagccgggctggagcggctgtccgcgccgtcgggcgtccggggtcgcgaagaggcgctgagccaggcccttgcggcatacaccgagggcgccgcgctgctgcgcgccctgccctcccgccgggccgccctggcggagaagcagcggcaggtggagctggccttgcgcgagctgggcctgcccgtggatgggcccggcctgctcgcgctggacttgagcgtaagcgtccgcgtgacgctggaggaactggcgctccggctgggagcggccgaggtcgcgcatcgcgaggcggagggcgcatgggcccgcgccgtctcggagcgtgagcggctggatggcgcgctggcgcgggtggacgccgagctgtcgacgctgccggaggaacgggcgtcgcgaattcgccagcaacaggcggggctgggacggctgcgcaccgtacgcgcggaggtggagcgcctgtcggagcagcgggccgagctgcaccggcaattcgagagcgtccgcacccagggcgagccgcaggcgacggcggcggtgcttcccacatggtgggtgccggcggtcgccgcggtggtggtggcgctcgcggtgacggcgtggctgctggcgggcaatgtggtgggcgcgctgtgcctcgtgggcggcttgctgctgacgggcgtgctggagctggcccggcgccgtgtggagacggcgcgcgacgcggacgtggaggcacaacgcgcgcgccagcgctggcggcagcaggaagaggagcggctgcgcgcggccttgatgggtctgtccgcgcgagaggaactgctgcaccgtgagctactgtccgcggcgtccgaggccggactcaacctggtcgcgacggcggcggacatggcggcgcgggaagccgtgctggcggatgcgctggagcgagcgggacggcgggagcagctcgagcgggagcgggagacgctgcacgccgagcacaccgccgcgcgacgcgaggagcaccgcgcgagtgaggcggtgggcgaggcggagtcgcggcaggaacagttgggcacagagctgacggccctgctgtccgagcggcacttccctcccacgttggccgcgtccgcggcactgacgctgtggcgtgacgcggcggcgctccgtcagcgactcctggacgtaggcgcggaggaagccgcgctcacggtggacgcgcaagtctgcgccctggtgacgtcgcggctgtgggcggaggccgtggtggcggaactcatcccgggcgcgacggaggcccgtgaattggacgccggtgtcatggagcccctggcgtcgcgggtggcggcggcgctggaagcggagcgcgcgcagagcctggagcgcaggacgctggaagagcggcggcacgaactgcgagcggagaaagcgcgactggacgggctgtgccacgacgaagaagcggcgttggcgacgctgctggccgaaggtggcagccccgacgaggagaccttccgccgccgcgccgcgcaggcacgccgctacgtggaactgacgggccggacgcgggagctgtcacaccgcatcgaggcgcgcacgggcctgtcggagacgctcgcgcggcaggcgctcatcgacgtgggcggcgagcagggcctgcgcgtggagctggaatccctgcgcgaccgacaggcggaggcccaggaccggctgaaggcggtgctcacggagcgcggcgcactcagccaccagttggagcagtgggagaacgacgacgcgctggcgaaactccgcatcgtcgaggagtccctgcgcgcacgggccgccgagctggcgaagcagtacgcggcggaccggctgaccctggcactgctggcgcgggcgcgccgccgcttcgaagaggagcagcagccgcgggtggtgcagctcgcctcggagcacttcgccacgctcacccagggccgctaccagcgcgtcttcatccccacgggagaggagcgcgagctgcgcgtgggtgatggtcagcgtgactggagcgcggcgcaactctcccgagggacgcgtgagcagctctacctcgcgttccggctggcggtggtgcgtgacttcggcgagacgcgcggggcgctgccgctcatcgtcgacgacgtgttggtgaacttcgacccggagcgggcgcgaggcgccatccacctgctggcgaagctctccgagcaccagcaggtcatcgccttcacctgccatccctggctgcgagacgccttcgccgccgagggcgcgcgggtgcaagcgctggacgcttccacgagcgaaccgcccgcgcccgtgtccgtgctgaagacgggctagccagatggcgcggaacagggtcatcggcatgcgccacgaagcagaccggcgccgcgcgacacctccaagtacaagcccacctgccgcgagcctgtggcacactgcgcgcgccattcgactcctcttctccatcgtcttctgggcgttcctgatgctctccagcgccgtgctcttcgtgggcgccgtgctggtctggctcgtcacgttgccgttcgaccgcgacgggcgcgtcctgcacctgtattcgtgcttctgggcgcagctctacttctacgtcaacccgctctggcacctggaggtcgacggccgcgaacacctgccctggcggggcccggccgtgctcgtgtccaaccacgagtcgctcggcgacatcctggtcctcttcggcctctaccgccccttcaagtgggtctccaaggcgtcgaacttcaagctgccgctcatcggctggaacatgcggctcaaccgctatgtccccctggtgcgcggtgacagggcgagcatcacgaagatgctggccgactgcgaatactggctgtctcgcggcgtgcccatcctcatgttccccgaaggcacgcgctcctccgacggcgtcgtgaagcccttcaaggacggcgccttcgcgttggccttgaagcagcgctgccccgtcatccccgtggtcctcaccggcaccgcgcgcaccctgcccaagcacggcctggtgctggagaccaccgcccgctgccacgtccaggtcatgccccccgtcgaccccagcgccttcaccgacgtggcctccctgcgtgagcacgtccggaatctcatcgtctcggaaaaggcgcgcatcgaggcgctgacgcccggcgcctgacacatccctcccggcccgcccctttcaccggctcgagaacccaggcaaagatgcccaccgggttcgaggcggggctctccgaggaacgcgatgcgcaaacagccggtggtgatggtcgcgctcggtggactcgcactggcgctggccgtggcgctcgtccatgcccaggacgactcgagtgctcgaccaccgccacccaccgcgcagcacggtccatcgcttcgaaagctcgacgcccccacacccccgccgaaaggcaaccactcgctccgtggccgcgtgctcgacccgtggcgccgccccgtcgcgggcatccaggtctccgccacgcgcgagatgcccggcgagtccctgtccgcacttccctgtgacacacgcgcgccggacctgtcgctgtcctccggcgactgcattggagtgcccgaggagcaggtgcggggcctcgtcgaggtgggccacggcggcgcgcccgtggtggcccaggccgtcacgtcggcggaaggaacgttccgtctcgaaggcctgcccgagggcacggtggcgctctggggcatcggcgagcatcacgccacgctggcgctcgacgtcagcaccggcgcgcaggacgtgacgctcgtcctcgccccgggcctcttccttcccggccgcgtcatcgtcgaatccggcgcatcgctgcccggagcccgcgtgacgctcttccaccaggagcactcccgcttcttcgatgccaggactggcgcggatggccgcttcgccttcggtccgcttccaccgggcgactacaccgtcgtcgccaccagcgacggcctgctgacagactcccttcaaaacgtggagatggaggacctgaatcccatcgtcctccacctcccccggcggctgtccgggcgcgtgcttgcccaggacacgcccgtagccggcgcggaagtccacgtggcgtacacgtcgtccgtcacagtgacggacgaccagggccgcttctccttcgagccactctctccaggtgattacgaggtgcgcgcggagcaccagggcgcgtacggcttcgccatggtgacgctcaccgaggaagacggggacgcggacaccaccgtgcacctgggcacgctcatctatctggaaggcaccgttcgcgacgagtccgggcgccccatccctgaagcccaggtgggcgctggcgcggccagggggcgggcccctcccgtggactacgccaccacgatggcggacggccggttccggctgggcccgctgcggcgggagccctacatcttcaacgtcctcgcctccggctatctgggcacgctgcgcgacgaagtcgccgcgcctggactgcgtctggacttcaccctcgcgcgcgcccacctcatccgaggcaccgtcatcgacgcccagggaaccccggtgcccgatgtggacatcgacctggacagggagtcgctacccgacaccgagacagacctccagcgcgtggacgccaccacgtcggacgagcacggccgcttcgagctcgcggtcccccatccaaggcgctacgaaatcgtcttcatcagccagggccatctggaggcgcgggtgacagcggacgcgccgggccccgagctccgcgtggtgatggaggcgaccgcccgcgtggagggcaccgtcacgagcgcccagggcctccccgtccaccacatggcgattcacctcgaggatgacagcgacaccgggaactcccacaccgttgagagtgacgaggaggggcgcttctccatcaccggcgtgctcccgggcacgtaccgcctgcatgcggggacgaacacccacccggccacccgagcggcgtcgcgtaccgtcaccgtgcacggttcggaggtcgtgaatgcctcgctgcggctggagaccggagcgccggtgtccggcatcgtcgtggacgagcgcgggcgcccggtggcgaacgccacggtagaggggcaatccctgtcgggccggcgcagcgacctcccccccagcgtcaccaccagcgacgacgagggccacttcaccctgcaccacctggcggaaggtgagtgctcgctgcgcgcggcgaagggccggtatgtgctcgaggccaccgagcctcgtgctcccggcgcctcacatcccgcggtcctcgcgcagtcgggagctcgcaacgtgcggctggtgctgcgaagccagggaaacgtccatggccgcgtggtgcgcgcgaatggcacccccatcacccgcttcaccatcaaccaggagcccttccgggaccccgaggggagcttcaggttcgacgcccccgtcgtggggacacagcggctgaccttcgaggcccccgggctgacgcgcgccgtgcgcgaggtgcaggttcccgcggccgaggacctggacctggggcaggtgcggctggaggctgggcgcaacgtccgcggccgagtggtggacgcggcgacgtcgaagcccatcgaggacgccatcgtcgaggtccatctgccgggtgaaggcggcgcgttcgaggaagtcaccgcgctggccgtggacgtctcccaacgggatggcactttcgccttcccactgctggaagcgcgcccgctggacgtgctggtccagacgaaccaggggcaccccatcctgcgccatcggattggcacgggtgacgaaaccctggagttgcaggtgtatccgggcgcacaggtggaaggcaccctgaatgaccgcgacggaaagcccgcggaagccatcgtgcagctcgtcgccgaagacagggactactccgcctcggtggatgaggggctgggggcattccaggcccggaacgtcccggcgggcacctacacgctgtcggcttccatgggacagaacgcggaaggccgcagcgtggccttccttccgcagcgcgtgaaggttccgcccatgggaaaggtgacgttcgccttcacggaagccaccggtggcggcacgatgcgactcggcatccggatgcctccggtcaagccggacgtggggatctacaaggcgttgctgtcgggcacgctgccaccgaccgtatccggccgggagctgcgcacgcgggcccgcttcggagacatccgagcgtccacgaagagcctggagggcgtgttggtgtacgagcagctcccggctggggcgtacacgttcatcgtcctgctggaagaggggaagcccgcccgattcaccgtccaccgggaggagctcttcctcgcggagggggagacgctggagcgggacgtccaggtgacgccacggcccctgccctgagcgcgggtgcgattatcggttgtccccgcccacgcctagagtgaagcggatgagcgacaagcgccccctggcggacacgaccgagttggagctggactggcgtggccgcgccccccgcaagccggaggcgccctccagcgcggccttggaaccgctttccgaggtcgaggtgccgtccggcgcgggcaaggggctcccgggcgacccgcgccacatgagcatcgagttgcgccagtcggtgcaggggatgatggagacgcccgcgctgcgcatgcggcagatgcgcgaggggctggagattttcttcggcgcccagacgcgcaaccgctacgaggtgtgcgacgacacggggcgcgtcgcgctctacgtggaggaggaggcccgtggcttcggcgccatgctccggcggaccttctcgcccttctacaaggcccggatggagtgcatgacgctgggcggcatcgtggcgctcgtggtggagcgtccctggagcatcctcctcacgaaggcggacatcctggcctgggacggccggctgatggcgcgcatccagcagcgcttcaccctgttgggacgccacctggacatcgtcacgcccggcggcgccgtcatcgccaccgtgaagggcccgctcttcagaccctggaccttccgtatcttccagaatgacgtggaaatagccgtggtccgcaagcgctggagtggcttcctccaggagagcttctccgccgcggacaccttcaccctcgacttccagccccagtgcaccgacttccggctgcggcagttggtgctggccgtcgccctgctcgtcgacctgacgtacttcgagaacaacagcccccgcgccgccctgggcccggggctggacctgttcgacgcgttgatgttctggaagaagtagcgtggtaaatccccctccatgtccacgtccacgagcgatgcgctgagcgcggcagacctggagcggctggtccgcgccgagtcccctgacctggccgatgccgtcctcgccctgctcgagcagcccgagcagacgccggagaagccgctgccgaaggatgccttcaccttcgacgcactcctccggacgctcacccaggcccgggcgcactacgagtcggacgggcggcgtcaggcctcctccgaggcgtggcagcgctacctggcgcagcaggacgtgccccgccctccccgcctggccctggccgacctgctggtggcgctctaccagcgcggcacccaggcctcgcgcgcggcgctgatggacatcgcccgccgcgcggacctgcgcttcggcctctggggcggactcaagcgcatctacaagctggcggaggccaaccacgacgcggagctgttcggcgtgctcgcctggcgcttcgacgtggagcgccaccgccccagcgccagccgggaagtctccggcggcaccctcacctacctgcgccgccgcgcctggcgctacctgcgccacctgggcgccgccgtgccggagctctacccgcagttcgcggtggaggtgctgcgccactacgcgacgaacacctcctggtacggcgtctgggtggcccaccacatctgggcgcacggcagcggcaagtacacgcaggactccttcgccatgccgccgccgggcgacatggtgaagcaccgcgccttcccggacgcgtggaagcgctcgccggacgcgctgatgcgcctgctggacgtgtgtgagtcggaccccgccgccagcttcgccatccagggcctgcgcaaggacttcccggaggcgctgcgcaaggtgacgcccgcgtggctggaccggctcgcccgccgtccgctgggcagcgcgcacgacttcctggtggagacgctgcagggctcgcccgagttccaccagggccggctgcgcgagctcggcctgcacgaggcggtgctggcgctgctgctgtcccccagcgccaaggcccgcgcctacgccatcgagtacgcccgcgcccacgcgcaggacctgccggcggagcgcctggaggagctggtggcccagggcgccccggacgtgaagtccttcgccgcggccacgttggagaagcgcaacccgcgcgagctgggtgtggcgctgctggggcggctcctgcagcacaaggccacctcgaccttcgcggcgagcgcgctggcgcagtcgttcgaccgggcggagctgcccgcggacttcctgcgcgacatgtacctgggcaccggtgagcagctcaactgggtgaagggcttcatcagttccaagtacggcgccaccgagctgcccgcggacttctggaaggcgctgctggacgacccgcggctgcagaagaagccccaccccgtggaaggtctggcgatgcgggcgctgtcggcctacccggccgcggccatcggtccggagtggctgctggagaaggccgcccatccccgcatcagccacatggcgacccaggcgctcatgcgcgcggacagcctgcccgggctggacgtggagcaggtgaaggcgcgcgtcttcagcgcgaagtaccggggcgtggccctgggcctgctgggcaaccgcaagctgttcaccgcgcgccagctcaccgtgccctggctgctggcgctggcccgccgcgccgacccggagctgcacggcttcgcgcaccgctacctgctggagaacgtggcccccgcggacttcagcgacgcgggcgacgcggccgcgggcctggagcgcctcttcgagctggccctgggcgcgaagcagccggcgcccgtgcgcgccttcgcgcagacgtacctgcgctgccaccaccccgtcatcgggccggagcagccggagtcgaagtcctacaacctcaagccccgcgcgccgcgcaaggcgtacacgccggagctgctgtggcccgcgctcaccgattcacgggacgacgtgcgccgcttcgccctggccattgcccgcgcggagctgcgcgcctggggctggcacacgcgcgtgtacgagctggcggacgccgaggcgaaggagattcgcaacctggcctatgacgctctgctgcgcgcgggcgaggaaggcgcggacgcccggcacacgctccagccagaggagctggaccccgtgaaggtgttctccctcacggagagcaccaagcgcagcacgcgcgaggtcgcggtggagctcatccgccgacactacgcgcggctgggcggcgccgagcggctcgcgtggctgatgcagagcgcggaccgcgaggtgggcctgttcgcggtgcgcctcctctgggagaagcaccggcccacgcacctgccggaggggtggaagcccgcgggcgccaaggaggccccggccgccagtggcacggagcgcttcgccaacgtggacgcgctgcgcaccttcctgcggaagatgctcttcggcctgccgccgggccgcgccaaggaggcccgtgagggtgaggtgcagaagcgcctgtccgccagcgtggccaagcgccgcgtcatcgagctggtgcgcgacctgggcctggacgacgcggccttcgcccgcgtggtggcgccggtgctggaggagttcaccggctcgctggccaagggggaatggcagagctgcctcgcctcgctggtgcagctccgggccgcgcacccggatgcgcaactcggaagcgcctgagcagattgaacgcccatgctgctcgatgaactgctgaatggctttccgcgggagcgcttcctccaggagcactacctgcggcgtcccttcaccggcgcttccgccgcggagcgcctccagcgcctggggacgtgggagaccatcgacttcctcgtcgaggagacggcctgcgacgtgctgctcgcgcgccagggcgtaccctacccgggagacaggcccacgacggcgaaggcggcgcgggagctgttcgcgcagggctacacgctcgcgctgcggcagccggacctgcaccacccggacctggcccaactggcgcgcgccttcagcgcggagctgcacggccgcatcaacctgcacatctactgcacgcccgcggggcaccacggcttcggctggcactgcgacccggaggaggtgttcatcctccagacggcgggccgcaaggactacctgctgcgggagaacacgctccaccccgtacccctgccggagtccgtacccagcggctccctggcggcgcaggagaagacgcccgtcgagacgcactcgctgagcgccggggacttcatctacatcccgggcgggcactggcacatggcgcaggcaaccgaggaggcgctgtccatctccatcggcctgatgccgcccacgctcctggacctcctcgacggggtgagggccgcgctggccagcagcccggtgtggcggcggcggatgccctcgctggggcgtgcctcctcactggacgacccgagcaaactggcgctgctgcggacgctgttgtcggagctgggcggtgaagtccagcgccagctcgccgaccccggctaccccctgcgcttcctcgcgcagacggcccggttctatctgcgctccacgggaatccggggcaacgggcgctgacggcgcgcggcaccgcgaaccccttcactgcgcgctcttctattgagggcgctggtgctaagaagagcagccactgaggagcgtgatgcccgtactcgccatcggcaacatcgagaaggtccgcgcactcgcggccaatgcgcgcctgctgctggtgggcggtgctcgcgcatccaccgccagccgcctcaccgcgttcgagccgggcaccaacaaggtgctgtggagcacggagctgccctccgcggtgaacgcgctcgccctgtccggtggacagtgggccgcggccggcgcggatggcacggtgcgcatcggcacgctgtccgacggacaggtgcagttccaactcaatgacgtgcaccccggcggcgtcacggcgctggcctccagcgcggatggcacgctcctcttcagcgcgggcgcggacggcgtcgtgcgcgcctgggactgggagtccacgcgcaagatgcacgagtggaaggcgtccacccagcccctgcgcgcggtggccgtggacccctccggcacctacgcggcgggcgcgggtgacgacggcgtggtgcgggtcttta

SEQ ID NO: 1141 - DNA, 18809 bp, Myxococcus xanthus
tctacgggttgtggacgcgtccacttgcgtgcgcagaggcacggtgttggcgagcagacccacgacgccttcgagcgaaggatgggtgcggccggagacgggcgtgccgacgcagaagtcgtcctgctgggagtagcggtacagcagcgcggcgaacgcggcgtacagcaccgtgaacggcgtgacctgctgttgccggcacaacgctcgcaggctctcggagagagacggcggcagcgggtggtagccggtgttgtcgccccggtgcgtgaggacggcggggcgcggcttgtcggtggggagctggagcagctccggcgcatcggagagccgctgcttccagtagtcgagctgagccgtgtcgcgagcgcggacaggctcggagcgctgccaactggccacatccacgtagtgcagcgcgaccggggccagcgtgggcgcatggccctgctggaaggcggaatacgcctcgcccagttcgcgcatgagcaggcccgcggacagtgcgtcgctcaccagatggtggaacacgacgaccagcacatgccgcgcttgctcggcttcgagcagcaggaatcgatacagcggaccgtgctccacatcgaacggccgattgccttcttccgtcaggcgccgagcctgacgggcctgggcgtccgcacccggcgccaggggctccacctggagcacgctggcggggaccggggacacgctcgcctgcggctgaccctgtcgtgaggacacggtggtgcgcagcaccggatggcgctccagcagccacttcgctgccgcatccagcgcggccacgtccaccgagcccgtccactccgcggcctgtccgacgacatgcgctccggagtccggctggagctgatggatgaaccagaggcgctcctgagcctgggagagcgaaggcgccgagtcagaaggcgtcggaggaggaagcgaggagacgtcgcgctgaagcgaagcgacttccagcgcaaggcccgcgacggaaggggaggtgaagagggaggagaggggaagctgaatgcccagggagtggcggacgcgagccaccagccgggtggcggagagcgaatggccaccgaggtggaagaagctggcctcccgctcgatgcgctcgaggccgaggacctggcagaagagctgagcaagcagctcctcttggggcccgcgaggaggcccaccctcggagcgggaaggggcctcgtcgagaggaatcgcggcgagggccttgcggtcgagcttgccggtggaggtgagcggaagctgggcgcgaaggacccagcgagagggaagcatgaaggccgggaggagacgagcgagggcggcctggagggagtggacgtcggtgtcgggagaagcggggacgacccaggcggcgagccaggagtcggagggcccgcgtcgttggacggtgacggcggcggagcggacgccggggagcgaggcgagggcggcctcgacttcgcccaactcgatgcgcatgccgcgcaccttcacctggaagtcgacgcggcccaggaagcccagtgttccgtcggcattccagcggtcccgatctcccgtccggtagaggcgggcgcccggcatggtgctgaagggatgcgggatgaagcgctcggcggtgaggtccgcgcgtcccacgtagccgcgaccgacgcccgtaccgccgatgtagagctcacccgggacacccggaggcagcggctggagcgcgtcatccaggacgtacacctccaagttggccttgggcgtgccgatgggcgtgctggcgctcgcgggcggtgcgtgcatgcgccagagtgtggcggtgtccgcgcactcggcggggccgtaggcgttgaccagtggcaggccggggtggcgctcgaaccacgcacgacaggtcgaaggcggcagggcttcgccaatggtgagcatctggcgaagggcgggcagcggcgcttctccaggctcttcgagcagggcctggagcagcgagggcaccagctccacggtggtggcccccgcttgctgcaaggccgcgatgagccgggcgggctcacgcaccacgtcgtcatccacgacgtaggtcgtccctccggcggccagcgctcccagcatctgccagatggagatgtcaaaggagagcggcgccgtctgcgcgagcacgtcggacgcgccaagttgcagcgagtgctgcatgcccagcaggtggttgagcatgccgcggtggtccaccatgacgcccttgggcgtgccggtggagccggaggtgaagaggacgtaggccagcgagtccggcgtcgtgaagggaggcaacggcgcgtcagactcggcctccaggttctggagcgacagcacgcgcggccgatgctcgagcggaatctccgcgagcacctcggtgagcagcgcctcgatagggcccaggggaaggacgaagggcgcgcggctctccatcagcagccgtgcgaggcgcgccgcgggcagttgcgcgtccagcgggaggtaggcggcaccggccttgtgcagcgacagcagcgcgcgaacggtggcctcggagcggcggccgaggacggccaccacggactcgtgcccaacgccctgggcgcgcagcgtgcgcgcggcgcgaagactcagggcctccagttgcgcgtaggtccactgcgcgtcggcggaggcaagcgccagccgttcgggcgtgttgcgcgcatgggcgctgatgcgctcaggcaggcaggtgtccaggtcgaaagccagcggcgcgggacgggcgtggcgaagcaccagcgcctgctcgtcggacgacagcaaggatagccgcgacagcggcagatgcggttcggccagcgcctgggtgagcagacgctgatagtgctccatcatccgtcgagcggtctccggttcgaacagctcgccgctgtagcggaggaagagctcgaagctccctgcctgctcgatgacgctcaacgcgaggtcgaacgggctggcgcgaatgtcgacgggaaccgggcgcgcatccagccccgtgaatgcatccgcgagcgaaccctgcacccggtgcaggtcgaacatcacctggtacaggggcgcatgactgaggctgcgctccacgccgagcgcatggaccagttgctcgaagggcacgtcctgatgagagagcgcatccagcgtggtggcgcggacctgggcaaggagcgaagcgaaggaggtggacgcatccacctgcgtgcgcagaggcacggtgttggcgagcagtcccacgacaccttcgagtgaagggtgggtgcggccggagacgggcgtgccgacgcagaagtcgtcctgttgagagtagcggtacagcagcgcggcgaacgcggcgtacagcaccatgaacggcgtggcttcgtgttcacggcaagcgcgctgcacggtgtccgtcagcgcggcaggcagtgcctgggtccccgtggaggcgccctggtgcgtgaggacggcggggcgcggcttgtcggtgggaagctggagaagccccggcgtgccggagagccgctgcttccagtagtcgagctgggccgtgtcgcgcgcatggacaggctcggagcgctgccaactggccacgtccgcgtagtgcagcgccaccggggccagcgtgggcgcatgaccctgctggaaggcggcatacacttcacccagttcgcgcagcaggatgtccagcgagaggccgtccaccaccaggtgatggaacacggccagcagcacgtgccggtcctcccctacgtcgagcagcagaaagcggtacagcggtccttgctccagcgagaagggccgccacgactcctgctgaagccgaagctgcagtgcctcgggggccgcgcgcagcgcttccatttgaagcacacgcacgggaacggaggacacctcgacgcgcgcctgtccctgctgtgacaccacggtggtgcgaagcacgggatggcgttccagcagccaccgcaccgccgcatccagcgcgtcggcgctcaccgtgccgcgaagctcgacggcctgggggatgtggtaggcgcccgagcccggctggagctgatggatgaaccagaggcgctcctgagcctgggagagcgaaggcgccgagtcagaaggcgtcggaggaggaagcgaggaggcgtcgcgctgaagcgaagcgacttccaacgcgaggcccgcgacggaaggggaggtgaagagggaggagaggggaagctgaacacccagggcgtgacgggcgcgggccaccagccgggtggcggagagcgagtggccaccgaggtggaagaagctggcctcccgctcgatgcgctcgaggccgaggacctggcagaagagttgagcaagcagctcctccaggggcccgcgaggaggcccaccctcggagagggaaggggcttcgtcgagaggaatcgcggcgagggccttgcggtcgagcttgccggtggaggtgagaggaagctgggcccgaaggacccagcgagagggaagcatgaaggccgggaggagacgagcgagggcggcctggagggagtggacgtcggcgtcgggagaagcggggacgacccaggcggcgagccaggagtcagagggcccgcgtcgctgaacggtgacagcggcggagcggacgccggggagcgacgcgagggcggcttcgacctcgcccaactcgatgcgcatgccgcgcaccttcacctggaggtcggcgcgagagacgaactggagcacgccgtccggcaaccagcgccccaggtctcccgagcggtagaggcgcgcgcccggcgtggcgctgaaagggtgcggaacgaagcgctcggcggtgaggtccgcgcgtcccacgtacccacgggccacgcccaggccgcccaggtacaactcgcccacgatgccgaccggaacgggctggagggcgtcgtccagcacgtacacctccatgttggccttgggcgtgccaatgggggtgaagctgccttcggggggctcgttgatgaagtggaggctggcgacgtccgagctctccgtcgggccgtaggcgtccgccatccggcagcctgggcagcgctccagccaggtccggcacagcgcgggcgggacgggctcgccgccgagcaccacccagcgcatgtccgggaagtcctgctctgggcgagcgccctccaggatggcctggaggacggagggcaccatctccatgacggtggcgcggccctgctccagcgcgtcggcgagccggggcggatccctcatcacgtcgtcttcgatgaggtacgtggtgccgccaccgggcagcgcgcccaacatctgccagatggagatgtcgaagctgagcgcggcaatctgggccacgacgtcatacccgtccaggcccagcgcctcgcgcatgcccagcaggtggttgagcatgccgcggtggtccaccatgacgcccttgggtgtgccggtggagccggaggtgaagaggacgtaggccagcgagtccggcgtggcacgcggcggcagccgctccgcgctctgtgactcgagtccctccagcgacagcacccgaggccgccgggcttcgggaacgcccgcgagcacctctgacagcaaggcctcgtccgtgtcgagcggaagcacgaacggcgcgcggctctcctccaggagtcgggccagccgagccgcggggagctgcgcgtccagcggaaggtatgcgccccccgccttgtgaatggacatcagcgcgcgcacggtggcttcgctgcggcgcccgagcacggccaccacggactccaggccgacaccctgggccaccaaccgtcgcgcggcgcggttggtgtgggcttccagctccgcataagtccaccgagcactggaggacgacagggccacctggtccggcgtgcgcgcggcctgggcggagaagtgctcggggaaggcggcttccagtgggaagggccggcgcggcgggttcgaatccgccagcacgcgggcgcgctccgcatcaggcagcagcgacagcgcatccacgcgcgtgtccggcgcgcgcagcgcatgcgtgaggagctggagatagtggcccagcatccgccgcaccgtggtggcctcgaagaggtcggtgctgtagcgggcgaacagctcgaagccggacgcgctctcgaagagcgtgacgtgcaggtcgaactcgcacgcgcccgtgtccatggggaggtcgcgggcctcggggaaggcgcccgccagggaatgctccacgcggtataggtcgaacatcacctggaacagcggggagtggctgaggctccgctccacgcccagggcctgcaccaaccgctcgaagggaagggcctggtggcccagcgcatccagcgtggtggcgcgaacctggtcgaggagcgcggtgaaggcatccgccgcggtgacgcgcgtgcgcagcaccaccgtgttgacgaacaggccgaccagcccctccatggacgggtgcgtgcgcccggagacgggcgtgccgactcagaagtcgtcctgccgcgagtaccggtacagcagcgccgcgaaggccgcgtacagcgtcatgaacggcgacacctgccgttcgcggctgaaggcgcgcagcgcgcccgtgagcgaggaggggagggcgatgggttccgtcagcgccccccggtccgaccgccgggcgggccgaggcttgtcgatgggcagctccagcccctgcacggcgccttcgagctgccgcttccagaaggccatcagctccggttcattcgcggcggcgtcgggcgtgtgctgccacgcggcggcatccgcgtactccagcgggagcgccgtcagcgcggggacttcaccgcgggcgtgcgcggcatgaagcacacccagttcgcgcatcaacacgttgatggacgcgccgtcggtgacgaggtggtggaacaccaggaccagcacctgccgctggctggagaggttcagcagccggaagcggtacagcggcccctgctccaggtcgaacggccgagaggcttcttcgcgcagcctgcgcgaaagccaggcctcgctcgcgcccgtcgcatcctccacgtcgaggacgcgctcgggcaggtccaggtagcgcacctggggacggccgccctcggcggggaagcgggctcgcagcaggggatggcgcgacagcagggctcgcagcgccgcgtcgagcgcgctcgcgtccacgggggactccagcatcgcggcccacggcaccacgtaggtcgcggtgtcggggcggagctggtgcaggaaccacatgcgctcctgcgcgggcgacagcacgtcggtcgtccccgccgggcggcgcgaggggcccaccacgttccgctgtggcgaggagggcgcggcgctccccgtgccggggttcttgcgctgctccagcaacttgcgcaattgctcgcgcttcgcggcggcgagggagtcggagtcggatcgcgaggtcatgaagtcggattccggaaggcccggtgggctagatgcgaacgtagaggctcacgcccgcgcggaagacgcccagccccgaaccggaaatggtggggtccgcggggaggctctcgaagcggaactcgctgccacgttcaccgtagggcacctcgacgaaggtctggacgaagatgtcccggatgtcgaagggcgatgagttgaaggccagccgtgacaggtacgacgcatcctgcacgttggcgatggtggtgaagatgagcgacagctgggacacgccgcgccggccgatattgacctgccccagtgcgtagtagcggccatggaagagcggccggaagtctccctgcgaactcagccagggcaggaaggcgcggtcgtcgtagcccagcgggttgtggaagccctccacccggatgacggcgcggtagagctcggcgaagttgaacgtggccgaaacgcccgcgctgaccagcagcttgcgtccctccagcgtgcgctccacgaagctgtcgccatcacgggcccagagccgcgtgttgccgtcgcccacccaggccacctcggcgttgaagtccagcaggcccagcgccatcgtcgcgtccaggccgtaccggggccggcgcgactggtcgaacaccgccgtcgcggcgatttcgcccgtgcccaccgccatctccgcgcgcacgccaccgccgtagcgcacccgccggaggtcctcgctgacgtcctccacgttggcggtacccaggagcgacaggttggcggccatggcctcccacggcaccgtgaggcggaccatgtcgacgcccgtgcgcaggtcgaagatgttgagcggatccgggttgggcgcctgcaggaagtcggtcgggttccagatttgcgagctgccccagcgaatctcctggcgcccggcggtgacgaacagccgttgggcgacgtcgaacttcagccacatctgccccagcacggcggcgggtccgttcgcctccgtggacagcgggtcatacgccagccggcccatcatgaagccgcgcacgtgcttcgacggcgtcgcgtccaggtagatgtccgcgagtgcgggcaggacgggctggtacgacgtcttcccctgggagcgcagccccgtcagctccgcgcgctggaagtagatgccgcccaccgcgagcacgtcctgctgacgctcctgcgccgtctcatgccaggggtccgcggcctcgccttccgggccctgccagccctccacgatggcgcccgatggaccggccggccgaggcgcgggagcgggagcgggagcgtccagcaggtcctcgaaaccgtcgggcgcaccggccccgctcgggtccacggcggcggtggcgagcccggaggcggagtccgtgtcgggcggcagcgtccccgtggcgggcgtcgccctcgggacgtcgaacgccgccgcggccggcacggtggcgccttcactcccggccgaagccatggatcctcgtgccggggccgggctcgcggaggccaggggctcgctgtagcgcatcgacttcacgcgccgctgcttgtcgaggagcacgctcagcccgcgcgcgcggtagtgccaccagcgctggcgcgcgggcgcggcttcctcctcgtgacagtccgggcctccctccgaggccttcgccgcgccacacgcggggccgtacagcgcgacgagccccgcctgcgtcggcggcttcgtgggcaccacctcgacgcggcgcagcacgccctgccgggcgtcgaagtggaagcgcgtgctccgggtgcctcccggcgcggccttgcgctggtacgtcagcaccaccgcgccgtcctcgtggacctgccgggtgggcgggccaaaggagagcaggacctgctggagcgtcgtcgtgcccggctccgtgccgttccagggctcggcggacacggtaagactccagagcaggatggccgcggccagggctcgaacgggcaaggggggcatcatcacaggggccccctgagcgtatacgagtctcaatcagcgatacatgtgtcgaaaaattcttaagaaaggggactccggattgacaggccccccagacagccggacacaatcgcgcccccacccccgactcaggaggcctcatggctccggaagagaccctgtccgcagcgcccgcccactccgagcccgccacttccgaggcggcgcacagcgaggtctccgccgcgcccgagaagctggatgagatcgaggagatcgacttcctgctcgaggagatcgagagcaagattgctccgctcgcgctggcttgagggtcgtgcgttcctacgttgacgccttctctccgtactggcacccggtcgccttctccagcgagctgacggccgttccactccccgtgcatttgctggggacggagctggtgctgtggcggacgggctcgggcgtggccgtgacgcaccggcgatgtgcacaccggggcgccgacctcagcgtgggcgtcgtcaccccggaagggctgcgctgcggcttccatggctggacctacggctcggacggacgctgtgtgcgggtgccgtcacagcccgccgcgcccattcccgcccgggcacgcgtctccgccttccaggccacggagcggtacggcctcgtctgggtctgcctgtccccggagcccgccgcgccgctgccggagtggccggagctggaggacggcgccctggccaccgtgccactgccggtgctggagtgggacgtcgccgcgggccggatgattgaggtcgtcctggacgtggcgcacctgtccttcgtgcacgaaggcaccttcggcaacccggagcagccggaagtgcttccctatgaagtggagcggcgcgccaccggcgtcggcgcgcgcatcgtctatccagcgctggctccggcgacggatggcatgccgccccgggtggatcgcaccacgctcacctacgacgtgacgctgcccttcgccgcgaagctggccttcaagcccacgctcttctacgtccacaccgtctacgccatcgcctctccgctctccgaggagaagatgcggtgcttctacttcgcctcgtaccacccccggctgcgcaaccacttcccggacatgttcgtgaagagtgagctggccatcctggagcaggaccggcgcacgctggagggcgtgcgtccccgggcccagcccctggacttcgccagcgaggtccacacacccgcggaccgcctgcccatcgaataccgccggggtgtcatcgccctgcggctgggcaagcccgtggacggacccgccccggaatgaggacccacacccccatgcgctcccatctcctgttcctgctgctggcgctgagcgcctgtcagcgcaacgaatcgccgccgccacccgcgaaggctccggccgcatccgcgccgtcgcctcgtgctcccgccgtcccggccgtcaccgcgtccgcggacgcggcgaagctggagcggggccggtacctcgtggagaacgtgctcgcctgtggctcctgccacacgccgcgcgactgggctcggtatggaggccccgcctccgggcccgcgctctccggcgcctgctgggatgacgcggcctgggagctgcccggtcgcgtctgcgcgcccaacatcacctccgatcccgagcacggcatcggccgctggacggatgaggagctgatgcgcgcgctgcgcgacggcaccgggcgcgatgggaagacgctcttcccactcatgccgttcctcctctaccgcgagctgtcggacgcggacgcccatgccgtgattgcctggctgcgtcaggccccggccaccccgcgcgcttcggcccgctcggtcatcccggacgaggtgtacgcgcagtacaaggacatggccgcgcccatgaagacggccgtgccggagcccgccgcagatgacgtctctcgcggtcgctacctggccaccatggcgcagtgcgccgcgtgtcacgcgggcatggacgaggcgggcacgcccttcgtgggaggacgtccgctgcccacgccgcacggcccggaagtcgtatccaatctcacgccgcatgcacacggactgggcgccgtggacgaagcagccttcgtcgcccgcttcaccgccttcaaggacctggcacccgcgcccgcgcgggcgggccaggtgaacaagctcaccatgccctggggtttcttcgccggactggcggaggcggacctcaaggccctctaccgttacctgcgcacggtgcccgccgtggcccccgccgcgccgtccgcgtctggcaaatgacccattctggcgccacctgggagcgtccggtagactcccagcgcgtcccctgaaagcccatcgttgcgcgcccttcccccaggggcgcgcgtgacgcgtgcccccatgaaatctcttttcaagcgactgctcctgtccgtgctggtgtgctccgccggctgcgacgtcttcaacatcggcgacgccgaagggacccgtggccgcggcgcgagggcgttcgacccgtattcgagctcggcctccggcgccatctccctgtccctgctgtacttcaatggctgcgccatcctgcccaccggtgagccggtgtcggccggctcgctggacctgccggactatccggccacctgcgaggccatgaacaggatgggccagcaggtgccgccctcggcgcggttcgaggtgacgccgggcgtcagctacttcatccgcgagttcaccgcggtggacgccgtctccgacgtccacaccgacttcaagaaccagcacgccccgtccttctggatgcgcaaggagtcgcgcttcaaggacctggactggtcgggcgtgacggtgggccgggacgagtggacgaacgacttcgactccacctttcagcgcgagacgtactacgagaacgccgcgtggatgcgctcgctggacgacaccttcctcatcgaggtgctcgacgcggacggcgccgtgcgcacctccatcacctacagccgccgtgacttcatgggtgagggcgccaccacgggccgcacgcgcgccagctggctggtggcggacctggcgcggcctcgcttcccgggagacccggaggtgagcctgctgccggacggcaccgagcccacctacaagacgatggtgaaggcgtccttctccggcgccaccaacccgttcaagacgctgaccatgccgcagctctccggcgagggactcatccgcgtcacttggagccagctgcccctcaagcccttcctcttccccatcgtcttcgcgcccgaggcggagcgcccggccacctgctaccggctggatgaaagcgggctggccaccgatgaacaggtgccttgtggcttcggcctgacgcaggcggtgcgcgtcaaccgcccgaccaacggcagctacttcatgcccggtgactcggtggacttcatggtgtcgctgcgcgacggggacggcaacggcctgcatccgcgcaaccggatgcccagctacaacgagtacatgggcgagtcctccaacggcctcgcgtacttcaacgaggagatgctgctgacctaccgcgaggccagctcctcggagtccggcttcaaggtggtgggcccgctgcaggacctgcaggtgtcgcgcggttcctacacgctgccgtacttctccttcccgctgttcagcgagccgcacttctacctgccgcccggctccaaccagctcgcgggcggcggtgatgcccagccgcccacgcactactcggtgacgctgccgccgaacgcgaaggcgggcacctacgccatcatcctcaaggggcaccgcaccttcatgggcgagcgcctcaaccggctggaccccttcttcttccaggtgggccaggcccagcccaccacctacccgggccgcgtgggcaactgccaggtgtgccacaacggggtgaactcgctctccaacgtgcaccacggcatgtccgtggaccacgtggaggcgtgcaagacgtgccacatcgaggagggctacgggtacctgccggacatcatccaccgcatccacaacagctcgcgcaagtacaaccagaacaagggtgactgcaccatgtgtcacctgacgcgggagagcacgctgtggcccagcctgatgagctgcaatggctgccacgtggcatcgcacggcacggagtacttcgaccttcgcttcgagcccatgcagaacacgcccaacggctacggcaactgcgccgaatcgtgccacgtcaccacgccggcgggcgagcacatcctcccgccccgctgagccctcagaggaacgccatgaaggttcgctctctcattgcctcgaccctgtccgccgccgtgctgagcgcgtgcgctgatagcagtgcaccgcctccacccaagctggacgccgaggcgccctacaccgacctgcccgaccggcgggtgcccgtctccggcgtcatcttcgatccggaggcgatgttctataccttcgtcatgtggccgcccgacccggaggacccggaggccgggccgccgctgccggcgctgctgtatggcatgcccacggtgatgcgcgcgtccgtgtggggcgcgcaggtcagcatggtggggcccaccggcgaggtggtcgacaccagcggccccgcgatgccgccctggggcaacttccagacggaaggcattccctccgacccgacggtgccgtacctcatgcgcgccgagcccgcgcccgggctctccgtgggggccgccgacatgttcccggaggaggagggccacgcgcccatccccgcggtgccgtactacgccaccaccagcctgcggcccatcgcggccaccgggacgcagtgcctcatccagtcgccggccatcgtgggcgaggcgggcgcgctcggcgcgctggcgcaggtgatttccgaggagacggggacgtccgtctccccggccagcctggcggatgcctcgtcgggccgctcggtggcgctgctgtgggtctactcgcccagcccggtgctggacgcgttcctgttccccagcggtgacatcgcggcggagacgacggcgggcacgctgtacgccatcgactgggcgccgccgggctcgttcccgggccagacggagatgggctacttcgccatccccggcggcatgagcagcctgggctactacgccctggtggtgcagccgggcgccccgagcgcgctgacggtgagcttcgtggacaccctggaggacgaggaggagggccggccctgggaggtgcctcccttcttcgtcgagggcctgccgccgggagtgtccttcacgcgcctgttcgccatggaggcctcgccgcccgtggaggagaacccctacgaggagcccgcgccgccgccggacttcggctttctctgctacccggaggggtgacgcacccaggcgcccacggcgctcaccgcgagggctccaccgtgagcccgcggaagcgcaccgtgggctgcccgaaggacaccggaagcgggccatggtccagcttccggcagccgcgcgtggcgaagaggttcttcgtgtccgcgcccaccgcgtcgatggcggccagcgcctccagcccgttgccccggaggatgccggggcccacgcggcgcccaggccggccgtttcgaatttcccgcgcctccacgatgtagaagctgaagtcgcctgacagcaggtccatctgccggggcgtgaggtgctgcaccagcagcccgtgcggaatgtccgccatcagcgcctccaggtgtccctggtgcgcgtccacgcgcgtgtgggccatgcgaggcaggggcgggtgccggtagctgacgcgccgcccgtgtccgttgggcgcgcggcccagcgcggcggcgctgcgagcatccagcaggggcgcgtccacccggccctcgcggatgagtgtcaccgggagcgcggcgtggccttcatcgtcccaggcgaagccgagcgcgccgtggccgtccgtcgggtcgtccgagacgctgaggtgcgcaccagccacctgctgccccagccgccgcgccaggtatgagccgccgcgcgcgacgacgtctccctccaggggatgtccgcacacctcgtggaagaagcagccggaggcggcgcctggtggaaagacgatgggcagcacgtcgcgggggcagggcaccatgggtgttgtgtcccgcagctcccgcgccatgctctccacgagcgcttccaacgagggcagcgcggtgcgtgccccggtgacgtccggccaggcggcgcagcgccacagttctgccatgcccgcgccggtgtcgtggaaggccttcacttcgagcagggcatggcgctggtggtcttctctctggtgcgcgtcgctggcggacagcgtgcgccgctccacttcgcgcagcagcacgtccaggtgctgggcgcccgcggcccgcgctgtcgcctccagttggcggacgagcgacaccatggcctccgtgtcgctcgcgagccggggctcggcgtcgagcaggggacgggcctggtatgccagcgcctccggcatgaggccgtgcttccatcgggcgccagccacctgggcccattgccaggccatactgtccggggtggtctgccccatggaccagccctggtcgagcacgggggggatgacgcggagcccggaacgctggtggaggacctcggtgacttcgcgccgctccacgaaccaatccaagcgagtgtcctccggccgggcaccacgcgggctggccgtggcgtcggtgacgcccaccgtgaaacggcgggcacaggttcaggagcatacgccagacggcgaggcggacccatgcacgcgcctggattgcgtgcacgcacggacggacggttgaaccaccgatacggaatccgcgcgacaacgcggagcgtccccacgcgaggacggagaccggtatcctcacgagcagtcccagcgtgtgtcggcggaggcagtggatgcggggcggttccggttccgaggaggacagcggggtggcggcatacgcgggccttcagcctcgcgaatggctgacgtccgctggcgaagcgctggagggcttcacgcggcaccacgcaccctcgcaggccgagctgttcctcgccgcggagcgcaggctgtcgttcgaatacgacgccgggacggggcgctccatcgtcaaccagggggagaccatggatgccatggcgcgcgtgagctgggacgcgcggcagggcatgttgaccgcgccggtgggtgagacaggcgcgctgccgctgctcctggagcgcaccgcgcgacaggccacttcaggacgtgcgagtccgctgccagagcttccagctcagagcgattccccgagtgtctcgagtcctcctccgctccagccggagcgcgcggcgcgccggatgaaacacttcatcgagaccgccgtgccccctggcagcgtcgtgcaggccgcgctgctcacccaggtgtccacgtggcgcgccctggtgcgcgcaagtggcgcgcgccgtgctcgcacggaatggcgcgaggaactgttcgtgcgctgtgagacgccgcgaggcgccgtggtggatgcggtggcgtttcccgaaacagcggcggacgacacggtcatcattccgctgcgccatcgactcgcggaggctgtagctgccctcacgggccccgcggagtcgctggaccgcgacctccccctggtgctgcggccggcggtggccgcgcctctcgcggcggggctcatctggttgctacggggcgacgtggccgcggccacacccgccctggcccgggccgtggggcgcaagttgttcccctcggtcctgagcgtggtggacgacccgaaccaccccacgggcacgcggcgcgtatccatggatgatgaaggactctccacagacacgctgtcgctggtcgacgcgggcgtgctgcgaggcttccttcacgcctccgacaccgcatcgcggctcggcgcgccgctcaacgggcgtggcttccgcaccagcatgtcaccacccacgcccgaagccgtgaatcccttcctcgtgcccggtgagaccgccgtgctccccgcgcactacacggaactcgtcgcgcgcgtggagaccttcaccaccatgccgcgtcccggcaccgtcacgttggtggcgggcggctgggaggtacgcgacggccgtcgtgtgcgccgcatcgctccggtggaactggagctccccgtgctggagaccttccgcgcgctgcgcggcgtggggacggacctgacctttttccccaccgccgagggctgtggcacgccgacgctcgtcttcccgcccctgctgtcgggtgcccagggagggcaggcggccaggtgaagtccacgtcccttggggcggcgcggggccagccaggcgacgcgggcccgcctgccctgcgagcaggacgcgcgctgtcttcgaatccggtgcatgctgcgcgcacgacgctgggccgccggtacgaggcccccgggcccagggaggcggcgtcacgggaggacacggatgtcgggtcagtcgctggcggcgaagatgctggaaggggcgcgggagtgggcgaagcgattgccgaatgcgctctccaacgacatggcggtggacgtgagccgcaggcgggtgcgcctgtcgcatgcacgcgtggagaccgtggtgagccagcttctggcccggctgaagaacttcgagctgcgcgagtggtcctcgcgggagaacgtctatgacatccgcttctccgtgcacggctggaagctgcgcgtggagacggcgctggagcgcgtggagctggcctccgggcgctaccggctgtggttgaagacgccgggcgtggtggcgctggaggagtcccgcacggcttcgtcgctgatgatgggcgtgcttcgcgccggggcgggccgggccgcgatgcgggtgttggcggagcggctgctgcctcccggcattcgttgggacggtcaggtgttacaagtggaagggccgttgcccgaagagggcgtgctgcctgcccggctgttcgattcggcctccctggccatgaccgccgagcatcagtccgagggcctgtggctggccgccgacgcctggcccgggctcatggacctgctccaggtggtgtttggcacggaacttccgcggacgccccccggcgcctagcgggcaggccaggaagccagcccctggctgctccttgttccgggagggcggggggcccagtggtgtccaggaatgtgccctccatggcgctccccaggggccgcgggcgcccccacattgaaggaacgtccgacggtgaaggggcgtcagacgattttcggggcgtggtgccaccagtcaaggggctggaattcttcggttctacgccacgtttccttcacgcagagaacagc

SEQ ID NO: 1142 - DNA, 15268 bp, Myxococcus xanthus
gctgtaaaggcggcggagatgatgctggccgcgctgcgtcccctgctccaggccatgcccgcgggcgcgccgctgcggcccgcgctgctgctgggcgtggccctgggcgccaacgtcggcggcatcgccacgcccgtgggcagcggtcccaatgcgctcgccgtatccgccgcgtccgagtatgcgcaagtcaccttcgcgaagtggatgtccttcgccctgccgctcacgatgctcctgctgctggccggcttcggactggtgctgctgcgcttccgcgtgggcggcaggctgacgctgccccccgaagcacccgtgtccctggcgcgctcgggacggcgcgtgctctgggtgagcgcggcgtgcgtggtggcctggctggcagagccgctccacggtgtgcccgcgcccgtggtggcgctggccgccaccgcgctgctcttcggcagcggcctgttgaagcgcgaggacctgggccggttggactgggccacgctgctgctcatcgccggcggcatcgccctgggccggctgctggagcactccgggctcatcgctcgcgcacttgccggcgcggaccttgcgggctggccggtgccggtgcagttgggggtattggtggccgtcgcggcggtgctgtccgcgctgatgagcaacacggggacggcggcgctcctcatccccctggccacacaactgcatcccgccgtttcgacgccggtcctcgtggccctggggtgctcgctgggcatgcccttcgtcatcagcaccccgcccaatgcgatgacggtgggcgaggggctggcctcctccgagctgatgaagttgggggttcccctgatgttgggcggatgtctgctggtgagcgtctcgggccctgccgtgctgcgcctctttgggttgccatgagtttctctcccagcttgctcggcaccacggtacgaacgcggcgtcccggaagaagcagtcgcgcggcatgcgcgttgaaggggcactgcctgctcaggcttcggcggaggtgagcccgtgacgaacgtgaccatcactgagtatgaaacgcgcctctactggcagggagagcgcggcgccgtgctgacgagcgaccgtgcgccgcccgtgcccattggccagccgctgaccgggcaggacaccgtggccgtgggcccctggtccccggaggccctgctcgtgggcgcggtggagggacgcaccctgctggcgttcctggagcaggcgcgggaagcggacgtgcgcgtgctcttctaccaaagctccgcggtggcccgcgtggtgtgtggcgcggaccagccgccgcatctcacggatctcatcgtgcgcccacacgtggccgtggccaccgaagccgacgcggaggccgtccgcctcatcttcaccgagctccccgcgcactgcttccccagctccgtcatcaacatcactccgcgcatcgaaccggtggtcgagacgtggcacgctcgtagcagtggtcgaagcgtacccgccgcgaccgcccccgcatcctgacctgacagcaaaggctccacctcccccatgtccccacagcgaatcctggtcgtcgacgatgaggacaatgcccgccgggcgattgccaccatcctgaatgaggaaggctacgaagtggccgaggccgccaatggcgccgaggccctggctcgcatcggcgagttctcccccgcggtggtgctcaccgacgtgcgcatgccgcagatggacggcctcacgctgctgaagacggcccgcgagcagggcagcgacgccaccttcgtgatgatgacggcgttcgccagcgtggagacggccgtggaggccatgaagtccggcgcggacaacttcctgctcaagccgttggacgcggaccaggtgctcgtcaccctgggcaaggtgctggagaagcgcagcctgcgccaggaggccgaggcgctgcgggaccaggtgcgctcgcgcgtccgccgcttccacgacatcatcggcgaatcgccccagctccaaggcatctacgacgtcatccggagggcggcgggcacgcgtgccacggtgctcatcctgggcgaatcgggcacgggcaaggagttgattgcccaggccctgcaccaggagtcgccacgcaaggacaagcccttcatccgtgtgcactgcgcggccctgtccgagaacctgctggagagcgagctgttcggccacgagaagggctcattcacgggagcgctggcccggaaggaaggccgcttcgagctggcggacggtggcacgctgttcctggacgagattggagaaatctctcccgccgtgcaggtgaagctgctgcgcgtcctccagcagcgtgagttcgagcgcgtgggtggcacccagacgctgaaggtggacgtgcgcatcgtcgcggccacgcaccgggacctggtggccgaggtgaaggcggggcggttccgcgaggacctctactaccggctcaacgtggtgagcgtgacgctgccgccgctgagggaccgcaagagcgacgtccccgcgctggtgaaccacttcctggagaagtacagcgattcatacggcaagcaggtgcgaggcctggcacccgggacgctccaggcgctgctgtcccatgactggccgggcaacatccgcgagttggagaacgccatcgagcgcgcggtggtgctggcgcaggggcaggagctgtccacggatgacctgccgcccgtgctgcgtgggccccggccgcacgggacgtccacgggcgcgctcatcccgggcgccacgctggcggcgattgaacgcgaggccatcctgcgcacgctggagatggtgcagggctccacatcccgggccgccgaggtgctgggcatcagcgtgcggaagattcagtaccggctcaaggaatacagcacgccggatggcgcgccgctcaaggtcgtggccgatgaggcggaggacctggccgcggagtcgtagcggtttgatgggtgggctggggcactgctaccgtgccctggatgggatggcattcgaggcgagcctcggttcaccggggcaacgtgctgctgagggtcctgggatggggtgtgagcggaatcctgctgctcgccgtgttggccctcgcggccttccacgtctggtctcagcgccaatatggccccgccatcgggcagttccgggccgacgtcacggcgcaggtggacttcttctgcgaacaacaggcgctggtgggcgcggagccgtggtttcacgaaccgcggggctcgggcgatgcaggcccgctgctcaacgaatggctccgcgtggcttccggcccgcccggtctggaagagtcaccccttcggctcccggcacaccttctgttgctccagaaagccgagagcatggaggactggataacgtcggacctggacctctccagcctggacttcggctggatgcgccagatgcatgcgttcgaccactggaatgccattccccgtgcgtccatcgcaccgggcaagcctttcgacctgatgtccgcgtcctttccggagttctcgctcctggtgctctggtcgaagttgcggctccggcatgcgattgaacaggggacgccgctggaagccgtgcgcgacgtgaggcagctcgcgtggctggcctaccgcacggacacgctgttgggcggcatggtcgccctctcattgctcaccgtcgaacacaggatccacgccaccttggagaatcccccgcctgactggcggcccatgagccttgaacaacagaggcgcttcaaggccgtgctgtggtccgcctctgccttttcgagcatcgcttctcccgtggaggtcagcgagaaggcacgcacgtgtgagccggcgattggccgctgtattggcctggtggaagccgcccttcgcggccgttacctggaaccctatgcgaaaggcacgcaccagcaggcgtacctggaactcaagacagccagcgcggcgggccactgccccacgcaactgctggcgtccatctgggagcaagggctcacggtgacggatgacgatacagggccgggtgcaggggacgagcgtcccctggcggcgcggctgattcccacgagcgccctcaggggccccttcgcactccaaatcctggcatcctcgctgaccaccctcgacccgctccgcgagctcaaagccctggcccccgccccttagcaagggcaatgcctccaggaacggccatctacgacgggcgtcgttgactcttacgacggccgtcgtaatactccgcgagatgaccacccacgccctcccgcagccgacgcgggccgagctggccatcctccgtgtactctggaagcagggccccagcaccgtccgacaggtgcatgagctgatgcggggcacccaggacaaggacaccggctacaccacggtcctcaagctcctgcagaacatgacggagaagggcatcgtccagcgtgacgagagcgagcggacccatgtctatgaagccgccatcagcgagacgcgcacccagcgcgacctcctgcgcgacttgatggaccgggccttcggggggtccgccacgtcggtcgtggcccaggcgttgtctatgaagcgcgcgtccgccgaggagctggcggagattcgcaggctgctcgacgcacacgaaaagcgggggaagtgatggacgcgcgttatctccacgccctggagcaggcgctgctcggcttcctgtggcagggcgcggtagtagccctggcggtcgcgggtatcctgtccctgacgtcgcagcgcgccgcgcggacgcgttacgccaccgcatgcctggggatggtggccatggccgtgctgcccgtggtgacgttcctgaccgcgctggcggaggcctcgcacgccgtgacgttcggcgccttcgggtccctgacccagtccagcatgctgaccgtggccacgacggagaccgcgtccctggcggctcctcactggacggaggtgctccgcccctggcttctgccggcgtggtgctgcggcgtgctcctcctgtcggcccggaccgtgggcgcatggatcatcacccaccggatggcccgacaggagacggaggccccctcggcccactggcgtgaggcactgactcgtgcgttgcaccacgtccgcctgtcccggcccgtgcgcctgctggcctccacccgcgtcgacgtgcccatggtcattggcctgtggcgccccctcatcctggtgccggcgggtgccatcaccgggctgtccgccgcgcagttggaagccatcctcgcgcacgaactgggccacatccggcgccacgactacgtggtcaacctcctccagtccttcgtggagaccctcctgttctaccacccggccgtctggtggctgtcccactgcatccgcgaggagcgtgagcactgcgcggatgacctggccgtccagtgctgcggggatgcgctgctctacgcccgcgccctggcccacatcgaggagctgcgcctggcgccatcaccccaccccgccctgggcgtcagcgatggctcgctgctgatgcgcgtgcgacggctgctgtccgcgtccgagggcatgacgccgcgcaggtcctggcggctcgccagcggactgggcagcgccgtgctcgccgtggccctggggtcgtcgcaactgccggagacggcccacgccacggagccggtgagcacgccgcccctccacgcggaggcaacccccggcaccgtgcagcgactgtccagcgccacgcccatgcaccatctgctcgtggccccggcgaccttctccgcccagaccccgcaggcccccgcgcccatcgagcgcccgaaggcggcggcgaaggcggagcgagcacccgcggcgaagccccgtcccacgcggcccgcccccctcctcatcccagacatggggacgattgcccgcacggagctgtcgcgcgtgccctactcgctcgacggtgagcccgccgcgcccgtcctgctcgaggacacctccctggagtcgcccgacgccaccctggccgaggccgcctccgcgcacgccgacgagcacgccgccgagctgccccgagtggtcgtctccgcgccggcaccctcgcgcgcttccgcgttcgacgccgtctacaaggccatgaaggcgccggctcccgtcaagacgctccggcccggaatcaccccgccccggttcctctcgggcgagcgcatccaccttcccagtatcgtctacgggattcagtcccacttcggaggcttccccaagggcgcggtggtggcccgctgcatcatcaccacgcagggctccgtcaccgactgccagcccatccagggcctgcggggcctggaggaaggcgtcatccgcacgctctccacctggcgctacgagcccgccacgctcaacgggaagcccgtggccgtgcgctacgtattcgacgtctggttcacgaaggagccgggcggcggaacgcacgaatcccggcacttcgcgggcctcgacctctccgatgtggtgggcgccgcggccccagggacgtgcgacgactgcgacaccttcgagttccacagcccgacggcgcgccggtagcgcatcctacattccgctgacgggccctaccccgccagcggcatccggaggatgaaacgagcgcccccaccgggcgcggtgtccacctccagcgaaccaccatgctgcgtgacgatggcatggacgatggacagccccagccccgagccctgagccttcgtggtgaagaagggctcgaagatgcggtcccgggcctcctggggaacacccgggccgctgtcgtccacggtgagccacacgcgcccgccctcgtgccccgcagacagcgtcacggtgcctcccgctggcgtggcctccagcgcgttgaggcacaggttgatgagcacctgacgcagccgctcctcctcgcccgccaccgacggcaccggcgcctcgcgtggcgtgacttccagcgacaccttgcgggacgcggcctgcccgctcagcagatccaccacccgccgcagcatctcgttcacgtccacggaggcgggacggaactcgcgtggcctcgcgaactggaggaagtcctccaggatgtgatccaggcggcgaatctcatcgcgcaccaacagcagcggctccagcaagggcgcctgctgtccatccggaagacgccgtagacgccgctcgaggacggagagctggagcgccgccgcgttcagtggattgcggatttcgtgggacaggcccgccgtcatcgtccccaccgccgccagcttctccgtcacctgggcgcgccgcgccagctcgcgcttctccgcgtgcaggcgcacctgccgcatcgcttgctccagcgtcagcagcagctcctgcggcgcgcaaggcttcatcaggtacgcacacgcgcccgcccgcaccgcggccaccgccgtctccaacgtggcgaagcccgtgagcagcaccacctccgagtccggcgacgcggccttcagctcggcggccagcgccgtcccgtctccgtctggcaggcgcagatccaccagcgccacgtcgaagccctcccggacccgctcgcgtgccgccttgcaactggacgcgccgcggaccgcgtagcccgcgtccccgagcaactcctccaagttgtccagaaaggccgcgttgtcatccaccaccaggacggacggacgggacggagaggtgggctcgctcataaggcgtgggtgggacgtgccgcgtgcgccgtttccagcacctccatcagcgcgcctgggttgaatggtttggagaagactcccgtggtaccgtcaagcggggccgcatctgtataggccgtcatgacgaacgtgggcaggtgaggatagcgcgcgcgcagccgtcgcagggcctcaccatccggcccaccgggaacgcgcaggtccaccagcgcggcgaagggctgcacgcagaggattcggtccgcgtccagcaccgaggccgccgtcacacaggagaagccgcgcccgcgcagcagctcggcgatgttgtcgctcagcgccgggtcgtcctccaccagcaccaccaacccatcccggcgagcaccggacagcagctccaccaacgtggggatgggcacgggcttgggcagcaccgcgagcagaccttcgcgccgggccgtctccaagtcatcctggcgtgggtgcgcggtgatgaccaccgcggccaggcccgggtccacgcggcggaggtggtgcacggcatccgcgccgctcatgccgggcatgcgcatgtcggtcagcaggacgtcgaagcgcgtggtgcgcgccaaccgcacggcctcgtcaccgctcgtgacgacagtggccgcgtccccgccgtcgcgcagaatctccgcgaggttctccgcgaacgccacgttgtcatccaacaggaggtactggcgcatgcgtctcctccgaagcgacgagggaaagccgaatcacgaagcgcgctcccgcgccgggacgggggacatacgcgatgctccccccatgccgctccacgatgcgcttgaccagcgcgagcccgagcccgatgccgcgcgccttcgtcgtcatcagcggctcgaagaggcggcggcggatgacgtcgctgacgcccggcccggaatcctccagcaccagctccaccatctccggctcgcgcgtggcagcggacagtgacaccgtcccgcccgtctcctccagggcctggacggcgttgtcgagcaggttcacgaacacctggcgcagctgccccgcgtctccttgaaccgcgggcaatgaggtcagtccctccgcgctcacgacgacagcgtcgggccgctgcacggccttgagcgcttcctgccagacctcgtccaaccagacctcctgccggtgcaggggccggtcccgaatcatgtccagcaggtcggagacgatgcggttggcgatgcccacctggtcgccaatgcggtccaggtgcttcgtcgtgcgctcgtccatggcccccgggcgcccccggaggatgtagagcgacgtctcgatgacgcccagcggattgcgcagctcgtggccgatggaacccaccagttggccaaaggtggacagccgctcactgcgcgcctgctgcgccagcagatcttcccggtacgtgtggagcatgatggccagctccaggtcgagaatcttccccaccgcggagcgggccgcgcggagcgccgcgggctcttccaggtaggtggcgtcgatgtggctgttgaactcctgccgcaggatgttcatcgcgccgaacatgtagtgctgcggcagggcgatgcgcacgtgcatgcggccaatgcggcagcgcagcgcgtagtagacctcgtcccaggggccgcggaggagctggtccatccacacctgcagggtgccgcgcaggtggcccacctggctctcgcccccttcaagcgcctgccgagccccttcgtgctccaggatgcggtcgtagaagacgcgagcgaagcgcgcgaagtggggcttcgcggtggcatgcaaggtcacgagagcctgctcgtccgccgagctgaaccccacgtaccgcttcaattcctcgaacaaggtttccgccatgagtcctggggtaagagcctatccgcgctgaacgcatgagcgcaggaacttcctcccccgcttcgcgatggctcggcacgccgcccaggggccacggcccgcgagtccaaggactccgccggggacgtgacatggaccgcctgtggcgcaccgcgaatggccatgaaggctcctggagccaggtcattccggcccggcgagggcgcttcagcaagccccaggccagtgcctgtgcacggagggcggcccaaggacgcgtgcaggaagtgcgcgcatcccgcatccggattcaacgggcgcaaggtttgcacgcgaacatgggggcacggcgaatccccacagccctcagactgcactctgttctggtatgcgcctgctcccccttgacacgggtgtgccgtcattcccctccaccgagcaggtactccagcaacgcacgaacaggagatgacaggccgtcccagtcctggaaacagacacagagccgacgctgggcccaggcctccgaaaggggcaccttccgataggtgccctcccgctgatgccgattggcgacgcgctccgggacgatgcccaggcccacgccgtgagacaccatctcgcacagcccccggaagcccttcatccggacgcggaaggacacgtcgaatcccgcgcgacgtgcgtgcccatcaatgtgctcctgcaaggcgctctcggccgcgaggccgacgaagggctcccgatacacatcgcggagcgcgaggctcttggatgcagccagcgggtgcccggcggggatgatgagcaccaggggggcgggctccaacgggcggacttgaagcgtgcccgtctccacggcgtccgaaatcagtccggcctccgccaggcctgcctcgaccgccttgacgatatccgcgctggttcgctctctcaggtcgatgttcagcctcgggtgcctggcaagccatggcgccagcttctcgggcaggtactcggtcagcgccgcggtgttggcatagaggcgaatggtgccgcgccggcctgaaacaaacgcattcaactcatccttcaacagctcctgttgatgcaggatcaaccgagcgtggtgcacgagtgcgtcaccggcctcggtcgtcaccacgccccgaggccgcctctcgagcagcttgacgcccaccgcatcctcgatgcttcgcaggcgctcgctcgcggatgccagcgtcaggttcgcgcgttgggcaccttgcgtgatgctccccgcatccacgatgcagaggaacaagcgaagatccgcgaggtcgagtcgcatcgcgccccctgcgcacgctgcctccggtgcgtccgaagggagtcacgagacgctccgcattgtgccagagcacgccggatggtccagtcagcgcacgtcgggcgcctgagcgcgcccactgaaatcgccatgcggccggacagttggaacgtggcagatgaaggcccgcagcggggcttcaggtgtcttggcccgctgaatggtcgccacgagccccggcagggaaacggagccccagcgaatcaggaagtgattgaagcgccggggccggcaccgcctagtgagtgagggggccccgggacgacatacgtcggggcgcgatctgctcgcgcgtcaccgtctcacggccggtggcccttccccgctccagcagcgacttgaagcgcagcaggtcgtcatccatctgcttcttcgggtccgcgcccagcagcttcgcgaaggcatggccaatggcccccgctggcgggttgtaggacagccggatgtccacccgagtgccgcctcgcggcgtggactcgaagtggatgacgcccaggttctccaccgccgtgccctccacgctcttccaggccagcaccttgttgggcacgaacttcgtgacgacggcctcccattcgaagtgcagccccgcgggcccgcgcaccttccagtgcgagcggccctcgacgcccggaatcacttcatccacgtgtgtcatgaaccgggggaagttctgcatctccctccagaaggcgaacacctcctccaccggcgcgttcacgttgatgtccttgtgaagggtgatggcccgccgtcccgcgcccatccccgtgagccgccgcagccccaggttcgtgaaggcccgcgtgcccagcatcacgccgcccacagccgccagggttcctgccactccgcggcgtcccagcccccaggccgtcagtgtcaggccgcccagcgccccgaagagccgttcggacggcgaccagtgctcctggaagaagggcctcgactcacccgagcgcatgctgcctccttgcagcgccggatgcgctgagccctccgcatacggaacaagctggttgtccagcccatgcaccccctgcaccttgccgatgcggggcagcacgcgccggagttcctcgcgaaggatggggccttccaaccgaaccacgccatcccgagccatcacgcgaatcgctccgggatgcgagcacacccggcccagagccgagcgcacccgctcctccaggacgaggtcctccaccggttcccggtgcagcttgcgcatcgattcgaaaaagacgccgcgcgagcgctgcgagaggtcccgagcgacgacgcccaccgcgcctcccgcctcatgcgccgcgtggacggccttcccctgcagatgggacatgcgccaacggccactgcgtgggtccgtccagtacatcagccccaggcccagccccgcgccaccgattccccatagggcagctttcatcgtccgcctccttctggctcgtgtccttcgctccacggaacgtgacggcggcgatggcgcggtgcagcagacgggaaggggctgcctcgctcgcgtccgcgggggatggctgatcaccaaccgggcggcccggggcccggaggtcctcgcgctgactgggcagccaggacggtgcccaatccgcctggacggtcggaattcatcgcgtgctcaacaccgggagcgcggcggacgagcacgccgcacccacgcggtgggagggcgggagcccaggcgagcaacgggtgccaacgcgaacgcccgccccgttccacgaggccaccggcgtggccagctttctcctgacgagcgcccgttccattccagggagcggcgaggagtggcggcatgcgagagcccgaattccaggaccgctatgagggaggccgcgtgctcgcggaccacctgcggcgccatgcgcggcaacccggcaccctggtactggcgctgccacgtggcggcgtgcccgtgggcgccgaagtcgcacggaagctcggagtgccgctcgatgtcttcctggtccgcaagctgggcacgcccggccacgaggagctggccatgggcgccatcgcctccgggggcgtgcgggtgctcaaccgcgaggtcgtgaacgagctgaacatcggccgcgaacagattgaagccgcggcccgccgcgaggccgtggagctccagcggcgtgaagagagctaccgggaaggccggccgccccccaacgtgcgtgggcgcaccgtcctcctggtggatgacgggctggccactggaacgacgatgcgggcggccgtggcggcgctgcggctcctggagcccgcggccatcatcgtggccgtgcccgtggccgcggccgagtcctgcgaaagcctggcccaggtggcggacgaggtcatctgcgtccgcatgcccgagcccttctattccgtgggcctgtggtaccgcgatttcgcgcagacggaggacgacgaggtgcgcgccctgctcgccgaggcaacccgggaaggggctgccagcgaagcacagccctccgcctgagcccggcgcctcgtgccgcacggagaactccgcgccgctgcgcgcccggccctcgaaccggatgtggacatccatgggcccgttccctcgtccgcggcgccaccacggcggcacgccaatgcccggcgagccaccgtccgaccggggattgcggttaagctcccacgctcgccgcccaccgcatgcacgagtttccttcccgtcgacagttgatgctggccgtcctggtggccacgactctctccgcggctgtcgagggagtctggagctactccggggcggtgagcccccctgctcgcgtcctcctcaccgccgcggtggggctgctcatcagcggcaccctggcgctgttgctcctgcgaacccgggagcgcgctcaccgggcacgggacgccgccctgcgcagcgcggatgacgccagcgcgcttcgcgcagccgtcatggacgtgacgcccgtgggcttcgccttcttcgaccgcgagctgcgctacgttcacatcaacacggccctggcggcgatgcatggcctgcccacggagcggcacctgggccggcacgtcaccgaggtgatgcccgacctgggcaagctcatcgctccgcgcctccaactggcgctcagcacgggggcctccatccaggacaccctgctccaggtggagacgcccgccgcgccgggcgaaagccgcttctggttcggcagctatctgcgcgtgtgcggcgcgaacggcgaggtgctgggcgtcatcgccgcgatgtccgagctcaccgagcgcatgcgcgcggaggagagcctccaggagcacgagggccggctggacgtgctgacgcgctcgctgccggactacctgtggggcggcaagctgcgcggcgggaggctgcgcgatttctactgcacgcccgtcatcgagcgcaccaccggctatgccgcctccgcgttcgtccagcccgcaccggatggcggaccgccgccgctgtgggcggagatgatccaccccgaggaccgcgcccgctaccgggccagcatcgagggcctggcccccggcgccgaggcggagctggagcaccggctcatctgcgccgacggccgcgtgcgttgggtgcgcagccgcgccgccgcttccgcgttggatgcgcaggcggagctgcatgtcggctgtgtcgtcaccgacatcaccgaccggcggctcgcggatgacctgcgccagcgcctgcatgacagcttccgccgctccgcccaggaatggcgccgcaccttcgacgcggtggcctcgccgctgatggtgttgggggcggatggcaccgtccagcgtctcaacgccgccgccatcgcgctcttcggaggcatggacccgtccggccagccgctgttcaccgcggccagtgccccaccctggtcgcacgcactgccgttggtggaggaactgcgccgcacccgcgccagcgccacccgcgagctgggcgacccggtgtcgcgccgcacgtgggaggtgtccgccacctgggtggaggaagccggcggcgaggactcgcgcatcatcctggtggccacggaggtgacacgtctcctggagctccaggccagcctgcggcgcagtgagacgatggccgccatgggcgccatcgtcgcgggcgtggcccacgaggtccgcaaccccctcttctccatctccgcggtggtcgacgcggtggaggccaccttcggcgcgcgcgcggagctcaagccctacgtcgacgtgctgcgcggcgaggtgaagcgcctcaaccacctcacgcaggagctcttagagtactggcgccccacccgcggagaatgggtggaaggtcccgtgctcccggtgatgatggatgcactctccgcatgtgc

SEQ ID NO: 1143 - DNA, 19598 bp, Myxococcus xanthus
  unsure (1)..(19598): unsure at all n locations
gggcagggccgacaggtccttcagtgcgaagaactccaggaactcgcgcgacgtcccatagaggatgggccgccctacttcttcacgcttgcccaggatcttcaccagcttgcggtccatcaacgccttgatgaccgcgccgcagtccacgccggggatgtcctcgatttctggccgggtcaccggctgccggtacgcgatgatggccagcgtctccaccgccgcccgggtcagccgctgtggcttcacccgcaggtaacgccggacatattcacccgaatgcgggtccgtccggaactgccacccgcccgccacctcatacagcacgatgccgctgatgccgtcgcggtgaatgccggagagttggttgagggcctcggcgatgagctcccgctcgatgccggtggccatgtacagctcgtccaccgacagcggccgctccgccacgaagagcacgctctcgatgacggtgcggatgcggtccgtggacagcttgcggctcttggagaggagcttctcgaacgacgtctccagatccggaggcgcctcgtccgagtcctcctcgatggaggccgcttccaactcgtccagctcatccgccgggccggggcccgtgacagcagcgatttcctcttcggagaacgggccggggccaccgggcgtgcccggttcgggagtctcgtcctgcggtccgttgctaccggtagtcactgtcgtcgacctccgtgggagccagcttctccagcgcgtccccgttgggcagcagcaagatgggccccagcggctcgtcctgcaccacccggatgagccgccgcttcaccatctccaggatggccaggaaggtgatgaccacctcctgtcgcgacggggtttcctcttccgtgaacaagctctcgaacagaacctgtccatgcgggcgcaggcgctctactacgcggaggatggcctcggacagcgtcacgcgctcccggaccacctcgtgctgcagtttgggctgcaaccgctccagcacccggtcgagcgcctccaccagcttgaggacgctgaactcctggaggcccacctcctcctcggggatgggcaccgcctccaccgggacgttgcgggcgaagacgtcgcggccgagcaggtcctgcgtggcgagctgttcagcggcgtccttgtacttctggtactccagcaggcgccgcaccagttccgcgcgtgggtcctcggtctcctcggcgaccgcgagcacctccgccccctcctgcgccgaggcgacgtcctgccggggcagcagcatgcggctcttgaggtgcgccagggtggaggccatcaccaggaactccccggcgatgtcgaggttgatctcccgcatccgctccaggtgctcgaggtacttctccgtaatcagcgccagcggaatgtcgaagatgtcgacccgatgctccttgatgagatggagcagcaggtccagcggaccttcgaaattgggcaacgcgatgcggaagttgtcgccaggactccgcggcaactccccttcccgaggggcctcatcggtcggcgagcgacggtcctcactcaccggatgtcctggatggcgtcaacggtgtgggtgggggcgcgtcatcgcgtaagggcccgactttcttaggcagcgggcacgagcctggaggacacacacccataccagtgccccccaggagggtcaaacaatcggcagtgaaagcccgttcaggcacacggactcatgggactcccacggccttgcggacccggtccatgaggcggctcgcctcggccctggcccggctggcgccgtcctggaggatgcgctccacctcgcccgggtcggccgccagttcggcgtaccgctgacgggccgggccaaaggccgcatggtaggcctccaggagcttcttcttgtagtcgccgtagcccttcccgcccgccctccaggtggcgtccacctcggcgaactcggactcgggaagcatcagcttcagcaagtcgtagagcggcgcatcgctgacgagcccgggcggcggcgactgcgtgggcagcggcttgggcgcgtccaccggcgtcgagtccgtcttgatggacatgatccgcttcttgatttccttctcgtccccgaagagctcgatggtgttcccgtaggacttggacatcttctgtccgtcgacgccgggcaccgtctgggtggtctcctggatgcgcgccgcgggcagcttgaggatgccgggcgcatggccccgctccttgccttccggatcggccgggtcgtagccgggcacgtactgggtgttgaacttcaccgcccagtcgcgcgcgaactcgatgtgctgaatctggtccttgcccaccgggacgaagtccgcgctgtagagcaggatgtcggcggccatcagtaccgggtaggcgaagaggccgaagtccgggctgatgcccttggccaccttgtccttgtagctgtgggcccgctccaggtgcgcgtgcggcgtcacggtgcccagaatccagtacagctccagcacctcacgcacgtcgctctgccggaagagcacggccttcttcggatccaaccccagcgacaggtaggccatggcggcctcgcgcgtcagcgccagcgcggccttgggatccctcacggtggtgagcgcgtgcaggttggcgatgaagtagtacccctcgccttcatcctggagctgcacgaactggcggagcgcgccgtagtagttgccgatgtgcagcctgccggacgactgcactcctgaaagaattcgcatggactcgctctgattcggttgggcggaatcgggaatcggacggggctcgttcgcacacccgacgcggccctgcaaccgtccgttgcccgtgtcctgcgcccgttcagtatccgaagtcaagacggactctccctggaactttgcgccccatcaggaaatcccgagcaaattcaagtacttgcaattgaatcacagtggggtgcgccggtaccctgggggttcctcacgcgggcaacccaccttggaggaagcacctgtatggagccattcaacggaagtctcgccaactatcgcttgcagttggtgatgccgccgctgttcagcgcgcccggggttgaaggggtgctgagcgtggagcgtggcgcggtgcggcgctgcttccacgtcaaggacggctacctggtgggcgagagctccaacgacccgcgcgagcacctggcccaaatcctggtgaacctccgcatcctggacgccccccgcgccgcggcggccttcgaagcggccgagggtgcgggcatgccctacggcaccttcctggtccagcgctgcttcgtggagctgccccgcctcatcgaggccctggagcacaaggcgcgcgagtccctgttcgactgctacgcctgggagtccggcgaggtggggttcacccctggcctgccgccctcagcccgggcgattgggctcaagctgtcgctgtccaccctgcaccgtgacgcggtgtcgcggcagcgcgagtggagcatgttccgcgacatcttccctcggatggacacgacgttccgcgtcttccgcgagttcgccgtggagacgtattcggaggaagaggacgtcctgctggacctggcggcgagcggcgccacgctgggagagctgctggcgagcgcccgggaggccccgctcttcgccgcgcgctgggtgcttcacctgtaccggcggggggccctggccccgcgcaaggccctcggcccccgattgggtgaagccgccgagttggaggagctgctcacactggtgaagcgcttcctggaagccggccagtatgaccatgccgtcgccctggccgcgcaaatcctggagcaaggccccgtccccgaagcccacgccctgtaccgcgaggcggagatccgcctgacgctggccctcagtgacgagctcttcgcgctcgacgggcgcctggtgttcgagccgattccgcgccccaccccgcccgacctgacggcggatgacctgtacctgtactcgaagctgcgcggcagccgaagcatccggcaggccctgcgcacagcggccatgggcgagctcgccgcgtcccgctccgtgcaccgactgatggcgtccgggctgattcgcgtagccccgctgccagggagcggaccccgacgggcccacacggacccgttcggcctccccatccacggcgtggggagctgagcgccagcggacggaacgttccatccacgacgccgaggctccgggctgccacccctatcgcgcggcggcccgcgccttcttcgccttggggacgaagacatcgctgcgcgggtggaactcgtcgtacacggaccgcagccgggcggcgttcacgtgggtatagatttgcgtcgtggcgaggtccgcgtgccccagcatctgctggacggcgcgcaggtccgcgccacgctccaccaggtgcgtggcgaacgaatgccgcagcttgtggggagacagcggcttcaagatgcccgccttcagcgcgtaccgcttgagcagcttccagaagccctgccgcgtgaagccagagcctcgtggcgtgacgaacaacgcctgggacttgcgccgccccagcaccgccggccgggactccgccaggtatgcctggaccttctcgatggccacgctccccagcgggacgagccgctccttggcgcccttgcccttcgccaccagatagcccgccgtgagctgcacgtcgttgatgcccagcccacacagctcactcacgcggaggccggtggcgtacagcacctccagcatggccttgtcacgcacgcccgtggacgtgcgctcgtccggggccgccaagagctgctccacctcttccagggtgaggaacgacggcagcttccgggctgagcggggcgtgtccaggtcctccgtcggatccttgtccgccatgcgctcggcgacgaggaaccggtggaagccgcgcagggccgccaggtgacgggcctggctgcgcttgcccaagccccgcttgcccagcgcggacaggtgcgcggacacgtcctcctgccgcgcctgcgtcacgtctgagacgccgcgggagcgcaggtcctcgaagtacacgttgatgtccgcggcgtaggcgtccaccgtcttgccggacagtccgcgctccgcgcggatgaagggcgatgaacgcgtcgagcagtccttccatcgccgcgcaggctaccggaggcgcgcggcgaggcaactcagcggctcaggcccggggctccctcgccccctccggtgacgccgactccagcgcctgcaccacccacggccagcccaccacgatgttccccggcgagcgcaggcaggcatccgccaccgccagcacctccgccggccgcgagcgcaccgccagcgccagatgccgccccaggaagggatgcggcagatagctgaggttgtggtgacgcaccggcacccagcccagcgtgggccgccccgtccagcgctccacggcatacgccaccgcggacgccagcacctccagcgcatagagcggcagccggaacgcactcaccaggaaggccaccaacgcactggcggccaccgcgccggcgtaggacgcattcgtcgtcccactccagagcagcatcggcgtcaggctggcgaggatggccgccatctggaccctcaccacggaggggccccggccaatggcgatgccgctgatgctcccacacgccaacccggccacgctccccaggcacacgcccaccaccatgcccgccactccacccagctccggcccgaaggcatccgcggccgtggcgtgcagtcccaccagcgtggccagactggacagcgagcccagcaggacgcccgcggccagccccaacacctgcgccaccagcagtcccaccgccgagcagaacagcgccgacaacacccagccgcgctccagcggcaggcccgccgtcatgagcgccaggcccagcacctgcgtcaccaccggcgcgccgacgagcagcaccagcagcatgcgccggacatagacggccgtggcctggtctccctcggactgctcgcgacacaacgtccccagccgtgcgcccggaacgcggatgcccgcggctcgcagccggtagtgcaggtccaccggccggaacagcagcaacagcaataacttgagcagccctgggacctgctccggtgcatccacggagctcggccgtgttcccccctgtgccaagaaatccccctattctcgggttctagtcctccagcctacccttcccctgccggaggatttcaagtgaatcgccgatgagtgaaatcacggtcgacggttcattgagcgtcacgcccccgtcaaggatgaggtccaggccgtgtcccagatcggccttgatatcctttgcgtccgtgaggggctcaccctccgtattggtcgcggaggtcgtcaccagagggcggcccagggctcgggtcagctcgcgaacgagcgcggagtccggcacccggatgcccacctgcttctgcttggacatcatcaggtccggcaccagacgcgtcgcttccaggatgaaggtgaacgcacccggagtgaggctcttcatggtccggtacgcgaagttgctcacgtgcgcgtagcgcgccacgtccgacaggtcggggcagagaaaggacaggggcttcttcttgtcgcgtcccttgagctggtacagccgctcgatgcccttcttggagctcaagtcgcagccgagcccgaagtacgtgtccgtcgggtaggccagcaggccgccgcgctccagcacctccaccgctcgctggatgtggcggggtgatgggtgctccgtgtccacctcgaggatgggtgcggccatgatgtcctccgtgcctcctgtgactgctgctgaaggtgtggatgcctgacagcctatgccgttccctgcgcgtcgtccgcgcggatctccccggaggccgccaaggcgcgccgggtgaggaccggccccaccagctcgtgggcggtaatcatggcgacgatgagcacctccacctgggggccaaaggtcggaaatgtcctggacaccagggccgccaggccaaacgtcacgcccgcctgggagatgagtcccatccacaggtagcgcttgagccgcgggtcgtccgctggggcgaagcggcggcaggagagccagatggccacgccgcgcagcgcgaccagcaacatcgccgccggccccaccgtcagcagggagtccagcttcagccccgcgcccgccgcggcgaagaagagcgcgaacactggcagccccgcctgttggatggcgttgtggatgcgctcgcccgcgtgctcatccaggttcgcgatgagcgcccccgccgccagcgacaccaacagcggggacaggtgcaggcgcgtgcccccttccgccgcggcgaagcacaggcccaccaggaacagcggcagctcctgcttcacgccgcgcatgtagacgagcatgcccacggccagcaccagccccaccaccaccgagccgaacagctcccaccccaccccgcccagcagctccgtcacgtccagcccgccgccgaagctcgccttcgtcaggcccgcggccagcgcgaaggccaccatcaccagcaagtcgccgatgatgaccagcgccatcaggaactccgtgaaggcgccgcgcgcgctcgtctcctggacgatggcgatggtgacggtgggcgagaatgacaccaccaccgtggacagcagcgcgctgaccgccagcgcctggggcaccgtcatgtccgccaggaagggcagcaggggcttgagcgcgaaggtggccccgaagcacaccaggaaggtgacgccgcacacggccgcgcacagcaaggccacgcgcgcgcccacgcggcggatgagccccaaccggagctccgtgccggccaccagcgcgatgaggctcaccgccagccccttcaccagctccagccccttcacgcccgcgttcgggatgaagcccagtgcatagggccccaccgccacgcccaccagcaggtaaccggtgaggcgaggcaggcccaggcccttggccacctttcccgcgaacaggccgcacaacagcagcgcgcccgccgccagcatcaccggtgttcccgagtccgcccggagcacctgtgcccggctgatgatggccaggagcaccatcaacagcagcagccggatgaccgcgcccgtcatgccgccaccttgtcgctgtcagccgggttctcggaaatgctgcggggcgggtccaccacgtactggaaggcctggcccgccagcagctcgttcaccaccgcgcccatcaccaccacgtccagcacgcgccgcgacagccctcccggcacgagcatcccgtactccgccaccaggcacagcgccagaccgccctgggcgatcagcgcgtagcccagccggggtggcaacacgagcgtctgctgcaccagccgccgcgcgaaccggccgcccagcatcttccccaggaagcgcaggcccacgaaggcgggcatcagcacccaggcccagtagtcccgcgcatgcaccgcgcagcccacgaggaacacgagcaccaggaacacgggccgctccacccggcccaacgcgcgcgccacgcgctccgaggtgcggcctcccaccaccgccagcgtcgccccacacgccacgcccgccagcaagggcgacacccgcaggtacgccgccgcgccgctcaccaacaccacgccgcccagcgtcaccgtggtcagctccgccaggtccttcaacgaatgcgtgaggaaggccagcagcgccccacacatgacgcccagcagcaaggccagacacaccagccccaggccttcgcccacgttgctggcggcgccgatcatcaacgccagcgccagcacgcccagacccaccgcgtcatccagcatggtgagcagcgccacgcccaggccgcgcgcccggtccaggcgccccgcgcgccatgcgagcacggccgagtgccccgaagaaagactggccgccgcccccaacatcgccgccgcgcccaccgcgccgagcagcccccgggcggacgtgaagacgagcggcaccagcaatggcagcgcgacgaagaagaaggctgttccggagtgcgccagccccgacaggtagacggaccgcggcaacaggcgcagcagccggggctccaggttcaggcccagcagcacgcccgcggtgcccaaccccagcgccatcaccgggcgcatggcctccaggtgccgctcggtgagcacccctgctacggaaggccccaggaagatgccgagcagaacgaagagaaagccgctggccgccagtctcgccagcgctggaaagcgccccgggtccagcgcacggctggaggcgagcagcgacagcgccgcgatggataggaagacgagcagcgcttgcacagcccgtgcttataacgacggggcgcttcccgtcacgaccggcgatgcgtgggcgcggaaatcactggcatggcgaccagccgtcccatgggcggctcgtccgcgtccatttccagttggacgcgctgcaccaaccgttccatctcctcggcgggcaggcctggcaacaagctcaccaggatgacgcgatcgtcatcggcgcccaacgccagactgcggagccccgcgaacacggggacctcggcggataacgccgacgccgcgctccgagcccgcaccaccaacggctccgggataccgaactcccggagccggcggatggcccgctcggatccttccaactgttcgaggaacgtgatgaccaagtacacgcggccctattagtcggtccgcgagtctggcgccacgctcgtggagctactcgttctggaccggccccgccggctctccggaagaagggggggtggatggcgccggcgccgcaccctcctggggcggagcacctgccgcgccctcctgcgccgccatggcggcccgcgcggcccgcttgccctcttcgatgagcttcttcaccttctgcccacccttgcggccaatctcctcgtagaagttcggcccccgggtggccttcaccctgtcgccacccttcttgccgatctcctcgtagaacttggcgccgcgctcggccttcaccgtctcgccgcccttgcggccaatctcctcgtagaaggagcgaccgcgctcggccttcaccgtggcgccgcccttgcggccgatcgtctcgtagaactcgcgaccgcgttcgttccggaccgtctcgccacccttccggcccgcttcggccaccgtcatgctgcccttgttgtccttgtccgacatttccctatctcctctcgtgactaccccagccctcgccttggtgccccttgcctgaaaccttgggacggaagcgccccgatgcaagcaagctccgtacaccgccagccgttcacgcctgatacgccacacgaaaacacctgtgatttcgtgggtttcgcaacgcctgccgagctttcggaccgggcggcgggctgcccggccggacgctttcatgttggaaacaccccactgcacattgcggattcccgaagccaccttcactttcaggcccacggcgcggcggaagtggggccgcgggggagatacggcgtggcgcagtcggtgaagacctggctccgggtgttggccccgatgctcgtctcaatgggggggcttgtcgcactccggctgctcgggccggacttcgtcgaccagcagcgcctcgccagttggttggagcccttcgggaagtgggcgcctattgcatacatcggcttccttgccatccggcccgtgacactgcttccgggtcagctgctgacggccgtgggcgggatgatgtttggcacgctcgcagcgaccctctattcactaacgggcggcttgctgtcgggcctgctgcttttcgcggcggcgcgcaagttgggcaccgggctcatgaagcgcctggctggcagcaagtaccccgcactggtgcgggcggcgaggcggcatgacttcctcttcgccttcaccgcctgcatcaatccgctgtgccccaccgacgtgatgctggcggcggcggcggcgagcggagcgcggctgacgcccacgctggccggcgccttgattggcacccttcctggcaccttcctcacggcgcagctcggcagtggtctggcccagggccgcacgacgatgacggcggtcgccgccgcgggcctggtggtgtcgctggtgctcggcgcctacatcgggcggcgcttctacaaggagctcaacgaagacgcgccggagccacagccacgcgcggagccgccgccgcccgcgcgacgccccatccgtcattccgaagagacggccaagcccgcggcggtctaggcatgcatggggggctccgggaagagctccacgcggcgctgcacgcgctcccctgggcccacgcccgtgggcagtgagacggcccgggccatctcctcaccgtgtcgcagccgcatccggatcacctccggcgcgaagtccaacatgtcccccatgggccgtgcgggctcgatgacggtgatgcgacagtaccggtagggcaccccatccggacgccgcacggtgagccccgcgtcgtaggcctgacggacgatgtcgttgatgcgcacgaaggcatccacgtcattgagcaagatttcgttgagggtgatgtcggcgaggctgcgcgtggccacctccaggagattggccggcggcttcgcccgttcgacctgggatggtgagcagacgatgacgacgatttccgtcgggccgaactccagcgcatcccccaggggcgtggcgttgcgcagtccgccgtcgaccagggccgtcgcgcccaccggctcccagaggatgggcaacgtcgagctctgccagacggcgtccaggaagtccctcgagtcgctgggcaccagctcgtagttgccagagaccagggacacgcgccccacgtgggcgggcacccgaaagcggtgtcggacgaggtgccgctggatcagctcccgcatgggcgtgttgtcgtacagccccagtttgcggaacaggcccacgagcaggtcgatgagcggccacggcagcttccggtagaggtccgcctcgcggatgttcacccagatgtcattcagcgcccggtaggagtgctgggccatcagcgaggcgttcagggcccccgcggacacgctgaagatgcgctcccaccggaagctgtggacctcccggaggatgcgctcggcgctgacgtggaaggctcccttgagccccgccgccggacagtgtgagcgttgcgggacgatccttcatggcacgcctcctgggaaatggtcctggcgcagatgcataggggcgtgccagcgcgacggcaatcaccccggggcgtgggcccctgtccaccgtccctcggggttcccggggcacctcggacggcaacttccatgctccgccgggccggaagcctctttaggatgggcggattcactcctccggagcttcgatgatccgcttgcctgaatgttgcgtggtggcgcctgctgctagggttcctgccgtccgcggtgctggcccagcagcccccngcggacgccgccatccatgacgcactgcgcgtcctcaagcaggagatggaagacgccctcaacgcccaggacatcgaccggctgctgagccacctgcacccggatgtctccttcaccacgatgaacaacgacgtgcgcgtggggaaggaatccatccgcgcgtactacgatgagatgatgcgcgggccgaatcgcgtcgtggaccgcatccaggcgaagttcgaggtggatgacctgacccgcctgtacggcgacaccggcatcgcgcgcggctcgtcgcgggaccactacgtcctcacggacggcacggacatcgtcatcgacggccggtggacctgcaccctggtccgggagggcgaccgctggcggatcgccgcgttccactactccaccaacgtcttcgacaatcccctcctcacgcgggtgaagcacctcgcgctcgcgggagcgacggtcatcggacttggcgcgctcgtggcgggcgcggccatcggccggaggctgcggcgccgaagccccgggcccacccctcacgcgccctgaagccggcgggccgtcacctcggccaggaagggatggcgccggggaaggcgcttgcgccagaacgactcgatggagcggtggaagaggcgcagcaacgccagccccggacggccctccagcgccgccaactggccggctgtgccatccagcaacgccctggcccggacgtgctccgccgtcatccatgcgcggcccgcctccgttcccagcagcgcgtcgatgtccgtcggatccgcgccgtcgccacggacagccgccgcgacctcttccggaacgttgtagagcccctgggccaggtcctctcgcaggtcccgcatcaccgagcaccagccgaaggcctccatcagcgcgggcgcgtcctcggcccggacgcccgccccggcgacgtgcagcatcaaatccaccgacaagcagaacgtgtcgcgttgctgcgcgcgaagcgcctccgcgctccaccactgtccggccttcacccgctcccggtccttgcgcatcgtccgcaccagcgcgaagacctgggcgcgggccgtgtcgtctcccaactgctcgagcagcacgcgccccagcgtggccgccgtcccccggtcctcccctcgcccggactccagctcccagaggagcgcgtccacccagtcgagcggctctccgtccaccgcgcggtccccatccagcacgtcgtccaccagttggaggaaacagaagcccacccgcgccccccgagcctcgcgccaccaccggctcaccgcgtagcggtagagcaccagggcaatcagcccgtaacgcaggtgacgccgcgcgaagcgataggactcccgggcgcacaaggcttcgactcgcagggcctcgaggaacgccgtgcggcgcgcccagggagccacccaccgccaggtgccccaggccagcaacgcccccgcgaccacgtccaccacgtggtgctcgtggatgagcaacgtcgacgccgcgatggccagcgcccacaggccgaagaggatacgccccagcacgccggcccgctccgcgtaggccagggccgccgtgcacgcgaaggccacgtggagggacggcaggtagttccgctccaggttcagcgtgtccgccagttggaagacgcccgcccaggccccctccacggcgcgcggcggccaggccacctccaccgggaagaggaggaagcacacggccgcgagcgctgtctccacacacagcgccagcgcgaagggcaccatgtcccgccacgtccggaagacgaagagggacagcaggagcagcacgtccatgctgacgtagaccagcgcccagggcggcatgaacgggatgtggcgctcgaaggacagctccacccggaggcccccggtgtagaagcccgtgagccagctcgcgccgccgtagaccgccacgaagaacagggcgaagcccgtggccatggcggccgtgagggacagctcctccttgcgtggccacccgaacaacgcgggacgtgggctcatcactcctccatcgcggcgggcagtggccgagggcctcgccacatggacagccagatgcgcaggaaggacggtcgcgccacctccgggtccacgtagcgccccaggtagagccagggcacgtgcgggtgccggtgatgggcccggtgatagtggtagttgaggaacagccaccgcaccggagcggccacgcgcaggtcccacgcgccgtcacggacatgcagcggtgaccacgcatggtccgcgtactggagcgcgctccagttgacggcgaaggccgcgtagcagagcccccaccccatcgcggacacatccagcgccaccacgagcccggcctgcacacaggccgccagcagcacctccgcgcggatggcacctccggaagcggcttccaggcgtccgaggtacgcgtccgcgcccgtctgctcgccgtaccgggtgcccgtgccgcgaagccggtgcagcaatccgggaacgagcgcgaagaccaccgcccccaccgggacgaacagccagtagagcccggtgaggatggagtaccactgcgcccgcttcaggaagcggttgtctccgggccggaagtagtcgaactgctccaggtgcgtccggttgtggcggtggtgattcaggtggaaggcgcgctgcatcgtgaaggacgtggggaagaacgccgcggcgaaccggcccagcgtgtcgttcacccaccgcacggggtgcagcacgccgtgcgtggcctcatgcagcagcgagaacacggtgttgttgacgaacgagaagaccaccgcggccagtgcctggatcgcgagccgctccgcgtgtgacgccagccacaagcatccggcacaggccgccatggcgcagaccaggagcacggcgttgagcgcggctggaatcggagttcccacgccctcaccctctgtcgtcatcgggcgcctccggcaggctgtcggtgaagtcgagcacctggcgcagcaccgggtccgccgccgcccccgcccggttgaagcgcatcccgtcgagcacggacaggtcgcgccgcaggaacgacgtgaacagccaccgcgacacctggagcgccaaccagtccacgcccggaagccggctgcggcgcgcggcgaaggcgagccgcacgaacaacccctcctcgctctgatgaaggcccgcgagcaacgcgctgcgcgtgcgtcccaggtcgctctccacggacaggagcgttccgccatgcaacgtgagcgtgacaccgatgcgatcgccggacaggaacttcatcacccggtcactgagcccgctgcccgtgacgcgggacgtgtaccgcacgcgcaaggtgaacgggtccgggcgctccaccactggcgcgtcccgcagctcacgatggtgcaccgtgcgcaggtgctccaagtcgaaggcattggccaccacgggcagccagtcacaatgcaccgcgaagcgagccgacgtgccccagcgcaacgcgccgctgcccacctccggcggagggaagagcaccaccgggccattgaagaccaggatggcgccgtaccgctccaccacggggaaggcccgctgtgccgtcttccctgggcaggcgccactgccgtcgaactgccagtggtggagtggacaccgcagcgaatcccccaccacggtgccaccacccaggtgcgcgcccatgtggggacaatgggcggcgagcgcgtggaccgcgccgctccgtccccggaagagaaccagctcccgtgtgcccgtgctccaacgcatcacctgcccgggccgaagcgcttcggaggggcacacgaggtgccacgcgcgcagacggcctggctcggggtgacgcacaggctccagccgcgaggcaatcttcaccaccatgctgaaaatctaacgcaacggatgatggggctgaaggatggacaaggaatggttcaggacttgccaccgccccggggcagcagtgtctccaccatgcctttgagcgactgcttcaggatgccgcccgtgtccacgtcgcccttcgccagcgcctgggcatagtgcttcgcctgctcgaaggtgatgtggggcggtagcagcgggacgtccgggtccacgtaggccttgaagacgacgggccgggttgcgctcagtgcctcatcccacgcgcgacccagcgactccggccggtccacgcgaatgcccaggaagcccagggactccgcataggccgcgtacgggaagtccggcaggtcctgggacgcgggcagcttcgggtcgccggccagcacgcgctgctcccacgtcaccatgttgaggtcccggttgttgaggaccatgacgatgaagcgcgggtccttccactccttccagtacttggccacggtgatgagctccgcgttgccattcatctgcatggcaccgtcgcccaccagcgcgatgacgggccggtgcgggaaggcgaacttggcgccgatggcatagggcacgccgcagcccatgctggccaggttcccggacagcgaggccatcatccccttgcgcatcttcaggtgctgcgcgtaccagctcgtgcccgaccccgaatccgccgtcaggatgacgccatccggcagccgtgacgacagttcgaagaacacgcgccgggggttgacgggattcgcgcggtccatcgcgagcgcctccgccgtcttctcccactgccgcacgttcttcaccacgctgtcgcgccagctccggtccttcttgtgctcgagcatgggaatcagcgccttcaatgtctcctgactgtcccccaccagcgccacctccatggggtagcggatggccagcatccggccatcgaggtcgatttgaacgccccgggcctgtccctccttcgggaggaactccgagtacggaaagctggtgcccaccatcagcaacgtgtcgcagtccgacatcaggtcccagctcgccttggtgcccagcagcccgatggagccggtgacatagggaacgtcatccggcagcacggccttgcccagcagggccttcgccacacccgcgcctagcaactccgccacgtgcatcacctcgtccgccgcggcctgcgctccggcgcccaccagcatggccaccttcttcccggcgttgagcacgtccgccgcccgccgcaagtcccgctcgcgaggcagcactcgcggcacgctgtagcccacgcttgaatggaccgtgccgtgcgcgtgcggaggcttgtggtaggcctcttcctggacgtcgttggggatgatgacgcacgtcacggtgcgctcgtagatggcgacgcgcatcgcccggtccaccgcgtggcggatggcggaggggctggtcaccatcgtgaggtattcgctgggcacgtccttgaagagggacatcagatccacctcctgctggaagtggccgcccagcgctgagcgcgtctgctgtccgacgatggccaccaccggctggtggtccagcttggcgtcatagaggccattgagcagatggatggccccgggccccgacgatggccagacacacgcccggttcgccggtgaactttgcgtgcgcacaggccatgaacgcggacatatattcatggcgcgtgtgctcgaagcggaactccaacgtgcgcccgagcgcgccgaggatgccgttgatgccgtcaccgggatagccatagatgcggcggacgccccactgggacaggcggtggagcaggtaatcggagacggtggtgctcatgacggattctctggttcagggacgccatcaagatatgcacccgggcaccgctgtctgcggtcgagctcccatccgcccgtgcagcggccggggcatcgaccgggcacttgtgaacactttgaggccgggcgagcgcggggagtgtccaccactgccccttgtggggaacgtgcaaggaagaagcctggaggcagcagtcgggcaatggcctgctgccttccggtcatggctctgtgtatcggcttcttcgttgcattcatagccgcggctttggccgtgctgatcacccggttgttcaagccatgggcaggctgggtgctggtcctctttccggcggggctggctgtgtggctcggcgctcacgtatccgccaacttgcagcgggaggtgctctcgctgacgctgccgtggatgccggacctgggcatcgacttcgcgctgcggctggacggcctgtccctgctgatggcgctgctcatcaccggactgggcacgctcgtggtcatctacgcggggcgctacctggtccaccatgaggtgttgggccgcttctacggatggctcctgctcttcatgggcgggatgctgggcatcgtcctcgccgacaacacgctcctgctcttcgtctgctgggaggtgacgaccttcagctcgttcatcctcatcggcttcgagcacaaggaagacgccgcccgagaatccgcgcagcgggccctgctcatcaccgcgctgggcggacagtccctgctggtgggcctgctcctgatgggcgacgtggtgggcacgctgtccatctccggcaccatcgccgcctcggacaccgtgcgcgacagcccccgctacctggccatcctcctgctggtgctgggcggcgccttcaccaaatcagcgcagatgccgttccacacctggctgccgggcgcgatgacagcgcccacgcccgtgagcgcgtacctccactccgccaccatggtgaaggctggcgtcttcctgctggcgcggctgtcgcctgtcctgggaggcacacccccgtgggaaaccatcctcaccatcgtgggcacgatgacgatggtgctgggcgccctgctggcgctggggcacacggacctcaaactggtgctcgcgtacgcgacggtgagtgtcctgggggccttggtgatgttgctggggcagggcaccgcggtctccatccaggccatggtgacgttcctcaccgcgcatgcgctctacaagggcacgttgttcctggtggcggggtcggtggaccactagacgggcac

SEQ ID NO: 1144 - DNA, 16350 bp, Myxococcus xanthus
ttgccttccggcgtgacgatgatgagggccacgccctccgggatgtcctccgcgcgcgcctgcgcgccggacacgtccatggggcagtcccgcttcatctccgcctgcgcgttgggcggcaggccttcgttttgccgtggcacctgctgcgcagtgggtggcatcccgccatgggatgtcttggcatttctggagcaaccgaccgagaaacacatcaccgccgaggcggccagcgccgccgggaacctgagtttggacatgagcccccctttgctgaaagtcctgcgcgcagaaggtggggagcggtgcgcggtggtggcaatacgcactgacgtaccagagggccagcctcggggccgatgcgcgtattcgcggcgcgacggatgcggccgcagttcacgtcagccgcgagacatcctcgggcgtgtccacgtcgtcgccacccccgggcagcgggacgtccaccacgcgcgaggccacgcgcgcaatcacaccacgcgcgccctggcccgggctgagcgcatccagctccgggaagacgtcacgcgcgaagagggcgggtacgcctcgagtgtcctcgtaggcggaggccaccacggacgcgcgagtccgttcaaaggtatccagcagcgtccgcaagtgtgcggcatccacgcgaagctggtcgcacagcaacacgagcacggcgttcagcgcggggggctccgtctcccgcagcgcaccgagccccgcgcgcagtgagcctccagggcctgcggcccagtccgcatggtccacggtgcgcacggggaggcctgtgagctccgccgcgaccgcatccctcgacgcgcccagcaccaccaccacggggccgcaccgcaaggaggccgcggcctcggcggcgcgccgcaccagcgtcgagccctggtatcgcaccagttgcttggggtggcccagtcgcgaggagccgcccgcggccagcagcaccacgcccaccgtcatgcgagcctctgcgccggcaggggcgcggcggtgtggatgggcgcgcgccgctcgcgaagcttgccgccctcgcgtccggcgaccaccgcttgaagctcggcgatgatggacagggcgatttcctccgcgccttccgcgcccaggtccaggcccacgggcgcgtgcagcttctccaggtgtgcgtcggtgggcggggagggcagctccgcgagcaatcggtctgtgcgcgagcgaggtcccaacacgcccagatagcgcaggggccgtgggaggagccgcgccagcagctcgcggtcctgcggcaggctgtgtgtcatcagcacggccagcgcacggggcgataggggcaccgcactgggcgcgtccggggccttcgccgacaccaccgcatgggcctggggaaagcggcgccgcagggcctgcgcgggccggtccgccaccaccgtgacatgccagcccagggccgcggcctggttcaccaccggggccacgtcgaatccgctgccaaagagcaccaggggatggggcggctccacgacttccaccagcacgtccgcgccgccgcaggggccgctccacgtccggcccgcttccagcgcctcgcgtgcggcttcgcgcacggcgtcgcccagtgcgccggacagttggcccgcttcggtgccgtcatcgcggagcttcaaccgggaacccacggcgttcgcggggccccggtacaccgtcgccaccaccgcccggcgccccgcttcccgcgcctcggcggcgaaggagagggcctcgcccgcgcccgcctcccagcgctccagcagcacgtccaccacgccgttgcagcccagcgcgaaggagaaggcaccttcgtcctccgcggtgttgctggtggagtcgtagcgcagcaggcggggcccggtggtggtccagaagaaggccttgcggacgatgtcggcctccaggcagccgccgctgatgccgcccgcgagccatccgtcctcgctcatcaacatccgcgcacccggccgccggtaggcggagcccgatacctcgaccaccgtggccaggaccagggggccgcgagcttgcgcccgcgcgcggaggatggcgtccaggtccttcatgtctcgtcgtccttggtgggggtgactggaacgcgacgagaaactgtagtcggcgccattccatcccggccagtgacgttctttcgcgggagttcccccggggcgggcctgggggcgacactcgacacacgcggcgactggatgaatcctcgcggctggggtgtagttcccatccgcatgcccgttctgcgttacgccttcaccctgaatgccgtgcgtgagctcggccgtctggctccggacatcgcccgggcacgggcggaggcggccctggacacgagcctcctgcacattcgcgaagcctgcacggccgcgctgggcatggagttcgacacactgatgtgcttcgacgcgcgctccgtggtccgcctgttctcacacgcggagcaggcccgcatcctggcccggctggtggacgagcgggcacgcacgctggcgcggctgggccgcttccaggaggcgctcgaggacaccgtctacgcggggcagttgctggcgtgctcgcgccagcgcttcggcctgcccaaggatgcacgcgcggcggagacgctggagcgcgaggtgcccgagcttcgttgacccacgcgtcgtgggccgcgcttcaccgggagcgctcgccacccggcggcggttcgtcctcacggcgggcgggctcgggttcgggttcgggttccggctccagtcgcgcctgccgttcgctggcttcccaggaggcctgggcatcgcccgcatggacctgacgggcggagtcgtcatcctgctggtccgtccacgaggtgtggccccccgcgtagccttccaggggacgcggtccccggtgggactccacgtccaggtccttctgctcctcctcgcgcagccgcctgcgctcctgttcccgctcgcgctggtgctgccgctccagaatgtcatccaccatggtgccgtcacctcctgcaccaaggtggtgtccctccgcgaagtcggcagcgccggacatggccacacgcggcgggccgcatgcccggcgttcaatcaacgggcaccgggcgcgagcacgctcgcgccggtgcctccaggccatgtcagccttcgcgcatgcgcagcaccaccttgcccgtggcgcgccgggcgtcgagctcacgcagggcctgcgcgccctgctccagcgggaacaccgggcccacgacgggcgtgagcacaccacggtccgccatggcctccaggtccttggcgatggtgggcgtcagggatggctcgtgcaggaggaagccgccccaggccacgccgaccacgtcgatgttgcgcagcaggagccggttcacctggacctcggggatgcgcccgctcgcgaagcccaccaccagcagccggccttcgggcgccaggcacttgaggctcttgtcgaagatgtcgccgcccaccgggtccaccaccacgttggcacccaggccgcccgtcttctcccgcacctgcgcgacccaatctccggtcgacagcagcacctcgtgcgcgccggcccgccgggcgacgtccgccttgcgctcgtcgctcaccacggcgatgacgcgtgccttcgcgccgcgcgccacctgcaccgccgccgtgcccacgcctcccgcggcgccatggaccacgacgctctcctccgccttgagccggcctcgccggtgcagcgcgaagtgcgccgtgtggtagttcatcaccacgcccgcggccgcctcgaagctccagtccgcggggatggggaacaccatctccggctgaatcgcggccacctcggcgaagccgcccagtccgaagctgaaggccatcacccgctgcccgggcttcacccccgcgcccgcgggggcttgccgcaccacgccggccacctccacgcccggaatgaagggcagggcgggcttgagttggtactgcccccgggtgagcagcaggtccggaaagctcaccccggccgccaccacgtcgatgagcaccgagtcccccgcctcgggctcgggcacgtccaccagttggagcccgtcagggccgtccagccgctgtagctgcaatgcgcgcatcgttgcctcccggacaggaagcgtaatggccagccacgtcgatgccagtgttgcctcacgcgcgcgggcggaccccgagtccggcacaaagttcacacgacctgtggaaaaccgaggcccgcctggacgacctgtcacgtcacgtggaaggttgctcgcactcgtagtggacctcgcaaatccacgaaagcaaaggaataatcgtaaataacctgaaatctaagaagaggatagaaactgaaataatcgcgcaaccttgaaatacgcgtcatccctgtgtcatcgtgcctcctaatctttccgcttaggaggattacatggtgcagaagagagttcgcggagcgctcggtattgcggcgctgtctgtcgttgtcggttgcaacgagtccacccctgcccccgaggccgacaagcctacggatgccgcgaaggcggcgatgctggagaatggcgcgaaggtcattctgacggacaaccagaaggtggcgcagttcgtcaccggtctgtcgattgctctgccggatattcctgccgcgggtcccaaggcgctcaacgcgtccgcgctggcctcggtcgtcgacgccgtggcgccgacgttccgcctggagccgggcaacctggtcttcaagaaggcgcacacggacaagcagggtgacagccactaccgctattccgtgaagcacaacgacatcccggtgctgggcggcgagctgatcctgcacgcgcgcaacggcaaggtcttcgcggcgaacaccaacgtccgcagcgacctgcgcgccgagctgaaggcgaccatcgcgggtgagattgccacgtccgcggtggactccgaccgcgagacgctcaagggctgggtcaccgacaagaacccggagctggtgtactggcgcgtcgatgacgagctgcgcctgatgtacaaggtcgtccagcacggcaacaaggcggacggcacgcccgttcgcgactgggtcctggtggacgcgcgcaacgcggatgtgatgctgcgcatcccgcagatcaaggagtccctcgaccgccgcctccacaacggcaacaacaccagcaccctgccgggcgcggtcgtgcgcatcgagggcgcggcgccggtggcggaccccgtggtcaacaccaactacgaccacctgggcaccgtctacgactgctacaacaccctgttcggtcgtgactccatcgacaacgcgggcggcacgctcatcagcaccgtgcaccaccgcgtcaactacgtgaacgccttctgggacggtacccagatggtgtacggcgatggcgacggcgtgacggccaccaacctagccaactcgctggacgtgacggcgcacgagctgacccacgccgtgacggacaacgagtcggacctcatctactcgggtgagtccggcggcctgaacgagtcgatgtccgacgtgttcggcgcggtgtgcgagtggtacggcgacggcgcggacgaggtctccccgcgtcactggctgattggcgacgacgtgtggaccccgtccatcccgaacgacgccctgcgctacatgaacgacccggcgctggatggcgactcgctcgaccactaccacaactacgtgcccggtaccggcgtgcactacagctccggtatctccaacctggcgttctacctcctgtcgcagggcggcacgcacccgcgcggcaagagcaccatcgtggtggcgggcatcggcatcgagaaggccgcgcagatcttctacaaggccaacacgttgatggtgccgacgtccaacttcgaggccgcgaagaccatctcggagcaggccgcggcgcagctcggctacgacgccgccaccatcgagtcggtgtcgaacgcgtggaaggccgttggcgtcagcgtcccggttccgcctccgccgacggaccccatcgtcaaggacacgccggtcgtcgtgtcgggtggcgccaacgagaagaagtacttcgaggtcacggtgccggaaggtgcctacaacctgcgcttcaccctgtcgggtggcacgggtgacgccgacctgtacgtccgctacaacaacgcgcccaccaccgcgctgtatgattgccgcccgtacgccggtggcaacaacgaggtctgcaccttcgcggctccgcagcacggcaagtggtacgcgatggtgaacggctaccgtgcgtactccgacgccacgctgaccgtgacctgggagggtggcttcgtccccatcgagagcggcatcgccgtggagaacctctcgggcgcggcgggctcctcgcaggtgttcatcctcgacgttccggagcgtcgcccgggccaggggaagaacaacatctacatccagacgggcgagggcaagggcaaccccgacctctacgtcaagcgcggtggcgccccgacgcacgcggactacgattgccgcagcgtgaaggaccaccagtcggagaagtgcaacctcatcaacgctccggccggccgctactacatcgaggtctacggcgcgaaggatggcttcgagggcatcgtcctcatcggctccttcctcgagccgctgcccaagtagtctgaagtgacggcgcggccttgagccgcgccgatgaggccccgggtgctccgcttcacgcggcgcccggggcttcgtgctttctacggcgtggggccggggaggatgacgcgcaggcagctctcccacgcgtgcacgccccggtacttccactgcacggggtagcccagcgacacctcttcgaagcgcacgccgtcacgccacagcgtcgcgggcatgtggaggtggccggagacgacgacctccgcgcggtagcgggtgtgccagtcctccgtctgcttcgtcccgcaccagatggagaagcgggggatgcgcggcagccgcacgtgctcgtagcgcagcgggtagtggttgacgaggacggtggcgcagcccggggggagggcgtccagccgggcccgcgtggcttcgacgcgcgcggcgcaccaggcggcgcggctggcgtggggctcggggtgcagcagcacctcgtcggtgcacagcaggtcatcctcccaggcccactccagcgccttgtccgcgggcacatggtccgggcggaacgtgtagtcgtagcccaggaacatggggacgatgacgcgctcggggccagggccgggccagcgggggtaggggtcctccggcgtgagggcgccgtagctgcggcacaggctcaccagccgctggtagcgcgcctcacccttcagttgcggctgctccgacggcatggtccacagctcatggttgccgggcacccagatgacctggcggaagcgctgggtgagggtgctcagcatgagctccatctccgccagcgtctcgcccacgtcccccgcgacgatgagccagtcctccggatgggccggaagcgcctggagcgccaggcggttgtcgttgtggcgcaagtgcaggtcgctgatggcgtagagcttcatggcgcgtcgagcggcaccttaacgcgggcttcccatcgatgctgcaccgatgcccagcatccgcagcagggcatgcacctccgagggtggcgcggcgcggtccatccacgtgatgtcccgcgccaggggcggcatcaccgcatgcagcgcgcaggcggtgcgggggtggctcgcacgcacctgctccagcagccccagcccgtctccgtccgggagcagatcgcccgtcaccaccacggacggcgcttcttccttcacgagcgcgagggcctcctccacgcagcgggcgaagcgcttgccgccgggtaaatccctcacgagacgccgcagcgcggcgagtgaacgtgggtcttcgtccacgaacaagaaggtcagcatggtcttcgcgccagcagggtgagacctgtgtggttggccaaacgcacgaggttgcctacctacaagactactcaggaagttcttggatgccaacctctcaagtcatatcgacatgtgcggacccgctaggttaacgacccatggaaaagactctcgcatcccgccttggcggagcggctcgccttgctcggacccgactgaacctgacccaggccgacgtggcggaacgcattggcatcgcgagcgaagtctatggccggctcgagcgcgggcacatgctgccgagcatccagacgttccgcaggttgtgcacggtgctctccatctccgcggacgaggcgctgggcctcaagccggtgcaggaggtgaagtgggccgccgagccgcccagtgactacggcgagtccgcggagctgcggcggctcatgcgccgggccaagcaactggaccggacgtccatccggatcctcagcgtgctcgcggcgcagttcaagccgcgcggctgacgcgcgttcccggcgggcgagcgcagcgctcaccgcccgggctccagtttcgccaggcgctcccgcagcttgcgcgcggaggggaagccgttgaagagcaccacctgcgggtgggcctccagcgcctctcgctccacggcctccttggccagcgcccggtccacgcccagcagcaggcccgcgtccggccgcgagcgcagctccgtcagcctccgggccaggggcgccgcatgccatgcgtggaagagctccagcgcgacttctctcttggacgcacggtggcggaaggtgaggtccggcacgcacagtccggaggcgcccacgtgccggggaaggggcgtcaggtccagctcccaggcgtcatccgcgaagccctccgcgagggaggccacttccggaggaatgtgacccagtgcggcgggtaggggcgaacgcagcgggtccttgtggctgagcatcaacgtggcctgccgccgtgaaagttccacggtggcggtcagctcccagcgctccagcaccggcaccacggacaggaaggtcgccagttgcaggccgtacttcttctggagcgccagcatggccccagggccctccacgtcgagcgcccagttgtcgtcgtcacgccacacctcggccaccaggcggcagaacttgagccaccggagcaccttgcgcacgcgcagcaggtccggcgcctgggctcgcaggcggaggcgccgtgcggacagcagggggccctgcgccagcgccaggttgtagcggtccagcaggtcctgggcgttcagtgcctcgccgtcccaccccaccagccggcggtggccgggcaggtccgagtacagcgcctctcgggcctcggaaagggggacggggagcgtctgggccagccgtgcctcgaagccctccaccgtggcgtcgggaggcagcgcacgcaggacctgtcccgccgccttgattcgctcccaacgggcttccgtgacgccgggcgcgggctcgtcgaagaggagccggtccaacaccagcttcaccaggccgcgcgccaccttgggcttggtgaaggcgccggccttcaagcccagcgactcctcgatgtcgtcgcgctggccgccgcgcgacgccgctacctccgcgagcaggtcctgggcgaaggtcagcagctccgtgtcatcgcgcttcacgaagacggggcgcaggacgccctggcgcacgcggaagttgagcagctcgcgtgtcagcatctcagccgccctcctgataggcgccgtgctggcgtcgccgctcgctgatgctgctctccgccgtctgcgcggagcacacctcgtacagcagcgcgcgcttccccggccgtttgcgcaggatgcgccccagccgctgcacgtgctcgcgcacgctcgcgctgccgctgagcaccacgcccacgcgcgcctcgggaacgtccacgccttcgttcagcacgcgcgaggtcagcagcaccggcagttccccggaggcgaaggcggccagcaacgccttgcgctcgggcacgggcgtgtggtgcgtcagcgcggggagcaggaagcggcgcgccagcgtgtacaccgtctcgttgtcgtcggtgaacacgaggacacggtcgtcccggtgctccaggaggatgcgccacagcacctcctgcttgccgctggacgtgagcgcaatccgccgttgctcgcggtaggcgcggtacgccgcgcggccctcgtcactgcgctggctctgcgccaggaagcgcgcccacccgtccggcgcggagagcggcacgctcagcctgcgcacgaagcccaggtacagcgcgcgcgccgtgtcgtagcgcgccttttcgtcgggcgtcagcgggacttccactcgcttcacttcatagggcgccaggtattcaccctgcagctcccggatgtccgagcggtgcacgcgggggcccaacagctcctcgcagacgcgctcgccgccatcggcgcgctccagcgtcgcggtgaggcccagccggtacggcgccagcgagccctccgcgatgaagcggtagctgggcgcgggcaggtggtggcactcgtcgcacaccagcaggccgaagcggttgccgtggaattccgtctgcatcgccgcggagtcgtacgtcgtcaccgtcagcggctgccggtcattcacgccgccgcccagcaggcccactggcgcggagaagtggcgcgccagcacgccctgccactgcgtcatcaggtccagcgtgggcaccaccaccagcgtgggccgcttcacgtgggcgatggcgagcaccgccagcagcgtcttgcccgcgcccgtgggcagctccaccaggccacgtccgcccgcgcgtgtccacgcctccagcgcctgctgctgatgcggaaagggttggatgggcgaggtgagcggcagctccagcggctcgaagcgcttcgccttgtcctcgtaggggatgcccagttcccgcagccgcagcaccgcctcgcggtaatgccacgcgggcgcgcggtagacgccggtgcgcccgtccttctggaagagggctcgcaggcgagcatcttccggcagtgtgggcgcgaccagggtgccgcagtcgaagtggagctcggtgggcgacggcatcggcgtgtagggacctagccggtcatcctgggtttcgccagtctcatcgaaggcctggaaggcaggcttgcaggcatgcgctgttcacggtacccagcgcgtcgcatgcgtttcatctcgctcgttcccatgctgtgtggcctggcggtcgtggctcaggctggtctcaaccgtcgcttcgggggccagtggggcctgatgagcgccgtgctcctgaacatggtggtggcgacggtggccaccttcgcggtgtacttcgtcgtgcgcacggtgccggggctctggccggaggccgcggcgggccagggtcgcttgagcggcttcacgccctggcacctgttgccggggctgtgcggcgtcgtcatcgtcctgggcatgcccttggccatgagccgcctgggggcggtgcagtccgtcctgctgctgatggcggcgcagctcctcaccagcctcgtgtgggatgcgatggtggaaggccgccccgtgacgttcccccgggtgctgggctccgggctcgccttcatcggggccaccatcgccgtctggaagggctagattcagctgcaagatgcgccgggtcctcatcgtcagtcctcatgcgccttcgcgcgagctgttgcgccgtatcctcgaggcgccagacctggccatctccgtcaccggggatgcggacgacgccttcgcctcgctgacgtcccggccccccgcgctggtggtggtggacgtgcgccgcccggatgaggaccacccgctcttcctgggcttgctccgcaaacgtcacccgacgcttcccgtcatcgcactcgtcccgggcaggttgcgcatcttcgacgggcggcacgagcgtgtggtcgaagcccacggtgacaccgccgagtcacttcatcagatgctcgtctcgcttcaacaggccatgcacgagctgctcgcccaggacctgctccggctgtggcgcccacctgtcgggcgcgcctgaagggcttcgtcgtcgcttcaacaggggaccggtatgccgggacgggctgttcggcccgcgaacgtagttttttccggctgccgtccggctccgcttccgccccctggttccgttttcttgtaagtggctgaaataattcgtgtttcgtgctccagatggcacggcacggcgaatgctatggcgttgggcacggtgcgacgcggaccggcggatggggatggttggcgggtgagggacgccggtgcgggtcgcgggttgcaagggcgggacggagctggggcggcgcctggagtggggaggcgggcctcggtgggatgggggaggaggacggcgcggcatgccggcgcttcgttgggggaagggggcggcggcggacgtggcggcagggcctggctcgcggtgggacagggggcaggacggcggatgggcggaccctgccgcgcttcgtgggggcgaagcgcggcgggttcgcgccagcagggtggggcaggggactccatggacgcggaggcaggggggcgagtgagcagtcgcttcacccgagaggccagtcatggcggcggggagggaggaggggcgggacggggcatgtgtcacgggaggcagggcatgggggtggtatccgcgctggcggcggtaggggtgctgctgacggcacaggcagcgccagcttcggggctccagcggcggacccaggacccggagcggctggctcccttcggattgatgctggacgccagcgcacccgagggcgcgggcctgtcactctccttccggcccacgcgaatgctccggctccacgtgggcggcacgcacaatggtgtccgccccggagcgcgcgtggggctcacgttgctgcccttgaaggggcgcctgacgcccgcgctgacgctggaggccggccatgcgcggcccgcgaatggtgaaggcctggagcggcgcatcgtggaccgcacgcagatgcccatccattcgttggagcgcgtgggctactcctacgcgagcgccctgctgggcttcgaatggcaggccccgaagcggctgaccttcttcgtgcgcggcggcttcagcatcatgcggctctacagcccgggcatcgtcggcgtggacgagcagttccgcgacgcgctggagcccgcgaacttccacggctggagcctgagcaacatcgagcccaccgcgaagctcggcatcctgttgtcctttggttgagccgaggccgctgcctcagtccacgcgcggctgggacaacaccgcgtcgaagaaggccagcgcctgcgcctccgcccagaagtggggccggtgtacctggccgccgacgaagccgacgtgtccaccgtgctccgtcaccacgacgctcaggtggggattcgcggcggcggcgggcgggatgacgggcgtctccagcatcgggtcgtccgcggcgctcagcagcagcgtgggccggcggatggcgtgcagccgggggccggcggaggactccgcgtaatagtgggcggcgtcgcggaagccgtgcagctcggaggtgaccgcgtcgtcgaaggcgcggatggtgcgcgccgcctccatggcctggccgtcgaaggcctccggaaagtggcgcagcttttcgcgggccttctgcttcagcgtccgcaggaagcgctcgcggtacagccggtggaaggggcctcccgcgtcgagcttgcgacagcaggcgctcaaatcatacggcgcgctgacggacgcggcggcctccacgggcgcgtcgtcgcccagcgtctccagcagccggcacagcacgttggcgcccagggagaagcccactgcgaatagcgggccggtgacgcgggcgcgcgtctcgttcagcacccggagcgcgtcgtcgatgtcgcccgagtggtacgagcgcgccagccggttgggctcgccgctgcatgagcggaagttgagcgcggtggcgccccagccgcgcgtccgcgcaccgcgcaggatggcggtgacgtagcccgcgcgggacgaaccctccaggccgtgcagcgccacgacatgcggcgcgcccgccgcgccgtcgaaggtgtccaggtcgacgaagtcgccgtctggcaactccatgcgctcgcgtcgcagcgcgggcgtgcgggtggggcgcacgagcgaggcgtagatggtctgcgcatgctcgttggccaggccgggcgcgggcacgaagggatgggtgggctggaatcgcacggccgggggataacgcccgtacgcggggacgacaagcgctcttgccgccaggcgcctagtccttggcgccgtcagggcggcgcagggtgtccaggcggcgggccatgcgcatggacgcacagccctgctcgcgcaaggcgcgggcctccgcctggagcccgaagaggctcaggtacttctccacgcgctcctccagcgtgggggcctcgatgagggtgcagacttcatccgcctggtagtcgcggcagatggcgggccgctcctcgtagactccgcagaggttgtcctcttgcaaatgtgggcagcgcaggcccagcggcttgtccagcgcggcgatgtccggcgccacgcagcaggcgccgcagcgcgtgcactccacgggcttggagtggggggcactcatcggggcacgaccttctccaccgtgcccaggttcgtcacggtgaggcgcgcgccctggcccttcttccagacgaggaacgtccgttcgtcctccggctccagcacgtgctcatgggcgccgtcatcctcgtagcgcagccgcaccgtgtacgtctcctcgcggcgcagccggtccgcggcgcccacggccagctcgggccagcgcggcgcatcgtcggtgccggacgcctccctgcgcgtcagcggcttccactcatgggtgtcgtaggtgcactggtccgcatacacgggctcccggcggtagcgcgtctcgttctggcagtcctcataggactcgcggcagtacttcgtcacgtcctcgcacacctcctccatgaagccgttgcccatgtccttgcggcggcacttctcctccgtgccgcaggccaccttgcgcgacttcgtccggcacacccgctccgtgccgtcggggacgcggcgggtgcctcgctggacggacacgcaggcgcggatgtcggccacgcccgccacctcgccggtgccgttgacgggcatgcgggccgtgacggagcgcaactcgttgcgccagccccgcttcgtcacccgggtgaagcgctcttgaatcacggtgcgcttccaggccgtgcccgtcacctcgccgggaaactcatgcgccttgcctgcccacaggccgaagacactggagccgaggcagcagaggaacagcgagcctagcgccaggagcatcggtgccttgcgcttcgcgggacgtgactgcggcgggggggggtggtgggggctcgtcgaacgcctggcgtggagccgccttcgcgtcgtcggtgcgctcggcgccgcagtgcttgcagcgcgtcgtgtccccccgcgtggccgcgccgcagaaggcgcagaaccagtcctctcccgccttggccagcgccaacgccgccgcgtcggtgacgccctcgcgcagcgacttcccgctggtcgcgtccacgccgccgaagtcgaactccgactccttgcccgtcagctcgcgcgggttgttgcactgggggcagcgcttgtgccgggcgcgaatcgacttcgtgtcacacgaggtgcagttccacgtgccctcgatgatgcgggttttgcgggcaatgggcgcatctaagccgcacgttcacgcccaaagggcgcaaccaaaggggatgtcttcgctggtggacaggccctcgcgcaggggccgcaccatgggcagcgagccatcccgggcctctcggggtggcttcgggaagccgggcccacccacggcatggtgcccggctcctcccacagcaccaccttggacagtccggccttgtgggcctgggcccccgcggcctccagcagcgcggcggcgtcgtcctcggagcgcgcgtccagcatcagcaccaccagctctccctggcgggccatcatcgcccacagcgcagtggacgcgcccaccaccgcgccgcaggcccggggccgggggcggcgcagcagctccgcgtagatgcgctcgcgctccaggtgccagtccacctgtgaggcgcccggccacaggtagaagggcacctccggccgccgcatccgctcgagcgccgagggcacgtccgcgtcttccagcagcgcgtccacctgcgaatcactgagagct

SEQ ID NO: 1145 - DNA, 14382 bp, Myxococcus xanthus
tatggacaatcaagacgcccggacaggtgaggcgtgaagacctggacgggtcgcagacaaaaacaacacccccggaggtacgcatggacgactcgaagaagggttctcgtcgtacgattcgcgcactcgcctcaccggctgccctgacggtgctcttcggagccttcgccagcaacgccgcgaccctgaagcccgtggtgaatgacaccattggcgtcagcaacgtcagcttcccgacgaccgaggtccagcagcaacagcagcagcaacagcaacaggtcgtgaagcctggcaccatggccagcggcaagccggtgatgctccagtcgctcgtcgcggacctgggcctcgcatagctccaccgaagtctgttgtcagcgctgccttcctgttgggaggcagcgcttctccgggggcattcaattcatgggagcgctcccggcgcgcgatgacgcacagccttgtcggttcagcccagcacatggaggttctggcccatggaaacgcccttgacgcagcggcccggtgacaccccccaggaggcccgcgacagctcgcgaccggaccttcatctcgtcttccctccgcagtggtctccgctccagcccttcctgagcaccccgtcgctcaaggcctacctggagcagaagggccaccgcgttcaccaggacgactggaacgtcgtcttctatcgctggttcatcagccgggcgcgcctgcccctggcgcgggcgcggctggagcgcttcatcgcggcgctgacggatgagcaccgcctctaccgcgcccggtgcctgcaggcgctggcgacgctggaggagtatgagcagctcatcgtccaggtggaggggctgcgcaccggcgatacctacggcacgatggagagcttcaaggacagcgtggacgcgctcaaggcgctgctcgcggcgttttccgcggcggagcccgtcatcgaggtggggacgacgtcactccaggatggcgacgtcctgggctccattccgtcactgctcgccttcatcgacaaccgcaacgccaaccccttcatcgcgttcttcgaggagcaggtcgcgggcgtcaagcaactgcctcgctacttcggcgtgtccatcatcggcaccgagcagattgtcgcgggactcacgctctgccgtgtgctgaagcagcgccatccggacgtcccggtgctggtggggggcagcgtgttctcccgcctggtggagaaggaaagcacgtgggtcacccagttgttcggcaggtgcttcgacttcatctgccggtagagggcgagcgcccgttggaccgctttctgtccgtggaagacccacggggagaccgcccgcccaacttcgccttcatggagggtgaggacctggtgctgacgccgctgggggactcactgccgatgagcgaggtccccacgccggatttcggggggctgccgctggacgagtacctgtcccccgagattgtcctgccgctgttgacgacgcgcggctgctactgggggaagtgcgcgttctgctaccacggcatgatttacggcgaccgttaccgcatgcgcgcgcccgagatgattgccaaggatttggaggtgctcaacgcgcgccatggcgtccggcacttcgcgttcaacgacgaggcgctgccgcccaagctcttccgcatgttgccgcccgccgtccccaaggggcgctacttcttcaccgcgctctacaagttcgagaagtacttcacgcgggaggacttccagaacatgcacgacatcggcttccgctcgctctacatcgggctggagacggcgtccgagcgcgtgcagcgccacatgcgcaagaacaacacgcagaaggtgatggtggacaacctccagttcgcgcacgacgcgggcatctggagccataccttcaacttcttcggcttcccgacggagacagaggacgaggcggaggagaccgtccagttcctgctggggcattcggacatcctgcactcggagggaacggggaccttcgtcttcgaacacaacgcgcccattcacctgtcacccgagcagttcggcgtgaaggccttcaagccgcgcacggacaccgtgctggacctcttctatgaatacgagcccgccacgggactggacgcggctggcgcgcaggccgtgctggagcgctacaaccgcctcaagcgcgagcggaaggtctaccagcacgggcactgggtggaccgggagcacctgctgctgctgctcagccgctacgggcgggacgcactgaagaaggccttcgccgaggtcgaggattcggaccggggctattccgcggcggagctgctgcggggctatgcgttcgacacgcccgagggcaagcgtcacttcgtggtgaaccggcggttgcgccgggtgtgcatcaccaacgaggacgcggtgcgcatcgtcgggtggctccagttcggcgccaaggtggaggacctgctcaccgcctatcccgcgctgtcggccgcactggacccggtgcccgaggacgtggaggagctgacagcgctgcgcgaagcgtcatgaggccggacgtccgtgtccctcgctcctggagaccccgggcgcgagggacagcgccccgtcatcgcttctggatggcgatgatggggtccacgcgggaggcgcggcgcgcgggcagccaggtggccagcagcgccacgccgcccagcaacacggcgaacacgccgaaggtcagtgggtccgtcccgctgacgccgtacagcaggctttccatgtagcgggacagtccgaaggcggcgacgagccccacgccgattcccaatcccgccatcttcatgccctggtccatgaccagccgcaccacccggcccggaggcgccccaagcgccatgcggatgccaatctcctgggtgcgttgcgagacgaggtaggagatgacgccgtagaggcccgcggtggccagcaccagggcgatgagcgcgaacgcgcccaggagcgtgaggctgaggcgccgccccgccacggactgctggatgatctcctccatggtcatgatgttgtagagcggctgctcggagtccacggcgcgcaccgcgccgcgcagcgtggccgccacgctagcgggcgccgtgcgtgtcttgagcaccagcgtcaccgcttggaagtaccagagcgtggagcgcggatggttgtaggggaggtggacctcggggaggggctgctggtccaggcccgcctgccgcacgtctcccaccacgccgatgatttccacgggctggcccccgatgagcagccggcgtcccacggcctcgcttcccgcgaagtgccggcgggcgagggcctggttgacgatgacgacctgctcggcgctccggccgtcgtcctcggtgaagtcgcggccggccagcaacggtatccccagcgacttgaacaggtccgggctggtcgtcctgaactccgcgaacagcgtcttgcctggctccgccggcagctctccctccacggcgtagtccccgctggtccacgccgtctggatgggtaggagggagatgagcgccgcggactccacgcccgggagcgtccgggccttctccaggatgggctggaagaggcgctcgacgacctcctcccgggggtactggttcggggtgatgggcaggtgggcggtgaggacgtggcgcggctccagcccgggctcggtgcccagcaacgtcacgaagcctcgcagcagcagccccgctccgacgagcagcaccaacgacagggccacctccgtcacgacgagcgcgccgcgaaagtagtggtgcgcgcgcgacggagactgcttggcccctggctcggcgaggctggcgcgcagcggcgtgcgcgtggcctggagcgccggtgtcaggccgaaggtgagcgcgcttcccacggatatcagcaggaggaagccgaggacccgcccattgaggggaaggtccccggtgagtgggaaggacgcccggaccaggttgcccatggtgttcacaccccaggcgcccaggagcacgcccagcagcgcgcccagcagcgacagcagcaggctctccaccaggagctgcctcacgatgtggccccggctcgcgcccagtgcgaagcggacggcaatctcctgctgccgcgtggcggtccgggcgagcagcaggttggccacgttggcgcatgcgatgagcagcaccagcagcaccgcgccctgcaggagcagcagcgtgggccgcacgttgcccgtcaccgtctccgccagggacaccgccgcggcgctccgcccggcttgctgcgcggggtgcgcttcctcgatgcggcgcgccacttccttcagctccgcggcgagcgtctggggcgggacccccgggcgcagccgaccgaggacactcaggaagtgcgagccccggttgtccacccggtcagcggaggggacgaaggggatgaagacctccatccgggcccccgcgggaaagcccaccgccgtgggcaggatgcccaccacggtgtgcggctgtccgtccagcgtcagcgtgcgtccgacgaggcccgggtcggctccgaagcggcgttgccacaggccctctccgatgacgacgacgggcgcggccccgggctggtcatctccgggcgcgaagccggggcccagcttgggcgaagtgcccaggagctggaagaggttggccgtggccgctaccacgctcacccgctccgcgccctcgggcgtcatcaggttgcggccctggaactcgtaggcggccacgccttccagcgaggggagctgggtggaccagtcctggtaattgggccatgacaccgagcccagccacgtcgggtcccgcgctggtgtcgtctcgaagaggcgaacgagctgccctggctcgtggtagggcagcgggcggagcagcaccgcatccaccacgctgaagatggccgcgttggcgccaatcccaaatgccagacacagcacggccaccagcgtgaagaccgggtccttccggagcatccgcaccgcgaacttgaagtcgctcgcgatgtcccccactccgtcggcgatacgggccatgtccacctcgcgcgggtaagcctagcaaaaacagctcacccggcaatgaacccaggcccggaggtgacggtggtcaggccttggaggggatgggcgcgtcccgcgcaatcaacccttccttcttcagtgcctcccagaaggcgtctggaatcgcgaccgtcatggactgcacgttcgccttcacctgttcgggcgtgcgcgctccaggaatgacggaggagacgacggaaggcgcggcggcgaactggagcgcggccgtgcgcaggtcgatgccgtgcttcgcggcaatcgcgctcatgcgggcgcgcttctcctgcacgccgggcggaatggtgccgtcgtagaggtagcggttgcgtccggcgaggtagccggcgtcgagcggcgagcccaccaccacggagatgccgcgcttctccagcgcggggaacgtcttgctcagggcctcctcgtggttcgtcagcgagtactgcgtggccagcaggaagatgtccgggtcgctgacctcgagggcgcgcagcgcgggctccgctcggttgacgccgaagccccaggccttgatgaggccttcctcgcgcatcttcgtcagctcggggatggcgcccttgatggcctggtcgaagtactccgtccacttgtcgcccatgtcctggttgtccggcgacaggtcgtggatgaacacgatgtcgatgcgcgacacgccgagccgctgcaggctgtcctcgacggagcggcgcaccccggcggccgaatagtcgtattggtagttgaagggggaggcgtcgctccacagcagcttcggcggcggcgcgtccgcggcggtgaggatgcggcccaccttcgtggacagcacgtactcgttcgcgtcgcgggtgtgcaggaagcggccgaagcggcgttcactcaggcccaggccgtaccagggcgacgtgtcgaagtagcgcacgccggcggcccaggcggcctccagggtggcctgcgcctgcgcgtcgctggtggacgcgaagccattgccaatggccacgccgcccaggccaatgcgggtggtgggccggaacttgttgcccggcgcgttggtgggaacggaccgggtggcgtgcttgcccttcgtcggcatcaccgtgccttcgcccgcggcgcaggcgagcaggggcgcggcggcgaacgcggcggccccggtggcggcggcggaaaggaattggcgtcgagtccgcatgtcttccttcaggaagtccgggccgggcgggctcgcgggtgcgcgcatccggaaaggtgaaggaaggaccgtgtcggtgacaccgtggtgtgtcaatcggatggcgccgcgattcgccgggcgctcatcacctgactgtgaagcccccagtcccgagcacggggcgtaggggcttcacggggcgcgtcacctcagtggggagcgatgccctgcttctcgctgggcgtctccgtgtagatggacttgaacatcgaggccagcccattgacggtggagccgaaagcctccacgcccgcctgtttgtagttgcccttcttggcgctttcgaaggcgtcccggccgaagttcagggcctcgcgctggtgggcgttgacctcgctgcgttcccccgtctccaccttcttcacgttgtcgatgacgctggcctgggagcgcgaagagatgccgatgttgtgccggtcgagaatctggttcacgccgccgaccgcgtgggcgtagtcgctctgcttgccctgcgtggtctggtcgatctgctgccgcatcggattctggaacgtgtggttctgcttgaccttgaacatggcgtttcccccgtgggccttcgcggccccgcgatgtgtttcttgaaatgattgtcggggtatgtgggcgaaagtttcctgtgcgcgcttttcctcacacaagagcgccagtctgcggcttgtgtgcgagggtggccgcaggcgttggaagaagtcaggcaggctggtttggcggctgcccttgtggacgccgggtgcttcaggggccgcccttggatggcgcgcgctgaggtgagccctccgccgcggcgccatgcttcacgggacatgtcctggggaaggttcccaaggattcgacggcgtagccatccgggtagctgcggatgttcgcgcgctgccgggcgtaggcgggctccttctttggagacagggcgtagcggacgaacgtgccgcgcgccttgagcgccagacggaacaccttgcggctgaggctggacgggtgggggtagtggaacgcgtccagcagggcgtcctccatcagcgtgcgcgcgaagagggtgaccagccgcttgggcgcgaggttcgtcggcgggaaggtggtgagcagctccagggtggcgtccgcgacggccttgctgcgcgcgtcgaaggcgaagtgcgtggcttcgtagccatccatgagcgaggtgaaggcctcgtaggtctccgggatgtcctggatgcccatgtggcggccgacggcgcggtagtagttcgtccagcccgtcacttcatgcggcgtgaagggccgccagccgaagtccgcaatccagcgcaccggcatcaccacgaaggtggagagcacgtagcgcatgtcatcgttggagatgtcataggcgccgtgcatctgattcatgcgccggaaggcgctccggccttcctggctggccatgccgtgctccaggatggtgtccaggatgagcacggtgtcgtcgtagcgcttctgggtgcgctgggtgaactcgtccgtgtcgtgcaggaggacgccgatgctgggcaccgcgtaggtgcggaacagcgcgaagctgagcgcctgttcgacgtcccaggggaactcccgggtggcgaggatgcggacgatgtcttcgtgttgggtctgggcgtcgaggcggtccgtgaggtcgcgcagcgcgaagcggttcatccatcgctcctctgtgaatgcgaacgcggagtctagcccagacagggcctgccgcgcccgctggcgccgcgtcgggtccttgcccgcatggttgctgacgctcgcgcccgggttggcacctttccggcggcgtccgtcccgggcgccggaccaaggagcagcgcgcatgaacctggacccttccacgcagaagttcgtctcggacctggcggcctcgaacagcccgccgctgtacaccctgacgccagagcaggcacgggaagtcctcctcgaggcgcagtcgattccagtgcccatgccagacgcggacgtggaggagcgcaagctgcccgtggggcccaggggctccgtccggacgctgctcttccggccgaaggggagcaaggagcgcctgccggtgctgatgttcgtccacggcgcgggctgggtgatgggagatgccaggacgcacgagcggctggtgcgggagctggtcaagggggcgaatgtcgcagcggtgttcgtggactatggccgctcgcctgagaacaagttccccgtggccatcgaagaggcctatgccgcgacgaagtacgtggcggagcacccggacgaattcaacgtggatgcccgccgcatggcgctggtgggagacagcgtcggagggaacatggcgaccgtcgtcagtatgctcgcgaaggagcgcggggggccgtccatccgcttccaggtgctcttctatcccgtcaccgacgccaacttcgacaacggctcctaccaggagttcgcggaggggccgtggctgacgcgcaaggcgatgaagtggttctgggatgcctatcttccggaggccggcaagcgcgtggacccacatgtttccccgctgcgggcgtcactggaccagctcaacggcttgccccccgcgctggtcatcaccgacgagaacgacgtgctgcgtgacgagggcgaggcctacgcggcgaagctctccgaggcgggtgtcaacgtcactcaggtccgcttcctggggacgcatcacgacttcgtcatgctcaacgcgctggcgcagacgccggcggcgcgaggcgccatcgcgctgaccaccaccaagctgcgcgagtggctgcacgcgaactgagccagcctttcatttctgagagccggccggggagactggcgcgcgcatgacgggcgccggctctccaaggcaatggctgcatgacgactgcctctcaatcttggcggcccccgctgcgttggaggtcgccatgaagcgtctgtctctcaagtcctcattcgctgttgccagttgcgtgagtggtattgccgcgctggcgttcacggtcgctccctcggcggcgttcgcgcaggttcccccacccgagttcagcctggtcgagtgcacgcagggaaaccagagccagaactatgcgccggccatcacgctcttcgcccgcctggtgagtgtgacgggctcggggcagttctcgtcctgtctggatgagacgaaccccgggattgcctttggttcgttcaccatcaccgggaatggcgcggcgagctgtctgatggcgagcgtgcccacccagaacaccgtgacctggaatgacggctcgcagagcgtcatcgagttcatcgatggggtggatgtgcggccggtggggatgacgatggtgacgctgctgggccgggtctccagcggccggtatgagaacgcgctcgccatcaagacgctggacgtgtcgtccgtgcccggggtgacccagtgcgtcctcggcggcgtgcgctccgccacgaagaacgtctcgctgtccctgctgcggctgttctaatcgctgtcttcggtatttgattcgctggggcctgagggcgtggccccagccggggcgaaccgtggctgtcaggaaggcgctgcccgcggggccgcaggtcctcaatgtggacagcagggccgtgctgctcacgtgctgaaggcgcgggctccgcgccggctccccctcagggcctcagtcgtaggaggaatccatcccgagggcgagggtagggcgtgccttctggaagcgagcgcgccaacgcgcccgccgcgaccgtgtagccgctcgaatccaccgccaccgtgcgcgccagggtggggcttggactggtgaagctgcgcacccagagcgaagcgccgtcctccggatggagccgggccacgtagaggcccgcgggcacgtcgccgtcgcccaaatccagcccgccatcatgcgagcccgccagggtgagctgctcggcatcatccgtggccagcgcggtggcggtggccgcgaaggagcgcgcccagcgttccttgccatgggtatcaaagacagtcacgaatccctgatagccgctggaggtatgaggcttcccctggaagtagaagcgcccggagaagttcccaccgacgaagacgcggtcggggcccaccgccagggcattggcggtgccctcggtgccacgcaagtcccggctccaggcgtgttcgccgcctgaagacagcttcagcacgaaaggcgtgcgctgccgcaccgtgacgagcgccggcccgccaaagcagacggaacccgcataggcccccgcgatgtgcacgccgccaaagacatccaccgctacggcccgggccgtcaccaggccttcgctccccgcggcccaggtgcggctccagcgcgtctggccgctggcgtccaggctcaccgcgaaggcggagcgctggccctgtggggattccctcacgccgtcgccgaagtcgcgttggccctggaagtctcccaccagcaccacgccgccagtgccgtccggcgcgagcgcattgacggtgagcgcacccgtgccgccgaagttccgcacgcgctccagcgcgccctgaggcgacagccgggccaggaaggctccgggcgggattttcaccgcgccctgcgcgaagcctgcggacaggccgcccagccacgcgttgccttcgccatccacggtgagcccgcccacgtgcgcgcgcgcggtgtctgcctccggtgtcagcccatgcgcccagcgcagggtgccttccgaagagaagcgcgccaccagcaggtgaggcgctcttgatacgtggttgaaaggcaggggggctgccccaaggtccagaggctcacggtaggtcgccgcgacgaggacgtccccgtcgggagccaccacggcatgtggcgcttcgctgtcccccagcaccagcggacgcgtccacgccaggaccccctcgccctcacctgcagccgaccccgccacctccaagcccggggcgcgggctgccgcgtgcgccctctccccgcaccccacgaggagaagcccgaacgccagcaccccgattgcccatcgccgccgccccaccatccccgccccggtctctcccccaaccccagccccgacaaccccctgcccctcaaccggagaacctcttgtgcaagggcattgccagacgccgtggcggggcggctcccctctggagacggacggaacattgccctcggggcagaggcggatgtcgggcgcgctgaaaaaactccctgtccggcagggaacgtcaggggaaaaacgacggactgcccggccttggaggcaggtgtgtgccgggtgcgccaacgcaaacgcccgccaggtggcctgagggccgctggcgggcgctgaggtgcttccacctgcttcaggggtgaatcagagcaccttgacctgaatctccttcagcacctggtccccgcgcagcaccgacaccgtccaggtgccaggcttgttcagccgcaggcccgtccactgccgcgcgcgccagccctcgcccttgatcttcacgtccttcgtctcacggacgacggcgccctgcttcgactgcaccatgatgtcctcgacggagtcgccctgcggcaccagataggcctgccacagcatcacgctggtgccggccttgatgccttccgggccgacttccgcggtgcactcgtacttgttggggccttccttggcgacctcggtgcagaccttggcctccaccagcacggggccctggccctggcccttgtagaagtagttccaggtgtcacgcaccgcgtccgcgtccggcgccttcacctgcgcggcggcgggctccgcgtcctgcgccatggccaccggcgacatacccagcaccgcgcacagcaggccccgcgtcagcatcttcgccatctcaagtcccctcgttctcgtgatgtgacaggcccccaggcccgccttgccaggctgggtctaccacagcccgcgtcgccgctcagccgaagaggaagaaggccagcgtcaccagcggcaggtacacgaggaaggccaccagcaggaatcccaggagctctttgaactccaagcgcgccacggccagcagcggcagcgcccagaagggttggatgaggtcggtggccatgtcgccccacgcatacgccagcaccaccttctccggcgccacgcccagccgcgtcgcggcgtccaggaggtagggcgcttcaatggcccacttcgagccgccggaggggacgaagtagttcaccacgccgctgtacaggtagacgatggcggggaacgtctcgcgcgtggacaacgacacgaacagctcgccgatgcgctccgtcaggccggtggccttgaagatgccgtagatgcccgcgtacagcgggaactggaggacgatgccgtgcagcacggtgccggcctcctcgctggccttgagcagccgcgcgggggtgccgtgcagcagcaccgccagcaccaggaaggtgaagttcaccacgttgaggttgagcgcgcgccagcctccattcatccacaggtgccgcgccagccacacgagccccaggacgccgatgacggtgttgagcagccgtgagtggtccagccacgcggcgaagccacgctcggagggacgcgggggcggggtgaagtcgcccagggactccagcaccgcggggtccacgcggacggtgttctccggcttcgggtgcagcagccacgccagcagcgtcagccccgccaccacggccagcgtgaggccgatgttgaagggcgagaagagcgtcctgtcgatgggcagcacgcccaggctcttctccaggaagtggcccggcgtggccaccagcagcggcgcggaggcggacaggcccgagtgccaggtggcgcccaggccgaagtacgcgcacgccaccagcagccggtagtccacgtccggccggcgcttcaccatgaagcgcaccagcatggcgctggccaccagggacagaccccagttgacgtaggccagggccatggagacgaaggccatccacgccgccgcgccccggggcgtgcgtggcacccgcgcggcgcgctccagcaacgcgcgcacggggccggtgagggccagcaggtagccggtgaacatcaccagcgccatctgcatggagaagccgagcagctcccagaagccgccgccccaggcgtccagcacggcgggcggcgcggcgccggcccagccggtggccagcgccatggtgagcagcgtgagcaggacggcgatggcgaacgcgctggggacgaagcgcgaagagaagcggccgaggctctccgcgattcggacaagggtctccacgaggtgtcgctccttggcagggccggcacgttacggcatgtgcggcgcgccggcggcgcaatcccgtcgcgagccctggccgcacgagcccgggcacgcaggctcccctggctgaaggggtgcccggagagggagggcggaggttccttccgcgccgcacggtgtcaacgctccaggatgcgccgactgctgagacacctgcgctccgtcctccgcgtccggccaggaaagcccgccattggcgcgggcttgcggaccgcgctggccacctccgtccccctggtcctcgcgttcctgttgggcgtgaaggacgcgagctggggaggcttgaccggtctcctggtgtcgctggccgacaagggcggctcgtaccggacgcgcgcgaaggagctgggcgcggtgacgctgctgggggccctggtgggagcgctgggcgcgccgggcgggtccatgccgtggctggacgtatccttgatgtggctgggggtgacggcggcggccttcgcgcggagctacggagagacggcgggctccgtcggcgggcagctcgcggtcatcttcgtcgtgtcgttgggcgcgcccgcggtgggcgtggatgccgcgctggcccgcgccttctggctgctcttcggcggcctgtgggccatgacgctgtccctggtgctgtggcccttgcggccctaccgcccggcgcggagggccatcgcgcgcgtgtacggggagctgaaaaaggaaagctggtatttgggccgcctgtcgcgcgagggcgccagctcccaggggtgggtggaggc

SEQ ID NO: 1146 - DNA, 17262 bp, Myxococcus xanthus
agggatcccgccctcgccgtccgcgaagcatgcccgccaggacgcgtgccatcgtcgcgggcgagcggagccgacatcccggtgctgtcatccaggtggtccatgggagggtcgcgtccaacgcaaggaggcaacgaggcgccctccccgttggcgtgcctcccgtccaccaacgactcctggacgccattcctcgtcaacaatgttgcctcgtggccacgccgccaagccgcgcactccgacgaggccagcgctcggtgaagaagcccgttataggaagggaccattccttcccttggagccgccatgcccgtcaccctccgtcccgccaagccctcggatgagccctccctggggcgcatgggcgcggcgctcgcccggaaacaccacgccttcgacgccgcgcgcttcatgctcccagaggacgtggagtcgggcttccgcaagtggctgggcagcgaggccgggaagcccgacgcggtcgtcctggtggcggagctggacggcgaggtcgtgggctatgcctacggccgcgtggaaggcatggactggaatgccctgctggaccgcagcggcggcttccatgacatctgggtggacgagaaggcccgtggcgcgggcgtaggcgtcctgctcgcggaggagatgatgaagcgcctgacggccctgggcgtgccgcgcgtcgtcctccacaccgccgcgcagaacgcgaccgcacagcgcctgttcgcgaagctggggtggcgccccaccatggtggagatgacgcgcgaggcgccccctcgtgacgctactgaatgattcgccgcatcgtcgggggatgggccaccgcggccttctggctcggcgtcaggcgcatggacttcagcgacggtgcctgggacggtggcaggccctgcgccagtccgaagacgaagctgaaatccgacgcgatgcccgtcttgccagcgagcgtcgcgttccggtgacagacgatgcagttgctcgcctggggcccctggccgaagtccgcggtccgctggatataggtctccatggtcgtgttggcgatggccactgacccggagggcgtgggcgcggcgaagggcagcggcgccttcacgggcttcgtcgggctggggctgggattggtggaccagagcacgttcaccagcacgtagtgcttccacaccgagtccgggaagtgcatcgcgatgttctgctggaccagttgattcacccgctgcgccatcgggtcgatgggcgtcagtcgcgtcacctggatgggcacgggccccgggcagccgccgccaatgtggtacggcggcggcacgttgggctcgcaccccaccgtcacctccgtggacttcccatccgccgcgcagttggcgggcaccgtcagcgtgcgcggcgagcaggcggcatcgaagaagttccacgcgcccgtccccgcgtcggtgccctggtccggtgcattcgcctcgtgttcgaacgtggcccagatgatggacggttgggactgggtggcatggatgatgtgcagccccaccagcgccacggtcgccgtccggcaccgctgcgtcgacgggtccaccaccacggcgggcgacagcttgtaggtgttccagcgcgcgtcggagggattgggcacttccatccacgccgacttcagctcgatggcgcccaccgagccgggggctggctggtacgcgccttgtggcaggaccacgggcacgcctgaatccaccagggccagctggttcgccgcgttgtagagacccgcgtcgacgatgtagtcgtattcgggctggttgaccttcacgtcgtaccagacgttggtgtctccgggcgcccccagccacgcgggcgagccgtcgaaggggaacgcctggttcgcgctccccgggaagaagttctccgcgaacttcgacgcgaccatcaacggcaggcgctcccgggcctgcgccacggagagccccgcttccgccagacacgcatccgtgatgcgtgcctgcgtgccccaggcgggaggcgcgcccccgtccggcaggaagagctggccggtgctcatgtacgtctgccattgcacgggctccaggtccccgggggtgccaaagccagccatccccccgtccatgccggactcgggccagttcaacgcgatgaactgctgccaggcgaagcagttcgcgtcttcctggcccaccacctggctgaagtccggaggcacctccgggccgagctccagaatctgctggctgccacagttgaactgcggtggagcgccggcgggggctgcatgggcgggagccggagcccccgtctccgcctgggcaacagtccctcccggaggcgcttcccgggaggccctgtccctggcacagccagcggcgagcaacagcgacgccaacgcgacgccaacgcgattctggagcacgggcatgggcacgctcgcgggcctaccgggaggcgacgtgcagcgccgaggggaacggcgtcggtgtcttcgtctgccccgcaccggtgacgaagacaccccgggggcccggcgccgcgtccgcctgcacggagaccaggatgcggatggccgccaccggcccgggataggtgttcccgggcaccgcgtagtccaccgacttcatgtcctgcacctggacggtgatgccgcccccgtcgacggccacggtcggcagcgcggagatgtcgggcagcagcgcggtcagcaacatggggacattcgtgtcaccggccctcaccgtcggggcaatcaaggtgctgttgctggccaggttcatgggcacgcccatgaaattgggcacgttggtaccggccagggcgctgaacacgctggaatggaagagctggagcggctgcgccagctccgtggacggcacgcccacgcagtcctgtaccggcgcgcgggatggctgcgccagccccatgccggtgatttgcatgaggaaggtctgcgccacctgcccggcccagcgaatcttctggccgttgatggtgatgtcggagacggtgtagcgcttgttcggcggtacccggaaggtggcgtgcaggatgtagttgcccggcatgggcctgccatccgggtccgtcagcgacgaggtgcctcggacgatggtccagaactccgccgcgttcgtctggtccggcgtctggtagccagagaagtctggcatctggatgtagagcccgggcggattggccagggtggccttgtttgacggccgctgcggattgggcggcgcgacgagctgattcacggacagcccgatgtgcgggtcgctgttgcgggcgggctggccatactgcgcgcagcagatgagcgtctgcggattggagttgcccacgggacgcggcaccgtcgcggccgacgcgagcccgatttccgtctggagcgtgttgggcgtgctcgtcaggtgcatggcgccaccctcgctcgccgtggacaccggcccgctgttccaccggttgagcgggttgtacgcggggcgtcccgtggacgggtcctccaccggccgtcccgtggacgggtcctccagatacaggtcctccagcgcgatctgccgcttgcccagggtggagcgatacagctccagcaccttgttcgggtccaccgcccacagcgtgttccagtactccggattctcacacgtgaagtcgatgcggaggatgttgccctggctgtcgcgctcgacgctccactcgcaatattcgtcctgccagccccgagggccgaaggggccgtagtggctcacgtccccggtacagggattggtgatttgcggcaggtccgagaatggcgttccatccttcgtccggcccgtgtccgccagggccagcaggtcctcctccggtagcaccagccccttggcattcgtcccaccctgccctccgaagtagaaacccagacggccggggaacgcattccattggatggcggcgtagctcccctgcgccgtgtccgtctgcgcggggttgaaataccaggtgttgttggcggagttggacatgttccacgggttgcccgtgatgccctggtcggtgaagcccgtgaggttgaagttccatgcctcgttgagcttcttctgtgctgtcgggtcctcggggaaatcaatctggttcgccggggccaggaaacgatgcacgccatcgggggaaggctttgccatatcatggactccttttttcgacagccattgacgccaacccttgtcgtgcatgaatgactgcctttcaagacaccccttcacttctcatgaacaagcgtccgacagaaaacccgacttctggactaagggaaaaccggggcggcccgcaagaacagctgcaatcacccgcatccccgcacgtactgcgcgaaatgaaggggaggtctgaatgagatggctgagcacgcgcctcacgggcgtactggtggcatgggtgctggtggcaccgctggcggaggcggcgaaccggaagcaggaggtagaccggtacatccatgggttccaccagaagggcatgttcaacggaacggcgctcgtagccacggaggggggcatcctcctcaagaagggctacggctccgcgaacctcgagtggaaggtgcccaacgcgccggacacgaagttccgcatcggctccatcaccaagtccttcacggcaaccgtcatcctgcagctcgtcgccgagggaaagctccagctcgatgaccccatcacgaagcacctgccggactaccggggcgacaccggtgggcgcgtcaccatcacccacctgttgaaccacacctccggcatccccagctacacgtcagccccccatttccgggccgactcggtcaacccctatggcgtcgcggagttcgtgaagaagtcctgcagtggcgacctggagttcgagcccggcacgaagtacgcgtacaacaactgcggctactacctgctgggcgccctcatcgagaagctcaccggccagacgtatgcgcaggccgtgcaggcgcgcatcttcgggccactgggcatgaaggactccggctatgacgtcaccgccacggtgctgcccaagcgcgccagcggctacacgcccaggccgggcgggtacgtcaacgcgccctacatcgacatgggccagccctatgccgccggctcgctgtactcgacggtggaggacctgtaccgctgggaccgggccttctacggcgacacgctgatgcccgcggagctcaagcagaagatgctcaccccgggccttcagcactacggcttcggctgggccattgcccccgtgcaactgcatgacggcaagacgaagcttccaggtatcttccacagcggcggcatcaacggcttctcatccctcctggtccgcctgcccgagcgcaaggaggtcgtcatcctcctcgacaacgcgacccacggcgacctccaggagattgcgggcggcgtgctgagcatcctccatggcatcgccccccggcaggcccggatgcccatcggcaccgtgatgatggagtctctcggcaagggctccaccgccgaggccatcgccaactaccgcgcgctgaagaagacgaaagaagcccagtacgacttcagcgaatcgcagttgaacacggtgggctaccacctcttgcgcgacgggcgcgtggtggatgccatcgaggtgttcaagctcaacgtggagacgttccccaagggggccaactgctacgacagcctcggcgaggcctacgccgcccacggcgacaaggaacaggccatcgcgaactaccgcaagtccctggagctggaccccaagaacgagaacgcggtgaagatgctcaaggagctcgagcagcccgccgcgacgcggtaggccgcgagccttccgacgaaagcaccgtgccgggtgccgccagcgtgggcggcacccggaagcacgccagggactacttccccttggcctgctccttcgtccatgagtccttcagcgtcaccgtacggttgaagacgggcttgcccggcttcgagtccttcgggtccacgtagaagtacccggtgcgctcgaactggtagcgcgactccacggcggcatccaccagcatcggctcgacgcgggcgtcgcgcagcgtctggaggctggtcgggttgaggaacgtggtgaagtccttggagtcgtccgcgtccggcgcctccacggagaagagccggtcatagaggcggacctccgcgacgggcgcgttgccgggtacccagtgcagcgtgcccttcaccttgcggccatccggcgcgttgccgccgcgcgtggccgggtcatacgagcaacgcaactccaccacgttacccgcggcgtccttgatgacctgctcgcacttgatgaagtacgccgagcgcagccgcacctccttgccgggcgccaaccggaagaaccccttcggcgggtcctccatgaagtcgtccgcctcgatgtacagctcgcgcatgaaaggcacctggcgcgtccccatctccggcttctgcggatggttctgcacctccagcagctccgtctgcccctccgggtagttctccaggaccaccttcaacgggcgcatcaccgccatggcgcgcggagccgtctcgttgaggtcctcgcggatgcacagctccaacaggctcatgtcgatgagctgctgcgccttgcccacgcccacgcgcgtggcgaagtcccggatggacgccggcgtgaagccacggcggcgcaggccggtaatcgtcatcatccgggggtcatcccacccggccacgaagccctccgtcaccagcttgagcagcttgcgcttgctcatcaccgtgtagttgaggtttagccggttgaactcgtactggtacggccggtccccgctgacgaggttgtcgacaatccagtcgtacagcacgcgccggttctcgaactccagcgtgcagatggagtgggtgatgccctcaatcgcgtccgacaggcagtgcgcgaagtcgtagagcgggtagatgggccacgcgtcgccggtgcggtgatggtgcgcgtgacggatgcggtagatgggcgggtcgcgcagcacggggttgggcgacgccatgtcgatcttcgcccgcagggtgtgctggccgtcggagaactcgcccgcgcgcatgcggtggaacaggtccaggttctcctccacggagcgctcgcggtacggactgttgcgccccggcgtggtgaagtcgccgcggtactcgcgaatctcctcaggggacaggctgcacacgtacgccttgccctgcttgatgagctgcacggcgaagtcgtagagcttcgggaagtagtcggacgcgaagaacttccggtcctcccactcgaagcccagccacttcacgtcacgctggatggcctcgacgtagtcggtgtcctcggtgacggggttggtgtcgtcgaagcgcaggttgcacttgcctccgtattgctgcgccagcccgaagttgaggcagatggacttggcgtggccgatgtggaggtagccgttgggctcgggcgggaagcgggtgtgcacgcggcccgcgtactttcccgtccgctggtcttcctcgatgatttcctggaggaagttcaggccctgcgtttcgttcgtcgtcgtcatgatgggggcgaatcctcgtgaagcagccgggggccggcaagggattcctgctccagatgccgccggccgggcctccgggacgaagatggacgtcccgaagccgtgcaggggaacccccgggggggctcatttcatccccccgtccggaaggcgggggaccgggcccctctccctctgtcagagcgacgagagcagggactcccaggccttgagggcgcggtcggcggacagctcctcggagcggcgccgggcccgggcggacaggtcggcccggtgcacgtcgtcctggacgatgcgcgccagggcgtccgccagcgcctggggctgctccatgggcaccaggacgccgtgcttgccgtgctccagcacctccgcggggccggaggggcagtcggtactgaccacggggcagcccagggccagcgcctccaacagcaccatgggcagcccctcgaagcgcgaggacagggcgaaggccgccgcccgccgcatcagcgcatgggggttgggcgcgaagcccggcaggaagacggagtcctccacgcccagggacttcaccagcgccttcagctccgcctccagcgagccttcccccaggatgagcaggtgctggtccaccccggcctgacgcatcagcgcgtggctccggatgagcacgtcgaaggccttctggtgctccagccggcccacggcgatgaccacgggcttgcggaagatgggctccgcccaggcgggcagcgggtgctcaccggcggcgcgcacccggtcgccgtccacgaagttggggatgacgtggagctgctcgggccgcaccggcaccaggtcccggaaggccttcgctgaatcgtggccgcacgcgacgatgcggctcatgcgagggtagagccaccgcaggccccagagctgccgccggggctgctccaggtggaaggcgccccagtcgaagtgaatcatgcccaccacgggcttgcgcagcagccgccccgccaggcacgccagcagcgccgcccggccctcctgccccgccacgatgacgtccacgtcgcgcgcctcgcgcaccagccgccagaagaaacgcggcagcatgccccgccggtactcgaaggcgtcggtgccccacaccacctcggtgcgctgtggaatccggtcactctggctcttcggatggggccggtggtggaagaacatcttcgtgtcgaactgactggggtccagccccgtcagcacgttgcacacggaccgttcgatgccgcccgagcccaggaacaccagcgtgaacagcacccgcttccgagcggctactggaggcgcctcgccctgtgtcgttacgagcatcacccgcactctcacgtgcttcgagacaccgcggtccaggaccttcggagtgacaggactccccccggctccaacctgacccacccgcggtgtaaccaacttgcattcgctccgccaccccctcggctcagctagggttcgctttattccaagccaatcccagatatccgtgaaaacacgcactcaattccgctgtctcatggcgctggcgcccctctgcgtgttgctcgccgcggcgggatatctcgtggtgaacggtcatcgcattggccagggcctgctgcatccgtcgcccattccggtgacacgtcccccggcggagccggcgttgtcgccgctggaggacgtggccttcaccacgtccgacggggtgccgctcaagggctggtacgtgccttcccgcaaccgcgccgcggtggtgctggtacacggcttcgcggacaaccgcgcgcagttgctcttcgaggcccggacgctcgcgggcgcgggctacggtgtgttgctctttgatttacgcgcgcatggcgagagcggcggcgacacggtgacgtggggagaccgggagcggcgcgacgtgacggcggcgctggatttcatctcacggcgcccggacgtggacccgggacggttgggcctcttcggcttctccatgggcggcaccacgtcgctcctggtcgccagcgaggacgcgcgggtgaaggcggtggccgccgcgggggcctatcccgcgctggaggcggacatctacgcgggctatggccgctggggtgcgatgagcgcggagccggtgctgtggaccctgcgccgcgcgggtgtgacggtggacgcggtgcgccccattgacgggatgtgccgactgggcggcaggccgctgctgctggtcaacggcgacgtggacccggacgcgcccgcgaagctccaggccagcctcttccaggccgcgtgcgaacccaagtcactctgggtcgtcgagggcgcgggccatggccagtacgcgcgtgtggcgccggaggaatacgcgcgccggctgctccagcacttcggcgcggcgctccaggccctgcctcaagcctcctcgggcggcgccacccactgaggcgccgcgtccagcgcgggccgctcctccagcaactcgtgcgggcggaaggcgcccttgtagcgcagggacgcgcacgccaggacgcggtagcccaggtagacgtggggaatgccccgcgccttcgccagctccacctggtgcagcacgttggccgtgcccagcgacaggtgcgcgtaggcggggtcgtagaagaaatacacggcgctccaggcgcgcggcgtctcgtcgcagatgcccacgcccaccagcctgggcccgccctccgcgccgtcgtcgtaccacgccacctcgcgcgcggacgggtgcggataggagaactggagcgagtactcgcgcgcggtgatgggtgacggctcccattcgcgcacggcctcgcgctccgaatgccactggcgatacagcgccagccgcgcgtcatccacacgcggcggccccacctccacgcgcaggtgcgcgcacgcggcacgcgcccggcgctggctgcggttgggccggaagccctccacggggatgcgcaatgacacgcaggcattgcagcccacgcaggccggccggaagtacaccaggccgaagcggcgccagcctcgcaccagcaggtgctcgtactcctccggcgtgacgtcctccagcacgaggttttcgagcgaggcctcccgctccggcaggtagctgcaggcccggggcgactcgacttcgtgtgccaggaggaacgccatgtgtggcctgttcctgtcgcgaccgtcgtccggcgtcaagtctgacccggtgacccgaagccaccacttccgggcgagcccccgcttctcagagggaaaagcgtcgtccgcggcacgcccgtctgcccagccgtcaggctggcatgacgtctgcacaaccaacggccagcctcgcggagtcgaggcaggaggatgaccatggcccgccaccgcacacagccttcgctgaaccgcctgtcgcattgggatttcggtcgagcggacaggcaggtccgtgcggccactggcagccatgactgggtggttgtgagcgccacatccccctcccgtccgagtgggaaccgccagaatccggacattcctgtcctacttgcggcggtccgggcacaggtcgagtgcgacccggaagaggtggatggagtggatttcgacctggagttcgcgagctactgatgtgacggggtggcgcgcgggcgtgcggcttctcaggcgtggccgccaacgcgtataagtccgctatgtccgtcattgacgtctcggtggtgatgcccacccacaagcgggagaaggaagtggtggaggccatccgctcggtcctccgccaggaaggggtgaacgtcgaggtcctcgtcctggacgacacgcccgagggcacggcgcgcgaggcggtggaagggctgaaggacgagcgggtccgctacctggtgaacgatccaccgtcgaagggccgcccggccgtggtgcgcaaccacggcgccacgctggcccgcgggcgctacctgcacttcctggatgacgacgacatgctcgccgagggcgcgctgcacgccatggtgagcgcgctggacgctcggccggacgcgggcgtggcggtgggctgggtggtgcccttcggcgacgacgcggactggctcaaggacaagagcgagtacttcgagtgggccgcccaggtgggcgccagcacccccaacagcgcgtggacggtggcccacatcctcttccgcggcacgctgtatgtgaactccgcgtgcatggtgcgccgcgagcacttcgccccgctgggcggcttcgacgccaccatccccgtctacgaggacgtggacttctacctgcgcggcatccgcgcgttcggccacgtctacgtcaaccggcccatcctgcactaccgcaccggccggccgtcgctgatgcacaacctgggcaaggacggcacgctggtggtgcagtccaacgagatgattcacggcaagtaccgcaagacgaacggcatgctggagtaccgcctcatgcaggccgccctgcgggtgctgcccttcgaggtcgcccgccgtctgccgctgcgcctgcgcaaccagggccgcgcgtcatgagcctcaagagccggcttctcgggacggccagacgccaggtgaagcagacgctgcgcccggtgctccagcgggccatggccccggcgcgcaaccacatccccgcctcgcactggggcctgcgggacgtgcccggccagggcctgagcctggagggtgtcccgctggcgcagttggtggagcgctggggctcgccgctgcacgtggtgcacatggcggcactgcggcgcaacgcggagcgcttcctcgcggtgcctccggggcgcacgggcggctgtgaagtctattactcgtacaaaacgaacccggtgcccggcgtgctgtccttcctgcacggcctgggcgtgggcgcggaggtcatctccgcctacgagatgtggctggcgctgaagctgggcgtgcccccggagcgcatcgtctacaacggcccggtgaagtcggaggcctccgtgcgcgaggccatctcccggggcatccagttgctggccgccaaccacgcggaggagatagccgtcttcgcccggctggccgcggagctggaccgccgcccgcgcgtcgccgtgcgggtgacgacgaacagcggctggtccgcgcagttcggcacgcccatcgcgggaggcgccgcgctgcgggcctaccagcaggcgcgcggctcgaagcacctggacgtggtgggcctgcacgcgcaccgtggagaaaccatccgcacggagggcgacttcacggccttcgtggagtcggtgctcgacttcacggacacgctgcaccaggagctgggactggacttggaggtgctcgatttgggcggcagcctcaacacgcccaccgtcgagcacatcgccgagcgcgactggcgcctcaacctcaccttcttccgcgacgtgcccgcgcccgacccggcggcgtcgctgtccatcgaccgctacgtggcgctggcggtggagatggtggagacgcactacgcgcggcgcggccggcagcgtccccgcatcttcctggagccgggccgcgccatgacgggcgacacgcagctcttgctgggccgcgtgcacgcgctcaaggcgggggaagacaggacgtgggcggtgctggacgccggcatcaaccatgccgagtgcgtgcgcaacgaataccaccagctcttccacgtgaaccggccggacgcgccggccgacaaggtttacacggtggtgggccccatctgcacgccgggcgacacgctctaccacgcgaagcggctacccgacctgcgcgtgggggacacgctggccatcatggatgcgggcgcctacttcgtgcccttcgccacgtccttctcctatccccagccggccatcgtcgcgctggaggacgggaaggagcggctgctgcggcgcgcggagacgttcgatgacctggtgacgttcgacgcgctggacagccgcgccgcgctcaccggttgagcaccatcatccggatgaaggcccgggggtggcgcgcggagccgtagagaatctgcgccacctccaccgcggtgggcatcaggtcatccgagtcgatgagcgggtccaccgccacgtcccggtgtgacgccagccagctccgccactggcgggcctcgtcctccggcagcgcaccggacagccgctggaggttgagcagcatctccagcgcgatgcggttgcagaacacctcgccgttgccacgccagtcacgcgcggcccgcagctcgcggcgcagggcatcccggtcccccagcgcggcgtggtaggccaggagcggcagcggcaggccccgggcgatgtcgaagcccatctgcccgtagtaacgggggttgaagtcgatgaggaggaagtcgtccttcgtctggatgaactccacctcgaagacgccgtggtagcccaggcgcttgcacagacgctggagccccgcggccagctcctcgcgcaccggggcggattcgaagcacacgcccacgcccagccgccgcggacgctggagcaccttcatggcgccgcgcacctcgaacagctcgcccgtctcgtccacgaaaccagagaggctgtagatgccctccgccgcctccgggtggaactcctgcaccatggggcgcgacaccgcggggtcgaagcgcaccagcatgggcgcgtacccgtctcgcgagaaggcgcggtactcctccgcgagctgctcgggcgcctgcaccggctgccccttgcggtgggtggagtagagaatctgcgtagtgggcttgatgaggacggggaagcgcgcctcgcgggacaccacgttcaggtccgcttccgattcggggaaccaggtgcgcggcagcttcaggcccgccgcctggcccgcctcgaagagcttgcgcttgttgagcaggccgtagacggcgtcgatgcccgggtcgtagaggtggaagtactccgacagcgcctcgcggtggacggacaccagccacgccagctcatcgctcgtcggatagagcacgtgccgcatcggctcgcggcggcccaggtccatcagccactcgacgaaggcctcggcctgggactccggaggacactgcacgcggcggcccacgaagcgagaccagctcgcgggccccagcttgccggggtccgccaccgtgacgtcaatgccattgcgtccgaagcaacgcgcggccgcgagcgtgccgtagaagcccgcggagaagagcagcacggacggacggccctccattcgaacctggggtgcctgctccaacatgacagtgtcgttctcccgctgcgttcccggcacgcctcacgcgaaggagaggaggtgccgtttcaagtcctggtcgcggcgaaggataaccgcacgcccccccacttggcttccctcggctgcgccctctccttctctgagaaagacgcagtcccctgtcgtcaaaaacagacgccccccttgggcctccaaacaacgtagccctgggacaagagccacgggtcggtcgccactccctccatgcgtgcggagagccccagcgcggcttcgcgaaacgcatcgggtgggtgcgtatggcccagggtccgcgcctgctgccaggcggcgctccatgcggagaagaagtcatggatgggctcccccggacgtacccggcggcgcaaatcccggggcagccagtcccggaagagcatgggcgcaaagcccaggctgaagtcggtgtggaacaggagcgcttcgcgcagcggcagctccgcgccctccccaacgccgcggcgcagcaggtgcgcggccatcaccgcgcccgtcgcgtccgcgctcccctccaccagcaggcccgacggcagcaggtagcgggtcagggtgcggtgcacctcggggacacgctcgggggcgccctggcggagcaggttcatggcccgcaccagccgggcgggctcgtcgggacgaaggggcagcgcgaagccgccctcgcggaaggacgtgcgggcatccgcgtccgcctgcgccgcccgagcgcgctccgcgtccagctccacgcccaccacggcgagctccgggttgagcgcgcgaaaggcctgggcactctccagcgtcgtccacgggtgctcgccgaaccccacgtcgacgaagaccgcgtgggcccagggcccgtcacggcgttcgagcaacgggcgctcgaagcggcacaggaacgcgtccagcgcgcgcaggcgcccgcgcgacgtccgtccccgtgttttcgtgtccagcggcggcatggtgcgctcttgggtgagtctggcgtggtcgtcaagcccaccccgctccctccccccgattttcgccggacacggcggccccctagagtggaaccaccgtggaagcctcgtccccccaggcctgcccccgctgccagtcgcctcgcgccgccgggccggagtgcccccgctgcggcatcatctacgccaaggcggaggcccgggcggcgcggcagcgcgaggaagccccctcagtggcgcccggggaaccaccgccgctcgtcgaccccgcatggctggcgacgcccgacctgcgcccggacgtgctgccaccggagacacccgcctgggacggcgacgccgaggaggccgcgttcgagcaccgcctgcgcacctgggccatccccgtggcactcctggtgtcctacgtggcgctgaacggcaacttcagcgccttcgcggcccggctcatcaccatgccgttccatgagctgggccacgccatgacggcctggttctgcggccggtccgcgttccccacgctgtggaagacggccatcttcggccgctcctatgtcctcgcgctgatgctcgccgcggtgctgggcgcgtgggcgtggtgggggtggaggcgccgtcagtggctgtgggtggcctgcggcgcgagcctgctggcgctccaagccgtgggcacgctgctgctgtcgccgcagacagtggacatgctcatcaccttcaacggcgatggcgggatgatggtgctgggcacggtgatgatgctgaccatctatgccccggcgggcagctacctccacaagcaggccctgcgctggggcttcctggggctcggtgcgctgtcgctcatggacggcctcctcacgtggtggaagtcgaagaaggacttcaacgccatccccttcggcagaatggaaggcgtgggcctgagcgacgccagcaagctggtggggatgccccacaactggggcgagcaccagctcatcggcaggtacctgacggtggccaccgtgtgcttcgcggtggtcgccggggtgtacgtggtgcagttcgtgcgaggccgggcccggctcgccgcgcgctgagtccccgcgcggcggacgcgtcacgccgcgtcgccgaaaggccacacgaagccagggtggcgcaccacctccggtgtcctcgcgcccttccagcgcagcgactctcccggccgcagcaccaggggactgggaacgtccttcatcgtccgccggacctcggcgagccgctccggataggggtccgcgtccgggttctcatccaggtgactggcgccgctcacgggctcgccggggtagcccgcgtagcgaggccccatgccctcgcgccagtaccagggcgccccgccatccgcgcagggcaccacgtagcgcgcgcccagcaaggcgccatagcgcagcgcctcctcgggcccggccatgagccg

SEQ ID NO: 1147 - DNA, 19455 bp, Myxococcus xanthus
  unsure (1)..(19455): unsure at all n locations
actggtgaagcgctccagcccggcgcgacctgagccggatccgctgaaagcatatggccgtgcaggctggtcccagagtgcaggtgccccacagccatccaggccggaggcctgacggtagtagtttcctcccgaggcccactggagggggcagcgcgctgcccatgagcccatccccgctgcgaatcgtcacctacaacgtccgctacttcgggcacatgctccgcggcctggcgagcaccgtgggccccaagcggcgcgtcgctgcggcgttggcgtcgctggacccgctgccggatgtcgtctgcctgcaagaggtggagacgtcctcgctgcgcagcaacatcgccgaccggcccaagcaaccgggcgagacgcagctcaccgccttcatgggccggatggtggagacgttcgacaggctgggccgggagatgccctacgaagccttctacttccgcgcccaccactacaagctccgcgaggtgtccctctacaccactgggctcgcggtgctggtgaacacgcgcaagctggaggtggccacgcacaacgtgggcgccccccaggccatcacccaccaccacgtccaacggctcaaggaccggaagcagagccgcatctgcgcgcacatgcgcctgctgcgccgcgaggacaggcaccccttccacatcttcaacacccacctcagcctgcccacgcccttcgcccgtgagttctgggccacgcgcgacaagatgggcggcggcgtcaaccagctccacgaggcgcgcaaactgacggagttcatgcaagggctgaccggtgacgagccctacatcgtgtgcggagacttcaactcaccgcccgcgtcgcccgtataccgctacctcaccaccgatggccggctcacctgcgcacaggccgccgtgggacagattgacccgaacgtgtcgcgcggcttccccaccgccggcttcttgcacatgcggatgcacctggaccatgtgttctccggcgcgggcgtgcgctggctcgacacgcaggagacgtctcctttcggggacctccgcagccgcttccacgggttgtccgaccacatgcccatcgtcgcgcgcttcgccttggacagcggcaagacgctcatcacgcctccgccgacgtcgttgctgctgtagccacgcgggctcacgcccctccggacagcgctcgctccacctcttcccacgcgtccagaatctcccgcgtgcgcagctcggcgagcgcgtggaactccggcgccaggtgcgccaccttgtccgggtggtactgcaccaccagcgccctgaaggccttgcgcgccacatccaggggcgtcccgggcgcgatgcccagcaccgtccacgggtccttcctcggcggctcgggcggcggcacgcgcgtaccccggggcggcgtggcctcatcgtcccagccggtccgctcccgcgtgcccgtggcgcgggcgttcgtgccaccgctcgcgggccgtgggggtgagcggggcgcgggctccgcgcggcgacgtcctggccgctgggccgggtccggcgggggcacgcgaggggtgagcctgctcagggcttcttgcaggaaccagaggtcctcgaacggagtgccctgcttgcgcaccaccgccgcgggccggccgtcccgcagcagcaggtagcccgtggacgccgcgtaggcgtcatcccggctgccggggtggagccggtcgcccaggtcccccagcgggtctctccacatgccatccgaggtgccctcatcggccaccagcacctgtgacaacacgtcgccgtggagccgctccagcgtggcgaagggctcacggacctccggaggacgcatggccgcgccgtgccggacccctgtcaccagcaacaacccacgggtcgaatccacccgggcgaagagctgctcacgcacctgtctatcggagaagaagaggacccactgcacggtggtcagagactacccggtcgacgccgttccgcgtgtgttcaggtgcatgtcatgaacgccccagtggggaggggcgcgaccctggcgtcatcttcatgacttcgtcgataaacgacgctcatcggcccccgggtgcactcctcctcgacggtgaggcgggcttgcggaagagtccccggtgcccatgcgctgctgccaccgtcacgcctccgagtccgtcccctccggcccccgtcccttctcccttcctggcgccaccgagcactacgccgccgagcggccggtccgcgccgagcacgtccgcatcgaggtcgacctcgatttcgacacccaccgcatcaccggcctgtgcaccacgcgcgtctccgccgtccgtccagtccacaccctcaccttcgacgcggtggacctcgacgtgtccgacgtccaggtagacggccgcgccgcgcgcttctccaactccggcgcccacgtccgcgtggagctgtccgcgccgctcgccgccgggcaggcctgtgaggtggccatccgctacacggcccggcctcgccgcggcctctacttctgggcgcccgacgccgcctatccgcaccgtccccaccaggcctggacacaaggccaggacatcgacgcgcgtgcctggttcccctgcctggacacgcccgcccagaaggccacgtccgaggtcatcgccaccttccccgaggcgatgacgtccctgtccaacggcacactggaaagcgaccgcgtccacgatggccgccgcacccagcactaccggatggcgcagccgcacgccccgtacctcgtcacgctcgtggtgggtgaattcgaggaggccaccgacacggctggcacggtgcccctgcgctacctcttccccaagggccgcaaagaggacgcgctgcgctgcgtgcgccgcacgccggagatggtgcgcgtcttccaggaagtcaccggcgagccctacccctggagcagctacgcccaggtcttcgtcaccgagttcatcctgggcggcatggagaacacctccgccaccagcctcacggacaccgtcctccacgacgcgcgcgcccaaccggactacaacgccgagccgctcatctcgcacgagctggcccaccagtggttcggggacttgctcacctgccgtgactggccccatggctggctcaacgagggcttcgccacctggctcgagatgctctggaaggagcgcgccgacgggcaagacgaggccgaccagcaccggctcgtggacctggaggcctacctgggcgaggcgcgtgagcgctatgcccgccccattgtcgcgcggcgcttccacgcgcccatggatgtcttcgaccggcacctctacgagaagggcggcctggtcctccacgagctgcgccgccggctgggcgatgacctgttcttcaagggcctgcgccactacgtcgcgcgacaccgccacggctccgtggagacggtggacctggcccgcgcgttcgaggacgccacgggccacaacctggacgccttcttcgaccagtacatcttcgcgcccggccaccccgagctgaaggtcgacgtccgctacgacgccgaggaagcgcggctgcgcctccaggtgcgccagacgcagtccacggcggacggcgtgcccctcttccggctgccgctggatgtggcgctcaccgtggacggccgcgacaccgtccaccggctggaggtgacggacgcggagcacgcgttccacctgccctgccccagcgcgccctcgcaggtgcgggtggaccctcggcgcggagtgctcggcacgctgacggtggacaagtccgcgggcctttggatggacgagctgcgtgccgcgccggagatgcgcgcgcgcaccgaagccgccgtggccctgggacgcgacggcagcccccgcgccgtggacgcgctgggcacggcgctggcggacgcgcgtttgttctggggcactcgcgccgcgtgcgcgaagtccctgggccgcatccgcacccccgattcccgcgcgcgccttctggacgcgctgtccaccgagcatccccgcgtgcgccgcgccgtggtggcttcgctgggcgagttccgccgcgatgcggaggtgacagcccgcctgcgcgccctggtgaacggcggtgacaccagctacttcgtggaggcggaggccgcccgcagctatggccgcgtgcgcgcgccggacgcgttgggcgtcctggaggccgcgagcacccggccctcgtaccaggacgtcatcgccgtgggcgcggtggatgggctcgccgagtctcaggaccccgccgccttctcggtggtgctggcgcgcaccgcctatggccacgcggctccgctgcgccgcgccgccacgctcgcggtggcgaagctggcggaggtcgcgggtcgcaagcgcgaggccgtggacctgctggcggagctgctccgcgacccgctcttccgcgtgcgcatgggcgtcttcgaggcggcgcgcacgctgggggattcacgcctggtgcccgcgctggagcagacgccactgttggatgccgtcgcccggcgcgcggcgcgcgagacggtgcgcttcctgcgcgaaggtgaaccgcaagtccgcgaggtggcatcgctgcgcgaagaggtggaccgcctcaaggaggagacacgggccttgcgcgagcggttggaagggctctcgctgaagccccccgaaccgccgcgtccaccgcgcgggggcgcgaagccggcgcgaaagcaggtcactgcgcgcacgaagacagccgcacgcaaggcgggtggccggaaacgcaaggccacgcgccgctagacaggggcccgctcgctcgcctgcacgtcgaacttggcgtccgcacgccgaccatcgacgttgacggcgcgggctgtgcctccaatacctacttgtatggaaagggacacgccctccgcatttcgcgtcgaggcgtttcgagctcccatgtcccgggacgctggcaacgacgaccagcgggtttccgaggagagcatggcctcaggcatcgacgaactcagcgcgtggctggacgccgccgtggaccctttcgtggcctgcgacgccggtgagaacgtctgctttctcaacgccgccgcggagcgcctgctgggatggacgcgagaggagctcatcggccagccggcgtcccggctctttccccagcggctgcaccgccacgaaggcgtgagcctcctgcgccacctgctctcccggcgggccgcgctcggagggcgagcgacccgggtgctcgcacgtcgcaaggacggcgctgaaatcatggtggagctgacggtgggcgcctccggcaaaggccgggatgagcgcatcgtcctcaacttccgccgcctgcacgaggtcgtcgacaccctggccgagcccgtggagcgcacgctgcacggactcgagtcggagagcgttcctggcgacgcgctcttccggaccgtcgtggagcacgcgcccatgggaatcatctacttcgaccggagtgccatcgtcatcgcgtgcaacgagctgttcgtgagcatcatcggctcacccaagcgcttgttggtgggcctcaacctcctgtcgctccgggatgagggcatcctccactgcgtccgggagacgctggcgggacatacctgtgagtacgaaggcgagtaccgcgccatcacctcaggcaggaagacgccggtccacgtgcgcttcgccccctgcttcaacgcggccggacaggtggagggcggcattggcatcgtcgaggacatctccgagcgccgccgcgcggagcgcgagcgcgagcgcctgtaccgtgaagcccaggaggccatccgcgtgcgcgacgacttcctgtccatcgcctcgcacgagctgaagacacccctcaccccgctgagcctccggctggccacgctggagcgccggctggcgcgtggcgagctcgtggagtcctccaccttgcgtcaggcgcgcctgtacctcttgcgcatcaccagcctcatcaacgacttgctggactcctcacgcatcgaggcgggacgactggcccttcaccgggaggccacccggctggaaggactggtggagcacgtcctccacgagctcgagccccagcgcggcaaccacaccgtgcggttcgacgcgcccgagcagcccgtgcaggtgaacgtggaccccttccggatggagcaggtgctcgccaatctggtggagaacgcgttcaagtacagcccgaatggcggcaccgtgcgcgtgagcttgcgccagcgcggcgggctggcgctcctgtctgtctccgacgaaggcatcggcatccctccggaccagcagaagctgctcttcgaccggtacttccgggcgcgcaacgcctccgcccattccttcggtggactggggctggggctctacatcagccgggacatcgtcgagcgccacggcgggcgcatctgggtggagagcgagccaggccatggctccaccttccacgtcgccctgcccttgatggcgggcgctcccgcgcagccgaacgtcgaggaacccggacagctcatccactgaaactccgccaccccgccttccgcaaaaatgacaggtgtgggtgtcttccattggccaagaggcggggggaagcgcctggattcgcacgcttccggcgctggcatggcggctgctctatcgaaaggcggaggatgcacctcgagggaggatgaccatgacgaccgacacgcctgcttggactcgtgacaatgaaggctggctcgtccgcgtgaaggtgggcggacgcatccaggaggtgcgctgcaccacagagagccaggcccgctacttcgccaccgtgttggcgatgaacccgcccaagccgtcgaagctgcgcaactagggtggctcaggggttgaggcggacgatttcggcgttgagcacgttggcgaagcccacccagcccaggtacggcaccaccatccaggccgcagggcggtccacatccttggtgacggcgacatacgccgtcacgctggccagcagcgccaggttgtccgccagggcgcggcgcggctggtgtctgccgaagaagagccaggaccaggcggcgttgcatcccatctggatgccccaccaggccagggcctgggagcgggccgcgcccgcgggcgccgtccatacacgccaaccagaaagggcgatgaggccatacagcaccgtccataccggaccgaagaccttcggtggcggctggaacgagggcttgtgcagacgccggtaccagcgcgtgtccgccgagctgacgcgagcgcccagggccgccgcgcccaacgtcagagcgccgaagacgcccagcgccaccacggactccttgcgcagcgtggggttgagcgccgtgcgccgcaccgggtcaggcatgtttcgcgtcgtcggctccagcgtccagtccatccgcgtcctcccttggcggagcacccgccagtgtcgggtggaaggtggtaccgacgcctcccagccgccaccccggctggcgccggtgtacaaggcggcttcccctcgttgacgaagaggcgtctcatggcgagcgcagaggaaatcctgagcttctggttcgggcagccacgtgagcggtggttcctgcgggacgaagccttcgatgatgaatgccggcgccgcttcctgcccgccgtcgagcgcgccgccgagggcgagttggacgactggcgggacgagcctcgcagctgcgtggccctgctcctgctgttggaccagttcccgcgcaatctcttccgcggcacgccccaggccttcgcctcggacgcgcgggcgcgcgaggtggcccggcacggattggcgcgaggcctggacatggccctgccgccgctgtggcggtggttcatgtacctgcccttcgagcacagcgagtccgtcaacgaccagcggctgtcagtggccctcttcgaggtgctcgcgctgtatcactcggacagccgggcagcgctcgactacgcccggcaacaccgggacgtcatccagcgcttcggccgcttcccgcatcgcaacgtgacgctgggacgtccgacgactccggaggaaaccgtcttcctccaggagccgggctcgtcgttttgagcattacatccgcggccagccagccacgcacccagaggaggtgctgcacctccgaatccagcgcgagctggaagcggtccgccagcgtggcatggcccaggtcgcgggccagctcgatatgtcagtgaggccagggaggggtgacgtcagaggctccagtggcccgcccggatgcctgctggggcacccactgaaatctcgggtttctccgtgagtacacggccgacacgcccggacatgcgaggtgactgcccatgcccctgccgctggggtagtgtccactccagcacgcttcgcaagagggggacgtggcaggcgagcgctggaagacggtccgttcacggtggcagaaccactggcggctgatgctgggcgtggcggtgctggccaccacgctggccgccgtctgccttcacttcgacgcgaagctgggcggcctgctggaggaagcggagcgcaccgcgtacgacaccgtcgtcacgcgattcaccgcgcgacgcgaggtgtcatcccaggtggtgctggtcaccatcgaccagccaagcctggagcgcatccgcgccaacgaacagtacgcgctcaacttcggaagctggccctacagccgcaacctctgggcgcgcgtggtggaacagttggaagccgagggtgctcgggccatcgtgttcgacgccgtcatggacgagcgcggcacggacgagtccatggacctggccttcgcgcaggtgctccaggagacgtccatccccttctacctgggggtctccacccacgcgaacgcgccgctgctgccccccgctgacttcggcgcggcggtggcggtggaccgccccactcaggaggaggacaccttcccggaggaagccggcgcggaaacgttcgaggacggcgccctggaggcggtccttccctccgcttctccggagcagcttgcccgggccatcgcgtttccggtgcgcgcgaacggccggacgctgcccgcgctggattacgcgacgtcctcgggggagcggctccccagccacccggtaccgcccattcccgtgctggtgggcgcggtggatggcttcgggctggtggagccggagtcggacgccgacggtttcatgcgccgcacgcgcttcgtttattcggatggtcccaatgccttcgcgacgctgccggtgcgcgtggccgcgggcctgttgggcgccagcgccattgagttctccgggcgcacgctgcgcctgggctcgcgcacctacgccgtggatgcggatggcagcgctggcatcgacttcggcgggcagttgcatgaccgcttcacgagcgttccgcttatctccgtgctcgacgcatgggtgcaccggggacagggccaacccacggggctgccgccggacgtcttccgcggcaaggtggtcatcattggcggcaacgcggtgggcctcaacgacgtcaaggccacgtccttctcgtcgcatgagcccggcgtggtgaaacaggcggcggtgctggacacactcctgggcaacggccgcttcatcacccgcgcaccgctgggggtgagtctggcgctcgtcttcgcggtggccttcgtgtcggtggtactgctgatgacgacgcgctggacgccgctggagattgcgtggccgctggggctctacgccggcatgagctgggtgacgggccccgcccttggactgacgaacacctacgtgctcaccgccctgcccgcgctggcgggcgtgctggccagcgtcagtgcggtggccttcaaccacctggtggccaacgaggaggcggctttcatccggcaggccttcagccgcttcatggagcccaagctggtggagcagatgattgcccagcgcgagctgcctcggctggatggggagaatgtcgaaatcaccgccttcttcagcgacatccgaggcttctccaccttcagcgagcgcttcaaggacgacccgcgcaacctggtgcgcctgctcaatacgtatctgacgcgggtgagcgcggcgctgctgaaggaaggtgggtgcctggacaagtacatcggtgacgccgtggtgtgtctcttcggcgcgccgatgcgacaggcggaccacgcactgcgcggctgcaagggcgcgctcgcggcgaaggcggcggtggaccggctgcgcgacgagttccgcgcccaggggctgccggacatgtacacacgcatcggcgtcaacaccgcggtcaacttcgtgggcaacttcggcagcgagcagctcttcagctacaccgcgattggcgacgggatgaacctggccgcgcggctggagggcgcgaacaaggcctatggctccgtcatcatgattggcccgcgcacgtacgagctggcgcgcgagcacatcgaggtgcgggaactggaccgggtgcgcgtggcgggcaagacggaggccgtcaccgtgtacgaattgctcgcgctcaagggcgggctggacgcgcgcaagcggaagacggtggagcgataccacgcggcgctggcgctctaccgcgcggcgcggttcgaggaagcagcagcggtgctgaatgcgcgccgcgcggaggacccggaggacgggcccacgcaggcgttgctggagcgctgtcaacgatatgtgaaggcgccgccgcaggacttcgacggcgtggcgaacctggacaagtgagcggtgcggaaaggagtcggggagacatggggatgaagacgcgggtggcgtggaccaccgccctgctggcgctggcgattccggcgggagcgtcggccgtgaaggtcggcgagccgctgtacgtgaaggcgaagaacacgcgcgtacaggtgagcccgtccggctcggacaacgccgtggcggtgctccagcccggagagcgggtgacgtggggcggcgcggatgcgaagcacaagcagtggcaccgggtgaccacggccaccgggaagaagggtttcgtgttccagacgaacctgtccaccacgccgcccaacatggagctggtgacgcaagggaatggcacccagcaggtggatccgaagaagttcgtcgccagtggcgccgcggtgaaggcgctcagtcccggcgcggagcagtacggcaaggacaagggcggcgaccacggcaaggccgtgcaggacatcaaggcgctggaggcgctggcgaagtccgtgtccacggcggacatcgccgcgcacgtgacggcggcggggctcttcccggtggtgggcgccagcgacacggtcgcgaaggccgggacgaacaagcggagcggcaaccgatgatgcgaacgggctggaaggtgctcgcgttggtgggtctgggcgcgctgacggcgtcctgcaagggcttcaatgcgtcctcactcacccggggtgagaacatcctggggaagctgagcgccgcgtccgcggaagccaagacgtgcaagaagctgcgcgccgcccccagcgtgcaggaggagtacgccctgggcggcgcgctggccatcaacttcgtgcggcggggtggcgggctgctactggacggccccaacgacgcgctccaccgctacgtcaacgtcgtggggaagaacctggcggcgcaatccgcgcggcccacgctcgagtggaccttcggcgtgctccaggacacgtcccagttcaacgcgatgtccgcgcccggcggctacgtcttcgtcacccggaagctgctccagggactggagaacgaaggacaactggccggcgtgctggcgcacgaaatcgcccacgtcacgctcaagcacgccatccaccagtacggcgacgcgaaggtgaagacgtgcgagctggtcacctacggcgaggccgtgctctcccccaccgcggtgaaggtgctctccgcgggccgcaacggcgacgggacgctggatttggaccaggacccgggcctgctgggccacctgagcgagaagaccatcgacctcatcgacaaggggaacgccaaggagcaggagctggaggcggaccggatcgccgtcgagctgatgctctccgcgggctacacgccggacgactacctcgccctgctggccaagacgaaggacgggggcagcaccttcgccaaccacccggggaaggacgagcgccggcgcaacatcctcgcgcacgtccaggcactgaaacagccggctggcgccttcagtggactggccaccgaagggctccgctcgccgccgctcagccccgccttcgccgccgtgcgcggtggaaacaacccacgcggcgtggcgaaggacgggaagtagccaggcggcttcagcgcaccgtggcctgactcagggcccggtgcaccgactccagggccttgcgcgcctcgagcaactcggcgcgctcggcggtgagcgaggccacctgctgagccagcacgtcgcgctctccctggagtgcttccaccgcgcggtgcagcgacgtggactcgtccttggcggactccagctcaccggcgagccgctcctcctcggccaggctgtccaccagggactgcttgccgcgggcgacctcttcttccagggcctcgcgctccttggcagcggcctgaagcgcctgccgcgtctcctggagcgacagcagcgcctcgtcgcgctcgccctccagcgcggacagctcgcgctccaggtcggccagcagcttcacccggccctccatctccgaggacaggcggcgcgcctcgtccatgcgcaggcgggcctcttccgtggccttctccgcctgacggcgcgacacctccaggtcctgcgtgagggagaggttgagcgccttcaccttcaccagctccgcctggaggtgggtgatgcgctccacggcgcgctgacccgcctccgccacggtggcgggcagcggctccgggcgcggattctcccgcaccgccttgagccgggccttcagtcgctcacggcgggccgaggagtcctgcccgtcctcgcgcggcggggccggccgctgcacctccacctcggtgggcggcgcttcgacacgggccaccggctccgcgacggtggcggtgacgtgcggcatggacacgggagccgaggcctgcgtcatggggtgcgcctccggaggaggactgacggcgtcgaagtgcagcgcaggaggcggcgcggcgaaggtgacgggcccggcgtgcggctcggtgtcgagcaacgcctccgcctccggcggagccccgtacgtcacgggcacgtcggcgaccgcttcgggctccggcggcggctcctcgtagacgggcgcgtcgtccggctcgcgcagggcggcgtccatggcctgggcggcgctggggcgcggggtgcgggcgcgctcgatgcgggcgcgtacctcggcggagaggtcgggggcctcggcgacgggctcgggggtcgcttcggcctcgggctcgggaggcgtgggctcgacggggtcgacgaggcccgtcagcgcgcccaggcggaggcgcggcttggcgcgggacacgttctgttcaaaggctttcttcatggttctcagccggcctgctgggtgcccttcgtctgggcgacggctgccgcggccaccagccggggcaggatgttgtcaatcatggcctggatgtcgttggcccccttggacgaggggtccgcgacgaacaccggccgcccctcgctggaggcctgcgcgaacttggtgcactgccggatgatggtgggcagcaggaactccggatagtgcgtctggagcgcctccagcgcctccttcgccagcttgaaggtggcgttgaaggagttgaccacgatgaagacgtggtcgagcacgtggttcaggtcctcctccaggctctgcaccgtttcgaacagcagcttgaggccgtggaaggacaggaagtccgcgagcacggggacgaacaagtcgttcgccgccatcagcgcgttgaggttgagcaggccgaaggacggcggcgcgtcgaagacgacgacgtcgtactgggcctccacgtccttgagggcgttgcgcagcttgaattcgcggccggccatgggcatcagcgcgaggtccaccgtggacatggtcaggttggacgggacgaagtccaggttgggcagcgaggacttctggatgaccttggccaggggtgtcttgcggacgaggacgtccaggagcgtcttctcgaagtcctcgccctcgtagcccaggcacttggtggcgtggccctggctgtcgaggtcgatgagcagcaccgcgtagcccagctccgccaggcgccaggcgtaggacgtggacagcgacgtcttgccggtgccacccttgaagttcaggaagagctggcggcggtggcccagccgcgccgggaaacggtcgagcgtggtgcgcagctcccagatgtcgtccggcgtgtaggcgtccttccgcgattcctccggaatctgcttcggggacacgccgagcatctcggcgacctgcttggagctgtacgtcggcgcttccatggacgacccttcgaaagacgtgcgggacggctaccttgcctcaagcggcgaagtatttgtgcccccttcgaatcaccgctccccgtgcggacaacagagtgagcgcctcctgggcgagctccgagggcgccgagagcgcgaccgccagctcgacgagcgagcggcctcggacggcgacgcggacctcggccagcatctgcgagcagagggattccaccggtgacgcactggggcgcgagggggccgccggacgggacggccctgcggcggcagcgggaacacgcggcgcgggggcggcctgcccgggcaccgcgcccatggccaccaaggccgcttggacgggggacaggcgagcagccggagcgcgcggagcctgcgcgggactggaatggcttggggtgacctgcggagctggcgcaggcggacgctgcacgggagcggcggcctgtggcggcggcgcgggcgaacgctgcaccggagtggcggcctgaggagttggcgcaggcggacgctgcacgggagcaacggcctgtggcgttggcgcgggcgtcggagccaccggcgctcccacggggcctgctcgcccctgcacaggccccaccggaccagcgccctgcgcgaggcccacggtgacggcctgccgattcgcagcccccacggcggcgaccgcatgagcgggctgctcgaccgccgccaccggcgcctgaaccaccgcggcgacagccactgccggcgcgaccgcctgcaccgaagccaccaccggacgaggctgctccagccgcgcccgcacaggcttcacaggcaacgtcgccagtcggcgaatctcccggcggcggtgggtctcgtccaggtccacgaccgaggacacgtcctgccccaggatgcgcgacagactctgcgcggccgccttgcgaacgcgctgctcacggtcacccaaggcgcccagcagcagcgtgcgcgcgttctccccagcgccagctccgagcgccagcgcggccagcgcgcgcgcctccggatccgcgtcgtggatggcttcctcgcccagccgccgcgccgtctccccttccaggcccagcgccagcagcgacgcgcggcggcgcaccgagcggtccgggtccttcatcgcctgcgccagatgcggcgccgcgtccttcggcgccagcgtcaggagcgccttgagcgccgcgatgcgcacctccggcaccggggacgcgagcagcggcgacaccaccgacgcgccctcttcctggcacagcgacgcgaaggcctggagcagcgccacctgcgccgtcggatccgtctccgcatgcagcgccgacgccagcgcgggcgcggcggccggctgtgacagcgccttcaatcgctccgcggcacgcactcgggccgcgccatcctgcgcggacagctcgcggatggagaacccgaacaacgtctcatccgtcggcccaccgaaacccgcgtgcgaggacagctccgcgtgctgcgccgcgctcacgcccaaccgtcccgcctgcaggaagcgctgcgcctcacgcgccaccggagacaggccgtcgcccccgacgacagcggccacgggcggctcgctcaccggcgccggcgtcacggggacactggccgccgtctcacgcagcggcaccggcgagcgccgcgtggggaccaccagcccgcgggccaccggacccgcctcaccgcgcagcagcacctcgctgcgaagctgggagatgaacgacgccaggtcgagccccaggtcgtcgtcctcgtcgtcgcgctcctgggcggtggcgcggatgcgccccacgtccagcagcttgtccatcatctggttccgctcgccgcgcagggcctggttgagccgggccagttcctcgcgttcggcctggagccgacccacgcggacctccagctccgcgacctcacggcgcaggcccagctcgcgctggtgcgtctccgcgacctcgcgcttgaggtgctccatctcatcgcgcgtcgaagccagctcgctgtggagctgttgggcacgcgcctcgaagtagacgatcttttcgagtgcgctcttgagcagcgcgtccggacgctcgtcgctcacgacctcaacagcctccccgcgaggcacgcggcgcggcctgcggatccgagtcaccgggggtttgcaccggattcccggtacctaccggggggcccaccctacgtcagacgtcctcacttcgtaaaccacggaaacaccagggcttttttcaacgcgtcccgggccgtcattgacaacaccgcgcaggccgaattttcggcttccgcgcgcacgagggggccgcgagagacacgcccgtctcaaggggttgaagcgctcgattccggacgctccagcaggccctcccggaagccccggaatgtcagaccccactcgtaatctgtgttccacgaggcagccaacggccgtcacttctccccggagcctctccgcctggatgcggggggacgaagccctcttttcgacaggttttccgcacgccatggaacaacgactggcaaccctcattggaaacgcggtccgcgcggcgcgacaacggctggagctgacccaggctgacgtggccgagcgcgttggcatcgccaccgaggtgtatggccgcctggagcgcggccacatgctccccagcgtccgcacgttgcgcaagctgtgcctggtgctcaactgctcgtcggacgtgctcttgggaatggcgggcgtggaaggcgcgcccacgctggcggaggatccgccggaataccgcgagcgcccggaagtccgccggctgctgcgcacggtgcgcaagctggacgcaccgcgtcttcgcctgttggggcaggtggcgaacgcgctcgagacgtagcgatacagcggagacccggccggggcggtggagaccctggctgggacctgaagggtggtgaggggccggacggattgcgccctggcgcaagcgcttggcgcgtggagtgaagcagccgctgctgggggggcgtactgaatgcttcatgaccnccgcccgccccccgcccccttcagccgacctgccgcagctcgcagttcatgcgttgtggtgggggtggttcccagccttcatcttgagctgggacgcgcttccctgggtggggcggctggccatgtgcctgctgggctgggccatctgcttctggaactacgccgtcctgcacaaccacatgcacgtgtccatcgcacggcctccgctggcgcactgggtggtgtcccgttcgctgggcatggcgtgtgggttcccctaccggggctacttcatccaccacttcaaccaccaccggtacgatgacggcccgggcgactggggccgccgccgtcccggagagcgcgtcttccgctactgcctgcgctcggcgctgacgccgtggctgtggccctacgagacgctgggccaggtctggcagtgggcgaagaagaagaaccagcggctggagctggcggtggatttcctggtggtggacggcgcgctgctggcgctcatcgtgtggaagcccgcgctgggcctggccttgtggggggtgctgctggtgacgcagttctgcatccactggctcaacctggcagcccacttcgaaacggactccgaacagaaggacgccctggggaccacgtcttattccgccttctacaaccggtggttcttcaacgccggctaccatcaggcccatcacctgaagccgcaggtgccctggtacgagctcccggccctcaccgaggagctcgctcggacgtccaggctccgtccagagctgacgaccgggctctcccccatcaatccgttgtgggtggcacgggtggtgaagcgctattctgccaagccgtgcgatcggcagacggagtcgaagattaccgccgggacccccacggccgttacctagtcggggagggcttcctccactggtacgcctcggtggacctgtgcggcttcatcctctggggacgccccggagaggccgaggtgcgccggctcgtccaggtgctggacgtggagttgtcccccgccaagccgcatgcctcgctggtggacgcgcgccggctggaggccgcggaccccatggcctttgccgccctggtcaaatacatgcagccccgcgagaaggacttcagtacctccgtgctgaagcaggcgctggtgcggccggaaggcgtggtgggcgcggtggtgggcggcttctacacgctgctgtccggggcctatcccagccgggcattcaccgctcccgacaccgcccttcagtggttggggcagccggaggccgaggccgcggcgctgctggcggagctcaacggactggtcgcggaggccaccggccagtctcccctgctgcgcgagctgcaccaggtgatgcgaggccggctgccggaggtgaatctgtcggacgtggcccgggagatgggcatgtccgaacggacgctgcaacgccggctgaaggaggccagcacgtccttccaggcggagctcaacgcggtgcaggtgcgcatggcgcagtcgctgcttcgcgagtcgaacatgaagctcaccgcagtggcggtggaggtgggctgcgcctcgctccagcacttcagcagcctcttccgcaagctggtgggcgagtcccccagcgcgtggcgggaccggcagaagcagccgcagggcgacggcacgccaccacccgccgaggccctgatggaggaagtggctggagcgcccggtaagggccccgtcgcggccacgtccgaagtccccgagtagtcacgccctggagccgggaagccgctggctcccggcaatccctggcagtcaccacaggggctcaacattcccaaacgttgtcaggcgggactgcgcgactcagcgggtgacgcgcaagtctttgacacctcgtgggggccatacctggcgcgcgggac

SEQ ID NO: 1148 - DNA, 17726 bp, Myxococcus xanthus
ctctaaagccttgcgtccggcgccatagagcgcgtcgcagagcagggggtggccggcttcggagaggtgcacgcgaatctgatgcgtgcggccggtgagcaggtccacctccaccagcgcggcgccatcaaaggtctcgaggacgcggtactcggtgatggcgttcttgccctccttcaccttgcccgtgaagcgctggcggtggatggggtgacggccgtagagcgtctcgatgcgcccttccgccggcgggacgccgtggaccagcgccaggtacgtcttctccaccgcgcgagtcttgaaggccttctggagcgccaccagcgcctgctcgttcttcgccacgacgagacagccggtggtgtccttgtcgagccggtggacgatgccgggccgcagctcgccgccaacaccggccaggtccttcacccggtgcagcagcgcgttgaccagggtgccggaagcgtggcccgcgccggggtggacgaccatgcccgccgccttgtcgacgacgaccaggtcgcggtcctcgtgcagcagcgcgagcgggagctcctccgctaacgggacggcgggaacgggcgccggaatgtggaggacgagcagctcaccgccgcgcagacgccgggccggtttggccggctggccgtccgcgagcacatgcccggcctcgatgaggccatggatgcgagagcgcgtgaggtccgggaacgcgcgcgcgaggtattggtcgacgcgctcgccgcgagcttcgggcggagcgcggtgctctcgcgtgtcaggcgctaccacggggagggggttaccagatcttcgacttcacatgcgccttcgagcgcaggacgatgtcgttgatcgcccgctcgaagaagttcatcttcgtgaagatctcctggctgacgcggctcttgtagagctcgcggccctcttccagttcctccttgaggacctcgaagaggttgtcctgttcgattcccttgatgatcttctgctcgttgtagagcgagatatccgaggcaatcgcacgggcgagccgcatcgccttgaccttttcctcgtccgtcatcgtgctacctacttaggcagcggctggaggcgagtcaactttcctcgcaacgccggtgacatccgagcacttccgggcgcctcccctacttccggcctgacttctcagaagacagggccaggtagctcttggagacgcggagtggatccaaccccagctcgcgggcgaggctcatcaggatacctcgcaggtagaccgagggcgggagcaggttgtagcggtccgcctcgacgttctccaggtgcatgcgcgtgatgcgggtgcggtcggccacctgctggagggtcaccccccgggcctctcggacctgccggagcagctcgccgttgaactctgcgtcggacgggatgtccgggacgcgaggccggggctcacgggcccgcgacgcggcctgggacgcctgcgccagcgccgcctccgccgtggcgatggcggagtcctgggcgatctgctgcgcgtctcccaggggccgcccgggacgcgcgccagcccggcccggctcggacggagcctccgaggtgggcgcacggacgggcagggacgatggcggtcgactcggcctcgggcgcctggggggccggcggtaccgggctcgcactcgctggaaccggcaggtggggcgcagtgctggtttccgatgccggggcgccagtcacggcggtggcaggcgccgaagggggcagagccgccacggcgctgaccggagcgccttgcgtggggaccggcgcggcggctgggctgctggcctgagtggccgaggcagccaccgcggcactgccttccgccaccggggagctgacgggggcggccgaggcgggcgtcggcacggcagccgtcgcaggcgccggcgcatcgctgaccgaagccagcgcgctgacagcgcctgccggaccaggcgtcggcgcggcggccgaggcaggcaccgaggcgtcgctgcccgaagaagggacgctgacctggggagccgtcgctggagccggcgcgctgcccgttaccgcagggcctcctggggaaaccgaagcagttgcactggccgccacgacgccaggcactaccgcagcggcctcatgcgccgcggacggctcactcaccggagccgcagccaccgcaccgggggcctcgcgctgcgactcagcgctcgcggcccccgtgccactacccgaaacctgaggctgaatcgacgcgacgggaacatccaccgcgctccccagccgctgcgtgtcctgcaacgagctggacacgtatgcgaacgagaacccacggaaaaacgacgcccggaagtccgcctgtcccgaggacgccggcatcgcctccacccgaggctccgtcgcctgggccccggcctccccttccccatcccgccccgtcatcgcggtctccgagtcctccaccggcacgtctcgcactgctcctgtcctcccgttcgtccccgtttcggggatctgcgtcgaaaggtggccagtttgatcttccgcgccggaagcggcaaccccaacgagctccggctccgcgcgctgctccaccggcgcggcggcgtgtgccacctcgcccccggtcgacaccgcgtccatcaaccggagggccgggagccccaggtccttgtcgtactcggcacgcagctcttcgtcggagagaatctccagcgcctcggcgagccgagtgcggagctcatccacctggccctcatccacgagcgcatagacggcgatggagtccggtgcatacagctccgtcagccgttcgtacgccgcccgaatctcctccttcggagcggtgacggggacttcgagaatctcgtaataggtctgctgctcgaagggcttcatggtgtggaacgctggggggagccgtcgagtgtgaggatacgcgttgcgatgcccagaatggcagtggccgccgcggaatccggtcgctcgatgaggacgggcttgcgcttgcgcaccgcgcgccatgcctcgtcgtcgtagcgaatggctccgaggacatccatttcgatgccaaagaacttcttccatgcggcggccaccgaggtgcccaccgacaggtccgcatccgtgcgcgcctggttcacgatcagccggatgcggaacgcggagagctcgcgctccaagcggtccgcgatggccgggtccttgcgccgggcctgcgccagcacgtcatgcagcgtgcgcagcgccccctcacgggtggtgagcgcgtcgtccaccaggtcctcgatgccgtactgcgactccacctgctggagcttgcggaagaaggccgccttcgcgaagcggtaggcgttctccaccgacgtgggctcgggcaacatcaccagcacgccgtggtcggcgaggatgaagaagtcgatggtgttgaagctcgtccccgcgcccaggtccaggatgaggtagtccgccgacgtgcccatcaacgtccgcagcagcttctgcttctgcgcgtacttgaggttggccgcgtccagcgcatcctgcgcgccggcgatcagcgacagccggggcacgcccgtcggaacgatgacctcttccaactgcgccttgttccgacgcaggaagtcggacagcgtcgcgttgggctgtccgacccccaggcacgtgtggaggttggccccgcccaggtccacgtccacgagcagcacgttggccccggattgggccagggccacgcccaggttggcggacaccatggacttgccaatgccgcccttcccgcctcccacggcgatgatgcgccgcgggcgaggacggcgtgacagaccaggagggccggagaccatggagcctggctccgtggggcccaggacacgggattcggtccagggcgctggcgagggttggggcatgcccccccatcaaatcccgaacccggggtcgcgtcgactccccggcctactgcatccgttcagtggagcatcccggcccgcgcatgcgccggaaacccgtcactcccggtgtttccagcccctgcggtgagcccggatgcccaccaggcaggcgctactcgtcgagcagctcgacgttccagtacgacgcatccgccaggtgcaggaacggtagccactcctgatacgtcaccttgcgggtggcgccgcggaacagcggcgtccagcgcgggcgcacgggcttcttgagcagcttcatgtgggcctgctccggcgtgcgcccacccttcctcaggttgcaaggcacgcaggagcacaccacgttctcccacgtcgtcttgccgccctgcgtgcgcggcatgacgtggtccaggttcagctcgctgcgcggcaggttcttgccgcagtactggcaggtgtcgttgtcacgcgcgtagatgttgagccgggagaagcgcacccgccctcggggcagatggtcatacgcgctgagcaccaggacacggggaacgcggatggtgcgctcgatggtggtgatgcagtcctgtgtcgcgctcagctctgcccaatccgcgaactcgtagagccggtactgcgagtcgatggccttggccacccccaggtacaggagcgagaacgcccgcttcaccgaggtgacatgcaccggctggtagtaccggttgaggacaagcacggcgctgttgatcatggcgggttccctggaatggcggccgcgacggcatccgcgacggcctggagctcctcctcctcgagacaccggacgtcgaggagcacctcgccatccgcgatcctcccaataaccggcgacatgcctccgcgcaggcgctccaggaattcttccggcgtccctagggtgaggatgcacgcggaggacggcaacctggccagcggcatggcacccccacccacctgcccctccacgctggccacccgcgcacgcacaccctgccccgccagcaggccttgcagccgtaccgctcgggcgcgcaggtcttccggcgactgggcaagcaggcgatgcaccggaacctcttccgcccggccatcccggtacagcgccagggtggcttcaagcgcggcgaccgtcagcttgtccacccgcagggcccgcatgagcggatgagccttgatgcgtgccagcagcacagaccggcccaccacgactcccgcctggggtcctcccaacagcttgtctcccgaaaaggcgaccacgtccgcgcccgccgccacggcctgggccaccgtgagctcccggctcaggccctcgcccttcagcggcaccagcgcgcccgcgcccaggtcctggaacaccggcacgccgcgcgcgcggcccaacgccgagagctccgcgacctccacctcttccgtgaagcccaccaacgcgaagttggagcggtgcaccttcaccagcagcgccgactccgggcccagcgccgccgagtaatccgacagccgcgtccggttggtggtgcccacctccaccagcttcgcgcccgactgtcgcatcacctccgggacgcggaagccgccgccaatctccaccagctcaccgcgcgacaccacgcactcgcggccggacgccaacgccgccagcaccagcagcaccgcgcccgcgcagttgttgacgacgaccgcgtcctccgcgcccgtcagcgagcgcagcagccccaccaacggcgcgtagcgactgccccgctctccctcatccaggtcgtactcgaggttggagtacccccgagccacctccgccacgcgcgccacggtcgaggccgccaggggtgcgcgtcccaggttggtgtgcagcaccaccccggtggcgttgagcacgggccgcagccccggtgtggccagcgtgtccagggcgtgctggacgtccgcatcctcgaagcccggcccgcccgacgccaccaaccggccccgggcccggtccaccgccagccggagcgcggccacggcgcgggccctggggactccgctcaacaggggttccagcgacgggcgccgcaggagctgctcgacggaggggagcgcgcgcaagagcgcattcttcccaccgtctccactgttcgacggggcgcccatgccccgagtctaggggagccgccgggcaagttccaggcgcgccctggaacatcggggtgacaaaaggaaaaggcccagcctccctcggggagactgagccttcggactaagcgctatgagcgctcagtaggtactcagaccgggcgaacgttctgagcctgcaggcccttggggccacgggccacgtcgaactcgaccttctggccttcctgcagcgtgcggaagccctgggtctgaatcgcagtgtggtggcagaagaggtcctcgccgccgccgtcctgcatgatgaacccaaagcccttcgcatcgttgaaccacttcacggtaccagtcgccattacgcttctcttcgtctttctctaccagcttcatgaattgagctggttgccacgccgtgtgagggtgcggccttggccatgtgtcacgtttccggccagttgcatagggggtcccccacacgcaggcaccctttttccgggcgtggacataacccgcggcgtccgcgccccattccgcacgaattctccaccgacaccacccagcaggcgcccggatggctgcagcgcacctacttcgcggcgctcttgagcaccggcagcttgggcgcccgtccgtacagcagttggtacgtgttgaaggagcgcagcacgcgcttgatgtaaccgcgtgtctcggagatggggatttcctccacccatgcgtccagcgccaggtccggcctgtcggacctccaacgattcaccgcgccgggaccggcgttgtagctgcccaccgcatagggcgtgtgcccgttgaagcgcttgagcaagccgccaagatagtgggcccccatgcggatgttgaggtcgggctggagcaactggtccacgctgaagcgcttgagcttcagctcgcgcgccacgcccttcgcggtggacggcatcaactgggtgaggcccatcgctcccgcccacgagagcgccttggggtccagcgcgctctcctcccgcatcaacgcctggagcaggtccggctccacgcccgcgtccgcggtgtgcttctcgatgctgtcgcggaaggcgttgggataggccacctcccacaccacgcgcgtctccggagtgatgcgcccgctcaagtccttgcgcagggcgagccgcgccaccgcgtgggcggagcgctcgtccccggcctcgtgcagcaccagcaccagcaggcgcacggactccgcgggcagattggtccggttgacggccagcatctcggacgacacggcttccttgaagcccaggcggtacagctccacgcccgcgcggaagtgcgggtcctcgcccatggggccggcgaacagcggccaggggctggcggcctcgggcacggcgaagatttcggcggacaccttctccagccgtggcgggtccaccttcgccagctgcgagcgcgccatcagcccgtagtaggtcgccgggtggtccacggagagcttctcgaacagctccgccgcgccctggatgttgcccttctcttgcatcgtccgcgcccgccagtagcgcgcgcgctccacgtcgtagctctcgtccgccttggcgaactgcgcctcgatgcggtccaggaacgacaggccggagtcctccacgcccgtggtgcgagcaatccagaacgccttgaagagcgcctcgcccaggaagtccccctgcgggtacagccgggccagcgtgtccaggcgggccatggcctccttcggacggcccgtcttcaggtagaggtcggccgcgtagaagaggccgtcatccgcgaacgagtggtccgggaactcgcgcgccagccgctcgtaggtctccgtgccccgcgcctggtcgacgatggagcgcgacgagccgagcacgtacagcacgcgcgccagcaggtcgcggtcctggcacttctccgccacgggcgtcagcacctggatggcgcgcgtgtgctggcgctccttgcgcatgcccttgccgaaggcgaagtgcgcgcggcaggccagcgggtccggaagcgccagcttcggcagcagcggctccaactgctccaggccggccttgttccggtgcagctccaccagcgcctcgccacgccccaccctcgcatcgacgggcggcgtctgccccttgaggcgcttctcggcctgcttcgacaaggcggacagcgggtgcgcggcccacaggcgccacagcgcggcgcgctcggcggccttgtccttcttctccgcggcgatgtcggcgatggccatcagcgcctcggcgcccacgttgcggccccagctgggcgccgcgcgcgacgtgagcggctccagcgcggccatggcgcccgccgcgtccttcttcttgcgcagcacgcgcgacagggccagccgcgcgtccacgtacagcttggactcgggtggcacctgctccagcagcaccgcggcctcatcgaagcggcgcaggctctccagcgccacgccgccatgcgtcaggcagcggtccttcagcgcgggatagtccgggaccagcgcggcgaattccttggcggcggacgcgtcatcgccggcgcggacggcggccagggcgcgcaggtagcgcaccggcgggctgtcgccctcgtccttcagcagctcgcgggcgcgcgtgtactgtccacggtcgaacgcgtcacgggcctccttcttcttgccctcgccgaagtaaggcgccaggtcctccagcgcgtagcggcggccccggtgcaccaccggtgtgggcggcgcggcattggggaaggcggggttgagcacctccacgtagcccaccggaagcggcgccttctccgagtcgggagggggcgacaactgcgcctctgaaggcgcgttgctggggtgctgggccggcgcttcggacgcctcgggctcggccggggtggacgaaaccgccttcggggcgggtgcctgcgcggtcatcaggagcgcggaggcggcgacggcgagcttggaaaggaagggcttcatacgcgggggctgggtcccagggagatgcgcgcgggctcgccccaggacaaccggcaggtcatggaaaatttccggaggctgacacaggttagactgtccgcctcctcatggacatccggacacagagcgcgctgctggcatccatcatcgggctcgccctgggcgtgtccatgttgctgcggcccggcaggcccagggtactgacgctgtactccgtcttcgcgctgacggtggccggctactacctttcgctcttctttcacagcgtcttcccggccggcgactacccgtggacatcccgcatcttcgtgggcgccaccatcctggtgggttccctggtgccgggcgcggccgtagccttcttcctggagttcctgggggtcagcaaggggacgaacctggtgggccgccggctcgccctgctgtccgccgtcctggggctgaccgtggctgtcacccccctggccgacaagctctgggcccgggtgggcatgggcgtgtgggtgctgggcacgctgctgacctacggttcattgctgctccaccgggtccgcaccacggagtcgcgcatcgagaagttccggctggcgtatctggccagtggcgcgggcgcggccatcctcttctccgcgctggatttcctggtcagcttcggcatccccttccccacgctggggtcggtcttctccacgctgtacctgttcttcctggcccacacgctgctgcgcctgcggctgatggacctgcacgagctgctgggcaagattgcctcgcagacggtgctggccagcatcctggccgccgtcttcacggtgctgacggcgtggggcaaggagaacaccggcctcttcctcttcaacacggtggtggctgcgttcgtcatcctcatcctgctggagccgctgaaggtgaaggtggaggagatggtggtgcgcatcttcttccgcgagcgcttcgccctcctggactcgctgggcgcgctgcgcgtgcgcatcgcgaatgtcatcgagatttccgagctggcccggctggtgctggacacgctccacgagacgggccgcgtcacgcacgcctccgtgtacctgctggcggaggaccggcccgggtaccggctgctggactcacgcggcccgctgccggtggccttcctggacacggcggtggcacgcggcctcctcttcgcggcggccagcggacagaaggcggtgctgcgagagaacgtggagcgccgcatggccaccatgcggctgcaggcggtggagggcaagcgctaccgggacgagctcaagcggctcaacgacacgcgcacggcgctggtgcaggtgaaggctggcatcgccgtgccgctgatgggcaatgaccgcgtcatcgggttcctcaacctgtgggacgaacgggtgccggaggccttcgcgtccgacgaaatcgccatcatcctggaggtggcggagcggctggcgacggtgctggagaactccaagctctacgagaagattcgcgagcgggaccgcctggccgcgctgggtgagatggcggcgggtctcgcgcatgagattcgcaatccgctgggcgccatcaagggcgcggcgcagtgcctggacccggtgcactaccagggcgaagacgccgagttcctcgaagtcatcgtcgaggaggtcaaccggctcaacggcgtggtgacggcgttcctcgactacgcgcgcccgctgaagcagagctttggcaccaccgacctcaacgaggtggtcacgcgcaccatgcggctcatccagaacgacgtgccatccaacctccacctggccgtggagttggacttgatgctgccgcgcgtggacggcgacgcggagcagctcaagcaggtgctcatcaacctggtgcagaacgccgtgcaggcgctcgagacgcgcgagggccgcatcagcgtgcgcacggagaagccggagcgcttcggtgagctgcgcagcgccggcgccgagttcgtagaggtgcgggtgtccgacaacgggcccggcattccttcggaccagcacccgcacatcttcgtgccgttctacacgacgaagcagaaaggcaccggcctggggctggccatctgccaacgcatcgtgaagaaccacggcggcagcatctccgtgcaaagcaagatgggcgagggcaccacgttcgtcatccgcctccccgccctccccaccgagcagccacccgcggaggccagctccgtggacggcctgcccgccgggaagcggccgtcgcagtcattgcccgtgtccgacgaactgcgtgatgcgggcaagccatcgcatgtggacggccgcgccaagcgggagcgccgcaagcggctccgcgcgtagcgacaccgggcggtgcacctggggaacgcaccttccagacattgctgctttcgcccctgggggagagcgcctataggtcatccccatgagcgcatgccccttctgccagaactcgatgcagctcacgcccagcagtgagcttcccctggagacatgtggcgcgtgcggcgcggtgtggttcgagggcgaagcgctcacgaaagtcatgggcggctccgtgtcggacgcgctcctgcgacgcgcgaagaaccgcccaggctgctgcaagggctgtcagggcgagctccagttcgtcccggagtgcacacactgcggcacccgcgcgcccacgtgtccacgctgtggccgcgcacccctgcccgtggtggaggtgttcggggtcaccatggaggtgtgctcgggctgcgcgggcgtggccctggatgagggcgagctccagcaactgcaagacgccgtggagacgtaccgcgatgagccgctggatgcccgcgccacggtgcggctcgaagggcccccctgctgtaccgcgtgccggcgcaagctccggctggagcacggcttcgtcgcggaggagcgcctctactgcgggagctgcgcgcccagtggcgccaccccctacagggaaacgttcagcagccatgacatcccgatgttcgtccccacccggcgcggaggccagaccttcaacctggccgggtacgcctccgagggcttgatgtggctgctccaccggatgctcacccgatgagccgggcgagcgccgcgcggccctcatcccagtgacgcggacgcctcggccagcttctcctgcgcagcctcccagcgggcatagaggtcttccagctcctccttgctcgcgcggtgcgtgtccatcagcggcttggcgcgcgcgaagtcgttgtagagggccgggtccgcgagctgcgcctcgcgctccttctgtccggcctccacctcggcgatgcgcgcctccagcttcgcaatttccttcttgaggggcccctccaccacgctgcggcgctggcgcgcctccgcctccagccgcttgcggtccttatccgtcatcggcccggaggccaccttctcaccccgcgcctggcccgccgccagggccgaggcctccgccgccgcctgctggagcttctgctggtggtacaggtagtcgtccaggttgcccggatgcggcgtgagcttcccatccgcgacctcccacacgtgcgacgccaggccgttgatgaagctccggctgtggctgacgaacagcaacgtgccgccgtagcccttcagcgcttcaatcagcatctcggccgagtccaggtccaggtggttggtgggctcgtccatcagcaggaagttggacggcaccagcaacagcttgggcagcgccacccgcgcgcgctcaccaccactcagcacgccaatgggcttctgcacctcatcgccgctgaagaggaacgcgcccagcacgccgcgcacgtagctctccggcttgtccgcggccagcgggcgcacctcttcgatgatggtgttctgccggttcagcttgtccgcgtggtgctgcgcgtaatagcccaccaccacgttgtgccccagcgtcaccgtcccggtgtccggcgccagctcgccagcgaccatcttcaggagtgtcgtcttgcccgcgccgttcgcgcccaccacggcgatgcgctgcccacgctccacgcgcccggtgaggccgtcgtagatggtctgcgcgccgtaccgtttggtgatgccctccagcgtcaccacgtcgcgcccgctccgctcgacctcggggaagcggaacttcatcgacgtccgctcctccaggacctgcaccttctccagcttctccaacatcttggcgcggctctgggcctgacgcgccttggtggccttggcgccgaagcggtcgatgaagccctgcagctccgcgcggcgcgactccaccttctcggcgcgggccctcaacagctccttctcctccgcgcgcaggcgcttgtattcgtcgtagttccccgcgtactcgcgcacgccctccacttccagggacaccacccggttgatctgccggttgaggaagtccttgtcgtgggagatgagcaccagcgccttgttggagcggcgcatgaagtcgtcgaaccacgtgagcgtgggcacgtccaggtggttggtgggctcgtccaacaggagcaggtcggggtcctggagcagcagtcccgccagggccgcgcgcatccgccagccgccggacagcgcggaggtgggcttggccaggtccgtgtcgcggaagcccagacccttgaggatgcgctcggcgtggtggcggccgtagcggttctcgaagtcgtccagctccgcatgcaggtccgccagggactgggacagctccagctggtcctcctcgtccgtggcggcggcgagcgcagcctccgtctccttgaggcgcgcctccatggcatcgcggccgggcacggtgctcatcaccgcctccaccacggtgccatccggcaacccggcgatttcctgcggcaggtagcccgctcgggccttgcggctgtattgcaccgtccccgagtcggcctgggacacgcccgccaggattttcatcagcgagctcttacccgtcccgttggcccctacgaggcccacccggtccctgggacccagtgtgaaactgtcctgatcgaagaggaccttctttccgtaggagagacagaggtcctgggcgatgacgaggctcatggcgccggggatgtaacagcccgcgagcccctcgggaatgtcggatgtgcccgcccgttcgctctggggccctacaggggctttccgggttgggccggggcctgtctatactctggccccacatggctgccccctgtccccattgcggaagcaccgacggcgtcgaccacctctgttcaggccagggcctccagctcctcggccaggtgctcgacggccgttataaaatcgaaagcgtcctgggccagggcggcatgggcatggtgttccgcgccacccagacgtccgtgcaacgcccggtggcggtgaagacgctcaacccgtcgctggccgccgccccccagttcttcgagcgctttcgccgggaggcggagctcgccagccgactgcggcaccccaacgtcatcaccatcttcgacttcggccggtcgccggacggcacctgctactacgtgatggagctcctggaaggcgaaagcctgaaggagacggtgaagcgccagggccccatgtccctgcgacgggccttgagcctcgtggagcaggcgtcccagggcctggcgcacgcgcacgcggagggttgtgtccaccgcgacctgaagccacacaacatcatggtgcagcagctcagcggccaggacttcgtcaaggtgctggacttcgggctggtgaaggccatggagtccgaggaggaggagcagctcacctcgaccggacaggtgctgggcacgccccagtacatgccgcccgagcaggccggcggcgagtccgtggaccagcgctccgacctctactccatggccggcgtgctctacttctgcctcaccggcagctcgcccttcggcgcgaacacggtgcgcaaggcgctgacggcgtcgctcacccaggcggtgcccgccgtcaacaccaagcgccagggcgcccccgtgccagccgcgctggatgccttcttcaagaaggcgctcgccccggagaaggaggaccggtaccagaacgcgcaggagttcatcgacgcgatgctggacaccgtggcggacctcacctccgaggagctcgacgccatgccgagcggcggcgtccccagcgccagcgagcgcggcagcaacagccgcagccgttccagccgtcaggggagccagagcggcatccgctcctcgcgggtgggcgccgcgccgagcctgggccgaggagccacgcccttcaacgtcgtcgtcgccaggccccagggcggcgcgagcggctcgtcgtccttttccagccgggtccgctcgcagacgtcccggtccgcgccgcctcctccgcccccgcctcccgagccggagggcatgtccaccggcaagaaggtggccctggtcgccgtgccgctggtcctgctgggcattggcgcggccgtggtcctgggcaaaccgggcggcagcgcccccgcgacgccggtggtggtgaacgtcccccgcgacgctccaccagcgacgacgcagaccgcgaccggcacgacgggaacgcccgaggaggcgtccgtcctcacggtgagcctcgattcgacgccgtccggcgcatccatctacgaaggcgaggagatggtgggcaccacgcccacgaagctccagctccgccgcgacaaggtgcactcgttcagcttccgcttgccggggcaccaggacaaggagctcacgctcaacctgcgccgggtggccggggatacgcagtcggcgaacgtggtgctggagcccgtgcgagccgcggcccccgggcgttcgccgcgccccccgccgaagccggcgagcccgtccgggcctgacatctccgtcttcgaatagtcgctacgggggcacgcggaagcaccgcggtgccccctgtccttccgccccccgcgtcaggcgagcttcgcgagggtcgggaggacttccccgctcttgtccacgatgcggtgctcgaagcggttggagttctccgccgggtccaggttgacgagccacgtcttcccgcccgccttgcgcacctggtccacgattccagcggccgggtacacggcgccagaggtccccgccgccagaaagacgaagcgtccacccgaagtggcggcccgcagcgagaagtcctcgatgcgctggatgtccgccgggtccaggtattcgccgaaccagacgatgtggggccgcagcagctttccacacgcgtcgcactcgggcaccgcccctgcggggtacacggtggcgtcctcgaacgggggccgcccgcagcggctgcagcgcgtcttgaagaggttgccgtgcatctccaccacccgctgacttccagcgcgcgtgtgcaggccatcgacgttctgggtggcgagcaggaagcggtcccccaggtggcgttcccaggcgacgagcgcctcgtggcccgggttggggtggacggcggcggcggccttgcggcgctccgaatagaagcgccacaccagcgccgggtccttccggaagccctcgggcgacgccacggcctccacgggttggtcctcccagagtccgctcatcccgcggaaggtgggaactccgctttcagcggagactcccgcgcccgtgagaacgagcagccaggtattcgaatcgaggatgagcgaatccatgtcggctcctgtgcggcggaaagcgaatcaagctatggatgggacgctgaccctaccggggcctgatgctcgcgggaggtcgccttgcgaggtcccatcatggcggaagtcaccctggatctgcgcggcatgcccaaggccgaagcctacgccgagctgaagcagcatgtccgcgcggtgctcgagggcatcgacgacgacatcaccggcatggccaccatgagctgcctgctgcaccacgccttcgggcacctgtggacgggattctaccgcgtcgtcacgccgggccggctgctgcgggtgggcccttaccaaggcacgctcgggtgcctggaaatcccgttcggcaagggcgtgtgcggtgcctccgcggcgaagggcgagtcggtggtggtggcggacgtccacgccttcccgggccacatcacctgtgacgggcgctcggcatcggaaatcgtcgtccccgtgttcggccgcaaccgcgagctgctggccgtgctcgacatcgactccgagcacaagaacgccttcgacgaagtggaccgccgcgagctggaagagctggtgcgctggttccagcggtagcgacggcccacgtccgggtactcagctcgcgcgtgcgtacgccacggcgagctgaccggcgaagcgcgcgttgttggtgagcagcgccaggttggccttgagcgtcttgcccccggtgcgcttcgccatttccgacaggaggaagggcgtcacggccttgccgcggatgccctgccggtccgcgtcggcgagcgtcgcggcgatgtgcaactccacctcgttgcgaggcagggacgtctcctcgggcggaggcacggtgtagagcaccccaccctgcttcagcgactcgaagcgggcgcgggcgatgcgggcggccgtgtccacgtcatccgcgcggtgctccagggggatgccagaacccccgctgtagaacgacggcaactcgtccgtccccacgccgatgacgggca

SEQ ID NO: 1149 - DNA, 14431 bp, Myxococcus xanthus
tagctccagcatacgtccgtcgtgcgcaccttcatccaataccggcgccgcctctggacagagtgggggtggtcgagtgggtggctgacggacctccccatcatgcacgtccttgacgccgcaccgacacaacctccgccgtcaggcatccttgaagcgtatcgcgtgggcccgtgcgcccgcgcggcgggccttctctccgaggaggagcgcattgccatggctgtgcggggcttgagtcagttcgcgccggagctggcctccgaagtgcagtgcggaacctcctacgcatgggacctggacccttgggctcggggtgcctttgcgtggttccggccgaggcagctcacgcagtggggacgtgcgctcgcaacgcgcgaaggcagggtccacttcgccggagaccaaacctctcccatgcccggctggatggagggagcgctcttgtcaggccaacgcgccgcccttgaaatcctgtcaggagccagcggggcgtgcatggcagagggcctgcacggcgtctgattcatgccgcggtggtggcttgcgagagcccgtggggccagctgcccgacttaggggcccggtgagtgcggactcggacattcgtggccaatccctccacgaacgcctcgtccgatttcaccttccgcgcgacgggaacaggcgatgttccgctgggcgctccggcctgcgtccctgcctactggcctggggcggagggccggtcctttcgagaacggcgggatgtcttggccgccgccgctggcttccccgcggctttcttgccacgcgtcgccgcgagcttcttggggcggggggcgcggggtttctcctcctccgtggcagcgccgtcaccgcggcggacgcgtgccaccgcgccgctcacggaccgggtcagccgcgcaaccccgggagtggctccaagggagtgggtcagtccctgcaccttgtgggacacggagctcaacgcgcgtcgctcccggtccgacacgggaagcagcgccgctcccgcgacgcctgctgccagcgtggtcaatccaatggccaccgcgtgttcccccagttggtcggctgcccaggtgcgtgccttgcctgctcgctcacggagtctgtctccactggggacccggtctcgcaggtgctccagtgtctcgcgccctcgggtgctgacccgctgcatggcctcgcgtgtgtgcgcggcgaccttctgagggcgcgtcttctcttcctcctgggccttgcggcgcttccaggccgcggtgagcttgcccaacctttttctcccggatgtggtcgtctgcgccttggccatcgcgctctcccttgtttcgccctcgttgggggccggcgttcctcgtgtcaaagaaggtatggatgagagaacccggcgcaatgtgctgctgcgggtgaggacggccggcacgacgaaggtgcgctgggcgccgagcgcggcgcccgcccacattcctccagccgtggccagcgcgaccgtcgtgctgccagctgggccccgcgccctcgctgcgcctgctttgaccagggtcgcggccgcgttgagtgccagtcccgtcccgccatgcttgaagcgttggaatgcctcctggtcctcgaagaggacgacctccgaagatgtctgtccgcccaactggactccgagggtcagttggaccagcgccgcgtatccgaccagccgctcgtgacggaagacctcgcccatcccccaggtgcctccgagcacggcgcttccctggcctagcgaagggaagacggcataggcgtaggcccgagccctcgcctgagcaagctccggtgagcgggcctccagccggtgcaatgccgcccttgcgtcaccatgcagtctgcggtggacgcccagctccttcctcgcgagcttcagcgcgcgttggccttggctcgccagtttgtctcggatgggcgcttcattcgtggcgagcactggcctgtgccttgatgattcgggtgagcagcagggcggcagccgtcagccccgtggtcagggcaggagggggctgcgacgcttgcagccgcgaacgctgcccggtgtcatcggccccgttctcctcggacgcatcctgcctgcggaagcgctgcaccaggcctccgttccctcgctccgatgcgcccgacgaacgcggaatgaacgtgaacttctgtccgcccagggaggcctcgagcagcatgccgccacgcgagtaggcgtgagcaacgcacttcgcatagttgatggttccggacgccgccgccttcacgatcactgcggacgcgttggcggcgaaggccgcctttcctcccttgaacgcttcaatggcatcacggtcctcgaagaagatgagctcgctcagggtctgtccgcccacctggactccgagggtcagctggctcagcgtggcgaagccaatcggcttgcccttctcgaagacttcgccgtggccgtacgagccgccgaggaccagcgatgccctgcccagcgaggggaagacggcatagccctgtacctgctccagctcttttttcagctccggatgcttgaggaccaggcggtccaccgttgccacgacctcttcgtgaagcgtcttctcctgctctggcttcatgttcgcctcctgatgaatcaacgtggcgacggccatgtccgcaaggtacccacgggacgtgcgtgcgaacgaccacgccgtgagcggtctggttgcccggacgtgacgcggaggtgtctaccttcggtctcaggaggacgcacatcatggcctcgacgaagacaaaggagaggaagcgctcgcgcggcccagcgcgaaacgcatcacccaggatggaagctgcgcagaagcaggtcgaacaggtcacgggatacgcacggggccgggtgatggagcgcctggacttccagcggggcttgctcgtgtcggtgctggaggacatggcagaggggctgggcagcgccacccggcgtgcacggagcccggcatcgcaacgcatgctggagacgggagagcgcatgttccgcggcgcctcctcgcggctggatgagcaatccgtcgaggcattcctggaccgcacgggacagttcgtgcggcagcgcccgggattgttgctcacgggactgctgggggcaggcctgctcgcggggcggatgtttcgcgccagcggtgctggcgatgtggaaggggaggctgagtcatgagacgtagcgcgaacaaggcggctgcgcgcgagggacggaacggcggcgctccaggtcaggcgcaagggggactgatgccgttgcgggcggtccgcgacaagggccgggcggttgctgggagtctccgagagaagtttccctcgcgagacgatgcgcgctcccgcgcggtgggagcccaaacgtggacagcgcagacgatgcgacagcatcccgtgggggcgggacttggggtcctggccctgggcttcctgtcggcgtccctcttgccggcctcggcgctggagcgtcgcgcgtatacacgtgtggcgggaaaggcgcgggacctggccgaccgcgtggacgcatcggggcgactcgaagacgtcctggcgaccgtacgacagatggcggcggacgcggcggccgagcagttggcctcgttgaggcccgagcccgaggaaggtcctacgcggcgcaagttggagcgggtggaccgaaagggtgggtgattgccgggcgggtaggggacggggggcggcccgccctggctaccgatggaggttcagtcgcgtctccgcccggagcgcttccgtgggggcgctgaaggctcctgaaaccgtgttcccacatgcatggctgcttcgaagggcccgtagtgccctgccgtgaggggcgccggtactcccgtccggtgcgaggtatggatgctctcgacgccaggagacgaccaggtgcgaacatgaacgccatggattgcatgcacgacgagcgattcgccccgggcgcgtgcggtaatggcgacgtcatcgttcagctcggattcctggtcgttcaatggtgcgctctggaaacgcgcgtgacttgattgcggtggtcgacgtaccggcatggggaactccctggggcatgggccaacagctccctttcaatctggagacgcgttgctcgggaggctgtggcaaggcgggcgtggcctgcttccgtgggggccctggctgcctgggtgagaggccgtgcggcctgccggcagtgcctgtcgatggactgaggccaatgggacgaggcccttggccacaccgggtgtcaggcccgttgtccgctcctcactcttgacagagggaggaggtcgaccgtggcaaagacaggatggggggcatggcgattccggggaacgaagtccgcgaacaagacggagcatgacaatcccgaggagcggccttcgcagcgggaaggcggagccacgcgagaggacacacggaatgcgctcgcgcaggcgggcgtcgacgaggggcccatcgaaatcgtgcccgacgtgctgctcgacgtcccgacggtgaaggtggatgagattacgctcgatgtggagaacttgcgtgcacgcgtctcactgcatgccgagctggccaacctcgtgcgcctcgatgtgggcgccgacgtgggcatcgaacgggtcaatttgaccatcaaaggcgtggaggcccaggcgctgctcaaggtccggctccagcgtgtctatgaaatcctgagccgcgcgctccagacattggatagcaaccccgaactgctcgccagcctgcttcggcccgtggggcatgcgataggcgaggtgggggaagccgcccatgagagcctgaagcctggcggagcggtgtccgaggccgtccgggacgtgggaggggcagcgaagggggcgttggaacctggcgggacggtgaaccgcgtggccgaccaggcactcgggcctggtggacccgtgcgagacgccgtgaagggcacggtcgggcccgaaggcgtggcgaaagacgcaacccgggcgctcactggctcgatggaagcgggcggttcgaagcgttcgaagcgcccatcacagggcgacggcggcgggaggcgagagcgaaggccgccgcagccggcccccgccccggagcagcgttccggcgcacaacgtttcagacacggcccgcctgccggtggctcgaagcgccgtgcgtcaggacgaccgcgtcgtcgccagaagcgctaagggcgcggtgagagccagtggtttcccacacgcgacgggagcgcgtggacgtgctaccccatccccatgtctcgcgctccccgaaccgatgcctcgcccgaggggccgaacccctccacttcttcgtccgcgccgccgctggactccgccttcacctggcactcagagagttcggaacccgcgcctgctcggctgtctcctgtgaatgaccgactcagcgcggatacggcgctcaagcgggtgcgccgaggcgagttcctgctgtactccggtgacttccacaacgcgaagcagctcctcggcgcgctgagccggcggctgccgcggccagcgaaggcgcgctcgcccctggaggcattccgtgccgagcggcgggcccggcagctcgaacacgagacgctgtcgcgcatcgtggtgtctctcgaccgcgattaccggctcgggctcgcgcgggcaccggatacttcactggcatgccatcaggtatggggggcttcaacgacggacaccaccgtggtcccgctcaaacaactcctcggcatgctcggggcggcggagtggcgtcgcaaggggctcgctgttcctggcctcactgggctgcttcacccgcactacggcgtctaccttccgacccgcacggattacgtggagttgctgaactcagtcacggaggtgaagggcaagcgcgtgttcgacatcggcactgggaccggcgtgctctcattcatcctccttcagcggggcgcggcgtccgtgcaggcgactgactgtgactctcgcgccgtggcctgttcccaggagaacgcggagcggctcgggctcggcaagcgcttccaggtggccgaggccgacttgttcccgaagggcacggcggacctcgtggtgtgcaacccaccctggattcccgaaccgcccaagaaccgggtggaccgcgccgtgttcgacgaggacagccagttcttgcggcgctttctcgaaggactctccgcttcgcttgctcccgggggagtgggcctgctgctcctgtcggacctcgcggtgctgctcggcctgcgcccacccgggtggctcgaagcggagttcgaacggtgcggcctgtcggtgcagtgggcccggtcgaccccggcgcggcattcgaaagcgaaggacgcgtcagacccgctgcacatggcgcgctctcgcgagcgcaccacgctctactgcctgaagccggtgagcccgtagttcaggtgttgtcgttggcctgctgccgccggaggaatcccccggcggcagcacgagccgcgaatcacctggcgtgacctgtgcggctctccacgtggcttacggatggtgaaggtggacgtcccccgcatttcgatgcgctcggaaaggcgttgcgcgcgcttggatgagccaggggctcggtgggcttgcgcgtgacggagtcatccggccgcacttgtcggagttcggcggccaggagtaagacgcgcggatgcgattgctccgcatcctcatgctcttgatgtgtggattgttcattcctcgcaccgccagcgctcaggccgtcgtggtgagtggacctcccgtggcgccccttcccgagatgacgggggcgggtctctgcgtcgcgacgagcgtctcgcagaatcccgcggctgacttcccccaggctcagtcgacgtacatcgctggtatcaatgccttcatggaggcgaaccggggcaaccgcgtcacttcggtgctgcggacgcccttggacctgtccaacaacctcaatgacgggaggacgctgagctacggggacttcactggggccgtcgcgggctgccccgtcggcgggtgtgacttcggctacagcgatgccgtcacatccttcgcgacccgcctgcgtggcttcatcgcggtcacgagcgacatggtcgacaggcccctgcacttcgggttctacgccgacgactcggtgagcctggcgctcttcgaccgcgaccagacgagctacccggtcatcaaccgtccgctgacgctcggctttccgacgtggcgcgccaccaacacggtccacttcgcgcagcccggactctacggcgtggaggtgctccacacgaacgtcggggagcacgccgcactcgagatgtcggtatacgacggcgtcttcacggacttcgagagggcagcgaccatgccgcccatcatcaatctggctaccgagggcttcgtgcttgtcacgcccggcatgttccatcagacggagtcggggcagccctcgttcccaactcccaccgagtgcgcccaatgcaaccgtcagttcgccaacgcgccagggaatgggggatgcgagacgggctaccgctgcaacgcggcggccttgtgcgctccctgtgattcatcgctcttctgtggggagtcgtgcgctccgtgcggtgcatcgacgccgtactgtgtgagccagaccgagggcttcgtctgtgcgcagtgtcaggatgcgaatgactgtgtggcgccggatgaatgccacctgcccatctgcacggagacgggcaactgcgcctccactcccgtggaggatggcacggagtgcacgggagggacctgccagcagggcgagtgcaggcccgtggacgcggggacccccgacgctggagaggcggacgggggagaggcggacgggggagcggcggacgcgggcccctccgatgggggagcgacggatgcgggagcggcggacgcgggagaggcggacgcgggcccctccgatgggggagcgacggatgcgggagtgacggatgcgggcgcgacggacgcaggtgggcccggcgaggtggacggcggctccaaccctggcgtggatgggggaagcacggacacggacggtggaaatcccacggcggactcgggagttccggccggggacgcgggctctttggctggaggctcgccggaggacccttcggagccggagtctggctgcggctgtcagggtggtccgtccgcgctgttccccatggccctgctcgcgctatcgctcgtcgtgagacgcggtcggcgataggacacgccgtcgcgcgatggaggagcgcgacgcgaaagtcgccgccccttcagctcaacggctcatcacggtagcgccacgtggcgattcggttggactggatgtgcgtctccgccacccacaacctgaaggcctcgcgcttcgcgggccaaggcgccgaggcgtagatctggtcgaagtagcgccagcgcgcgctgtagatggccagcgcgatcgtgaaataggcggagctatagggcagcttctgcgaggggtactgcgacgcggggtagttggcgttgtaggtgaaatacggggcgaggtccgcgatgagctgacacaggccgtcgtactcattgtagagccggtcgttttgatacagcttgatggcgttgaggatgcctcggaactcgttctcaacggagctcatcaccgatgactcaacgccgaggtaaacggccttgacgatgtaccgctgatggcttcccagatgaggttggggttggtggtggagggccagaaaatgcccatcaggctgctgaggaaccctccgatgtccgggatgaggttgatgagcgcccccaccagcgactccagatcgttcgagatggtggcgaagagcgctttttgttcgacaatcgccaactgggtgatggccccattccgtgccgcggacgcaccgggccagtccgcgggctgggcgctgaacatctggaagctgtcgatggcgatgagccaggtctgggggccggtcaccagcgactcgatgtggtcccccaccttggcgctacctggggagctggagccaaacagcgtgaacttgtagtcatccagatccgagacgttctgagcgcccgtgaagttgatgtaggcgtgctggtagccccacatgtcgaagcactgcacccaggttccagaagcgctcgtgcttggcattgatgtctctctcagggagaagccccagccgagccccaccgcaattcgcgcacccaacgacctccaggggtgggcgcacgttttcatctggaagcggggcgttgctgcgtcacgggaggatgcaactgcgttccagccgctgcacgcttcggcgtccaggtctggtccgccaccgtctaccggctgcgtgagcggggcgagcagggcgcgcattcgctccgaaaccttggcctcggcgggtttttgacacccgcaccgaatggctccgaagctcgccccgtcccttcccccgagaggcttcactccatgctcccatccctgtcccgcagcggcctgcccatctggacgctcgtgctcgccatgctcctctgcggcaccgccaacgcgcagttcaccggcaagcgccgcgcctatgcctccagcttctggggtggcaccggcgccagtgggaagaccatctcctggagcgcgctctacgtcgcgctccccctggactacggctacaacgccgccaacaacaccatcgtcaacctggctggcgtcaccgcggcccaatcggacctgcgcaccagcagcacgcgttcgctgaagtggggcacgcagattcgcatcaccaaccgccacccggggcacgcgggctatggccgcagcgtcctcaccacgctccaggactccgggcccgccgatagcatcctcagtgacgccgcgctgggcggccgcgcggcatctccctacaagcccctggggtgctggattgacgtcaccccgggcgtgaaacaggcgctgggcagcacgaagccggagacggaaaacctcatcgtcgacttcgaagtcgtgaacgacctcggcagctcactcgatctggactccaaccccaaccttgccttcggcatggcggccagcgcgagcgactcggagaacacgggcatcagcgcccccatcgccgccgtggacggcaatggcgcctaccacctggagaactatcgcagcgcatggcgctcggcgtaccacgccaacacctcggacacggtgtggctcaacgtcaacctgggccgggcggaggccgtgcgccgcgtcgtcgtgaaatggggcagcttcgtgccccccggctacacgctgatgggctggacgccgggcatgagttcctgggtgacgctcgccacccgcacgggcgcgggcggtggcacgcacgtccactccttcacgtcggaccagacgtaccagtacttcggcctgagcatgagcggcgcgacccgctatgacgtgaaggaactggaagtctaccgctgggactactgacgcccggagtacagcaggtccccagtcctcgccgcgacgcctcgttggtcgagcgctggcctcggtaacgaaggtgcaggccctggtggaggctatcggtcggctgccaaacacgaaggccggcagtcccgagcttcctcaaggactaccggccttcatgaatgcgcggcggaagggattcgaaccctcgaacccgaaggaatgcgaacctgcccccttcgatgtccgggctggagtagggccgtcccttcaccgacctgtgcgtcgggtcgtcagagggcctgattcgcctggacgtcccacgcgacctcgaggctctcgtgcctccggacggtgacgctcctcaggaagcccggcttctgccccggtacgagccggagccccgggagacttcgaagcagcgcctccactgccaggcgtgcctcgagccgcgcgagcggcgcgccgatgcagaaatggaggccctgcccgaaggcgaggtgcttcttgacctcaggccgccggatgtcgaagcgctcaggctcgtggaaccgggcctcgtcgcggttggccgacgcgtagacgatgcggatgtgggctcccttgggaatgggcacacccccaatctccaccgcctccagcgccgtacggaacatggcatgcacgggggagatcatccgcaccgcctcctcgaccgcgcctgcgatgaggcccgggtcgtcccgaagtgcccgcagttgctccggatgctcgagtaggagctccaccgctcccacgatgaggcccgcggtcgtctcatgtcccgcgaagtgcacctgcatcagcaggctcacgagctccgccatgctcatgggcggcgtcatcccctgcgccccggtgacgatgtcgctcagcaggtcctctcggggggacacctcccgctccttgagtgtcgaggccaggtatcgctggaactcgaccacgccttgcgcgcatgcgacctggtgctcgatggggccatgcgccgcgaggaccgtggacagctcatcggaccagcgccggaaccggtggatgtccgagctggggattccgagaatctccgcgatgatgctgcacgacagcggatgggcgaaccggaggaacaggtccgcctgcctctcgtgcctgaaggagtggatgagcgcgtccacgagggtgcggatgaagggctccttctccgcgaggcgcctcccggtaaaggccttgctgacgaggctccggaagcggccatgcgctggcggatcattgtcgacgaggcttggcaccagggggtaaccgtccatcagcgcggtgaccacctccggcggcgtcgtcgcggcgcccaccgtgatggactctgcggacgagaagcgtgtggtatcggcgaccacggcgctgatgtccgcatggcgcgtcaccacccacgcccccaacgccggactgaagaacaccggttcctcactccgtgcacgcgcgaggaacggatgcggattctcgagctggggagagtcgagcgggtggtactcggacccgagtcctgaaggggcgttggtcttggacatgcgtgagctgacctcaacggtttgttgggtggggagcgggacagcggaccacatggtgccagggcttacggcttcgcacacggggctgggcgatgctgaacggagcgtcccatgtccacgcgatgccgcctggcttgcacatagggattcgaaacctcgaccccgagcttgggaagctcggcctcgacccgtccaggcgttatcagccgttcgcaaacccttacttcgccttggggattccgggccgggggcctgtccatccgtcgcagcgggtagcagggagtctcaggggggttgctgcacccgtgctgcaaagtccgggtcccgcgcggctccgcgcgctgccgagcggggcaggctcacgccgcaaggtcgactgcgccgccgtgttcgggcggccagcgcgttccatgaggcatgcagcctggacgcgccgccgtttttgttcccatcactctcggcaatccattcatgcacatccgccagcagcacgatgtggtacgtccctttgggaatgtacgtgagaaggtgatggccgtgggcggcagactggacgtgcctgttccggccgccacggagacctcgctgatggaggagagtcgccggtcattggcgtctgccaggagaattcctaccctggaaccagaaggcgcggcacaactcgtatccaaatcaaaggagagctggggggcccatcaggatgggggcaacttcagaccctctaaaccaccgctcgtgattctcgatcggggttggtgagcgggcgggcgcgcggggcgataggaagaggcaggggcacatcccgttcggctctgtgtgcgcagaagaccaggaatcagaaaggccccgccccgggacaaaggtagtccccgtctttcgcgactgcagcgccgctccctcatccgttggggtgaaaggagcggctgcccgctcaccctgcggcggtgcatggcggtggtgggagtgtcgcgcggcgaatcgtgcaggcaggtagcacgtgctctggcgtgcgccacctccacagtcgtctctgcggtcaatcgctaccggacgggacggcgtaaagccctggtggaccgcagggcggccaatggcgaggcgaaggtggatgagcgcttcctcgccattctctcgcgcgtgctggcgggtactcccgaagaggtgggttggtgccgcccgacgtggacacgagagttgctcgcgctggagatggagcgccggggcctggcgcgggtgtcagttgccaccatgggccgtgcgcttgccaccctcggtgcgagcctgaaggcggccaaacccgtggtgggctgcccttggccgggctggaagcggcgccggcgtctcttcgagttgcgatgcctggaagcatgtgcccggtccgacgagccggtcctctatgtggacgaggtggacatccatctcaatccgaaagtgggacgcgactggtgcctgcccggccagcgccgggtggtgctcacgccaggcaacaacaagaagcgatacctggccggcgccctggactcgaagacgggccgcctcacctgggtggaaggcaagtcgaaggccagctcactcttcatccaactgctttggcgcatcgccggtgagtaccctggcgccccacgaatccacctcatcctggacaacgcctccatccacagcagccagaagacgagaaaggcgctcgagcgactcggcggcgggcttgtcctccacttcctgccgccttactgcccggacgccaatcgcattgagcgcgtctggctggacctccacgccaatgtcactcgcaaccatcgctgccgcaccctccagaagctcatgcggcgcgtccatgcctacctgcacgctcgcaacgcccagcggcgtgccagtcctatcctccgcaaggtccatctgcggagcgccgcctgagcgcgtgcgagattcatgatcgggcgtttaggggctgtccctgattagcgcagccaaagaagcatggatgcgacgtgcaggacggcgaggtagctcgtcgccgtcttgtcatagcgggtggcgacggcccgaaagcgcttgagatcgtggaagaagcactccacccggtagcgcatccggtacagggtgcggtctaacggcaacgcccgcttacggctcgggtttgaatggatgacaggcttcatcccgagctttcgaacgttggcgcggatgcggtcggcgtcatagccggtatccgcaatgaaagcggcgccctcggcgtgcaccataagttcttcggccattgtggactcgtgctgctggccgggcgtcagcgcgacgtggagcggcttacctcccgtcgtagtgacggcgtgaactttcgttgaaaaacctcctcgagaacgccccaaagcattgcttcggatcccccttttccgcccgcggcgtcctgatgcgcccggacgaccgatgtgtcagctctcgag

SEQ ID NO: 1150 - DNA, 19954 bp, Myxococcus xanthus
cattccggacaggcccgaggcgctcgacctgggtgagcgggtcatcgtgggctacaaggcggggacgcaccgctacgtggcggcgttgtcggtggacgccattggcgaggtgacgccgctgtatccggaggcgggcgccagcgcccccgtggcacccggcagcggacagcactggctgcccggaggctgggagttcaccggctccggagatgagcgcgtcatcgtcgtgctgagtgacgagcccctgccccaggagacgctggtggaagccgcccggcgcgcctttgcccaggcggatggcgacgtcggccggatggccgaactggaagtccccggagcgcagacgcactgggtgctgcagaagccatgagccgtctgcccggcctcacgcgcgccctggcgcgggtgctcgccctgacagcgtccgccgcggacgcggacacgctgcgccgcttcgcgctggtggccggcgatgaccagggcggcgccgacacgcgtccgctgcgcttcgctcgggacgacgccgggaagatgcatgcgctcctgctgcggctgggcgacacgaggctggggttcgacgacctcaagcgctggctcgcggagccctcctcgagcatccgcatcgccatcctggattcatgccgcgctggcgcgatgacacgcaccaagggcgcgcgacgggccccggacggccggggcatggcggtgctggacgtgctggccggctaggaggacagccgagcggacattcccgcgcatgaatggtgacgtgcggggtggattctctatgctggccgctgttctcccgcgccctccatgtccaagccctccatcctcgaagttctcaagagcccgcgcatctggctgctcgtggccgttggtttcgcctcgggcctgcccctgtggttgacgggcgtcacgctgtccgcgtggatgaaggacgaaggcgtcaacctgaagacgattggcgtcttcggcctcgtgagcatgccgtacaccttcaaggtgctctgggcgccgttgatggaccgctacaccctgcccttcctgggccggcggcgcgggtggatgctggtgacgcaagtgctgctcatgggcgccattgccgccatgggcctggtgaatcccaaggacgcgccggtgaccatggccgccatggccgtgctggtgacgttcctgtccgccagtcaggacatcgtcgcggacgcgtggcgcacggacatcctcaccgtggaggagcgcggcctcggcaactccacgtacatcaccggctaccgactgggcatgctcaccgctggcgccctggccctgacgctgtcggacatcgccggctggtcccagacgtacttcatcatgggcctgctgatggccgtgggtgtggtggccacgctcctggcccctgagccccagggctcgaagccgccgcgcaacctgacggacgcggtggtgaagcccttcgtggagtacttcacgcgcaagggcgccgtcgccgtcatcctcttcctggtgctctacaagctgggagacgccatcgccgccggaatggtgacgcccttctacaaagagctgggcttctccaacacggagattggcgcgctcagcaagggcctgggcatggtgtccaccatcgcgggtggactgctggccggcgtgctgatggtgaagctgggcacgcggcgcagcctcttcgtcttcggcgcggcgcaagccctcaccaacctgatgttcatggggctggcgctggtgggaaagaacgacctgatgctggcggccaccatcaccgtggacaacctctgcggcggtctggcggtgacggccttcgccgcctacctgatgtcgctgtgccacaagagcttcagcgccacgcagtacgcgctcctgtccgcgctgggcacggtggccaaccgcctcatctccgcctcctccggctacctggctgagtggctgggctggcccaccttcttcgccggcaccgtgctgctcgccgtgcccgcgctggtgctgctcgcgttccttccggagaacgcggccacgccctccgacgagcctccagagacggcccctgcctcgccgagcgtctccaccgcctgagcggaatccgtggcgcgcggtccgccacgccaacgccagacaaagacagacagggcccagaagccttatctgttcaccagcgcacaggctggcgccacgcgcctaagtcggaaagacccgccatcctaggatgcagcggctcttccattcccaaggggggattcgtggcgagaccatccgagcagctcctgatgaaccggcggtggatccttcgagcaggcacactgatgggcctgggtgccggtggcctgtccaccgcgcgcgcccgtggcctggagccccatccccaccggggcggggggcgatgccccgtcgcgtaaagttcgtcctggcctcccgccaatgggacgggctcgccggacaccctggcgtgaacgcctccccagggctcattcggacgccctacgacaccgagcccgctgccgcggcagacccgggcgccgggctcgcgagctcgttccagctccatttccggaactcctacggccatcgaatctggatctgcatctcgttctacgacccggcccggtgcggcgcctggggcgtctggggaacgcggggttggtggtccatcgacaatgggcagtcggcctacgtcctcaacacgacacaccggcaagcctacttctacgccgaggccgccaacggcgcgttctgggccggagacgcccacgccattcatgcgccacagacgactttcgactcctgtctgtggaaccaacggattggtgaccgctacctggggatgcgccccgtgtacatcagcgcggacgtctacacgcagaacctcacgccctgagcgtcggcgccgcgtcaccggaggatgtaacgcggtgcacgctcgccagaatcgttgagccttccgccgtggggcatggctatgttccgcggccatggcccacccgctcgctggcaagccccctccggaagacttcctcatcgaccccgagaaactgcgcgccgcgtacttctccggccggcccgacgtggacgtgccggagcaacgcgtggccttcggcacctccgggcaccgcggttcctccgcgcgcaacagcttcaacgaaggccacatcctcgcggtgacgcaggccatctgcgagtaccgccagcagcagggcatcgacgggccgctcttcctgggcatggacacccacgccctctcctcccccgcgcagcagacggcgctggaggtgctggcggcgaacggcgtgcaggtgcgcttcaccgacggcgccacgcccacgcccgtcatctcccacgccatcctcacgtacaaccgcggccgcacggcggggttcgcggacggcatcgtcatcaccccgtcccacaacccgccggaagacggtggcatcaagtacaacccgcccaacggcggccccgcggacacgaacgtcacctccgtcatcgagaagcgcgccaacgcgctgctgggtgcgggcaacgagggcgtccagcgcatcccccacgagcgcgcgcgcaccgcgcccacggtgaagccgtacgacttcatcaccccgtacgtggaggacctgggcaccgtcatcgacatggaggccctgcgcggtgcgaagctgcgcatcggcgcggacccgctcggcggctccaacgtcgcgtactgggagcccatcgccacgcgctacgggctgaacctgcacgtggtgaaccccacggtggacccgacgttccggttcatgccgctggaccacgacgggaagattcgcatggactgctcgtccccgcatgccatggcgaacctggtgcgcctgaaggacgcgtatgacatcgcgtttggcaacgacgcggactcggaccggcacggcatcgtcacccgcagcctggggctgatgaacccgaaccactacctggcggtcgccatcgactacctctatcgcaaccggcccggctggaagcccggcaccgcggtgggcaagacactggtgagcagcagcctcatcgaccgcgtggcgaaggacctgggccgccgagtcgtcgaggtgccggtgggcttcaagtggttcgtggacgggctgctggacggctcgctcggcttcggcggcgaggaaagcgccggcgcgtcgttcctccgccgagacggcacggtgtggaccaccgacaaggacggcatcatcctggacctgctgtcggtggagatcctcgcgcgcaccggaaaggaccccggtgagcactaccagtccctggcggcgaagttcggcgcgccgcactacacgcgcatcgaccagccggccaccgccgcgcagaaggccgcgctgaagaagctgtccccggaggcggtgaaggccaccacgctggccggtgagcccatcctccagcgcctcacccgcgcgcccggcaacaacgcggacatcggcgggctcaaggtggtggcggagaacggctggttcgccgcgcgtccctccggcaccgaggacgtctacaaaatctacgcggagagcttccgcgacgaagcccacctccaagacatcctccaggaggcgcgcgccatcgtcggcgaggcgttcgcgtcgacttgagcggcgtggcggaggtgctgctgggcgtggacctggccatcctccacgcgagcgggctggcagccggggcctcgtcgccctgttcatcgccgtctttccagccacgggccgcccgcccggctgccctccggtgcgtccttccttgactcgccggggggtgctctttaggttcagaggcttccagtagccccaccgaaatccgaaggacgttccatggctcgcgttaccgtcgaagactgcctccccctcgtcgacaaccggttcgcgctggtgctgctcggcgccaagcgcgcgcggcagctgatggcgggtgcccgccccatcctcgagcagtccaagaacaagccccccgtgctgtccctgcgcgaggtggccaccggccgcgtgaagttcgaccgtgacgtgcgcgaggcgctgtccggcaagtacacgggcgacgagcccaagtagtccccgcggttcccttcagcccccttccttcccggcaatgctcaccggggagggggcttcggggagcaggccctgggagcgcaaccagcgcaccgcccgcgaggcaacggccttctctcctttgtagcccagcagtggcaccagttggaccaccggcacccagcgcacctcgtccacctcgatgcgcggtcccggcagcggccccagctccccctcctgatagcggaacaggaagaagtggacgcgcttgaagatgcgctgtccgcggaactggtacacgtagcgaatctcgcccagcggggccatgagcgacacggacagccccgtctcctcacgcacctcgcggctggccgtctgctccggcgactcacctgggtccacgtgccccttggggagcgcccacaaggtgcggccatggggacggatgacgaccacctcccagtggccggcgctctcccggatgacgacacctcctgcggacgcctcgcgtggcatacccgcccaccctacccgatacggaaggagaaaggtgctcacccgccatgcgcgaaatggcgaagcttggcctccgcccccagccggtaggcgtaacgcaggtccgccagcagccggtccaaccgccgggcggcgacgtgccccatcagccgcgagcagaagcggcgtgacagccggttcgcctcctcgtagcgccaccgctcctggacggagagctgcttgcggtaggacacccggtcgaagagacgctggagcagctcccgcgcccaggcccccacgccttcgccccaccggtgcagcaggcacaccgcgaacttgtccacctccgcctgcgcctccagctccagcagcgacaccgtccggccgtgggccgccgtgtgggccacgtagaggaagtggctcacgccttcggccagctggcagtaaccggccaggtcgctgtccagcacgtaacccagcggaccggattcgtagggcttgagcctgtcgagcagcgccggtgacaggtagagggccagctccagcgcgtcgtctgcctcgtgcaccagcagctcctcgtcggcgcggccggtgcctcccagttgggcggcggcctccgtgtccaccacgaagacctccgcccttgcctcgcacgtgaagccgtagatggcctccaggtggtcctgaacgcggccaatcatccccacctccggctagttggcgagctgtcccttgggccgcggcatcatccccgcgtcgagcagcacgcgctccagccggtcactcccggtgcggacccacgcctcatagaccttcagcacgccgctggggccggcccgcaccatgccccgcgcggagatctcctccagcacctccaccaccttgcggaacttctcgcacagctcccggtacacctgcgcgaagcccgccgccggtgtcagctccgccacgtggccatacgccgtgccacccatctggatgtagtagtccggccccaccacgccgctctgcagcgcgccggagaagaagcccacggtgtacagcgacacgtcgcccagccggcgcagcgtgcggatgcgctcggcgcgctcctgctgcaaggcctggtggtagaggatggccaggggctcgtggtccttgcgcccgccctcctcgcaggtgaacagcttgtgggtgacggcgaactcggacagcaggttcaccaggtagaactccgtcacttccgccagttctacccgctgccgccccgtgacctcgcccagaagaggtgtgaagaactccttcagagacagggacgccaccagtccactcatggacacctcccgtcattccccgggcggacgtcgccccgaggagacctgggaagcgtagcaatcaggtgcgggcgcggcaaaagccactcccagtgattccaagcacttgcgttagcactcgggtatcgcgagtgccatccagcgtcccacggcagcccgccgggcacgaggccacaggttgaggacgtcacggaaaaaccccaacaatgccgcgcagttggcacgttcgggagcggtcagccagcgtcgcttgacgggtcgacttcgctggttattatccgccgcgcctgggcgttagcactcatgaggtgcgagtgctaaccccatgggtcgcgaggccctttttcaacccccaagcagctttcggttgccaacggaaacggcgccggaagcgacatgtaaggagcaggccatgaagattcgtcccctgcaggatcggctcatcgtcaagcgcgtcgccgaggagaacaagaccaagggcggcctcttcatccccgacacggcgaaggagaagcccctcgagggcaaggtcatcgccgtgggcaacggcaaggtgcaggaggacggcaaggtccgtccgctggacatcaaggccggcgacaccatcctgttcagcaagtacgcgggcaccgagatcaagctcgacggcgaggagcacctcatcctccgtgaagaggatgtgctcggcgtgatcgagaagtaatccggcttcccccactcttccttcaaggaaccatccaaatggcgaaggacattcttttcgacgtgcgcgcgcgtgaggccatcctccgcggcgtcaacatcctggccgacgcggtcaaggtcaccctgggccccaagggccgcaacgtcgtcatcgagaagagcttcggctccccgaccatcaccaaggacggtgtgacggtcgccaaggagatcgagctcgagaacaagttcgagaacatgggcgcgcagatggtcaaggaggttgcctccaagacgtctgacgtcgccggtgacggcaccaccacggccaccgtgctggcgcaggccatcttccgcgagggcgcgaagctggtcgccgcgggccacaacccgatggacatcaagcgcggcatcgacaaggccgtgggcgccatcgtcgccgagctgaagaagctggccaagccgaccaaggacaagaaggagattgcccaggtcggtaccatctccgccaacggtgacgagaccatcggcaccatcatcgcggacgcgatggagaaggtgggcaaggaaggcgtcatcaccgtcgaagaggccaagggcctggagacgacgctggacgtggtcgaaggcatgcagttcgaccgcggctacctgtccccgtacttcgtgacggacccggagcgcatggaggcggcgctcaacgacgcgctcatcctcatcaacgagaagaagatctcctcgatgaaggacctcctgcccatcctggagcaggttgcccgcgccggtaagcccctgctcatcatcgccgaggacatcgagggcgaggccctggccaccctggtggtcaacaagatccgcggcgtgctgaacgtgtgcgcggtgaaggcgccgggcttcggtgaccgccgcaaggccatgctcgaggacatcgccaccctgacgggcggccggatgatcgccgaggacctgggcatcaagctggacaccatcaccctccaggacctgggccgcgcgaagcgcatcacggtggacaaggacaacaccaccatcgtcgacggtgcccggtggccagcaggagatcgaagcgcgcgtgaagcagatccgcgcccagatcgaggagacctccagcgactacgaccgcgagaagctccaggagcgcctggcgaagctcgtgggcggcgtggccgtcatcaacgtcggcgcggccaccgagacggagatgaaggagaagaaggcccgcgtcgaggacgcgctcaacgcgacccgcgcggccgtcgaagagggcgtcgtccctggcggcggcgtggcctacatccgctgcctcaaggcgctggacggcctgcagctgtccggcggtgagaagttcggcgtggacatcatccgccgcgccgtcgaggagcccctccgccagatcgtcggcaacggcggcctggagggcagcgtggtggtgaacaaggtcaaggagtcctccggtccgttcggcttcaacgccgccacgggcacctacgaggacctgctggccgccggcgtcatcgacccggccaaggtcagccgcaccgcgctgcagaacgcggcgtccgtgtcctcgctgatgctcaccaccgaggccatggtggcggagcgtccgaaggaggagaaggacctccccgccggcggtggcatgggcgggatgggtggcatgggcggtatgggcggtatgggcatgtagtccgcccctcaccccggcatccgtccggggtgacgtcctgaacgcggcctccggcccctcatggggacccgggggccgtcgtctttgtgggctgggtggcggcacgccctcctggcccttactttggtgaatacgaaggaggagacacccgtgaagcccgtgaagatttttacgaccacctactgtggcttctgcgtccgcgccaaggacctgctcaagcgcaagggcgtggacttcgaagaggtggatgtcaccggagacgacgacctgcgcgcgaagctcgtggagatgagcggtggccagcgcaccgtgccgcaaatcttcattggcgacacgcacgtcggcggctactccgacctgtcccggctggacaccgagggccgcctggagccgatgctccaggcctgagcacgccaggcagccggccagccgcccccgccaaggctcccggctcgccgtgcatagctttctctccgtggcacttcactcatccacgggaggcggcatggcaggcgaagagcggcagacggggacccgggacgagcagtacaacctcatcagcgtcctgtaccacctgctcaagggggcctcgaccagtgaggcgtacatccgggatgccgaggaaatcggcgaccccgagctcgcccagttcttccgcgattggcaggaggagcagcgaaacctcgccgagcgggccaagaatctgctcggcgcccgcatggcgggcgtgtccagggcgggcaccggccgcaaacgctcggcccaagagggcaggcgcggcgcgggctcggtggagaagcaacccaccaacgcgagcgtcgcatcgggcggcaatgacacgacacgagacgccgtggacgaggagctgctggagacctttcccgcaagcgacccgccgggccgctactgaggccccatccggcttcctgcgtccttccgcgagggagtgacgcaggattctggattctggccgaacgttcgtcttgtatggggggtcgtgaagcacaccgccccgttccactgcccgcgcctgatgctgctcatggtggccatcctggccgcggcctgccggagcacgcccttccaggtgcggggcgccgtgcccgaatcgctgggcgcgtccgcggtggtcgtccagcccttcggcttccagtgggcggagcccgactggcgctccgtggagctgtctcagcggctggtgaacgtggccctggcgcagacgggtgacgcggccctcttcttcggccccaccgagctgcaggtggcgcggcccggcgaggacggcggtaacgggctgacgcgcgccgtggtcgcgacattggcctcctacggcgtccggcctgacggattgatggtcctccgcccctcggcggagaaacgcatccagtccggtgaacgtgaactgattgacaccgagggctacacggtgggccagagcgccaccgaggtggtgatgtacgtgggccgtgtcgaggtcctccaccccgccacgcacgaggtggtgctggaggtcttcggggaggccaccgtgaatccctacgcagacatcctcgatgagggcgcggatccggctccggagctgacgagcctcatggaggcgctcacgcgcgaagccctccgcggcctgtcgagccacctgaagccaccccgcgcgccatcccccgcgctggccacctccctggcgtgggcgccgtgggacgtgctcgacatggcggcgtggatgcccaaggacatgaccgacctggaagcgccgctgcgcacagaagccgggcaggacccgcgaagcctgcgcatgcagcgcctgcgcttcgccaacccgcacgcggacgccgcgctgctggaaacactggcgcggcgccccggcggcctctatgtgcgcgccgcacccgagggcgcgaagctctccgcgggggacctggtgctcacgctcgacggccgccccgcacttccccagacacttgcccgcgcacggctggcgctcgtgccagtcgaagcgcgcgttcaacaaccctcaggcaggattgttccactcgtactgccttgagttttcccgatgtgaagaggctcgcgtcgggcttgcccgcccatgcgactcgcacctaaagaggacccgatatggataggcccgaggtcacccagaccactcagacggagcaggaaggccgcaccacccgaatccccatccccgaatggacggtggaggtggttgccggacctgacaagggcaagaaggtgaagacgcaggacggactggtccgcgtgggctccgacagcgcctgcgacctggtcctcaccgacgccacggtgagccgccgccacctggaggtggagcgcaccgcgcgcgggctgatgctgcgcgacaccggcagccgcaacggcaccttcctggacggccgacaggtggtgcaggcctacctgaccagcggcgacaaggtcgagctgggcaagacgaagctctccgtgaaggtcgccccgcgtcccaccgaggtggatgttgcgggggcggagtccttcggcgcgctggtgggcgcctcggagaagatgcgctgggtcttcacggagctgcgccgcatcgcccgcgaggacatgagcctgctcgtggagggtgagacaggcaccggcaaggagctggcggcgcgcgcggtgcaccagcactcggcgcggcgccacggccccttcaaggtcgtggactgcaacctcatctccgaggagaaggccgagcgcgagctcttcggcggcctgcgcgcgggtgacggcgaggaccgcgaggcgcggggcgtcttcgaggcggcccggggcggcaccctcttcatggacgaggtgggcgagctgccgctgcccgtgcagggcaagctgctgcgcgtgctggagacgcgcgaggtgccgtcgctggacggccagccggtggcggtggacgtgcgcgtcatcgcctccacccaccggaacctggaagaggacgtgcgccagggccgcttccgcgcggacctgtacttccggctcgcggtggcgcgcgtgcgcctgccgcccctgcgcacccggcgggacgatttgcccgcgctggcccaggccctggcccagacgctgcgcgccagcatcaccctcacgccccagacgctggccctcttcgagggctatgagtggccgggcaacgtgcgcgagctgcgcaacgtgctggagcgcggcgccctcatggaggagacgggcaacagcagctggctggacttcctcgcccagccctcgcgacgcgcggagggacagccccccaccacccaggtggccacgctggtgggcaccctgccctaccacgaggccaaggacagggtgctggccgacttcgagcgcctgtatttcgccgaggtcatgaaaaccgtgggcttcgacatgaaggccgcggagcagcgcaccggcctgtccatgcagagcctttatcgccttttgaaaaaaaacgggcttcggctcaaggacctcaagaacgccgagggcctggagaagtaaagaagtccgcaagcaggtccacctctagggagaacaaccgcatgttgcgtcgtgttgccgtagcctccgtcgtattcactgccgtttgcgccggccagcataagcccgcagcccaggccggacaggccacgtcgaccgaggagcgtgtccgcatcaccaaccagcccccgttcgacctggtgaattgcttcccgcgcgagctgcagctcccggagcaggcgacccagggcgtcatgctgagcgcactgctcaccacgcgtccccaggtgatggagtgcttggtgtaccccaagcacccgggcgcggagaagagcaccacggtgtaggtcaagacgaccgttacggaccagggcgcttcgcacgccgtcaccgggacgaacctcaccccgtaaggccaggcctgcatccagaaggtggtggacacccaggtgaagctgtccgcgctgcccaagggcgcgcagccggtggaggcggccatccccttcgagcacaccaccagcggcctcaactccgtcaccttcaacatcaacgagggctcggacttcaccggcgcggtgcgcctggcgcagccgacctggtgtgagtgctacgccaacttcaaggagcaggtcccgccgccgctgacggcgaagatcaagctgctgaagacgcagcccaccccggccgaggtcaccttcgcgccctccggcaacaccgaggcggaccagctggccgcctgcctccagccgaagattgccgcgctgccggcaaagctgacctccgacgagctgggcttctcctaccgcttcgtccacttcgactcgtccgcgccggacgccgcgtcggccgccctgccgcccgagctgcgcttcctccaactggacctcaaccgcacccagcgcgcggcggactcggccatcgccgatggcgcccgcaccccggcggccctggcctacgccgaggtcgtggaccgctaccagaagaccaagaactggcgcctgttcgacgagatggccagcaagtgcgacgcgctggtgaaggcggacgcggacgtcatcgagtccatcaaggcccgccaggccacggaccaggccgcgctggcgctggccacggagatggcggcgaaggacgcggagaactggggtgacgtcgtcaccgccacccagaagaacgtcgacgagtccgtgaaggaactggccgacgcggagaagatggccgcgcaggacaaggccgcctgcccgaagaagaagttctaggagtccccgccccacggcggaaaacacgaaggcgcgggagcccggaagccggggcccgcgccttctgtgtttctgagggagaaaccgtcgccgcggggcggacaccggaggcccggtgccctgcccgcccggacgggcctacgccgccgtcaccttgtcgtcgttggccgcgcccgcctcgcgcatgcgcacgctgacgagcttggagatgcccggctcctccatggtgacgccatagagggtgttggaaacctccatggtccgcttgttgtgggtgatgaggatgaactgcgactgcttgctcatctccttcaccatgtcgttgtagcggcccacgttgccctcatccaacggcgcgtcgacctcgtcgaggaggcagaagggcgtcggcttgatgaggaagatgccgaagatgaggcccacggcggtgagggccttctcgccacccgacaggaggttgacgctctgcagcttcttgccgggcggctgggcgacgatttccacgcccggctccccgcccggcccctcgttggtgaggatgaggctggcccggccaccgccgaacaggcgggggaagatggcctggaacttctcgttcaccacgtcgaaggtctgcttgaagcgctcgcggctggtggcgtcgatgcgctggatggcctccttcaactgctcgatggaggactgcaggtccttcttctgcgcggtgaggaaatcgtagcgcttggacagctccgcgtgctcgtcgatggcggtgaggttgatctcccccatcttctccacctgcgcgcgcaggtccttcagatcggcctccgtctccggggccagcgcggccagcatgtggtacttgtgcagttcgttagccagctccacctggtgccgctcatggatgccccccgccaggtgctccagctccagggggatttcgcgctcccgcagcgagatttgcgacaggccctgcatcagcttgtccacgcggccgcgcagctcgcggaacgtcgcgtcctgctcacgcacctccgcggaggccgtggtgtgcgccgcgcggtgcgcctccagcccttccgcggcgagccggtgctcctcggcgcgctgggacaggccgccctcggtgtccgtcgtgcgccgcgccagctcctcgacgcgcgccccaccctccaccaccgtggcctggagccgggtgatgcgcgtctccatgtcctgacgctgggagacgaggctgtccagctccttgcgggccgactcgccacgctcgctgccagcggccaccttgatgcgcaggcccgtcagctcgccgttggccgtctctgcgcgcaggcgcagcgactcctgttcggacacgagctgcttcacccgctcctcgcggccctcgcggtccgcctggccgtgcgccacctcgccgcggctcgcctcctcctcgtgctccagggcctggtggctctgggtgagctgcccctcctccacttccagggcccgcacccgctcgcgcacgcgggccaggtcctcgcccgccttgtgcaggtccttctcctggctggcgaggttcagctcctcggcgtgctgattcttcgccagccccttgaggacgccctccgcgtgccccatctgcttctggagcgtgtagtgccgggtgagaatctcgttgtagcgctcctccacgcgggccacctcggtggccagctcggcgatttcgcgcttcttctggagcgcgcccaccgccgcgccctcgctctcaccgccgacgatggtgccgtccgggcggaacacctcgccctccaccgtcaccagcgtgcacgccgggccgcccgactcggtccacgcgcgcgccgtggctacgtcctggacgatgacgacatcccccagcagcagttggacgagcggcgtcagcgcctcctcacacgtcacctcacgcagggcatgcgcgagcacgccgggctggctgaagtccggctccagcggggccggcagcgtgtccagcgcgggcaccgggaggaagctgccccggccctcggcgtggcccttgaggtagtccaccagctccacgcccttgtcgcggctctcgacgatgacgtgctggagccgctctcccagggcggcctccaccgcgcgctcgtagcgcggggtgacgttgatgacgtccgccaccaggccgaagatgccctgctcacgggcctgcacaccggcgcgcgtcatcacggcgcgcacgccgcggtcgaagccgtcgtagttcttctggatgtcttccagcgtggagaggcggctgcgcttgtcgctcagctcctcccgcagcgcgatgacctcgatttcgttctccgtgaaggccgcgcgggtgcgggtgagcgcgtcctcctcctggcccttgcgctcggccagctccgcggcgaggtgccgggtgtcctccacccgcttcgccacgtcgccccggacgttctccagcgtctgctcctgggcgcgcagggtttccagctcgccctggagcttcgcgcggcgggcacccaaatccccccgctggcgagcgaggttgaccaggttgctctcgtggttggccaggcgcgtggccacggccaccaggccggcgcgctcctgctccaggcgcagcgccacctccgtctggagctgggacacgcggcgcagttcctcctgcgccacctgcatcgcgacctcgtcctccttccacgagccggcgatgcccgacagctccgcctcgcgggcggccatggcctcggacatctccgccttgcgcgccaggagcccgtccagctccacctgggcggcggccacgcgggcccgcgtctcctccaggtcgcgcttgccgtaggtcatctcctgcgtgtcgcgctgcagggagctctccagcgtgtgcacctccgcggccagcgcctggagcgcggcggtttccgcctccaactccgtgcggcgccgggtgatggtctcctccagctccttcacccggtccaggctctcccgctcctcggagcccaggttctccagccgcgactggagcatcttcttctccgccatcagctccaactggcggtgcgtggccgcgtgcaggtcgatgtcccgcatgcgcgccttgagcttcttgtacttctccgccttcttcgcctggcgcgacagcgcgtcgagccgcttctccaactcgttggtgatgtcagtgacgcgcagcaggttggcgtcggtcgcctccatcttgcgctcggcggccttgcggcgggccttgtacttggtgacgcccgcggcctcctccagcaggtggcgccggtcctccggcttgctggacacgatgaggcccacgcggccctgctcgatgatggagtacgccttcgtgcccacgccggtgccgaggaacaactcggtgatgtccagcaggcggcacagcgtcttgttgatgaggtactcggagtcgccgttgcggaacaggcgccgcgtcaccgtcacttcggagaagccctggtactggggcgcgagctggtccgtgtcatccacgatgaacgtgagcgacacctccgccatggacagcggcggcttgttctccgagccgttgaagatgacgtcctccatgccgcggccacggaggttcttcgcgctctgctcacccatcacccagcggatggcgtccacgacgttggacttgccgcagccgttgggcccgacgatgcccgtcacgccttcgtcgaacgtgaagacgctccgttccatgaaggacttgaagccggtgatgtccaaccgcttgattcgcatgccagcgggctcctagagcgggctcggtacgaggagaaaatcgcgcgcgaggccgaaaaatcggcctcggagcgttcagcagaaaggagtaccagccaccttccaggtgatcaagcatggccatgccacgcatcgccatacgttcggttgcctggtatgcgacagagcagacgtgctctgtagctgtagcgcgcgcactgcgaggcggcggcgtgtgcaccgcgcttctacgctcccatgacgtcctcccgctggtgcggctgcttcagccctgttgagtcctgttgcgccacgcgagcgcgtgaccttccgcgggacgtagcattccggtctgacatgccctcggcggacgctgggttccttcgacacgcccccacccgagcccacacgaacgcgccgcccttgcccacctgacaggcaggcgtgtcgacgcggtgcggaagggcctcgtcgagcacgcgaacgccggtatggcagccgcgcgtgccgggcatcacgcacgcatcatgacccgggggaagggtgagacagaaccgccgcgtcgtgaagcgcgggtcgcccgcagcgaagaagccccagccaggaaccagcgtctacgggctcaggactcgttcgaggcgccagagggcggctcaccggcgcccgccgagccgtccgacacggtgcgcgcggacgccgtccgcgcttgcggctccacggtgacacgcaccacgcgtggcccttccaccgcgtccacgacgatgcgccacatgtcgagccgcagcgtgtcccccttcacgggaacacggcccagcctcgtcatgaggtagccggcgatggtcgtcacttcgccctcttcgtcctcatccaggtcgaagttgacgtccagccgctcctccaggtcgtcgagctgcgcggtgcccggcagctcgaagcggccgccaggcagcgcgcggacctcgtccatgcggcggcccagctccgcgacgtcgcccaccacctccgccaccacgtcggcaatcgtcaccagcccggacgtgccgccgtgctcgtccaccaccagcgccgtctgccggcgccggcgccggaactccgccagcaactgctccagcgtggcgccctcggggatgaacagcaccggccgctggacctgcgccaggctgcgcagctcgccccgggacagcaggaagaagaggtccttggcgttcaccacgccctcgacctcatcgagattgccccggcacaccggcagccacgtgtggcccgccgcgcgagcatccgcgatgcacttctccagcggctcttccacgtccaggaacttcacctggttgcgcggaaccatcacctgccgcgccgtcttctgcgccatctccagcgcgcgctccagcagctccgcgcgcgccgtcgtaatcgcgcccgcctgcgccgagctgtggaggatgaccagcagctcatcctcgctgtgcgcctcgtgcgcctcccccaccgactggaggccgaagacgcgcagcacccacgccgccagcccgttgagcaggacgatggccgggtagaacaggacgtagaacacccgcatgggcagcgccaccgcgagcgtcgtgtcctcgggccgctgaatcgccaggctcttgggcgccagctcaccgaggacgatgtgcaggaaggtgatgatgctgaagccaatcaccaccgccgcggagtgagccaacgtggtggcggcgccctccggcaccagttgcaccagcaccggctccaacaaacgcgcgaaggccggctcacccagccagcccaggcccagggaggccagggtgatgccgaactgcgtggcggagaggtacgcgtccagcttctccaccatcttcatggccgtgggcgcgcccggcgcaccttcgtccaccagggcctggagccgcgtggcgcgaatcttcacgatggcgaactcggtcgccacgaagaagccgttggcgaatacgaggaggatcgccaaccccaggaacaaccattcgttgcccatggctcagaacaaggcttcgaagtccgggtcacccttgagggcgtcgaacatggggtcggtggacagccaccccatcaccttcggccggtccgcggtgagcgacttctgcaggtactgcacggcgtccttgggacgcccccacagcgcgaacagcgcggacaggttgtagttgagcagcaggtcttccgggttgagcgcccgcgcacgctcataggcacgctccgcctccctgagagcac

SEQ ID NO: 1151 - DNA, 17480 bp, Myxococcus xanthus
caaaggcccgtctcaggcggcgccccaggggcgcccacctcagtcgaagatgttgaagttcacctcggaccgggcctgcttgtagcggctcttcacgtcctcgatgatggtgcggaccttgtcggagtccgggttgacgatgcgcggggtgacgaagatgaccagctcgcgcttggtggagtcgaaaccgcggctcttgaagagctcaccgatgatcgggatgtgacccaggccggggagcttcgacacggacttctgctcgtcgtggctgaacacgccggacaggacgatggtctcaccgtggcgcacggtgacgttcgtcttcaccttccgggtccggaagccggggatggaggccgaaccaccgaaggacaccgccacggaggtgtcgatttcggaggcctccgcctcgatctccgtctggatgttgccgttgcggtccgcggtggggcgcaggttcaggatgacgccgtacttcttgaactccaccgtgaactggttgttcgtgatgagcgggatgggaacctcgccaccggcgaggaactccgccttctcaccgctggcgcacaccagcttgggctgcgcgagcagacggccgtaaccgtcgttgccctggaagccgaaggagaagtccgcgttcgcgttgagggtgagcgtggaaacgccggagccgaaggtgcccgggaagagctcctgggagatgctggcgatggccgtcgcggtccccgtgatgtccgtcgggtagcggatgccgtagcggtctcggctgttgcggcggatttcgacgaactggacctcggagaggatcatccgcttgatgccgacgacgaggaggttctccaccttctcaccgatggccttggtgatgagctccgccttctggagatcctgctggctctccacggagccctccaggaagatggtggcgcccaccacgttggcctggacgttcttcaggcccgccttctggaaggccgcattgaggttctgggccaccagcttcttggcgttgggggcaatcttcacgaacgacttcacgttcgggtagaggcccaccacctgctcgatgcggtcggcgtcctgcgtggtgtaggcctgaccgtccaggtagatgcgatcacccaccatgcggacggagacgccttcaatctcacccagcaagcgcttgatttcggagatgacctcgttggggtcctgcttgcgcaccgccaccaggtagctgacgcgctggcccgaggacttccagacgagcagcgtcgtcttgccttcagcctgaccggtgatgagcagctggccggagccgagcgtcttcacctcggcgacgctcggatcaccgagcgccacgcggctgagaccagggatggtgatcaccttctgggaacccacgccgaggctgacggtggtgccatcctgcgccagggcgctgccgcccgccaccagtgcgatgagggcgcctagcgccgcggcatgcgtgatgcgtgtgaacatcgtccgtgtcccctcttctcttccagaagtccgagctaacccaacgttccgtgctgccaccacagcgcccagacggtgccgagcgcgatggccactccatggggaatgtggcgctggggcgccggctgcgcgtgcgtgctggccaaacgcacccacaccgtccaccggcgcaccactgccgccagcgtgtcccaaaccgcgccttgccagagcagtgtcaccaccgcttgaagcgcacccaccagtgagatgaaggccgcggccgcgagcaccgccgggaagcccagcacggctccgaccccgcccatcaacttcacgtcgccccaccccatccgcccgcgaagcgccgctgacagcagcatcaacgcgagccctacccccgataccacaccactgatgagcccatgctccaggtcccccaccccttcggtggccaggcgcacgcccagacccaccgccatcagcgggtaggtgaccgcgtcgaggatctcgcggcgaagcacatccgtcaccacggagatcacgagggccactccaagaaccgtccacaacgcgatttgaacaggcgtcatcatcgcctgtcctcttcgcggcaggcgtccggtatcaaaccagggacgcctggagcccgtcaattggcgaacaaccagaagccccgcgggacggggcctgggtcacctcattatcggaccaggagacggattttctcgctgcagatgaaatactcgtccccgtcctcaaccttgcggcgcttgatgcgctgcttgttgaaccaggtgccgttggacgagcccaggtcttcgatgatccagtcgtcgccctcgtggacgatgaccgcgtgctcacgggagaccttgccggagttgatgacgaagtcgcagtgcttgccgcggccgatgacgaagcggtccttgacgatctgctcctgatcaccggactcggtcaccaggtacagcgcgccgacctcctcctcctcggcgaggtcgtcggcgggctcttcctccgcctcatcggggggcggctcctcgtccatgaggcccggatcctcggcctcgggcagcggctcctcgtcctcctccaccatgtcgtcggcgggagggggcggctcgctgttcttgcccttgatgaggcgctccagctccgcggcggtctccaggacgcgctcggccacctcgcggcgcaccgggtcattgtccaggccattggcgggggcccgctcttccggcgtggcgcgcacgggaggacgcgcgggcgcgggcgtggactcaggccggggcgcgggcgccagcaccggcggcgcggccggacgcggcggcgcggcggcagcggcctgcacgggcttcaccggcgcagcggccacgggtgccacggcggcctcggagcgggacttcacctcgaggaagccgttcaggcgcgcgaacatgaagagcgcctggttgatcagggcatcgcgatccgagcccatctgctgggccatgtcttcgaacgcctcccacaggtggtcggcgatgcctaccttgcgggcaggacgggagttctgatcgatcatcggtcttgactcgcgtgaaccaggaagccccggacgatagcagaggcctccactcccgcccagttactcgaagggaaccagtgccaatgactgcgcccggttgtcggtgagcccctgaaagccgacctggaggatgccatccgccgacgggtaggcgatgtaggcgaacctcgcgctgcggtcctgggcagccaccacaggcccaggcagcgtgtagaaggccagctgcgtccccgccctgacgtcaggggtgaagacgtagtttcggatgccggaaatcaccgtcaccacgtagcggtctccccgacgcacctcgcggcccacggccgccacgcgaatgcgcagcggcggcggcggctgggggaacttggacaggttcggcaccggcggcgtctgagggttggagtcgtcgtcgaagtagaaggtgtcggggtggaagaagtactccgtggggatgctgtagctcgagccccccgtcacatcgcgggacaggaaggtgcccgcctcgtcgaagaggacgaagggttggtctccacccgcacggacggtgaagcgcgtcaagctggcgcagtccgtcggaatctcctgcgagtccgcgatggcgaagcgcacccgggtggtccccgcaacgggctccaccgacgcgatgggcaggtcaacggcgcacacgacatccgtgccctccaggacgatgatgtccccggcccgcgccgaagcggccgcagtggcctcgacctcaaagagccgcggggtggagggctcccgaggcaggccgctcagccctggcaacgcgccctggtagatgatccggtagaagccgttcggaacggagccctcgtagagcaccgtcgactggagcgtctggtcttgggtcaccgtcaccaggtccgccgtctcgatgacgatcggcaactcgttgctgtccagcagcgccaccgtggagcgtgcgctcgcccccgacaggtcgaattggcgcaggtcgctcgcggagaacaacgagatgtagccgttggaggacggcatgacgcccaggagcggcacccgcacctcggtcgccgagccatcgtcgagcacgatgcgaagctgcgcgtccggaaccagggtcagtcccgtcggcaagccgcccgcggggaagatgggcagcatcggcgcaccgctgaggtcccgcgccgtctgcccagggggggatgactcggtgtccaccgcgagcactccggaacactcgcgcgcggcagagcaagaggcctcgtcacggacgccgaagatgtagcggcccgcgttgatggcctcgacgtcggggatgaggatccgggggtggctcaccaggagccgcaccggcacgttgccgaagccctcggacaaatccatggtgggcgcggaaggctgaagacagtccgcgaccggccccgaatcggtgacgagcagcgtgcggcccgaccggcccgaggcctgccgcgtggccaccgcgaactggccctggcccgccagcatcgtcatggacaggatggactcaccgggctggagacagaacaccgtcaccggttcgggaatcgccgcgggctccgcggcctgcagtgcgtctggccccggaatctcctgccgcagcacccgggcgccaccggtgtccgcgctgaagatgccgtcggggtcctggatggcgtagtacagcgtgctgggtccgccgctgcccgcagcgggcgagcgcgccgcgaaggccgtgacgatgctcggcgcctggagccggacgacctgccggagctggtcgcgcgcggacgccaccaccgaaaccgccgacgagcccgagctgcgcgcgtagatgtacggccccgggacgtcgttgccttccgcgttgtacgccacgtcgcgcgtgagtgcgtccggccggtccagcacggggatggacagcgcctccagcgggttgggcgcggggacgaaggtgcgcgggttcgagtccaggtcgagcacgcgcagctcgtcccggtccgacgacgtgacaaagacgaggttgttggccagcgtcacgtcgaaggtgccggacaggccagcgaaacccgtcgtcacgttggtggaggagcaactgccggacaggccggcgctcgcgaggagcagagcaagggtaccgcgcttcacggtgaggtctcctggcacaggctggtgccctggcgcgggtctcttccctgccgggcgccgagccgcgccaccaaccgggcgttctgcggccggtcgaggtcgggaatgtcgatgatggccacgcggccgtcaccaaaggtgctggtgaagatgcgagcgctgttgccgcggacgtccgcggccaggccaaagggctggctgggctggttcggatcgttgtcgcccacctgcacctgggcgacgagctgccccacttcttcgtcgaagatggccacggcttcgtcgccgctgcccgtcaccgccaccaggttgccgcgcccagggccgcgaggaatgacttccagttcgctggcgcccgcgggcaccggcagcgccgacacgatgcgcacgctgggggtcgtccccgcgtcgggcgccgtgcccgccgcgttcaggacgtccaggatgagcaacgtgtccggaccgcgcgccagcaggtagacgcgctcgtccacgatggtgagctcgggcgacgccgggtcgggcacgcgcgtggccgagggaaccaccgccacgccgcgcgcctcacgcaccgagtacgacagctccaggtcggtctccagcacgcggcccgcgacggtccggtccaccagccgcaggatgaagcgcgccggcagcgcccccatctgcgcggaggaagagttgcgccccgaggcgtacacataccggctgccaatggccgtcgcgtgcgcgacgccagagaggcggtcattggtccccagcgccacgaactcgctggtgttcagcgcgtcgcgcgtggggttcgccgcggggaggtgaagcacgtagcccgccaggtccgcttcggcgaaggtcgtcggcggtccggccagttccgtgtgcgtcacccagacgcgagcgtcctcgccgttgccggcgacgctgacccccagcggccccggagccgaaggcaatccgttggaggcacctgggacatccagcagcgacagcgcattgacgcggcagtcgcgctcgccgccctgcacgcagctcaggctgaggccgtcatcgcccacgtcgatggcgtgaagcagactgccctccgcccgcgccgggacgaacagccgcggtggccgccccggagggctccacaaggccatctccccagcgaagctttgaatctgcacgtaggactgggcgccgatgccaagcgacgtgacgtcgttgggcagcgactccccggggtcgaagtccgtgccgaagggccgcacccccacggcatccaaatccagcgcgacgaccgaacccgagtcgtagcacttgtcgaagttggcgctcgccacatagaggtatccgttggtggacggacccgcttcggggcgccagaaggcaagaccgctcgggtacacgagccgggtggacggaggaggcttgctctcggtgccgacgttgcaggacacgaggagcagcgcggaggtaagaaggtaggcgcgcatcggaggggggcggagtctaggaaggggtctccccccgggcaaccggaaacgcggcgggccattcccatgcgccttgcgcccgacgcagccgtgccccccggggtgcttcattccccggagggcaggcaggccacgcatcaggccgcggcggctgtttcagcctggatcttcgagaagtcggccacctggttgaacagggcgccaatctccacgagcaggcggatgcggttttccctcagggccttgtcctcggccatgaccatcaccttgtcgaagaaggtgtccacggcgggcttcaggcccgtgatttcccggagagcaccggagaaatcatccacgcgcaccaaccccgacaccgtgctccgggcctgggtgaaggcggtgtggaggttccgctccggctcgtccaccagcttctgggggttggtctcccccccctgcacgtcgcggccctgcttctccacgatgttgaccacgcgcttgaaggccacggccaggggctggaagtccgcccggccgacgatgtggctcagggcctccaggcgcttctgcgcggccaccaggtcgtcgaagccggcggacagcaccgcctccacgacgtccgtgcggtgctgctcaccccacagcgccttgaggcggccgcggaagaactccagcacctgctcacgcggcgcgggctcgccggccttgcgcttggcgttggcaatcttcggcgccagcaaccggagcgactcgtccaccgcggccgacaggctgaagcggtaaccccgccccagcaccagccggatgatggcgatgcacgcgcggcgcagggcgaacgggtccgccgcccccgtaggcgccttgccgatggcgaagatgccgcacagcgagtcgagcctgtccgcgataccgatgagcgcgcccgggtcctgcgtgggcagcgcgtcctcggcgccacgcggcaggtagtgctccgcgatggccagagccacggcgtccggctcaccgcccgcgcgggcgtactcccggcccatgatgccctggagctcggggaactcgcccaccatgccggtgacgaggtcggccttggccagggtggcggcgcgctcgatggtagccgcctcccctgctcgccccgcctcctggcccagccacaccgccagcgtgcggaaacgctccaccttctccaggtagctccccagttgcccctgccacaccacgcggcccagcttctccacgcggtcgatgagcggcgtcttccggtcctcgtcgaagaagaagcgtccgtcggccagtcgcgcgcgcagcacgcgctggtagccacgcaggctgagctgctcgtcgcgcaccggcgtgttggacacggcgatgaacttcggctgcagcttgcccgcgctgtccaccagcgagaagtagcgctggtggctcttcatctcctgcaccagcacctccgggggcaggtccaggtggcgctcctcgaaggtgcccaccaccgggctgggcagctcgaccaggttagtcacctggtccaccagcgactcgtcctccagcagttgggctccggccttgctcgcggccgccctcaccttctccaccaactgcgcgcggcgcttcgtgatgtccgccaccacgtgcgccttctccagcgccacctcgtactccgccggagccttcagctcgatggcgtcaggcgacaggaagcggtgcccccgcgtggtccggccgctcgtcacgtcaccgaacaccacgggcagaacatcgctccccagcagcgccaccagccactgaaccgggcgcgcgaaggacgtgtccacgtcaccccagcgcatggacttgcggaagttgatgccgtgcaccgccgcgtgcagcgtgtccttcaggatgtccgccgccgggcggaccttctcctccacgcgcgcggacaggtactcgcccttggcggtggtggcgcggcccagctggtccaccgcgagcttgaggctctcggcgaacttctccgccgccttggtgggcttgccctgcgcgtcgaaggccgccttggcgctggggccgagcacctccttgatgatgtcctcgcccgcgtccgccacgtccttcacccacaccgcgagccgccgcggcgtgccgaaggtccgcacctcgccgtgcttcaggcgggcatccgccatgcgctcggtgatgacgcgcttcaggtcatccagtgcggggccgatgaaggacgccggaatctcttccgcgcccacttccaggagcaggtcacgcgccatgggccacctccgccttctgcttcttctccacgggcttgttgaggacgaccgtcttccagtagtcgctggccggcttgccctccagcaccgggggctgctcacccaccgtccacggcgacttgagcagtgggtagcccagccgctcacgcatctggagatagccctccgcgcacagcctggcgttgtcgcgcacgcgcttgatgaagttggcgcgctccgtgacggagatggcgccgcgcgcgtccagcaggttgaacgcgtgcgaacacttcagcgcgaagtcgtacgccggcagcggcaactggcgttcgatgaagcgcttgcactccttctcgtacgcgtcgaaaagcgcgaagagcatctgcgcgtccgactcctggagcgcgtacttgctcatctccacctcgttggggtggaacacctcgcggtacttcacgcccttgacccactcgaggtggaagacgttctccacgttctgcaggtacatgcagatgcgctccaacccgtaggtgagctccacggagacgggcttgcagtcgaagccgccgcactgctggaagtaggtgaactgcgtcacctccatgccgtcacaccacacttcccagcccaggccccaggcgccgagcgtgggcgactcccagtcgtcctcgacgaaccggatgtcgtgctccaacgggtcgatgccaatcttccgcagcgactccaggtacagctcctggacgttcttcggcgccggcttgaggatgacctggaactggtggtgctggaacaggcggttgggattctctccgaaccggccgtccgcgggacgccgcgagggctgcacatacgccacgttccagggttccggccccagggcacgcaggaaggtgtacggggccatcgtgcccgcgccgacctcgacatcgtagggctgcgtgttgatgcacccctggtcggcccagtgcttctggagcgtgaagataaggtcctgaaaatacatagcgcgcggaccctagtgacgggggtccggagcgtcaaggacggcgctcactccttgtacggtgggagatccgccagccggatttgaatcttcgtctcctcgcccggcttgatgggagccgacaggagccggctcaccgactccacccccgtcgggtccaccacgcgcaggcggtagacccccacgggcagcgggaatttcttcaggggcgtggtgcccagctccgtggcgccgtcgaacacggccgcccgcggcaccgtgtagagggtcatccaccccaggcccgccttcgcggcccccttcgcggtgctggtatccagcacctccgccattccctcggggtcctgcgtcaccgtggtgacgggctcggcggccggctgggcagccgccacgcgaggcgctggctcacgcggaggtgggctggcctgcacgggcggcgcggccttcgcactgacaggttcggcctcggccttcggggcggctgctcggcgcgacggcgaagaggcaccttccttcgccttctgcccgggcggggcctttgtcggagccttggcttccggcgcgccgtccaccgcctcttcgtccgagccttcgccgccagcagcctgctcgacctgggcaacagcttgggaaggctcggcctgacggaagccgggtggcgggcccgcctgctgcggtggccagggctggttcgcggggtcctccgccggcggcggattcaactccgcgctcacccacgccttggcggcctcgaagcccggcaggagctgcgcacgcacggcaggcagcgtcgcagcccaaccgaggcctcccagcagaaggagcaggaacagccgactggcccagcgcgatggcggacgggctgcgggcgtctccaccggcgtgtccgaggcccgggacgtatcggggcgcgccgaccgtccggagacccgagcaccgtccgcgccgggccgctggggccgggaacggaagcgctgcgtctggagatcgctcggctcgtcgagagattcggactcggccgggacctcctgccgggcagtgggccgcggccgaggtgtacgcgcggccggcgcgctgtcctgccctccgcgcggtgtgcgcgaaaccggagaagccgcctcactggtccggcgctgaggggcgggcttgggcgcgctcccgttgccggcgactgaggggccacgcaaggccacgccgccctccgccggacggcgctggggcacgggcttgggcgcgctcgaatgcggggccgaaggcgcaccaggccgggcgcgcggggccggcatctgcgacgtgggggcggagtccgcgctgtcctcctgctggagggcacccgccgcctcgctgacgcgggcatcctccgcgcggctggccagctccaacagcgtgcgcgtcttctggcgcttgtcggcgaagaggtcgcccatgacggcggtcatggcgtcctcgtcgaagagctccgagccgagcgccgcttcaatggcgcgcgccatctcccggcagttggtgaagcgctgggacacgtcccgggacagcgctcgcgtcgccacggcttccaaggcttcggggacgtccgggttgatgccgcgcagcggaggcacgtcggcctccacgatctgcatcatcaccgccgcttcgtgcggcccgctgaacaaccgctggccactcagcagctcgtgcagcatgacgcccacggagaacaagtcactgcggccatccagggtggccacgcctcgcacctgctccggggacatgtagccactggtccccttcaccgtccccacctgagtgcgccccaaccgtccgcgcgccttggcgatgccgaagtcgatcaccttcacgacgccgtcgtaggtgagcatcacgttcttcggagacacgtcgcggtgcaccaccaccgcgggccggcccgacgggtccgtgaagtggtgcgcgtagtgcaggcccaggcaggtatcgcgaatcacccgcccgacgaagccgagcggcaacgcgtagccctggcgcgtggaggctttcatcacctgctccaggttctgcccgggcaggaactccatggcgaggtacagctcgccgccatcctcgcccaggtcgaacacctgaccgatgttcgcgtgcgagaaggccgcggtgatgcgcgcctcgtccaggaacatctggacgaattgctcgtccttcttgatgtccgggagaatctgtttcaccgcgacgaacttgcgaaatcccccaggccccgaggtgtaggccaggaacagctccgccatccctccgatggagaggcgcgtgaggatttcgtatttcccgatgcgccgcccccgatcgggatcgtcaccggcgccaccctgcatggacattcggcgcggcatgttaactcccgcatgggtccgagtcgaccttcgtgacgaccccttcctcgacaagctggagggggctcccgcacaccgcgtcggggactggcaccggctggctgcctgcccgtgcgccggccggagtgtccgatggccgatggccacatcgcgcgattccccgtgacggaggggggcgtgttctcataccagcaagtcagagtaggaggctcatggaagacaccaacggctgccccggacttgccaggcgcatcgcatattccgggcaaggcgaatccaagcaagacgccgcggaccagctccggctgttgattgagagcgtcactgaccatgccatcctgacgctcgacctggacggatacgtagcgagctggaacccgggcgctgagcgcatcaagggctaccgcgcggacgagattctggggcagcacttcagccgcttctatccgcccgaagccgtggcgcggaaccggccgcggcacgggctcgaggtggcgacgcgtgagggccgcttcgaggaggacggctggcgcgtccgcaaggacggcagccgcttctgggccaacgtcgtcatcaccgcgctgtatgacgagacagggcaactgcgtggcttcggcaaggtgacgcgcgacttcaccgcccgctaccaggcccaggagcaacgggagatggagcgcctacgggaggcgcttcgcatccgtgacgacttcctgtccgtggcgtcccacgagctgcgcacgccgctcaccccgctgcaactgaagctgacggccatgcgccgcgccgtcgacagcgccccgggaggcatgctgccgagcgagcgcgtggagcgcgacctcgacgtcgccgtccgccaggtgcgcaagctggtggagctggtggacgacctgcttgacgtgtcacgtatcagcgtgggccagctggccctggagcgcgtgcccgcggacctcacggcgctgcttcgagaggtcgtcgcccgctacctgccacaagccagccagctcggaagcaccgtggaactggacgcgcctgcgcccgtgcagggcgaatgggacacacgccgggtggagcaggtgatgaccaacctcctctccaacgcgctcaagtacggagggggcaagccgattcacgtcagcctgcgcgcggaaggcggcatggcgctgctgagcgttcgcgacgagggcatcggcatcgcgccggaagcactgccccacgtcttcgaccggttcatgcgggccgtgtccggccgcaacttcagtgggctggggctcggcctcttcatcgcccaccaggtcgtttcggcgcacgggggcgacatccaggtgtccagcgtgccggacaaagggagcacgttcagcgtccggctcccgctcggccccacgtagacacacgccatgggacgcccctgtcaggtgctcagcgcacgcacccggcccgcgaggttctgggtgaagaggcggaagatgcgcagcgccgccgcctcgtgcgtatccacgaagcgttcgaagtcgacacggctgatgcgcagcgcccgcacggaggtccgcgcacggacatgggcggacacgggcccatcctgcaccagggagatttcccccaggtacgccccgggccccagcgtgttgaggtgccgggcgtcctcctcggggccactgaagacgtccacggagccgtccatgaggacgaagagtcccaggccgggcgcgcccttctccagcaacacggcgccgggcgcgatgacgacctgacgcgccagccgatagaggtccttcatgtcctccagggacagctcgccgaagatggggatggccttgaggaaccggtacccgttcgccgcaggcgccgacgcgcctccggaacggcgaatgagcatggcctccgcttccgcctccatccccatgcggcgcagcagccgggccttctccgtcaccagcgccgggtccccgcgcgcatcctccgagctgctcaccgcgtccgcgagcaccgccagcgcccggtgcgtgaagccctccgcgtccagcaactggcagatgcgcagcaccgcctccacgaagcgcgggtcctccgcgcgcacgcctccgagcgcctcgacctccgcgtgcgcctgtcccagctcccggtagagcgtggccgcctcgaagggacggtccaggcgcaccaggcactgcgccatggcttcgcgcgagcccagctcccggtagatggccagcgcgcgttccagcgcgccacctcgctcgaaggcggcggcggcgcgctcggcatcacccgctcggaggtagctctccgcggcggccatgtacttgccactctggaagtagaggtccccggcggtggcgtcctcgccctggccgtccatcagccgggccgcgcccaggaagtcccgcgcgcgccgcagcacctcgacgaagccacggcgctccttcgccggcccctgttcagcttcgtgacggatgcgctcgcgctgcgcatcgcccagctcctcgtagagctgtgccgcccggtccgtgtcctccaactcgaccagagagcgcaccgcgcggagggcaccctccacgggcgtgcgcagccgcccgctcccctcgccctgaccacctgctgactctgtcatgtcgggtctcccgttccggtgagaccggccagcatgggcgccgccaaagcgttgcgccccttcccggcctgcccccctcttctcccagagcctcgcattgaatgccgggcctgccaacgcctgccgcgaaaacgcgggcgtcagtccgcgtcccgcgcccgctccgccagctgccgctgggaggcagtcctccgccacgcgtcctccaacagttggcggacgagcgccggacgcgccgcggcaacgcgcacgagcaggtactcggggtaccccgcgtaatgttcggtgatgtagcaactgtctggctcggcctgaatgaggacgtcccgcacgccgggctcgaccttcaccaccagcgactcgccgtcctcatggaagcgggcgatgaacttcttgcgcacgcggaacgcgggcgtcccgaaagacgtgccctcctccatccccggtagagacagcgccagcgcgcgcaccgcgtcgaacgtcagcccctgcgtccccccaccgcgcatcgcgcggcgcctaccccgtgtcgccatggcgcattcctaccagaggcccaggcaaacgcggcaggtagcgcgccatgttgaaactccgccccgtggaatgacagacatgatttcatccccgggcagatgtggcgatgcgatgacccgcggtgtcatgtctgtgatttcatcagcacgaccgcccgcgccgacatgtggggtccgcgacactccgagtccgctgtgacacagcacctcccagccgagaaggtccagacagcctcgactagcggaaatcccggagatgccgcgcctccgcgcgggccccgcctcgctcccaaagcgggcggccaacaaccgccccccaataagaatgagcccgggagagaaccgttcggatgtcggctcccgtgatatcttgacttccatgtctgcactggatcgggctcatgccgcaccctcctcgccggacgtgaagggcgactcgcaatggaagatggaagtcgaaggtgggcgtgacacgccgctgcacgtcacgctgccctacgagcacgcgcgccggggctatgacgcctccacggtgcgccggttccggctcacggtggcggaaggcccgaacatggggacgacgtgggagtccacgggcgacacctgctcggtgggctcgcacccgctgaacgacttcgccgtggaggactccacggtgtcccggttccactgcgaggtgcgcatcgggccacggggcccccaggtgaaggacctggacagcctcaacggcgtcatcgtcgacggggtgcaggtggtggagggcgtgctgcgcagtggcagcctgctgcgcctgggccgcgtggtgctgcgcttcgacttcagcgcggagacaaccgcctgccgctgtcggagaactcgcgcttcggcacgctggtgggcgcctccgtggccatgcggggctgcttcgcgatgatggagcgcgcggcgggccgcgacgtgacggtgctgctcgaaggcgagacgggcacgggcaagagccaggccgcgctggccatccaccaggccagtccccggcgcgacgcgcccttcctcatcgtggactgcggcgccatccccgcgcacctgttggagagcgagctgttcggccacgagaagggcgcgttcaccggcgccgtccagcggcgcgcgggcgtcttcgaggaagccgacggcggcaccgtcttcctggacgagattggcgagctgcccgcggagttgcagcccaagctgctgcgcgtgctggagaaccgcgagattcgccgcgtgggcagcaacacgtatcagccggtgaacgtgcgcctcctcgccgccacgcaccgagaccttcgcgcggaggtcaacgcgggccggttccgctccgacctcttcttccggctcgcggtgctgcgcttgctgcttccaccgctgcgtcagcgtccggaggacctgcccatgttggtggaaggcatcctcgacctgctcggcgcggaccgcgagcgcacgggcgcgctgcgcacgcaggacttcctggccaggttgcggcacgcggcgtggcccggcaacgtgcgcgagctgcgcaactacctggagcgctgccttgtcttcgaggaagcagtcgagctctccgaggaagaagcccaccgctccggcccacccgaggtggacccctcgcagccgtacgccgaccagcgccgtcacgtcgtcgacgacttcgagcgccgctatctgcgcgcgctgctggagaaacaccagggcaaggtggcccaggcagccgtcaccgcgggcatggaccgcgtccacctctaccgcctgctgcgacgccacggcatcaagccgtgagcctcaccgcgggcggctgacgcgcaagcaccccagtcccgcggcggacacgggtgtcaccaggaaggccgtttccaggccctcgagcgcccgagcggtcgccaccaggtccgttcctggtggctccgcgacccagcccggcaggtgcaacaacccgccgcccctgccctcgcgaggcagctccgcgacgtgaacggtgatggccaggtctcacccgcggaggggcctcgcttgccgccacgaactccaccagggccagcgcggcgtgcagcactcgcgctcgcgcggcttgctccgccc

SEQ ID NO: 1152 - DNA, 17727 bp, Myxococcus xanthus
  unsure (1)..(17727): unsure at all n locations
cgtgtccaggtccccgtagaagatgaggttgttgcacgcgtccagataacggttcctcggttatgaccttggggcgtccgcgagggtgctggatgatggccagttgctcggtggcctgggccgtcagcgggatgggcgtgacatccgggaggacgtcgagctggatgagcgcgtagtccggctccatcgactgctcgatgacggtgccctccgtaatcaaagggtcgccgtccgcgtcgtcctcgaagttgaagacaatcagcgggatgtccccgaggttgacacagtggcccgcggtgagcaccacggggcccgcgcttgcttgaatcagcgttccggtgcagcgcccgtcaatgagcacgacggcgtcttcccggtcctggatgatgtccgagagctcgccgacgtagctgttgatgggggtgaagtcgagcgtcggaccgcactgcgcgaaagcacgaacctccggactggcgggtggctcacagaccgcaggctcggccggctcggaccgtcctccgcaggcggtgaggcccaggaagacggtcccagcgaggagcgaaccccacagcgtcaggtggaagtctgtggggtgtcgcgccatgactcagtacaggtactggagcgccgtgacgtcggagctcttgaagttacccgtctcggacgagccgaagcaggagttcatgagcgagccgccgcgggtggccgtggtcggcgtgcccgggatgtggatggcgccaacgcccgcggtgccttcgttggtggccgcgccgccgcagctgatgctgcggttgtagtagtcagagtggcgcaggcccacggcgtggcccagctcgtgggtcacgacgtgctcgaccacggccacgccgtaggtggccgtgccggtgccgatgttgatgatgccgtagggacggccgccggaggggaagcccgccgagccgccagcgccggacatggtgcgtgcggagatggtcgcgctgcagccggagccgccgcgctgcatggtgaacgacaggcccagcgcgttgtagttggcgatcgcccggtccagggcggacatcagcgtggtgttggcggcgtacgcggagttcgggacgatgcagatgcgggtgatggaggcggcgacgaggttcgtcgtgcggtactgctcctgcgtcttcaggtccgtctggagcatctcgcgggacgcctcgagcgtcacgtgcgcgtcgcgacccacgtacacctggccgtcggagagcaggatgtcgtccgccgggaagccggcctcgaccaggttggagatgatctcatcctgctcgtgctgcgaatcggcctgcacgtcagtgccgcagcccgtcagcatcatgctaccggtcaccgcgaggactgcagctcccttgaacatcttcttgaacatgggcatcggagattcctcgtccgttttgactgcggggggacgcgccgtccgcctggtatccaccagccgcggcgagacgcgtcccggcccttgagcaaatggtaggccaatgagtcccgcagagagagaaacaaggaatagttgactagcgtggagtatctgcgctccaggcccgcgtcacgggcgcgtaaatagagttgacgccagtcgccgcaaacccgcgtgattgcttcgggttccatggatatggtcgggcgtttcgaaaccgcacagtgatgtctggttatcggtcacctgccccatggggcaaagacaccccaggcatgatctgactcaagtgaaaacaaactacgaccctgtaatgggctgggaaaggacacttccctctgacgagaggtgcgcgtgaatacactgtcggtgtattcagtcgcatatgcaaatgcgccacgtcacctgtcctgtcgccgcgctgctgggcgcggccctgtcgttcctttctggctgtgggggcacgatgtcgagcaatccctcgcccatcgacgctcagagccagaccgccacttctcagcaggccgcggaggcctggaagcgtgcccgcgtgggcgatcgcgtcacctatgccttctccgcgacccagggcccgaccccccgtgcggctgacgccgcgcgcacgctcgacggccagttgacgctggatgtcgtgtccgtccagcagccctgggtctatgtgcgggtggccttcacggacgcggcgggaaatccgttgacgcagacgcggctggcgcgggacctggtggttcccgtgcgctcggacatgacgcgctcgctggacgtgccgcgtccagggcaggtgacggcggagcgtccttccttctccgggcgcaactgggaggccactcgctatgtcagcgatcaacggcccgtggacggtccgctgcgcacgcgcgtgtatgccaatgattcggcattgctctacctgacgcgcggcctgctggaggccagcacggagtccgccgggttccggacgccgggcggcatcaggctgtcgctgcgtgagttccaggagggctccaccggggccagcgcccccgtgcccgcgctggagcggcccctggggcccggcgcgtactacgacaggaaggtggacatggcgcccacgcacgaggtgctgcgcgtgtgtttcaccgcggagcgcggctacatcctgcgcgcggagggccccttgggcactgggagcgagccgtgcgccgacttctccaaggcggagcctgagtccctggaggaggtggtgatgggccttccttgggaggcgctggtgtcaggcgagtggcctccctccaaggacggcgcccgtggcaccttcaccgtgggagaccggaacgtgccctccatcacggagcagcgcacggaggacctggagggcacgcagcacgtcttcatggacacctacgcggcggagccctgggcgccggggctcgcgggcctgccgtatgaagcgcgcttccagtcgctctccagcggctccgagcgcgtgggccccggggggcagcgtgagttcgcgggcggcagtcggatcgtccagtggggcccgtggctcggcgggcagccgtgacggttcggtagcctccagaaagaggccccggggccattgcgctgagcggagctacactgggtgcggactggaggcgtcatgcaccttgtgagatttcgtcggctgcccgcgctcgtgcttctcggactttccttcgccggtgggatggggtgctcggaggacgacgggggtgtggacacgcccaaccccctgacgaatcccaaggatgggcctcccgccgggaatcagaacccggaggccacgtgcgccatcccggccgaggctggcctcgcggatgtcgcccggcccaccacggtcgtcggcacgggcagtccggagagctgtaccagtgacgcgttcatccaggccgtggcgcggggcggggtcatcaccttcgactgcggtcccgagcccgtcaccatcaccctggagcggacggcgaagatcttcaacgacacggggccggagatcgtcatcgacggcaaggggttggtgacgctgagcggggcggggcggcaccgcatcctgtacatgaacacctgcgaccgggatcaggtgtggacgacggcgcactgccaggaccaggaccaccctcggctgacgctgcagaacctgacgttcgtggatgccagctccaagacggaggccgagttcgacggcggcggcgcggtctgggtgcgcggcgggcgcttgaaggtcatcaactcccggttcttcaacaacgtctgctcggatgtgggaccggacgtgggcggcgccgcgctccgtgcgttcagccagcaccggaaccagcccgtgtacgtggtgaacacgaccttcgggggcaaggctggttacggcggtgcctgctccaacggcggtggcatcagcagcatcggcgtgtcctggaccatcatcaacagcctgttctcccacaaccgggccgtcggcaatggcgccaatcccgcgcggccgggaactccgggagggggcagtggcggagccatctacaacgatgggaacacgatgacgctgtcactttgtggcacccggattgagcacaacgaggtcaatgcgcacggcagcgccatcttcttcgtgagcaatgaccactcgggagatatccgcatcgaccgctccgtgattcggaacaatacgggcgggtcgtggtacccgacgcatccacagatttcgaatcacgatgacacgcccatcgtcgtgacgaactccacgattgagtgaccaatcgcccgcctgccgcgcagccacgccgcctcgcgtctgaagagcgcagggcggagaaggcagatggtccccccgtcgtaggccacccagccacaacaaccttgacgcttactgcctggcggctcagcgccgcttctttcccggtgcctttccgtcaatgagtaccgccagtccatcgagcactcgctcgagaccgaaggcaaacgcccccctggggtcgtgtgccccgtaggtctctcccgcggtcttcccgacgcgggacaggacggggtagggcgtgaagtcgatggtttcgaggaagggggcgacgcggtaccaccactcctcgtccgtcatgccggtcaggtccttgaccatcttttcccgggccgcgttgcggaccgcgccgtggacgtagtcgaggaccagggtgatgatccggtccatctcgaggtccgtgagccccaggccttcaatggcgctcaacgcgatgtctgcggaacggaaggtgttcgggcccagcacagtgcggtgggtcgcgagtggaatcacccacgggtgggccaggtagaagtcgcgatagtccgtcgccacccgctgtcaggttggcgcgccagtcggcgggcttgaagacgggccggtccttcaggatttcgccggacacgacatccatcatcaagtccaacagctcggccttgccggggatgtgcgtgtagaacgacatgggggagatgcccactgcctccgcgacgcggcgcgtgctgaccgcttcgagcccctcggcatccgcgatggtgacggcggctgacaccagctccgcgacgctggccttcgccttcgggccgcgcttcggtgcctcggttcgtccccatagcaactgcagtgatttcaatgggtcgccccgaccggaaatctcgtcgctcatccgtacctcaggataactatttacagtgtacggggttgttgtgctaaacctcgtgcgccgtacgaagttacggcgtagctgaaaagatgtcgagcgatttgcgggaagcctgttcgtggacgtgccgcgtccgcgggcagggcgtcactctaaggagaggccaatcatgtacggctccatcaagattcgcggggcacgcgagaacaacctgaagaatgtctcgctcgacatccccaagcggaagatcacggtcttcacgggcgtctcgggttcgggcaagtcatccctggttttcggcaccatcgcggctgagagccagcggctcatcaacgagacctatccggcctttgtgcaacagttcatgccgcactacggccagccggacgcggagagcctggagaacatctccgcggccatcatcgtggaccagcagcggctgggagggaactcacgctccacggtcgccaccgtcaccgacgccgcgcagatgctccgcgtggtgttctcacgcctcgccgagccgcacctgggcagtccgggcttctattcctacaacgaccctcgggggctttgttcggagtgcgagggaatcggtcaggtcgcgtccatggacatggacgccgtcatcgacaagtccaagtccctcaatgagggcgccatcctgcccaaggactatgcggtcgacagttggtactgggccatctacgcacgctcgggcttcttcgacgtcgacaagaagctgtccaagtacacgaaggaggagatggagaagctcctccacctggacgacggccggaagatcaagctcgacaagatgaacctcacctacgagggccttgtccccaagctgcgccggacgctgggtgccaaggaccctgagacggtccagccgcacgtccgcgccgaatacgagcgcatcttcacccgagccacctgcccttcctgcaagggtgggcggctcaaccaggcagcgctcggcagccacatccaggggaagagcatcgcggagtgctccgcgatgcaggtgtcggacctcgccgcgttcgtccggaagattgccgctccgtccgtggggcccatgctggaggccctggcccaccggctcgacaacctggtgaccattggcctggggtacctcagcctcgaccgcgagagttcgacgctgtcgggtggagagagccagcgggtgaagatggtgcggcacctgggctccagcctcaccgatgtgacgtacatcttcgatgagcccagcgtggggctccacccgcacgacgtaggtcggctcgcgggcctgatgcagcaactgcgcgacaagggcaacaccgtgctcatcgtggagcacaagccggacatgattgccattgcggaccatgtggtcgacatggggcccaaggccggcaacaagggtggacaggtcgtcttcgagggcacctacgaggggttgctgacctcgggcacgctcacgggcaaccacatgaagaagcaccagccgctgaagaccacgcctcgaaagcccacggggcagcttcaaatcaagggcgcccggctcaacaacctccaggacctgtccgtttcgattccgcgaggtgtgctcacggtggtgacgggcgtggcgggttcgggaaagtcgtcgctgattcagggctgcctgcccaaggcgtacccggagaccatcatcatcgaccagaacctggctcggggctcgcgccgctccaacaccgccacgtacaccggcatcctcgacaacgtccgcaaggccttcgccaaggcgaacaaggtggatgccgcgctgttctccgccaactcgaagggtgcttgcccggactgcagtggcctgggcgtcatctacacggacctggcgcacctggacccgatggtgaccgtctgcgaaacgtgcgagggcaagcggttcaccgaggaggtgctggcgcaccggctgcgcggcaagtccatcagcgacgtctacgagatggccgtcagtgacgcggtggccttcttcaccgaaccggcgatcgccaaaatcctccaggggctggatgacgtcgggctcggctacctcacgctggggcagccgctgtcaacgctgtcgggcggtgagcgccagcggttgaagctcgccgcggagctgggccgttctgggaacatctacgtgctcgatgagcccaccacgggactgcacatgaacgacgtggacacgttgattggcctgttcgaccggttggtggatgccgggtcgacggtcatcgtcatcgagcacaacctcgacgtggtgtcccgcgcggactgggtcatcgacctggggcccggcgccgggcatgagggcggacaggtcgtcttcgaaggacttccggctcagctcgccgcgcacccgcgctcgctgaccgggcagcacatggcccgccgaggcaaggcgtaacggcgggcccgccggagcggcgcgagacacctcgcaccgctccggtcgacgcgtacggctccggcggcaatggacgtctaccggcggcggcgctgctgcatcgcccggcgagccgcggcccgggcctcaccgcgcgccgcgacttccttgagcgcttcttcctcgccgctgtcacccgacaggaacccggagagggtgcggatggtggggtagcggaacaggtccaccagcgtgaggggtttctccacctgggccttgagcttctccagcacctgcaccatcagcagcgagtggccgcccaggtcgacgaatttgtcctccacgccgaccttgtcgagcttgagcacgtcctgccagatgctggcaatcagcgcctccgtctcgccttccggccggaccagctcaccgcgcgcctgcgcctgctccggaggtggcagggccttgcggtccaccttcttgttcggcgtctgggggaaggtgctcagcgtcacgaaggactgcggcaccatgtactcgggcagcctcgtgcgcagaaactcgcgcagcgcgtccgccgcgggcggctcgcccggcttcgcgatgaggtaggccaccagccgcttgtcgcccgggatgtcctcgcggacgatgacaaccgtctcccgcaccgcggggtgttcgcccagccgggattcgatttcgcccagctcgatgcggaagccgcgcaccttcacctggtggtccagccggccgatgtactccaccagaccgtcgtgcctccaccgcgcggcatcaccggtgcggtacatctgcgcgcctggctgggaggagaacgggtccggcacgaagcgctcgcggtccagctccggacggtggtggtagccccgcaccacgccctcgccgccgatgtacagctcacccgccgcgccaatgggcagcggacgctgctgcgcatccaggatgtagaactgcgtgttcgcgatgggcgtaccgatagggacgccttcgcccacgttcttcaccgggtgcgtggaggaccagatggtcgtctcggtggggccgtacatgttgatgacgtcgccggacaccgtctcggagagctgtcgcgccagcgggacggggaaggcctcgccgcccaccatcatcttcttcagccgcttgaggccctcgcgcgagcgctcctcggccaggagcatgctcgcctgggacggcgtgcactggagatgcgtcaccgcgtgacgctccatcagcgcggggatggagccgtcgagttcgggctcggcgcccggctggcccacgcccgagttggcgcgctggcgcacctcggccagcagcggcaggtgcttcatcaccagctccgtgggcacaccgaagtccacgaggcaggcaatctcgtccacgtccagtcccttgagccggtccacgagcgcgacgcacgcatccacgctgccgaacaggccggaggactggaagtagcgctcgaaggagaagtcgagaagcgcgtccatctcctcggcggacaggtggtcggtgccgaagttgccgttggccagcgtcgtctgcgccttgaaggccgggaagctccaggccgcctccttgatgaggcccaccgacgacctgaggtacgacttcatcggctcgcggacgacctccttcacggaagcctcggagtcaccgacgaaggtgtgcagcatcagcgacacggtgcccttgccggggtggccggccttggcccacgtctcccggtagagggcaatcttctgcgccacctcttccaccgactggcccagcaggtgggtgaggacgtggcagcccgcgcgcgccgcttcctcgaaggtctccgggttgcccgcggtggtgacccagatgggcagctctttctgcaccgggcggggcagggtgcgcagcttcacggtgtggcccgtgccgctcttcgtctccagcgcctcgccacgccatagccggcgcacgtcttcaatctgctggaacatgatgcgcttgcggtccgggaaggtctccggacgcagcgcgaagtcgttgggctgccagcccgcggcgaacgaaatgcccacgcggccgtgggagatgttgtccaccacggaccagtcctcggcgatgcgcagcgtggggtgcagcggcgacacgaggctgccggcgcgaagctgcacgttgcgcgtcaccgccgccagcgcggccgacgtcaccgccgggttggggaagagtccgccgaacgcgtggaagtgccgctccggcgtccacacggcgcagaagccgttcgtgtccgcgaagcgcgcgctctccatgagcaggtcatagcgtccctcgggacgctcgccttcatcactggagaagtagaagagactgaactccatggcgcgcgaggcgtgcttgccggcctgcgccgtgtcgtgccgctccgcgtgcagcaccaccgtgaagccgcgcgtgagcgtccagagcagctccagcacggagatgtcgaagttgaggctcgtcaccgccagccaggtgccgcgctccgtgcccaagcgctcgtccatgccaacgccgaagttcacgacgttgcggtgttcaatcatcacccccttgggcttgcccgtgctgcccgaggtgtagatgacgtaggccaggctgtccggcgtggccggcggcgtctgggcctccggcgcggcggcgatgcgctcccactgctggtccaccgcgagcacggccttcgccgcggacggcacgcgcgacagcagccgctcctgggtgagcaccaggtggcagcccgcgtcctcctccatgaaagcgatgcgctcggcgggataggccgggtccaacggcacgtagcagccgcccgccttgtgcgtggccagcacgcccaccatcatctccagcgagcgctccatgaagatgcccacgcgcacgtcgcggcccacgcccgcgccgcgcaggtgccgtgcgagcacctcggcgcgcgcgtccagttcgcggtaggtcagcgaggtgccccggcagatgagcgcggtgtcgtccggcgtgcgccgcgcctgggcctggaagagcgaggccagggtggcgtcgcgggggaagtcccgccgcgtgtcgttccaccgggccagcaactggcgctcctccgcgcccagcaggtcatgctcgcccaccgccttgcccggcgcgtcccggagcgaggcgaggaacgcgttgagctgccgcgccacgtcgtccacgcgggccttgtccacgcgcgtggcatcaaagtgcaggtgggcgtgtcggccctgcgcgtccacgtcaatgacgagcgccgcgccacccacggcggggttcgccgctccgatgcgcagcgcgacgggatacgccacttcgccgccgtggcgctggaggttggagagctgcgcggagcggcccagggcgtcgcgcgcgagcacgcccttgtcgcgcagttgcgtcagcgccttgcggaaggcacccgcggcctgctccggcgcatccttcatcggcagctcgatgcgcagcgggagctgcgaggcgaagaagccttccacgccttcgatgtgggcgcgcgtggacgcatccgcgtagccgacgtcgaagcggggctcgggggacaggcgcgccaggaaagccatggcggtgaagagcagccgctcctcgggaggcaggtccgtgacccagcctggggtaaggtcgctggcctcgaacttcagtgtgtgcgtccccacgtccttggagctgccgcccaggaaggacaggtccggtggcgcgagcgtctccaggcgacggaggaagaacgactccgccttgcccgcctgcgtgcccacctcggtcagccgggcgcgcagctccggagcggcggcgggcagggcgtcaccccgggcaagcattcgagcgccgagcacgtcggcccatgacagcggcgcgccgcacagccccttggggcccttcagcgtgaggtctccgccctggagcgccaccgtcagcgcgtcaccctcgatgtcgagcacggtgcccggggcggactcggatgccggctcggcgcggcgggcctcggagatggcgatgggcccgttgcccagccagaccttcgcgaaggacagcgggttggggtagccgccgtagtcgagcgccgataccagcgcgtgcgccacgtccacgtctccgtggaggtcgacgacgcccgcggcctccggacgctgcgcgaggccgaagtagctgcgctgcgcgaagtcctgctccttcgcctcggacgtgcccgcgaccagctcttccgcgagctccgcgaaggtctccatgcccagcgtgtagcagcgggcgttgaggctgaaggccgtctcaccgggggcgatgtcgaagaggcgctgcttgaggatgcggccctcgtccgcgcccttcgtcatctcgtgccacgtgacgccgtgctgaggctcccggttcagcagcgcccacgacgtgacattgagtccggcgtagcggggcagcgggccgtcatggaagttgatggccatgcgccggggcaggcgcaggatttcgtccttcaccatgctcaggttgacgatgctgaagagccagtcgaaaggcgcctgggacaggaagggcagggcctgctcgccgggcggcacgtgcggcacgccctgctcctccgcccacttctggagcgcgggctcgcgcgtgacgagcccgagaatccggacgccgcgctcggtgagggcttgtgcacagggaacgacgagggtgccctcgccaatgatgaaacagttgggcgactccggagccgcgctcattcagtgcctcctgcgttgctgcgattcgggtgttccccgctcacaagcccaggccctgccgggcgtcggcgagcgcggggggatgcttcaaaagctcggcgtgaccgataccggggtacgtcttgaggggagcgcgaagcccacggctgacgcgctcgccctggacggggggcagcgcgctgtcggcgcctccatgcagcacgagcgcgggcgggagtcgcttgggttgcagcagcggctggttgtcgtaccggtgccgcccgacgaggctgccgatgagccccatgcgccccaccttcatcgcctggaacggcgcgaacagcaccaggctccgagcgggcgtctcctgcgcccgaagcgcgtgggccgccgcgagcgccgacatggttcccatggagaagcccacgaggtggatgtcctgcgccgcggcaggatgtgtctccgtcagccagcgcatggcgctcgcggcgctgtcacggagtgcttcgggggagggcttgcccggcgagccgtcgaagccggggggcgcgatggcggcccagcccgagcccacgggccttcgtccagcgagagcaggacggacttcgcctccgcgaggtaccccggggtgttgccgccgaagtacaccagccaccgcgtctcacccgcggagggcggccgcgtcaaggcgacgagcctgggcggcgcgtcggggcctgtcaccgtccatccctccgaggccaggcgcgcccgttcctccgccgataggggcgcgccggtgtaggggaacgggcccgggagatccgcgtcgtctcgagtcaaccccaccatgagtatccccaccgccagcacggcggctgtgaccagcgggaagcgctggttcaccctgaagcgcgcccctctcacttcgtgcccacccggcgcgcctcgtcacgcgtgccgcgctgtgcatcgtccagcgcttcgcggagcagccgccccaggacatgtacgttgggctcgcgcacagctgtcgtgtcgcccggacctccgnatgttagcgccgcaccagcggctccagcccaggtggtcccatgtggcgtaatggcgtatctctgcgcgcgacagcgtccagacgcgtaggctgggacgtacgcttccaggctgaagcgctcggtagctgaggttgccagctcatggcagcgcttctccccgctgctcgtaccagcgcagcttgagctggctcaacagccgggtgccgtcgcgctccaccttggtgcgcagcttccggctgacgtagctgcccgcgccctcccggcgcagctcccgcaggcgctcatggagggactggcgtcgctcctgggtggacgggtggaaggtgtccaggaacgcgaccagcgccaccggctcgcccagcgcgtgcagccgctgcgctattttgtaggcgaccacgccgccgccggagtagccgccgagcaggtagggcccgtggggctgcacctgacggatgctctccaggtagatggacgccatctcctcgatgctgtcggccggaggcagcttgccgtccacgccacgcgcctggagcccgtagaagggctgctccttgccgagcgtctgcgccagctcgcggaagttgaggacgttgccgcccgcgccgtgcacgcagaagaaggggagggtattgccgcccttctggatggtgaccagcggagaccagctcttcggcaccgccttgacgcccggggcctgcgcagccggcgccgcgtcacccggacccgcgtccggcgtgaagggaatcccggcggcctcacgcaccagcgcggcgcactgctccagcgtgggagcctcgaacagcgtggccagcgtcaggtccgcgcccagcgtcttcttgatgcgcgcgaacaggcgcaccgcgatgagcgagtgtccgcccagctcgaagaagttgtccttgagccccaccttcggcgcaccgagcagttgctgccacagctccgccagcttgcgctccacgtcgtcgcgcggtgcgtccgcggccgccacaccggacggcgcgcctgcctgggccgtggccgccgccgccgccgcgggcttcgcctcctgcttcgggcgcatgcgggccgcgagggtgtgcaggtccatggagctgacgaagagcgcgggcgtgtcctcgagggacagcgcgcgcaggaaggcgtcctgaccttccgctggcttgatgcccaaaggcagccagctctccagcagtgagcccttcttctgcggcgagcggccgaaacgccgcgcctcgacggacgcgacgaggtagccctcgatggcgcagaagacattcccgtccgtgtcggtgagcgtgacgtcgagcagcgccccgcggccttcctcctggcgcacgcggacgtggctcagcgccacctggggccaggggccccagacctggagttgccggtaggagacgggcacgtgcagcttccccggctgtcccgcgtcggggagcagggagaaggcgaagccggaggcgatgtccagcagcccgggcggaatcccgtacgtcgacaggtcctcgcggtaggcggcgggcagctccagacggcccagggcctcggacgtgccgaagcccgcgctgcgcagcaccttccagcgtggaccgaacgcgatgagcgcgtcctgcggcagggactgctcaccctcgccgaaggtcagcggccgctcaccacagcgaaccttcgccgcggacacgttcagcgccgtgggacgctggcccgtggcctggtggagccgcgcggtggcgtgctccgtccatgcgtttccggccgcgcggctgcgcacgcggaaggtgaagccgtcgccctccggcgccagcccgatctccacctcccgtacctcgccgtccgggacgtccagcggtgacaccagcgagagctgcgacaactccagcggctcgccaggacgcgccagcgcccaggcggcgcgggccagctcgacataggccgtgccggggaggacggggcctccgccgcgcatccggtgctcatccagcacccagtgggccttcgcgtcgtagatggcgcggaagacgtggtgcccttcgggggcctccacgcgccgctggagcagcgggtggatgacggactcgccgggcggcaactgcggcgcgagctgcgccgcggccatgccgacctcctgccagacgccccagcccaacgcgagtgcgcgcttcgcgatgcccgtggcctccagccgtgtcgcctgcgccagcaggtacgcgttggcggcgacgtagtccacctgccccgggggcccaagccacgcgctcgtcgacgcgaagctgacgaagaagtccagggccgcgccttgcagcgcttcttccagcgcgagcgcccccatcgccttgggcgcgagcacccgcagggccgagtcgcgcgttttcgcctccagcggcccgtcctcgagcgtgcccgccgcgtgtaccacgccatgcaaggcgccgaagcgctcccgcacctgggcgatggccgcgcgcagttggccggcgtcggtggtgtccgccttgagcagcagcacctgcgcgccaagtccttccaacgtgcgctgaagctccgcgtgcgacgcgctggccgccgaccgcgacaccagcgcgagccgggccttcaccttgcgagcgaagagctcggcgagcgtgcggccgatgccgcccaggccgcccgtgatgaggtagacgccctgctcacgcagcggcgtcgggccctcgtccagcgccgtccgctccatcacctgcaccagccggcgtccaccgcgcagcgccaccggcgcctcgacgtccgggcgcagcagctcgtccgcgagctcccgcgcctggcccatcacgttgaccaccagttgcaggtccaccacgcgggccttgagctcgggaagctccttggggcccacgagcagcggaccgaagctgagcgcctgctccgggctcgtggcgtgtccttcggcgggcagggcctcctgggtcacccgcatgtagcgcaggcccggaggcagcgactcggaggtcagggactgcatcagcgccagcggcgtgaggaagtaccgcgacaccgcgagttcccaacccagcggggccttgtcccggctggtgatgtccacgatgcgaggtggcacgcgcccctcggcgcccagcgcatcccagagcgcttcccagtcctcgcgcgcgtcgaaccgcagggtgaagtgcccctcgtccgcgcggccaaaggcatcgcccggcagcacgcgcatcacctgggcgccgcgcgccgacagctcgcgagccagctcgctaagcaacaggtgctgctcgcccacgaggagccagcgctcgttctccgttggtgcctccggcgccgcgccggcctgctcgcggaagcgcggcacgtagccccagcgcgacacgttctcttcacgcaccagcgggcgctcaccctcgcgccgcgccatgaaggtgccactgcctggctccacccagtggcgctcgcgctcgaaggcatacgtgggcagcgccacgcggcgccgcttctggccatcgaagagcgcggcggcgtccaggtccacgcccgcggcccagaggcggccgagcgcgagctggaagaacgccaggtccgccacggtgtcgttggggtgccgcagtgacggcaccaactgctcggcctgcggcttctctacctgggcgcgcagcaactgcgtcagcgtctggccagggccgacctccaggtagacacgcgccttgtccgccaggagcacgcccgcgccctcggcgaagcgcaccggctgacgcaggtgccgcacccagtagtcgggcgacgtggcctcctccggcgtcacccatgtcccggtgacattggagatccacgggccggtgggcttggtgaagcgcaccgtgcccaggaactcacggaagggcgcgaggatgggctccagcatgcgcgagtgcgcggccacgcggatgtgcagccgccgcgcctccacctcgcgagccttgagctgggcctccagcgcttcgatggcggccacttcaccggagacgaggcacagccccggcgcgttgtgcgcgcccaggtccaggccctcgcccagcagcggcttcagctccgcctcgggcatctccacgctgagcatcgcgccggcggggagctggtcgaagaggcggccacggcaggcgacgatgcccagcgcgtccttcacggagaaaacgccgttgagctgcgcgcaggcgtactcgcccatgctgtggcccatgcaggactgcggcgtcaggccacgcgccttccacagcgcggcgagcgacagctccacggacagcagcgccggcagggcgtacgtggcctgctccaactgggcgcgcgcttccttctcggcgccggcctccgggaagagcaggggccgcagcttcaacgactggtgctgttcgagcagcgacaggcactcatccagcgcgcggcggaacacgggcttctgctcgta

SEQ ID NO: 1153 - DNA, 17639 bp, Myxococcus xanthus
  unsure (1)..(17639): unsure at all n locations
gttctctaaggagctgcgactgctcgacgaccttctcacgaaggggcaacaccactcgccggtaacggtcggccaccaggcgaagcgccagcagccgggcgcgggcggcgcgcacttccgagcgggtgttgacggacagctccatcagccgccgctcaccctggcggtgctgagcttccagccgggcgatgagggcctggcgctggtcgaagatgggcaactccagagacagggtcgggccaaagagcctggggccgtccgcgtcccggtgctcgtgaacgcccacgtccacgcgcccgaagaagcgagtactccgcgcgagctccagcgcattccagagcagcatgacctgctttcgggcagcgtcgatgtccagccggtgacggatggcgagcgactccaggtgcgccagcgaaacctcctggtcaggcaacggcgggagcttctcggagagagtccattgcgtacgtggcccccacaggcccatgaggcggttgaggtgctcccgggcctccaccaacgcgagctccccctccgccagttcgagccgggctccctcggcggcggcctgttcactcgcaagctccagctcggtgatgttgcccgctgcgcgcagccgggcggagaggtccgccgccgccacggccgcctggagcgccatgcggcgcagctccatgagctgttggagggcctgcacctcgctgaaggccttgcgcaccttcgccgcggtggccagcgcttcgtgcgccacccgtagcgtgtccgccatgaactgctcccgggcgacgcgcttgcgcaggggcagcgtgaagagatccacgaagtcctgcaccagcgagacctcgtgctctgacgcgccacgcccggaaatgggaaagccgatgctcccgtccaaagtcgggttggagagcaggccggcctgaaccatgtcggcctgcgagacgcccaggtcctcgtaggtggcctggagcgccggattgttgagcagggccacctccaccgaatggtccgaggtgaggtcctccttcaggagcgcgtcgagatggcgcgcgacctcagcgtcctctggagtgccctggttccagcgcgtcttgcggcccagccgctcctcgacgagcgccgcgacctccgcgtggccacgctccttctggatggacgcgcaacctcctgctagcagtgccgcgcccacgagcaaagacagcctcacggatgccccccgtgcccgggggcgtggtcatggtcggccggtgcagcgccgggtgcccctgcgtcccccacctccgtgtctccaggcttctccggaaccagccccatagcgcacttcgggcagcttcctggcttgctggactgcacttcagggtgcatggggcacgtgtagacgacaacgcctccatccgaggatgcaccgtgatgggagtgccccatctctccttgtgacatgtcagacgcaggcacttccggagtggaggccgcgaatgcggtcaactggggcgctggcggggcctcgggcgcatctggattcgaggggtccatggaggcgggcagcctcttcggctcggagacacaagcaacgaaggaaacgatgctcgccaacagccatcggtttcggcacatggggacctcgatcgaggttccgtaccacccgcatccgctcggcaaaagccaccggtgaagcactgacgctcagagacattgaaactgtaagcccgacaacgtgcggcgcctcgcactcggactcacgcagcttcgtgtcggacatgcgtcggcctccgcaggggcaatgccgccgaccgcacgcggagggaacacgtcacatgaccgcgaacttcgtcagcgcaggtaggcggtgccctggaaggcggcgaccaaccgttcctcggcatcgacgatgcgcacgtcgtaggtggccagcttacggcctcgcgatatctcggtggctcgcgcctcgatggccccatcgccggcagccgcgaggtacgcgatgttggcttgcacgccgatggctctctggtcgtgggagttgcaggccaccgcgaaggcaacgtccgccagagcgaagatcacggcaccgtgcgttgttccgagcccatttgagcggcgcgacgatgtgggaagacggacgcgcgacgttccgggaccgacctccaggagttcgatgccaagctctcgtgcgaaggcgtccttctcgaaatactctcgtccagcggtggtttcagccatggtcagagcatggcttggaggggtcgagccctccagaggcgcgacggacatagactatggcgaaacggacaaccaggagcgctcgcgtcggaatctgcctctatcccggcgtctggggttcgagcgcaagcctcgcgaaggacctgatccacatcgcgtcggtgatcgctcaggcacgaccgggcagcggcaatatcgaggcccgattccttggtgcaaagccggccgaggtgacgactgctggcggaccattgctccgcgcggaggacgcgtgggatcgcgtagacgtcgacgtgctcgttctcccgtcgctggcgattccgttcatggagcccgcgcggcagccaccggggctctcggactggattgccgggcaacaccggcgagggtgcctggtgctcgcgctcaccacagggagctggttgctcgcggagacaggtttgctcgatggccacacggcgaccacgcactgggcctgcctggagcgctgtcgccgccagtatccacgggtgaactggacgagcgaacaacggctcgcggtaacgggaagactcgtgaccgcgcgggacatgagcgcgtcagcgacggcgctctgtcacgcaatcggtcgcgtcctgagcgcgccgatcgccgagcgcacctatcagtactcgctcatctacgagcccggcgcggatgcgctgcccctgctgcacaccattccccttcgcgaccacggagacgcccaggtcctcatggtgcaggagtggatcgaaacgcactacggcgagcctgtcgctgcagagggagttgcgcggatggtgcacatgagcccgcgcaatctccggcgccgcttcctcgacgccacggggaagacccttgtcgactacctcacggaggttcggctggcgcgcgcccgagcgcttctactctccagcaacgaggccgtctcgcagatcgcataccgcgttgggtacgaggacgcctccacgttcaccgcgctcttcaagaagcggcacgggctgacaccgagcgcatatcggaagacgtcggcggggcccgctggcttgagccccgcatacgacggcgagcgtcgtactgcgattacgtagcgagccacatgaccgcgcgacgacagttgctgtcacgtagcgatgtccgcgatttcgcgtcctgcctccagggtgagaagccctccctcactgccgggccatcgcctgggtgacctgagcatccgtgtggcgtgctggctccaacgctgtctccgggtgcaagtccacggtgacttcgacgaccttgcccgtaaaggccgcgagcggctcatactcgtcggtcacgggcgctcccttgtcgcagccgacgtcgaacgtctcgtcgaggctgtacatgaacgccatcgtctgcggaatcctgccctcggcgacccacttgccgtccaccgcgaggcggcccatgcctccggcgccgtaaatgacgggcttgcccgtgtcggttcgatgctcgggctggatttcgaactcgaagcggagcgtgtggcggcccggaccgatcttctgctgcgcacggatgtatgtgtattcgacagcggcgaagttgtagcaaaacgtggggacgccgcctttcaggtagagggaccacccggcggtgtctccgcccatcacgacgatgggaccttcggcgccctgctcggggatttcaatctcggcggtcatggcccacgagcggtttttcgtgtcgggcgccgcggcctcgggaatccgtaccgcccccagcccgaacgtgaaccgcgtccgtttcttggccagctcggccctccccagcaggcgctcctggaaccggtcatcgagcgggagcacgttgtagcggccggcctcggcccaccacaggccgaccagatgaatcatccgcttcacggccgggtcatcttgcttcgacaaatcccgctgcgccatgaggtcatgacactcggtcgggtctttctcgaggtcgtagacctcccagtgatcctcgtcgaaggaccaggccgcatggttctcccacggcttgcgaccgtggtaggtgacggccttccacttcccgttgacgatggcgcggttgcccagcatctcgaagtattgcgtcgggtgatgagtgggcgcgtccgcgtcgtcgaacgagtaattcatcggcacgccttccatcggcgcctgggagacggagttgacgacggcgggcgcctcaatcctggcggccttcaggatggtggggacgatgtcgatgacgtggtggaactgcgtcctgatttcacctcgggcctggatgcccttgggccagtgcaccacgaggggattccgcgtcccgccgaagtgcgtgtactgcttgcagagcttgaacggtgcattcatcgccagtgcccaccccaccgggaagtggttataggagcccggctgcccgagcctgtcgatgcgctggaggttcccctccagagtctcgaccgtctcggggcgctccgtgccgagcgcgccctcgttgaagaggcccgagttcgtgccttcgccggagcagccgttgtcgccgatgaacacgaagagcaacgtgttgtcgagctggcccgaccgctccaagtactcgacgacgcgcccaatctgcgcgtccgcgtgcgacaggaaggcggcgtagacctcggccatccgcgcgaagagccgcttctggtcgtccgacaaatcatcccacctgggcacgccttcgagcatgggcgcgagtgcggcgttggccggaatgacgcccaactgcttctgccgcgccagcacctgctcgcggtagcggtcccaccccatgtcgaacttgccacggtacttctcaatccactctggccagacgtggtgcggagcgtggcaggcgccgaacgcgaggtaggcgagccacggcttctcgggcgtcaacgacgcatggttcgagatgaaatcgaccgtcttgtcggcgaggtcctccgacaggtggtagccctcctgcggcaggcgcggagggtcgatggcctcgcgccccgcgtagagcttcgggtaccactggttgttgtcaccgcccatgaagccgtagaagcggtcgaacccgaagagcggcccgtcgggccaccggtcgaacgggcccgaggggccggactcctccgacggcgtgttgtgccacttgccgagcgcgaacgacgcgtagccgtgctggtggagcatcgcgccaatggcggccttgtccggcttctggcgcgcgtcgtagccagggaagccggttgcgagctcggtgatgttggccatgccaaccgagtggtggttgcgccccgtcaagaggcacgcgcgcgtcggtgagcagagggccgtcgtgtggaagttggtgtaccggagaccgttgccggcgagccgcgtgatgttcggcgtctcgaccaggccgccgaacgtgtcacacgccccgtaaccgacgtcgtcgaggatgatgtacaggatgttcggcgcccccttcggcgcctcgggaggcacggggaaggccggctcggactcctcccacgtcctgccaatgcggccggggaaacgctccccttcgtggtacgtcttcattccaccggagaccgccgccgactgcccgtcgccgccctgctgctcctcggacgtcttccccttgccactcttccgcgccatgtcgggcctccccctctccccaggcaaggttgagagcacaggactcctctgcaaccggaccgtctgtcgcaggcaacatgcgcttggggcgcccaggcaggcgcgggcgcgctggcctggagcccttgggtttggcacgccggttgtcagcagtgagttcggcgccgcgcgactgtaagtacccgcgacggtccgcgtctccctcttcgagccggcgatgaacgccgcttgatgatggagccacccgatgaacccgaatgatgagaccctcctgaaggtcgagggaatgtcctgccggtcctgcgtcagccacatcaacaccgcgctgcggaaagtcgaaggcgtgcaggacgtcaacgtgcggttcgagcaacgccaggttctcgtgaaacacgacgccgcgaccgcgaacgtcaacatcctcatcgaggcgctccgcgacgccgggtacgaatccgcccccaccgcatgaactgcccccgtgtgcggacggncctncttgcccatgcgttccaccagtcgttccccacaccaatcccctcgtgtgagccggcgccgagggaatgacagccaacctgcgcgtgaagcccagacggactcgggctcctgccggcttggctgagtccgttcgactggaacagccgggcatgtcgctttggagactcggtcagagtcaatgccttcgcgctcccgcagcccccggccttcttctcggcgccctgcgtcgcgcacgtgcagtccagacagccgtgcgaggcgcacgtaccgcacgaaacctccaactgtttcttgagcgccttgcgagcacggtgcagtcgcaccgccgcgttgttggacgtgatgcccgcctccagggcgaaagccgggacgctgacgccctccacctccacacgccgcagcgcctcggcatactcgggcttgagggtgccggccagccggcccacgcactggcaaacagcctgcgccagttccgcttccggcgcatggccctcctcgagctcgctggccagcgaagccagcgcgcgctccgtcgtgccacgacgccggtaatggtcgatgaccgcgttgcgcagcacgctgtagaaccatgccgtcagcgactcatcttcgcggagcgtctccgccttgcccatgccacggacgaacgcatcctgaaggatgtcttccgccaccgcgcggctcccaacccgacgctcgaggaagcgcaagaactcccggtggttctccaccagactggaaatgacgtcggcggacaggggccgcaccacgccatcgctctccgcacccgctccgtgattcatgtcgctcatgccgttcaggtacagggacagaggacctggtgcaagccgtcctctgcccccttcgccatcaaccaaagcgcacgtccggattgatgccgtccgcgtccatgcgcaccgggtcggccttttccgccaccgtccccttcgggtgcacgtaccagccgctcccatcctcggtgtccgggttctcgcgcaccttgaggagcgtgaacatgccgcccatgtcgatggggccgaagggcccctttccgcccttcatgggaatgctgttggccggcattggcatgcccatctcttccatgccgcccatgccatcctgccccatcgtcatgtaccccggcaccagcgcctgcacccgccggtcgatggcccgtgcgtcagcgcccagcgtcaccggacccgcgtgtcccatctggttcatcacgtggtgggtcatgtggcagtgcatggcccagtcacccggttcgtccgcgacgaactcgatgacccgggtgctccccaccggcaccaggatcgaagtctccgggtagcgggcggactcggggacgaagcccccatccgtccccgtcatttcgaaggacaggccatgcaggtgaatggggtggtggtccatggcggacagattccccaggcggatgcgcacccgctccctgcgtccgatgacgagcggctcggtggccgggaaggccttggagttgaacgtgaggacattgaagtcgctcatcgcgttggggtccggccggcgcatgcctggaagcaccttccactcgtgcgtcatcagcgcgaagtcgcggaccaccttcgggccgcgcggacgcttcggatggacgatgaacatgcccatcatccccagcgccatctgggtcatctcgtcgtagtgcgggtgatacatgtacgtgcccggctggttcagcgtgaactcgtaggcgaacgtttctccgggggcgatggggcgctggttcagcccggacacgccatccatgccattgggaatgatgagcccgtgccagtgcacggtggtcggctcaggcagccggttggtgacgtagatgcgaaggcgctctccctccaccgcctcgatggtgggccctggcgtcgagccgttgtagccccacgcttccacctccagcccaggggcgaaggtgtgcttcacaggcatggccaccaggtggcccaccttcacgccccccaccttcctccagggtagcgtggagccgttgggcgtggtgacggccacctgcccgcccggagcgacgatgctcggcgtcctggcgcgtgcgctgacgggagcggaaggcacggcgtgggactgtccttgcgcgagggcttggcttgcgaccagcgtgcccccagcgagcgcgccgagctgaatgaactgtctgcggtccatggtggtgtgtcctctcaatgtcgaagtgccgtgaatgcgaaggtcagtgcgcgtccgccgcggcggctggaccggagctcgcgctcatcgacgaaacgcggatggagcccaactccaagccttggtgacggcccgccaggagttgctccagcgccgagcgggcgcggtggtggtcgagcagcgtctccacgtaggtgctggccgtgtccgtcacggcggcctgggcacgcagcacctcgaagacgcccacctgcatggcgttgtactggagcaccgtctcgtcgagcacctggcgccgggccggcaggagcacgtcacggacgtgccgcgctcgtcgccccgtggactccactcggccgctggcctggcgcagcgaggcgcggattgcggtggccgtggcctcgtaacgggccttcaaggactcacgcgaagaaagggccgccatgcgcacgccctgcttgcggtcgaacagcggcagccccaccgtgaggtgcgcccccatctcccaccggtcctcgtccttctcgccgtggaagccgccggacaggtggggcagaaacccctccgtccgcgcgagcctgtggcgccggtcggcggcctccatgcggccgcgcagctcggccaggtcgaggctcgcctcgatggcgcgcgcctccagcccctcccccgaatccaggtcgttgactgggtcggccagcggcgaatccaccgtccactgcgtgcggggaccgaagaggcccagcaacacattgagggcctcgcgcgagtccagcagggcgttctcggcttcggccacggccaggcgcgcggactccacggcggagcgctcggtggccacctccagtgcgcggacgttgcccgccttctccagctccaccgccgtgccgtagcccgcctgtgcgacctgcagcgcccggttgcgcagttccagttgctggtgccgggcctggacctcgtagaagcccaggcgcgtgcggtaggccacatgcagcacctcgcccgccgtgagtgcgcgctcagccgcgcgctcggcctgggccaccccgcgacgctgcggcaggaggatgagctcggacaggtcgtactcgagcccgatgtccccttgcagcggctgcccgccacgggtgggctttcgcatctccagttccacctctggattgggaggaaggctcatctgcaccaggttgccagtggcgatgcccagcgcgtgcatcgcggcgcgcaggtcgcggttgttcagcagcgcgatgcggacggccgtgtcggcggtgagcggctgggccagcagcgcccgcactgccgcgtccgcgtcctctccccggagggcctcgctggtgagcccggccatcgggtccccaggcgtccaacgagcgctgagcgtcgtgtgcacgtcacgcgcatcattcgccaggggaacggtgacgcatccccccaatgtgagcatggatgcaacgagggtacctgcggcgggccgcttccagcgtgacgatgaccaggtcttcatggtgcctctctctccgtcgcgggcggctagtgctggtgatggtcgtggctgggggcgggactgccggcatccggggcgctaccggagtgccccccgtgtccatcgtgagcgctcccctgcttcgcgccatgccccgtgtgcccgccatggccagagtgcccagagggatgccccgtcgtgttgccttgccgagcggtgccaccatgaccgcctgggtgcccgtgatggcccgcgtggtcgctcccctggactccgtcgtcggaggcaatccccgacggcgcgcgcagcggatcagcatctgtcagcacagcgaccagattcggacggggggcctccggcgcacgcaaggaagtgggcgacgtggaatcctcgtcgagcgcgctccagggagcggcggcgcaggcggtgaggggagacaacaaggagaggacgaggagcttcttcatgatgggattcctttcggagcaggtgaccggcttcggctccttggacgtggcaggggccggcgacttacaggtccggggctcaaacctctgcgatgaggcggccgcgcagcatgctcatgccgcaggtgaagtcgtacgcgccgggcgtgagcgcgggcaggtcaatggtcaccacgcgcccggtgggcagcgtgcgcgagacgccgaggtcgccgagcacgatctgctccgagcacgcggagcggtccgtgcgcaggacgttgagcttcaccggcacgcccgcgcgcaccacgatgcggtcggggcggtagccgccgtccaccatcaggtccacttcctgcgcgccgccgacctcgctccgggcccgggtgcgctggcgcgggccgaagaagaacaggacggtggccgccgcggccagcacgctgccagagacgactcccacttcgatagaatccaacatgacgctctctccctggacgcaggttccacgcggcgggccagggagcaggtcgcgccctcatgtccaccgcgttcacccctgttgacgggccaagagccgggctcttacaggtgccgtgaatgcacgaacgccacggtcccgaatggaggaccgtggcgccgtggggacttcttgaggaaggtttggctcacgccgcctggggcgctggcaggcgcaggcgccgtagacacacgctgttgagcaggaccgacacactcgacagggacatgggcacgctcgccagcattggtgacaacagccagcctgtcaggccgtatagcaaccccgccgttaccgggatgccaagcacgttgtagaggaaggcccacaacaggttctgtcggatgacccgaatcgtggggcgagccaccccgagtgcggccggcagtcctcgcaaatcggagcgaagcagcgcgacgcccgcggcatcccgggccacgtccgtccccgtgcccatggcaactgcgaggtccgcctccgccagggccggtgcgtcgttgatgccatcccccaccatggccacgcgccgtccctccgtctggagcgtacgcaccacgtgcgccttgccggacggcagtacaccggcgaagacccggtcgatgccgagcgcgcgcgccacccgtgcggccggtccatcatggtcgcccgtgagcatcaccacgtgcagccccatgctccgcagggattggaccaccgtggcggcctcctcccgctctggatccgcgatgccgatggcgcctacccagcgcccgtccaccgcgatgagcacgggcgtctgcccgtccgtcgtgagcacacgctcggcgtcctcgctcccggacacgccccgtccgtccagcatccgacgactgcccacgagcaccttgcgcccgccaacctcggcttccacgccatgtcccggagtggcggtgaacgactcgggcgttccgaccttcaggccccggttggaggcctcggacacgacggcacgggccagcgggtgctcgctcgccgattcggcggcggcggcgagggtcagcacttcctcctccgtcatgccgctcgcggtgaggacgcggaccaccgccgggcgcccctgggtcagcgtgcccgtcttgtcgagcaccacggtgtcgatacggctcgcgccttccaacgaagcggcgctcttcaccagcactccgagctgcgcaccccgccccatccccaccatgagcgccgcaggcgtggccaggcccagggcgcacgggcaagcgatgaccagcacggccaccgcgttgagcagggccatcgtcaggcgcgtctcctcgggggccaagacgaaccaggccgcgaacgtggcgatggcgatgagcagcaccaccggagtgaagacgccgctcaccacgtccgcgaggcgcgcgatgggcgccttggtgccctgggcccgctccaccacctggacaatctgctggagcgcggtgtcactccccaccttggccgcgcggaagaccaggcggcccgtgccgttcatcgtcccggcgaagacctccgcgcccgcggccttctccaccggcaggctttcccccgtgagcatggattcgtccaccgaggaggccccgtccacgacggagccatcgacggggatggactgccccggacgcaccaccacacggtcccccacccgcacctcggcgagaggaacctctcgctcgacgccattctccagcacggtggcgatggaaggggccaacgcctgaagccgccggatggcatcccctgcccgggtgcgtgctcgcgactccaggaagcggccgagcagtacgaaggcaatcaccgcggccgccgcctcgaagtagatggggggtgcggctccgtgcccaccatgacctccgtggtccccggtgaccatgaatgtcggccacacggtggccaccaccgagaaaatgaaagccgcgccggtcccgagcgccaccaggacgttcatgtcggccgacctgtgccgcaacgcggcccacgccgcccggaagatgggaccaccgctgtacgccatgactggcaccgtcaggccgagctgcacccagatggaaccggtgaagtcgagcgctccgtgggacatggccagcacgaccaccggcaagccgaagagcacggccacggcgagccggcgccggagccctcgctcctccgcggcgtccgtctcttcggcggtggaagcctgcggcacctcagcgcgatagccggcgtcggccaccgcatcggccagtgcactgacggacgtagcccgagcatcgaagagtacgctggcacggcgggtggcgaagttgacgctgcactcctggaccccctccacctcgctcagagtgcgttccacgcggcgcgcgcatgcggcgcacgtcatacccgacacggcgaggtccatccgctccagggcgcccgcgggagaccgggacgaggctgcttcaacggcattcatggggcttcctcctgcccgcgagctagcgggtcaccccactgacgcgcctcccccgaaaggcttacacctgcgaagagggccagccgcggtggccagcgcctcgtgcgccacccgcagcgtgtcggccatgaacggcacttcacggctccgtggaacgacgctgctccacgttccacctgtgaccgtgacggttacagcgaaacccatccgggtactccggacaggtgccgcgccacggcaaccccgcatgaacaggctcgctcagccctcggcacgcgttgtgctccagcggaccgacttcacgggatgccggacgtcctcgagagcatcctcactctgggagcaaccaagcgatgaagaagagcctgatgggactccttgctgcactccccctgattgccgcggcccccgcggtcgcgtgtgacgagcacgccaagcacggcgagcacgccagccacggcgagcacgccaagcacggcgatcattccgcgctcggaggcacggccaagaaggccgctgcgcccgcacagaagcccgcctcggccccggccaccaggaatggcgtccagaccgtggacctcacggtgacccccaagggcttcgagccctcggacgtgaaggtgaaggcggggcagcccgtccgcctcgtggtcacgcgcaagacggccaagacgtgcgccacggaaatcgtcatggccgacctgggcatcaacaagccgctccccatggacacgccggtgaccgtggagttcacccccagcaagtcgggcacgctgcgctacgcctgcgcgatggaccacatcagcgggctcgtcaccatccagtagaccgccgttccgggcaggctgcgcaccgaggtcacgcgcctcggggccgggccacgccaccacggcggcctggtcccctcctcgcccgcagcttccatccattcgtgaagaggcttcatgcatcgcaatcgctggttcatcgcggcagctctcgttgccctcctcgcaatgctcgcggcactcggcctcggccaggaggatgatgccgccatggcgacgctccggcagccgcgcgtggcaccgccctaccctgaagacaccccgtccacgggccgcgtgcgcgagttcgagctcgtcgcggccccgacagccctcccgctcctggatggccggagtctggaggtctgggcctacaacggccaggtacccggccccacccttcgcgccacccatggcgacacggtccgcgtgcgattcaccaacaagctgccgcagccgacgaccattcactggcacggcatccgtcttccgaacggaatggacggcgtgcccggggtgacccagcctcccatcccacctgggggaaccttcctctatgagttcaaagtgaaggacgcaggaacctactggtttcacccgcacctgcgcgggagcgagcaagtcgagcgagggctgttcggcgtgctcatcgtggaggaccagaagcccggtcctttctcacgcgagctcgtctgggtgctcgacgactggcgactcgacgcgagtggccagattgacggccgattcaacacgcgccacgacctcgcgcacgacggccgctgggggcaggtctccacggtgaacggggctgtccagccagaagtcccgctgcagcccggcgagcgggtgcgactgcggatggtcaacgttgcaaacgggcgcgtgttcgcgccttccttcgaagggctgggcgcatctgtcatcgcgatcgacgggctggccacggaccggccgcagccggcctcccgcttggagctcgctccagggaaccgcgtcgacctggacttcaccgttcccgaggcgctgagcaaccagcgcatggaggtgatggaccacttcacccgcaggccgttccctctcgcaacgctggtggtgtctggagaggtcgtgcggccacccgaagtggcagcagttgccccgcccccgagtcctgacctctctccagcgcgtgcactgcaacccgcggagacctttcggctgaatgcgaggcgaggaggccccttcggcatcgagtggaccatcaatgacgaggcgttccaccacgagggggagcatgcctccgcgcaccacaaggtctaccggctccctgcccaccaatgggccacgctgcgtttcgtcaacgagtcctcccgcctgcaccccatgcacgtgcatggccagttcttccgggtggtggcacgcaatggtgcatcggtggacgagggacactggcgcgacaccgtgctgattcgtccaagagagacggtggatgtggcgatgttcccgcaggacgtgggggcctggatgctccactgccacatccaagagcacgccgaggctgggatgatgacgctcgtggacgtccatgcggagggttcccagtaagcgagccgcgccattccgacagcgccgcgttcgccagacctgaagtcgagcccccggcccattacagtgtgaccagcctggtcacacccggcccttttctcgcaacgatgagggaacgccgcccaggaatgagttcagccacttgcagcgcgcaccacattggcctgcctgttgctaaatccctaccttcgttcgccaggggatgtcgtgtccggaaccgctcgcaggctcttatacgccttctcgctcctcgtcctgaccttcggcgcggcagcctatgccgcgctcgagggcatggcggagatccacgaggccctgcacagcgtgcggcggcaggaaacggccgtgcgcaccacgctgtcgctcgcgacctcggtgcgagacctctacgcacaccaggcgcacaccgtcatcctcggcaacgccagccacctgccgctctatgacagcgcctatcaccgtgccatggagcggctcgaagcggtacaagcccaggccaccacctccgaggaacgcgcccaggtggagaccatgcgccgcaccacgacggagctggaccggcttttccgcgaggcgctcgtgccagccgtgctgcgcgaggaccacgccaccgcggcccgtgaacacgccagggccctggaactggtcgacgtcatccaggagagcgcggacaccctggcctcgcactacgagcgcgccattggcaacttcgaggagcacgcgagcacggtccagcacgccagcttccagtggacggtcgccatcctggccgccgccgccctgctcgcggcgggcgtaggcctctacatcggccgctcggtggcccgcccggtttcactgctggaggccggcgcggcccgtatcgccgcgggcgacctcatgactcgcatcgcgctggaccgcccggatgagttcggaaggctggcgcagcagttcaaccggatgaccgccgcgctacgcgagcaccaggagcgcctggttcaaagcgagcggctggcgggcatcggccgcctcgcggcgggcgtggcgcatgaaatcaacaatcccctaggggtcatcctcggctacgtgcgcctgcttcagcgcaaggcggagggtgcgctcgcggacgacctgcgcatcatcgaagaggagacgctgcgctgccgtgacatcgtggaggggatgctcgacctgtcgcggcccctccaggtcccgggcgagacgctggagctgcgagagctggtggaggaagtcgtctcccggcagcgggagtccgcccagcactccgcggcatccctgacggtggaaggcgaagcccaggtggcagggcatccgcagcggctgcggcaggtggtcacgaacctggtcaagaacgccatggaggccgcaggtccctctggacaggtgacagtggccatccaggcccacgaaggcgaggtggcgctttcattccgcgacagcgggcccggcctctctcccgaggcacagaagcggatgttcgagcccttcttcaccaccaaaccccatggcaccgggctggggttggcggtgtcgcaggccatcgcccaggcccatggtgggcgcatccagccgcgcaacctgcctggacgtggtgcggaattcaccctgcatctcccccggagtacgccgtgacggacagaccgagtgttctcgttgtcgacgacaaggagaacatgcgccacctcatcacccgcattctcggtgacgcttatcaggtgaggacggctgaagacggaggccgtgcgctctccctcatccagacgcagccgttcgacgtggtggtgacggacatccgaatgccaggagcgggc

SEQ ID NO: 1154 - DNA, 15351 bp, Myxococcus xanthus
gagttcctggtgaacaacgcgggcttcggttcgtgcggtcccttcctggcgcaggacctggcgcgggaggcggagatggtggaggtcaactgcaccgccctcctgaagctgtcgcacctgttcgcgcggcccatgcaggagcggggcagcgggcgcatcctcaacgtcgcctccaccgcggcctttcagcccggccccttcatggccacgtacttcgcgactaaggccttcgtggtgtccctgtcggaggcgctggcgcacgaactgaagggcacgggcgtgacggtgacgtgccactgtccgggtgccacgcacacggagttcacccagcgcgcgggcaacggccagacgcggctgttccagcagccgggcgtggccaaggcggaggacgtggccgcccatgcctacgcgatgatgatgcgcggccgggtgctctccatccacggactgctcaactgggtggggaccctgggcgtgcgcttcagcccgcgcgtggcggtgcgcgcgctcgcggccagcctcaaccagcagggctgaggctggcctccgcggcggcgccgctcagttgtacgtcgcggagaagacgagcgacacgttggtgacgttccagctatcgctgttcgactcgttccggatgcggcccagggccagctcggcaccgatgccgaggccccagttcttgctcacccaccactccttgcccacgcccaggtgcagtccgccgccgatgtccgactcggccaccttctcaccgtcgtcggtgacgctgagctgcgtgtacgtgagcgcaccggacagatacacgttcgcgggcatgatgtaataggtgacgcccaagcccacggcgccgaagttctcgctcaagttctcgttctgcccttcgacggtgaggtcccccacctggaggctcgggttgggggcggacgcaccgtagaacttcgcgtagaggatgaagttgttgacgagcgcgaagccgagctccgcgttgatgttggcgccgccgcccttcaccacgagatcgggcgagacgtcagtcgccttggctcggagatagccaccgcccacctgcaggcgcaggtagaagccgtcgtgggcgtgctcgtcgtattcctgggcgctcgcggtggtggcggtgaaaagcagggccgcgatgatgctggggtatcgcatgaaaacagctccttcggagaatcccacccggccgggggctctgcgctatgtagcacggcgagctgaaaggccagcgtccgcttcaggccgggccgcgttcgcgagacttgcgcgtccgcgttcgggtgccggaagctccgcgccaccatccgggtggtgcgccatcctggcgtggccggaacgaccaagagagggacggggatgaccgcgaccgtggaccacgaggcactggcacatttcctggactcggccaggctggagcgtcgcgaggtggcgcccctcacccgcgagcaacccgcgttgagcgtgccggatgcctacgccatccaggaggccggaatccggctgcgcctgtcccacggcgagcgcgtggtgggcttgaagatgggcctcacctccgaggccaagcgcaagcagatgaacctggactcgcccgtgtatggcgtactcacggaccggatgcaggtgcccgctggcggcgtgattcaactgtcacagggcgtccaccccaaaatcgagccggagattgccttccgcaccgcgcgtgagcttcgcggcacggtgacgcgcgacgaggtgctggacgcctgcgagtccgtgttcgcggcgatggaaatcctcgactcgcgctaccgcgacttcaagtacttctccctgccggacgtggtggcggacaacgcgtcgtcctcgctgttcgtgctgggcaccgccgagcatcctccgcgcgcgatggacctcacgcggctggagatgaccctgtcggtgaatggcgagcccgttcaatccgcccgcgcggatgccatctctggcgaccctgtcgtctccgtcatccagttgtgtgagctgttggcccagcgcggccaggtgttgccggcggggagcatcgtgctcgcgggcgccgccaccgcggcgcacatgctgcgcccgggggaccgggtgcaactcacggtggaaggactgggcatcgtggcggtgtccgccgagtaacgccgggcgctacccgtcgagcggagcgcccgccgcttccattacgggtcgaggcgcgcgcgtggatgacaggcgctggagcaggtgccacgccagctcccgcgcctggcctcgaatctcggggacggccgtcgtctcccacaactcgccccggcgcggcgggcccagggtgtagaggcgtccagaggcacgtccacccgcgcccagcagcgcgccgtcagcgtccgtggccagtcccatgcccaggacgtccgggcgcaccagcccggcctccaccagcccacccagcaccggatggccgcgcgtcatggcgccctctggccccgtgcagttgatgacgtgctggacgtgcagcgtctcctcctcgccctggccccgagggcgtacgcggacttccacgccggacgcctccagcgcgaagctccggacgcgcgccgcatggagcgtcagccggccctcgcgccgcagccgctccaccgtctcgccgatgcagggcgccatccggtgccggtgcacgtcccagtacgagcgcaggtgccggaggaagcgctgtcgctcgcccaccggcaaccgctgccacagcggtatcgtcacgggccgcagcgcgtccaccaccgtccgccagtccgcgcccgcctccgccgcgcgccgcacctcccggcgcaagaggtggaggatggggcggatgcgcacgggaacggagtgcgtgcccgtcacgctcatgtcgccgcgctcgcgccgcacctcctggcgcagggcccgcagcgcctcccggatgccgggcgaggcatacgtcgtggcgcctgcccggggtatctcctggtgcacgtggggcaacaggccgtgccgggacagcgcatggatgtgcccccggtgtcccatctccatcagcgacaatacggtgtccaccatggtgagccccgtgccgatgagcagcacgtcgtcggtggcggacacgccccggagcgcgtcttgagcccaaggggagcggtgataccggcggctggcgtatagcccgccgtcgggcacgcgcaggttggagggcagcgcgttgcccagggccagcaccacggtccgggcctccaactgtcccccgctggccagcgcgacgcgcaccgcgccgtcgtccgtctcctcgaccgaggcgacgtcgctggtcaccacttccagatgcacgccctgcgcggcgtgggcgcgcgcctcgcgcagcaccgactccaggtagcggccatagcgctggcgggagacgaacgcgccgggcgccgtgtccggcaactcacggcgcacccagcgcaggaagtgctccgggtcgtccgcgagggcccccatccgcgccgctggcacgttcagcaggtgacatgggctcgtcgtcgaatacgccagtcccaggcccgcccgcccgctccgctccaccaaggccacgtggagcggcgcacgcgcgctcctcaggagctgcacggccagcagcgtgccgctggcgcctccccccacgatggccacatcccaccaccctagtgctcgcacgcacccatcgtaggtcctgacatgctcgctggcatcctctggtggcggccgggtgtccaagcgccgggcccggatgtccggcccccctccctgggcaggggcttgttccgtgctcacactccgtcgcacacgcgggggaaacaccatgcgcgagcccatcatcgaccagcgggagcacggcgcggtggcccaggcgctgctcggctggccattgccggaacagacagaagacatcgtctccatggcatggctggtggagcggctgcgctccagcagggtcgactggggactgctggacaaactggtgcgcttcgagccctcgggctacacgcggcagacgattgcccggacgacagcgtgcgagctgctgctcgtctcctggctccccgggcaggcgtcccgcgtccatgaccatggcggctccggaggggcctcctggctggtgcggggcatgctgcgagagacgcgcttcgcgtgggcgggggaccggctggtgcccgaggtcatcgtgggcgcgaacgagggcgacctcctggtggagtttccggacaccatccaccgcatcgacaatgcgtcccgccacggggcggtgtccctgcacctctacgcgccgccgatgcaggggatgacgccgtacgacgcgagcctggcgccggagtcgctcaggccaccgcgtccgcttgctgcgaagcgcgaggcgcctgggcgaaggcgccggccacgggcaacgtgacgcggaagatgctgccccgcaccggggcgctctccaccgtcagggtgccgcccagcgacgtcacgatgccatggcataccgccagccccaggcccgtgcccacgcccaggggcttggtggtgaagaaggggtcgaagatgcgctcgcgatgctccggggaaatgccgcagccggtgtcgcgcacctccaccgccacccgtccggccttcgactcgcaggcgacgatgtggacctcgttcttctccacctcgccggggacgatggactgcgccgcgttgagcagcaggttgaggaacacctgacccagccgcgcgccattgccctggaccggcggcaggccctcacactccaccaccagccgcgcgcggtgccgcagctcgtgcatggccatcttcgccgccgtgcgcaccaccgagcccaggtccgacgggcccgtgcccacgtcctccgcgcgtgacagcgtctgcaggtcccggacgatgaggcggatgcgctctgctccgtcgcgcgtctccgccagcgcctccagcacctcctgccggtcctgctcggacaggtgctccttctgctgcagctcctggtggatgtactccaggttgctgaggatgaaggccagcgggttgttgatttcgtgtcccacgcccgcggcgatgcggcccagcgcaatcagtcgatccgcgaacagcagctgcgcctgggtggcgcgcagctgctccaggctgcgggacagcttgacgttggccgcctccagcgccgcggtccgttcgcggaccgtctcctccagcagcgccgcctcccgtgtggaggaccgcggcgcgcgaagccgcacgccattcacggtggggccctggagcgtgtcgaaggcgcgccgcagtgttccgcgccgctgtgccaccgccgacatcagcatcaccctcgctcgcagcgtcatcacgtccggctccagcggtgtggtgtctgttcgtggaaaatccccgagtcgtgacagacccgcgtagtcaacactgtcatggcggtcaggggcaagggacggaaggagggtgacagcgtgcgccgcaggacggaggcagtgtgttccatccgagcacccgctgcatcagtaggggcacgtgccgcagtccgcctggcagcttcccgcctcgacgccgtcgccgcaacgttccgtgagctgacagacgccgtctccacagcggtggatgtcgcgtggctgcagacgcgtcgtgagcggctggaaggtccgtccgttatacgtgcaggtttcgtaatagggcggctcgccgtaggggggtgggttcttcctgtccgcgtcccggtcgaaggggagggccgccgtggcggcgcgttggcagagcgactcgcaggtgcccgcgtggatgatgggcaggcagtccgagtgggcggggttcgagggcaggccgcaggcgcgcacggtgctttcgtcctcgcgcaggtagccgcggtccgtggccgcgaagacgccggtgccgtcgaagaggttgccgaagaagcacgcctcccgctcgctgaacgtcgacagctcctgctccgtgtacggcagggcaccgccccgcgcgttgcggcccagcacggagatggcgacgggaagcccgaacttgttcgcatgggccgccaggcaggctgagacgatttcttcttcctgggctgtcgccggtgcgcccgtggcccagttgagtgcgaggcccaggcctccctcccaggtgtacttcacccccgtcaccgggttggtgtacttgcgctgctgattctccttcaccgcgcaccggatgatgtagcgcatgagttcatcggcgcgtgcggggtcctggttgaaccagtgggagaatccaatcgtggagagcccattggttgataaaccattggtggacagtccgttggtcgaaaggccattggttgacaagccattggtcgacaatccgttgcctgattcggccgacccgtgggcttcgcacagcgtccacgtatcacccgcaagctccgctggaccacatgccccgcctccgaatcccagcgccaggcccagcagccctccggcgatgcgcggccggcgcaggtgtttcaggcagtgattgattcggaatccagacagaaacgctggcatgagacgcatggctttcccccgtttcggggagcgagcaatgcctgctccccggatgccatcagttccagctcacgcgaactaaaacactgtcgctgatgggtgaagccagtgtgacggtgttcaagccgtgagaaaatatggcccggcgggaatattcgggtgggggtctgcccggagacacctggtttgtgtcatgggcgacgacgtcacgctcacctgctcgcaagctgataacagatacgtgttttccgtcagctagtcgctcccgtcgaactccagggcgagcgacgctgctggcgtgagtgcgaagccatccgcggtgcgcaggcgccatgtgcctacgtcggtgacggggcctcccacgacttccgactccgaggagtcgccgcgcgtctccgcctggcccaggtggacgcagaggtggacgcgggcgttcaccgggtccgccagcttctgcgccatgtcctggagcacccgcagcgtacgctccgcctcgcgcaggtactcggtgcgctcggcgctgggggcgccgtggtccagcgggtgtacggccagcagggaggtgccggactggagcgccagcaggaagccgccgccgcgcaggccctgctcgagcccatccagcacgtccgcgagcaccgcgtacacggcgtcgtcatcctgggcggaggcggcgaggacgacctcggcgtggacggccagcgccagccgcgtgcggcgcgtgggctggacgggctcctcggccgcttcgctgagcgcggcgaggaaggccgtcacgctgccgaagcggcggctgccgtccttctccaggcagcgcagcaccaccgcgtccaccgccggggacaccgcggcgatggcgctgggccggggcgcgggcgcctccaggtgcagccgctccagctccatccggtcctcgcactggaagggatagcggccggtgatgagttgatgcagcagcacgcccagcgcgtagatgtccgtgtgcgggccaatggggccgccgcggaactgctcgggcgccatggcgtgcgcggtgcccagccgctggccggcgatggtgagcccttcctgcgaaggctcggcgtgcagcagcttggcgatgccgaagtccagcagcttcacccgggggcgctcaccttcctccacgacgaggatgttgctggccttcaagtcgcggtggacgacgcccgcacggtgcgcggcctccagcgcgccgcagacgggctccaggtacgcgagcgcgcgcgtcgacgacagccgcccgcgctcctgcaccacctgactgagggtgcggccggtgagcagctccatgacgtagtaggggctgccgtccggcatcagcccgaagtcatacacgtccacgatgttggggtggcgaatctggttcaccacgcgcgcctcgcgcacgaagcgcttgagcatctccccctggtccgccaggtgcgggtggaggaccttcaccgcggcccgccggcccaggatgcggtgctccgcctcgtacacgctgccgtgcccgcccgaggcgagcagcgccttgaggacgtactccccggccagcgtgcccgggcctcgttgcgcacgggaaggttcgctctgtgcccgctcggatgcatgcaggtccgctcgggcctggatgcgaaaggtgctctcggagtccgccgccatggggtgcctcatccttacacctttcccccaggagtctgctcagacgccgggctgaattcccgccgcgccgcggcatcggcgtgtgggcgttggccacccatcggggaggacgtgggcgtgtccgcggggtgttcgctggcggaaggtctgctgccctggagtcgggggggattggacggaggggccctggcactgatgggattcagggggcgtgaaacttcgcacggagagagcggggatggcgggagcgcggggcttcgggcgagcgtcggggggctgctacatgacgacgttggatgaactcacgacgtgcgcgggccttgccttggcgccaccgtcctccacgggagcctgcctcatcctcatcagcaccaccacgccggcagccatcggcaaggcctaccgcctggaccagggcgagcacatcatcggccgcggttccgacgtcaccgtgcgcatcgacgaccacggggtgtcacgcaagcacgcgcgcgtcgttcgtgcgggcgacggtgcctgccacgtcaccgacctggactccaccaacggaacgctgctcaacggcgtgcccgtcagcaccgccgagttgatggaaggggaccggctgcagatcggcaccgtcaccgtgttccgcttctccaagcgcgaagtcctggagcagcgggaggagcagcttcgccaggcgctgaccgccgcgcgcgtgggcatctgggactggaacgcgcagagcggccgggtgacgtggagcgagcaggtggaccggctgctggggcttcccgtgggcaagttgtccggccgcgccatggagctgtcggaggtggtgcacccagcggacctgccgcgcgtgagcgaggtgctgggcgccgcgctggagaagaagacgcaggtggacgtggagtaccgcatcgagccgcaggggagcggctggcggtggatttcctgcaagggtgacgtgctgtgtgacgcctcgggcgcgccagcgcgggtgacgggcacggtgatggacatcaccgcgcgcaagctggccgaacaggagctgcaccgccaatcgctcatcttcgagagcatctacgacggcgtggtgattaccgacctgggtggcggcatcatcgactggaactccagcgccgagcgcatgttcgggcgacagaagtcggaagcgctggggcagacgctcttcagcgtgctgcacccggatgagcccgaccggctcaccggcctggttctcaccgcgctggacaagcaggggcgctggtccggagagctggagttcaagcgccacgacggcaccacctgttggtgcgagtccgtcgtcgtgccgctgcgcgacagcgaggggcgcgccatcgccaacatcatggtccaccgcgacacgacggagcggaagcagctccaggcgcacctggtggtggcggaccggctggcgtcggtgggcacgctgggcgcgggcgtggcgcacgaaatcaacaacccgctggcctacatgctcgtcaacctgcatctcatccgcgaagggctggagcgactggagagccaggcgcccgcggcgcccgtggcgtcgttgcagcagttggtgcgtgagacagcggaaggcgcggagcgcatcgccaccatcgtccgcgacctgaaggtcttcgcgcgcggtgagcaggagacgcggctgatgccggtggacgtgcgccgggcggtggagctggcgtgcaagatggcggacaacgtcatccgccaccgggcgcggctggtgacggagttcgagccggtggcgccggtggaggccagcgagtcgcggctgtgccaggtgttcctcaacctgctgctcaacgcggcgcaggcgattccggaggagggcacgccgggcgtggagcacgagattcgcgtggtcatccgcgccggagagaaggaccgggtggtggtggaggtccgcgacacgggcatgggcatgggccaagaggtgctgggccgcatcttcgacccgttcttcaccaccaagccggtgggcgtgggcacggggctggggctgtccatctgccacggcatcatcgaatccatgggcggctccatccaggcggagagcgagccgggccggggcagcaccttccgcgtggtgctgtgcgccgccacgcgtgagctggaggtgttaccgcgcctgtccgccaccatgcaggccaacgtgcgcgcgcgcatcctggtggtggatgacgagcccaacgtgacgctggcgctccagcgctcgctggccgcggaccacgaggtgtccaccgcgaacagcgcccaggccgcgctgcggctggtgagcgacggcggccgtttcgacctcatcctctgtgatgtgatgatgcccgggatgacgggcatggacctgtaccacgagctgggccgctgcgccccggagcaagctggacgcatggtgttcatgacgggcggcgccttcacgccgcgcacggtgtccttcctgcgtgacgtgcccaacgccaagattgccaagccgctggacctgatgcagttgcgcgagctcgtgggccgctccgccgaggcggggcgatgagccacccggtgagtggcctctctggaacggacccctcggaggtcgcgcccgcgccctccctggccctggtgacggagcgccccgcgccgctggagttgacgacacgcgcgctgggcatgggtctgctcattggtgggctgctggccatcaccaatgtgtacatggggttgaagacgggctggtgggagagcggctccgtcaccgccgcggtgctgggcttcagcgccctggcctcggtgtcccgcaggcgtggcgcgccctatacgccgttggagaacaacctcacgcagacggcggcggcggccgtgggggccatgccggcggcggcgggcctcttgggcgcgttgccagcgctggcgctgctgggcacctccgtcccgggctggggtgtggcggtgtggagcgtggcgctgggggtgttgggcgtgctcgccgcgcacctgttgcggcggcggctggtagcccaggaggccctgccgtttcccaccggcatcgccaccgcggagctgattaccgcgatgcacgcgtccacgggcgacacggtccgcgcgggccgtggacggctgctggcgggcgcgggcgtggcggcggtggcggtgaccgccgcgcgggatgcgttcaaatggctgcctgggatgacggcgctgcccggcacgctggcgggccttcccgccgcgtcgctgacgtggggcgtggggtggagccccatgctgctggccattggcatgatgacggggccgcgcctgggcctgagcatgctggcgggcgcggcggtggcgtggggcctgctggcgccggggctcgcgggcatgggtgcgctggcggacacgcgctacgagacgctctccgcctggctcacgtggccgggcgtggggctgatggtgggctcggccctggcggcgctgttggcgcaggcgcgcgacttcctgagcgcggcgcgtgacgtgagcagcctggggcggggcgcggcggtgccgtcctgggcgctgggcgcgggcctggcggcgtgcgtgctggcggtggtggtgggctcggcgctgttcggcctcggcgtgccgtacatgctgctggcgctggtactggtgctgcccctgtgcgcggtgtgcgcgcgcggcgcgggacaggtggacgtgtcccctgtgacgcagatggggcaggtgacgcaggtcatcttcggcgcgctgctgccgggggccatggcgcccaacgtcgccgcgggcgccgtggtgtcaggcgcggccgcgcagacgggcgtcagcatgtggtcgctcaaggcggggcacctgctgggggcctccgcgcgccaccagctcgccgcgcagctcgtgggcgtgctggcgggctcggtggtgggcgtgccggtgtacctgctgctgtccaggacgtacggcctgggctcggaggcgctgcccgcgcccttcgcccatcagttccgcgcggtggcggaggtggcggtgcgagggctggacgggctgccgcctcacgcggccctggcggcctgcgtggccgtgggcgtgggcgcgctgctcacctgggtgtcccgtggccgggcggcgcggtggctgccgctgccggtggcgctgggcatcggcttcatcctgccggcctactacgcggtgacgctgtgcctgggcgcgctgggactggcggcggcgcgttggcgctggccccaggcggcggaccggaacacgtccacgctggcggcgggcgccatcgcgggcgagtcgctggcgggcgtgctcatcgccgcgttgatggccttcggcctcacgtagtcgacgaagactcgtgcaccttctccagggagcggcggatgcggccctccatgaggttgggcacgtgccgcgcgcgctccagagcctcgcgcagcacgcgcgcggcttcttcccggtcgccccggcgcagcgccgccagccccatcatctccaggacctccagcggctcctgctccacggacacctgcgcggagcgctcgcgcagggaccaccacgcctcgggggcggcgtcgcgggtggccagctccaccatggagaagagtacctcctccgacgggctcagctccacgcccggcgggccttccgccatcacgtgccgcacctgggctagcacctcgcgggcacgggtgtgccggcccatccaggccagggcccgcgcctggagcagcagggcccacgggcgtgacgccacctctgggtgccgtcgctccaacgcgatggcgcgagcgatgtggggcgccgcggcgtcggcgtcgccggcctggtagtgcagctcaccgaggttgtgctcggcgaagtactcccatcccaccatgcccagctcgcgtcccaggtgcatgaagcgctcctggtccttcagcgcccgcgacagctccttgcgcgccacccacaagttgcgccggttgttgatggcgctgcccaggtggaagtggtcaccgcgctcggtgcaggcggtgatgacttcggtgagcacgtgctccgtctcgtcgatgtcgcccaggttgggaaggatgacggccagcagcagctgcgccaccacctgcgtctcatagcccgcgtcgcccaggcggcgcgcgcgctcggcggcggcctccaggggcatgcgcgcctcctgccactcacccttgcggaactgggcgcgtcccagcgccagcagcagccgcgcctgtacgtagggcgaggccacggtggccgccaggtgctgggcctccagcgcgcgggcctcgctgcgcgtgtagtcgttcacccagtccagcgccatggcctcgtccagcaacagctccacctccgtgcgcgtgtggcccagccggcgggcgcgctcgcgggccgcggcgaagtccgccagcgagtcgtcataccggccaatgcggatgcgcatcaggccccggccgcgcagcgcggtgaggcagcgcagctcgtcggtgggctccagcagctccagcgcccgtgtgtacatggcctcggcgtcgaggaacgcgtggcggccccgggcggactcggccaggtcgatggagagcgcggcggcctcgtcgcggcgcccggcggcggccgcgtgcagggccaggcgaggcaggcgctggcgctcaccggcgccggccgcgctgaggaagtagcggtaggcggcgtggtggacgtgctcgcgctcggcggcgggcagggtggaggccaccgcctcgcgcagcagctcgttgcggaagctcaacccatcgtggcggtgggacaccagcaggccggagtccaggagccgcttggtggcgtggcccgcgtccagggggaagccgcccgcggcgccttcgcgctccagctcgcgcaccacgccttcggccgtggccgcggtgaagtccgtgcccagcatcgcgcacaggcgcgcgtgcgcggccagcgatggcggcagcgcgcccagctcgcggtccgccagccactccaccagccgcagctcgggcaccttctccagcccgtctgtgacgaggtaccagctccctcccggcgcgcgctggcgcaccaggccctggcgcttgaggccgcgcaccagctccaccaggtagagggggacgtattgcgcgcgctcgacgatgcgctccaccgcttgcgcgggcacgttctccaccggcttgagcagcaggcggcacagcgactgcgcctggtcggccgccagcaccggcagggccaacgtggcctgcttcgcggcgcgagtgccccaggtgggacggctcttctcgaagcccgggcgcgccagcacgcacacccacagcgggacactggcctcggcgaggcaggcgtactccagcgcgtccagcgccgtctcctccgcgaagtgcccgtcgtccaggacgaggcacagcggacgctcgcgggcattggcggccagcagctcaccggcggcgcgcatggccagcgagcgaagcgcaccgggcgcggcggcccagctctggagctccggacccccgggcgtgtaccaacccagcgtggcggccacgccgggccacagctcggtgcccagcgtggggcccaggcgctggaggatggcggcgcgtgtctgctgctcggtgtccgtgtcgtcgcgctcgaaggcgttgagtgcgcaccgcagcagcgtgcgcagggtgccgtcggggtcgccctgcaccggctcccgggagcgcgagctgtacacccgcgcgtggggcagcagcaggcggaggcggcgggcgagggtggcggccaggtggctcttgcccaggcctcgctcgctcaagacggtgacgatggtgggcgtggcgccgcccaccgcggagcgtgcgctctccagcagctcggccagctccgcctcgcggcccaccagcacctcgctgccgagctggaggacggtgatgtccggacgaggcgcgacgcccggcggcgcggggcgcaacaggccccgcagctccggcacctccatgcagggcacctcgggcacggcctcggcggcggcgggagacagcaggaggccatgggcctcgggcccgctgggatagcggtcctcgcgggacaggatggcgcccaggtagcgcggcgcgccggtggggcggcgctgcacggtgacggcggacacgtccacgaggccgttgggtgaaaggccccgctccggtttaga

SEQ ID NO: 1155 - DNA, 19302 bp, Myxococcus xanthus
  unsure (1)..(19302): unsure at all n locations
cccatcagcgactcccctcccccgtgctccgacagcgggtcttccaggtccagctcgagcacgaggttggagggcaccccgggcttgctcgcggacgcgagcagcatcaggcccacgaggcccaccacgaagaggacagacagcgcgcccacgaaggccagcgcgccgatgaagaatcgtttcatccgaagggactcctgatgcccgggagagacagggtacggccctggcaaggcgtgcttactactaacgcgcgcgggcgacgatgcttgcgcgtccccgtgctttccccgcgtgacggtacgcccgcggccgggccggggatggccaccacaggccctcgtcgagcggcggaggaggcacggcgggccgtggctgtcacgtcggcgacgccgggttgctcggagtgccaccgtccgggatggcctgggggacatctcgggttagaagccggtgcactcccagacgacccgcgaggaccgcatgaagcgtcgtaccccgctctccctgatggcggccctgatgatggtggccggcactccagtgtgggcccagactcccgcccccgccaacaaggcccccgccacccagtccgttgtcacgaagagcaaggcgaagggccgcgtgctcgcccccgtgacgagcgtggaaggcatctccgagtaccgcctgcccaacgggctgaaggtgctcctttttcccgaccccaccaagcccacggtgacggtcaacgtgacgtacttcgtgggcagcaagcacgaaggctacggcgagacgggcatggcccatctgctggagcacctgatgttcaagggcacgcccaccacgcgcaacgtgccccaggcgctcaccgagcgcggcgcccggcccaacggcaccacctggctggaccgcaccaactactacgagacgctgccggcctccgacgccaacctccgctgggccctgtccttcgaagccgaccgcatggtcaacagcttcatcgcgaagaaggacctcgacagcgagatgaccgtcgtccgcaacgagttcgaatccggtgagaacgacccgcgcggcatcctcttcgagcgcgtgatgagcgccgcgtacatctggcacagctacggcaagtccaccatcggcgcgcgctccgacttggagaacgttcccatcgaccggctccaggccttctaccggaagtactaccggccggataacgccatgctggtggtggcgggccgcttcgacgaggccaaggccctgtcgatgattcaggacaccttcggcaagctgaagaagcccagcctgcccctgcccgccacgtacaccgcggagcccacgcaggacggcgagcgcgaggtgcaactgcgccgcgtgggcgacaccgcgctgctcaccagcctgtaccacgtgcccgaaggtgcgcaccccgacttcgcggccatcgacgtgctgacgctggtcatgggcaacaacccctccgggcgcctctacaagtcgatggtggagacgaagaagtcctcgcgcgtgagcgcgtcgaacctccagcttcgcgacccgggcatcatcgtcttcagcgcggagatgcgtgacgaccaaccggtggccgcggcccgcgaggcgctgctgaagacggtggaggacgcatcccgcacgccgttcaccgaggaagaggtcaaccgggccaaggccacgttgtccaagtacatcgacctcaccatcaacaactccgagcgtgtcgccatcaacctgtcggagtgggaggccactggtgactggcgcctgctcttcctgcaccgcgaccgcatcgaggccgtgacgcccgaggacgtgacgcgcgtggcggccgcctacctcaagtcctccaaccggacgctgggcactttcatcccgacgccgaagccggaccgcgcggagctgccggcgccagtggacgtggcgaagatgatggacggcttcaagggccgtgacgccgtggcgcagggcgaggcgttcgacccgtcaccggccaacatcgagtcgcgcgtgcagcgcggtgagctgccgggcggcgtgaagtacgcggtgctgccgaagaagacgcgcggcaacatggtgaacgtgtccctctccctgcgctggggcaccgaggaggcccttcgcggcaagtcggacgcggcgcagtacgccggacgcatgctgatgcgcggcacgaagaagcgcacgcggcagcaactccaggacgcgttcgacaagctgaaggcgcgcgtgggcgtggatggcagcagcaccggtgcctccgcctccattgagtgcccgcgggagagcctgccggaagtcctcaagctggtggccgaggtgctgcgcgagcccgccttcgacgagaaggagttcgccatgctgaagcaggagcggctggcgtcgctggagtccgagcgcagtgagccgcagacgctgggcaacatcgccttctggcgttcgctgtcgggccactatgcgaagggccacccctactacgtggccacgctggacgagcgcatcgccggggtgaaggacaccacgctggagcaggcgcgtgcctaccacaaggccttctacggcgcgtcgaacggcgagctggccgtggtgggtgacttcgagcccaaggacatcgtggcgctcgccggcaccctgctgggcgactggaagagccccgcgccgtaccagcgcgtgcagcaggtgttcggcggcggtgcgcccgcgtccgtcgcgctggagacgccggacaaggccaacgcgtactacatggcgggccagtcgctgaagcttcgcaaggacgacaaggattggccggcgctggtgctgggcaacttcgtgttgggcggcggtttcctcaactcgcggctggccacgcgcatccgtcagcaggacggcctctcctacggcgtggccagcagcctggacgcgagcgacgtcgacgaggtgggcaccttcttcacgtacgccatctacgccccggagaacgcggcccggctggagacggccatgcgtgaagaggtgactcgcgcggtgcagaagggctactcggcggaggagctgcagaaggcgcgcacgggcatcctggagtaccggcagtcggcgcgggcgcaggatggcagcctcgcgcggcagctcgccagctacctgttcctgggccgcacgctggccttcgatgcggcgctggagcagaagctgacccagctcaagccggaggacgtgcgcaaggccatggatcgtcacctggactggacgaaggtgacgcaggtgcgcgcgggtgacttcgccaccgcgcagaagaaggccgcgcccgccgcgaaggtcccggccgcgccgtgacgccgtagccccgtcacccctgtgagggaatcaagcccccgcggtgcccgagtggccccgcggggcttttgattgagaggctgaacggcttccaccctttcgtcgcagtgcttgacagagaatgcggaaaaggcccccaaaggagccctgcctcttgtcctttggaaggaatgcctcggtttgccggacggcgacgtgggcgcgcacctgtttgaactgcgcatctcggatgcttggctcgttggctctgacgtccgcgtctgaaaagaagtgccagagggagtgagggatgccgagcagttcctcagaggccttgatgcggtcctggaccttctgcgcctcgtcgtaccaaaggcgctgctctgcctttgtctgggcaggcagctccatgagacgtcggaggtcctgagcgagctcacgtgggccgtaggggggtggggatgaggtattcatgagaggcgaccccgtgtgtacgcgccctcccctccccttcaacgcggcggcagtgtggcgaggaatgcatccagcgcggcgttgaagcgctccggtgcatccatcatcagccaatggctgacacctgagaacacggtgtgcggcgtgcccgggtacaggaggtggtaggcattgggctggatgaaggcatccacgacgagcgtgtggagagggcccttgtagcgttccagcacacggtccgaattgaacgtgagcatgctctccagcgccccgaccaccacctcgcgcggcgtggcatgcagccagcgcatcaccgactcgtgcgtgtgtggcttcgcgttctggaggatgggcgtgaaccatgcgtccatgaaggcgcggtaggactcgggacgtgtgccttcgtggaagccttggagctgttcgggcggaagcggcggcatcgtccccgcggcatccacgatgacgagcccggccagccgttcgggccagccacgggcgtactccgccgcgacgtagccgccgaagctgtggcccaccaggacgaagcgctccaggtccagggccgtggccaccgcgtggatgtcattggccatgtcctcggcgccgtagcggccctgggcgtcgaggcccgagtcgcccatgccacgcaggtcgaacgacacggagcgctgcttcaaatgtgcttgctgcgcggcccattgctcacgccgggaggcgttgctgtggacgaagacgatggggagtccaccattgccagtgtcggtgactgcgagctggcccgtgggtccctggacggtacgcgaggtggaagtcatggcgcggaggacgatgacacgattcgcggcccgtgcgcttgggcaccctcccctgcctcctgctggcgcgtgcgcgcccggagcccgaagaacgcggcgagccacgcaagcagtgccatggcggtcatgaccccggccatgggcatcgcggtgccattgttgaacgtgctcacggcccacgacgcgccggccgccgcggtgaactggagcgcgcccagcgcggccgacgccatgcccgcgcgcgtggcatgccgctccagcgcaatcgcagccgcgttgggtcccaccaggcccatggccgacacgaagaagaacagcgtgacggcgatgccccacaggcccatgaagccggtccacgccaccgccagcacggccaccgccgcgacgacgcacaggctcaatgccagacgcagcagccggtgcagcggcaggtgtgtcaccagcttgcggttgagctgcgccaccgcaatcaaccccattgcattgacgccgaagaaccagccgaagtgctcctccggaatgccatacagcgagatgaacacgaacggcgagcccgcgatgtacgcgaacatgcccgcctgcgcgaagcctccagccagtgcggggcccacgaagtccgggtccttcatcaatgcgcccatccgggagcgcatcgactgcgcccccacgtgcggcggcgccgtctccggcagcgacttcagcacgaaggccagcgccaccgcgcccaccgccgccagcaccacgaagatggcccgccatcccgagtactggagcaccattccgcccagcagcggcgcgaggatgggcgccacgcccatgaccagcatcagccgcgacatcgtccgcgcggcgttggcgccggaccacaagtcgcgcaccacggcgcgtggaacgaccaatgccaccgagccaccgagcgcctgcacgaagcgcatggccaccagcatggacgccgacggtgccagcgcgcagccgagcgagcccaggacgtacagcgccaggcccgcgtagagcggacgcgtgcgcccgaagcggtcgatgagcgggcccgtgaagagctggcccagcgccaatcccgcgaagcacgacgcgagcgtgagctggatggcgggcgcggtggattgcaggtcctccgcgatgcgcgggagtgccggcagatacatgtcgatggagagcggtgcgaacgctgtcagcgttcccagcagcaactcgaggccgagtgtgcccttctcaatggactgggtcgaaggcgtggtcatggactccctgggccgagggccgagccccggcgaataaccggcttccggcctccgcaccgtgaatgtgccgcgcacccagaagcacggttgctggaagggaacgccatggctgtacacaccaccggcgagcagcctcgtgggcctccatcggcatgtcagacccccgggttattccttttcccgtcgcgcacacgaaggtgtcgggccctggcggcccgagcttgatttcgccactgcgccctcaccgcacggagcgagtccacccacccgtgtacgcgacacccgattcccccgcgcgcggcggagatgtgacgtcgcgcgcgggggaaaagcgcggtgccagggccatgggggccaggggccgcgccagcgtggggcgggccttcgggtccgttgagcggggaggtgccgtcaacccgggggggcgggcggtgccattcctttctccccacgcgacgatttggttttttgccgcccgggacggggggcgcggtccggctcgaaagccgggcccgaccttccgccaggtggccggtgcgcgcgaggcagacagcgcctcaacccctcccactgcctgcctcgcgcgcttccgtaaattctcgaacgagggcagggcagggcgctcgctccatcgggcgccctcccgctctcgaagggcctttgcttgccaagggcccgggttgggcgccatacgaaggcgcgaaacggcggcggggcaggtcagcctgcccgcgtcgcccgcgaccttcgtgagacatgggactccggtacgacgtcatcgtggtgggactgggccatgcgggcagtgaggcggcgctcgcctgcgcgcggatgggattggccacgttgggcctgacgctgaagcgcgagcgctcggcggtgttgagctgcaacccggcggtgggtggcacggccaagggccacctggtgcgtgagctggacgcgctcggcggggagatggggcgcgcggccgaccaggtgggcacgcacttcaagacgctgaatgcctccaaggggccggcggtgcaggcctcgcgcctgctctgcgaccgggatgcctacgcggtcggcatgcaggcggtgctcttctcgcagccgaacctcacggtgcgcgagggcgaagtcgccgcgctggtggctggcggaggccgggtggagggcgtggtgttgggggacggcacgcaggtgtccgcctccgcggtgctgctcaccacggggaccttcctccaggcgctgatgcacgtgggcgagcagaaggaagtcggcggccgtctgggggacgacgcggcgcgcgggctgtcggagtcgctgcgcgcgctgggcttcaccctgggccgcttcaagacgggcacgccggcgcggctggcgcgcgcgagcatcgactgggacgcgctggagccgcagccgggggacacccgcgtgcggcctttctcctggcgcaccaaggtggaaggggagggcgggatgccgtttccccgtcagccctcggtgacgtgcgcgctcacggagacgacgccgcgcacgcacgcggtgctgcgcgacaacctgcaccgctcgccgctgtaccagggggacatcgtcggccgggggccgcgctactgcccgtcactggaggacaaggtggtgcgcttcgcctcgcgcgagaggcaccaggtgttcctggagccggaggggcccacgtcgccgctggtgtacccggcgggcctgtccacgagcctgccggcggacgtgcagctcaccttcctgcacaccatccggggcctggagcaggtggaggtggtccgcttcggctacgcggtggagtacgactacgcgccgcccacacagctcaaggccacgctggagacgaaggccattgccggcctgtacttcgcggggcagctcaacggcacctcgggctacgaggaggccgccttccagggcctgtgggccggcatcaacgcggcgctccagttgaagggcgagccgccgctcctgccgggccgcgacgaggcccacggcgcggtgctggtggatgacctggtgaccaagggcgtggacgagccgttccgcatgttcaccagccgctccgagcatcggctgaagctgcgcgagggcaacgcggacctgcgactggcccgtcacgggcaccgggtggggctgctgccgcgcgaggccttggagcgggtcgaggcgcgaggccgcgcggtgacagaggaggtggctcggctgaagcgcaccgggctggcggcgcggctgcggcggccggaggtgacgtacgcgcagttgggcgaaggccgcgaggactggcccgtgctgtcacccgacgtcgccgaggaggtggaggtcgaggtgaagtacgagggctacgtggcccaggccgcgagggcagcggcgcgcgaggccgagtccacggaccggtggcggattccggagggctattgcttccatgaggtgcggggtctgagttcggaggcggtggagaagctgaccgcgcatcggcccgggacggtgggacaggctcgccggattccggggctgacgcccgccgcagtgtcgctgctgctggtggcgctcaagcgcggaacagaggcccccgcagtctgcgctcagcccgaggattgatcaaataaggggctgtggacaacgtgtgggaaactttagggcgtgctgtctcctgaatgattccagtgggttgtaggtaggtttgacgtggagggcttgtggataacgcgcggttcgaggatcagctcgcggcggggtgccgggcgctgggagtgacggtggcggcggacctggggccgcggctccagcggttgatgagcgagctgctcaagtggaacgcgaaggtgaacctcacggcgattacggcgccggaggaggtgctggaaaagcacttcctggattcgctcgcggtgttgccggaggtgacgggcgcggcgacgttgctggacctgggcgcgggcgcgggcttcccgggtctgccattgaagctcgcgctgcccgcgctgggcgtcacgctggtggacacggtgggcaagaaggtcgcgttcatcaaggccgcggcggcgagcctggggttgcagggtgtgcgcggtttgcacgcgcgtgcagaaggccagccggagacggaagggattccgcgcgccgaggtgctgattgcgcgcgccttcatggacctgccggattggctcgcgctggcgcccgcgtatgtggagccgggcggacgtgtggtggcgatgctcggcaagccgcagacggacgcggagctggcggcgcgcgcggcggagcggcaactgcgcgtcgtctccgcgcgggcgtaccggctgccgttctctggcgccgagcgccaggtggcggtgttcgccaaggagtaggggaggggagtgccgccgtgcgcgccggcccgtgggtgattccgggcggtgtgacacggcggtgtttcctcccggggatgcacggcgatgctgagtgacttcagcagcgcgcatcccggcggcagggaagggtggcgcgagccaggggcctcgttaggtttcacggcggaggtgccacgcatgcagccgcttccgacggaccgtccacgcgcctggttgttcgagcgtcacgctcacgccgtcacgttgaaagcctcgcgctccagcttcgagcgccagtggggccctccacattgcgtggtgactcgcgatgacggccgcttccaggaggcgcactggggttggcgcagcgagtgtgggctcgagttggtggtcgtctcgatgcgagaggccgaccggttccacgtcttcatcgaacccctggaagtcgaccacgccctggcccacctggggttgaaggacgaggtcgtggaatggcgagcggacgcggggttcccgcttccgcgtgaaggctgggttgtcacgcgcatggatgagacgggcaatcgctacgacgtcgcgcagtcgcccgagcgcgcgcacgtggcgtgcttcgcgcgcatcctcgaagaccgtgcgcacaagcagtcgtactacgtcgagtttcgcggcacgccagccgatgaggacgccgcgcggaaggactgggccgtcatccgtcaggacgagtacggcaatcgtgcggaggtggctcggcttcagtgtgagcagggtgctcgcgcattcgctgatgtctacgaggcggacccacggcacaagcagacgtacttcgtggagcccgtggctccgcgttcgtgagtcctgttcgagggtgcggggtgggcgtgtcgaactggctgcgcgcacctcgcgccccgcgttggcgttgaaccgtcgatgtcgatcggagcagcaggcgcttgctcacaacgatgcaagcgcatcattcgtgcgttcagggtggcagcgagcgttgctgtatcgcgacagattcctccacgggcagccccagtcagagcaggcgccgtacagtcaccggcgcgaggacgtgtacgtcaacgagctgtcaccggcctcccacgttctggcgtagctgtcggcttgggttcgcggctagggcaccgtgcatcctcacaaggacctctgtatgcgctcgcgacaagagcaccgcgcgctctcccggtgcggagcaactccatgacccggaaggacatcctcgaggcagtgaagagtttcgtcggagttctcgacgagcagaatcactttgaggaccgcgagggagtgctgcgtgcttccctggaccggctcgcgctggcctaccattttgccgacgccccgttcgaccctacgaagtatccggacgcgcctcgtgccgactacaggtccctgcgagagtgcatcgcgccactctttcccgccctcggcctgtacaacgaggcgttgcacatcgcggacaaggtgggtgagtccgagttcagcatcggcgacgccatcgacgacctcacggacatcgcgatggacatgcacagcgtcctcttccgctgggaaaacacgagcgaaggagatgcgctctggcacttccgctttggcttcgagacccattggggactgcacctgcgaagcttgcagctctacctccaccagcgtgcctgctgatgtgcccagcaactcgcgatggtagctgagccgccgccgattcccctggctcccgaggcgctagcaggggaggggacgcggccctgcttggtgcatgtccttgtgcgcagtggctcggaagcaaggccggcaacctgagctgcaggtcggtcgctcggtgcatgaccttgcgcgcagcatctggagagcatcattggtcgcctgcgctgcacgtgggtcgccgtatgcaggacgacgggtggttggatgatgcgccaacacggccgagtcactgtccatcgaggtgcatgtcgaggcgtgggttgttgatggagcgctgcgtggacacggtcagctcacctccctcgggcaggcaggacaacgctcgtgccgtcggatgcgcggagtctgtcgaaggcgatgtccgtgaagagaggccaagttgaagtcctcgctgactaggcagctaggccagcgcctggttggcgtgtctgcgccgaacgcggtgtcttcatcgcacggaagaggcccacgtcgttgatgctgccggcgggctcgtcatcctgaacgctgcatccgtgcgcccggagttggggcagtccgagcatcgggcgcgagcgaatgtcgtgacacggcgcctcgggggacttgatgcaagtcgggatggggtgacgacgacgtgcatcctcgccgcggtttcgtgcgcacgggacgacgcgtccgtcctgtgcggagcggtctgagtccgtggtgcttcgatgcagtcgaatggatggagatgcatcgcatgtccgactcggtgatgccgtctcgtagaggcgcgcgaagtctccccgactgcgctcagctgagggccgacttgaggtgacgaagacacccgggatggagcttcgcgttcggccacttcgtgcgcggtgctgcttgaggcttcggggtggtcatgtgcccgcgcgtcaccggtggggacagtggctcgctttcctgtgggcctccaagtccgactgcatgttggtgcctgaccgcgctgctcgcgaaccggtgcggtgaccgagctcgcaggttcatgcgcgcgatgcgcggtatggcgccagttcaggtcgtgatggtctgcgtgaagcgggcgccttgcttgggtccaggtgttggtgtggtgcgcgcctgcacttcgtcatcctgggacagcccctgggacgtagcgaatgccgccggggacaggggttcttcagcggctgaaccgatgggtctcgttccacgtggagcaggggaggggagcgctcgtcatggcgaccacgtcacgcatgtcgccgtggctccgcgagcgagcggcacctttggctcaggcacatgcgaacggtgatgcgtgatggctgcgccacttctcgcgagggctctcatccggcgcgcgttcatcgggctcatgcttcacgcggaccgtggtggcaccggtttcgacatggaagcgctccgtgagtcgcgatgtgcaggcggtcgcatcgacatgagtgggcgcgtgcctgttctggacgaaccgcacgttgatgggagtgggcgtcgagcatggcctcgcggtggatgcgcgcggcgcccgaccggcgcgccgacctggatgcctgcggagtcgatgaccggaccgatgtggatgcgagcacggcatgtgacgggcggatgccgttcgctttcgtgacgggtccaggttcccgttccacgtggaacgggacgcttcgcatgcccatgcgtcgtggtggaggacacgtctggtcgtgggtatggctcaggccccatcagcgttgagcgcgggcatctcctgcacacgccatcagggagaactggcggcgcgggtgctcatgctcgggacatcgcgtggtccggggggccggagcgtgggtgacgggcgtcagttgttcgcgggcccagcctgcggctgacctcgtcttcgacctggcgctcgttccaattggaatgtggagcgcctcacctcagaagcggtcgtcagttgttcgcgtgctcacccaggtgctcgcgccgcacggcgcgcggggaactgcgagcacacggcttcgatgagcgctcatccaccttggccgagccgttccacttggaacaggacgatggatgcgcaggccgtcgtactgaccggagtggcttgctcaagccggtgccaccgccgttccctgttgagcgagaaggcgcgaactcgtggtcccgttgaacggacgcgacgtgctcatgcgcgggccccttgctgttccacgtggaacggggatgcgggaacgaacggatgtggcgtgttgctcgtcccttcatcgtgcccagcgaagaaggaaggagggagtgcatggccgcgttggacgaacgtggctggctcatgcgcgatgcctctcgtggtttcacgtggaacaggaagaagggacgcgtaggtggccacgctgagcgggtgtggctcgctcatgcgcgatgcctctcgtggttccacgtggaacaggaaggaggcgttggtgagtgctcccgctgggcgagtgcgactcgctcatgcgcgatgcctctcgtggtttcacgtggaacaggggatggcgaaaccacgtggtcgtgctgaacgagttcggttcgttcatgcgcgatggcctcggtgattccatgcggaggaggaagaggtgttggtgcgtggctgcacgaagtgggtgcggcttgcacatgcgcgatgccagccgtggttccacgtggaacaggggagggcgaaaccacgtggtcgcgttgaacgagtccggttcattcatgcgcgatggccaccgcggttccatgtggtggaggaagaggtgttggtgcgtggctgcgcgaagtgggtgcggcttgcacatgcgcgatgccttccgtggttccacgtggaacatggagacacggcacaagcgcgcggtcgtgctgagcgagttcggctcgtccatgcggagaatgcggatgtgttggcgcgtggctgcgctgagcgggtgcggctcgcacatgcacgatgcccgttgccgtccatgtagtgcgggagctggaagtgcgcggcgcggtctgatgcgcgcagttcttctgcctgaccgttccacgtggaacagcgagacggtctgagctcatcgacatgggcacatcgcagggatgcgcgaacgctggaggtcccttcgcggagtccgttgctcgttccacgtggaacatggccggggctgtgagcacgtcagcgcggagaacaggcgccgttcgctcatgtgctcgagtcatccttcgttccacgtggaacacggaggccatgagtgagtggccgcagttcccgaggtggcgtgaacacgcgcagcgctcgctacccgttccacgtggaacatggagatgccgtgcctgagggtgatgcgcgagcgcctgcttcttcgcgtgctcagctcacggcgtgttccacgtggaacgccgcggcgatgtgcagttggagtgttgggcgcggttggcgcgctcaagtgcgtgttcggttccacgtggaacatgcggacgcgatgggcgtgctcgcgtgcgctgcttcgaagcgttccacgtggaacgcgggtggccgcagcggcacgccaacacggcggttgagcgtgcctcagttcttggtagcgcctcatcacgtgttccacgtggaacgtggacgcggctcatcgaagcggatgaagccacgtggtccgccacttcttgggctcccagttcatggatgcgttggccgtctcgcatgcgtgagatgcacgctgcttgttccacgtggaacgcgaacgcgtggcgtgcacccgtgcgtgtgcgcggtgcatcgccagttccacgtggaacgtgggcagggctcgggcgcgaactcgtgggtcatggaggagcttggtcatgtggcgggttcggtggcgtgcgttccacgtggaacgcggcgacccgtcatccctggtgttggccagcgccgatgagcagcggccttcgccttgctccatcttccagatggctcggcctgcgacctcttcatcaatcaccgcgtggtggcgttcccgcgagttcgcgaacgcgtgttccacgtggaacgaagaagcggcgcatgaggtgctgcttcgcggtggttggaggccgccgctcggcatgcgcacttcgcggggacggtgatggtggtggggcgcctgcgcaccgcatcgattcgcgcatgcgctccgcttggcgtgagttcctgacgcttggtgggaaggatgcgcgtgctgatgcgtgcacctcagtgaagtggatggcgcggctgctcatgcgcgggttgctcagcgcctgttccacgtggaacgcgggatggattgatggtgggcacgcgcgcagcgccggagagttcgctgacggctccgcgttcaggctcgtgatgcgctcatggttcatggagtggtgagtgctccaccgggtggcgtggagaggtgtcgcaaaggggcctgcgctcatccaccatccagtgcctgctccatgtggagcgcctgatgcgcttcgtgatgcatggaggccccagatgggggctctgactggcggcaagtggagccaccttgatgcacgcgctccatgtggagcgcccgtgtgcggtgcggcgccaaccacgcaggcagtccagtgcgcatgctgatggagattcctgggcagtgtcggtcgtgcgttgggcgggctccatcccggcgctccgcgctgaagttcccatgagctcttcgacatctgtgctgaacgcggggcgttccacgtggaacgcgttgaacgtcgaagtggtgctgacgctgcgttactgcgtccccgcgcacgtcgcttggtgcgcgcgagggatggcgagcttcaggtggagccagcggtgaggactggcgatggcgtgggtggccgcatcagcgcgagcggatgttctgctgtgctcaggtgagctgcgagcccaagtggagcaggtggtgcggactggcgatggctgggactgtcgcgtctgagcgagcgcaggccaccacatgctcggacgagctgcgagctcagttggtgtggtgggtccagaccggcggtagctgccactgccgcattcggctcggccagatgatgcagcctcgttcccgcgcggataggacgcgatggcggtgtggaaagtggggcgaggactgacggcaacgccgactgtcgtatcgggacgaccgcatgtcgccgggtgttcgaggggaggcggtgcgaggccccgtggagtttgggggtctaccggagacagctcgaactgccgcattggcaccgtcgcacgctgtcctgacgtgatggtcaccaggtgcgagtcccgtatggagctcgcggcgacgatggacagtggcttgaactgccgcatcggcgcggctgtgcactatcgggaacgcactcgcgatgaagtgcgagtccaagggatggagccagtggcgaggatgggtggtggttcggactgtctcgttggcgaacctgcatgtcgtccgagttcatgcgcaacgaggcgcgaggctcgagccgatggcgcagacggcgagaagtcgtgctgacgtggatgagctgcggcgtcggtatggccgcgtggcgttttgaagcgatgggcatgagacgcgcgttccgcggggaacagtcgacgcggagcggctgcaactcagaccgaggggctcaggggctcgccgtccggagtccatgctcaccgagacgtgaatggctcgtgatgcagtaggcgagaaatggtggcaactcagcctgcgacgtccgtagggccgcaggtcgttcggagctcatgatcaccaaggcgcgagttctgtgtgacgcagccgacgaggcccgacggcaactcgcaccgtgacgtcagcccggccacatgcggtccggagtctctgcgcgccgaggcgcgagtgtcgcgtgatgcagtctacgagggctggagccgccgcagaccgcgacgtatgcccggccacatgtggtccggagttcatgctcatcaatgccgaggttcgtgtggctcagatggcagggacatgcggccactcatcgcggcgtgcggatgaagcgagcagtcggcgactgttgagtgagaggaggtaccgcctgccatgtccggtacgcattcgctcgacctgcgcgagcggtccatcgcagcttggcaagagagccccccacccctcctggcggccatttctccgcgcgatgcagccggtgggttggcccaccggggcgacgcaatcgctcagcccttttgaggcacgcgatgaggcgaggcgccccaagggccggggcgcacctcggcagctcgctgttcggaaataannannaattnttnaanttactacncaacaancaattaaaaaacgngctgttcatctccaccaacatccactcntccttcacatccatagagtccggcatccccacgctgacaacaccgggcatctcctacggctccatcaaagagctggcgggcctgaacgtaatcggcgcgggcttctacaccggcagcacggtgtaccggtacatcatgacggagctggacaagtcgctgaaggaagcgcaccccggcatggcgttcgtggacagtgatgcccacggcttcatggtgctggaggtcggcagaacggaggcgaaggcggacttccacctcataccgagcacggaaatcgacaaggactactcgctgcaccagccctacaagctgacggcaaaatttacccgccgcgattttataatcaaagacggaaccattacctcccccttaggagagaatgcttctcttgttcggtcacgagcgaggcacgctccgggacccacgtgctctggtcnnncggctggcccggtttcagggtggggcgcgcccggtggaatgccggcaaggtgcatggcgcaggcgcttccggtcctggttcgcgcgggcctcctgaattgctgcgccgcggcgtggggcgcgctagaagcgaggcatgttgcccggtgctcccgtttccgatgtccgactcgttcgcgcccggccggagcacgtggacttctggctggacatgcgggcggcccctggcgcgcggcgcttcgtggacacggaggacgacacgcgggagctgctcctgcggcgcatcctggaagcgggcgcgttgggtgagccccgcgcgcggagcttccggtggttcgtggaggcggacgggcagctcgtggggacggtgtccgcgcgggatttgtcgcgcgtgcatggccgcatcgagctgggctacatgatggcggacgcgcaccacggccggggcctgggctcccgcgcggtggggttgatgctggagcagttgttcacgctgccctacctccagcgggtgtggctgacgacgctggcggagaacacgggctctcagggcgtggcgcgcaaggtgggcttcacgatggaaggcaccctgcgcgggcactgtctgttccaggggcaacgccgggaccagcaactctggggcctgctgcgcccggagtgggacgcccggcgcgcggcgttcgtcgcgggctgagcgcttcggacgaccggtctctgggagcagtggggggcccgggttatagaagcggcgtcatgcatccctacgccgctgagctttcccaggagctgggcctcaggcccgagcaggtggaccggaccctcgcgctgcaagaggacggagccacagtccctttcatcgcgcgctaccgcaaggaagtcacgggcggcctggacgaggtccagattcaaaccctcttcgaccgggccaccgagcgcgccgagctggactcccggcgcgacaccatcctccgctccatcgaggagcaggggaagctgacgccggagctcgcgaaggcgctcaaggccgccagggcgcgcacggagctggaggacctctaccttccttacaagcccaagcgccgcacgcgcgccgccattgcccgggagcgcgggctggagccgctggcggacctggtgtggaagcaggacggtcgtcgcggcgaggacgtggccgcgcgcgtgcgcccctacgtcaacccggagaaggacgtaccggaccaggccgcggcgctcgcgggcgcgcgcgacatctgcgccgagcgcgtggccgaggacgccggcctgcgccgcgaggcccgcgaggtgagcgcgcgccggggcacgctgtgttcgaacgtggtgcccgcgaagaagggcgagacgaccaagttcgagaactactatggccacgaggagcccctgtcccaggccccctcgcaccgcgtgctggcactgctgcgcggcgaggaagagggcgtgctgaaggtgaagctctccctgcccgatgacgaggtgaagggcctgctggccgggcgcgtggtgacgaagccgcagtccatcttctcacaggagctgcgcgccgccgtggaggacagctgggaccggctgatggggccgtcgctggagccgtagctgcgctcgtaggggaaggagtgcgc

SEQ ID NO: 1156 - DNA, 16387 bp, Myxococcus xanthus
ggagcgcaggcgccacgatgacggctaaccactgtcggtttgcgtgcctaatagcttctccgccgggctgttcatcatcaccattccgcccgccgggtcggacaggatgagggggtccggcacggagtccagcacgcggtccagccggtgacgctcgctgcgggcctcccgctccgtgtcgcgcaggcgccggtagctctcacccagcgcctgggtggcgcggcccaggtccgtcacgttgcgcatcacgctcaccagtgactcgcggccatccggctggagcacgggtgtgctgacgacctcgaagagcaggtcgattccctccaccgggtccaccagcgggacttcccggcggcgcacggtggacgtgtcaccgctggcgaagctggccagcgcggaggagaacacctgccggttgagctccgtcgcccggcggcggccttcgctcgcatccggtccggccaccagcaatacctccgcgcgggcgttggcgatgtggggccgtccctccaggtccgtcagcagcacggggtccgccacggtgtcgatgatgcgacggagcagctctccgcccgccacctcacggtcctccgtgggcagcatggcggccagccgggggccgacgtgcgcgctcacccaggctgcgtccggcgtcagcgtggggccgtccgcggacagcagcaacaggcccgcggcgggcgctccaggacggcccaggggtaccgcgatgcaccccacggctgggagtggggcgcagggggcggcgaagaagcgaggcgccccctgcgtcagcgtctccgccaggggatgggaggtctcaccgggctggaacgccagggcgtcacgctgggcctcggagaggttccgggccgcgaggcagacccacctttccgtgccgctgtcgcgcgcgaggcaggccgcgacgtccgacggccgctcgcgggtgagccacgccaccacgtgctgcgcgcacagacgtggctcgtcgcaggcgagcaggtgctcggccagggcgagccgtgcttcgacgtctggctcgggggttggggtgggcagtgcggtgggggggaccactgcgtcaggctccacgggattgaggggtaggcgttcgcacctccacgaacttcaccacgatggtgcgtgtggatgcgggtggccagtcctggagcgcctgcccgtggacgttcgcgtcccagcgcagaccgcggtccagcacccggtccaggacgtcgacgaggctggcgcttccagccaatctttccacgggcatcgtcgaagctcctcggctcctgggaccgggtttttgtaacgcgcgtcggtgagccaccccagagcaggcttgcccgcaccgtgatttgcgaacacgagaaggccggcagtgttcgctcgtgtacatctgcaacgccttggagctgggtaggcggccagccgtgcggtccgctcccgtggcttatcgctccgaggcgccgttcctagccttgggccatggacgacgagcagcgggcgcacaggtcgctttggacggtgacggcccccccgcgggacttcccggcgctgccgggtgacgtgacggtggacgtggccatcattggcggggggatggcggggctgaccacggcgtggctcctgaagcgcgctggcaagcgcgtggtggtgctggacatgcaccgcatcctgtcggggcagacgggccagacgaccgcgcacctcaccgaggtgctcgacacgccctacgccacgctgcggcgcgacttcggtgagaagggggctcagctcgcggcgtcctccagccgcgcggccatcgagcagatcgccgcgcgggtcgacgagctcggcatcgactgtgacttccagcgcgtgcccatgtaccgctacgcggagacggagcgcgagctggccgagctgcaccacgaagtcaccgccgcgcgcgaggccggcttgctggccaccttcacccaggacgtgcccttgccgtatcccgtgaagggcgccctgcgggtggaggaccaggcgctcttccatcctcgcaagtacctgctggcgctggcggaccggattcccggcgacggcagccacatcttcgagaacacgcgggtgacggaggttcacgacggcgcgccctgccgcgtcgttaccgaccggggcaccgtcaccgccgcggccgtggtggaggccaccaccacgccgctcaaccgcgtggccatgcacaccaagctctacccctaccgcacctacgtggtggcagggccgctcaacgggccgctggagccgggccagtactgcgacagccaggagccctatcactacatccgcacgcagcaggtgaacgggcgcacctacgtcatcgtgggcggcgaggaccacaaggtcggcaccgacgaggacaccgcccggcgctacgccgcgctggaggcctacacgctgcggcgcttcccggtgacggacatcacccaccgctggtccggccaggtcatcgagcccgcggacgggctggcgtacatcggccgcaacacggccagccgccacgtgtacgtggccaccggcttctccggcacgggcatgacgttcggcacgctggcggggatgattctctccgacgccatcctcgacaggcagaaccccttcgcggcgctctactcggcgacgcgggtgaagccccaggcgggcgcgaaggacttcatccaggagaacgcggaggtcgccttccgcttcgtcgcggatcgcctgtcccggccgaacgagcaccggctggcggacgtggcgcccggcgagggcaaggtcctggaggtggcgggacagaaggtcgcggtgtaccgcgcggaggacggcatcacgcacgcggtgtccccggtgtgtacgcacctgggctgccacgtgcactggaacggcgcggagcgctcctgggactgtccctgtcacggggggcgcttcagtcccaccggcaaggtgctcaacggccccgccgtgaaggacctgccggcgaagaagctgccgacctgagccacacgtcttcacgcctcaacacgacacccatcatccacaagggagagggcgaccatggacgctatcgaactgttggcgcagcaacacgacgaggtgaagaagctgttcaagaagtacgagaagctctcggagggggcggaggcgaaacgccaggagctcttcgagatgattaccgaccgcttgagcgcgcacgcctccatcgaggagcaatacttctatcccgcggccaaggcgcaggacacggaggacctcttgcgcgaggccgccgaggaacacctgtccgccaagcgcctcatcgccgacctgctggacctggagccgtcggacgaggagttcgacgcgaagatgcaggtgctccaggagcagattgagcaccacgtcgaagaggaagagggcgagctgttcaagaaggtccgcaagctcctgtccaaggagcagctcgtggacctgggtgtccagatgcagcaggagttcgaggagctcatggagggcgagcctcgcacccaggtgccggccgagacggagcacgccgcgccgatttgagcggcggcggcttgtcgcaagaatcgggttgcgtgaagggggctgggcggcggcatcatggtcgccgcccatgccgcgtcctcctcccgacgtcattcgataccccagctactacacgccctcggtccgccgtgccctgtcgcgcgcggacccgacgctgggcgcgttgatgaagagcgttggccccttccggctccaggtgcgtccgctgcacagccccttcggtgcgctggcggagtccatcgtctaccagcagctccacggcaaggcggccgccaccatcttcggtcgcgtgtgcgagcgcgtgggctcgggacgcaagttcacgccggaagcgctgctggccgttccggacacgtcgctgcgcgaagcgggactgtccgccaacaagctggccgcgctccaggacctggcgcgcaagacgctggacggcaccgtgcctccgctggccaaggtgcggcgcatggatgacgccgagctcatcgagcacttcacccaggtgcgtggcattggccagtggacggtggagatgctgctcatgttccaactcgagcggcctgacgtgctgcccgtggacgactacggcgtgcgcaagggcttcatgaaggcctatggcctgacggagatgcccaagcccaaggcgctgcttgcttatggcgaacgctggcggccctggcgctcggtggccagttggtacatgtggcgctcggcggagctccccgacgcgccgaccgtggagggctgacggcgtttctgggctgtggcctcaggcggtgttgagcgtggtgctcggggcgtgcttctggcgccgcatgggcaccagcagcaccaggaaggccacggacaggacggtgcccagcaggaagacgggcgcgtagcccaggctgagtccgtgcttcgcgtccgcgagccagcccgcgagcgggcccgcgggcgccttgccccagacctccatgctggcgagcagcgtgtagtgcgtggcgccgatgcggcggtccacgcgcgacatcatgaaggcgaacatcaccgtggtgagtgcgccgccgaagagctcctcggccatggtgatgccgatgacgcccgcgtcggtgacgcctccggtggccagcagccaccgccccaccaggggaatcacccgcagcgacgcggtgagccccacggcgcccagcagcggcatgcgcgaggccagcagtcctccggctagtgagccgacaatggacgcgcccgtgccccacgttcccacccacaggccaatctgcgcggcggtgaagcccgcgtcgacgaggaacggcttgaagagcacgtcggacatgctctcgcccagcttgtacgtggtgatgaagagcagcagccagcccgcgcccggcagcaggagcgccttcttgagccgctggaacagctcgcgccaatccggctcctgccgggcggtggccgcggacggcgtggcgtgcgcctcggggggagactcccgggcgaagagcatcaccatgaagacggccagacacagcagcgccatggcgacgaagaggccggaccagccgatgcgcgcgctggcccacaccagcagcccgccgcccgtcagcattcccagcttgtagcccaccacctgcgcggtgttgcccaggcccagctcactggggcgcagggtgtccacggcgaagccatccaccgcgatgtcctgcgtggcggcgaacaggttcatcaggaagacgagcgccagcagggcggggagcgcgtctcgtgaagccgcgaccgccgccgcggcgcaactggccgcgagccccacctgcatcggcagaatccacgacttgcgccggccgatgcgcgtcgagccataccggtccaccaggggcgcccagagcgccttgagggcccagggcaaccacagcgcgccgagcagtccaatggtggtcagcgagacgccctgcgagcgcaggtacaccggcagggcggtggcctggaagccgaagggcaggccctgcacgaagtagagcatgcacagcagggcgagccgggacgacgggagtctcattgacacccagcatagagccaccgggtcgggaacgaggaagtgtccgctcgccactccggatgtggggccctgtccacggcaatgcactggggccctgcgtctcatggacggggaggggacggtctctaggctcatcctccccacggccgggtcgcggcctcatcttgcgccggacggcggaggctgccgcggcgcgtggagcacgtcaccatgcaggagcagcaagcaggagtcgaagtcgtgaagcgtggtgagtccgcgccgtcgccgtcgttgcgcgtgctggatgtgatggccctgacagtgggcatcgtcctgggagcaggcatcttcaaggcgccctcgctggtggccgcgcagtccggcagcggtgaggccatgctgctcacgtggctgctgggcggtgtcgcgtcgctggtgggcgcgctgtgttacgcggagctggccagcgcctggccacacccgggcggggactaccactacctgtaccgcgcgctgggcaaggggcccgctttccttttcgcgtgggcgcggctgaccgtcatccccaccggctccatcgcactgctggccttcgtcttcggggactacgccacgcagctcttccccctgggcctgtattcgtcgcccgtctatgcggccatgctggtggtggggctgacggcggtgaacatcgccggacttcggcaggggacccgtacgcagaacctgctcacggccctggaggttctgggcgtgggggctgtcgtcatcgtggggttgcttttcacgcccgcgctggtgcccgcggcggcgccgccggcaccggccgcgtcgtcagggaccgcctggggcctggccatggtgttcgtgctgctgacgtacggcggctggaatgaggtggcgtacctgtcctcggaggtgcggggttcgcggcgcaccatcgcctggtcgctgttggcgagcatcgggctggtgacggcgctgtacctgctggtcaacgtggcctacctgcgcggcctggggctcgaaggcatggcgcgttcggaggcggtggccgcggacctgatgcagcgcgcggtgggcagcgggggcgcgctggtgttgagcgtcatcatcgccatctccgcgctgacgtccgccaacgccacggtgctgacgggggctcggacccactatgccttcgggcgggacagcgtgctgttcaatgggctggggcagtggcatgcgaagtccaatggcccgtcccgcgcgctgctggtgcagggggccatctccctggcgctggtggggctggggacgctgacgcgtcagggcttcgagacgatggtggagtacaccgcgcccgtcttctggctcttcttcctgctgacgggcgtgtcgctgatggtgctgcgcgtgcgtgagccggatgcgccgcggccgttccgcgtgccgctgtatccgctcacgccgctgctcttcatcggcatctgcgcctacgtcctctattccagcctggccttcaccgggctgggcgcgctcgcggggctggcagtgctgggcacgggcggcgtgctgctcgccgtggaggcggtgcgcacccgcaggggctcgcaggggacctcccccaaggccagttcctctcccagactgcaacgaacgaaggaggcgacatgaagcgaatgatggtggttttcgcgttcacggcggcgatggccgcgaacgccgcgagcgtttcgacggcgcagcagacggtgacggtgcaggtccgcggacccgcgggcagttcgattcagtcgcccgaggttcccttcgtccccacgccggaaggtgccgtggacgggatgctggcattggctggcgtgaagcccggggacactgtctatgatttgggcagcggtgacggccgcatcgtcatctccgcggtccagaagcacggggcgaagcacgccgtgggcgtggacatcaacccggagcgcatcgccgaggccaaccagaacgcgagccaggcgggcgtgaagaacaaggtggagttccgccagggggacctcttcgacgcggacatccgtgacgcgtcggtggtgacgctctacctgttgccctccgtcaacgagcggctcaagtccaagctgctctcggagctgaagccaggcacgcgcatcgtgtcgcacagcttcgacatgggtgactgggcgccgaccaagacggtgcagagcgagggacggacgctctacctctgggtcgtccccgagcgcggcacgggcggcgcgccccgctgagtgcggctcgaggcgtccggggccggccacctcgcatggaggggccgggccatttcacgtcagggcgccggaggcggctgacccggcgtgcgcgagtagtggagcaccatggcctccagccgcgacagggccttctccagcgtctccatggacgggccgaaggacaggcgcacgtagccgcggaagcgggagggtcgcgcgcggcgcttgccgggattcacgtcgaagaactcgcccggaacggcgatgattttctggtccagcgcggcgcggaagaagcccatgccgtcgttgagcggcggcggcagcccggacacgttgccccagacatagaaggtgccgtccggcgcgcggtccgtgcggatgccgatgcgctccagccgggagtggaagcggtcccgcttctcccggaaggtgttgtggatggccatcgtctccgccaccacgggctcctcctggaggagctgaatcgccgcgcgctggagcggccggctccctccgccatccaggaagctccccgcgctggcgaccgcatcgatgacctggcgcggccccacggtccacgtcatgcgccagcccgggtagcgccagttcttggtgaagccgtcgaacaagaccaccgggtccttgttcacgtcctccacgtagcgggcggcgctctccaccggcaggtgtccggggcggcccgtccagatgtagtgcgaatagaactcgtcgaccagcagcgcgcactcatgctcgcgggccacgctcacccagcgcgccatctcctcgccgtgcacgagcttgccggtggggttgcaggggttggagaagagcagggcggacagaccccggccctgcacctcgcgccgcaagtcctccgcggtgaaggcgtagccgcgctcaccctccaggaggatggggatggcggtgaacgccttgaagacgtccaacagctcctcatacgccgtgtagtccggcaggaagtggcccaggttgatggcgcccaggctggccgcggcgcgggtgagcgccgcgcggccgccgccagacaggcacacgttctccgcgctgtactggctgggcatgccccggcggtagagccggttgtagaggcttgcgatggactcgcgcacctcccagagcccggcgacgggggcgtactccatgtcggccacgtcgatggtgacctggttcagccggggcggcgcgccggggaggtctcccgtctccggctggccctggcccaggttgcaccactccgggttgctggagcggtagccgcggcgggtggcctcggcggtgacgaagatgacgccggtgcggggcacggcgcggaatgccggaagggggacgtcgtcgctcacggcatcacaccctagcggaagtccgccccgtgcgcgctgccgccgcgcgcccgctcagcggacgatgggcaccgtcaccggctccaggtcgtcgaccgtcacctcggccttgcccaggcgccacaggacgggctggaagcgggcttccacgcgccgcccgtccgccgtctccagcaccgcggtaccttccttcggcaggtattcacccacctcgtagtgcagccccgtcagcgtgaggcggtcggtgccctgagggcccgtcagctcgcctggaccgtccagcaccagcgacgtgccaccaaacacgggcatgccggctcgcatgcccacgcggccatcgacgcggaacgtgtggccctcccgtccagggacgccgccctgcacatccgcccacaggcgcgtctcgtcgccgcacgtgccgtagcccacctccgcctggagcgggtgtccgtccactgtcagtccgcgcaggtccgcctccacttccatgaggtcctcgccgccgcggtagaggaacgccgcctgaccggcgaagcgcaggccgtgcacgtcacagccgccttcatcgaaggtgagcaccacgcggtccgtcacgctgtcatggggctccaccgcggcgtgggcgcaggcccaccgcccgcgcacgccatgcgcggcggtgctgaggaaggcgcgacggggctcaccgcaggtgtacaccggcagcacgcccagggcttccagcgcgccgcgcacctgatgcgaggccgccaccacgcgctccacgcgctgacgggccgcgtccacttcttcctgcgtgggggctccgccgccacaggcggtgacgaggacggtgagggcaagacaggtgatgcgtcgcatgggcgcttctccaggggtgcacgacaccgcggcttcgcggcgggtcatgcccccgtggagagcaaccatcatgcccggtgcaacctcgcgagaacacgaggctcggccggaacagggcctgggatgtgcgtgcagcgggttgcacagccccggcgggcccgtccgggtgaggcggctcagccttcgagcgaagcgcgcaggaaccacgcgtgcttctcgaactcggtgatgatgtccgtggtgaggccctcggagtccgagtccccgttctcgacgaagagggcgcggctcttccgcaggccgtccaggtagacttcgatgcgctcggccaggagcttcacgtgctccatgtcacgcgtcgtctcctgcggatactccggcaggcggctcgtcttgcccacgtggcggctggtgccgtaggccttgccaccgagcgtcaccgcgcgctcggcgatggagtcgttgtgcgtggccaggctcaccgcgaacgtctcgaacagcgggtggagcgaggcgaactgcggacccttgatgttccagtgcgcgaccttgatttgcgagtgcaggtcgagcccgtcggcgagccgctcgttgagcgattcagcgatggcggcgcgggccttctcgggaagggggctggggctgcggtacatggtgtcttcctttcgaatgtgtgtttgtcggtgtcggctggttggatgcgcggcggccaaaaagggagcgccccccggtgtttccaccggagggcgcttgaaacttccgcgatgcctcgcgacagaggggcttaagactccagccccaccgccgccgcgtggatgaccgacgcgatgcgaaccgcgtcgtgcacctggtcctcggagaggccgccgtcgaggacgaccttctcgtgggactgcatgcacatctcgcagccgttgatggcgctgacggcgaggcagaccagctcgaagtccaccttgttcgtcagcacctgcgcgagccggttcatccgcagcccggcacgcttggtcgagtaggactccttcccgatcatgtgcctgaagcggtagtacacattgttcatcgccatcaacgacgccgccgcacgcgcgtcctcgatgacaggctcgggattcgcgagggccttcttcgcctcgttgagcatggcctccttcagccgctcattccgagcggcgaaggcgcatgccacggccacaccccaacgctgctccgcggtgaggctgccaccttccaggacaccctggaggttgaggcgggtgtccttgtgggagtccgcgagttcagagcggacgacttcgagcgaggccatggtggattaccccgccttcgacagcttctgggtcagggtctcctcacccttggtccagttgcaggggcacagctcgtccgtctggagcgcgtccagcgtgcgaatcgtctcggagacgttgcggcccacggacaggtcgttgaccgtcacgtggcggatgatgccctcggggtccgcgatgaacgtcgcgcggagggccacgccctcttccttgtggaggatgcccagcgcgttgcacagctcgtgcttgatgtccgccagcatcgggaagggcaggttcttcaggtccgggtggtgcgtgcgccacgcgtggtgcacgaactcgctgtcggtgctcaggccgaggacctgcgcgtcacggtcagtgaagtccttgttcttcttgccgaactccgcgatctccgtggggcagatgaaggtgaagtccttcggccacgcgaacaggaccagccacttgcccttgaaggtctcgttcgtgatgtcctggaactccttgcccttctccagggacacggtggccttcaccttgaagttcgggatcttgtcgccaacggtcagcattacggctccttgggatgggggcccggcggtgagccgaccccagtgaacgtgttctgtcctaccgcttagcagtcaccgtgccagaacctcgaatcaatgattccaggggtttggatttcacccccactgggtcggtgccgctgggccggtgtctaacgaaatctcggtgcgtttcgccactgcaatttcggtggatcgacgaaccggggggagactggccgctcatggtcctcacgagcgggcggaaaatacgagaagtgccgcgtggttgcacccactccgggcaggcaacggctcgaatgtgcggccgcgaacgcgtgctccgttcacctacaaggcggcccctccccgaatgttcaaaagaatctctttgtgttccggaggttgcgacggatcttccggcctggagtggttgcctggacggtggggcacgaaatctcggtgcctgcctcactgcaatttcggtggaaccctattatttcgtaggtatgcaggacgacttttcaggcgccatcgacggtgcgaaggacgctcgggacctcctcgagctggcaacggcggaggattccgtcggggatttgctgcgccgtgggctcgactggctgacgcgggtggtgcgcttcgacctggccacggtgttcctcctgaaggagggccggctggtggcggtggccgcacgagggtcgttggccaacgcgaaggtgcggcagcactcgttgccgttgtcggagttcccctcgctgcggcaggccctggagacgcggcgggcgaaggccttcacggaagaggaccatgcccacggggatggagaccctttcgacggcgtgttggatttgccgccggggcattcgtgcatggtggtgccgctgtgcgcgggtgatcgctgctacggcgtgctctccctggaccgcgccgagtgtgagacgtacccccagccggtggtggacctggtggaggtgtacgggcagatgctggccacggccatccagtcggccgagcagcgcgccaccttcgagcgtctccaccgtcaggaccacgagcacgcgaagctgctggaggcgcagctcggcggagactcggagggcatcctcgagacgtcgaagagcccggtgatgcgagacctggcgcggcgggcgcggcaggtggcggagacggacacgccagtgctgattaccggtgagacgggcacgggcaaggagcggctggcccgcgccatccaccgttggagcgcccgcgcggaccagcccttcgtcacgctcaactgcgctgccattccggcgggcttgctggagagcgagctgtttggccacgtgaagggcgccttcaccggcgccacgaaggaccgggccggacgcttccagatggcgcatggcggcacgctgctgctggatgaagtgggcgagctgcccttcgacctccaggcgaagctgctgcgggcgctgcaggagaagacattcgagccggtgggcagcgacaagacggtgcgcgcggacgtgcgcatcctcgcggccacgcacgtggaccttcagcaagccattgcccagaagcgcttccgcgaggacctctactaccggttgagcgtgttccccctgcgcctgccgccgctgcgcgagcgccgggaggacctgccgcagttgtgcgccttcctcctggaggaacaggcgaaccggacgggacggcggggcatgcgggtgacgccagagggcctggtgcggttggaggcctacgagtggccgggcaacctgcgcgagctggccaatgcgctggagcgggccaccatcctcacgcgagggacggagctggggccggagtccttcgacgttcccacgcgcggcgcggccgtggtggcggccctgccggaggagccggcgcccgcggcgggagggccgaagcggggccccgtgctgacgctggcggccgtgcagcgcgagcacatcatgcgagtgctcacgctcacgcggggccgcgtctacggcgccaatggggccgcggcgctgctggggctcaagccgtccacgctccagagccggatgaagaagctgggcatcgcccggctggagcagttcgttgtcgacgaggcgtgagccttgaaaccgcgcgcctaggagacgcgcggtgccgagggcgccaccgggtaggttccccgctgaccgaacggcgggtcgaacagcgccgggtccgactgccgcgagcggaagaggtcgacgatgtagttcatccgctggtccagcttgctccagtccttcgccccggagcccttgaggctgtcctggctcttgtcgagctggcccagcagcgcgcgcagctcggggttttcgatggagcgcaggtgcggcgggaagagcgtcgactccatgcccggaggcggcggcaaatcattgcccagcttcagcgcgctgcccggcacggccagcttcatcatgtgctcggtggcgacgcggcggaacacgttcgccacgccatccaccacggggttcagcgccgcgtccaccaggcccgtcttcaaggccgccttgcccgcgaggttggcggggaaggggagcgcattgatttgcgcctcgacggtctgcttgaggatgtcgcggaaggtgtccttcaccggcgagttgagcgccttctcgacgtagggctggagttgcgtctgctcgtgcaggcccaccttgtcgttggccaggagcatcagctcggccttcttgttcgggtccttctcgaacatggcctgggcgtagtggccgaaggcctccttcagcagcggcttgtccgcggggaagccactcaggtactgctccgccttggcggcgtcatactgggtgtcgccctggaaggtctccacgaagcgggcgaactcctggcccacctcctcgaacaccagcttgttgccgtcggcgatggccttgctgacgttctggagcgcctgattgcccgccgaggcgatgtcgcccagcggcagcgaagggaggcccagcttgcgcagcaggtcgtccaccttggacatcggccccatgacgccgtcggcgcccttgagcgcgtccgtgaagaacttgggcatgtcctcgccgcggatgctcacgccggcttgcttcgaggcccaggtcgcgaaggtggaccagttggcgttctccgtgcccagcaactgacccatggcgttggacaggtccgaatagccctgggtaatcgcatggttgcgcgccaccgggtcctgcatggcggcgatgttccgcacgtccgcggcggtgggatagctgcccggcgcgacgctcgggccgcgcgccagggccgcgggggcgttcagcgccacgggctgttgccgggcgggcggggactcgaactgggacaccccggacatgccgggccgggtcacctgggccttggcctggggtttgacctcgttgcgagcggggcggggcggctcgcggagctcggtgggacgggcgggggcgcggaaaccgatttttgggggactcatcttctccagtatcggttgaaaccggaaaaagttgcgtcccctggatgctggaactcaggggggcggggtcggccttccaccgacaccgaagtgctccgcgtggtgccgccacgcttcccgtgcctcttccaggctcacttcctggaaccggacagcggctcctggacggcgggcgcacagccgtccccaatcggcgcgaatgactgtcgcgatgagtggatagccacctgtcgtcggatggtcggggcccagcacgatgggcgttcctgaaagcgtcacctggatggccccacgaaccatggggcgcgacgtgcccgtgccttcgtcgccatgggtgagcgatggcccttggagccgcatccccacacggtcggtggcggcggacacggtgaaggcgcccgacagcagggtggccacggttgcgggtccgaagcggcggttgtccggtccgagcgtcacgcggatgggcgccgctgcatccagtgacgcaccgggcgctcgtgcctcggcgcgctcgttcgtgtcacccaggggcaggctgtctcccgaacgcagcaggcggccttcgtgtccgcccaggcgcgcgaccagcagtgtgccgcgtcctcccagcacttccggcacggcgagcccgccgtccaccgcgacatagcgcacgctcgtcgactcgggcgcggggacggtgaggcgctctccatccgccagcgcgaaggcgtgtccgcccatggacacgcgaacgcttcggcctcgggcgcgcagctccaaccgaccgaaggcttccagcgccgccgttccactcgcgttgcccacggcgagattggccagggcgagcagctccgggaccagcggtcctcccggaggcacgccgtggtgcatcttccccggccgtcccgcgtcctgcaccgtgacgggcgcacccacgcccgtgatgtccagccagcccgtcatcggtccacccgcttgaagcgcacccggtccccgagctgaagcaccgagccctcctcgggtgtgaaggcggtgaag

SEQ ID NO: 1157 - DNA, 18537 bp, Myxococcus xanthus
gtcgtcacctggcgcgacgatgaaatcgtctacgagatggtgacggacatggacgaaagcgacatccgccggatgctcgccgagcgtgacagcggtgagaagctcgcgcgcaagtccgcgccggaggccgacgagccgctgtattcgctcccgcccgcgccgcgcacgccgcactcctggccgcccatctccgtcgagccagtgacgtacccgacgtaccctcagtgacggaaacgtcggctgtgtgacggcgcttgcccgctccccgggcagccggaattccgcccggtccgaacattgacgctcccgcacatggccgatagcctcgacgcacatcatcaccttgcgcgtcgcggccggtagggcgtttgtgcgcgccgcacaccaggacgggccgtccctccatgtcgaagaaaatcctgatcgtcgaaagcgacaccgcgctctccgccaccctgcgctcggccctggagggccggggcttcacggtcgacgagacgaccgacggcaagggcagcgtggagcagatccgcagggaccggccagacctcgtggtgctcgcggtggacctctccgcgggacagaacggctacctcatctgcggcaagctgaagaaggacgatgacctcaagaacgtccccatcgtcatcatcggcaacccggacggcttcgcgcagcaccgcaagctgaaggcccacgccgacgagtacgtcgccaagccggtggacgcggatcaactggtggagcgcgcgggtgcgctgatcggctttcccgagctgcccgccaccgaggatgtcgtcgacgagagcctcacgctggacgcgctcggcgacgagccgatgacggcggacttcggcgaggagatctccgtggagaccgcggaggagccttccgttacgggcgaggagctggacctggacgccgccttcggcgacctgtccgcgcccgaggagacgccgtccttcgaggaagaagtcgtcgtcgcgccgcccgaagcggtggtggaaggcgtggaggaggacttctccacgctcgactcgctgggcaccgactcggtggatccgctcgaggggctggatgacgcctccgacgagaagacggtgatcggcttcattgctccggcccccgtcgccgcgcctccgcccgagccgccccgcgccgtcgcgccgcccccggtgccccgtccctccgcgccggcccgccctgccccgccgcccgtcgcggtggcgcccgcggccgacgccgcggagctgcgcagcctgcgcgcgaaggtggccgaactgcaggccgagctcgacgactcgcgtggcgcggcgtcccacgccgaggagcgcgtgcgtgacctggaggcgcagttggagagccaggccacggagctggagacggcccgggcgtcctcggggaagaacgacaaggacaccttcgccctccgcgacgcggccaacaagaaggacaaggagatcctccgcctcaagacggagctgaatcaaaaggaccaggaaatcatcgagctcaaggacgagagcctggagctggagcagaaggccagcaccgccgagtccgagctcgcccagcgcgacgcccagctcaagacgctgagcgcccgggcggagtcgctcgccacggaccgcaggcgcgtggaccagcagttggccgccgccaaggaagaggcccggggcgcgtccgcgcagctcaccgcgctgcagacggagctggaccagcaccaggcccaggcgcatgcctacgccgcggagctggaggagctgcgcgctcgcgcggggcagctggaggcggacgtccaggccgcgcagcatgaggccgaggacctgcgcgtccaggtgggccaggcccaggtggagctgtccgagcagagcagccgcgccagcgcggaggccgacgaactgcgcggccgcatcgccgagctggaggccgccacggcccgcaacgaggagcgcgtgacgcgcctctacgcgcgcatcaagagcgaggagaagctgcgcgagaagacgaagaaggcgctcgtcatcgcgcagcagctcctggacgagcccgcgtcctcggtggcggacgacgccagcgaagccgcggcctagtcgcacgggccgcgctccccgggccacccgtgcccggggcactgccagcccctacccctgcttcttcggggccgtcttcttctcgtgcagcttcttcgcgaaaccctgcacggccgcgggcacgttcttgtcgcggctgaggtccttcagctcggcgtcgcggaacgagttgaggaacttcatggtgacggtgagcgggaccttggggttcttcaccagcgccatcttcaccttgtggttcttcgtccactcgcggttgctgtagatgacgcgcagcacgtcatccatcatcgcgcggttggcggcgcacgaaagcacctcaccgtcggtgatgcgcgggctgcggatgacggccaccgccaccagcttgttcgtctcgcggatgagcgcggtgcgggcttccttgttgcccagcgtggccagcttgatcttctccgcgatggacatgcgcatgacacgctgggccagcgtcaggcgcttgccctcctccatgggcgcggcggactcgtccgcggcctcctggaactcctggagcacctcctccgcggtggggccctgcggcgggggcgcctccgcggcctcggggccgaagacgcgcacgcgcgcggccttcatctgcggcacgtccatcagcgtcagcccgctgcgcaccgcgaagtcgcagacgttgtcgacgagcgacaccggcgcgctcgcgttggcgcagaggttgcggaggatgtcctcgtggcgcagcagacggagctggttctgcccgatgatctccgccagcttcgggctgcagtccttcgccacgtccgccaccgcatcgtccggcgtgctggcgttgaggaccagcatctccgcgtaggcctcgttgcccttcacgagccccaggaggaagccgagcacctgcggctgtacctcttcgtcacgcagcgcggagcccagaatcctgtccggcagccccgcggccgtcttcgcggccgtctcgcgcacgttcgcgtccgggtcgaacgtgagcatgtagagcgcgcccaccatgtcggaggggctgagcggaacgagcgacttcgccgccatcatccgcagcggcaccggcgccgcggggtccacgtgcttgcgcaggttgggcggcaggaactccgcatcgaagggacagcccggaggcggcgccgggacggcgttgggagcggcagtggtcatgacgcgtgattccttccgtagatgatgcgcaggccctcgagcgtgaggaactcatccacctggtggatggccttggactcgctggccaccagcgacgcgagccctccggtggcgacgaccttcaccggaaagcccagttcggcctgcatgcgggcgcagatgccgtccaccatgcccacgtagccgtagacgagcccggcctgcatggagtgcacggtgttgcgcccgatgacatgcggcggccgcgcgaactccacgcgcggcaacttggaggcattctggaacagcgcctccatggagatgttgatgccggggcagatgcagccccccaggtactcccccttcggcgacaccgcgtcgaacgtcgtcgcggtgccgaagtccacgaccaacacgccggcgtggtgtctctcgtaggcggacaccgcgttgacgatgcggtccgcgcccacctcccgggggttgtcgtagaggatgggcatgcccgtcttcacgccgggcccgatgaacatgggacggacgcggaagtaccgctcgctcatcttctccaggttggactggagcggcggcaccacgctggagacgacgaccgcggtcaccttcatcgggtcgatgccgcgatgggtgaagagctgccggaccaggatgccgtactcatccgaggtgcggcgcgtgctggtctctacgcgccagtggtcgagcaggcgccggccctcgaacactccgagcacggtattggtgttgccgacgtcgatggccaggagcatgacaccgcgcactctaccgccgtgggcgcagctgctccacgtcgcccgccaacacacgttcgagcgagccctccgccgtccggaccagcagcgccccggatgggtcgatgtcctcggcccgcccccgcagctcgtgccggtcggtgcgcaccagcacgtcctgccccagagtggaggacagcgccttccagcgggcacgcaccgcgtcgaagcccgtgtccaggtagaggtccaaccactcctccagccgcgtccagagcgacgcagcgaagcgagcccggtgtaccggctgccccagggccagcgacaacgacgtggcggtggcccgcagctcctccggaaagtgttcgacctgggagttgagattgacccccacgcccacgatgacgaagtgcacgcgctcgggttcggcggacagctcggtgaggattcccgcgaccttgaggccgtcgatgtggacgtcgttgggccacttgatggcggcctccacgcccgcgtcgcgcagcgactccgccagcgccacggccgccaccaacgtcagctccggcgcgcgctggggcggcaggccgggacggaggatggcggagaagtagagattgaggcccggcggagacacccaagtgcggccccggcgccccttgcccgcggtctgctgctcggccaccacgacctcaccgtgcctggcgccgtcctgggccaggcggaaggccttctcgttggtggaaggcagcgattcgtgatggtggatggtgcggcccaggtcgcgggtgtccagcagcgggcccacctcgagcgaggtgagccggtccggcaccgccaccagccggtagcctcgcgcggacaccgcctcgatgcggtaccccttcgcgcgcagggcctccacgtgcttccacaccgccgtgcgcgacaggcccagcttgctggagagcgcctcaccggaggtgtaatcgcccccgctttccgacaggaagctcaggatgagctcttcctgggtctgctcgttcgcattggcggccacagcggcacctcgtggagagtctccaccgtatcagcccgaaggcggcgccgcgccgtcccgaagctgccaggccgtcagctccagggaggtctgcggcatcagctggccgttggtctccacggccatttcgatgcgcaccatgccgacgccaggcgcgaacgtcatcgtgttcaccagcgtggccttggcgtccacccggttgcggccctccacctggacacagcgcgggaaggtgcccgcgggcgtctcacaggagtctcccgcctggacgatgtggtagcgctccgtggaggacacggacaccacgttcgtccacgagtgcccggtcctcaccggaccgcgcagcaggtagcgcttgggatctctcaagccgtagccgtccagcgagagctgaccgccctggctgtcatggaagacgccggcctcttccttgagaatctccacggtgacttgtttgtcgtcgcggccgttgatccggtaggtccagctgttgcccaccgcgagcgggtagtactcggacacgtcatcggtgctggcgctcgcgcccgcagccgcgtcgacgttcttggaacagcccgtgcccagcaccaaggccgccagcaccgcggccccgcccatgccgaatgaacgcttcatgtcgatgtcagtccgcgcggccggggccacgcgcctccgcaggtgagtgcttacgtgatgcgtagagcgtgtccagcgcctgttgcgcggcggcctggacggcgggcgcatcgtgcccctgcgccatcgtgtagagataggcctccgcctccgggccaccgatttcgcccaccgcgaagacaatctcctgcacgaagcccaggtcacggccacgcgccaggtcgatgagcacgggcacggcgactcgcgccttcatctccacgagcgagcccatcgtcctgcgcaccgtctctgcgtcggtcgcttccttgagccggtcgatgagcagcggcgcggccgccgggtgctgccgttccgccagcgtgcgcaggctgaactcccgcacccgcgagtccgtggccttgaggtccaacaccagcgcttcatcggagcggtccagcgccgtcaactgcatgacggcggactcggtcacctggcgcagcacgttggtcagcgccgtgcgcatggccatctgccgtcccgcgggcgagtcctcctcgacgggcgcctctccgagcccgaccagttcgtagcgctggggcagactcccaccgaagcgctccaggaccaggttggcacccacttcggcgaagctgcgcggatcaccgtccttcagcacttcgcgggtgaagggcacgtccagcgtcatgcgccagggccgctcctcacgaggcgcctccgcgcctttctgctcgaaacggccggagtctttcagggcggcggtgaagagcgtggccacgccctcgggatccaggcccagcagggcgttgtcccgcagggtggccccagagagttccaccggcgccaccgggtagcgcggcgactgccaccggcaggcaccgagcatcaggacgacgcaggaggcgagcaacaggaccggcttcatcgctccccagggtaacacctggagagcgacggcgccgaccaatccctcacctcctggagtgccgcgtcagctatcgcgctccccggacggccccttggggggcacggacgagtcagcgggcggctcaccgtcggtgggagaggaagcaggctcgctgacctgcgcgccctccacgaatccagaagacgtcgtcgtcgcggcaccagggaccacttcgcccgccgagccgtccggcacgcccgcctgcgtctgccccgaagtcagagcagccgatgacgtctcctcggaaggaacagtcccggacacgtctgcctgcgtggcgacgcccacggacgcggatgccgcttcgccggagactgccccggaaccggcaccatcacccgccgaggcaatcgcttcgcccgacacggcacctggggcagcaaccgagccctcgccactgtcagcgcttgcttcgaccgactcggagacgggaggtgcctcgcctgcgccgttggcagcaggagactcgacacccgtcgcaccggctccggcagtcgatacgcctgtggcaccgacagaagtcgcctctccagcgacgtccccagcaaccgtatctccgccagcgcccgcagccgaggctccggcctcgtcagcggcggcaccaacagccacagcaaccaaggcacccgcctcacccgcaaccgaagcgcccgcctcacccgcggcagcggcctctccagaagcccccgcctcaccaggagctccggtggcaccggcctcacccgcgcggctcccacggccgcgacggccccggcgacgacggcggcggcgcttgcggtcaccctgtgccccttcggcaccggcctccgcgggagttccatcgggacgcgcaccacccacgaaagcgctggcggcctcgaggtcctcatcctccccgtcctcgtcgtcgccctcctcatcgtcctcgcggccctgcagaaccggcgcggccggaactggagcggcttcatgcgcatccccggcgggagcagccgaagcctcctccgtggaagcccccgcggtggcctcggcttcacgagcctcacgggcctcgcgcgactcacgctcacggcggcgcttctcacgcggacgctcgcgctccgtcggcgccgcggcctcggtgggctcctcgccctcccgtgcctgcttctcgcgctgacgctcctcgcggcgcttctgggcctcctcggcgtccagcttcgcggcctcgaagaacttctcgtcgacctcgtacagcgcgacctgcgtgacggagacggccgtctccgcttccaggaacttctcgcccagcgcgtcaccgcaccagagcatcaccagcgaaccattggcctgcgcctcggtgcgcgcatcaccgcgcacgtcacccgcgctcaccaacaggcccacctgcgccgagtaatggcccaggtcacgccgcagctcctgcaccgacttgcggtcgatgccaggggtgcccttcagcatgcgcaccgcgtagcgcagctccacgctgccctcgcgcttgcgcgccgtgagcaagggcccttccttggaccgcttggcaaccttcagctcgcggaagcccaggccgtgcatcatcttcacgacggacttctcgaacgtaccgacgtccagctcgcccaggcgcttgcgcagcccacgcgccacggagcggcgcgcgtccttgagcgcggcgcgcagcgtggacaccagcgcggcatccgcaggggcctcgcccgcggcagccggcttgcccagcaccggacggcccgcctccagcggaatgcccagcgcctgcgcgaacgcggcctggagctccagcggcggggcctcgctcggggcgccagcgcgctccagcgacacctcttcgagtccttgttgaaggcgtactgcggccggcggcccgcgtcgatgcgacgctggttgtcctccagcagcgcggtgagcaccgcctccaccgtggtgtcctcggcgcacagctccttgacccgggcgtgctcgatgatctgctcggtgcgcagcccgatgtccgactcgctgagaatctcgaacaccacctcgggcagcggcgggaagcgcttgcggcgaccgccacgctcctcgtcctcgtcgcggcggcgcttgcggtcgctgccacggcccgcgacccgcacgttgtccgtgcgcggctccgggtgacgctccggcggacgcagcggcggcagttcttcttcaggatgcggctccaccacgccggtttgagccagtgcctcgacgtcctcgggaatcgaccagtcaaccagcgcgaaggtatccttcgccgtcacaagtaccttgcgatcccgcgtgcggcgcgccatggctgcgaggcgcgacagcatcgtcacctcaggcgtcttgcccacgtgggagagcaggctctgctggatggacttctcggtaatttcaaggaagtggaggggacgaccttcgctctccaggatgcggagcgcggcctcgtagaatgtcatcgagtattccccaggaattccgaacggttacaaaaatgtaggtccgtataggcggcggatgctagccatcgctaaactggcttgtcaacgaacgcaagatgacccgcatacgcatcggacagcgctggaaacgcgaacccgcggcttccccgctcgattccatcgcactggaattggacggggtggaccttctgtccggggccgtggaggagtctctagcagaagtcgtcccctccctggtgcgctcagttgcggagctcgcgggtggacgtcagaaactggcccaggtctccctgcccgaggcccacctggagctggtgctccgccgcatggggccggaggtggagctgctggtggccaacctctcccgccctgcccggctgatgcgcccgcccgtccgggtggagttggaggaactggtggaggcggtccgggaggcaggcgagcgattcctcgccgacgtcacccgggctgggcccaaggcgctcgccaccaccgtggggcaggccctcaaggagccgctgaaaggcctgaaccggcccgcccgtccacctgacgaggcgccggcccggcccgtcacccggcgcgtggagcccacggaagtcccaggcttcggcttcgaactcagggatgccggagctcccatgagccgtggcgccgcgcgaggaacggccggactgcttgcgcccctgctggcagcgggcgaggtctggctgtcgctgcccggcaagcccgaggcctggcgcgtccccagcccgccgttcctgacggcgctggagctgtcgcgactggcggtggagctggcgcgcgcggtggagctgggcgaaagccgcttcgaactggcccccgcgggcgcgaagccttcgctcctggtcgacctgaagacgggccaggcgaaggcgggacgcaccgggacgcccttcccgctcacgggcaccgtgctcgccgccgccctcttccacctgggcgagtccctggccgcggccttcgcggaagcggaccacgcgctggtggccaacccgtaccgaatggagctggcggagcgctgccgcgagggcctttcgcacctgcgaggccccgtgcagccccccgaggccaagggcgcggcccgcgagaagaaggcccgggccacgggccagggcacgtcacggccgttgaaggtccccggccgcttgcgccggctgcgcttcgcgaagctgtgggagaagcgcggtctgccggacgcggaggaatcgcggctgctgcttggccggcacggaccggtgtactgcgcgccgcacctggcctccgcgttctcccgaaaggacggagaactgctgtggaggcgcgccgcggcgctgggtgtggccgcgtcggcggatggccacgcggtggcggcggacatcgcgcgcgtctacggcttcacgggccggggcggtggcgcgcgctggctgcatgaccacgacggaatcccgctgggcccgctgctgctgcgcaaggacggcctgctgctcaccttgtccgaggaccgcaccgtcgtggccttcgcggaggccacgggccgcgaggtctggcgcctggcgccgccgcgcacccagcgcagctggctggccacccagggacaccgcgcgctggtgggcacggactcgggctacctctatgggctcgacctggaggatggacaggtgcgctaccgcatgcgcgcgcccatgccgttccacgggcccccggtggcctggggccggcgattcctggccatgctgggccgcggctcgcactgggccgtgctgctcgcggacgcgcacaccggcgaatccgtgtggacgtatgagccggacctgtcccacctgtccgcgccgttgcccgtgggctcacgggtgttcatcgccggagagcgcgagcgcgaaggcatgctgctctgcctggacacgaagggccggcgcctctgggagcgcccgctcaacctgggccctggcccctttgcgttggcgtccctcccccgcgcggtcgtggtgacgagcgcctcgggcgccgccacccgggtggccgcatccggcacggtggactggcgcgtgggcgccgcgggcgagccgctcatcagcgcgctccccgcccataccgcgcgcgacatcacgctggtgccgggggagcgcgtccgcgccgtggacccccgcggcgggcaggtgctcgcggaggtccaggccggcgtcgggctcgtcgcgctccaggccgacgtgcgcctcaacctctacttcctggacgacgccggcacgctgtccgcgtaccggctcggctctcacttcacggtggtggagtaacccccgcgaaggcctagttggccgcggccttcgacgggtcgatctcctcctcgggccgctcttcctgggtggcgccctcccaggtctcgccagcgccgagcttccattccgacggcacgtccagcttccacacgtaggtggacgccgcggtgccgcccgacgccgcgctggaggagaggttgatggtcatctccaccttcgccacctcgttcgggagcaggtccaggtcgtaatggcccagcatcatctgcggggggaacgcccggacgaagcgctccgggtggtcaatcttcatggacgggtcggcgccgcgcatctcgcccagcagcttccccttcgcgtccgtgagcttccacaccgtgtcgaacgttgcgctggtaaccatcttcagcaccttgccgtcatccttgagcacgcgctgcgcgccccacaccgccaactgcaggcggatctgcggcttgcccagcaccatcaccacgtcggaggagatgatgtccaggcgcatgcccttgtccgtggccgaccacaccgggcggtaacggccctcgcgcaggctgtcgaacgtcttgcgcgtgtactcgtagaaggccttgcggtccttggcgcggtcatccttcgcgccactctcctcgcgcttctccagctccaggaggtagtcgtcgaacttcgtgttccccttgaaacgcgtcaggtgcgcatccacctgctcgaagtagttcttgaagaagggcttcaactcatcacggtagctggcctcgtccgggttggcgcgcatccagcccacgcgttcgaggtactccgcttgaatccgttgctgatccgcatcccgctgagcctccagcgcgcgaccgctcgcgctgcgatagctcatgacggcggccagcagcacacccgcgacgatgacgatgactccgaagtagcgcttcacgcggcagtctcctgtgcctttgtcccggcagtgatatgaaaaatccccaacgtgatccaggccaccgggacccacctgttcaccacgccccttcccttggaggaaggagagctgctgggcaatccccaggtggcgtgggcggcctatggagaaccatcagacggcaaagcggtggtgttgctgcacgacctcgcgcattcgcacctcgcgttgggcccgcctgaggactcggcataccagccctccggctggggacgcgccctggtggggacgaacctcgcgttggatcccgccattacccccgtcttctctcccgggttgctcggcagccctttcggcagcacgtcgcccgcgacggtgaatcccgcgtcaggtgaacgctgggggctcgagctgccgccgctcacggtgcaggacatggctcgcgccgtgtcggccacgctgcgcgcgcggggactgacgaaggtgcgcgcgctggtgggcgtgggcctgggcgcccatgtggcgctgcgactggcgtcactgttccccgacctggccgagggcgtggtggccatcggcgcggcgcgcgcgctgcccgaaggcgtgcgcgagaagctgggcctgtcctggcaggtgctgcgcgcggacccggactaccgggacggcctctacgcgctggatgcgccgccgcgaaagacgatgcgcaagctgcgcctggacttcctgaagctgctctgcgggcgtgagttcctggcctccgtgtacccggcccccgaagcggcccgcgccgcgctggaggcggaagcggatgccttcgcggacgccttcgacgcggtgtcctgggcgtcgctgtgctcggcgtatgcgggcagcgacgtgtcggacggcttctcgcgaatccgtgcgcgggtgctcctggtgacggggacgtcggatgccatggccccggtgaaccgggtgcgtgacacctaccacctgctgagcgccgcgggcgtgagcgcccgtttcctcgagctgccggggcccggggaccacgcagcactgctccaggacgcggagcggctccatgccccgctgagcgacttcctgcggcggtgctgactagtcccgattcacggcgccagagagcttgccgcgaagcgcgcccaccagcatgccgatggcaatctcgttgttgccgccgtgcgggatgatgatgtccgcgaagtgcttggacggctccacgaagcccatgtgcatgggccgcacgtggcgcaggtactggctcaccacgtggtcgaagtcgcggccacggtccttgatgtcgcgggtgaggcgccggaggatgcgaaggtcgtcgtccgcgtcgacgtagatcttcacgtccatctcatcccggacctccttcatgtggagcaccaggatgccctcgatgaggatgatgtcgccggggtccactttcttcgtctgcggcgtacgcgacgaagtgacgaagtcgtagacgggcttctggatgggctgcccggacttcagcgcttgcaggtgctgaaccagcagctctctgtcgaaggcatccgggtggtcgaagttcacctcacgcctgtccgccagcggaaggtccttcaagtcccggtagtatgaatcctgatcgatgaaggccacgcggcaatcggccaatgcctcgcgtaccttgcgggcaacggtggtcttgccggacgcggtgccgcccgcgattccgacgacgaggggggacgccatgtccgctcaacgactctaaccctgacctccaggccaacggttgggcccacttccagacaattcttcccgctctgcctggcggatcagccctcgcgccctcgccgcctccaacaacccaggggcgacctccgcctcgaccatgggccgcacagcgagcattcccaggaattcccccaaggccgggggcactgacatcacctccggtcctcctgccctgcgccgagcgacgaaggaccagggccccgggcccggccggcgcgccacctggttcagcgaatccaggccggacagctccaacgtgccacacgcccacgcacgggccgtgaggtgccggcgcacggctcgggcggaatggaccagctcggacaggtccacgggaagcgacccgacccgcacgtcctccatcaaccccacctgccccggcgcgggcgcgggcacccgccgcgtgaacagcgacggcagcagcatctccagcgtcagcgccgccgatgccccctcatccggtgactcgcgcaggcggcgcatggcccaggacgcgaaggactgaccgggcgtccgcgccacggagtcgaagagcttccggtactccttcgagccggtgaaggccgccagcccctcccgcgtgcccgcgagcaacaaccgggtgagtggccaatcgcggtccaggacctccgcgaccacggccaggcggaagtcctggtccgccagcgtgcccgcttcgtcctccacggaggccgcgggcgcagcggcgtaaccggcgtcgaacaaggcccagggctggctgtcctccgtgagtggaggcacggccgcgacagccgccgggacgcgccacgtcagcggcgggcgcgctcccgcgggcacccactggcgcaggcggcgcaaggacatccgggcgacctcgggcgggtggccatccccctcgaaggtgacggcgcgcagcgctgggcagcgcggaatcaacgaggccagcaggtcgaacagctcctcgcgcaccggctgcgtgtggtcatccacgtagaagctgcgcggcccccggtgcgtcaccacgcctccggcgatgtgcagctcgatgacctggtcgagcggaaagccgtccagccccgtctgcagcggcaggccggcggagagttgatggctgagcaggtgccccaggtcgagcagcagcggcgccccggtgcgcgcgtgcagcttcgccatgaagtcgagcacatgccactgcccgcgccgcgcgagcaccgcggggttctccagcgcgagcggcacggacaggtgttgctggacatggagcgcgtgggacacgcacgcctccaggcccgcttcgttgaagggcggcgtgaagtagaggtagcccgggaagggctgcccatccacgtgccaccagcccacgtcgttgcccacccaggggctctccaccgcgcgcgcgtgggcgtccaaatccctcaaggcctggacgggctccagcgcggggccccagaggttgaggtggacgggatggaagagcaccgggacgtcctggcgacggcgccacatctccgggaacagcgaggcgtgcgccttcgactcttccaaggagagcggcgcgctgtactccacgtagtcgaagaggcccggtgactcatccagcaagcggtagggctgcggcacgtccgccacgctcagattgctgctcaaccccaggccccgccagggcagcgtccacgtctcggaaaccacatgcgtcatgcgctcaacgtagacgcgccccgcgtccaccgccacccgcgactgccgggcagtggcgcgatgagcgctcccgaggtcgggtatgctcgccgattcccttccccccccaggagccgcgatgcccgccccctcacgcgtcgagatagacgagtccaacgcgcagtttcgtggagcctggaggctgttcgccctgggcagcaagtcgggtgaagtggtggagcgacccgaggtctacatcaccgcctgccacgtcgcctggtcgatgatgaactccgccttcctgcgcgcgcccgtcgaaacggaacaagcgctggcggcctcggcggcctccgcggcgcgctacttctccgccggcaaacatggctggagcttcgtcatctgcgacgactggctggcgccctccgtgcgcgacaacgcgccatccatcctcgcctggtacgggctcaagtccgagatggacgtcaccggcatggtggcggaccggctggcgccctccattcacccacggcatccgttcgccgtgcgtcccgtcacggatacctggggccggcaggccgtggccgacatcaacgccaacgtctacgacgtcccccgccacttcggccgtgaagccttcgacgaggacacgctctacaccccggactgccagggcttcgtggcgtgccgcgacgaagaggccgcggccagcacggtggtgctgcgcgtggatgccgccgcctacgtcgccctggtcgcgacccagccgcaacaccgccggcaaggtgccgccgaggccgtgatgcgacacgcgctggccaaggcccatcaggactggggcaccgagcgcaccgtcctccacgccacgagcgcaggcgagcccgtctacacccgcatgggctaccggccggtgacgcgcttccgcatgtacatggcgccaccacctggccagggctgagccacacgcggtactcggtacgggggagtagaaacagactcacgccatttcgagagagtgactggctttttctaccgagcttgaacgccagccgctccatcgtattgaagaatgccgctcccgcatgaactgcggcccacattcttcgatggcgtggaggttgtggcagactgatccgtgagggggcttgccgcgcgtcttgcatcgcccagccacacggagtccgcacatggccaagtgggatgatctcgtcctggcgattccaccgcacgggggcggcaggcatcaggctcccgccgcggtcgcgctgctggagacactcctcggccttcacgaagcacagctcaccctccttcgcgggttgcgtcgcgacgtccggccgctgcaggaaggtccctttcatgccgggcggctccacctggaggccgtgcgcgcccctcaggccacccgcgacgaacagttggagcggctgaagtccgcgcggagctgcttcacggaagccatgggcaccgagcgcgacaaggcgcggctgtcgttcatcgccctgcacttgggcctctgctggctgctgctgggcacggagcgggatgcgcgggagtggatgcagctggcccaccgcacggccgtggaggccatgaaggacatcctggtggaagcctcgaagcaccagggcctcacccagaaccggtacctggatccagcgctcaccttcttcatgttcttcaccagcacggccacgctgggcgcgggctacctcttctgggaccgggtgctcagcaagcgcacgggcacggtgatgcggcgcgcgctggggcagatgcaggcgctggcggactacgtggacatgctgggcgatgtccgcctccacctgggcgagctcccccatgacgtcgcccgttacgagctgacccacggcgtggacgaacagcagtccgtcgcccgcatcaccatccggaagctcatcaacgaccgggaggccatctacttcaacggccgggagacccggaaggtcacctggaacgaccaggaacgctccgaggtcatcacccgcgagctgatctgacgccgggcgctgtcaccgtcccgtcaaatcctgttttcaggattgccgcgagcgcaacgtcagacctgcccgccatagtagcggcacttccttgatgggggcgaaggtgacggcgcagacgatgctcgtgttcattccagtgattctcctactcgccgcggcggttgcgattccgcggccccgccggcgctcacgccggtagtggtagtcacggccggggttgcgccccggccgtctccctggcccgggcgggtgtagagtgcggcagtcgtcgcaaccctcccctcccgagcagccgtggccgaacgtcccacagtcctggtcgtcgacgatgatcctcacctgagggaaatcgtccgcttcgcgctggagcagggaggcttccgggtggatgaggccgccgatggccgcgccgccctgacgcaggtcgaccgcggcctcccagcgctcatcgtcctggacatcatgatgccggagctggacgggctcgccgtgtgccgtgaggtccggcgcaagcacgagctgcccatcgtcttcctctcctcgcgggatgacgaggtcgaccgcatcctgggcctggagctgggcggcgacgactacctcaccaagcccttcagcccgcgcgagctcgtggcgcgcgtgaaggcggtgctccggcgcgcacggcccgcgccggccccggaggtcgaagcgcccgcggcgcggatgcagtcccgagggccgctgcgcatggatgcggagcgctggcgcgcgtggtggca

SEQ ID NO: 1158 - DNA, 17125 bp, Myxococcus xanthus
accggatctcccccgggctcctcagcgtcgagcgcagggattcgtgacggcgcaccacctcgttcacacaacgggtgagcagggcccggtccagccgcccgaagaactccacgctcacgtggacgttgtaggcagccatgctgctgggatccagctcatgcaggacccacagacgctgctgagggaaggatgcaggagcgggttcgttgctttcgcgccggaccaggacgggcgccgccgcgtgaggctgcgccgactgctgctcttggaggagcaggtcgagaagggcgcgctgcgagggagaaagctgctcgagggcccgagagatgtcagtcatcgaagtcgatatccagaaagtggggggatcgggtgctccagcggggactggagcttccgttcacgcggccttcacgccgcggcgccgaagctcttcggcgagctcctgctcggagacgcgggtgacccggtcgagcagctcgcgatagagggactcttgttgccgcgcctggaggtcggcgattgccttcgccagacccgccacggtgggcgacgtgaagagcagtgccagactcaggtccagctgcagccgtgagcgaaggcgcccgacgacctgcgtggcgagcagcgagtgcccgcccagctcgaagaagtggtcgtgccgcgccacctgttcgacacccaggacctcctgccacagggccgcgatgacacgctccagctcattggcgggaagctcttcgtctccggtgcggaccttgcgagcgaccttgggcagcgcgaccgcccgctggagccacgcagtcagtcgccgtgacacgtcacccgtggccaccaccaccgggccatccaggccgcccgtgacgactcgctggaaggcctcggtggcttcgttctcggtcatggcatacggctcgaggccaggagcgcgcgcatcgctggcgccggccgctcgcggccacgggtcccaggccacgctcatccaaggcgttcctgcgctccggctgcggtgagccgcgaacgcatccacgaagaggttggccgccgtcgaaggcgtgtcgccgaagggcgacagcaccgccgccgacgcggagaacagcatcacgaagtccagcgcccggtcgcgcaggacgtcctccagcacgtacgtgccgcgcaccttggcgcggaaacgggcctccgcgtccgggttcgtcgcggagggcggggtccgttcgggcggagccaggggaaggtccgcgcagtgcagcaccccgtggagcgcgccgaagagctggtccacctcggccaggacttcctgcatccagtgcggcttggagacgtcggcgctcaggacgagcacctctgctccgtgtgactccaattcacgcacgcgccggatgagcaggctggcgtcgtcgtcctcaccctgggtggaaacccaatcgtcccagagacgccggggcggcagcggcgtgcggcccaccagcgccagccgcgcctgcttcgtgcgcgccagatggctggccagcagcaggcccacgcggcccaggccgccggtgatgaggtacacgccgcgctcacgcagaggtcgcgcgggggcggccgtctccgtcagccgaacgggagacagctcctggacccagcggcgtgaaccgcgcaaggccacccggacgtctcgtgcctccgtggcgagctcggcgacgagctgttcggccagggccgcaacgccttctgcgccagggaggatcacatcgacgccgcgcgcggtgatgtgcacgtgttgctgcgacagcacctggcaggggcccaacaggggcgccttctccggcagcgcctccgctcggccgtccgggtcgaacaggtggttggagatgacctccacccggagtgggcgcgcatccttcagtccggcaagggcttgccccaggtgcaccacgctgtagtagcccaacgcttgcgcggcctggaaccgcgtcagtatggactcgcgctcgccctgcggcgtcaggctccacaggtggacgaacacttcaggccggggtgtcaggtcctccagcgcgctcagcagcgcggcgtagtctccaggtgcgctcggagccacggtgaagcgccgctcatcgtcacgggagaacgcggcgcccgcgtgcacggtgacgacgtactgtcccgcctcttccaaccgagagacgagccgcgaggccaacggacctccgtcggtgaacaccacccagcaccggggctgggcgagcgccgagggcgccagcgtggccggaggcgtgcgccgccacgagggcaggtgaaaccagtccgcgatgtcggtcagcttgctggcgcccgcggcctgcgaggccagcagcgcggcggaccggtccagaggagcaacccaatatcgctgcccttcgaaggggtacgtgggaagggggatgcgccggaccgtctccgtcccgtgcacgccgctccagtccacctccacgcccgcgagccacagccgtcccagcgcattcaagaagacggcctcgtccggctggtcatccttgggatggcgcgcggaggagacgatggtgcgcgcgccggcgggctcgccttggagccttgccacggcggtcagcgactgcgcgggccccacctccagcaggacgcgcgtcgagtcctccagcagcacctgcatgccgtcccggaagcgtaccgagtggcgcagatggtccacccagtactgaggccgcgtcacctcgtcccccgtgacgggctggccggtccggctggaaatgtaggggcgctcggggggacggagcgtcagacgggacacgcgctcgtggaagcgcggcaggatgcgctccagcatgcgcgagtgcgccgccgcctccacgtgcagttggcggtgctccacgcctcgagccgtcagctccgccatcaatcgcttcacctccgccagtgggccggagaccacgcactgcgagggcgcattcaccgccgcgaggtccaactcctggcccagcagcggcaccacctccgcctcgggaaggctgatgctcagcatggacccggcgggcagctcatccatgagctggccacgcagcgccaccagggccgccgcatcctccaccgacagcacaccggcgatgcacgccgccgcgtactcgcccaggctgtggccgagcatctgctccggctccacgccacatgacatccacagccgcgcaagggcgtactccgtcaggaagatggcgggcagcgcgagcgcgttgcgggagagccccggcacctcctggaggggctcctggtagagcaccgtgcgcagatccacgcccaggtgcgggcgcaggacgctggcgacctcgtcggcggcctcacggaagacgggctccgtgcggtagaggcccgcgcccatgcccaggtggtgggtgcctcctcccgggaagaggaacgccacggggcggcctcgtgcctcttgcttcagcgtcaccagccgctctggctcctcgcctcgcaacacgcggatggcgtgctcccggtccttcaccacggcgatgcggcggtgctggaaggcctgccgtcccacttgcagcgtgtaggccacgtccttcagcgcctgctccgggtgttgttccaggtggctggccagcgcctccgtcgcggtatccagggcggtgcttgtcttcgccgacaacggcagcacgtaccagggacgggcgtccgcggtgggggcgacggctggggcctcctccaggatgacgtgcgcgttggtgccaccaatgccaaaggcgctgacaccggctcggcgaggggaggggcccggcgggccagtccctcagcgcggcgttcacgctgaagggcgagcgcgcgaagtcgatctgtgggttgggtttctcgaagtgcagcgtgggcgccatctgcttgtggcgcagcatctggacgaccttgacgaagctcgccacgcccgcggccgtgtccaggtggccgatgttcgtcttcaccgagccgatgcggcagaacccgctcttctgcgtctgcgtgcggaaggcctgggtgagggcggtgatttcaatcgggtcgcccaccggcgtgccggtgccgtggcactcgatgtagtcgatggagtcggcgctgatgccggagacgttgagcgcctccacgacggcgtccgcctgcccgtccacggacggcgccaggtagcccaccttgcgcgcgccgtcgttgttcaccgcgctgcccttcaccaccgcgtagatggtgtcgccatccgccagcgcgtcctccaggcggcgcagcacgatgacgcccgcgccgctgccgaagagcgtgccctgggagcggtggtcgaacgcgcggcagtgcccgtccggtgagaggatttctccctcctggtacaggtagccgcggtagtgcggcagctccagcgtgacgccgcccgccagcgccaggtcgcactcgcgcgccagcaagctctggcaggcggagtggatggcgacgagcgacgtggagcacgccgtctgcacgttgaggctgggcccgcgcaggtccaggcaatacgagacacgggtggtgaggaagtccttgtcgttgcccgtatgccgcacgaggaacagtcccacctgttccatcagttgcgggttggtgaagaggttgtagggcatgtacgcgttcatgcccgagccgccgaacacgccgacgggccccttgaaccgctccggcggatggccgctgtgctccagcgcttcccagcacacttccaggaagtggcggtgctgcgggtccatgagggacgcctcgcgcgcgctgaagccgaagaagcccgcgtcgaagtcctccaggccctcgtacaccatgcccgacttcacgtagttcgggtcctggagcagcgccgggtccacgcccgcgctcaggagctgcgcgtcactgaagtgcgtgacggactcgacgccgtcgcgcacgcggcgccagaacgtgtccacatcgcgcgctccaggcagtcgcgcggccatccccaccaccgcgatgtctggcgaatccgcaagcccttcaacgtcttccgtcatgacagtagtcctgaaaagtaccgcttccagcagttcaaatcagcacagtttgaggagggtcgaacccgccccagctttggaaccggcgtacctaggtctgtcatgacatccccccgctgcgctcagcctactcgtgtgtggcattgagcccgaatatctggcgcagccgtccgagtatacggccgacctcggcgggaatggcgtcgttgctcgttccgctcgcttcggccaccgcgcgcagctgggtccgccgctgggcaagcatggaggagagctgccgggccaggccgggatactccgtgaagaggcgggcgaaggtgggacggtctacttcgaggagcaatgagtcctccaccgccaccaccgtggccgaacggcgctctcccgtcagcaggcacatctctccgaagtagctgccgcggcccaggcgggtgacttccgactgggacttccccgtgcgcacgctcacctctccggaggcgagcacgtagaaggtccggccctcgtcgccctcctggatgatgcgctcgccggcgccgaagcggcgcaccagcgactcctggcgaagccggtccagctcctccgtgtccagggactggaagaggtccacggcgcccaggaggctgcggatggtgtcctccgacagctccgtgcgcgccatctcctgtcgtacgtgcaccgtccgctgggcgtagggaatctcgatgttcgcccggcgcagccggtaccacaggcgggagtggaggtcctccttcaccgcgtccgccaggccgtaatcgccgatgaagaaccgcaccatgtagcggatggcggaatcctcgtagcccagcgtgcgcgcgatgggagacggctccgggaggatgaggggggtctcccgcatcgtctccagcagcgcgtgcttgacctggttgggcgcggcgtcccgtgacaggcggaactccacgtcgatgccgacggggttggggtcctgggtgaagttgaggaccagctccttggccaccatgctgttgggcagcgtgatgacctcgcggcggaagttggccagccggatggagcgccagccaatgaagaccacgcgtccggtgtgtgtgccgatgcggatgaagtggccgacctcgaaggggcggtccagttggagggacaggcccgcgaagaggttgcccagcgtctcctggagcgccagaccgatgaccaccgacagcaccgcggacgtggccaccaggcccgccaggtccacgttgaactgggtgcgcaggagcggcagcaccgccagtgggtacagcgtgaagtcgatgacgttgcgcaggattttcggtgtgcccaccgccggcgcgcgcagccggatcaccttcagcgccagggccacgctggcgcggatgccaccgaaggtgaacatcagcatccagctgacctggagcgccttcttgaggccttcgggggcggtcgccggcaaggcccacgtcgccagccggagcacgatgaacgcgatgaggagccggttggcgctcttcaaatcctgccgaaggtcggcgtcttgagcggcggcgcgcacccccatcagcacgacgatgagcagcgcacccacggccagggacaggttgctctgaaggaagggcagcaaggcggggggaatgtctcccgccatctccatgggggtcaaggcggccgttgacgcgtgccgcgtgagcggggatacacgcgccatgacgctcgcaacggtactgggacagcctcgcgcggtggacgccctccaggcggccctgcgcagcggcgcggtccaccacgcgtacctcttcgccgggccagaaggggtgggcaaggagctggcggccgtcgggctggcccaggccctcacgtgccccgagcagccagacgtgggctgcggcgcctgcgcgagctgccagcgggtggagaggggcctccacccggacgtcacctgggtgatgcctgacgatgaacgggtgtcccgggggctggcgggtcggtccgacttcactgggacgcccagccgggagctacgcgtggagcaggtgcgccagctccaggagcgcatcgcccttcgcggcctggagtcgcgccgcaaggtggcgctcatcgtctccgcccagaccatgaacgtgcaggcgcagaacgcgttcctcaagacgctggaggagccgccttcggacaccacgatcatcctggtggccagcgcgattgaccgcctgctgcccaccattcgcagccggtgcggaaaggtgcacttcggcccactgccggtggacatggtggcccagcgcgtggcggaggcgcgcaagctggacgcggagacggccatgctcgcggccgtcatggcgggcggcagcctgggccgggccatggcgctggacgtggacgcgctgtcgcggcgcaaggacaccctcaccgccttcgaggccctgcgcggcgaggacgccgtcggcctgctgcgcttcgcggaggcccatggcggctcgcgcgaggaggcggagagcaccctggagctgctggcgctgtggacgcgcgacgtggcgctggtgaagtcaggcctggagtcggggctggccaaccgcgacatggtggacctggcccggcaggtggcggcccgcacgtccgacatcctcctgcaccgccggcattcgctgctggatgcggcgcgggcggccattgcccggaacggtgcgccccggctccaactggagcggatgctcatcgacctgttcacggaggcgtcgcgatgagcgccagtgagatggatgacgtgctggcgagcgtgaaggggggcaaggtcgccccggtgtacctcttggtgggcgaggaattcctggtccgcaagggcgctgacgagctggtgaagctgctcgtccccgacgcggccatgggcctcaacctggccgtgttggacgcgggcagcccgcgcgaggtggcgcaggagctggccacgctgccgctgttccccggccgcaaggtggtgctggtccgcgacccggagttcctggcgcccaagaaggggcgaggggacgcgctgggcaaggcacgcgaggcgtggaaggcgggcaagcgaaaggagggcgcgcggcgactgttggcgctggcggcccgtgctggctggggcgtggaccagttggacccgagcacgcccggggctccgtcggtggagaagtggaaggacgagctcaacgtcgagctggccgacgtggacgtggccttcctcaaggaggcggccgccttctgccgcgaggagcgcatctccgcgcccgagggggatgcctcggcgctgctggacctcatccagaagggcgtgccggcgggccatgcgctggtgctggccgcgtccgacatggacgccaagaatccgctggtgaagctggcccacgacaagggctacgtcgtcgagcggaaggtggcggcgcgtcacaaggacctggacctgacggacatcgccaaggagttcctggcgcccttcaagaagaagctgggccccggtgcgctggacgaactcaaggagcgcattggcgggaacatccgcctgctccagtcggaactggagaagctggccacgtattcggaagggcccgccattgagcgggcggacgtggccgcgctggtccaccacgcgcgcgaggaggagttcttcgagctgtccgaggcgctccagaagcgcgacttcggcggggcgctgtcctacgcgaatgacgccatggggcaggggacgcacgcgttgcagttgctgggcgcggtcgcctccatcgttcggggcctgctggagagccatgagtggctgtggcgctatgcgggaggcaatccgcctcgcaccgcgaaggacgtggaggcgcgcgtcttcccccggctggaagcggagctgaagggcagcaagcggaagatgcccaacgcgtgggcgctcacgttcagcatgaaggccgcggcgggttatgagcggcgggagctgctgggcgcgctggtggcctgcgcagaggcggacctggcgctgaagtcgtcggcgaacggccggctggtcatcgagcggctgctggccacggtgtgtgtgcgccagcacggcgcgggttattagaggaggcgcatatggcggacaagcgtcgtttcgacctcttcgcggatttcctggtggagcgcttcaacgcgccgcgggtcttcgacgtggcgggcgggcaggggaagctcaacgaggcgctgacgaagcggggccgagccgtcaccaccttcgacctgcggcacaagcacctgcccgtcacctacgcccagcgcatcttcacactggaggagccgtgcgaggcggagctggtggtgggcatgcacccggatggcgccacccgcatcatcatccagtacgcggcggcgcaccggctgcccttcgccgtggtgccgtgctgctcggacaacggcatgccctacaacccgtggatgcggcacctggccgagctggctcgcgagtcaggcttcaccatcgtggaggaggtgaagctctccatggacgggcgggcccgggtcctcgtgggcgagcatggcgccgctgcgtcttgaaggcgtcggagtccccgccgactgtcactcggtgggcccggtcagcaggcccgtgacatccttccagggtccctggcagggcggcgtgtccgaggcgaggtagtgcccgacgcgccccggcgccagcgccaccacggcggacgagcgcgtcccgtagagcggcgtgtggatgcagagcgcctggagccgttgcaggaagtcgcggggcaggtcctcaccggcgcccgggggcggaatcagctcctcggtggggagggtcgggtcggccagcaccgccttcaagccctccgccagctccggccagggcttcttcgccacctcggtggtcagcagccgggcccgttccaccttgggcagctccggggcattcagcacgtcattgggcaggacatggacccccggggggacatcctcccgccgcaactgccggtccgtcctccgggcgtaggccacgcgcagtcgctgggcgtccccatagagcaggttgaagggcatgaactcatcccctggcagggaatctaggtaccggtccacggcgtccacgctgccggcctggagggccttgagcaccacctcgccccgcgagcggggggccggaccctggcctcgctcgccccgctggttcgtcaggccgacgaacaaaccgccgtgggttacacccatccacgtcccaccgcgttcctcatcccggccgcccacggcgagcggggactccagaagcacttgggggccagtcgcagggcgggcgtagaactcgtcccggttggccgcgagcaccagcggccattcgggggggatgtggcgcaggatgatgatggtgcacatgcgtatccggtcgataacatctccggctccgcggcgcattcgggcccgcggacttcacgccgtcgatgacctcggccatccgagcggctaaggtccgccgccctcaggagagtccatggctgagagaaccctcgtcaccagcgcgctgccctacgcgaacggcccgctccacatcggccacgccgtcgagtacgtgcagaccgacatctacgttcgtttcctccgctcgtgcggcagggacgtcgtctacttctgtgccgatgacacccacggcacgcccatcgagctgaacgcggcgaagcagggcctcaagcccgaggaattcatcgcccgcttccacgaggagcaccagcgggacttccacgacctcgatgtccgcttcgactacttccactccaccaactcgccggagaaccgccagtacgcggagctcatctacgggcggctgaaggagaagggcgacatcgagcgccggaacatcgagcagacctactgcgagaacgaccgccgcttccttccggaccgcttcatcaaggggacctgccccaactgcaaggcttccgaccagtacggcgacgcctgtgagaagtgcggcaaggcctacgaccccacggacctcatcgacgcgcgctgtgccctgtgtggcacgcctccggtccgcaagcactccgaacacctgttcttcaagctgtcgcggcacgaggacttcctccaggacgtgctgcgcaagccaggcttcatccatccgggcctggcgacccaactccagggcttcttcgagaagggcctgtcggactgggacatcagccgcgacgggccgtacttcggcttcgccattccgggtgagacggacaagtacttctacgtctggttggacgcgcccatcgggtacatcgccaccacggagaagtgggcgaaggagacgggcaaggcgaagagcgcgctggactactggagcgcggacgcggacacccgcatcatccacttcatcggcaaggacatcgtctacttccacgcgctgttctggccggccgtgctcaacgtcgcgggcttccacatccccagcgaaatcaaggtccacggccacctgatgttgaacggcgagaagatgtcgaagactcgcggcaccatggtgccagtgcgcgactacctggaccagttggaccccagctacttgcgctacttctacgcggccaacctgggcccgggggtggaggacctggacctcaacctcaaggacttccgccagcgcgtgaatggcgagctggtcaacaacgtgggcaacctggccaaccgcgccctgtcgctgctggccggtccgctggagaagcgtctcgcgcccggccgtgccgagggcccgggccgcgagttggtggaggccgcgctcgcccgcgtgccggaggttcgcgacgcgttcgacaagctggagtaccggtccgccatccgcgtcatcaccgagattgcgtcggccgcgaacggcttcctccagacggccgcgccgtgggcccaggtgaagaaggacgcggaggtcgctcgcgcggacctgtccgacgccgcggacgtggcctacctcctgggcgcgctgctcgccccggtgacaccgcgcctgtccgagaagctcttcgctcagctcggcgccgagccgctgacgttccaggccctggagggcgcgaagtacccgctgttggatcgcagccgtcccatcggcacgcccgagccgctgctgccgcggctggaggaggagcgcgtcaacgccatcatcaagctaccggaaggcgccgctgcgccggacgccgcggaggccaggccggccaagggcgccaagacggagaagaagcccgccgaggctcccgccgcgacgcaggcggcggctccgagcgctggcgcggccgagtcgccgggtgaaatcgagtacgacgacttcgccaaggtggtgctgaaggcgggcaaggtgctggccgcggagaaggtgcagaaggcagacaagctgctcaagctcacggtggacgtgggcgaggggagcccgcgcaccatcgtctccggcatcgcggaggccttcgctcccgaggcgctcaccgggcgcaacgtggtggtggtggccaacctcaagccgcgcaagctcaagggcatcgagtcgcgcggcatgctcctgacggcggggccgggcggcaaggagctgtcgctgctcgacccgggcgatgtggcccctggcagcgaggtgaagtgacgtgacggactggcgcgccgaccgggaccgggccctcctgacgctggagcgcgagaagcgcccggcgttcaggacggaagccgcgctccagctctatcacctcgcgtcggaggtccccgagcacgccgccgagttcctcgaggcgctcccccggttgttggcggacaagcaggtggaggtgcgccgcgcgggggtgagcctggcctccgtggtggtgcctccggcggagctgccggacctgctcatcgcccggcttcgggacgaggagtggcagattcgcctggaggccaccggccggttggcagacctggcccggccggagctgcgtggggcgctggcctccatgctggaggatggcaccttcgaggtccgcttcgaggcggcacgcggcatcgccagcctccatcacgccgcggggctggaggtgttgctggaggcgctggacgcggacctgctgcgcttccgggccctgggcgcgctggcggagctgggggacgcgcgcgcgctgccccaggtgaagaagctgttcggccggtggcttctgcccgccttcgacaagacgcaggccgccggggtgctggcgaagctgggcgattcggacggcccgacgtacctcatccagcggatggcgaagaagcggtggagcccggaccgggccctggccgtggaactctgcggcgaggtgaaggtacccggcgcgctggagcgcttgaaggaagtcctggacgacgtgaaggacccctgccggggcgcggccgcgagaggcctgggccggctgggcgatgcgcgggcgctgccctggctggtcgggctgctccaggacgcgcaggcctccgaggacacccgattggacgccgctgacgggctgtggcgcctgggcggggctgaggcgcgtgaggccgttcgcaacgcggtgagtacctttccctcaccagaggcccgcgccgaactggaagagctgttgcaggaggagccatgaaattcgtcgacgcccactgtcacctcgaggtgaaggactacccggacgtcgtggccgtgctcgacgcggctcgcgcggcggggctggtccatgccgtcgtggtggggcagttccacggcccgggtaactggggcaacgcgctggaggtggcggcggcgcacccggagttcctgtcgcccacgttgggcatccacccgcacgaggccgcccgggccaccgaggaggacctggccacgctggagcgcacctgcgcgcgtcccgaggtccgggcggtgggggaggcgggcctggactactactacgaccactcaccgcgtgaggcgcaggcggaggtcttccggcggcagtgcgcgctggcgctccggctgggcaagccgctggtggtgcacgtgcgcgacgcgcatgacgactgtgacgccatcctcggcgagacgggcgtggcgaagggcgtcatccactgcttcaccggtgacacggacgcggcgcggcgctacctggaccggggcttcctgctgtcgctgtcgggcgtcatcacctacaagaagacggaggcgctccaggacgcggtgcgcttcgcgccgttggacaggctgatggtggagacggacagcccgtacctggcgccggtgccgcaccgggggcggaagaaccagccctcgcacgtggtggagacggcgaagaaggtcgccgaactcaagggcgtgacgctggaggaggtggcctcggtcaccaccgccaacgccgccgccctcttcaacctcaacctgcgttgaggccgccggccagggccgcgaggtcctggtccatctgcggcacgtccagcagcaacgcgtccgggtcgtactggaagtccgcctgcttcagcttcagcagcgcctggagcgcgggctcgcctgagtgaccaccgaaggacgcgaagacgacgcggcctcgctccaggtgcaggtagccctccagcgtgtgctggcgcaggttgagccggccgctcttgtggccaccgcccagcgtgcgcagcagctcgcgaggggggagttcgtcgaagctgccgcgcaccacgcgccccggcccgttgtgctggacccggtcgtcgtagagggcctgcaccgtcttcgcgatggcgggcttgtccgcgggcgacagcacgtccgtggcgcccgccatgagcaggcgctcccgcgtggcattgtcgggctcgcccaccaccgcgatgggcagacccgccgtctccggcgccgagcgggcctgcgccagcaggtccgtcacgtcctgcagccccagccgcaggctcaccaccagcacgtcgcagtcctgccgcgccagtccgtcctgcgcgccctcgacggtggacagcgcgtgcgccaccaggccctgcttcagcaccgcttccagcagctcgccgcgcgccgtctcgtccggctccaccacgagcacctggcggccttcgctctccagccggtggcgcagcagctcaccactctggagctggatgacgatgtccgccaccaccgggtcatagagcgcgcccgcgtacttgcgcaggtgctccagggcctgctccttgggcagcacgcggcccagggcgttgcccgggttcttcgtcagctccaggaagctgtccaccgcggcgaggatgcgcgcgcccagggtgatgtcctcgcccttggcgccctggggcgtgccggagccgtcccaggcttcgtacatctgcgcgaggatggtgttcgtctgcgcgggcaggtgcaccgtctcgaacatgcgggtggggatgcggcaggccaccttcgcctgcgccttccactccgggttgacggcgttgctcgccagcgagaagtgccgctccgccggctttcccaggtcgtgcaggtaggcggcgatggccagcgcggccagctccttgtggggcatgcccatgcgctggcccacgatgccggcctgccgcgccaactgcgcggagtgcccgcggtggcgctgccggtcctgctccagcaggccgaccatgatgcccagcgtctccacgtagtcgctgtcgctcaccagcccgcgcggcccgccgggttcgcgccgctgggtggacgggcggaccgcgggggtgccggtgctgctgccgcgttgcagccgcatccgcgcgtccgtctccacgcggaagttgaggctgagtccgccacggttgcccgcgcccgtcccggtgccgctgcccgcgtaggtgcgtccgtgctccggggcgcccgggcgggacggcgcggccggggcctggccctgggcgttggcgccttccagcagcgcggcgaaggcggtgggatcgccgtagtagtgcttgcggatggcggcggagatggcgctgcgcaggcccacgtacgcgtagacctccgacatgcccgtgacgagggcaatctcgtccatcagcgacttgttctgcggctcggcggcgaccacggagagcagcttgcgctccgggtccaccgccagtggcagcacgttctgcgcctcggccaggcgcaccggaagccggtccagcacctcggtggcgatgcgcgccttcgccagcttgtccgcgctgacgaagcgcgtctggaactccgccgccaggaagcgcagcagcgccgcttcctggagcagtcccagctccaccagacaatcaccgaccttgtggccggtgattttctggtgctccagggcctgttccacggccccggcgttgacgagtcccgcctcgatgaggcgctctcccaacctcttcaccatgtgctgcctcagctctccgaggaaccctcaccgcccttgttgccggaatcggacggtaacgacgtcagcgcgctgaacggcttgaaggtcagctccttgggcagcgagctcgcgtcacgcggcggacgctcctcgcggggcggacggggcgggcgctcctcacgcgcgcgctcctcgcggggcggacgctccttgcggggcgggcgctgggcctgctcctgctgcggggcgccctcggccggggtacccggctgctgctgcttctccgcccgggccttgcgcttctcctcgcggcccttgcggcggccacccccctccaccggggcgcggccccgcgaggtgggcgaggggcccttccacaactggcgctcataggggcgcaccacgtccgtccacttgtcgtgcgagtcgcgctgcatggcctccagccacgaggcgatgcgcgcgtccagcgactccagcgagtggatgatctgcgcttccagcgtcaccggcgacttcgggctgccgtgctgcgcgtcgccgtgctgggagatgaccaggtgcgtgaggtgctgctccaggagcggcgggaagccggggatggccagcgccttctcgcgcagcttctgcgccgtcaggacgaggttgcccaccagccggccctcgtcggaggtctcggaggcgtccgccgccttctgcacctgctgcaacagcgcgccggccagcagcaggtcgcggtccgccatggggtactggtccgccacgcggagcgtcagccgcatcaccgacaggatgtgctccgccagtccgccaggc

SEQ ID NO: 1159 - DNA, 14541 bp, Myxococcus xanthus
gatgtcgtcgacagcgttgccaaggcggtgggccagcgcaacgctgtctcgaccttcgttgagcggctccgtcggtggcaggagtttctcgaacggcatggtccagaaggtctcggggctcatgcccagcgcggtctgtatggtgagctctggtgtctgcgtcatcaagcccttcggctcatgggggcagagtgcgccatccttgcatggacagggcccgatcggagcaaccaggacttccagttcgcgtcctgcgccgtcgaggtgaagacgactgcgagcagcccgcaccatcacgtggcgatctccaacatccggcagctcgacgaaacgcatgtgccagcgctgctcttgctgcatgtggcgctcgaaatccgacatgattccggcgagactctcgtcgggatggtggcgtcgctgcgggatttactacgcccttccgggcagcctctttccctgttcgaggagaagctccgaagctggggctatctcgatgttcacgcagttcgttacggggaggccgcgtatgtggtgcggtcacatgacttctaccgcgtgatgggctgcttcccccggctcaccgaagcggacatacccgacggagtcggagacgttcggtactccgtcgcgctgtcggcatgcgctgcctaccggctgtcaccggatgcagcggcagcactcatcgttgggaagtgacaatgtcattgagcccggagcttcttgagtttgctagtgagttccacgctgaaatcgtttcctttgctcgaggagagatgtcgggtcacgcgagtgcttcgcaggcggcggagttcaaggagaacgccttcaccgagcgggtggtggacatcatcgcggaagccggtgccattactggtgggcatacctgctatttccgcaaggaactcgggaaccgtcatctcaaggcgaacggttacaacgtgggggaggacgaggagcatctcgatatcatcatcagtatctacagagatactcccgttccgccgacgctgcgcatgacagaggtctatcaggctatccagcgtgccttgaacttcgtcagtgcggccgcggctgacctctcgagcaagatggaacaggcccaccctgcctacgacatggcggagcgggtcagggaggtcttctccaaagccagtgtgcagcgtgtgaacgtgatcgtgctcacggattgtgtggtgcgtgagcaccaactgcagaagccgctgaagattagcaagcaatcccggatcgatgttcgtgcggatatctgggacatcgagcgtctgtatcggagcatgagttcggggtgcgtccgcgagacgatcgatatcgactttggcgaattcgagcgcaccatcccctgtctgccggttccaatctccgaaggcgaatacggagcctacctcgccgtggttccgggggaggttctcttcaggctgtacgacgaatacggtgagcggctcctcgaactcaacgttcgctccttcctccaggctcgtggcaagatcaaccgcggcattcgtgacacgctgctcaaggagcctcagctcttcttcgcctacaacaacggcatcacagcggtggcggaggacgtgaagacgaagttgctcccggacgggacgacggctcttgtctggatcagggggttgcagatcgtcaacggtggccagacgacggcctccatccaccgtgctggaaagaaggaccaggcggaactctctcgggtcttcgtacagatgaagctctcacaggtgcgcttggtgcatcttgagacactcgttccgcgcatctccctgtatgcgaacagccagaacaaggtaaacgaggccgatttctccgcgaacgatttgttccatcagaagttggagagcctctcacgtacgatttgggcaccaggcgagcagagccgctggttctacgagcgcgcgcgcggtcaataccaggtagcccgcgggaaggcctctacacccgccaagcagcgacaattcgacagcatccatccgccatcacagatgttcacgaagacggatcttgcgggctttgagcacagttggggtcaacggcccgacttggtcagcaagggatcccagaaaaacttcgtggagttcatgctcttgttcaaagcgcagcagcccgatttcagcccggacgagcagtacttcacccagctcgtagctaaggcaatcatcttccgtaaggtccaggcgcttgcacgtgaagccaggattggcgcgtacagagcgaacatcgttacttactcggtggcgtatcttgcatcacgagtcggtgcgcgcttggatcttgccgaaatctggcgagcgcagaagctgacgcctcagttggaggcggcgcttcgtgggctgctgatgcccattgaagaagccatcaagcgaacagctgaggggcggaacgttacggagtggtgcaagaaggcggagtgctggcgcgctatcaaggccatgaattttcccgtcccggccaatgtggcgggcgcgttgtatgctgcgcgcgccggccggaagggggccgcgaaggaggtgcaggagaacctccggaaggcagcgttacccaagcttgcggaagccgtgaatatcgccctgatcagcttcgcccgagcgggacagaaggcagatgcggcttcgattgcggacgcaatcacgaagacactcgcaccaggggggcttgaggttatcaacaacgttccatccggaggagttctctgggttgtgggcggtatggaactttcatcgattatgagggaggtgcgtgagcatgggcttcgcgccgagtttcgcgaaggtggaggcagggcaaccgagcaccgccctgcgtggtacatcacctgctgagagcggccgtcggcctcgtacgtgtcgagcagggagctcagtcccgctaggttccaacctgcctcgccactgccgacgaagaggtagttctttcgtaaccgaccgacggacggtcagttgccggcgatctgctcatcgactggccagcgacacgagcaactactcggatcaagcgcagtgcgtccgacgcagtcaaggataatgaacaacgccattggccattttaaccatttcccatactgcaaaggccttttcgggaagaggagtcttcgggtcgcgtgcgagcgcatgtgacgccgcaagaagacttttggaaagaagcttggcacaggttgctgcatctgcgccaccgttcaaatgtgcaagtatcccctcaagcaatgcgttggtttgtcgatcgaacattgagggatgggtcgcaaacttgtacttgatcttaaagccaacaaagccagatgcgcctgcgccaatgagagtagggccaagcgcgacggcagtgcaacaggctatgaagtaacaaaacttgcctttgatcagatgcgcatcatcagtgccaatggcggtctgactgcttgggcaaagcaggcggtcatcatgcccgtgcgtaaaggcgactacgacgtttgcgacgttccgttccaatacatcatgcaggcgcgcggtggcctgtggggaaaatgcgccataatcgatatacgagcgtggaacgatgtgttgtagaaaaacatcaacaattcgccgcgcaacagcttcccatgcgtcaagcggcccggccgctcctgggcggatgattacggttttcacggtttctgactggcgagtatctgagtgagcccttggcgataatggttgagtaaagctcggccttttgaggtcgccttcttcatctcctccagcgcttgtcgaagcgagtactcagacccatcttctgtaactaaaagtggcgcatcagcatccgggctgtattgaacccattcgtctagggcggcaattacttgacgctgcttcgcaatctcgcgctcaaggacagccgggagcgccttcggattgtcgcccttctgtagaataaagtcaatgccattgattgccagatcggttcgggcctctccggcctctagtccgagggcgccgctcatgagcacgacagggatataggcatcgctctctcgaatgcggtgaagcactgaaagtccatttggaccgtcttttaggtcaaaatccaaaacgatcgcatgggggcggaatgtctcaaggtcttctttcagcttgtccgcagagtcacggacttggacctcgtagtcatccaattccagcgattccttgaccgttgctccgtatgctgaatcgtcgtcgattaccaggattctttcggtaggtttcattttgcacgcggaattgcaatctcaaatgatgcaccagcgatcgtgctacttttcttcaggctcaaactccctccgtaatcggcagcgatttcgcccgcgatcggcaggcccaatccggagccgttgggcttggtcgaccaatacggctcgaagatgacgccctcatcctcggtaggcacaccgggtccttggtcggtgacggctatgaaggcacttccgtgttttgcgaaaacagagagagttacttgccctccttctggactccagaacaaggcattgtcgacgaggtttctaacggcttgatatagctctccatagtctacctcgacctctgccggactcgacggtgacgcaaatttaatttcaatgtttctcttgcttgctggttcagtgaaatcgctttggatgtcgatggctagcctgctgaggtcgatcttctcaatctttctgcgtgcgcgcgtgaacggaaggagtctgcgcacttcccgagccacgatgcccgccgattcatctgcacgtgccaatgcttcggatacacccacaatagtgacggaggcttttgctaggcgcttgaggccattgtctatcgctcggcggataatgtcgacctgctgcctgatttcatgagccatccgagttgctactactgataggcttaggattcgacgatatcttgaaatttcttgcgaaatcgtttcttctgcggacgatttttctgcctctgctgcgccaatcattgcgaggacttgcgtgcttgcaactgattttgatgtttccgctatttcccgcaagcgcttgagactttccagttcaaagagccgcctcccggatcggcgttgcttggtggtcggcttgtcgacgagtattcggttttcgatctctctgatgacctgcctgatcgctgagcgaagatcgttgaaggcgtcattgtttaccaagccttggcgattggtctgatcgcgaagttctgggttgtcttgctcgcttaggtagatgcatccaatgatttggctgttgctgagcctctctttgggcgtgttgattcgctctttgtcgaggtcgagccaatcgttacctggttcgccataagggaagacgcggaagccgtctctatagactgaaattcccgaccacttatcaagcagtcctctggcctcttgaagcgagagatccagtgtctcgcgaataccagccagtccttctgcgcttctgacccagacgtcgatttcaacggcaaaatggccggctgcgctcttctttccctttgctcctccgccaaggggtcgcacgcgctcgggctcattattgattgcaattgcaatttcgtcttcggttgggctgtgtgcgcgaacgacagccctcactcgccaaggacagagtgtcctgagtgactgcggaaaatggcctatgtcctcggaaatcccatcaacctccagctttacctggaacgtggcaagcgctggaggtatcacagggctgcccagaacttctgtggatctgaatggaggaaatagctttaatagttctaatttgagatgggcgattctgtcttcggaccaagagctgcggaggtcttggaggaatagactggtgccatggccagtggcaggggttggatgggagtcaatctgtggatggatttcgtcgagaaacttcataggatcgtcgaactgattccagtcgacgaccgctcttgttgctgtcgtctctccctctttctttgtgatgagtactagctttctagcgagtttatcagcggcaaagcgaccaatgcccttcttgccaagaagcggccgtcctgatggagatgcatgccgaagtttcttgtccggggtagcaggttggagccatgacccaaggacggtctctttcgacatgccgtgtccgtcatcaatgatgtcaagacttccgccaagtgcattttgggcattgtgaaatgcgaccttgacgcttagcgcatctgcgtcccatgcattcctgactagctcgacgacggcaatggtttcgtcgctgattagttcttcaccgaggagtcgtaggacacgagctctaggacgaaagacgtgctgcccttgcagggttgccatgagagtgacactagcgcaggattgaggcaggccgtttccagaaagtgggccagtcagcatctaacttggctcgctgtcggaatgtaccccccccctgggtcagggaagaagtcgcctcggctgacgtgccgagctgacgacgccttgagggcgagagcaggcaggacgcagtgtcgtacacggatgcattcaatgcgcagatggtgaagcaaatggtggacccaggcgcggtgagtgccgcggtgttggcccgccaagtgggggtctcccagccgaggtgggcgcactcactgttcccgagccggttgcggactcgtccgaagagcagtcgtcgccgcgctgagagcttcccgctcacggcctcaagatgaggcgtctgctcgtctcaccgaagacggggttcgttcagcggatacccaattccgcgtccaggtccaccttctcgtgtggggcggtagcggtgagcgtcaaggtagttgtgtgatgcctggaggaactcatggacccgtagggtgaaagtcccgaggcggcaacaggtcaaggccgcatagctggggtggcgccgacaggggagacccctgcggtgaagcccactgacaaagccccgtttcagcggggtgagcgagtgcacgggccgtaacggcgagtgaatgcccagtcgaggccccgtcaattgatgcctccgggtgccgagccgccacaactacggcgaaggcagcagggcgtccccgcagaacgaccagggggacgcaccacccggcggggtagagggcgacggcacgtgcacaaggacatgagtggaaacagggaagggctcctcgtcccgtggagaaaacccgcggaagcaaggtagccgtggcgagccgatgaggcgaagcccggtgaaggcgagagcccgacggatggggccgtagtagcgacgaagcggggtaatgcccgtggagcgaagggcccctaccggaggtactccgagcagaggagcgaggcgggagcgggatgacaaagcccaccatcagtccgcaggaactccgcgcgaggataggccatcgggcgaaatccgccccgacgcatcgcttctggggattgtacgtccacgtcctcaaacccgaagttctcgaagccgcctatctggaagcccggcgcaacggtggggctcccggtcaggacggcatcaccttcgagcacatcgaggagcgcggacgagcagggttcctcggtgcagtcgccgaggaactccgcacgggcacgtaccgccccagaccgtaccgacgaagagagattccgaaggagggcggcaaggtgcgcgtcatctcgattccgtcgattcgagaccgcgtcgtccagggcgccctccggctggtactggagcccatcttcgaggctgacttctcgggcagttccttcggggcgagaccgggtcggtcggcgcatgaagccatcgacaccgtgcgccaagggttgcgacggcgcaggcaccgcgtagtcgacgtggatttgaaagcctacttcgacagcatccggcatgcgccgctgctggagcgggtggcacgaagagtccaggacggcgaggtgctggcgctggtgaagcaattcctcaggagcacgggggacaggggaatcccgcagggctcgcccctgtccccgctgctggccaacatcgcgctgaacgacctcgaccatgtcctggaccgaggacgaggcttcctcacctatgcgcggtacttggacgacatggtggtgctcgcccccgactccgagaaggggcggaggtgggcagcacgggcgctggagcgcatccgccaggaggcggaggcactcggcgtgtcgctcaacaaggagaagacgcggacggtgacgatgaccgaccgcaacgcctccttcgcgttcctgggtttcgacttccgctggaagcggagcccgaagactggaacgtggtacccaaacacgaaccctcgacgaaagaaggtcaccgaagttctgcgccgcgtgcgccacgtcctgcgggacagccgagcactcgcagtgcagtcagccgtggtggaggtgaatgccattgtccgcggctgggtgaactactttcggtggggcaactcgtaccaggcgctcgacagggtgaaacaccacgtcgaactcaaggtgaggcggttcgcggcgaagagagcgaagcgagggggcttcggttggaagcggtggagtaaggacgtcgtgtacggaagctgggggctctttgatgactaccgggtgaggtactacgccatcctgaaagctggctccccgccgagcggaagcataaccccggtgagatgacgccttcgcggtgagccggatgcgggaaacccgcctgtccggttcgatgtggcggggaccggagacggagtgatggcgcgctctacacgggcacgaagccggaaacggcggatacggccaagagcagcctgcacaccaccgcgccggcccccgacccgaccgcctcggctgaggtgccgagctgacggcgcccaaggggcgagagcaggcaggatgcggtgccgtatacggatgcattcaaggcgcagatgggatgtcacacacgagaagcccgggtagcggcccgcaacctgctctagaatcgccgatatgagcactgcaccgtaccctattggttcccccggaagcccctggggtgaggcggaagtcacgacctggcggtcccgccagacccgcaagcgcagctacgcggccgacgtgctgagcgcgatagagcgcctgcgcgcgcgcttcgacgtggtgcagtacggcctgctggactacccgccggacacgtacccgctgttcgcgctcgcgagccgcgactggcgcgacgggttgccggtggcgctggtcacgggtggggtacatggctacgagacgagcggcgtccacggcgcgctgcagttcgtcgagcggcatgcggctggctacgcgggccgcttcaacctgctcgtcgtcccgtgcgtcagcccgtgggcctacgagcggatccagcgctggaacatgaatgcaattgacccgaaccgctccttccgcgagcccagccccgcggaggagtcggcggccctcatgcggctggtcgccccgctgcgcgaccgcgtgctcgtgcacgtggacctgcatgagaccaccgactcggacgaggcggagttccgccccgccttggccgcgcgcgacggcaagccctttgagcccgaccacacccccgacggattctacgtcgtgggcgacaccgagaacccgcggctcgacttccagcaggcggtcatcgccgcggtcgcgaaggtcacccacatcgccccgcccgacgccgacggcaagatcattggctctcccgtcgtcgccccgggcgtcatccactacgcactccgccagctcggactgtgcgctggcatcacgcgcgcccgctacgtgacgaccaccgaggtctaccccgacagcccgcgtgcgacgcccgcgcagtgcagcgacgcgcaggtggcggcggtcacggcggcgctcgattacgcattggcgcatccgtaggggacgtgccaatccaatctcgacgtcgagcgcacgccacgctcgacctcgtggccgtcacggctcacgtgggcgagccgacgcaggcggcgccggtggccgcggcgcagggcccgctggagtgagtgggagtaggacttcagggtggcgtgtcgtgcctatcgcgccccggtggccgcgtcccggggtgcaggcttcggtgcatcgcctgccgcctcggcgatgggccgggcgtacctgaccagcgacagcagcatcttgcccggctcttcgttcatgatctcgtgagccgagttctcgaaccagaccaggtgcttgatgggtgcgtgaaggcgctcgaaccattcggccgcgacgcttgccgacacgttgtagtcgtgccggccattgaagaggagcatcgggcactcgagccgggtcacgttgctgaagtcggcccgcaacacggcggggaacagcttctcctcggagagctcgttggcggtccacaccgaggccagctcggcatccgtgtactccggagagagtgcgaagccctccgcttcggcctggccacccgtccgcccgtgcacctggccaccatagaagccgagccacttgcgctggatcgcgacgacgggcagctcgagcgcagcgccatgcgccgcgtagggcgcaatcgattgcagctccctgatcgcctcctcgtttccggctgcgcgtgctctgtccatggcaaagcgccatccgcgccgttcgctctccagaacatcggtcgcctgtcccattccgatatacgcgtgcagccattccgggtgacgttgcgctacggacaggccgaggtagctgccccatgaatgtccgagcaggaagatcttctccttgccgagctccttgcgtgcccagtgaatcatctcctcggtatcggcgatcaaccgctccgccgtcatggtcgccgcgaccgcggaggggtcattcgccaggtaggtttttccagcaccgcgctgatcccactggatgacggtgaagtactcctcccacccccgctggaagtaccagctcgtcggcatcgacacgaagccgggacctccgtggagcatcagcaacacgggattcgcccggtcgacgccgcggatcgagacccattggtcgatcccgccgatgcggatcttctccagccgctccacacccatgggggtcacgatccggcgcaggttggcgacgatggcggtcgcttcgcgccggctgccgggtccagcttgctccctggccgtaggggtgcctgcacagctcgtcaggaggatggccaggcagcaattacggaagaggttcgtcatctcggtcccgagacagtacgcaggtgctcgcatagggggcatcgcccacctccttccactctcttctggcagcgcaggcttgcacgagcctgacagtcgctgattgtcgcggcgccttcgccccgggaggagtagcgtccgccgacacggaggggactcatgcgtgcgctccttgtcgaggatgagccggaactcgcgcggctggtggcaaatgaagcgacgtcccagggcttctcggtcgacgccgtggcttcggtcaccgaggcccgtagcgcgatccatctgggcgcctacgcgatcgtgcttctggaccgccgcctgcccgatggcgacggcctgtgcctgattcccgagctccgtgccatgcagccggaggcgggcgtgctggtgatcagcgcgatgggagatgtcccggagagagtcgcaggcctggatgcgggtgcggatgactacatgggaaagcctttccatgcagacgagctgcgggcgcgcatccgctcggtgctgcgacggcctgcacaggcgcgacagctgcagccggtgcgctgcggcgccatcgagtacgacctcggctccaggcagatgacggtgcagggaaggccgctgctgcttcgccggcgcgaggcctcgctgctggccgccctgatgcgccgcgcgcggcgggtcgtccagcgcgacaccctcatcaaggaggtctacgggttcgacgaggagcccagtgccaacaccctggaagcacacatctccaggctgcggcggcggctcgaggattgtggcgcgggtgtggtgctgcacccggtccggggcgtcggctatcttatcgacgagccatgaagcgtctcacggactccctggcgccgcgcctgatcgcggccgtcctcgcaacgcagctcatcgtcatcaccgggctgatgctgttctggatggtgttctcccactccgtctcgcacgacgatctgtccgccgcgacctcccaacgtcgcgtcgccgagtcgatcacgctggacccggcaggcgcccctcgcatcgagccctcgagcgctctgcgcgcctatcaggcacgacgtccgcagctggcctacgccgtgtacctggacggccgcctggtgtccggatcatcgcagcagcttgcccacgcgatctctccacgcggctgggccgcacctggcgcgaacctcgaaccggcgcccaccctcgccgacctgtaccggcacttccccgacctgcagtgtgtgcagctgcttgctgagtgcggagatccggtgatcgccctcggagagggccagcgcgcgaacgtctcgatgttcccgatccacggcatcgggaccgcggtcgtcgtgacgagcggcaatcgcctcggactggatgacctgccaaccgcgctgctgacgctgattccgcgcgtgatgaagctgtttggttcggccgtcctcgccaccgtcctcgtgctgccactgatgctgcgtcgcgcgctacaacccctcacgagggccgccaacgccgcatccggcatcggcctcgagacgctggaccagcggctgtcgcccgatggcgtgcccaaggagatccagcccttcgtcacggccatcaatcagctgctggaaaggctcgagcgcggcgtctcccgccagcaactgttcgtcgccaatgccgcgcacgagttgcgcacccctgtggcgattctctgcgcccggctcgactccctgggcgacagccccgccacgcgcgacctgcggcgcgatgcgacgcggctggggctgatggtcgaccagctgctcgcggctttccgcatgcagggacagaccccggcggattggagagcgctggatctggtccagcagctgcgtgatctgatcagcgacatggcgccgctggcgctgcggagcggacgagccatcgccctggaagccgcatcgccctccgagatggtgctgggacaggccgatggccttcggtcggcgttggccaacctgctcgacaatgcgctgcgcgccgagcccgctggcgggacggtgatcgtcaggatggaagccagcacgtccagcgtcacggtcgacgtcgtcgatcacggccccggcgtcgaggagtccgaccgagagaacatcttcgagcccttttggcgccgggaaggtcagtggagtggaaccgggttgggtctggccatcgcccgccgcatctcggaaggccacggcggtagcctgcagcacctgcccacagaaggcggcggcgcgacattccggatgcgggtgggaagatctcccgcaggaagaagcatcgacccgtcagcgtgttgcaaggattgaggcgcgtactggctggagttgccccccgtcaaatcggacagctcaggggtgagagttcgcagtgcggaactcgcggggtgacttcaccttgagcccgcggtgcgccccccgcttcgaactccaccaggtcgatggcttgcctatagaagtcaggcgcgggtcttcctggcggattgatggccttcatgatgtggggcgtccccatgtactgcgcgtgagcttcgttgggtcaaagaagcgtgagatgtattctctcatgtcggccaagcgagcatcgcggcatcaatgatggcggcgagcttcttcgcggaggcgccatcgcgagactgtatcgacaagccctccagcaccgtggtgtagaacgcggcgagcatccccacctcggcggatgcagggaggtctccatcgagaatgcctcgctcgagtcgctgcttcagcgcacgctcacccctgaggcgattctccgcgaggaaggtcctgacccgctcgttctccggcgagcccaggagcgaagacaggacgatcatgcacccccgaggtttgtcgctggcggtgtaggcccgcgcattggcgcgcagcatctcctccaccgccgcgcgtgcggacggagcatcctccaggctgcgggtggtgtgaatgccttcgagccggtcgtagagttcaacggcttcgcggaagagctcttccttgcagccgaagatggaatagaggctgggcttgttgacgcccatcgcatcgaccagatcctggatggacgtgccctcgtagccgcgcgcccaaaacacccgcatcgcctccacgagtgcctcgtcgcggtcgaacccgcgggggcggcccatcacagcggaaggcttcttcgtcttcaccttgcgcggagtcatcgctcgattgcccgcaggccagcgacgccgatgccgatcatcaccaggaagaagatacgtggtgccgagacctgttcgccgagaaatagcatgccgaagaccgcgacgccgcacatgcccatccccacccagacatcgtaggccgttccgacgggcagctgcttcaaggcgagcgacagcagcaccaggctg

SEQ ID NO: 1160 - DNA, 16427 bp, Myxococcus xanthus
  unsure (1)..(16427): unsure at all n locations
tctaaggggccagcgcttcgacctggaggcgaagtaccggggcgccacctccagtgtgtttcccaagcgcagcctcacgctgaaattcccggacgaggacctgttcaccgagcctgtcttcggaaacggcttcgaggaccgcaagcgcgtggtgctcatcaccacgttcaatgacaactcctacattcgctcacggctcgccttcgacgtgtggagccggatgagcccgggccatatccacctgcgcacctacagcgcggtgctctacgccaacaacaaatacgtcggcctttacacggctgcggaccacgtcaacaaacgcctgatggccgcgcacggcatcgacaaggacgcggacgccttcaaggccgtggaccaccgcgccaacttctcgcgcctgcgcaaagacggcacgaccaagagcagcctccacgaaggcttcgaaaagtcggagggcgatcccgaggaaggcgagcctggcgccttcgcgcccatggaggcgctcaccgccttcatcgcggactcgaacgcggacgccttccgcgccggcttcccgcagcggatgaatgcgcgggactacgaagactggtggatcttcaacacgctcatcctgggcgtggactcgcaggcgaagaatgcctaccacgcctacgacccggccaccggcggcccctggcgcttcatcccctgggacttggacgcgagcttcgggcagacctacgacaccacccggacctcacccacggcgcggcccaatttccgggcggacaacctgctcttccagcgcatgctggccgaccccaccatcgccgggcccttgcgcgagcgctaccgggcgctgctgcacggcagcctgaacgtggaggtcatgcaggccctcatcgacggctacgtccaggagacggcgccttccgcgcggcgtgactgggcgaagtggggcgccaagcaccgcgccttcggcgacccgaatgacccgtggggcggccatggcaacttcccccactggcacacgcgcaaggacttcaactcctacgagaaggaaatcgagtacgtgcgccagtggattcggacccgctgggacgcgctggagagccagttgccctgaacgggcgggtgtcccctccctcggtggaggggacactcggacggcggtttagaacgccgcggagcccggcacgcgcgggtagggaatcgcgtcccggatgttctgcagaccgcacatgtagacgatgagccgctcgaagccgagcccgaagcccgcgtgtggcacggagccgtagcgccgcaggtcgcggtaccactggtagctctccggcttcaggccgaacttctggatgcgctgatccagcacatccaggcgctcctcgcgctggctgccgccgatgatttcgccaatgcccggggcgagcacgtccatggcggcgaccgtcttcccgtcatcgttcaggcgcatgtagaaggacttgatggcctccgggtagttcatcaccaccaccggccggcccacgtgctcctcggtgagatagcgctcgtgctccgtctggaggtccttgccccactcgggctcgaactcgaacttcttcttggccttcttcaggatttcgacggcctcggtgtagtcgatgcgctcgaagctggagttgatgaacttctccatgcgctcgatgacgcctttctgcacccgctcctcgaagaacttcaggtccggcgcacagtcattgagcaccgccttgaagacatgcttgaggaagcgctcggccaggttcgcgtcctcgttgaggtccgcgaaggcaacctccggctcgatcatccagaactcggccaggtgccgcgtggtgttggagttctccgcccggaacgtggggccgaacgtgtacaccttggacatagccagggcgtaggcctccgcgttgagctggccagagacggtcaggtacgcctccttgccgaagaagtccttgtgccagtcaatcttcccgtccgacgtgcgcggcggattcaccgcgtccagcgtggagacgcggaacatctgcccggcgccctccgcgtcgctcgcggtgatgatgggcgtgttgacccagaagaagccctcctcgtcgaagaagcggtggacggcctgggcggcgcggtgccgcacgcgcgtgacggcgctgaacgtgttggtgcgcacgcgcaggtgggccacgtcgcgcaggaactccagcgtgtgctgcttgggctggatggggtacgtgtccgggtcgtccacgaagcccagcacctggacttcgtccgcctggacttcataggcctgccccttgccctgggacttcaccagcgtgccccggctgatgaccgagcagcccgcggtgaggtgcaggatttccttctcgtagttgggcagcgaattcggagcgacgacctggatggggtcgaacgtcgacccgtcgctgacgttgacgaagctgatgcccgccttggagtcgcggcgcgtgcgcacccagccgcggacctccaccttcgtcccctcctccacccctcccgcgagggccttcttcacactgacgacctgcattgacgctctcccttgagccgtttcggggactgcgagttagccgggccccggccccgaggacaagggcgctgtgccccaagcctcgccgccctggccgcccagaggcgcttctgggggctccaagcaccccgccagaccgcctgaaacccgaccaaccatgtcagaccccccagtatctttttcccantggtcgcccaaaaggggaccagcgattccacgaaaccctcacgtccctcgcaggcctcacggcctgccctggccgtgccctacctggagagtcacatggctactcgtaagacgtccaagcgcaatgtcgtcgcccgcaaccgctccaccgaggccaccaaggccgccttcgaggagctcgctcgcaaggcgcgcaacaagcccatcgtctccaccaaggagcaggacgcgcaggaggcccacgcgaagaacgtcctcgcggacgtgtccagcctcaccgccgaatccgccgtgaagaaagtcacggaggcgggcctcaccatcaacaagacgctggccggcatcaacgagcaggtcatctcgctggtggaggagctgaagcagctcgacgaggccatccagctcaagacggaggagctgaacgggctgcacggcaaggacgtggccgccagcgccatcgacgtgctcgtggccgagtacgacaagaagaaggccgagctcgaggcggagatggagcggctccagaaggacatcgaggacacccgggcgaaggccgccgcggaccagtcctccgagcggcaggccaccgaggtctcccgcaagcgcgccgaggaggagtacgcctatgacacccagctccagcgcaagaaggagcaggatgccttcgccgagtcgctgcgccagcaggccgccaccgagcgcgaccgcaaggagaagctggagaaggactgggccacccgcgaggacgccctgaagcagcgtgagaaggagttggaggacctgcgcaagcaggtggcggacttcccgctggtgctcaagaaggagacggacaccgccgcggccatcaccggcaaccgggtgaagtccgagtgggagctcaagctcacgctcgccaccaaggacgcggagacggcgcagcgcgtcgccgccatggagatttcctcgctcaaggagaccgccaccaagcaggcccaggcgctccagacgcttcagacggagctggccgaggccaagcgccaggtccaggccatcgccgagaaggcgctcgagtccgcgtccggcgcccgcgcgctggccgaggtccagggcgtcatcgccagccgcgactacagcaagggcaagtagcccggcgcggtgggctccctggcgccgcgccctgtcctggcgccgccggggagtctcggatcacggcttattggcgtcatccctggtgatgacaggatttgagcgctgttagactccaagcatggacaagactcccggcgggactccgtttcccacgcagctactctatgagcgaatcggcggctattggctcacccaggtcattggcacggcggcccgtctgggaatcgcggacctgctctccaagggcccgcggagcagtgacgcgctggcggacgagctcggcatcagcgcggatggcctgtaccggctgctgcgaggcggcatctccgcgggcgtcttccaggaggtcggtgagcggacctttgccctgacgcccatgggcgaagggctccgctcggatatccccggctcgctgcgggacgtggccatcgcgcagagtgaccgcgcccactggctgccctggggccagctcatcgaggccgtccgcaccgggaagtccaccgtccgcgaggccctggggacagacatctgggagcacttcgccaagcaccccgaagaggcgacgcacttcgcccgggccatgggcaacctgtcggccctggtggcccatgagctgacgcaacaggtcgacttctcccccttcgcccatgtggcggacatcggcggcagccagggcgcgctgctagcgcgggtgctgcgcgccaacccctcctgccggggcattcttttcgacctgccgcacgtgctcgaaggcgcgaaggccccaatggaagcccagggcctccatggacgggtggagctggtgggcggcagcttcttcgagccgggcctcccctccgccgaggcctacctcctcaaacacatccttcacgactgggacgaggagtccgccaccgccatcctgcggaacatccatgccgcggcgcccgcgggagcccggctcttcgtgatggagctggtgatgcccgacaaccagacgccctctcccgtgcccctgatggacctcaacatgatggtgctggcggacggacgggagcgcacggccaacgaattccagacactgctgacccggacctcctgggagttggtgggcatccgccccacccaggccggcacgtgcatcatcgaagccgtgaagcgctgagctacggcgcgacctgttcgcggaggaggaagagctccgcgagcaggttgtccaccggagcgaagtcatccgtgagcagcaacgcggggcccgcggccagataggcgtcaatctccgcgcgaggcacccggcctgtgcgcggctgctcgatgcccacgccgcgcagcagctccgggagacgctccagttccatgggccgtgccgagcccgcgacgatgtagacaccctgccccttggagccactgcgggcgtcgtggagcagctccacgtgggggaagacctcctgcatcgtccggagggccgagcgcagaaaggagccccggggaatctcgtcgatgacggtcagcaggtagaggccgtccggcttgagcagcgagcgcaccagcatgtcgtactcgcgcgtcatcaggtggtagggcaccgacaggtcgttcaccgcgtcctggacaatcaagtcgtacgcgccgcgctccgccatctcctggaggtactgccgcccatccaggctgaaggaggcgatgcgcgtgtccggcttcacaccgaagcgctccagcgcgatgcgcgtcacggccgggtctatctccaccacctccatccggacctgcgggacgtaggtctccacccagcgcggcaccacgtagccgccgccgccaatcacgagtacccggggctccgcggtgcgcgcggccacgtggcgcaccacctccgagtggatgtacccgtgcgggtagcccaggtacgacgggtcctccaggtccaccatggtgtgcgtcaggtggtccagttgcatggccagcagccgccgaccgtcatgctccacctggttgaccttgatgcagaagtagtccgtctcctccgtgcacggcgacgcgaacagccccagcgcgccgaacatgcccgccagcgcgagcgtgcccgcggtggcgccgacgaagaggggccgccgccacacctgccccacgaaggccgccagcgccaccaggcccaggctggctcccatgaccagcgggtagacgcccaccttcgcgatgagccaccagccggtgaggaacgagcccagcagcgcacccgcggtgctccacgcgtacaaccggcccacggtgcgccccgcccgctccacgtccgccagcgccaaccggagcacctggggtgacagcgtgcccagggccgtcaccggcagcaggaacaccgcggccgtgtacccgacgatgcgagcctgcaggcccaggccgtcgaagtagcccttcagcaccagccactgatggatgggcggaatcagcaggcagctggccgccgccagcagcatggagccggcgagcacctcctgccggggccaccggtccgccaggtggccgcccaggaagttgcccagcgccatgcccgtcagcaccacgccgatgatgcctgtccagctcagcagggaaacacccacggtaggcgccaggatgcggctggccgccagttcgatggcgagcgtgcagaagctcgcgctggccaccaggaagcacgccagcacgggccgggtgcgcaggtccacgcccgtcgaggacggcgcggcatccgctgccgtcacggcgccggctgtcgcgggggccgccggttcgacgggcggcgcggacacggaggccttgggcagcgccagcagcgcgcacaacatcagcgcgcccgacacggtgaggacgatggtgggcacggggaaccacgccaccagcacgaagcccgtgaggaagttgcccgcgaggctccccaacgtgcccagcgcgtacagcaggcccacgatgcgcccggcgcgccccaggtccggcagcagcagccggagcgccagcggcgtcaccatggccagcacgaagctgacggggaagaagcccaggaaggtgagcaggaaggtgcgcggcagcacggggatggggcgcagcgcggcgccatcccccagcacggccacccaccccagcggcaggagcgcgagcaccgcccccagcgcggtgaggcccgccagccaccggaacgatgcgccccgctccgacagccggcctccggcatagctgcccagactgatgcccgcgagcaccacgccgatgatgctcgtccacgtgtggagcgaagccccgatgaagggcgccagcaacctggcggcggccagctccaacaccagggtagcgcagctcgtcaccaacacgaggagggcagcgcgaagcacatccagacgagacgcggggagaagagccatgcagtggcggcgactgtaccacccccgtccgaggcgaccatccgtgctggtgggaatcacccgaggtgcgggaaatcgcgcccggcgcatacgatggcgccatgtccgcgcgccccgacctccagcgcctcccctaccagggcctctggctcggcagcttccccctcatgggcatccccggccgcgcgcaggcccactcggaccaccccgtcgtcgccctggaacagggcgacttcctgctggtgagcctcatccgcaccagccccgaagaaattccgcagaccacgtcgatacgttggaggccctgaccgcatggataccgaagcgctcgcccgaatcccgggcgtcaacccgaacgtccccaatgccgcccgcatctacgactacacgttgggaggcacgcaccacttcgaagccgaccggcaagcggcggagtacctgttctcgctggtgccctccacccggaagtgggtgcccatgctgcgcgcctgcctgcgcaccgccgcgcagcgcctggcggccgacggcttccaccattgggtggacttcgcgtcggggctgcccaccggggaccacgtccacgccgtgctgccagacgcccgcgtgctctacagcgacgtcaatccgctcaccatcaccacggcccaccatctgctgggggacacgcctcgcgtccgctacatggaatgcgacatccgccaggcgggcgccttcctgcggcggccggacgtcaatgccttcctggggggagagcgccgcgtcgctttcggcgccaatggcatcaccgtgttcctgtccgcagaggagaaccgccagttcttccgtgacctgtacgactgggcagccccgggctcgaagctgttcaccaccttcgagacgaagtcaccggacctcagcaccccgaagtgggagcagttcgtcggcatgttccggcagatgggcgagtccttccagctctactccctgcccgagtacctggacctgtgtggcccctgggcccgggatgccaccggcgtgctgcccgtgcgcgagttcctcgggctgcccccggagcacatcaccgacgaggaccgtgagggcgtgggcatcgagttctacgccgtcgtcctggagaagcgctgaccgtcccccttggtggagcgagcgtgcgggcaggcgctcgcgcccatccccgtcagggcagcgccacggcacgcctccctgccgtctgcctccccagcggtgcgtgactaccgtctttgcaggcaacacgcgcacacggagaggagacggagcatgtttcaatcgagaaggcgtcgggttcttgcgggcgtgatgatgggagcggccctgtcggtggcgagcgttgggtgcagctcgacgcgctcggcgaaggtggacgagtcatggctggcccgggtacccgagagccagttgggcgacgtccgcgaggcccagacgcagcggcgcacggcccaggacgcggtgacccgctccgacgtggccctcaatgatgcgcgccgggagctggaggtggccaggcgcaacgaggacgcggccaagtcccgccggaaagcgcatgacgaagcgctgaaggccgccaacgcgaccgggcagagcagcaacatcacccaggcgcaggccgagctgaaaagcgcggactccagcatgagcgcggcccaggcccaggtgaggtaccgcgagcacaccatcaagacgatggaggccctgaaggacctgcgggagagcgagctggcggaggccgacgcgaagctcagccaggccgagtacgaggccctgaagacgaaccaggacgtgcgcgcccagaatctgtccgaggccgacttcgcctccgccacggcggacgcccagcgcaaggtggaggagtcccagcgcaagctccagtcgcagcagcagcaggagcggcaggctcgcgccacctgggagcggatgcgcaaccaggtgcagggctacggcggcagcggcaccgagcacaagcagcgcaatccgtaagtcaccgcgaccaccggcccggctgagccagaacaggcacggccgggtccgtggctcacttcggcggacggaagacgtactggaacacgggcgtgtcgggccccggcgggtactgcgcgtccatgaacgcgaagtgggcgtggccggtgatgaccgcttcgttgaggctgtcatagagcaccgtcacgccggtggcccggccggacgcgtctacctggacttgaaccttgaggttgcctttgatgcccggcgtctgctggagccggttcatgtagagcgcgaccaggcccaatgacacccggttgtatatctggtcctgggtcccccgagcgggctgggacggcaaccggaagtggcgcaccagcgcggcggcttcgctctcggcctcggcgacccggcgctcgggcgcagccagcgccgcgcggtaggcggccagcgcatcctggtgacgctcctgcttcaacaccaatcgggcccgcagcacgtggatgtcggcgcgggcgggcgctcgctcggaagccttcaccaggtgggtttcggccgccttggaatctccgcgcgcttcggccagctcggccaggcgaagcaacggctccgggtcttctggcgcggcggcgacgagccggaccagggccttgtcctccacgtcggcgcggcccagctcccgatacaaccgcaccagcaaccccagggccgcaggctccatgccgcccagctccgcgtagcgctccagcgacccggcggccttctccttctccgaggcggccagccacaggtcggcctggagccggtgcgcatctttgtcccggggcttgagggccaccagcttctcgcccgcggtcgccgccgcacgcacgtcgttggctgcgcgggccaactgcgccagcttccgcagcgcctcgggctgctcgggccacgcctccacggtccgcgtcagctccgcgcgcgcgtccgcttcccgctcgggaatccccgccagcaacatggccagggacgtccgaatctgcggcgcatccaactgagcgagcgcctcacgcagccggacttccgcctccgcgggcttgccctccgcttggagcaacacgccctgcgcccacagcgctggtgcgaagccagggacctgcttcagggcggcggcgatgggcggtcgcgcctccgccagcagcccccaccgcacgtagatgagccccatgcccacgaagggccacggattctccgggtccagggtggagagcgccttcagctcgttccagcacgcgtccgagggaaaggtgagccacgcccggtacatccgcggcatcaaatccccgggccggacccgtgactgctcttccagctcgctgtccatcgcgctggcacggccgcgtgcccgggccgtctccaactgccgcagcgtcgccatgacctcttcgggaggaggcaagcccgggcgcaccaccgccccccgtgccggcgcggcaagcgcgagcaacatgacgcacagcggaagcgcgaacgaacgggaggccatgaggcgcgcggacgatagcagacgcccgtccagcggaggctgcctgctcccttggcagcacgaactcattgatttcagggaagccccgctccggaaggacgaaccttccggagcggcgcctcgaccttcacctcaggacgacgggctcagccaatctccagccggcacgttgagctgcaaccatcgcggctgacggtgttgccgtcgtcgcactcctcgccctcgttctcctgggtttcgccgtcgccgcatcgggggccccagaggcagccacggccgcactcaccatagccacccgcgttgacgccgtcgtcgcactcctcgccggcatccgcgtccaccacgccgtcgccgcaggtggcggtgcactcggtgcgggcggtgaggaagttgttgagcgtgaggcggtacgacgagccctcggtgtggcgctcggcctggaacaccaccacctcgtagatgccgccccgccgcagccccagcgtgctcgcctggcccgacatgaagatggtgccatccgccgggccgtgcacgccgcccaggtccagcgccagccggccgttgacgaagacccacacgtcgtcgtcaccgcggaacgtcagctcctcggagcccttgtactcgaaccagtagcgggcctcgctggtgaagtggaagttgcgctgctgcctcgccaagtccctgcgcagcggctcgtggccctcggccacccaactgccgctgacatcgtcgagcgggaagaacgcatcgttatcgaacacgtacgagccatcggactgccgccccagcacgaaggagccgacgatggtcttgttgacgttctcgaccgccttgtaccactggtcgaaattggcccggttgctggtgttgttcgacgcctgtccttccttcgcgtagacggggcggccattggcatcgagccggttctcgacgatgccatcctcacggcccgcgttccggttctggaagtcctcgtggccgcggggcaggtcattcgccggatcggcgggcaggtcccaaccgcggaagtcacggtagacgacggggatggacacctgcgccggcggctcctgctcgatgagcacgcacgcgaagccatcctccaacttgcagtccggcgagcagccgtcattggcgcgcgtgttgccgtcgtcgcactcctcaacggcgctgttggggaggatgagcccgtcgccgcacgtctcctcgcagtttccatccgagcagcggggctccttggtgcacagcggcgagcagccgtcacccatcacggtgttgccgtcgtcgcactgctcggtgccctcggtgatgccgtcaccacaggtggtgcggctgcacggctgacccggcgggcacttccagccttcctcgagccggcagacgtcgctgcagccgtcgcccggagtggtgttgccatcctcgcactcctcatcaccggcgatgatgttgtcaccgcactccttggcgcggcagcggccaccctgggccgggcacgcccagccacgttcgacccggcagctcccgttgcaaccatcaccgctgaccaggttccggtcgtcgcactcctcgccgtcctcgacgcggccgtttccgcagttcaccaggtggacgcacggcgctcctggcacctcgcagatgaacccgccctccaccgtggtgcacgtcgcgttacagccgtcaccgtccaccctgttgccgtcgtcacaggcctcgccggactggcgctggccgtcaccacagtcgtcgccagcatccggcgtcgacccgtccggggtgttcgggccggtgccggcatcgggcttcgtcgagcctcccccgccgttacaggccaccaatgtgaagagaagagatgcgagcaacgcgctcgccagccgagacctgcgatgggggttcaccatgggagcaaatgctgaaagtgcttcgcaccgctgtcaacgcgtcacggcaggtcaacggatgcgcggtgcagacggcgcacagatgtgcaggcagaacggactttccatgagctccccgtctgctgcgcacatctacattcatgacaacaacgcctgaaacatcactttcgtagaaagtcggaagcggcgtgaagcacggggcgcacacgtcccgtgcgggccattccccccgttcccaccggcgtcactgggccacgttgcggacgtattgggcatagaagcgcaccgcgtccgcgtagcccttcaccgacacgcgctcgtccttgccgtggaggcgtgacaggtcggcgccgtccaggcgcagcggcatgaagcggtagacgttctcactcagcccggtgaagtagcgcgaatccgtcgcgcccagcatgaggtacggggccacgacgacgtcggggaacacctggcgcacgctgcgctggagctgcgaccacgcctcggagtccatgcgcgacacgggcgacggttcactgatgaagcccagcgtgcgcaccttcacccgcgggtcatccaccacgcgccgcacgtgctccagcacgcccgccacggagtctccggggaggatgcggaagttcaccaccgcgcgggcgcgggcgggcagcacgttgtcgcgctcgctgccctcgaacatggtggccgcggtggtggtgcgcaccgccgcgttggtggtggccttcgcggtgagctggcgcagcaccagcggctcgaacagccacaggttggcgaagagcgtgcgcatcccgaagcccatctccggccccgcgaactcgaacagggcccggctgccaccgcgcagcttcgcgggcatgggcgcatcctccagccgggagatggcgcggctcagcacgcccacggccgtctggggcggcggcatggacgaatggccgccttcgccatccgccaccaactccgcgctggcgaagcccttctccgacacgccgaccagggccaccggtgaggccacgccgggcacggtgccggacacaatcatcccgccctcgtccagcacggattccagcgtcacgccccgctcgcggagcagcttcgccatcgcctccgcgccctcgcgcccacccacctcttcatccccaccgaaggcgagcagcaccgtgcgcttgggctggaagcccgccgcgagcagcgcctccaccgactccaggatgccgaacacgctccccttgtcgtccagcgcgccccggccccagacatagccgtccgccaccagcccgctatagggcgggtgagtccaggacgcctccgtgccgggctccacgggcaccacgtccaggtgccccagcagcagcgccgggcgcagcgacgcgtccgtccccgtccaggtgtacagcaccgagtgcgcccccacgggctcgcgcttcagcgcctgatgaagccgggggtattgctcccgcatgtagtcgtggagcgcggtgaaggcggcgtcctccgcagcctgcccctccgccgccgccagcgtcttgagccgcagcgcaccgcccagccgggccgcggcggcatccgcgtccacggtgaactccgcgggcgcctccggctggacctgccgagaggtgaagcgaaaagccttcgtgaggagaacccccgcgagggcaacgacgacaaacaacaacgacaagaggatgcgtttcatcggcaagactcgcggtggggacgcctcacgctagcaaaggcggcccgccaccccactgcgtctccagggcagagcctccacggcaggcctcgcttccacgaaccacggctttacagaattgcaaccattttccatgttcgccgcgaaacgcaaggcgtgtagatgacgcggctcgtcgcagggggtgcgcagtgaagaagccgtccacggtgtggagacagctctggcttggcctggtgttggggacactcgctggctgcaccgctggaggcgcggaggacccgggtcttccgggcgccccgggcgcggccacggcccaggcagccgatgccgaggccttggtgacgtggctgccgcccacgagcgacggcggccacccggtcatgtactacatcgtgcgatgtgagcccgcctgcggcggcgccatcgtcacgtcggacgagttccaggccaccgtgcgcggcctccacaacggcttcgcgtacaccttcaaggtcgcggcggtgaacatcaacggggaaggtcccgcctccgtgcagtcggagctggtgacgccgcagcccggcctctccatccccaaccccaccgtcccgggccaaccccgtggcgtccgggccacgccgggcaacggccacgccttcgtgagctggctggctccagccagctacggtggccggccgctgcgccaataccggctgacggcggagccagggggcgtctccgtgatggtggacgcgccggccgcgagcgccgtcatccccggactggtcaacggcgtgccgtaccgcatcaccgtggcggccaccaacgagaagggggaaggccccgtcgcggtcgccaacaccatccagccccgcgccgggggcgagcccaccgaatgggtgacgggctacttcgtgggctaccaactgtggatgcagccggtggacgcggtggacctggcgggcatcacccacctcgtcgtgggccgcgtcaagccgaaccccaacggcaccctcaacgcgaacttcgacgccaacatcgacgacagccacggccgcgccatggccaaggccctggcgacgcgcgcgcaccagcaagggcgcaaggcgctgctgatgctcggcggcttcggcgagcatgagcacttcgtgcacgcggcgtccgaggcccagcgcgcgcacttcatccgcaacatcatccagctcatggacgagctgggctacgacggcatcgacgtcgactgggagcccatcatcctggccgcggacatcccggaaggcgcgcccatggagcccgatgacggagagcccctgctcgcgctgctggagggcctgcgcgccgcgcggccggacatcatcctcacagtgccggtggactggctgaactccaacttcaagatgagccgctatcgcgccgacttcatgaagcaactggcgtcgcgcgtggaccagctcaacatcatgtcctacaagatgagcggtcactggggcggctgggagagctggcactccagtccgctctacggccactcgcagttccaccccacctccgtctcgcactccgtggagggctacctggacgcgggcgtgcccgcgggacggctgggcatgggcattggcttcttcgggacgtgctggggcggcgtgacggagccgaacactcccctggatggtcgtgagggtgtcttcgagggccagagcgacaacttcatgagctacaccaacatcatgacgcactactaccgtgcggacgccagccgctgggacgacgaggcgaaggttccctacctatccttccccaccggccacggcccggggctctgcaactacgtctcctacgaggacccgcgctccatctccgtcaagggccagtacgcgcgcgagaagaacctgggcggcgccatcatctggaccatcagccaggggcacttcctccagccgacgaacggccacagggacccgctgctggacgcggtgaaacacgccttcctggacccgtgagcgcgggaagcactggcggcggagcgcccgctcccgcaccatggcggccatggagacttcgaagtccgtagccaccgcgctcaccatcggcggctccgaca

SEQ ID NO: 1161 - DNA, 17654 bp, Myxococcus xanthus
  unsure (1)..(17654): unsure at all n locations
gggcgccccgtgcgcgttcgaagtcgaagcggcccgtgttgagcacggcggagggtggcacgcggccccgttcggaggtaacgaggtgcgcgtccgggttgagcttgcgcaggatgtccttcagccgggccagctcctccgccgggacgaggtccgtcttgttgaggacgagcacgtccgcgaactccacctgctccaccagcaggtccaccacggtgcgctcgtcctcgtccgccgcggccagtccgcgcgtggcgaggtcatctgcggcgctccagtcccgcaggaagttgagggcgtccaccaccgtgacgagcgtgtccagccgcgcgacgtccgacagtccttggccctgctcgtccgtgaaggtgaacgtctccgcgacgggcagcggttcggagatgccggtggattcgatgagcaggtagtcgaagcggccttcccgggcgagccgggagacctccagcagcaggtcctcgcgcagcgtgcagcagatgcagccgttggacagctccaccagcttctcgtccacgcggctcagcgcgccgccgcccgtcttcaccagccggccgtcgatgttcacctcgctcatgtcgttgacgatgaccgccacccgcaggccctcccggttctggaggatgtggttgagcagcgtcgtcttgcccgcccccaggaagccggagagcaccgtcaccggcagccgggccgtggccgcgggcgccgtcatggcttgccctccacgaacagcacatgcttgcgcacgcgcgggtcgtacttcctgagctggagcttctcctgcgacttccgcttgttcttcgtcgttgtgtagacgtagccagtccccgccgacgacacgagatggatgatggtgcggtttcccttgggcatggtgggctccagcctcgcggacatgacagggcacggcgcggcgatgcgctgccgcggagtcacgtcgggacggcggtgttgatgtgttgggtgctgttgtatctgagttgcgtttgtggcgcaagcaactgcgcgggctggacgtccggggagcgcgcgctgctaagcctcggcgtcttcgtccacgtccggggcgcgagtcgcgctgcgccgcttccggtaacgcctgatggcgcgctccaggggacgcaggcccgccaggcacagcagggcaatggtcatggtggtgacggcggcgaagtagaagcccaggccggcggccaggcccacggacgcggtgagccagaggttggccgccgtcgtcaggcccttcacctggccgttgtggcgcaggatgacgcccgcgcccaggaagccgatgcccaccaccacctggctggcgatgcggctgatgtcaccccgggtaccctctggggtgtcagggcccaacgccacttcgatgaagacgctggccagcgtgaagcagcacgcgcccagggagacgaggatgtgggtgcgcagcccggccgcctggccgcgcacctcacgctccaggcccagcacgccccccagcagggcggccagggccaatctcagcgcgacaatctgctcatccacgaacggggagcctactcacccagctcgattttctcgtccttgtccgcttcgctcagttcgggattgggcaaggtggccagcgtggccgtcagcagcttgctggatggcaccacgtagggcgccacttcttcacccagctcctggacgtactgacccacgcgctgctcgtagtcctcgtccttggagttccagctcccggcggcgtcggcggaccagacctcttcaccgtcgcggcagcgcaccagcttcgcgctcaccgcggcctccgcgccgctgccccggagctgaatctggggagacagccagagcacgccctccagcccctccacgcacagcgtcttgaacgtggcgtccgtgggcacgtcgggcagcgccgcgctctccttcaccaggaagtcgcggttctggttcacccactggcgggcgatgaggctccacagctcgcccacggcgaccttgccgtcgggcagcggctgcgtcaccaccaccagtcgcttcacctggtgcttgtccaccgtgtcgtagtcactgcgcagccgctgattcttcaccgcggagcatccggacagcaggcccagcccgagcacgggcaacagtcgcttcatcatgatgtccctctcccggcccccttccgcgggaagggggcctccttcaggtgcatgcccgggccagacggctcaggccgccttcggctcggagtccttgccaccgccagtcgagccgccctcaccggaggacgcgcccgactcgcgctgacgccggtcgtacatgagctgcatcaccgcggccagcaccgtgaaggacaccaccagcgtggtgatgaggccaatgcacgctaccagacccatggagcgcaggccgttgtgggccgcggccagcagcgccgcgaaggccaccacggcagtgagcgtggaggacgcgacggccgcgcccacgctgcgcagggccaccaggggggatgtgccctccaggaagcgatggagcaggtagaggccgtgactcaccccgaagcccaggaggatgggcaggatgatgatgttcatgaagttcaggcgcagccccgtcagcgccatgatgcccagcatcatcgccacgcccacgccgagcggaatcacggacgccagcgccagcttcacgttgcggaagtccaggaagtgcatggccagaatccagatcgcggtgagcaccacggtgaccttgccgtcccagaggacgatgcgcgccagccgcgcgtagagctgcgtggcgcccgcggcgcggaactccttctccaccgtgggggccttggggtcccacgcgtcctggtcgaacttgcccggcgtgtacgcggccttgatgaccttcgtctcgtcggagaacttcagcatcttctggccgtccatcaggtccacgctcgcgtagatgtacgtgaggtagccgtggttctccggcttcgcggagggcaggttgcggaactgcgcggtgtagttggccgggacgccgtggacgtcgaagggcttggcgtccagcaccttcttgaagaagtccgcgttggcctgcatctccggcggcagcgcggcgacggagaagccctcgtcctccaactgctgcatctccgccttccactcctccagcaccttggcgttggccgcggccgtctccgccgggggcacgaaggtgaagatgctcaccacctggtcgatggaggggtacttgtgcgcgttctgcgtcagctcccggtacacaccttcggcctcgtccaggtccttggtgtagatggccatcgggtcgctggagatgttgaagcgctcgttgatttcgtcctggagcagcacggacgacatgccgtcggggatgagcgcgcgggtgttgtagttgaagctcacgccgtacttgaggcgctcgaagaagcccagctccacgcccttgggcggctcctccgaaccggcccagggcaccgcggcggcgcagatgagcgcgacgatggccgtgctgatgcccagcaccatcttcggcttggggatgcgcagctccttgccggtggtggcggagttggtgggcggcggcttcatcacgccgatgagcttctggggcagctccgggttgatgcggccggccagcgccaggatggccgcgctccagcagaacagcgtcaggcccaggatgagcgtgcccatgccggccaggaagccgaactggctgaagccgcggaactcgctgaccatcagcacgaagaaggagcccgccgtcaccaccgcggccaccgcggccggacggcccgcgttcatcaccgcgtcccggatggccacgtcgtacggcttgcccgcgcccaactccagccgcgtgcggaagacgaagtggatgccgtagtcgatgccgaagccgagcaggatgccgcccaggatggacgtaatcatgttcagctcgcccaccgtcgcgtaggtgaacccgagcgtataaatcgtgcccaccaccgtgccgatgacgaccaggaaggtcggcgccagcttgcggaagaagatgatggtgatgaggaagatggagcccagggcgatgagcgtcaccggctccagcgactcttcaatcgcgaaggagtcatccaccgtcgtcttgtaggaaccggtgaagccgtaggcgatggtcttcccatcacccatcagcttgtagtcctccaccagcttcaccttgcccggctgcgcggagtacgcgtcaatctggcccttgagccgctcgagatagtccttcgtcttgccgatttcggtgttgtcccacatcggcttgacgagcagcatcaacatcttcttgtcgttggagatgttgtagtcgtcgcggatgctcttcttgccaatggaagagtacttgtcgaccaggtcctgcatgtcgagctcgacgggcttggagccgcccaggtcgatgaagaacgggttgctgcgcttcagcttgtcgcgcaggaacgccatgatgcggcgcttgccctcgaccaggtcctccgtcttcacgaagaggaccatgttctgctggatgaactcgacgggcagcttgtaggagacgttgcggacgttctccttgtcgtcctgcatgattttcgcgagatcgtcggcggtgcgcttgagcgcggcctcgtcctccgagcgcagggcgaccatgaggaagccgctgccgcccaccatgtcgatgacctgcttgacgtccttcacctcttccaggtcctgggagatgaggtcgagctggttggagttgatgtgaagcttcgacgtcccccacagcgacacggccagcagggccagcatcaccaggaggaccgccccgggcctgcggaccagcagtccggcaaaggcgtgggcgaaacgggagtgggagttcggatttctatcgccgctcatgcggcggcgaccctactggcaaacgccctgacccgaaaggcaaagcccggccgcccggtcgctgccctgccacggacgcccgcgtcatggcggggcgccccagagcccgccctcagtgggcgggcggcgcggagacccgcagcacgtcgttttccggttccttgggaggtaaaaggaacgagcgcgggtgcttcaccaggtgcgagagcacggcgcgcaggaagggcagggcctcgcgggccgggacgtcgcgggcgcggacggccacccccagcgccagcgagaaggacaccccgaagttgatgaggccggtgaaggccatgcccgccagcgcggccaggaactccggctggagcaccgcgccgggccccatcgccgtgcccgccagggaaatcaagccgagcacgaaggtgacgtggcgcacgtccagccccagcccgaagaagccgcccaccaacggtcccaggaccagcaggaagcccagtgtcacgttggcccccaggccagatgccgcgtgctggaaggtatccgccaggcgccgggcgcgggcctcccccagaagccgccgcagcacgcggtggtgggccagcgcctcgggcagccgccggtacaccacgaagttctccagccaaccgcccgccacgctgctcatccacagaaaaacgcccgtgatggcggcgaatatcaacgtgccgctcttccacggatgcagcgaggccaacgtggcctgggccttggccgggctcatgaaggtgtggccggtgatgaactcgtaccccagcgcgaacacgatggccgtcggggccaccacgcccaggttgcccatgaaggccgccaactgggaacgggtgattcgcgggatgagctccaccaggctcgccagccgctgcccccgggcaccttcccccaccgcgcccgccagcgtggccgccgtcacggacggctgcttggtggccagggtgaagcccagcgcttggatgaggaggaaggccagggcgtagttgaggcccacggccaggaaggagaagaagggcgccagcatcaggcccgacaggaacgtcttggtgaccaccgcgatcgccgtcaccagcccgccgcccgccgcggagtgcaccatcgcgtggaagccctcgcgagtgctggtgatgtagtgctcgccggagtgccccgcgcgttcgatgattttgcgcgccagcatccgcatgttgcgcttcaccagctccaccacggagcggtccgcgtgcgcgcgccgcagcaggtccgacaccagcgtcatggcctcgcgccagcgcgcttcgcctcgaggggcccccagcactcgggcaatggcctccatgcgctccaggccccggcggatgcgctccagccggtacaccaggtccacgctgacgcccgagtcctccaggtggcgtgacacgctggccaccacctggcggcagtcggccacgcattgcgataaatcccgcagcgtgtccgccgccgcgtcgcgcgccaggaccgcgtcacagaccagccgcatccgcaggaagggcgaggcgcggaaggacgtctccgggctgcggtcgcgcacgtcctcggcgatgcccagggccgccacctgcaccgccagcagcagcagcgcgtccatcaaatccgcgcgcacgcgggcggcgggcatgggctctggcgacgcgggttcgccgaccagcgccgcgagctgcgcgagccgtgcgggggacagccgtgccagccaatccgcgtcgtccgggttcgggcacaggcgcagcagcagctccgacagcttgccgcgctccggaggggcgggcagcagcgaacgggcgagccggtccgacgcctccgcgaagaagccctgtccggcgggcagccctacctgggcgaagagcttgaggccccggctgccctcgaacacggcggccaccagccgcgtgagggcggcgcgcatggcgggctcgccttcgagcacgcgcaccatcagggccagccggctgtcggcggcggagacctcgggttcggaggcgtccaccagcgcgtgggcggggatgcgctcgcgcagccactgcatccagcgctccacccattggagccggtcctccaggccgccctcgggcacgtcgcacagcagccggtacaaatcccgcacggcggagtggcccggcgcccggggcgcgtactgcatgcagaacgcgtccacttcgcgggcggagggttgctgcctgggggcgggggacggcacgggggcggggtcggtcatcggccaggcacgaggggaagggcgactctacgcgaagcacggaccccgcgaaaacaacagtggtgcggccgggaagcctggtggcccggccgccgggcaggtgcgggctacttcttcttcaccttcgccagctccgtgcgcatgcgctccagcaacaggtcccagccgcccttctccatcagcggcttcacctgcgtgtcccggatgtcctggagcatggacgagcccagcaccgtcacgtccacgaccttccaggcggcggcttccttcaccagccgatacttgagcttcatctcctgcgtcttcagcgggtgcttgatgaagacggtggaggccaccgtggcctcggggccctgcacctgcgagggctcgtaggtgatgctgtccaggttcttgaagttctcccgcacgcgggggaaggcgatgttcgcgaagaggtcctggaacagcgtgacgaactccttgcgctgcgcatcggtgcccttgtcccagttatcgccgagcaggaactttccctgctcctggctgccgaagtgcttgagggccagggcgtcgcgctcgtagcgcacggactgcaccacggtcttcaccggcttggcgatggggtcttccttcgcggcgagcgcggggagggcgaaggcgaaggtggccaggaaggcgagggtacggaagcgggcgttcatgtcgggctgttcctccagagcggatgcgcggacgtctgttagcccaagggaacgtccggcgcctcgcgaaattcatgctggggtgggaggcggacatccggtcgtagttgcctggtcgctgttcgctggcggattccgaaaagttgaatgatgcggccctcttgcgcgtttgactcctctaggacgccacgtctagtgtccggccttcgcgcactgtcagcgcagcctctgagacgacatgcctaccgacttcctgttcacgtctgaatccgtcactgaaggccacccggacaagatcgccgaccagatctccgacggtgtgctggatgccatcatcgccaaggaccctcaggcgcgcgtcgccgtggagacgctcgtcaagacgggcctcgccatcgtcgcgggtgaggtgacgacgaactgttacgtggacatcccgaagctcgtccgcagcaccatctgccgcatcgggtacaccgacagctccatgggctacgacggcaacacctgcggcgtcatggtggccatcgaaggccagagccaggacatcgcccggggtgtcgacaacaagaaggaccagggcgccggcgaccagggcatgatgttcggcttcgcctgcgacgagacgccggagctgatgccggctcccatccactacgcgcacgccatcacccgccgcctggcggatgtgcgtcgcaagcagcacccgtggatccgcccggacggcaagagccaggtgacggtggagtaccgcgacggccgccccgcccgcatcgacgcggtggtggtgtccacgcagcactccgatgaggtctccaacaagaagatccaggaggccatccgcgaggacgtcatcgcgaacgcgctgcccaagaagctcatcgacaacaagacgaagttcttcatcaaccccaccggtcgcttggtggcgggtggccccatgggtgactccggcctgacgggccggaagatcatcgtggacacctacggcggcatgggccgtcacggtggcggcgcgttcagtggcaaggacccgtccaaggtggaccgctcggccgcgtacatgggccgtcacatcgccaagacggtggtggccgcgggcctggcccggcgctgcgaggtgcaggtgtcctacgccatcggcgtggccgagcccgtcagcgtcatggtggagaccttcggcaccgccacggttccggaagagcgcatcgccctggccgtccgcaagacgttcggcctgcgtccgcgcgaaatcaccgagtacctgaacctgctgcggcccatctaccagaagaccgccgcctacggtcacttcggccgcacggagaaggagttcacctgggagcgcgtcgaggagaagaaggacgcgctgcgggatgccgccaagagcgccacgccgtcaggtggccgccgcctgaaggccgtctgagacagggcgcttcgattcggcccccacgctgcctcaccggcgcgtgagggcccgcaagcacacgggccgcttcccaggaagggaggcggcccgttgtgtttctgcctgggcgcttcgctggcgcgcgagcccggcgtgctcgaggcttcgtcgcggccaagccctcgccccggtgcaggcgggcgagggcgacagcggaccgctcagtagcggtaggtgtccggcttgtacgggccggaggtcttcacgccgatgtagtccgcctgctcctggctcagctcggtgagctgggcgttgagcttcttgagctggaggcgagcgaccttctcgtccaggtgcttgggcagcacgtacaccttgccgacctcgtagttggcgctgtgcgagtacagctcaatctgagcgatggtctggttcgcgaacgagctggacatcacgtagctggggtggccggtgccgcagcccaggttcaccagccggcccttggccagcaggatgatgcgcttgttgtccgggaagatgatgtggtcgacctgcggcttgatctcctcccacttgtacttctccagggaggcgacctcgatttcgttgtcgaagtggccgatgttgcagacgatggcctggtccttcatcttggccatgtggtcatgggtgatgacgcccttgttgccggtggcggtgacgaagatgtccgccttgtccgcggcgtagtccatggtgacgacgcggtagccctccatggccgcctggagcgcgcagatggggtcgatctccgtcacccacacctgggcggacagcgcgcgcagcgcctgcgcggagcccttgcccacgtcgccgtagcccgcgacgacggcaatcttgccggcgaccatcacgtccgtggcgcgcttgatgccgtccaccagcgactcacggcaaccgtacaggttgtcgaacttgctcttcgtcacgctgtcgttgacgttgatggcgcggaacaggagcgtgcccttggcggacatttcctggaggcggtgcacgcccgtggtggtctcctcggtgacgccgagaatcttcgcgctcttgcgtgtgtaccaggtcgcgtcctcggccagcttcgccttgatggcggcgtacagctcgcgctcttcctcgctctgggggttggcgaggacgctggcgtccttctccgcgcgcttgcccaggtgcatgagcagcgtggcgtcaccaccgtcgtccagaatcatgttcggaccctcgtggtcgctgcccgcggggccgaagtcgaagatgcggtgggtgaagtcccagtactccttgagggactcgcccttgtgcgcgaacaccggcgtgccggcctgcaccagcgcggcggcggcgtggtcctgcgtggagaagatgttgcacgacgcccagcggacctcggcgcccagcgcctggagcgtctccaccagcacggccgtctggatggtcatgtgcagcgagcccgtcacgcgcgcgcccttgagcggctgcgtcttggcgtactcctcgcggatggccatgagcgcgggcatttcgctctcggcgatgcggatttccttgcggccccagtcggcgagcgacaggtcggcgatggcgtaatcctgcttcagggacttggttgcggcggtcatggcaatggctcctggtccagcgggcgcggcgttccgggctcggggaagttcggtgtggatgcttgcgacgactcaccctcgcaagagacgcgtacaggtgagcgccgttgggtgattccgcttcgagcctggggccgggtccggcctcgcagcgctcctcgaagtcagcggggaacctacgaaaaggaccccttcatttcaacgagagactgccgcccccgggggcaggcggacagcctgctccatccacttccagacgcccacctagcgagggaacgtggcgagcgtgagggactcgggagggacggccagctccttgggcgccagcgccacgccggacaggtagcgccagccggtgccgtcgtgccggaagtcggagcgctccacgaaggagcggtcctttcccttctcgaacaccttggcgaagaagagcacctgcgccaggccgtccgcgtccggttcccggcggtccatcaccaccagcttcgggtactggtgcgcctgggcgaaggcgcgcagctcgcgcagcacctcgtcctggggccgcgcgcggtccgggtggtgggggtgcagcgtcttccacagccaggccacttcgcgcagggcgaaggcgctgtagcggctgcgcatgaggcgctcggcgtcgggcggctcggcctcgcctcggtggaagggcgcgcagcactcgcggtagcgcaggccggaggagcagggacagaggggggcagggggcatggtgcggtccgagcctacccgtcccgcgcgggccgtgggtgttcgtgcgtacagaggcggtggaacacccttgctgggcggggagagcgggcatacatccgggggccgcaccctatgagcctcctcgaagccatcgtcctgggtctggtccagggtctcacggagttccttcccatcagctccacggcgcacttgcgcatcgcgccggagctgttcggctggagggacccgggcgcggcgtactcggcggtcatccagttgggcacggtggcggccgtgctcatctacttccgcaaggacatcgtgtcgctggtggcggccttcttccgggggttggcgcggcgcgagcccttcggcacgctggaggcgcggctggcgtggttcgtcctggtgggcacgctgcctgtcggtatcgccgggctgacgttgaagaagttcatcgagaacgagttccgctcgctctacgtcatctccggaagcctcatcgtgctggccctcatcctcctcgtggtggagaagcgggcctcgcaccagcggacgctggcggacatgcggtggaaggatggcatcctcatcggcatgtggcaggcgctggcgctgattccgggtgcgtctcgctctggcacgacgctgacgggcggcctgtcgctggggctcaagcgcgaggatgcggcacgctactcgttcctgctgtccatcccggccaccacgctggcgggcgtcttcgagctcaagcacctgctggaggcggagacgcggccttccgcgatggcgctctgggtggggacgctggtggccttcgcgtcgggcatggcggccatcgcgtggctgttgcgcttcctgcgcacgcggacgacgttggtgttcgtggtgtaccgcgtggcgctgggcgtgctgctgctggtgctgctccagacggggaagctgagcccgatgtcgggagtggagaacgtggaggtccctggcgagccaggggctccgccggtggagaagcagattaccgactagcgtgagaggacgtgggccgtgagtgtggaggcgctgttccagacactggagtcacggctgtcctctcggccggcgcgtgaggtgcacctgccggggtggaccctgcgggaggcctcggtgctggtgccggtgttcgagcgggacggcgtgccccacgtgctcttcacgcgcaggcccgcgacgctgcggacgcatgcggatcagtacagcttcccggggggaggccgcgaccccgaggacgcgacgcccctgcacacggcgctgcgcgagacggaagaggaactgggcatcgaccggcgcggcgtgcgggtgctggggatgctggatgaggtgcccacgatttcgcagtaccgggtgcggcccttcgtgggcgtgattcccggggacgggaagtaccggccgagcgcggaggaggtggccttcatcctggaggtgccactgtcggggctgttggacccgtccatcctccgcgtggagcagaaggaaatcatgggggcggagcgggacctgtacttctacacgtatgggacgcacgtcatctggggcgcgacggcgcgcatcctgcgcgacttcctgaaccacgtgacgcaggtgcctggcggggcggggtagggcgccgtcgcgtcagaccagtcgggtccggaactggagccaggggacgagctccgggtgcttctgctccacctgtgtattgtgcagggcgtgggccagggtgttgagcccgtgcttgagtcttcgcatggcgcggagcttctcgatgggaactgcgtgaaggtctcccagggctatccagtgggctgcttcctctagcggcattattgtgaggcgctggacccactcgacgatgggttcggagtcgaggacgaagtcaccttcgcgttcgccaagctctgcaatcatccatgcgcgcaggctcatctcggagaggctgaaggagtattcctcctcgtcggaatggcgttgtgcgagcaccccgtaaacgagcagcgcgatgtgggcccaacccaggctccgttcttgccgggcgcggagcgcgagagcgtaggcaaatccatgccaattgaagtgcgtgccgtcgacgggctctccgatggaaagaccgtcaagccactccctgattttggggagcggccacttcaagacggtttggaccaacgaggagtttgcttccatggcctcccattatgggggaaaggtgattccatattgagcgaaggcttttcggccaagctcaacgactcgcctgctcatggcttccgatgctcctttgaggtaatggccactctgaggggtgattcggataccaaaataagtggtcccgtggacggccagttctgcttcacccgctgccaccacaggttttcctccgctggcgacggcatgggagatttctacttcgctccacctgtgtggaacgattcggagctgtccctcttgagtgagtacccacttcactcgttcccctcgggcataacgcgcgaactgagctgaatctacgctgactggctggacccccagactgctagctatttcaagctcttcagggagtaggtcgggtagttggttggtgagtatctgctcggatgaagtgctgtccgtccggggcgatttctcacttcctggaccgcgagccgtcatggcgaccgcatggggcgcgaggcccacggtcatgactccctctgccacggtgatggagcgcactcctcctgccatcgccgcggacagccggaatcccgcctgcgcctccgcggccaatgccgcgctggcgaagccgggcagcgtcggtcccttggaggccatgctcgccgccccaccactcagcgccgccgtcagcgcaaggatgagcacgcgcgctccgttttctcccatgactcggccgaagcggtgccccgcgtactccaactcccggaacgactccgcgcggtcagcgtccgccgacagtctctgccagccctccacgaggcccatgaatgcgtccacgccgaggtaggcgaggacgaaggtcgtcagtgcgacggcgacgaccttggttacgggctccggcgcgacgatgaggaacatgtacgcggccatcgccgacgtcagcattgccttgagcgcgagcgggttgacgacctccttcacggcgtcctgtacgccgtcccacacgccatcccaggcgaaggcgagcgccatctgtcggcgcgccttggcatccaggaaggagaagccaccctccaggagcgtgaggcactcgccaggactgtcctgtcgggagcaccagtcgccatagtcgcttccggcactctggggccccgagtcccacgaagcgagccgaacccgtggtcgctccgcggccccgtcgtggagggagaagcgcatgtccagcacgagccgggtcatcacccgccggaacgcgtcttcgtccacctcgaccggctttgcgctcttcggcgggaggtagacgatgggctcgccctgtcccgtatccaggcgcacgacacgcggtgtcgcgcagcccacgagaagcacgctcaagagcagtgcacctgctccacgcaacgtcatgtcgtccccctggcgtgtgctccgaacccgtgggagcactcgtcaggaactagcacctgcctctgacgccctgaggaggtccggaggcaccggaccccctccgttgcgactcacgccttctgcttctgctccaactccgcgcgcagcttctcttcctgcgcgcgcaactccggggtgaactcggcgccgaagtcctcggcctcgaagacggggcgaatctccagctccgactcctcgccgggcatggggggcgggcagcggcgcgcccactccacggcctcttccatcgacttcacctgccagatccaatagccggcgatgagctccttcgtctccgcgaacggaccgtcgatgacgctcttcttcccgtccgcgaaccggatgcgtttgcccttggtgctcgggtggagaccgtcaccggccaggagcacgcccgccttcatcagctcctcgttgtacttgcccatctcggtcatcagctgctcgccgggcatcacaccggcctcggagttcttcgtcgccttcacaatgaccatgacgcgcatcggttcttcctttcggttcgggaggcgctgcgtcctcgttcaaaatggcgacgaataagctcgaagcggatcgacacgaggcgaaaaatcgcgaggcaggctggctcgcgcctcagggaggccccaagagtccaagaaatatcaaggggttgcgtgagtcgtcgggccgactgagtggctgcgaacctcgcccatggcgcaacgcgagcgatgcgtgaggctcagcccaccgcgccgagggctgcgtcccgtgggcccttgcatcgcctctccgccatgacgctcgtgccgcccgctccatgtcggcccaggggcttgcggcggccgggcccagcgagccctctacgcgcacctcccatgcggcgttgtaaagcgttgatgccgacctcaccgtcccgagaggcgccgccattgcgggggcgcgcctggagccggacatggtacggggcgcacggaatgaagggggcaggctgtttggcgcactctcgcgcttgatggcgatgcctctccatgcactggccgcggacgcgctgccgtcgtggaacgaagggcccgtgaagcaggccatcatcgacttcgtcgcccgcgccaccaccaagggtggggccggcttcgttccgcccgaggcgcgcatcgccaccttcgacaacgatggcacgctctggccggagcagccgctcgtacagggcgctttcatgctgaagccgctccgttcccgcgtgaaggaggacccgtcgctcgcgaagcggcagccgttcaaggcgatcctggagggggacctctccgaactctccaccatggacaagtccaagctgatgaaggtgctgggagtgacccatgccggcatgaccgaagaggcgttcatccgcaaggtccgcgcgttcttccaacacgctcgccaccccaggtggagcgttccgtacaaccaactggcctacgcccccatgctggagttgctccggtacctgcgcgcgaacggtttccagacctggctcgcctcggcggggggcatcgacttcatgcgtgtcatctccgaggacacctacggcatcccgccccagcaggtcatcggcagccatctgaagaagaccttcgacgacgcgcacgctccctcggtcctgcgccgagaggcgcgcgtcgcccacgtcaatgacaaggcgggcaaaccggtgggcatcgacgagcacatcggccggcggcccgtcttcgcggcgggcaacgtgcgctccggcggcgacatccagatgctccagtacacgcgaaagcgcccgcgcccaggcttcgccttgctcatccaccacgacgacgcggcgcgcgagttcgcctacgaggagaaggacggcgcgtcattgaaggccgcgcgagagggcggctgggccgtggtcagcatgcggcgggattggaggcgcatcttcgatgaaacgcgagcacggactgggaacgggaggggatgaagaggcggcgtcccgcttcctgctggacctggccagggcactgcacctggcctatcaaccctcgctcctggtggaatcgcgcgtgcgccgggcggcgagggcctgggggctgagcacggaggtcttcacggtccagagcctggccatgacgcaggtggtggcccctcgacggtcgcccgccgacttcgngcggntgcccttcgcccccctcttcctgcccggcatgttcgacccgcccaccgccgcgcgagagctgtcggattccgcgcgcgaagaggagccggagctgctgagcgcctccggtgagctgccgacgctgcgcgagacgagaaaccgctgacctgtgcgaggcgctgaggcactccaagggcaacgtggccaccgccgcgtgcatggccagccacaaccgcacggacttctacgaactgctgcgccgccacggctgccccccctgagagcac

SEQ ID NO: 1162 - DNA, 18192 bp, Myxococcus xanthus
ggccgcccaggccattggcctctcgcaaggcgttggcaagcgcggccttcaaaggctcgccgcgaagcaccgcgatgtgcgcttcgagtgccgccgtcgcaccacgacgggaaggacgacccaggcggtccgggtctacgggcgttaccggccagacggaatccacgttgcctcagccctgccctttcagtcccactgccacgaccaggcagccctccgggctgcgcatccgaggcgcctgcccggcccccaggaagaaatatccgggcgccgagtacgacacgtcatccacttcgaggacaccttcgaccacctgaacccccacgcccgagggcgtcgggtggaacgtccagccgaagtcgccgccggccgtcacggacacccacattgccctcaacgcgtcttcccgcgcgatctgaacgtgggcgccccgcggcgaccagacgctcgcggcaggccgctgcccctgggtggccagttgctccacgtcctgacgcagcgcgatgaagcgctccaccagggcgtagatgtcgtcgatctggaacggcttgaggagcatggcgtccgccacctgcggctggacggcctggatcacctcgtccggcgtcgcggcgctgacaatggccaccgcctgatgacgcttccgggcggcctcgacgaccgtccggccgcccagctcacctccggagatgcgcagatcactgatgaccaggacgaagcgcccggcctcgagggcctcgaccgcttcctccccggtgctgaccgcgtggacctgcgcgagctctgagatgagctcgcccatgccttcccgcaggctcgcgtcatcctcgaccagcaacaccctcattaacgggggacctccgccgcccctacctgctggagcctgtcctttaccaggaccgggcgcttccagcggaagaccacctcgccggtcctgcccttcggatgatggccctccccggactcgaaccgggacgcggggtcagccgcagcggattttgagtccgcctcgtctaccaatttcgacagagggccccctgctgtcgcgacgagcagacgtataccgcgacttgaaaccaagtgcatccgaagattgcggtgctccacgcacatcgctaagaggggccccccatgtacaaccttctcatctccctcggtgtgggaatcgccgtcgcgctcctggtgaaggtggccggcttctccatctgggcggggctcgtccccggaatcctggccctcgtcggcacctacatcgtgctcgctcgccgggtggccagccgcgtgcagtcgctgatgacggtggtccagaaggacctccagtcccagcccaccagccagaaggacgcccagtcgcgggtggaccgggcggtgaagacgctggagcaggggctcgtctacgacaagtggcagttcctggtcggtccggagctccactcccagatcggcatgctgaagtacatggtgaaggaccatgagggcgccaaggccgccttcgagaagggcagcggccgcaactacatggccaaggccatggaaggcgccctgtacttccagcgtaaggacttcgacgccatgaagaaggcgttcgagtccgccacgaagagcggcaagaaggagtccattgtctgggcggcctatgcctggtgcctgatgcagaacaaggacaaggacggcgcgctgcgcgtgctcgcccggggcgtagagcagaaccccaaggacgagaagctcaagggcagcctcgcccagctccagaacgacaagcgcctgaagatgaagccgtacgagcccacgtggtggcagttcgggctcgaggctccgccgccggtcatgccccccatgggcggccgccgcatgcagttcagcacccgacgctagcgacccgtcgcgcggccaccgagcgtccgcccgcgcacgggaatatctaccggtttgcccctcagcgcgctgcaacgtcttccgaccctgtacaacagggcgacgcagagggtgtgcaaccgcccggaaacactctgactgccctcccccaccgcggggcatggtgcttgctcccgcaccatgctcacggatgacggggaaaggcctcgtctcgcggagcctgacaggcttggcagccggaggtctcgggtgaaggttgtgggcgttggggtgtgcttgcaggaccgggcggcggcgggtgcgcgtggggcgcaggggcgttgggagcacacggaagggcgtggcacccgagactttcggcctgccatttcgcagcagccgaatgaagcggagtggtgcatggaacggcgcggccggacctccgagcggtcccttctgctcatcatcgaggatgacgcacaggtccgcgagagcctcgtagacctgctctccgtacgcttcgacgtgctcgccgctccggattcgaatgaggggctggagctggcgcgggagcaccacccggacctcatcctcctggacaggttccttcccagcggagacgggctcgcggtgctcgagttgctccagcgcgagtcgtgcacggaagccgtgcccgtcatcttcctgacgggcgacgcggacgaggccacgctggagcgctgcctggagatgggcgccgtggacttcatccacaagccggccagcgcgcgggagttgctggcccgtatcgaccgggcgctgcgccagagcgagcagcagcgccgactgcagatcctcgcgcagacggacggcctcacggggctcgccaacttccgtgcgctgagcatccggatggaagaagagttccgccgggcccagcgctaccagtacccgctgagcgtcgtcatcatcgacctggaccacctcaaggccatcaacgacggcatgggccatgacgtgggcaaccgggcgattctcgcgctggccacccagttgaagcacgagctgcgtgagtcggacttcgcggcccgcttcggtggagacgagttcgtcgcgctgctgccgcaccagacggcgttggaagcagccgtcttcgccgagcgcatccgcaccgggctgcgcgccgtcggcgtccagaagagcgacggccgccccgctcccttcggactgagcgtgagcgtgggcatcgccgaccataccttcgaagggcctcgcgaggacaccgagtcgctgatgaaggcggcggacgcggccctctacgaggcaaagcgcgaggggcgggatcgggtcgtcgtgttcggccggcccgcgaattcgcctccggcgcagcggcactgaacggggcgaggtgaggcaggcaacggcggggcagcagcgagggcgcggatgatgctggggaacagactggcgacgggttcgagggtggcggtggtgggaggcggcattgccggagcggggcttgccgcctcactccttttcaacgggagggctcgcgggctggcgctggacgtgcgcgtctactccggaggaacacaggagcgcaccgcaccgccggcggtgctgacgccggagtgccgctcacgcctggccgcgctgggctgccgcatcccctccgaatggcgtgcccatgagctgcgcggtgttgagatcatcgccgagggccggcgcgagctgctgtcctccacgcccggtggactctgggtggtggacggctggccccaggggttgggcggcctcgagcaggtgcgggatgtgctcgccaccgcggccagcgcccagggcgctcgcttccttccccgccacgtcgagcgcgtggagcgacaggcccccgcgccggatgcgcccgccgcggtgcgcggcgcgggttcgttggtggtacgcgcccagggaagtggcgatcgctttcatgcggtggcgctggcctcgggcgccgggccgctgatgggagacgccttcttcaagggcttccgccccgcccccaccatcccggcggtgcaggcccgcctgcgccacgcttcgcctcggctggaactggctccggtggcccggctgtggattgcgcccctgccagcggtcgatggcctgttcctgctgcctggcgccaactcggtgtacgcgctggccttcgggccggcggtgacgcccgcggacctgtgccaggtgctgatgatggccgcgcgtgacggcctggtggaggaaggcttcgagctggcggccctggagaccacccgcctgccctacggaccgggccggacgctggtcgcgccggggcagatcgcggtcgggcccgcggccttcggccacccgctccaggtgggattgtcggagacactggcttcgtgcagccgcgcggcggtggcgctactcgacggcgggctggacacgggcctcctggagcgccgctacgtgcgcgaaggcctgggcgaaatgctggaggacgccgccgcgggagcccggacgatgacctggctgcgccgagcggggcctcgggcgccggaggccttcgtcagggcgaaggggcgacggacgctgggtggcaccttcggcggcggggtgctgggcctgagcggaccctcgcccatcgcgctcctgggcgccgcgcgctgggagggactcaaggagctggtgggctcctggctgcgcaccacggtggagccggtgccctcggtggtgccggagttggagccggacctctactacgtcgtagatgacgacccggacgcacgcgaggcgctcacggcgctgctcgagagcaccggagccacggtggtgtccttcgccgacgagctggccctcttctgcgcggtggcccggcggccacccacggccatcctcctggacgtggtgctgcactgggtggacggcctgcggctggccgagggcctgaagcagcatcccctcacccggaacacccgcgtgctggtgatgagtggcctcaaccggccgcatgtccggcagcgggccctggacgcaggggcggaggccttcttgcccaagcccgtggacccagaccggctgctgcgcatcctcaccggccgagtccccgtcctggagcccgcgcccgcgccgcatgccgcggacgacacgcgcgagctggccgcggaccgctacgcgtcctgaccaccgccgggaatggcgaccacggagaccggggcgtggatggcctcggcgctcccgggcatcagcgccttgaggttgccgtggatcgtctcgcagatccgctccagcggcaggtcgttgtcgtcgtggccgaacgggtcctcgatctccacgccaatctcctcgatgccgaagaagacgtaggcgacgacgaacgtggccggcaccgttatccagccgaacgaatccaccagcgcgaacggcagcgtgtagcagtagaccatcagcgctcgccgcaggtgcatcatgtaggcgaacggcatgggcgtcttgtgaatgcgctcgcagccgccgatgtagtcgatgagcagttggacattctggtcgagctgcatctggacgtgttcggggtagtagccccgcagccggccctcatcgagcacggcggacatcttctgcgacaccgcgagcgggacgtgctggctgcccagcacggcgtccgcttcgtcgcgcggcagctcggaggcgacggggcccaggtctcgctcccctcgcagtgacgcggcggcggcataggggaaggcgctgatccaccgcaccagcgtgccgtagagcccggcgtcccgacgcatgaagacgctggatgcacgagccaggttgcgcgtctcgttgacgatgccgccccacagcttccggccttcccagaagcggtcgtaggaggcgttggtccggaagacgagcaacaagctgagcgagatgcccgccagcgtgtgcaccgtggccgggatgtccaggggcttggtgtggtgatgaaccgcggtgacgcccacggcccacaacacacagatgaggacccgggccacaatctcgcggaccatggaaccgcggaggtaatggaagtaactccaccaacggtgcgggtcatagtcgatcatattgtcgcagggcgcatacgctgccgcgcctgcgcggggcgtggcaagcgccaatccagggggacacgtgggatgtgtccgccctggacgggagctggtgcccttggccgcctgcccgtcaatgggagatggaggcaggcgtcgtcggaccgcccgagcggagcaccttgcgcacggtgagggcgcccgccatcagcgccacgccccggaagaagatgccgattcccaccagcgtgcccaccagccagacggcggagatgggccactgccgcatcacgacgatgcccaggaagatggacacggcgccgtagaagaagtcccagccccaccggggatagcggtccatcaccgaggtgacggcgtgaaagagcccgctggcgaagaagtagcccgccagcagcagggtcatggcccccagtcccgccgccgggtagacaaggatgaacagacccacgacgacggagaggatgccgctgagcaggtacagccagaacggcccgccctccttgcgcgtccggaaggcggagatgacttccatgacgcctgccgcggccagcatcgcgccgaagaggatggccgacaccaggctggtgaagaaggcggcccccagcgcgacaatccccagcagcaccatcaaaatccccatgatgaaggggccaccccaggccgccgagttcaccctcggcctcgagtcaggggtcaggatttccggtttgcgttcatcggtgaaggccatggtgactgctcccgaagcgagtgcacttcggaggccgagccgcctcgcgtctcgcccgcctgtcggcaggcgacaaaggaacccggcacatccatcgccgaacatgggctcccgcgttggagccgacaacgctcgctgacaccgctccgtcccccgcccgccccgacctttgggccgtcagggcgagcaacagccgccgagcggaagcgccgcctcgtacgggggagccaggaagacagccccgggctccttccggaaccacgtcaactgccgcttggcgtagcggcgcgtctcctgcgcggtgtcgtgaatggcctcttcgcgcgtcatccgcccctcaacgacggcgcgcgcctgcacatagcccacgctgcgcatgggcgccgaatcggcgtacccccgcgccagcagctcgcgggtctcctcgacgagcccacgctcgaacaacatccgcgtgcgcgtgttgatgagcccgtacagcacgtcgcgcggtggcgacagaacgtacagttggaagggatagcggtccggcgcgaaggcatgggccttccggaacgccgaggcgggcacgcctgtctgcgcatgaatctccagcgcccggatgacgcggaccaggtcctgcggaggaagcttcgccgccgtctccgggtccacctccgccagcctccgatgcaccgcctcgcgcccctcaccggccgccagcgcctccagctccgccctcaactccggcaaggccccgggcgcctcgagcacaccgtgaagcaacacgcgcaaatacagcccggtgccacccacgacgaagacaggccggccgcgtgcggcaatctccgcgatgacggcgtccgcacggcgctggtactcgacagcggagaacgcctccatcgggtccacggcggacaccaggtgatgaggcaccgcagccagctcctccgaggagggcttcgccgtgccgatatcgaagtgccgatacacctgctgcgagtccgcgctgacaatctcgccaccagcacgctgagccagcgcaatcgccagcgccgtcttccccgacgccgtcggcccggcaatcaccgtcaacagtggccgctgcgctccaccctcacccattcgccaacgctccctgaatcaccgccgccgcggacgcatcacgcgcgaacaccaaccgcacgggcgaaacctctgacagcaaccgtcccgccgcgccaagcagcccacctcgccccacgggcgtcgcctcgggcagcagggcattgacgagcagcatccgtccgacgtcgccagcggcctgcggctcccaccgcgacacgccgtcccacgccagcgtccccaccgcgttcaactccgcctcggcggcctgccccacgttccacggagtccccgccgctcgccagcccaggccgggctccggccacacagccaccaactcatcggacaacacctgcccgcccgcctgcgcccacaaggcccccagcgtgctcttccccgcccccgaatgccccgtgaagagcgcggcccggccccggtgcgccaccgccacgccatgcaccagcagcccgccacgtcgagccagcgcccgggcaagcatcaccttcagcaccgtctccacgggaaaccgcccctgcccctccacgtgggccaggaggccgtcggcggagagcgtcgcgtcgtagtcctcgccggccaggcgcagcgcgccgccctccccgcggaggacccgtggcagctcgcgaatgacaggtgcgggacgcgcctgggcgggggccacggccacgatccgagccacctcactgccctgtcgcctcggggacaccacgaaccgggagaacatgcgccggagcgagtctcgcaggcccgcatcaccgacttccacaactcccatccaaccggcgattcgcagacagagggccgcgtccgccgtggggccttccggcggaaggctcagggaatgcactccgactcaccggggatttggcactgggaaatctgcgccagtgccacgaagggctgctcccagagaatggccggcgcctcatagacagggccggcgtcaggagggggcgtcgtctggaaggcgtccgaagtcatggggcgtgcgagcgaggaagaagggacgttcttcaagggaaagggaccgggaacgcgcagatgcggccgtcttcggagcccacgtggaggcggctcaccgtgtggtcgatggtgggagtcccaatacgctgcgcaccaccaatcgagacctgaccggagtcggagccatccagcagctccagttggtgaacctgtccgtcggagctgccaacgtagatgcgcacggcgccattccgattgaaggagaaggtgccagagggagacgcgatcggcgtgctccaccggagcaccggcggcgactgggcgggccccgacacgtcgtacagcgccacccggccggccgcgagactggccacgaagcccgagccctggggccgcacgaagctggtgaaggcaggcgtgttcggcgccgggcgcgtggtgactggcaggctccacacgagctgcgccgtggcggcgtccacgccgtgaacgaagccatcgctgtccgtcacgagaatcaggttgctgtacgcattgcgaaccaagctcagctccacgtcgcccaccgggagctgggccagcacctgtcccgtcagcgtgttcagcacccgaagcgtgttcggcgagcccgcgtgcgcgcgcgtcgccacgaagagccggttgttggtgtagtccaccaccatgccgcccgccaccatgcccagattcccaggctggtagctccagaccagcgcgccggtggcggcattcagggccaccacccggttgcgcgaagcgtccgccagccgcgtggcgaagaagacgaggtcgcggttggggtgcgcggcccggtatgcggcattcgcgtagtcgaagagctgcgtgaccgggaacgactggatggtgccaatgggctggccaccattgtcccatcgccacagcacctgcccggtggcggcgttgagcgcgctggccaccccaccctggtcacccacgaggatgtactgcccggacaggccatgcagtggcaccaccgggaagcggctgccaatgaggcccgccagcggtcgaggccgccaccgctccgcgccatccgccgacggattggtgacctgggtgaggttggcgacgacggagtcgttgaaggcgctgaagatgcccgtacccagctcggtgatgggctgctgcgaggcattcaggcccaccgagtagcaccacagcggcgccgcgcccacgcgggcccgaggcgtggccaccagggcctgcgacgtcggctggttgcccggcgagtaccaccgcaggtcatccgagttgaagacgcggtagtagtacgtggtgccgttggtgacggacgtatcggtgaacgtcgtggcggcgccgacgtcgtccgcgtacaccacctgggcgttgcccagataggcccccaccgcgtagttcagcccctgcgtcggacagaggtttggcggcgcgccctccgcgcgaagaatcagcacgcccccgtgcaccgccgggttgtcccaggtgagcgtcacgctgccatcgcgcgccacacccgtgaggcggttgacgtcgggaacggtgccctgcgccagcgtcatgggggtttcgatgcgaatctgcggcccgccgtagtcgtcgatgaggtggaaacgatgacggaacgtggtgggcccggacagcgacgcgcccgccccgaagttggaatacaccaccgtgaaggagcgctcgccgttgaccgggatgcccgtggcgttcgtcgactcccaggtgatgcccgtggtggcgttgttggacgccatgcgccacccggtgggcgtctgcagcacgccgccgacggtgaagtagttgagcgcgggccgcagcagccggacctcatgcagcggcatggggccccggttctggatggtgtagatgacggaccggttcgtcgagttggcggccaacgcgctgatgttcgtccgcacgcggtgctgcacgatgcgcccctggttcgagtccaccaggttcgacgtcacggaggcgccgttgcgcgtggcatccacctgcccccggaaccggtagttcgcgaacggggttcccgtgagctggtacgtccagacgaagtgcgcggaggcgcccgggtccagccggggaacgctcgcgggcccaggccccgacacgagcgacacggccgccgttccctggaacacgggcgcgcgcggcgtcacgttcaggaacgtgtccgtcgaggacgggttggtcaccgtgagccgcacccgcacggtctcgttgttgaacgcgtcgtcggtgtccacgtccatggccaccgggagcgcccccacgttgaccatccgcgcgtccatcgagggcgacacagtgttgccgttcccgctgacgccccgcacccgcgccaccagcgttccggccgagcccgtccgcactctcgcggaatagacgcccgcgttccggttggcgatgttcatgcggaacggcgtcggctcggtgtccaccacctggaaggtgacggcgcccgcgcccgtggagggtccctcaaccgtggtgttgttgtggttcgtgcccgtccggttctccaccaccatccgcgcgtcgatgtcgccgccaacccccatcacccgaggacgcacgtccacctgggtgtacaggccggagcgactccagctcgcggccgaggtcgccaccgacgtggtgaagtcgccccccgcgcacgtgtcacgggcgaacgtctgactcgcgacgaagcgctcgttgttctggtcgttgttcgaagtcggcggaaccacgcgaaggacgaaccgggccgactcgtcctggcccaggccgtagtcgccgctgccgttgcaggagtcctgattgtagaagatgacccaccgctcgctggcgatgtagtccaccgtccatcccgggggcgggatggacgcgagcgggatgtagccgctgggcagcgcgaaccacacctcgttgatgcgccggaagagcggcgacccactggaggtgttgttgcggacatcgaccgtcagctcggaggcttcgtccatcaccacccgcgcgcgggtgtccccaccctgcggctgcgtggtcaagacggcggtcggggtcatcgactgcgcccaccccagcgaaggcgccaggagcgcgacggcggcgacgaggggggcggagaatggacgcatgatgaaaggagccctcacggatccagggtgaaggaagccgccgtcagcggcgccccatcgaggaagaaccgggcctgccacgtcccgctcatgccggacgtcgccacggtggtgcctgccacgggcagggagaagcgcaccgtgcgcgactcgtccacgcgtgaatccacttccgccgaccgccgctcatacggcagcccggaaggcggcacgaactccacggacaccgtgtgccggccgcgcacgccgctcaccgtcaggtccacgtccacctgcgccaccgacagcaaggccctgctcccctcgcccaggtcaatgacggtggccgagccccgcggaaccactggaggcggaggcacttccggctcctccaccggcgcgggcggcggccgggcctccgaaccctcgcgcggaggcaacacgtccgtgggcgccaccggttcctgcgccgggggcgcatgaacgggggcatagggcgccacgccatccgtgcacgaggccaacatcaccgccgccgccaggaacgccaaacgcgtccgcatcaccgcgcctcctccaactcgtcgatgagccccagccgggtcagctccgagaagaacttgagcgtgtcggtcagcacctgctccacgtcccatccgtgacgctgagccacctgctccaccagggcccgcgccgtgcgcgtcccgtcgcacaactcccagatttcaatggccgttccgttgagcccacgcagggtgttgccctcggcatccaggacgatgaagtccgaaccgaagcgctggccggagacgccctcgcgccagcgcggcgcatggtccgccgcgaagtccgtgctcatcgcgcacctccccggcccagcaacgcagccaggcgccacttcacggccacccgcacccgccccagccaccggggcccccggtcccaccccgcttccaggacgacgccgccccggcggacgcgccgcacccgccccagcacccgtgacggatccagcggagcatcgtcctggggtgagttgtcgcctcgcagcgccaccgccccggcctcccaccgccgcagccggtgcagcaccagggcatggtcgaagcgcgccagcaggacgtcaccaggtcgcggagccccctccagcggctccacgccggcatggtcgcccgagcgcagcgatggccacatgctgtccccgtggacggggacccagctcagggccggaggcacaacggggctggaagtgtcgcgcggcatcgcaggtcagtctagccgacccgacctgcgcctgcgagttcccgcgggcccaatagcccaacgtttatcaggggttacgcgcctacctcagtttctcggacttagcaagaatcgcccggaatactgctctcacccccgcagaacgctatgccgaaacgaccttacgctcccgaaccaccctggcgacctcgtcgagcgcgacggggatgggctcgcctccggccatgggcttcagcttcgcctggccgctggtgcgctcggcctcgcccagcaccagggtgaattccgcgctgctcttgtccgcgcgcttcatctggctcttgaggctgcctccgcgggtatcgaactccacgcgcagtccctcccggcgcaggcggctggccagcaccagggcagcatcgtgcgagcccgcgtccgccaccgcgacgaagacgtccggccgcacggtgaactgctggccgctctctttgagcagcagcaccagccggtccaggccacaggcgaagcccaccgcgggcgcgtccggcccgcccaggctcttcaccagcttgtcatagcggccaccggcgcccacggtgctggcggtgcccagcgcggggtgcgaggcaatgaactcgaagacggtgcgcgtgtagtagtccaacccacgcaccatgcgcggattcacgacgtgccggacgcccagcgccgtcagcttccgctgcacgtcgtcgaagtgcgcgcggcagggctcgcacagggactccagcacattggggccggccgcggcgatggcctggcacttctcgttcttgcagtccaggacgcgcagagggttcttctccatgcgcttctggcagtccccacacagcgcctcgcggtgggcctggaggtactccaccaacttcgcgtggtacgtgggccggcagacctcgtcccccagcgagttgatgttcagggtgatgtccttgagccccagccgctccaggaactgcaccaccatgtccatcatctcgacgtcctgggcgccttccttcgcgccgtaggcctccgcgccgatttgatagaactggcggtagcggcccgtcttcatccgctcgtagcggaacatgggccccgcatagaaccagcgcgtgagcggctcctgattggcgatggagtgctcgatgtacgcgcgcgccgcgggcgcggtgccttccgggcgcagagacaggctgcggtccgccttgtcgttgaaggtgtacatctccttcccgacgatgtcggtctcctcgcccacgctgcgcacgaacagcgcggtgtcctccaccatgggcgtgcggatctcaccgtagccgaagcggccgaacagctcgcgggcctgcgcctccacgtgctgccagatttcgatctccccagggaggagatcgttcatgcccttgacgcccgcgaccttctgactcacgtgatgactccgattcgcttgcccagccgaaccaccgcttcctcctggaggctgtcgtcccaggtgacgcgcttgggctcgaacaggaggatgacggtggagcccatctcgaagcggcccagctccccacccttctccaccggcatggccgagccgtagcggtgcaccttgccgggctgcccggtgtgcgtcgtcacctcgtcgtaggccgccttgatgcgcgacacgcaggtggcacccaccttcaccaccgcgcacttgcccgccacggtgtccaggtacgtcaccagccgctcgttcacgcagaacagggactgcttgttcttcaccgacgcggggttcaccggccagaactcaccggggatgtacgcgtacccggtgatggtgccgcccagcggcgcgtggatgcggtggtagtcgcgcggcgacaggtagatggtcgtccaggcaccgccgtagaagggcttggcggcctcggaatcccccagcaactcgtccaccgtgtactcgatgcccttggcctgcaggcagcgcccgtaatccgaatagcccacctgggacacgcggccatccaccggggacaccaccaccttctcccccgcgtccaccggacgcaggccgggcttcaggccccgggtgaagaactgggcgaaggtcgggtagtgctcgaaggagtgctcggcctcctccatgtccacgttgtaggccttggcgaaggcgcgcatggcggcctgatgcaccggcgcgggcacgggcagtcgcgtggccatccccaccacggtggagagcgcggacttgggcaacacctgcatcaacttcatgaaagtctggtcgttcatatcggcgaatcggttctagcgaccggcgtcggtcgcgggtgccggaccgccgtcgggagtgacggggacagtctgcacggcactcttgggtaacagcgtgaggaccttcccctcttcaatcaggaggaatgaatcctgatgctgggggtattccaggcgacaggcggtgcggtcggcgagctgccaggtctcccgcatgccccgtccctgcacatcgatgggggtgccccgctggaagcacccccggaagcccgccaccagttcggacgcggccgtgccagcctgggggccaccgccagcaccggcatccggaggcccggcatccggcgcttccaccggagccgcgggaggcgcctgctcctcggtggacggcgcggtgtaggagcccggcggcagttcccgcgcgctggccacggcctcgtcccgctcattggcggccaccgccattcgctgccgtccgtccttgatgcgctggagcaactcgcgggcaccctcggcgtccaggctgtccgcggggacgcgctggagttgcgcctcgatttcccccacctgcggatccaggaaggcgtcatccagcttctgcgcatacagctcgcggaagcggcgggcggcctcttcgtactcggcggaaggggcgggaggctcgcggcggcaggcggtgggcgccagcgtgagcaacactgcggaaaggacgcccacgaggggcctgagggacgctcggaggaccagggtgcgcacggacacgggtttatgtcatttccccgcgcctgtccgccttttgtgccccggaagcgcgcctcagacgcccaggaacaggcgcttgccgaagttcagcgccaggtccgcatcgaagatcttctgcgccgacgtctcgatgtcgtactcgacgcggacgtactccaccgtgcgcgcgtccgtgtcgcagatgacgaagcacgcccggtttgtcatagtcgcgcggctggcccacgctgcccacggagatgatgtacttgtagccccggcggatgccgaacttctgggccaccacgtcgttcacctcaccattgccaatggcgaaggcgcggcacaggtggctgtggccgatgaacgtcacctccggcagctccgccacgtagggcgtcagctcccgggcctgctccagcgcgaagatgtactcgtatgccttcgggtcgatgggcgaaccgtggcagaagcccacgtcgccaatccggtacgtgtacgggaggctgcgcagccaggccatgttctcgtccgtgaggacgttggcggaccagtccagcgcgtgccgggcggcgtcgtagtagtacgagtagtccatccgccccgccaccgccgcgtcgtgattgcccaggagcgtcacctccgccaccgagcgcaccagctcacaacacgggttgggcgacgccccgtaaccgacgatgtcccccagcgagacgaaccggtccaccttctggtgctcggcgacgcggagcacctcggtgagcgcctcgatgttggagtggatgtcggagatgacggcgatacgcatgcggggcctcggtccggtggcgtgggctcaaccggcccagccgaccttcacctggttctgctgctgctgcgaaatcatctggcgaagccgtcccagggtatcgctgtccagggactcgaaacgcaaccccatgcccgcgggaagcgctcgctcctccgcctcccgaagccacaccaccgtggcctgggcctggatgtcctggtggcccgcgggagacagcttcaccaccgtacgcgcccctcgtgccaggggcgtgctcgtgcggaggaacagtcctccttcgctcaaattcgagattcgcgcgtagagcgtgacgttgtcaccctcgcaccagcaccgaagctgggtgggaatccgcgtggactttcggttttcgctcaacccggaaccttcttccgtcacccgaatccacagcctagggacggcctgattccacagtcaagttcaagggtggtggagcgccccacccttacccacggcctcatcgctccagggagcccaggtcgtcgaagtgggtcagcttccggaactcggcgaagcgggcgtgaatctccggccgcgtcacctcgcgcaggcgctccaggctgaacttctccaccgtgaaggaggccatgacgctgcccatcaccatggcgcggcgcagcagcgcctggtccaacacgccactggaggtggccagggcgcccatgaagccgccggcgaaggtgtcccccgcgccggtggggtcgaagacctcggccagggggaaggcggggcacgcgaagatgtgctcggcctcgaagaggagcgcgccgtactcaccgcgcttgatgaccacgcgctgcgggcccatggccatgatggcgcgagcggccttcaccacgttgtgctcgccggccagctgacgggcctccgcgtcgttgacgaacaggaggttgacgcgggagagcgtcttgagtagcgcggcccggctgcccttgatccagaagttcatggtgtcggcggccaccagcttcggcgccttcacctggtccagcacctgcgcctggagctccgggtggatgttgcccaggaagacgtagggcgtatcccggtacgactccggcagcttcggggagaaggcctggaagacgttgagctgggtgtccagcgtctgcgcctcgttcagctcgtagctgtagcggcccttccagcggaaggtgcggcccgtctcccgggtgaggccctccaggtcgattccccgtccgcgaaggaagttgaggtgcccttcggggaagtcctcgcccaccaccgacacgacac

SEQ ID NO: 1163 - DNA, 16387 bp, Myxococcus xanthus
ggctgtgacgttcgacaggtcatggcggccgaacgcctgctgaagctgtgcgaagtggggaaggggagcgctggcatccttcacacctgcatgggcctcgcgccggatggccgcgggccgtgactccacggtgcctccggctgcctgaggctgcaccgcgtccttctccccgcacgccgcgcacgggccgcctccggattcacatgccgcgcacttcgtctggaccggagtcctgaggggggacgccaatccacctcgcatgtaacgcgggacacccgatgcggagttggggcgggcgcgtgcgccagggccgctctcgccggaccgcccgcgcaggaaggcgggaacgccaggagcagatcgctccgacggcgcgctctcaggacgtctggatgaatccgaaggccgggtcgactcactccggcgtaccgactttgacgtcgctcggctcacggatgctcgccccctggtgattcataccggaggagttcatgtgttcactgccagtgtcaatgggcggcactgtggtgaactggagccgactgtgagagcccggtgaggcaggagattttgccagcgcgaatcccaatccgacctgagaggtttggaattgacgcagccggagcaagctggggcgcgggtgggacgtgttcaagcagacgcggtttggagcatgtctccggaaggccgagccggcggtcgtggacgcgcattgaggcacacgacggccctccctggggctccagcggcgggccgccgtcatgtcagctcagtcgttccaggcccggtagttcccccctgagtatggcgggggcgcggcgtcagtcgcgcccccgttgtcgttcggctcgtcgagcgcgtttacctgaacctgggcaagctcacggtaaaacgggacgacttcaacattgtgcagttccaggaatggcgcgcgtgcggcgtcaaggtcgcctgcctcctggtgcttgattgcttcggtgatggcacgcgacaggcgccgcgagcccacccggatacgcttcgcaatctctttgagcagcgcgggggcgctcacatcgtctggagtgcctgggtgacttcccgtggcgttatggctacttcggaagcggtattggtcaggagcgcccggttttcatccgtgagaacgagcggttctccaaggtcggtaacgcggcggttcaactccctgatttcgtgccaagtgcggggttccggcatcgaaagcccctatcgacttctacggttgcaaagttcgaagggccactgcctttgcccctcgcagtaccgaaagcacgcatagcagtcgccatcccaacgcggcttcttctggtctcggcaggcgacgtaggtgttggtgcagtgctccctccatccgtcttcggcgtcgtcctcctcttctttcgccttgtcttgtgcgtgctgcatggcggcatccatggtcgcggtgtacgcggcggcttcgctcgccgtgaggccgcacgcttcgggcactgctgggttgcgctgtacgcagcacgacacggtgtcagtgcaggacgccagtgcgtaggcgtcgcggcggctggccgtgccggtggcgctactggagcaacccagcgacacggcggttaagaggcacaacaggctaatggcgatgttcaactttggcatgatgcgcggacgagtcacgtccagatatcgtgcgtctatcaccctgagtggggggcgcctagttgaactgcgcgagcgaggtcaagtccggaatcgtgtgtagttgtttcggagggggttcgggggaggaatgcgcctcggaggcatcaatcagcggcggggcaggggggatttcagcaggaacatgtcgaggtagcggcggtcatcccagacgccggtgacctcaagcgcgactacgtatacctggctcgcctggacagcgccgagggggcctccgatgcgggctactctggatcgagcgcccaggttccttcttcccagcgtttcaatgcctgctgcgctccgaatggggccagcccttgccccttggcagcttcctcaaggaccgctttggctccgtccgtccgatagcgaagcagatgcgcggcggccatcacgcgcacgtccagtcgctcatgcttgagcagcacggcgagagcgtcacgtccggcattgccgttggccaggagcttatcgacggcggcaccgtacttcctggcgtgcttgttcccgatcttggcgtctccccggaggatggcctcgttctgtccggccacgttctgggcgaactgctcgacaagatcctccaacttcatcaccagagccccttctcgatgttcttgagggccaataacccgaactcgctggcctactccggatcgagcgcccaggtgccgtccttccaacgtcgtagtgtcatgatcgctctgatggcggccacccctccctcgttcgctgccgcttccagtaccgccttggcttccgccgtccggtagcggagcaggaacccagccgccatggctcgaacatccgtacgaggatgcttcagcagcacggcgagggcctctcgcccagtatccccctgcgcgcgtagcgcctgaagcgcggcggtgtactgcttggcgtgcttgttccccgccctggaatctcctcgatgaatggcatcagtctgggccgcgacattccgagcgaactgctcgaccagttcttccaacttcatcaccagacctacgggaacgtcacgccggagagggtgatggcgcgcagcccgcccggtccccacagcttcagggtgaacggcccctgcgccgcatccggcgtcgcttctgcttccaccacgacgcggccgaacggatagcgagagatgggggccttttgccagacggtcaggatcttcagggacgtgcccggcttgctcaccagcgatgccccttccgcggtccaggggttcgcggcgtccgggttctcgaactccaccgctacggctacgcgaacaggggcgcgatagctccaagcccggtgtgcccagagtgcgttgcctggatgctgacgaacctcttcgttgacgcggaggagtttcgcggcgacgccctcctccttttggatgacaccgttggccaggaggcccgcgatgccgctcggttcccgctgttccgccctcatccgcgcgttctcctcgtggcactgctgggtttccgctcgggcctccttcgcctcctgctggtaggactccgccgtgcgcgcctgtctccacacctcgacgatgcgctcgccgcgcgcggggtgggcgacgaggacgaaggccgcatcaagggggaccgagccatcctggaagcgcaccgtcagcagtaggcgttcgccgggtaggagctgctccgagggcaccagccggagcgtgcttcgcccgaggtccacgagtgaaaagcgttcttcgccttcgagcacgaccttcgccggatccagggcggagtcgaactcgaaggacgtggacatgcgtgggcttatctgaacctctggaggcggcaccgccgaggatggctccgccgagatttcgacgcggcgcaccccaaggcccgagaccgtgggagacggttgggcggtcgcggcgcctgacgcgagcacgagcaccacgaaaaaggcgatgggtgacgcgggcacggtcggtcctcactcgaagcggcgcacggccttcaaatccagcgcggagtagacggtggccgtgccgggggctcgggttggctccatcttcaggagtccgatgcggccgtcctccggttcaacgaactgcacgcagacggggatgcgctcattcttgggagtacgcgcctcggtgagtcgtccgtagacccgctctggaccgacgaggagctgcccggagaacagggttcccggcggcatgcgtccccaatggacccccatgcgaaccgtcgtcgtgccctcacggaccttgatgtttctgccaccattgccggggctcaggtcgaacgtggttgaaggccgctcgagtccgggggcgaagaggccgagctgttccatggcctcaatggcccctggaggacagtcctcgggaggcggcgtcgggcgcacctgggaaccagggcacgccatcgaaaggcaggccgcgacacccaggccaatcgccttgccagcggctgtgccctggaggcgctgcggctcgggctcggggagcatgccggtgtccttcttcatcttcacggaggccttctccttggaatacgtcgcgggaacggcgacggccgcaagggtggatgctccatcgagcgagcctgcggcctcgtcagcttccagtggcctccagggtgccgccacttcctgaccgggactccaggacgtgggaacgaacgcggaaccgccggggggcgagcccacggtgacatgggaatggggcgccatcccgtgacgtgcggcaggaggggaggagggcatcagtccgcgcgcgagcaccagtccgcccacaatcaagaccaccaggagcgccatccaggccgccacgcgcagggccttggaatgaccggcgcgtgccgcgggcggcggctcgaacgggatggccaccgcgtttgcatcggattcgtacgcgtccccacctcgtggcggacgaggcccgcgacgaggccgggccttgcgccgcttcagccactgcgccagctcgtcttcgaccgcttgcggcgcctccgcgagcgtggtggcggtgtccgcgccatgggtgtcacagagcttcacgtcccaggcttcgtccgcctgggcgagcagggactccagctccgcgcacagcgtgtcggcgtcggggtgtcgctcctcgggcgtcttggccagcaggcgcatgcacacgtcgccgagggccccggggacgcgcgggttgagcgcctggggcggtctgggggcgcggttgagcacgggctccacgccctcgggctcgtccggcaggaagggctgcctgcccgtcaggagccaatagagcacgacgcccagcgcgtacaggtcatccgaggggccgggctggtaggagcggccacgctcgtcgccgtgctcctgctggaagcgccaggcctcgggcgcgcggtactccagggtgcccggcgggagcacgccgccggtgatgctgggggcgctctcgtacccgcccgcgccgaagtgcaccaccaccagctggccgtgcgagtcgcgcacgacgacgttgctctccttcaagtcccggtgcaccaccttcgcccggtgcgcggcgcccagcccgcgcgccacaccgagcaccttgcgcaccacctcacgggccgaggggttctcctccgtggcccacacgtccaggcggcgcccctccacgtagtccatgacgatgaagaaggactggggcgcctcgtccggccactggccgtgtccacggatgcgcaccaggttggcgtgcttgagccgcaggaggatggccacctcgcgctccgcccactcggccagcccccagagcgggatgagcttgagcgcggagctccgctctccacgccgagcgcggtacacggcgccgaagcccccggcccccagccgctcctccaccaggtacccgccaatgtccgtgcccgggggcacgacgggatgcagacgcgggctcacgagacctctccttcggcggggcgtacgggctcggcgttcctggacatgcgctcaacgggcaatggaactcgtgagggttccccccgcgaagcagcgcgggaggggcatagaccttggacggataccatggttgaacctgttgaggtatatgctcggagtgccgtccccgcggcattctcctcttttcccaggtctcttcatgtacgcgaagctctcccagcggattggaacccaggtccgcgccgcccggcatcgagtgggcctgtcgcaggcccaggtggccgaggctatccacgtgccgacgctggtgctcagtcgcctggagcgcggcaggttgttgcccagcctccccacgctggtggacctgtgcggcgtccttcgtgtctccgtggacctcctcctgagcggcgagggcctggcgtttcccgcgcccgagggggccggccggtaggtggggcggcgctgtgtgacaggggctcgtcgcgcatcgacacggccgccaagatgcggcaggaagggcgttcccgagtcgcgagcctcctgcccgcggcagacggggtcctcggtgttcctggtacctcgacgcatgaacgaagaactggcgacccgcattggaagtgccgcccgagaggcccggacgcagctcgggctcacgcaggcggaagtggccgagaagctgggcctggcgcacatggtctacagccgcctggagcgcgggaagatgctgcccagcgtgcagacgctgctgcggatgtgcgcggtgctgcgcatcggctcggacgagctgctggggctcgcggacgcggaggaggggaagggggcgcgaggcccgggcggagcgcccaggctgcggcagctcaccggcctcgcgcgaaagatggacgaggagcaactcgacgccctcgtgaaggtggcccaggtgctgctgcgttgaagcgtcgcccggccgcccgtgctcacttcgagttcggcgcgagcgtcgcttcgtctgcgtccagtccctcggggaagattcccgcttcgtccagctccacccggtcgcgcaggacggaggcgtccgacagcatccgtgccagctcctcagccgcctccttccgtccgaagggctgggcctgtgccgcgagcgccgcccgcagggcatcgcgcagctcggcggccgaggtgtagcgctcggagggcttgcgctggagggccttgtggatgatggccttgagcgcgtccggcaggcccgccatcgcgtgctccacgtcctcggagcggtagcggctgacgagcgcgatcatctgcgtgaggggcacggagggcacctcctccgtcttcacgtccagggcggcgatgggggcctgcgcgtcctccaggtcgaagaggtgcttgcacgtcagcatctccatgaggacgaggcccagggagaagatatcggaccggccatccatgggcttgcggagcaggtactcgggcgaggcgtacgccacgtcgcccttgagcaggaggcccggggtctcctcccggcccaccatgagcgagtaggcggcgccgaagtccgtcaccttcacctcgccactccgggccacgcggatgttccgaggagcgacgtcgcggtggatgatgcccagcggccggttctccgaatccctcagcgtgtgcgagtggtggagggcgtcggcaatctcggcggcgatgtagagggcgaagggcgcgcagagcggccgctcacgcatggtggcgaggctgatgacggtgtccagcgtggggccgtccacgtactccgcgatgatgtgcggcctgtcggcgtggattttcaggtgatggacctgggcgatggccgggtggtggagccggaaggcgagctggacctcctcgatgagccgctggcagcgctcgaaggatgcggggttgcgcaggcgtttgatggtgacatgcccggcgaggccatgggggaggtgacgctcggccaggagcaccacctcgccattgccccgccgctccagcgtgcggagtgccgcgtaggtggtggtgtcgatggtgaaccggagcccgggtcgggcgcgctccaggtcggagctgttctccggcgtcgggtcctcgaacttcgtttcgtgggtcggcgtgctgtcatcggtcatgggcggcctcctggtggggttgagacgcgcggcgggcgctggcacgggcatcccggcgctctgattggccatggctgcggcagtcgggctcggtggctgtcgcggtcatgggtctactatttatagacccttcaggtattgaaatcgctcccagggactcggcgctacgccaatgggccgaagacggtgccgaggggcgccagggcccttcacgctcggctgccgaaaggacacggaggagatactccctgccaaaggggctacattctgacttttcttggatgtcggggatgggtggtagtcaggaggctcctgttccggaggtctccatgacatccaggctgctgttcccggaaggcataggtgcgctgttcccgggggcgtttggctctgtgggcttgggatggaccatgcgcgctgactcgctccgggcaatttgggtgggtctgctgctcgttcttgccctgctgtccacaggctgcctgtcactgacaccaccgcccggccgggggatgaacctccgtcacgcgccgcacgaggcggcggcgcctacctcggttgaggggccaagcgttgaggctccgggtgtcctcgcctcaatgcctgagtccgaaacgccggagcggctgcatcggcgacaggcctcccgggtggaagtgacaggggtgggcctggaccgcgcggagagggatgcgcaccagggtgccctcgcggcccagttggcatttcgcagcgcctttctcgacgtttcggaccccacccgccgcatcgccggcgagttctccaggctgaaggcccgttggcgggggattcgcgtcggagacggcgttttcgtccgctacgtcgatttcggcacccagcagttgcggtggattgacgcccacctcgccgccgtcacccggctggccaacgccgcctcggaggtggaggacccggacatgcagctcgcgctgttgcgcctcgctggcccacggcttgaggccgccatgacgggctcgctcctgctcgccgtctggctcgactttctcctcctcgctgaagccgtgctcgcccagcagctctacagcgtggagaggatgttcgcggatctgtggcgctggcaggagatgctcaagcccgccatggcggcgctctcctctctggagcccgggcagatggaggccgcggcgcaagacgtccccgcgcttgtaggccagctctcgggcgagctcgccgcgaccatcgcgaccgtgcgcaagggagccgagaacgtcgcgaagatgctggtgctcaaggatgccatcgaggcgcttaccctgctttcggcgttgaagttctcgctgcccccggtgtctccgtccgctcccgccttgctcggcattggactctcggtgggaggcaacggcgtgatgatgggcacgcgaacggtcgtgtccgccgagtgggtggagatgatgcgccagttggtgcgcgcaggcgtcctctccctgtccgtcgtcagtgccgccgtgcggattcaggcgggccaggtgatgctggcacaggcgcatggcgagttgccgcagggcgtgcgcgaggcgttgggcgacggacccgaagtgcgtgccatgcgcgtgacgggcaaggcgggggctggcatggccgagccaccgcggcaccacgtcctgccaaaagagttccgcgaatggttcgagaagcgcggcttcactggcgacatggacattgaccagttctgcgtcaagctggagcaggctcaccacgaggccatccacggcgggggcgactggaagctgggacgcacatggcccggtgaatggaaccggatgatcatgagccgattgcttgaggccgaggtgttggccggacggatgttgacgcgaaacgagagcctggagatcgtcgcgaagaatatgagggactataagatcccgatgaacttcacccgctggagaggacgatgagcgacgagcgtgcctggaagggcaacgtgaaggcacgcctgtatgagcgggtccgcgagcacggctacgattcgctcaccgcctttgccaaggcgcgtcctgccgtcccgttgtacttgctggccgaagagcttggaaaggatgacgttgcagcagtgcaagtattgagcggattgcttggcgaggcggagcagcgcaagcaggtcacacgctttgttcgcgacgtacttgtgcgcgagttgtccgaaggtctccccaacggctggccggccgtgttgaatgacgccaaccgcttcgaagtcgccaaggcgctcagttcgtggattgcctacaccccagatactcatcaggacagagcaagacaggtcagcgcagcgctcctcgccaagccaccaccgcccggctggcgtccgctcgcccccgacgacgagctgctgctcacgctcctgccggacgaagaggtctggacttcgtctccgggagaggtcgatgagtgacggaggtgcctggcgggggagcatcagggcgcgcctgtatgagcgggtccgcgagcgcggttacgattcgctcattgccttcgccgaggcacgccctgccgtctcgctgtacgtactggccgatgagcttggcaagggcgacgtcgctgcggtgcaggtgttcagtggattgctcgccgaggcagcgcggcacaagcaggtcacgcggttagtgcgcgatgtgctcgtacgagaactcgccgagagcctccccgaaggctggccggctgtgatggacgacgccaaccgtttcaaggtcgctgaatcgctcggctcttggtttgcctacaccctagaaactcaccaagcgcgcgccgatcagatcatggcagcgctccgtgccacgccaccgtcccccggctggcgcccgctccgtcccgacgacgagctgctgctcacgctcctgccggacgaagaagtctgaaccccccggaaccccctccggaccaactacacacgattcgggacttgaccgacggtaccggccccctgtgtcagggaagatgtcgcctcggctggcctgccggaaggacaccatcgtttgcccgtggtcggcccaccttcttcttgggcctcggtggcggacgcagaggggcgatactctgtcagaatgcatagggtccaagttcttggaccatgcccctaaacctggggatggtccttgccaacagccagttcagtcccgattttcgagaggggctattggctctcttgagcggtcgaatgcgctagatacggacttccgaatacttgtctttcgacagtgagaagctcgaagtccaagtgctgggtttgtgatggccagttttcgggcttgtcgctaactgcgacaatgtagcctgcaggttcaatccagtttaatccgtcttcggtttctatgggctgaacactcatgcgaccctggttgtaatgggagggatcgtgtgtgagcctgacatttatctcaaagtggcttttcttaagtggcttgctgggtttgggggcgtgggcttgaatccaattacggatgcgtcgaggatctaagagttcattgggggtaaggttcatttccgccactgcagaatagtactcggatgcggatgcttctgcttgttttcgatctaccgcgttaccccgcgcgagaagatatgcagccacgggctctaaagttccccaggagagaagttcttttagccagaatgcgatccacggcaagccactgcgtggccagtcggaaatctcaagggggcggattggcattgagccatcacctgcatctagcaagagtcctaggctgcttccgatgccccagttagagcgatataggaagtttcgggacgcgtagtcaaaccagtttggcagttctttggggctgggctgtttcgaaagagtgtcttttgcgagccaccactggaggaccttttgccagtcggtgaattctgatcttttcgagccaaatttcttcgaaatgtagaacgaaggtacttctgatacgaggttgactattttggcgacgaactcaaagcgaaggtttgatggccagatggcgtaatcggagccgtctagaagtgctgaacgaagatcttcagttttctcgatcagagccagcgctgagcgcggaggtaagctgcttttgtatatccgacgcctgatgtcggtggaggggtaaaattttttaagtgacagtccccgtgtcagccatgctgagcgcagtctgtcttcttcagttgtacaggcgtgggcatatgttttctgccaaatgcgggcgagctcgtcttcgagttcagtatcggatagttctccgtttttgatttgctccacttcttcgattgttgacaagatgaaattgtcaagcgcatctagccgtatggtggcggcgttttctgagctttgggttgccgtcatctcgagccactcttcaaattcatcttgagtgccgtctggcgagatgtcgctccaggcgtcccatatggctaatattaaattgaatagtgggcttgatgcgtcttcttgttcgttgagtgctgcgttgtctgttacttccttgagttcatgtaccagtgtgtcaaatccttgccgctggcgattagctttttcattgtccgccatctggacggcgagagcatgcccttcagtggaaacccctggtcgccctgcgcgcccaattaggttgctgaactcctgtactgtgaatgcgtcgtttgcacggaatacgctgggtagcagtaggtagttgacggagatgtttactccctccgaaagggttgaagtcgcaatgatgatttttacaaggccagagtcgattacttgttttaagcgacgcgagacaagcggagggagtttgccgtggtgaactgctatcccacggactagtagtttgtactctattgagtccgccgaaaagtagtccgcaacggatgcgagacaatttgcccacgtgtcagttgctggtggtgttggaaagtagtcggggaggtgagtgttccatgagtctaggtgttctaagcagtcttccgcgaatggtgtaatgtgttgagttaacgagataagtaccgtgggtctggtgtcgtcagaacggcgcgctgcgaggtgtagtgctgcccatagtgttgggccgcgtagccgcttttctggcccaaggctgtcctgtacttcgttgggtaatggggggaacggtgcaggaataaatggcttctcgtatgtccgtccgttcttgaaacgcaatgaacgtccatccatgagttcgtaggtaatacgaaaaactccggtgggacttacttctagacggccaagcatttgcctggtgcttctgtagtctgaacgagtcggtacggagtctcgattggttgtaacccaacgggctaaggcgggagctgcattagcggcaacggcggatagggctactatgcgaaaattataggcatcttgggctcgtaagagtcgcgtgccgagtagttcaaggcggaatgaacgagatgttccgtcttcaagtgaggaagcattgcttctctcaaaatccaccatatgtgcttcgtctatgactactagtcgaacacggtggagaaaaagaatgccgagataccgaagcagggcgtctgctttttcgaatgtgcatatcaagaccgtaggtcggtcgctatcaatccatgcgtcggtaggtccccagtcaattccgccatatagccccgtaacgatgactggatcttgagcgacgctgcgaagatcctgctcaagacgagactcaacttcagcggcaagtgcccgggatgggactaagtataggacgagatttccggattggcgttggtcgtcgctaggagcagttgcgggggcggtgaatagggatttgattgcggcaagggtggcgattgtggtcttgcctgagcctgttggtgtgcatagaataaaagagtcgtctgtacggaggttttcgattccttttgcttgtgaaggccacacaagggcgcgacagtttgtaaaagaggctcgtgcaaactgagaaagagcagaggctgcgagctcgtgtgaattcgttaagatgttatctatcggcgtccaaagagatgttttgatgtacttgtgcgagatctctgctgttagtcgggcgaggatccatgagtaagggtcattgctgtgtagaaatccgctcgcgagtttatccagtttgtcgagagcacgggcgactctttcttcgcggcctgtgcggaggtgctcgcaaatcagtccaatgcacattacggtgtgttggatggctaggtcggaaaggtggccatctgttccgtccgtgccggtttcctgacgtgagcagcctgcccagtaggatttgattgctttgattgttcctgggaagttggctctgaggtattcgcgtagaatttcagacgtcgggtcgccagttgggatttggcgaatgtgtccgtgcgcgagcgctgggtaccctgcgagttgatatgctgccgctgagagaaaatgaagtggttggcctgctcgtctaaggtcgcgctgtgacaaccactcaaggatttctcctgcgcgtttcattccagaacgccatctttcggacttgtcggcctttttttcaattagcgctgcctgaatcaaaagcagtgcctcgtccaatgaagctgaaatgtcgtttgaggtgaacttagagagccctaatcgccccatttgcaggcgagcgctctggctgtatagttttgcttgtgattctgttagcgcgggggtggcaagttgaactcgagcgattctggctattcgaagggtctcgggagttgtcatttggctgcgattcggtagatggtgtttatggttttcgtgaggtctcttatgtggaattccatcccctcgagtttgtggtttgcgctgtacgacgagtgaggtgcgtctgctgccatccaggttggtttgggggggcgaattggtttgttttcgcagacatatgtgacgctgttgagtctagttgcgttcttgtgtccttcgtacctgaacttcaatagggcctcgcgccatccttgggcttgggcgttgtcgtattctgagagtagctcgattagttcacggatgctgtcgggtatttgtggtgtggttgcgatttttgcatgggcatcggagagagtagtggcgctgtgctttgttaggcatttggcctcgattgcgagtacgtgagtgattaggccggtgtcatcgcgtataaatgcaagaccgtcatcgccagttctcccggggcgcatttcctttgagttgttgggatcgtatgtttcgcctgcgcgcaatttttggttgatgcgttcgaggtgttgaaattcgacatcgtgaaatcgaaatagaaaagccggcacttgccagtctgttcgtccgtgtgcgccccagtgctcgatggcgatgattccgagtgtctcgcccaagtatccttgtagcgtgacttggtggagaagggcagggtagttggcggcggggtcttggggcgtatctttgaatggagaaagagtgtctgtaaagccgcgacgtagtcgctggcgagcgtcatttagggcttcgtctacgtatagtcttagttcggattctatgtttttgaaagctgcgggatcttcgtcccataggcgaagcgagtagttgttgtttgttgagttgaaggttttttctgctagccatgtgttgagatttgagagtgtaattcgccgggttcgaatcatgatgtggcagtgtttgttgcgctgctgatgcgtgggttgaggactgcacttgcttgctgtagatgggaacctgtcgtgaagggggcttggctagtttgggtcaaggttgcggaggagttcaaccactcaggaacacgccttgtgctgtgcgtgagtggtcccggggagcgatctgtgcgatgggggagagcccttgttgtcaaggctggtttgcccagaccggtgcttcactgatgaggcatgcggtcggtttagacctcagactgacagacgtgctgtagtaacgcacagttggcgccatctgttgaacgtgcctgggtggaggatggcagctctgatgctcttgctgtggaccgcaatccctcggaggaattggcggtagggcacgggaatcgaactcgccagggacgcctctcggcgcccctcaccggttttgaagaccgggccggccaccaggtccggaagccctaccgtctgcgattacgccggaccctgcggaccccgtcaaccaaggggcacgggcgcgactcaccgcgtctttttctgcgcccgtcccgccttcaatcccggcaagcccttcaccaacgtcgtcaccagcacctgcgtcagctcctccgcgggcgtgcccgggaaccccgtgcatgtgagcctcaagctcacgatgccgtgcacccccgcccacagcacctccgcgagttgctctggcttcgtgccttcctccagcctcccggtcgccagcaggtccacgaacacctgcaccagcaccccgaatgctctcgggcccgggccttccgggtggtctccgaacagggcggtggagagcttcgggtcctccatgaagatcagccggtacgtctccgggtgctccaggccaaagcggacgtaggcctccgctagcttgggcaaccgctccagcgggtcttccacctgggccgcgggctccagcatggccagcaggtcctggaagccgcgcacgcacaactccttcgcgatggcctcccggttctccgagtggaggtagagcg

SEQ ID NO: 1164 - DNA, 19726 bp, Myxococcus xanthus
  unsure (1)..(19726): unsure at all n locations
gctggaggcggcgcgccggggggaccatgcggaccctcggctggcctactacgcggggctcgtccatgagcggatgcgccgcttcgccgacgcggcggaggccttcgctggtgtgcccgctgaggcggatgtctacgccgacgcgcgcctgcgccgagcccgcagcctgtcgctcctgggcgagcactcccgggccctcacgctcttccgggccgcgatgcaggagtcgccagcggacgtggaagtccggatgcagttcgcccgggccctggagcgcggcggcacgccgaaccgcgcggagctgctccttcgcgagggcctgtccgccggtccctccgcggcgttgtatgacgccctggccgccacgctccaccgacagggccggggtcgcgaagcactgacactgcttcgcggggcggtggcccgctttccccgggacgaagacctgctgtacgtgctgggcgcggcccatgagcgacagggcgacgtgacgggcgcgctggcccgcatgcgggcggtgctggctgtgtcaccggaccacgccgccgcgctgaacttcctgggctacctgctggcgcaggcggggcagaacctggacgaggccgagcggcgcgtgcggcgggcactggagctgcggccggacaccggggcctacctggactcactgggctgggtgtacttccggcgaggggactacgcccgggccgtggacgcgctggagcgagcctccacgctggctccggatgagcccgtcatcctcgaacacctgggagacgcctatcagcgggtggcgaggacggacgacgccgcggcggtctggcggcgcgccctggaagtgctgacgctggatcctgagtcctgcgagccacccggccagcgcgccgcgttggagcgcaagctcaatgcgctacccacgcgtgcgccagaccgctaagttggtgggcctatggcgcgtagcgacgagggcttctttcccggcagggaccggacacgactgtgctggaagcccatccttgcagacgccgagcctgtgccgcatgtggcggtggtgcacgggtatggagaccacttcgggcgctatggcttcgtgacggacgcactgctggcggacggcttcgcggtccacggcttcgactaccggggccacggtaaggccgacgggcgccgggcctactgtgagaagtggccggactacctggaggacctggaggtcttctgggagcgggtgcgcgcggtgtcggagggcaagaaggccttcgtgctggcgcacagccacggcggcctgatgtcggcgacgtgggcttccagccggcgggtggaggggttgacggggctggtgctgtcggcgccgtacctcaagctggccatcacccctccggcctcgaagctgatggccgcgcgcgcggtgggcaagctggtgccatggctgagcatctcctccggactgaaggtggaggacctcacccatgacaccgacgtgcagcgggccacccgggaggacccgctccatcaggccatcgccacgccacggtggttcgtcgaatccacccgggcgcagggtgaggccgtgctgctggcgccgaagattcaagtgccgctgttcgtcctgtgtggcgcggaggatggggtggccgctccggcggcggcgcgggagtacttcgagcgggcggggtcgccggacaagaagttcaaggagtaccccggaatgcggcatgagccgctcaacgaggtgggccgtgcggaggtattccgggatatctccggctggatctccgcgcatctctgacataatcaggtcgcccggctcctagggaggagctggcgctgggtgaggtcaccgcatggcaacgggtgaaacgggcatcatcggcaagggcatcgtcatcaagggcaacctcacgggaggtggggacctggtgatcgagggacgtgtggaggggcagattgccctgaagaaccacctcaccatcgagagcaccggcaaggtgcaggcggacatccgcgccgaggagttgaccatcaacggcgaggccagcggcaacatcgacgcctcgtcgcgcgtggccatcaacgcctcggccaaggtggccggcgacatcaaggcacctcgcgtcgtcatcgaggacggggctgtgttcaacggctccatcgagatggacgtacggcttcctgacgacatttgagcttcacgccgcgcacggcacggcacacacctttcgagaggcggacaacactcatggcgaatacggtcattggctcgagcatcgtcatcgacggggaaatctccggcgacgaggacctggtcatccagggcaccgtgaaggggaagatttccctcaaggaaagcctctacgtggagggcagcggcgtcgtcgaggccgacatcgagacgcagaacgtggagatcgccggtcgcgtcacgggcaacatcgtcgccagcgacaaggtggagctgaagacggactgccgcgtggtgggagacatcaaggcgcctcgaatcctcatcgccgacggtgcctccttcaagggcaacgtcgacatggacatgaaggagcgctgattcgtggccaccgcgaaggagctctcagcgagcagcaacgtcgacaacaccgtggtggggccttccatcctcatcagcggccggttgacgggcgacgaggacctcacggtccgagggcgcgtcgagggtgagctgacgntcatccgcaccctcatcgtggagccttcgggcgtggtgaaggccaacgtggcggtgaagaacgccatcgtcagcggcgtggtggtgggcaacatcaacgccaccgagagcgtgcagctcacctgcgaaggccgcatggtgggcgacatccgcgctccgcgagtcatcattgtccacaggcccagcttccgtggccgagtgcacatgggggacgtggagccgggacgtctgccggccgagcgccccgcggtggtccgccccacggcggtgacccgtcccacggcgacacccgcgcgtccgacgattccggccgcacggcccatgcctcctccgccgccgtcgcggcccacgcctcctcctccgcccgcgcgcccctcggcgcctcccgcggtgacgcgcccctcggcgcccatcacccgtccggggttgggtggcctgggaagcaagccgctgccgccgcctccgccgacccgcgtggagcgggcggagccgcaggctgggcaggcgggctctgctgagccgccaacgccagtcctggtgggtgctggcgcgaagaagaaggtcgtggtgaagaagaagacccgctagcgcgcaccgcccgcgccgccagtcgttggcggtgcgggcgcgtgggcttttcaggggtgccaccatggacgccgagcacagggttgatggacaggatgggacggcgggtgctgggcccgaaggtggctcgcaggcgccgtccgggcaggacggcggccagggcggtgccgtgagcgccgagctgcacgcttcggggggcccctcggggccgcagggcgagcacaggcgcgaggacgcgtcaccggagtccggtggtgagcaccgagccgagggcacgccccccgccgaaggttcagaacagcgagctgagggcacgcctgccgccgaaggttcggagcagcgagccgagggcaagccttccgagcagggcgttgcgcagcgcgccgaggacacgccttcggaacaaggcgagccccagaacgccggctctgcacaggggcagggcggtgagcctcctgtcgccagtggcgacactcagggtgagggcgaacggccgcacaacgcgggcggggaagcgccgggctccgcggacgcctccggaagcgaaggttcgaaggaccaggcaggttcgcaggaaggtggactgcaggccgagggcaccacgtcccaggggcaggcagagccacctgccaaggatgcgtctcatgcgcagggcgagcaccaggccgtgagtgattcccacgggcaggacggaagcgaatcgggaggcaggtccgtcgccaacgaggaggcgcgcgccgagcagtccccctccgacggcgaggcccgtgtcacgcccgggctggacgagcgcccgcaaggcgcgttctggacgggggaggccgacggggacaaatccggcgactctgacgaggcgtcgcgggaggacgtcctccccgaacccgagcagcggctttcgggccgggtgacgacggtgctcctgccgctggagaagctgcaggacgaaagcgcgttcaagcttcgcccggaaggcgacgtgtcggggctggccacggacatcgcgcggctggggcagttgttcccggtggacgtccgcccggcgggggaagaccgctaccaactcgtctgtggcttccggcgggtcgctgcgctgcgcttcctcaagcgggacgccgtgcaggcgcggatccacttgcggctctcggacgaggacgcgctggtgatgtcgctggcggaggcgattcacgccacgccggtgggcccggaagtcctggaggcgaagcgcgacgagctcgaggcgcaggggcgcttgagcgcggccgtgcgcgacatgctggagaaggcgctcgccactgaggacacactggcgccggagggcgtcgaagaggagattgacgccgacgagctggcgcaggaagtggcgcagcggcttggggccatcaatcaagacctctcgctgctggcggacgtgttcgccgcgctggatgagtcgcgcaaggcggagctcctgatgcagctccgctactcgtccgagctggtcacctatctggaggggctgtaagccatggcggaacctctcgtgcgcgaccgtgcccggctgttggagctgctcaccgagcgctccttcgagcagcgccgcgtggtgctctcgtccggcaaggagtcggacttctacatcgactgcaagcgcacggcgctgctggccgagggccactttctcattggccggctgttcctggatgccatccggcgcgaggccccggaggccgtgggcgtgggcggactgacgctgggtgccgacccgctggcgtccgcggtgagcctcactggctacctgtccggcacgccgctggcggccttcatcgtgcgcaaggagcccaaggggcacggcacggggcagtggattgaaggcctgagcgggctggggcagggcgcggcggtggccatcgtggaggacgtcgtcacgacgggagcctccacgctgaaggccatcgagcgggcccagttggagggcctgaaggtgctgggcgccttcgcgctggtggaccggttggagggtgggcgtgaagccgtggaggcctcgggtcaccggctccacacgctcttcacccgcaaggacttcattccgtgaggcgtccgtttctcaccgcggcgctgctggggctgctcgcgggctgtgtcaccacgccgcccaccgccatcagtgatccgccgccgtcgctgccggacgagcacgcggagcattcctaccggaagattctcgcgcgctacacgggacagaaggaaatctacgacggcttcgacacgcgcgtgttcgcgggcgtgacgctgcagacgctgtccttccgcgaggcgcgcgtgcatcgccaagccgccttccagcaactgcccacggtgaaggtggagcagatgctcgccgaggagcaggcgaaggccgcgcaggcccacgagttcttcctgggcgtgcacttcaacgacttcgtctacgccgacttcgactacaagcactccatctggcgcctggcgctggtgacgcccgctggcgaggtgacgccctcgcgcatccgccggctgggccgggtgaacatgcagacgcgggcgtactacccgtacacgtcgattttctgggtggggtgggagattcagttccccacgcagatgtctgatgggagccccgtcattccgcccggcacggagacggtgacgttccgcatggcctcgtcgttgggcaaggcggacatgcaggtgagcgcgcagtagcgcagctcacgtctggctagagcgcttcagccacttctcggcggggggcatcgtcgggcccgccagcagccggtccaccagggccgtgggcgacgcgctcacggcgaagggcacggcctgctccagggggacgaagccttcctccgcgtgatgccgcgccatggccagcaatggctggaagaagccgcgcgtgtccagcagtcccatgggcttgcggtgcaggccgagctgggcccaggtcacgatttcgaagagctcgtccagcgttccaaagcctccgggcagggcgatgaacgcatccgagcgctccgccatcagcgccttgcgctcgtgcatggagccgacggagtgcagctccgtgaggccccggtgggccagttccttggcgccaaggaagccaggcagcacgcccacgacgttgccaccagcggccagcgcgccgtccgccaccgcgcccatgagccccacgcttgcgccgccgtagacgagcgtcagtcctcgccgcgccaactcggcgcccatgcgtgtggcggcgtccatgtactccggacgcgcgccgggccgggagccgcagaacacacagacacttcgcacttccatgtcaaaagcctccacgccgctcggggtgggctgcgtagagcgccaccaccagcgagagaaaaagaaggatgggcagggcgcgcgcatagacctgccgccccatgcgcagggccaatccgcaaggcaggccgaagaggaagccgcccagatgccccgcccagctcacgaaggggagcaggctgaggaccgccacctgcgccagccagatgaacaagtcccggcggccctcgcgtgtggcgacgggcagcatggcccccgcccagccgagaatcattccggacgcgcccaccgtgggcacgtcgaagtcgaagatgagtgagaaggtggacgcgcccagtgccgtcaccagcgacagtccgaagaagcgcaggctgccgatgcctcgctccagcgtgaagccgagcgtcaccaccacggacatgttgaagaggaggtggaggggactgccgtgctccagcaccgcgcctagcagccgccagtactggcccgcctgcacgaaggggccgtacaggcccaggggcggaatctgcatccgcccgtgctcgctccggaccacctgggagatgggcaggacctgctccgccaggaagagcgacaccgcgcaggcgatgattgcgtagcacacccaggggcgcggctgcggtgggcctggcatgggtgagccagggggctgcgcgccggtgccttcaccgcccgaggcggaggagggtgcatcgagaatgcgtcgtggacgggaagacattcgggctcacggctccctggacacgacggtgtcccgcaaccagcggtggtcgtccgggtgcgggtagtccagcgtgtagtggaggccgcggctctccttgcggcggctggcgcagtcgacgatgaggtaggcgacgtcggcgatgttccgcagctcgatgacgtcgcgagtcaccttgaagcgccagtagtagtcgcgaatctcctcgcgcagcagttccagccggcgccgcgcgcgcatcagccgcttgtccgtgcggacaatgccgacgtagttccacatgagcctgcgaatctcgtcccagttgtgggtgacgacgacgctctcatccgactccaccgcgctgcccgaatcccagggcggcgggtcctcggagggagagggctgggcgcgcacttcttcggcggccacctgcacggcgcggtggccgaagacgagcccttccagcagcgagttggacgcgagccggttggcgccgtgcaggcccgtacaggtgacttctccgatggcgtacaggctgggcacgttggtgcgtccctccaggtccgtcaccacgccgccgcacatgtagtgggccgccgggacgacggggatgggctgcaccgccatgtcgatgttgaacgccttgcaggtggcgtagatgttggggaagcgctcggcgaggaaggcgcgtcccaggtgcgtcatgtccaggtagacgcagtcgtcgcccgtgcgcttcatctccgcgtcgatggcacgcgccaccacgtcacgcggcgcgagcgcgcccatggggtggtagcgctccatgaaggacgcgccgctcttgagcttcagcttgccgccctcgccgcgcagcgcctcactgatgaggaagctcttggcctccgggtggtaaaggcacgtggggtggaactggtagaactccatgttcgccaccttcgcgcccgcccggtacgccatggccacgccgtcacccgtcgccacgtccgggttggatgtgtagaggtacaccttgccagcgccgccggtggccagcaccgtcaccttggccaggaagcgctcgatgacgccgtcttccagcagggcgtagacccccagacagcggctgaccccaggggaggggacgcgccggtcctggatgaggtcgatggcggccgtctgcgggaagaaggtgatgttgggggcttcgtcacacgcggcgagcagcgcgcgctgcacctcgcggccggtgatgtcgcccgaatggatgatgcggcgcgcggagtggccaccctcgcgggtgaggtcgaattcgccggtgatgcggcggttgaactccgcgcccaggtccgccagctcctgcacgcggctggggccttccttcaccgtgacttccaccgcgtcgcggtggcacagccccgcacccgccaccagcgtgtcctcgatgtgggactcgaaggtgtcagggggcgcgagcacgctggcgatgccgccctgggcataggccgtgttgctttcgaaacggtcgcgcttggtgaggatggccaccgtgccatggcgggccgcctggagggcgaacgaaagacccgccacgccgcctcccaggacgaggaaatcgaaccgatggggcatggtgagcagccttaacgactgtaagtgctggaaacaaggcgttttcttgaggactttcccgcggatgtctaaggttcgtgggccgatatgcgtgcctattccgcgttcctctccgtcgccgtgctggccctgcccttgtcggcgggggcggatgccatctaccggtacgtcgagaaggacggcaccatcatctatacgaacgtgcagccctcgggcagcaagcgggccaagacgctgaagggcacgttcaccaaggcccccgcgaagaacacgccggtggtgggccgcaagcggaccccgccggagttggatccgcacatcaccgccgcggcgctgcgctaccgcatcccgccggcgctcgtgcgcgccgtcatgcacaccgagagcaacttcaaccccaacgcgctcagccacaagggcgccagcgggctgatgcagctcatgccggccacggcgacggacatgtacgtgaaggacatcttcaacgagcgcgacaacatcgagggcggcgtgcgctacctgcgcgtgctcgccaacatgttcgacggcgacatggtgaagatggttgccgcgtacaacgccggccccgaagcggtgaagcgctacggtggcaaggtgcccccctacgaagagacgcaggggtacgtgcgcaaggtgctcaagctctactaccactacaaggagcgcgaggcggccgtctcgagcggccccagcgagcccacatcccagaatgacgacgcgcgcgaaggggcggggggagacgagccccgctgatgatgagttcctccagcagctctcccgcggtggcgagctgttggccgcaggcagggtccacgaggctcagccgttcctggagcgtgcccaccagctccatccccgcatggagaaggcgcagaacctgctgggcctctgctacttcaagcttggcctgtacgacagggcggccgagctgtacgagatgctggtgcgcgacaacccggtggacccgacactgcgggtcaacctgggactggtgtacctgaagacgtccgcgctccagcgcgcggcgcgcgagttcgagacggccactgacctggcccccgagcaccagaaggcccagaactacctgggcctcaccctggcgcagatgggcgagtacggccgcgctcgcgagcacttcctgctcgccggcagtgacgtcatggcggagaagatgtctcgcgccatcgcgggggagagctacgcgaagccggcctccgccgccgtgccgccgctccgaagcgcgccggtggagccccttgtcgccgagccgccgccgcccgccgccgaaccggaggaagaagaggagattcgcttcgccgaagacgagggccccagtgccctgtccggcgcctcggcgtccgaggcgacggacgccgcggctgacattggcgtggcgcgggaggcgcctcccgagtcggccttcgaagagaccgccgacacggtggccacgagcgtgccgctggcgcccgtgcccctgacgcggttgcatctgcgcaaggtgcccgcgacgtcgctggcgcccacgtctccggcgccggagtcctcacccgttcgggacggcgggcggtcgtcgctggccgaactcgccggctcggtcgtccttcccggcgcggaggcgtcgcggcccttctgcgcggggccgggctgctacaccgtggcggtggagggggagctcctgacgcgtctggatggcctggtggcgctggcggggcagctctccttccagccggagatgaagcggttccggggccgggccacggacaagtcgttcggggaaggggcggcgcggatggtgcgtgcccgggggcagggcgtgctctacctggagccggccgcgacccgtactttcctggcggtggacctgggcgaggactccgcgtacttccgcgacgagtgcgtgttcgccttcgaggagccggtcatgttcgagaacgggcgggttccgtcggacatcgcgccggacctggacctggtgcacctgcgagggcagggccaggtgctcttgagcctcccggggccgctgcgcgcggtggcggtgcaccaggagcagccggtgacggtgccgctgacgcacctggtgggctggcaggggaacctcacgccgcgcatggtgcccgtgctcaagtccccctctggggagccgcttcgggcggcggtggagctgggcggtgaaggttttgccctcatcgccctcggtgtccgctagaagggcccctgccatggccacggaccgagcggcgcggaaacagcggaagcgagaggagcgcgcccggaagcgcgcggcgcgcaagcccagcgtgttggtgcaggagttctggaacctgcccaacatgctcacgttggggcgcatcctcatcattccgctcttcgtgtggctgacctacgacgcggaccccctcaactctgtggtggaggggctcgtcttcgaggtggctcgccatccctgacaagggtgatgggtacctcctgcggaagtggaacctcatcaccacgggcgataagtacatagaccccctgaccaacaagctcatccacatggacgtcctggagaagacggtgcgggtggagcccatcgccacgcggatcagcatcgtcctgctggcgcggaagctcatctaccagaggcctgcgcaccatccccgccagcgagggcatggtcatcgcctcgggccacgatgggaagtggaacacgtccctccaactggtgggcatcatctcgctctgcgtccactacgtgcatccactggagttcggcaccttctccgtgccggtggactacaacctggtgggccaggtgctcgtctacctgtctggtgccttctcggtgtggagcgcggtggtctacttccgggcgttcctggccatgttggcgaagcgtgggggggagcccgaccccgcgaaaagtgtttgacgggtccggaagggctctgtataccccacctcacttccggcccggcggtcacacgacggtgacggaagcgtagcacctgatgcgggaatagctcagcggtagagcatcgccttgccaaggcgagggtcgagggttcaaatcccttttcccgctccaaaatcgggccctctggaaacccagagggccttttagtttgcagggtctgacgcgggaatagctcagcggtagagcatcgccttgccaaggcgagggtcgagggttcaaatcccttttcccgctccaaattgaggccctctgggaagccagggggccttttgtttttccggtgtcctggttgctcaggcgctggagccagggccggacattcgctcggttgatggcttgctcttcaaatgagcagccgtccgagggcgtcagcagagtggggccgggggcgccgggcgtcctcgcaacagcaagcggccctgctatagaaggccccctcatgattcggctcgtccgtgaactgtatcagtaccggggcttgctcatcagcctcgtccagcgggaactgaaggcgcgttatcgcggctcgttcctcggcttcctgtggacgttcctgaatccgacgctccacatgctggtgtacgtgctgctgttcaccgtggtgatgcggcagaacatccccaacttcccgttcttcatgttcgtgggcctgctgccgtggatctggttctccacgtcggtcggcggcggggccagcgcgatcagcgaccgacgggacttgctgaccaaggtccgcttcccggcccaggtgctgcccacgtcggtggtggtgacgaacctctgtaacttcgtcttgtcgcttccgctgatgctggtgctgggcatggcgtacggacagtggccaacctggcacgtggtgttgttcccggtggtggtgctcatccagctcaccttcacgctggcgctgacctacatcctggcggccatcaacgtgacattccgggacctgcagcacatcgtcagcaacctgctgacgctgtggttcttcgccacgccggtgctgtatccgctctccaccatccaggatgagagcgcccgctcgttgatgctggccctcaatcccatggtcagcctgatgacgtcgtaccaggccatcttctacgagcaccggcttccggacgcagagcccttgatggcgctggcggccgtctccgtggtgctgctgtgggccgcctcgtccatcttcgaatcccgccgcgaagagttcgcggagtccatctgagcgtcggcatgcctgaatccatggacgccatcatcctgaaggacgtcgtgaagagcttccggaagcggaccatccggggcgagtacacgaccttcaaatccgagctgcttcgctggctgcgcggcaagcgccagtcgcgtgatgccagcctcatcaccgcgctgcgcggcatcaatctcaccatccccaagggtaagacggtgggcatcatcgggcggaacggctcggggaagagcacgctgctcaagctcatcaccggcatctacacgcccacctccggcgacttgcagatcaacggtcgcatctccgccttgctggacctgggcgctggcttccatccggacttctccggacgggagaacatcctcatcaacggcatcatcctgggcatgacgcgcgccgaggtccgggcccggatggatgaaatcatcgccttcagtgagctgggcgagttcatcgacgagccggtgcgcacctactccagtggcatgtacatgcgcctggcgttcgcggtggccacgcacgtggacccggacatcctcatcatcgacgaaatcctcgccgtcggggacgagcacttcagcaagaagagcctcgccaagatgatggacttcaagcgtcaggggaagaccatcgtcctggtgacgcacgagctgggcaccgtggagcgctggtgcgacctggctgcgtggattgatggtggctacgtccgccgcgtgggcaagccctcggaggtcaccgccgagtaccgtgaggccatttccctggcggaggcgcagtccgccgccttcacgcctccggcgctcacggaagggggcggtgcgctgccgcaagtcccctccgaatcgctgcccgccgaagggcccgtccgcatccaccgggtgcagttgttggatgctcggggagagtccctggaagtcctgtcgccggaggagggcctggaggtccgtgcggatttctccgtggaagggccgtgtgaggacgtggacttccacgtgcgactgcaggccgcggacggacgcaccctgtatgagacgagcacccgcagtgaggcggtggtgctctctcggatgccgaacccgggcgtgcttcgtttcgtggtcgagcgcctgggggcgctggggggcgactactccctggtggtgtcggctcgggcctcgaagggtgagtcgtccgggcgctgtgcgttccgggtggtgtcggcgaccgaggaggagggggtgtttcgtcctcctcaccggtggttggtggagccgggtgccaactcccaggcgggcgtcccattcgagccgggcacgtctccgcgtgtggaggtgggatgaaggttcaggagcgcgccggtacccagggcgaagggtgagtcatgtggcagaagtgggctgatgtgacgcaggggcacgtggcggcgccggggccgggagatttcgcgcagatggtggctgtcctccggaaggtgctggaggagcgtcagccgtgcgcgcccgaacagtgtgatgagcgcagcgccctggaaggcgcgctgcgcctggcgacggagcacctccaccgcgcgctccccgacggcggccagggcatgtcctctctccaggaagccgcgaggctggcggacccggctgcgttctccatcccggcgtctcatcgggcgcgtgggggcacgctggtgacgtccgccaagcgtgccttcgtcaacgggttggagccgttccacgtcgagatgcttcggcctcaggggaacttcaaccgcgcgctcgtgcgggtgctggagtacctgacggtgcatcgggccctgggcctgcgcgatgacgtgtcctcctgggccgtcgctcaactggagccgctggcggtgcccacccggtgggtggtggggtcgcatcgcggccgcgtggcgggagcgctggtgggcttcgccaagcggggctacctctacacgttggggcccgtgctggaggccgtgcttcaggggcaggcccggtggaacctggccatggtggaggccatccgcgcggcggcgggtgcccaggcgccaggagaagccgaggcccgccgccatgtcgcggacgtcgaagcgctgcgcgagccgctggcgggccggaccctgcccggcgccctccgcgtcacccagccactgtggggcgaggtgctgcggcggcagtcccgtttcaatgccgagtcggtgctcgcgctcgccaacctcctgggcacgcggacggcaccgccacagccgccgtcgctggcggactaccccgcctggtgcgcggcgcgggagccggcgcgtgtcaccgcggcacaggaagccgtcgcgcggctgtcgcggcgcccgctcatctcgctggtcacgccggtccacgatgcctcggaagccttccttcgtgagtgcctcgcctcggtgagctctcaggtgtacgccgactgggaatggctcctggtggatgacgccagcaccgcgccgcacctggcgcgcatcctccgggaagcggcggagcgggagtctcgcatccgcgtcctcaccgcgtcatccgaaggggacacggcccgggccaccaacgaagggttcgcggcgtgccgtggggacttcgtggggttcctgggcgccgaggacacgctctcaccgcatgcactggccgaggtggcgctggcgttcctggcgcagcccgagctcgcgctcctctacacggacgaggacggcttggacgcgcagggccaccgctccgcgccgttcttcaagccggactggtcgcccgacctgttgcgctccgtggactacgtccgtcacttcctggtggtccgtcgcgagacgctggcgcaggtgggcggtctgcgagagggcttcgatggcgctcagggccatgacctgatgctacggctgagcgaggccacctcgtccattggtcacatcacggagccgctgtaccacgcacgtgaggggtcggcggcttcggccagccggggcgctgggctggacacggcgacgaaggcgggcgtgcgggcgctgtcggagcacctggcgcgccagggggagtccgcggaggtgacgagcccggcgcccattcagtaccgggtccgctatccggtgcggggcacgccgaaggtctccatcatcgtcccgttcaaggaccgcccggacctgctgcgcacgctggtggacagcctcctggcgcagacccgctacccccatttcgaggtgttgctcgtctccaacaacagcacccggccagagacattcgcgctgctggagcagtgggtggacccgcggctggtgaagctgacgtgggaccaccccttcaactacccggccatcaacaactgggccgcgaagcaggcctccggggagctgctgctcttcctcaacaacgacatggaggtggtggacccctcctggctggatgagctggtctcccaggcccagcggcccgaggtgggcgcggtggggtgcaagctgctcttccccgagggcaccgtgcagcatgcgggcgtcgtggtggggatgacgggcttcgcgggacatcctttctggcggctgccggaggggcccatctccactccgttcgggcacaccgaatggacgcggaactggctgtccgtcaccagcgcgtgcgtcatcctccgccgcgaggtcttcgagtcgctggggggcttcgacgagcgtttccaggtgtgtggcagtgacgtggagctgggcctgcggctgaatgcccagggcctccgcgtggtgtgcacggcgcagacgcggctcattcatcatgagtcggccagccggcgtgcggacgccattcccgaagcggactactggctgtcctatgctgcctaccggccgtggctggggccgaagggcgacccctactacaacccgcacctcacgctgacggccacggactgcggcctccgccgacatccggaggatggcgagcaactggcggtccggacgctggggcgcgacgttccgagcgcgcgggatgtccggggcgagcagcgtgcgcgggcacagcggcacctcatcgagcacctggaggcgtgggacttcacgcccgaacaggcccagacctcgcgcgagtcggcgccggcggcgctggcggcgctgcgcgcgaaggggcgggtggagacggcaacctggttcgttcccgccttcggccatgtctacgcgggcatccacaccatcttccgcttcgcggacctgatgcagcgccgccacggcgtgcgcagcgacttcgtcatctacgaccagccgaacgtgaggcccggtgacatcgaggcccgcgtggcggccatctgcccgggcgcggtcggggcggtgcgcgtgctgcgtcggccagaggacgtggcgctcctgcccgcatgcgatctggcgctggccaccgcgtggacctccgcctatcgcgtgctgcaccacccgcgggcgggccttcgcggctacttcgtccaggattacgaaccgctgttccatgcggcgggcaccccctccgcgctggccgagcagacgtatggcctgggcttctacggcatcttcaacacgcccgggctctacgaacacgtcgtgggcctgcatgggatggagggcgcctggttcgagcccgccgtggatgggaccttgtttcatccgcgccggccaccgcgccagggtcctgtgcgtgtgttcttctacggacgcccgggcaatgagcgcaacggcttcgagctggggttggccgcgttggcgcagctcaagcgggagctgggccccgccgtcgaggtgctcgcggcgggcgcggagtgggaccccgaggcctacggcgtcagggggcttgtcaccaatctgggaatgttgccggcggaacggacgggggcgctctaccgcgagtgtgatgtcgggttgtgtttcatgttcacccggcatccgtcgtacctgccgttggagatgatggcttgcggtgtcacggtcgtcacgaacgacaatcccaccaatcggtggttgctgacgcacggtgagaactgcctgcttgccgagccgaccccgagtggcgtactggcccggcttcgcgacgccgtctccaacggcgcgctccgggcccggctcggtacgaatgccgcggagcgggtcagccggacgtcgtgggaggccgaggtagaccgggtcatgaagggcttgctgaacacaggtgcgcacccagcggcgacgctggatgaccgggcttcatccttggaacacgccagctgaacacaggggcgctggcggtcgaacattggcccagggggccgcggcagaaggaatctccaccatgcgggatgacacccatcttcacatcgcgtcgtcgccggagccgagcgccccgcggcagtcgcagccggaagaagcggcaagcagccagtattggaaggccacgagcggctacacctatcgagagatgatccgcacgcgccaggacgcgggcaaccccgggtatggccaacaagaggcgctgctcacgaagctgatgcagaccgagcaacgcgcgctggggaggccgctggacgtcctggagtttggctgcggcttcgggcggcatgcctcctatctggcgtccctcgaaggcgttcgctaccacggctacgacttctccgaggcgatgatggagcccctgcggcacgcgccgcccgtggggctggagcccgtggaagagcggctcttctgtgggccggatgccctgacggcggtgggggacaggacgttcgacgtggtgttcaccgtgtccgtcctcatccacaacccgccggagcgcctgcctggcctgctggaatcgctgggcaagctggtgcgtcctggcggattgctgtgcctggtcgaaaaccagcttgttcccttcggtgtttgggagaacgcctggcaccagggctgctggctgcacccgtacgcggaactgacgcccgctggctgggacatgcatcatggcggtggcctcctggccacgcatgacgtctacgtcttcaagcgcaacgcgtcccaaggccgtcgcttcttccagctccagtccgtcgaggagccccgggacgagcgccgggaggtgacgctggagtcgctgaacgtcgagtccctgccccgactgcgggcgtggacggagcacgcgggcgaggtgctccgggaggggaacggcctgacggggatgcaggtctccgagctgacggagcgcctgacggtcgaactgaagcggtcggagcggcggcagcgcttgttgtcgctttcggatgagctggtccgccttcgcgccgagccggtggtgactgctcgggcgccggccgacgcgctggcgccgcggtatgggcatgacaacgcggcggaggccgtcgttgtcgatgcgccgctggatacgacgtgggctcacgtcgacccgcggctctcccgggtggtgcatctcttccaccaggagtggtacggcatccgtgctgcgtctggctacgcgccgggacacaagattggcatcaccgcgaatcgcgcgttgaccgcggcggaccaccagcgcatcgccgaaacgtgtgagcggctgggcgcacggtccgtcatcttccaggggttttcgcccaatgccctggaagtcatgcacatgcttcgccgcgtgttcggcagcacgctcaagctatgctgcgtgtggcacg

SEQ ID NO: 1165 - DNA, 16541 bp, Myxococcus xanthus
gactgacttcagccgcgcagtggcagggtgaaggcgagctggaagcgcgtgcccgcgtgctccgggcggacggtggcggtgacgtgcaccccgcggccgttgtccgtggccaccaactggccgcgcagttgtccgttctccgtggcgccccggaagaggaacacctccgcggcctgcgagaagatggcgtccacgtcgtcgccgccggtgcccgcgggcaactggtgccgcacccaggtggggaagcggacgatgcgcccggtgagcaactgcgcgggcagcggcaccgcgtagcctcgcgccgaacaccatgggcgcggggggcagcagcaccgcgtccgcgttgcgcccgctgcccaggcccaggatgccgcgctcctccagccgcgcctgcgcccggatggggaggaagtgctcggtgggaatgctcagcccggtatcgcggccggtgggcagctcccacatggcgggcgccttcaggccgccctgctggcccatgatgcgcgcgaaggcgctggtgtcccggaagctggccgccagcatcgccgccaccgccagcgcggggctggtgaagctcacgcgccgggccgcgccgcgaccctcgctggccaccaccgcgcggttgatgacggcgcacagccagcgcgcggactcgtcctggcgcagctccgtccaggcctcggggacatgctcgcgctcctcctccagcgccacggccagctccgcctgcgccacgcccaggagcggcgcggacacggcggccaccaccgggagctgcgcgcgctcgcccatcgccgcgagcttgcccaggagggcgacgtcgtcggtggcatccatgatgaagacggcgtcggggcgctcgaagggctcggcgcctagcgcgccctgcacggcgtccagcagcccggcgcgcgccacgtccagcacctccacggagatgcccgaggacgcgggcacctggtccagcagccacttgaggccgcgccacgcggactccaggtgggccacgggctcggcgccgagcaggtccttcgccgtgaggagcagcgcttgctccaccaggtcccgggccgtctgccgggtggcggcctccggcgtgacgacgggcgcgggcgtggcgggcacgcgtggattgatggcgcgcaggaaggcatccaccgcccgggacgcggcggcgggcgtgctcgcgtcggcgcgactgaggagcgtctccaccaggtcctcgccggattcggtgggcgcggtcgggcgccgtgggagcgggcggcgtggagaccgcgcgcagggcctcggccaccgcgtccggaaggcggcctgggccggtgacggtggccacgcgcgtggcggcctcctcgggcgtcagcgtgcgcagcggatcggacgtggacagcgattcgtgcaggtgctgcaaggcgcgcagctccgggacgcgggtgatgacgtccgcgtagctgaaggcgcgcagccggtcgaaggacagctcgacggtgcgcgtgtcacccgcgcccagtcggtccgccacggtgacgcggagcccgctggcggcgcgcgtgagctcatccccgaaggtgttcaccgtgagcgggaagcgccggcccgagggggacggggagaaggcacccaccaccagccagcgcacgcgtgcgctctcggcactgcttccgttctggctcatgtcccgcatcccctccacgacgagaaggccgctacgttagcgcgccggcatgtcggcacggctgccggacggagcctggtgactgcgaccaccgccccctgacggcggcagtcaccaggggccagggcctcacggggcgcgggcgctccagcgactcaagtgaaatcaggggtttggcggggaaaggagggctcccgacggttggcacacctgctgctactggtgcgtgggtcgcctacagcagccctccaaccctccccgaaggaacttccccatgcgcctctctcctctcagcggctccgcctcctccgccgtccgctccccggcccaggatgtctccgtctcccggccttccgcgtcgctgtctggtccctcgggtgcctcggcccagaagccgtcgctggggcgcatcgggatgcagcaggatggcttcgacctgggcggcggcaaggccgagtccctgggcaagctgctcgagggggccctggcgattatcaacacgctggcccagctccagcaggccatgcaggcgggcggcgcggcgggtggcgcgcagggcgcttcgtacggccagggcatttccggtgctcaaggcgcccagggcgcgtcctcgtccaagtgcttcttggacagctccttctcgcctgcgtcggcccgcggtggccgtcctcccgtggagctgaaccccagcgcccagggcccgtctccgttcatgaatgagccggtggagggcctcacgtcggcgcctgccgctggtggccccgcgcccgcgcccgctccggtgagtgacatcgagggtgcgccggtgggcggcatcggcgcggcgccctcggtgggcgcgagcacgggtgccggcggcgcgagcctgggcggcaacctgcctccggcgctggagaagctgcgtccggcgctcgagtccgcggcggccaagacgggcgtgccggtggagatgctggccgcgcaggtgtgggcggagtcgcgcggcaaggtggacgcctcgtccaccaacggcggcaacggcatgacggacacggggttgatgcaggtgaaccccaacaccttcaaggggctgcaggacaagtaccccgagttgcagggcaagaacctgtctgacccggagacgaacatcctcgcgggcgcctgctacatgaaggacatgaaggcgcagttcgggaactgggacctggccctgcgcgcctacaactccggtccgaacggcgtggacaagagcaacccgcatgcgattcccgcgggcctgggcagtgcggactacgtgcgcaacgtgaatcagttcgccagcaccctggcttccggtcagggcgcgctgccggcgtagtcgacgctggcaggtaggacgacggcgggaggctcaggaagactcgcggccgaagctgccgcgagcccgggagccaccgccgtcggtgttacccaggacgctggtgtggagggaacttttctccaccagcgtgccttcgtccatggcgctctgcgggtcgccgacgacgagcatgccgccaccctggtgcagctcccacgcggagcccacggagtcggcgatctgctgaccggacacggagtacttggtgcccgtgttcgtgtccttcacctggtagttgcccttgtcgtccatgccgtcgacgacgacccagtgcgagtcaccggcgatcttggagtccacgcccgtggcgagccggttggtgtccagttggacgacgacttgctgaccgcgggcaagcgcctcgttcaccgaaggcatgtcgaagttcgaggtgcccttcttcacctccaggccctcgtgcgcgagcatcttcgcgagctcctccggggtcgtgccgccgccgtcggtgaagcgcgactccagcgtgtccatcttctgcgccgccgacgcggagtccttgcccgcggtgcgcgacagcagggtggccaccgcggcgccgcagttggagtccttggtctgcttgatgacttccgatgcgcccgcggcctcgaagctgtcggtgaggtaccgggccaccacgtcggggacggacggctgctggggggcctgggtctgggcggggccggacgctgcgggcgggacgctctgctgcgtccgggtctccgagagcctcgcgatggactggaagaggttcactcgcatgggcggtcttccctgggggatgggcggagcccacatggctccaattcgagcttatctccaatctctggagaaagttgttttcggagcgctcaagcgccgccgctcggttcgataccgtgctttttcaggagcttgcggaggtagacgcggtcgatgtcggcctcgcgggaggcgcgggagatgttcccctcgcagcgctccaggaggttgcggaggtagtcgcgctcgaagccttccacgagccgctccttggcctccttgaagggcaggtccaggtcggccgcgctgtggccccgctcgctgtcggcgggctccagctccgggagggcctcctcgcccaggttcaccacctgctccaccacgttgcgcagctcgcgcacgttgccgggccaggggtactgggtgagcagggcgcgcgtctggtccgacagggtgctgggcgggcggcccgtctgctcgagcatggtgtcgatgagcagggggatgtcctcggggcgctcgcgcagggagggcatcgtcacgcggagcacggcgagccggtggtagaggtcgcggcggaacttcccctgccgcacggcgtcctccaggtcccggtgggtggccgtcaccacgcgcatgttgacggtgacgtagtcgttggcgcccacgcgcttcacctggcggcgctccagcacccgcagcaggcggggctggagctccagcggcagctcaccgacttcatccaggaagacggtgccgttgtgggcgcgctcgaaggcgccggcgcggtcgctctgggcgttggtgaaggcgcccttcacgtggccgaacagctcggactcgatgagcgagggggccacgcccgccaggtccacgatgacgaagggcccgctggcgcggcggctggcctggtggatggcttcggcgcacaggtccttgccggtgcccgtctcgccctggatgagcacgtccgcgccgcccggggacaggcgctccagcagggtgaacacctcgcgcatccggcggctgttgcccaccagcgcgccgaagcggtcgcggttggagagcagcagcgtgcgcttcgccgactcctctggcaccagcttcagctcggtggtgcccagggtgatgacggtgcctgggtgcagctccaactcggtgaagcggcggccgtcacacgaggagccgttgcgcgagcccatgtccgtggccaccacgtgttcgtcgtggaccgtcagcttgaggtgctcgcgggaaatcgtcttgtcggtgaggacgatgtcgcacgtgggggccttgccaagcacgtactcgggcctggtgagcgcatggctctggccggactcggggccggacagcaccatcaacttcagccggacccggccttgccgcgcgcggctcagcgtcagcgtcgggtccagcgcgggatcctcttcgttcgacggggccacgggagcgggacgctaacacggccgacacggcccgccacccgttgggtccgtggcgacttcaccgccggggcttgcgtcgcgcgggccggggggcaggctcgggcggcagcgtcgagagccaggcgtccacgtccgccacccgcgcatccaggccggcctcggtgaagcgcgcccgggcctgggccgcctccccgcgggccgccgggggctgctgcgtcatccacagggcgcgagccagggcgaagccggactcggccagcacgtcgggcggggccgacgcgaaggagacggcctgccgcagcggcgccaccgattcgttcgccttgcccagctccagcaacgcctggcccacgccgtcataggagtactggaggcgctcgtcgtccgcgggtagcgccgcgcgcttgatgaccagcgcctcttcgtaggccttcagcgcctcgtcgtagcgcttcatcgcgtgcaggcacatgcccacctcgtccagggtctccgcgtacaggacgctcgtctcgccctgcgtggccttgcggacctgggccgccgcctgcgcgtgcgccagggccttggcgtcctgcttcagctcgcgcagcgtcagcgacagcatgccgtggcgctgggccatgtccgggtgccaggggcccaccgcggcctccgtcagtgtcagcgcttcctccagcagcttcaccgcctcctcgggcttccccaggtccagcatcacgccgcccagcaggaaggtggttcgcgcgcgcttggggtggcccaggggcagggcgtgggcctggagcgccttggcctgctccagcagcgtgcgcgcatcctcgaagcgctcctgcgacaccgcgaggttggcctggttcatccgcacgtcggcttccagcacgggctcgccgcccagacgctggagggtcgcgtgtgccagctcgccccagtccgaggcctgggtgaagtgctgctggccgtcctccacgtagagcagcttgttgaggatggcgaccttcagccggtccgcccgccccgcctcggcgtcgcgcacggcgtggaagagctgcttcgacgcctcgggggactggccgttctgttcctggagccagcccaggtggaagcgcagctcggccgtgagcggcaggtggccggtggccagcaccggtgcctccagcgcgcgcgccgtctccagggctttcggatagcggcccgcgtccaccagcgccttcacgcccgcgagctgctcctccagcttctcgatgtcggcgcgcttcgccgcgtccgagggcagccgctgttgttcggccagggactcctcgtcctcgcattcgtgcagcgagggcagggcgtgcaccgcgtccaccgacttctccaccagcgacgcgtccgcgctggacagcagcgccaccgtggcgcgcacgtccttgtgccgccgcgccagacacaccgttcgccgtgtcagcagctcctccgtctgcacgccgtggacgtgggtggcttcgcaggcctcggtgctctgctgcttccacgcgctcgcgtagccgtccagcacctgggacaccttgccggccagctcctgcgcgaagggcttgccagtggcgaggaaggccgcctccacctgttgccgcgccgccgggctccagacgtcatccatgcgcgcgcccgcggccgcgcagacctgggactgctggtagaggacgccgcccaccagggccacgcccgccgccacggtgctcgcgcccgccacccagcgccggcgcttcgtgaagcggtgctcttgtgacagcgcgccgagcagcgcctccatggacgcgaagcgcgcggccgggtccagcgacaggccgcgcatcatcgcctgcttcacccaggcggggaccttcacgtcgcgcggcggctcctggatgaggacgggcggcggcaggggcttgggggcctctcgctccaggggcgccgtcacgttcagcggctcggtggcctcgaccacgggctgggcctggggcttccgcgaggaggcataggcctccatcttggcgggctcgaaggggcgctgacggtagagcgcccagtacagcgcgacgcagaagctgaactggtccgagcgcgggtccaggtcatccccacggaactgctccggggacatgtagctgggcgtgccgatgatgaggcccgcctcggtgaggggcgtgtccagcatgcgccgctcggagggaatgagggcctctgcgtcctcggagaggggctcctccttgggcagcgtgcccaccggccgcgccaggccgaagtcggtgacgaagacgcggcctgccttgttcaccagcacgttggcgggcttgaagtcgcggtgcaccagcccggcttcgtgcgcggcctggagcccccggcccgcggcgaggaaggactccagaatctctcgccaggagcgctgcccctccttcacccacgaggccagggtgccgccgtccaccagctccatggccaggaagacgcggtcaccccacacgtccacgtcgaagatggggatgacgttggggtgcgagacgcgcgccatggcctgcgcctcgcgcagcagccgggctcgggcctcctccgagtccgtccgcgagtccgcgtgcagcagcttgagcgccaccttgcggtccaggtccgggtcataggcggcgtacaccacgcccatgccgccctgtcccaggcgcttgaggaggaagtagcgccccacctggggaacgggtggcgcgtcgtcgcgccgcgacccagggccggtgccgaaggcatcgccctctcgattgcccgtgcccgcgcgtcctctaccgctgtctctcatgctcatggccgatgcacccggcgtcactctatccgcgcttgtccatcaggcccatgttccaggctgttcgcatggctgcctgcgcacccggcctgtgtctgccgtcaccgacgcgtgggggactgtcctctggacctcctgggtgcttcagaggacagggggcgcgtttgcgcgaactacaccggtgtgaacttcacgccggtcgccttcgcacgctccaaagcctgcttgatgtcctcggagacgatgagggcgatggaccagccccaggtgcggaacacctgggcgttgcccacctgggcgaggtcgacgcgcatgccgtagacatcccggtactgccccaccttctcgggccgcccatcctccgggcgccagtggagcacctcttccgatgctgcgtcgtcaatgcagcgaatgagcctcgtggccaccaggatgaagtacgggtccagggggccatggatgtccacggggaggagctgcacgtccttgggagccatctccaggaagatgttggccacgctggcgctgaccacgggagtgctgaagcccgcgagagaaaaatcgagggccttgcccggctcctcgataggaaccgtgaatcgctggctcacctccactggatggccctcccggaacatccaagggtcgtctacttcgtgacctcgcgcatctcccgggtggcccaactcccaacggcccggaatggaaacgttgtcggcgagctggaaatacttcttggccatcatggcgcctcggtatcactcggttcgagtgaggagcttgttcaagccggagcccggggcgccggcttccttggcgagttgtctgagttcgttgaccaaggcctcccggcactcggtcatcttccggcagcctttcgtcgcttcctccagccgtgcgtagacccgctcatgatacctctggggatgggggcccttgtggcccttcacgggcacgatgttctcagggtcttccagctccatccctgccttcttgaagattctcttgaaccggggcgtccagggcccgccgcgcacggtggagacgccgttcttgttcgtcgcgaggtggtggttttcggagcggccgccgctcatgccttgggccgccatggcgaccgcgttgggcgccagggcgacagtgaagccctcggccgtcatcgccaccgactgcacgcttccgatagtcaagtactgatagcccgcctgcgtctccaccgcgagcgcagcctgcgccgagcccggcagtctcgaggactgcgtcgccaggcccgccgtattgcttatcgccgccgtggccagcatgacgaagacgcgcgccgcgttctccccgagcacttcgccgtacgcctcgcccgcctcgctgagttgctcgaaggtggtggcccggtccacttcgcgcaccagcgccatccacccgtccagaatgcgccacacggtatccacgcccaggtaggcaatggccgaggccgtcagcagggcggccagtcccttgctcactggctcgggcagcgaccagaggagcaggtacatgctgaccgaggcactcaccgtcgccagcagtgcctgtgggtcggccatgtcctccagcgcctctgctgtctcttcccacaccgagtccatggcgatggccatggccagcgagtacttgccgtcgctggccagcagcgggccttctgacaacaggcgcaggcagtcaccgggctgcgacttgcgctcgcaccagcggccataggcgcgcgtcagttcgtcatccgcgtagacttccaggagatgcggaccgcctgggtccttcccttcatcctgggggatgagccgggggccgtgcccctcgtacaggtacacgccgcttcgctcgggaacgccgaagcgctggcgggcctcgcgcaggggattggagaagggccgcacgccccgggcgagcgccaccatggtctcctcgaattcatcgtcggccagttccacaggcccgtcgccttcctccgcgaagggcgtgtggacgatgagatgtccgtcgccggtgtccaggcgcacgagtcgcgtggtcgaacagcctgtgacggcaagcgccagcaccagccagatgaccgcatgcgctctcatccaagtcctccggttccggggcgcgctcctgcgagaccaggccaggaatacaagaagagtccgaccaagggccacgagatgtccaagcgcagtgacggctcgctcggcgaactcctggctcctgtcaggtgagcccagcgccgctaccatctccggttgggcgtaggtagacagtggtgatgccgggggggagccgacggaaggactcggcgtgcacgttccccactccgcggttaccttcgggccgccatgtcccttcgcaaggattacatcgagcggctcatcgaggagttcgccgccgcgctggcccgcatcatcaaggcgcgccgggagaagaagctcgcggacgcccagcgcctcatccaggagacggcgctgtcctcgctgggcatggagtacgccgcgctgctgatggcggacccgggggccaccgcgcggctgctgggctcccccacgcgcgtgaaggtgctcgcgcgcctggtcgccgaggacggagagctgagcgccgagcagggcgacaccgccacggccacttcccgcattcactatgcgctcgcgctgtacgacgaagtccaggccctgggcctcacgccggacgccgacgacacggccaccatcgcccggctgcgcggcctgctggcggtgcctgacgcccgctgaacgcaatccctcacacccgtccgagagatgggtcctctatctgacagagtgaacgcctggatgtcttccattgggcgtgtctaaaggcaccctcggggacccctgggttgcatgtcagtccattctcctggttacaatggcaggccatttctccacgccagacacctggggggtgtgcgtgtccttcatccagcttccgcggagcgtcgtctcgtgccgtaacctcgttggaggaagctggcaggtgccgcccggtgcggcgcaccttgatgtccggagcccctacacgggcaccgtcattggcagggttcccctgacgcccgcatccggagtcgcccaggcggtggaggccgcgaaggcggcggcggctgcctggaagaacacctcgctgcgggagcgcacgcagtacctgtaccgcttccgccagttcctcgagcgtgacctggacgccctggcccagctggccgccagcgaggcggggaagacggtggcggaggcccgcgcgggcctgctcaagggcatggaggtctgcgacttcgcgctgtccctccagaacctcgacacgggcgcgcacctggaggtcagccgcggcatctcctgtgagtaccgccgcgagccgctgggcgtcgtcgccggaatcactccgttcaacttcccggccatggtgccgatgtggatgttccccatcgccgtcacgctgggcaacgccttcatcctcaagccgtcggagaaggtgccgctgaccgcgtgcgcgctgggcgagctcatgtgtgaggctggctaccccgcgggcgtcttctccgtcgtgcacggcggcaaggaggcggtggacgcgctggtggcgcacccggacgtgcaggcggtgggtttcgtcggctcgtccgcggtggcgcgccacctgtacgcggagggctgcaagcgcggcaagcgcgtgctggcgctgggcagcgcgaagaaccacctcatcgtcgtgccggacgcggacccggagttgacgccgcaggcggtggtggactcgttcaccggctgcgcgggccagcgctgcatggcggccagcgtgctgctcgcggtgggcaacgtggagtcccttctccaggaagtcgtccgccgcgcggcgaagctggaattgggccccggcatgggcgcgctcatcgaccggggctcgttggaccgcttggagacggccattgcccgcgcggaggccgagggcgcgcgggtgctgctggacggccgtggccacaagccgcagggcgagccgtggtccggcggcaactggctgggccccacgctgctggacggcgtgcgtccggagatggaggccgcgcggcgcgagctgttcggcccggtgctctccatcgtccgggtgcccacgctgtccgcggcgctggcggtggagaacgcgtcgccctacggcaacgcggcgtccatcttcaccacgaacggtggggtggcgcagacggtggtggagggcgtgcgcgccggcatggtgggcgtcaacgtgggcgtccctgtcccgcgtgagccgttctccttcggtggcacgggcgattcgcgcttcgggcacggggacatcaccgggccgtccagcctcgacttctggacgcaggtgaagaaggtcacccgcaagtggtcggcccggaccgacggctcgtggatgagctgaagcgcgccccacgacgcgaagcaccgccccccgcaccccgactttgctcccgcgcccgcaaggagggcgctcccatggccgagaaaaagaatctcaatcacatccgcctcacctcccacccggatggcgacgtccccagcgtccccatccgctggggagacggcgagccgacgcgccgcggccccgtcgtcgccacgctgacggaagccgggcaccgcaacgtcatcggcacgcatgccggcgcgtatgccgtgtaccgcgcgctcgccgtggccgcgggcatgctgccgcaggaccaccgcgccgacctgaagaacaccgcgcccgccgcgcaggtggggccgcatccgtcgtggagcgacccgcagcgcatcgtctcgctggacccgtggggcgccatcgcgccgcaggcgttccggcccttcgcggagcagggcatcgacttccggccgaccatcgccgtcaccaaggcgcacatcaacttccccgaggtgcgcgacgccatcgatgccgggcgcttgacgccggacggggacctgctgcgcggcaacggcgacatcaaggtgaccaaggccgcggtggacccggtgtggtacctgccgggcatcgcgaagcgcttcggcatgacggagagcgcgctgcgccgtggtctcttcgagcagacgggcggcatgttcccggagctgattacgcgcccggacctgcacgtcttcctgccgcccattggcgggctgacgctgtacgtcttcggcggcatcgagacgctggcggaccgggatgtgccgctgacggtgcgcgtgcatgacgagtgcaacggctccgacgtgttcggcagcgacatttgcacctgtcggccctacctggcgcacggcatcgaggagtgcgtacgcaccgcgcaggcgggcggcgcggggctcatcgtctacctgcgcaaggaaggccgggcgctgggcgaggtgacgaagttcctcgtgtacaacgcgcgcaagcggcaggagggcggcgactccgcggccacctacttccagcgcaccgagtgcgtggccggcgtgcaggacatgcgcttccaggagctgatgccggacgtgctgcactggctgggcatcacccgcatccaccgcttcgtatcgatgagtgacatgaagcacgacgcgattacgcgctcgggcattgaaatcctggagcgcgtccccatccccgacgagctcatccccgccgacgccaaggtggagatggaggcgaagaaggccgcgggttacttcacgcaagggccggtggcggacgcggcggggctggcgcaggtgaaggggcgggacctcgatgtctgatttctcattggccaggccggacctctctcccgcggtggcgtggctgcgcacgccgtccgccatccgcgagcggtgccaccaactgttggacctggggctggcgggcaagctggagcacttccgcgtcgagccgtcgcggctgcccatcgtcgtggacacggtgctgcacgtgacgcgcgagcactaccccacgctggatgtgccgctgcacagccgctggcgccacttcgacgtgggcggcgtggcgcggttggcggagctggaggcgcggctgaaggacgcctctcttcaagagcgggcgcgcgcgaagctggacctggtggtggtgagcgtgctgctggacgcgggcagtggcccgcagtggcgctaccaggaggccggcggaaagacgtgggcgcgctccgagggactggccgtggccagcttccgcatgttcatggaggggcgcttctcgtcggacccggaccggccgctgcgcgtggacgcggaggcgctggggcggctcacgcgcgaggcgctcgcgcagggcatgcaggtgacggatgccaacccggtggatgggctggagggccggctgcacctgctgcacgggctggcgaaggtgctgcctcggccaggggcgctgctggacatcatcaccgcgcagcagcgcagcgtgcgcgccgcggagctgctggggctggtgttggaggtgctgggccccatctggccggggcgggtgatggtggacgcggtgaacctgggcgacgtgtggccacatcccgcgctggggtcggtggagagcctggaggcgctggtgcccttccacaagctgtcgcagtggctgacgtattccctggtggagccgctgtccgaggccggtgtggtggtgacggagctggatggcctcaccggcctgcccgagtaccgcaacggtggcttgctggtggacctgggcgtgctgtctccccgggagccgcgcctcttcacgcagtccttccacccgggtgacgagcccatcgtggagtggcgcgcgctgacggtggccctgctggaccgggtggcggcgctggtgcgtggacggctgggcctgagcgcggaggagctgccgctggggaaggtgctccagggtggcacgtggaccgcgggccggcgcgtggcggcggagcggcgccctggtggcgggccgcccatccgcgtggacagtgacggcacggtgttctgacgggaggacgcaatggagtttccgaactgcacggtggtggaccacccgctggtgaagcacaagctcacgcagatgcgccgggtggagacgagcaccgcctcctttcgggcgctgctccaggaaatctcactgctgctcgcctatgaggcgctgagagacctcaaggtgcgcgaggaggacatccagacgcccatggcacgcacggtggcgccggtgctggatggcaagaagttggtgctggtggccatcatgcgcgcggggcagggcatcctcgacgggatgttgcaactggtgccctccgcgcgcgtggggcacatcggcctgtaccgagacccggagacgctgtcgccggtggagtactactaccgcgtgcccggccagctcgcggaccgggacgtggtggtgtgcgacccgatgctcgccacggggaactcggcggtggccgcgctccagcggctgaagaagagcaagcccggctcattgcgcttcgtctgtctgctggcgtgcccggagggcctgacgaacctgcgcgagcaccacccggacgtccacgtctacaccgccgccatcgacgagcgattggacgagcacggctacatcctcccgggcctgggcgacgcgggcgaccggctcttcgggaccaagtagcgcggtggaggagataccccttacccggcaacggtgacttggcgcgcggacgtgtccgggacaggatgcgcgccgcggacggggccggcgcaatcggttggggtgcagtgatgcaaggaatgcttgttcgcgcccggcgcatgagggtctggctgggctgcgccagtgtgctgggactgtcgggaatcgcccgggcggagtcggagccgtgcgcgtgctccacgtcgaaccagagcgtcgtctccgaggtgccgtgcctcattttccgcgcgtccgtcagctgcggactgagcaacgtgcgcaacgcctgtgcgcagacggtgacgctggtcgactggccgttgtcgagctgtccggacagtgtgtgcacccaggcgctcgcaccaggtgaagaggcgagcttcctcttcggcagggaggagtccgagagagagcgcttcgtcgagcagtcctacacggtgcaggtggacggcgtggaccagcggctcgccatcagcgcggaggtgacgtgctgggacgtccgtgattccgatggttgtgcagcggcgccgggtgcgctgggcgcggcgggggtggcgctgctggtgggcgcggtggctcgccggcgccggggagcgtaaaagcagggcctgagcgccgcggtccgctagcacccggggggctcttccagcgatgccgggtgtctggattagggtggaggtgtgtccgcctccgtcctgctgctgttgcccctgctttgtgcctccgcccccacgcgcgtggagctggtgtttggtggggatgtgattccccatggcgaggtgaaggatgtcgcgaggctgcacgcccgcaccggggcgccgccaccggaaggaaggccgagcgccctcgcttcaaccatga

SEQ ID NO: 1166 - DNA, 17188 bp, Myxococcus xanthus
tgctatgggggcgccggaagtcgtcctgcgccgttgcgccctgaaggacggctgctcgtccagctcggtgctggcggaggtggacggcctggcgcggcagggcatgcgcgtgctcgcggtggcataccgggaggtgacggtgtcacacgtcgcgttgcgcatggaggacgtcgagggcggcctgcggctgctcggcctggaggggatgattgacccgcctcgcgaggaggccatggccgcggtgcgcgcctgccacgaggcgggaatcacggtgaagatgattaccggtgaccacccctccacggcggcggccatcggcgcgcagttgggcctgctgaagccgggggaggagggcgtcacaggcgcgcggctggccaccacggatgatgcggcgctggaggaggtggccctgcgctccaacgtcttcgcgcgggtggcgcccgagcacaagctgcggctggtgcgcgcgctccagcgccggcagcacgtggtggccatgacgggggacggcgtcaacgacgcgcccgcgctcaagcaggccaacatcggcgtggccatgggcatcaccggcacggcggtggcgaaggacgcggcggacatcgtgctgacggatgacaacttcgcctccatcgtcgcggcggtggaggaggggcggcgcgtctacgacaacctcatcaagtcgctggccttcgtcctgcccaccaacctggggctggcgctcatcctgctgttcggcgtgtccctcttccccatccaggaggtgggcggacggctggtgccgctgatggccatgctgcccactcagttgctctggataaacctggtggccacggtgtcactggcgctgccgttggccttcgaggcccgggagccggacgtcatgcgcagggcacccagggaccccgaagcgccggtgctcaaccgcttcgtggtgatgcgcaccggactggtggcgttgctgatgaccgcgggcgccatcggcctcttcctgtgggagtaccgccgggacattcctcgcacgggaaacgcgcacgcgctggccgaggcccagacgatggcggtgaacaccgtcatcagcttccagatgttctacctgttcatgtgccgcagcctcatgggctcggtgcgcaaggtgggcctcttcagcaaccgctcggtgttcgtgggcatgggcctgctggtgctgctccaggtggccttcatgtacctgcccttcatgcagcgcgtgttcggcaccgcgcccctgggcttggaggacgtgggcctgtccatcctggtgggcgcggtcgtgctgccggtggtggggctggagaagtggctgcggcagcgcaaggacgacacggacgcttcatcaggacgcggcgccgcgcggctgcgcgagcgtgtgcccacgtgaggcggctcagggacgcgcggcggcgtccggcagcgtccagtcccgctccatgaaggcgatgcggcactggtccagccgggggccgcaggcgcggtccaggtcactgcgggtgtcgcagcccgggcgctcctcgcaggtgtccggcaggaaggcccagacgaactggagcacgttgccgccgcggccctcgggcagcgcggcgaggaagtcctcgcggtactcctcgaagagcgacgtcaggtagacggtgtcccgctccagccgcacgttgcgccggtcgcccacgaagcggcgtccggcctcgttgagctgcgagtccaggaactccggctggaagtgcgagccgtccagccgggggcccccgcgcgcggcctggaagagcgccaggtggatgcgcgggtcggcgaactcgcggcgcagcacgcggttgtgcagtgcccacagcgtcagccgctctccgcccaacgcccaggagcggccccagaagaagcgtcccagcaggggctgctgcacggtttcgaggtacgggtagccgtccaccacctgctggagcacgagcgcgttgtaggcgttgagccagtaggccagcgcgtcctccggcgtgggaaagacgtccgggcggttgtggggggagaacgacgccagcgagtcgacgaagccgtccagcgtcttgcgctcgcgccccaccgaggcgaagtccacgtcaccgtccgggcgcacgtgccgcagcaccttctcgtagtcgtggtagctgaacggggtggcgggggagggcacgcgcgcgggcaagaggccctggacatgaagcgcgcctcccgcgcccagcaacgcggccacggcgagcagcacggcgaagacgtggggacgacggcgaggagcggaagaggtggccacgggggcgggagcataacccagggggacgggggctgcccggccctccagttcaccccgcgtaactcggagtccattccaagcagggatagtcgtcgacttatactgggccctcatggagcctacccccaaggtcatccgtcacttccacccggtgctctccgcccgcgcgctgggcacccggccggtccgcgtggaggtggcgggccgcgcctacgcgctcttccgggacggcacagggcagcccgcggcgctcgcggatgcctgcccccatcgcttcgcgccgctgtccaaggggacggtgcgcgcggacggccggctccagtgtccgtaccacggctggcgcttcgacgcggaggggcgcggcagcaaccccagccagccggagctgcgccactgtgacgcgcgcagcttccaggtggtggagcgctacggctacctgtggctggccgagcgggacacgccgctttcggccatgcccgacatgggcgatgagggctacgtcttcggcggcgcgttctccacgcacttcgcggcgccgctgcacgtgtcgctcgacaacttcagcgaggacgagcacacgccctacgtccacacccggctgggctgggacgacccgaacgcgggccgggtggagttcgaggcgcgcaacctggaggaccgcacggaggtgcactaccgtgccccgcagcggcccgcgcccatcatgacggtgctgggcgtgcgcgacggtgacttcttccagaacgactgggtgacgcgcttcgacccggtgcgcagccagtacaccatccgctgggtggcgccggacggctcgccgcgtcccttcatcacccgggcgaacatcttcttcgtgccggagacggcgcgcaccacgcgcctgcacgtcttctcattcctgcgcaccgaacagcggctgctgcgtccgctgctccccgtggcggcgcgggcggccatggcgctcacctggtgggaggtgcgcgacgacgcgcgcttcatcaccaccgtggcggacacgccctacagtcacaagggcatgcggctggaccgtttcgacgcgccgctggtgcaccagcggcggctcatggagcgcatctactacggcgccggtccgaagatgacgggggccgtggtgccgctctcccgcgaggccccgggcggctgaaggcccccagggcgcgctcgcgctcagtgcaatgagggagagggctcttcgtgcgccggagtggccacgccggtgcgcgcctcgtaggcgttgcagccgctttctccggacacttccaattcgaactcggccagctccggctgcatgcagcggtgcgtctcgccggcgctctggggggtctggttggcgaagtatcggcagcccttgcagttgccccactgtccttccgccatgacgtcctcctcgggaaagggtgtgatgcctctcttcacgagggtggggttggcgaaggccgctcacaaccggcgctcgccgcccaccttccacggcgggcaacccggcgcctgggaatggcgggcgccgggaagccgcgcggaattacggctgccggggggcgtccgccggcccttcctgggtgggctgcgtcggctgcgtctgctccggcagcggctggaggaacggcgcctccgaggtctccaccttcaggtccgtcgtcaggggacgggcgccgaacgcgcccaccgcgcgcagcaggcgcaggccggcgagcgaggcctgcagccgctcacccaccagaccaatctccgcctgcgtcagcgcggtgttcgcgtccgcgacctccaggtacgtggccacgccttccttgaaggagacctcggtgaggcgatgggactcgcgcgccagctccacggcctgtgaggccttgaggcggttggccagggcgctctccaggtcgagctgcgcggtattcacttcctggcgcgcggtgagctccgccttgcgctgcagcgcccggttctccgcgatgacggccgaggcctcctgcaggttggcctcacgcaggccgccgtcccacaacgtccagctggcgcccagggtgatgagccagatgcggttggagcccacgaggcccgccgcgttgctgatgttgtaggtgccggagacctgcacgttgggcaggtagctgagccacacgccgcgcttgttgatttgcgccagctccacggactcacgcgccgcggcgacgtccgcgcgctgctcgagcgagcgctcgacgagcacgccggtgtccgtcttctcgggcacctggggctccggtggcggcgccacgtcgaagttcgggttgtccagcgccagcagggtggccagcaccagcttggcggacgcctccgcgttgcgcgcgcggatcaggtcctgctccgcacgggccaggtcctgctcggcgcgcagcagcgccacgcgcgtcaccgtacccgcctcgaagcggacctgcgtgtccttggcgcgcgcgctgttgagctccaccagccgctcctgcaccgccacggcctgtgcctgcgccacggtgccgtagtacgcctgcgccacgccgaagaagatttcgcgccgcgcctgctccacgttgagctccgccacgcgctccgccttgtaggcggcctggatgccggcccacagctgcggggcgatgagggcctgccgcacctggccctgggcctgcatctgcacccgcggctggatgacgatttccacgggcgcgagcggacccgcgggaatcaccgcttcgatggagttgcgggtgatggcgccgttgacggtgacgttggggaggtagccggcccaagccttgcgcgacgcggtatccgcctgagcgaggcgggcctgtgcggccttgaggtccaggttctccttgcgggcgcggttgagcgcgtcctccagggtcagcgtaggcggcggtgccgcggccagggtggccgccagggacagcgccaggaatgaactcatgaccgcctctacctcctcaagggcccgcgccggcgcgggccactgcgtccaggatggacttgctacgggttcgagcctcgggtcggcagccatagtccatgacgtccgaatttggaagctccggaatgtagtagccctcaatagttgatgaggtcaattgtttaggtggctcaggtgacataacatgagaggcatgaacgggagcggcgagcagctggagcggaagacgaagccggggagtgggcccggacaggccggacccgcgggtgacttgccacgccaggcgtggacactcctcttcgagctgatgcacacacacatgcgcaacttccccgcactggcggcggagttcgacctgtcgccggtgcaggcgcacgtgttgcggcagttgggggaagggccgctggccatgagcacgctggccgcctacctgtcgtgcgacgcgtccaacgtcacgggcctggtggaccggatggaggcgcgcggactggtggtgcgccgcagctccgagcaggaccggcgggtgaagatgctggtcctgacggaggacggcgctgcgctgcgcgagcggctgctggagcgcatcttcgagccgccggacgccatctgcggcctgccggaagaggacctgtgcgcgctgcgcgacatcatgcgccgcgcgctgggcgcgcagtaggcgcctcgcgtcagtccagcaggaaggtgtacgagtacttcatctccgtggagacgggctcgccgcccttgatggcgggcttgaagcggaagcggcggatggcatccctcgccgcctcgttgaggccgtagccgggccccttgagaatcttcaccgccaccaccttgccctcgtggtcgatggtgatggagagcgtgacggtgccctccacgcccgcgcggcgcgcttcctccgggtagggaatcttcacctcggaggccaccgtgggctcggagtccacctggtagatgggcgcgtacttcggcgcgctgtaccccttcacgtccttggggtccttcgcggtggggcccgtcctgccatacgcggtgttgcccacgggcgcggcgaacgagcccgcgctggtggtggaggacatcgtcatgcccaccacgagcggcggcggcttggcctgcggctccggcggcggcggggtgtcgttgggcggcggcggcgcgtccacgggcggcggcggcagcggcttgggggcctcggccaccttcaccggcggcggcttcaccaccttgggcttgggaggcggcggcttgggcggctcctccggcttcggcggctcggggggcggcgggggcggcttcaccacttccaccatcaccatctccacggggcgcctggccgcggggagggtgcgcgaggcgccttccccgagcgcccagaagccgccgacgtgaatccccagcgacacgagcaggaagacgcccaccacggccagggagcggtcgcgtcggggcgtcggagcgttgtcgaggaccgcctgactcatgaagtgacgccttgcctcagggggctgcgggcgcggccgcgggggctacgtccttctcgatgttgagcgcgaacttggcgatgccctggcccttcaccacgtcgatgagtcgcatgacgcggccatagggcagcgactggtcggcgctgatgatggcgcgcgtctccttgtccttggccaccgcttcctgaacgcgcttctccaggtccttctcggtcatctcggtgccgtcaaagaagagcttgccctccttgtccagcaccacgttgaccaggccctgcaccgtctcaccgccgttggcggcgcggggcaggtccacctccaccgtttcgcggacgatgaagttggccgtcaccatgaagatgatgagcagcaccagcaccacgtccaccagcggggtgacgttgatgcctgtgatttcgtcgtcgttgtcctgcgcgccgcccgccatggcctagcgggcctccgcggcgcgacccgcagtggccgtgttggacgcggggcgctcggcgcgcatgctgcccaccagggcgtagcccagggcattggcgcggctggtgagcgtcttgagttggcggttgaagacgttgaaggccaccaccgccggaatcgccaccgccaggcccaccgccgtggcgaccagcgcttcagagatgccggccatgacggtctgctgcatggccccgccgccgccctgggcgttcatcttccccaggtcattgaaggccttgatgatgcccagcaccgtgccgaacagaccgatgaacggcgcgttgttgcccagcgtgcccaggtacgacaggaaacgctcgtactggggacgctcacgcgacagggtggaggcaatcacctgctccaccgtgtccgcgccctggtcggcggaggccagggcctcgcggatgatggcggcctccatgcccgtcttgccttcaatggccttgcgggccacgtcgtactcgccgcgggccagccgcaccgccagggcctccgagtccggcagccggtggcgggcgaagtacaccgtgcgctccagcatgatggcgatggagagcaccgagaggatgacgagcacccagagcacccattcggcggaggtgagcgtcacgccgagcagcttgctgctgagccagcccagctcggtgtgattcgtctgggccagggagaggaagggcgtcatggagggaagcctgggtaaaggtgggtcacggggcactcgcaacccggttgccaacctgcgggcccatgtcttattcccttggcgcggaaagtcaaatggaacggatgggttgggtgccgccctcccggaagcggacgctcaggcgcccgcccgggtggggcgggctcaggggcgctgggcggggacgtcggtcacggctggatttcgctcgatggcggggcccagcaccgcgtcaatccggcgcagcagctccggctccagcttcacgcccgcggccttcacgttgtcgtgcacctgctccggccgggaggcgccgacgatggcggaggagacgctgggattctggagcacccaggccacggcgagctgggccatggagagtccgacatccttcgccaatgggacgagctgctgcacgcgggtgagcacgtcatccgtcatgaagcgggtgatgccgtagcgcacggcgttggcctccgtggcgcggctgcccgccgggggggcctggccgggcaggtacttgccggtgaggacgccctgggcgatgggggaccagacaatctgccccaggcctgcttcgtcggaggccgggatgacctgcggctcgatgacgcggtagagcatggagtactgcggctggttggagatgaagggcacgcgcagctcgcgggccagcgcggcgccctggcgaatctggtcggccgtccattcggagacgccgatgtacagcgccttgccctggcggacgatgtcggcgaacgcgagcatcgtctcctccagcggcgtctccacgtcgaagcggtgggcctgatacaggtccacgtagtccgtctgcagccggcgcagcgagccgtcgatgctctccaggatgtgcttgcgcgacaggccgcggtcattctttccggggccggtgggccagtacaccttggtgaagagctcatagccggcgcgccgctcgcccttcagggcacggccgagcacttcctcggcgcgggttgccgcgtacacgtccgcggtgtcgaaggtggtgatgcccacgtccagcgccgcgcgcacgcaggcgagcgcggcctcctcctccacctgggagccgtgggtgatccagttgccgtaggaaatctcactgacgacgaggccgctgcggccgagcttgcggaagtgcatggtgcgcgcgagcctaaccgtgggcagccagtcgcgcacggccgcggacgggccaccagccgccagcccacgccacccaggcgacgtagacgagctggaaggggatgcgcagccagaagtaccagtccgggaagggcagcacatgggtggcggtgttggcctgggcctcgtggatgttggcggggaggatggccagcagcagcgcgatgagccccagggccgcgagtcggcgcgtgcgtggcagcagcagccccagcccgcccgcgacctccgcggccccggagaggtagacccagaaggcgggtgccgggagtcgcggcggaatcatggccgcgtagcgcgcgggcatgaggaagtgcatgaggcccgcgcccacgaagaagagccccgcggcgaccgcggcgcgcgccgtgggggtggacagcgcggggatgcgccgcagcggcggcaggtgcagcagcaggaagaaggacagcaggaggatggcgaaggacatggggtgtgctcctgaagagatgcacgggagggagtggcctgccgtgccgttgacttcaggatggggccccggtgctggcgttcgcttgaacgaactggctgcgacccgagaggcggcgcgcgtcgcgccgcccccggccttgccgctaccgcttgtcgcgctggttgacggcttccaccaccttgacggtggcccggaccacggccttgacgatgggccaccacaccttgttccgggccgagacgccatccaactccgcggccttgtcggcggcggtgagcaccttccgcaggaactccttcaggtccttggggtagttcgcggcgatgaactcgtcgacgctggtgctggccgggctgccctcggactggagggggattcgggcgtactcgagcagcagcgcgtgcgcaagctgctgcgccacaggtgcgcggtgctcagcgggtcgcaccgttgcggccctgcgcctggacgcgcggtccacggcgctgaagcgaggacggcgtggtgccgaacatccgccggaaggtgcgcgtcaggtgcgccgcatccgagaagccggccgcgtgggcggcttcactcaaggtgtggcccgcggcgatggcgcccgcggcccgctggagccggagccacaggaggtagggccgcagtggcacaccgacggattcggtgaacgtgtgcatcagccttccgggcgagaggcccgcaacctgggccagggcttcgagcgatgtgtcttccggcgcggcctccgcgcgcaggtggcacagcagcttgcgcacgcgcgggtggaggtgacggggggcttcgggcgtcccggagagggtggccagcgtggactccatccatccgccgaccgcttcgtgtgtcagtgctcccgcagtgggcagcccgccgaggagggcatcgcgctgcgtcgtctcgaacaggcgtatcggaccgtcgagcgcggcctggagtcgcgcgccgtcgtcgctctcgggttcgacgaagaggatgatgacctcgctgtctcgtgcgtcgagcgcgtggagaatgtccgggcccacgagcacgccggctgcctgctcggcggtcttcatgccttgcgcgcggacggacagggtgccctgccggcacagcaccaggtgcatggcgtggtgggcgtgcttcgtcgtcgcgtcgccggggccccacatcgccagagcggtgggccacaccaccaggggcatgtccggccacggcgcctggggcgccagttctggagggcgggcgaggagcatctggaagaggggttgtagcagcagtccggtgggcttgatggcactgggggacggtgcgtgggccgtctttgccgcgcggggcggcacctggggcagtctcgcgtgaaggcggggccatgggcacttcctccgcggggatgctgcgtcggtgtccgcgaggctcgggcggtccgtgccaggcggcggaagggggcgtcaatgcacgacgggatgcgaccgctcacacccggaccgcgacggccgggcgtcgcgtcgcttgtggggagtgggccgagtagtcgacactcgccgcttcatggctgccagtgaagaacgccgcttccaggccctggtgctcgcgcccatccggcgtgtgcagcggcgcctcaacgcggtggcatgggcggaggccggcatcgttccgatgtgggccaccgccacggcctgcgtgctggcccggttcctcctgcgcggcgccttcgtgtgggccctgccaccgcttctggcgctggggctgggcgcgtggttcttgcgtgcgcgttcccggcgggtgtcgttggagcaggcggcggtgctcgcggaccggtcggcgaacgcgggcgggctgctcctcacccggctggagcgcccggtgggggagtgggagctggccgtcaatcagttcgcgggtggggtgaagcctcctgacgtgaagtggcggcgcccggccgcggcgctcgcgggcgcggtgctcttcgcggtggcgggcttcctgttgcccctgtccgcgccacaaggccgcgccgtgaatgccgccgccgcggcgaaggtggccgcggtccaggcgcaggcggaggcgctcgccaaggaagaggtgctggaggaggccgtcgaggaggagctgcggcggctggccgaggaagtctccgagggccgcttcgacgccggagattgggaggccgccgacgcgctggagaagcggttggccgagcaggccgcggaggccgccgcgcaattggcccaggccgcggaggccgcgcgggcgttggaggatgcgctaggcgccgcgggaggcgccgaggccgccacgcgtgagcgcgaggccttggagcaggcgctgatggcgctgggaggcggcaaagaaggtggctcgtccgacagcgcggacggaacgggggaggacggggtgccgcacgattccgagaacggcgaagcggcacaggcggatgccacgcgcgcgtccggacaaggaacgcagggcgccgagggacagcagggcacggaaggctcgcggagtgagcgctccggtgaggcgcagagcgctgcccgcgcgcgggcctccggttcaccggaccagattgcccagcctgcgcgaggcgctggagcgcaggcgtcagtcgctggagaaccgcttcgattcgaacagccgcaacggttccaattcgcaggcccgtcgccagggttctggcggccagaactcggggcaggggcgccaagggcaggggcagtcggggcgcggcgccgagggtgaggtgcaatccggcgcgggcgaggggcaatccaactcgggccagcaggggcatgcgagccggggcgtgcggaagggcgcgggtgtgtcacgtggtggcggaagccaaccgctcgtctttggtgacgaggcggagatgaacccggagcggcttgctttcgagccgttgcctcccgggcaggggggcgacgagggcgaggaactctggggcctccgggccgcggaccctcggcggcgcgcgggaccggccgggcctggcggcgcgcagggcacccaggcgcggggggaggcgacggcggggcccggtgcggcgccgctgcttccccgcaaccgggacatggtgaggcggtactttggtggcgagtcgtctggaagggggcaatgacgtggcagcggagcttctcagtcccgccgaggcacagggagcggcggaggtggcggcccggctcaaggacgggctgaacaccgtcatgctggaccaggaatccgtcgtcgagcaggtggtggtggcggtgctcgcacgcgggcacgtcctgctggagggcctgcctggcctgggcaagacggagctgtgcaaggcgctggcgcggctgctgtcgctgcccttccgccgcatccaattcactcccgacctgctacccggcgacatcacgggtacctacgtgctggaaggcgatggccgccgcgacttcgtcttccgcgagggcccgctcttcgccagcctggtgctggcggacgaaatcaaccgctccagtccgaagacgcagtccgcgctgctggaggccatgcaggagcgcagcgtcaccgtgctggggcagacgcggccgttgccggaccccttcttcgtgctcgccacgcagaaccccatcgagctggagggcacctatccgctgcccgaggcgcagctcgaccggttcctcttccgcatccaggtgcccccggtgggcgcgaagacgctgcgcgcgctgctcaccacgcgcgtgcgtggcgcgccgccggagctgtcgccggtgctggacgcggagggcctgggccgcctcttcgccgccgcggaccgcgtgcacctgccgggccccgtggcggacttcatcggccggttggtggaggcctcagacccacgccaaccgtcggcgcccgatgccgtgcgccgcttcgtccgttatggcgccagtcctcgtgcggcgctcgcgctcgccgccgccgggcgcgcgctggcgttgctgcaaggcaggcccaacgtgggcttcgatgacgtggtggccgccgcgccttccgccctcaatcaccggttggtgctcgcctacgaggcctcgctggagaaggtcagcgcggcggacgtggtgcgcgcgctgctccaggccgtccccgaggtgccgcgtgcgtagcgcggtactgaccgcgagtgtcctgctctgcgccctgggaggctcacgggccttcgccacatcgctcgcggacgaggccgcgccgacgggctacgggtatcgcgatgcttctggaaccattgagacgcggatccacggcgacctgcgcgtctccatccggaccagcgcgctgaagccggagcgcggctacacccccatcgatgtcgtgctccagaacacggggctcgtgcccctccaggtccgtctgaccttccagggacattcgaactcggcgccgcgaacctccgagcgctccgtggaggtgccgccgcaacggcggctcgtcacctggctgccggtgccagcgaccgttcaggcggggagcatccaggtggagtcgcccggcctgacttcgctgccgcttcctgcccacacccccgtctatgtggagcgttcctcgggcgggacggtgctggtgctggggacgctcaaggacttcgacgacacgtcgggggtgcctcgggtggaggcgaccggcagcccgctgttcgccgtgcgcaccgttgacccgcgcgatgcgccccgggagctgtcctcctacgtgggctactccgtggtgatggtgccgggagacctggcttccgtgcccgcggatgtctgggccgtgctggagtcctacgtcctctcgggaggacggctcgtcctgccgcaggtgtcgagcagcctgacggagcatctgccgctgttcaccgcggaaggctccagggatgccgtgccgtatggctttgggcgggtgcggctgtgtggcgccgcgctcgaatgcggacaggccttgaacgcgatgctgggggagtccatcccagggcccgtgaatcccgcgggggccgcgcctcggtgggagcgaagcaacctgctcgccgggggcatcacgccgctgctggaccatgccaacacgcccgtggggcggttcctgctgctcatcttcgccttcgtgctggcggtggggccgggcgggctgatgctggcgcggcgccgagggccggtggcggtgctcgtggcggtgcccctggtgtcggtcctcacctgtgtggcgctcgtgacctggtcggtgctcgtggatggtttcgccgtgcactccgcgcgctacagcctcacgtggctggacgcggagcgctcgcgcgcggtgacgctcggcgtctccgcctggtacgccaacgtgtcttcggggccggtgcgcttcccggcgacgagcgcgctgctggcaccggacaacgccgacgagatgctggcggacctggactggacgaatggcctgacggtgacgcatggcttcctgccgccacggacctaccgtgagtggggcgaggtggccgtgctgccttctcgcgcgcggctcgtcgtccggcgggagggcggcaccgtgcgcgtccagaacgcgctgggggcgcggctggtgcagggctacgtccgggtggggagccagagctacgcgttgcccgcgctggaggatggcgcggaagggacgctgggcgaaccgctgcccgcgggcgcgacgccggtgagccagttggtgtccagcgtgggggggccgtcgctcgccgagggacgtctgtcagggggcgaggtgaacttccgcgctccgcttccggagggtggcttcatcgcgcgcctggagggcttggggccggcgccctcgtccgccgttgacgtggagctggaggccggcatgcacctggtgcgaggccagtcggaaggggggcggccatgagcctgctggaggtgaagggactgcggcgcgactacggggcgctgcgcgcggtggatgacgtgtcgttctccttggaggccggcagcatcctgggcttcatcgggcccaacggcgcgggcaagagcactacgctgcgcatcctggccacgctggatgtgcccacgtcgggcgaggtgctactggacggacactcgttggtggattcgccggaccgggcgcgtccgctcatcggctacatgccggaccggtacggcacctatgacgacgtcaccgtcttcgagttcctggacttcttcgcgcgcgcctatggactgaagggcgcggcgcgccggcagcgggtggagtcggtgatggcgttcaccggactcacgcccctggcggaccggctcaccaccgcgttgtccaagggcatgcggcagcgcgtggcgctggggcgcacgttgctgcacgacccgtcgctgctgctgctggacgagcccgcggacgggttggacccgcgcgcccgtatcgagctgcgcgagctgttgcgcgccctggcggaccagggcaaggcggtcatcatctccagccacatcctcacggagctggcggagatctgcgacacctgcgccatcatcgagcaggggcgtctactggccaccggcaaggtggcggacctgctccagcagcaggaggtgggcgcggcggtgacgcccgagctgacggtgcggctggccgtgggcgacgcgggcaacgccgtctgggagcgcgcggagcgggtgctcctcgagcagccgcgcgtgaagcgggtggcgcgggagggcgaggcgctgcgcgtgcgcctggagctggatgcgggcgcgggccctgcgcaggtggacgcggcggcggcggtgctgctggcggcgctggtggccgcggggcttcccgtgtgcgccttcagcgcgcgggagcggaacctcgaggatgccttcatgacggtgacgaaggggagggtggcgtgagcgcgcccatggatacggcgatgagccctccggccccggagccgatggcttcgggcggcggccaggtcgcgggcgcggagccctggtcgcagcggtggggggaccggctcaacccgctggtggtgaaggagctccgccagggactgcgcacgcgcgtcttctgggtgtgcttcgggttgatgctgctggcgtgcctggcggtggcgctggtggcctacgtggacacgcgcgagggcgcctacgcgcggcgcggccagggttacttcttctccttcttcgtctgcctgggcgtcgcgcacttcttcgtcatcccgtacagcgcctaccgctcgctggcgcgtgagcgcgaggacgagacgtgggtgttgctggtgctcactggcctggggccgcgccgcatcctccggggcaaggtggcgtcgttcctcgtgcaggcggccctgtatgcctccgcggcggggcccttcctcctcttcagctacttcctcaatggcatcacgctgcccacgattctggtggtgctggcgctgggcggcgcgtggctcgtcttcctcacggtggccagcgtgtgcgcggcgacgctggccgacggccgcatggggcgtgccttcgtccacttcggactgctgggcgcactgggcctggcgctggtgcacggactgggcgcggcctatgcgatatcggagatgggagaccggttcctgaatgatgtggagctcctctatctggtgggcaccgcgctgatgctgatgctcatggac

SEQ ID NO: 1167 - DNA, 18471 bp, Myxococcus xanthus
aacatcccacatggccacaactcaggcatcgacgcaggtgcacccagcttgcgcccatggccagacattcctcgcagcctcgcgagcgcggaggcgggtcttcggcctgtcggatgtgctcgcaaatcggctccatgtgacacctctctgtgactggggcgaccagtgccctctacagcgtaggcactgggtgcgaggaccttcagtgagcaccagccaggatggcgagccactggaggcacgtccccaccccgcagcagcggatggcacgcgcggagccccgggcgcacggtagagccacatgcccaccaacgcccccgacaccaccgtcgcctatgacagtcctcgcggccggggtgtgctgctcgccagcgtgctgggcagcggcatggcgttcctcgattccaccgccgtcaacgtcgccctgcccgccatgggccgcgagctgcacacgggcctgtccggcctccaatgggccgtggacgcgtacctgctcacgctcggctccctggtgctcaccgggggcgcgctcggcgacgcgaagggccagcgacgcgtcttcctgctgggcatgctcgccttcaccgtcacgtcagtgctgtgcggcctggcgcccaacacctggacgctggccgccttccgcgcggcgcagggtgtgggagccgcgctgctggtgcccgcgagcctcgcattgctgcgcacgtcgttcccgcctcaggaccggcaacgcgccgtgtccgcctgggccggactgtccggcgtcaccacggccgtggggccgctgctgggtgggtggctcgtggacgcaggctcatggcgcttcgtcttcttcctcaacgtgcccctggccgcgctcaccgcgtgggcggcgctgcgccacgtgccggacatcgcgccgaaaacaggggcgcgcgggttggacgtcgcgggctcggtgacggcggcgctcgggctgggtggcctcatctacgcgctcatcgaaggccccgcccacggctggcccctggcggccatcggcgccgcggccggaggcgccgtcctgctggccgcgttcttcgtcctggaggcacggcagcgggagccgatgcttccgctcaccctcttccactcgcgcaccttctccggcgcgaacctcaccacgctcgtcgtgtacttcgcgctcggaggcgccaccttcctggtggtgctcgccctgcagcagcagctcggctattcggcgctcggcgcgggagcagcgctgctccccatcacgctgatgctgcttctgttttcaccttcggtggggcggctcgcggggcacatcggcgcacgtccgttgatgacggcggggccgctgctcgcgggcgtggggctggcgctcctgacgcgcatccagcgcggtggtgactacgtcagcaccgtgctgcctggcatcctggtgctgggactggggctggcgctcaccgtaggcccgctcacggcggtggtgctcggcgccgtcgaggaccgctacgcgggcatcgcctctggcgtgaacaacgccgtggcccgcctcgccggcctgctcgcggtggcgctgctgccgctgctgggcggcctcgctggcgacaccggcatggacttcctggtgggcacacggcgcgcgctctgggtgtccgccggcctgtgcgccgtgggagcgctgtgctcgctgctcacgattccacgcgaggccgggcgcacgacctccgcgcaataggagcacgggaccaagcgcaccgcgtgggtccaacaagcgctcatgacgtcgtcgcgggatggcgcctcggcccccggctggcttcttcgcggccttgccggcgtgcgggctgtccccaggcccgcatctcaatgacgtccgtggtcgtcactcagcggaggtgcctcgcgcgccggctcggtgcccttctgagcgccgtagccgccaatccccttctggaggatgcggtcttcgcccacgtcttcgtccgtcacgtcgcctcgcaccgggcctttctggtgccgcgcctcgcgctccagttcttccgggcgcgtcgtgtccatccgctcgtcgccccgtaccggactgcccttgttgtcggccatggtcatttcccctttcagagggaaaggtccgaaccgccctcgcaccggacaaggcacctgccatggcgccgtcgcctgccgcccaagcagaaggcccccgccccagcagggacgagggccttcgggaatccacacagccgaaccagcgctagctcttgtacttcaccgagcagccgtagggcgtggtggtgctcgccgggacctgctggccacccaccaccgcgtccaccgccgtcttcacatggttggccggcttggcgttcttgccgcgcgggtcatcgtcgatggcgcccgcgtagcggacaacgcccgtctcgtcgatgacgtacatgtgcggcgtcgtcttcgcgccataggacttgcctaccgtgccgctcgcgtcctggagaaccgggtaggggaagccctcatccttcttccacgccgcggacttctccggggtgttgtgcgcggtggagtccaccgccagccacaccaccttcttcgcgtcgaagcccttcagcgtggtgaccatcgtgtcgttcttgtagtgccgctgaacgaaggggcactcggggttggtccactccaggaccacgaccttgcccttgtactgcgccagcgtgtgctccttgccggactcgtccttcagcgtgaaggtcggcgcgggcttgccaacttccgcgtcggcgagggcgggcgccccgatgagtaacgtgcccagcgcgagtgcggtgaagacctgcttcatggcgttcctccagcgttttggggactgcggggaagacagcgcgacttcagtgactcgggaaacccgcggcgcagaggacgttcgcgccgttgcccagcttcgagggtgcacacgccgccgcgcgcgtcacggcgtccgtcaccacgcccggcgtgagcaactccggcagcacctccggcttgtcgggggcgcccgggctcagcaccaggtacatgggcacaccggcccggccgtgctcggccagcttggtggtgatgctcgcgtcccggcgcgtccagtccgcgatgaagaaggccacctggtgcttcttgaaggcgtcccgcacctcgtcggtggacagcacggtgcgctcgttgaacttgcaggtgaggcaccagtccgcagtgaagtcgatgaacaccggctggcccgccgccagcgccgcgttcaccgcgtccgcgctccacggctgcgcctgcgccaccgtggacccgacccgaggcgcctccacggggtcctggtcatcgaaacgcaacgtcagcagccctgacgccaccagcacgcccgcggccaccgccacggtggccagcttgcgcacaccgtcctgcgcctgcccctgaccgtacagccacgtgacgagccccaccgcgaccaggaacgccagcagccgcgccatgccgtccacgccggccagcccgcccattacccacaccagccagacagtggtggccagcagcgcgaagcccagcacctgcttgaagcgctccatccacgcgcccggcttgggcagcttcttcgccagcccgggcaccagcaccagcacacagaagggcagcgcgagccccaggcccagcgcggtgaagacggccagcaccgtcatggggcccgccgcgaaggcgaagcccaccgcggtgcccagcagcggcgccgagcacggcgtggccagcaccacggccagcacgccctcgccagcgctgtgcatcaggccgtggctctggtccaccttgcccgccagcgccgtgccgtccaggcccacgttgaagacaccgaagaggttgagcgcgaaggcgaccaacaccgcgcacacacccgcgacgaagagcggctcctggaactggaagccccagcccacgctcgcgccacccgcgcgcaccgccagcacgacgctggccagcagcagcatggtgccgatgatgcccgccgcgtaggccgccgcatgcgcgccgacgcggccctgctcctgctgcaccatgcgcgtgaagccgtaggccttgagcgccagcacggggaacacgcacggcatcaggttgagcagcgcgccaccgaagaaggcgaacaccagcgccagccccaggcccatggacgactcggccgcgggcggcgtggcgatggcggcgcccaccggcttcaccgccgcgatgctgtccttcaccgacggcggcttcaccacgggcggcgtcccagccgcgccaccggccgccaccaagggggccagcggcgccgtcacctcgaggtactggtagcccgtggccgccgtgcccaggcgcagcacgcccgtcaggtccggcgccgacgcctgcgcgtccggctccgccttgcccttgagtttgaagcggcccggaccgtccgaggccaaccccacgcgcacgacgccggggatgcggtcggcgacgaagaagtcaccttccaccgcgggcaccgccgcgccgcccggggccgtcagggtgagggtgccggtgaaatcctggcccgcggtgagctgcggcgcatccagcgccaccgtcgccgcggggccgctgtccttggcgggacggggcaccttggccagctcggtgtcgaagacagccgctgtctcggcgtcgcgcaccgtctggggacccagggggatggagcgcgtcagcatcagctccgcggggatgcagtgcacctcgcacaccagcgcttccacggcggcggacaccgtcagcaggcccgtggagggcccttccacggccttcgcgtcggcgatgaggatggcctcaccgtcatagccatgggtggtgatgaagccgtcgggcgtgcggaacgtctgcgggaagggccactgcagcggccccacggtgacgccgggcgtgtcccacgccacttccgtctccaagccggagtcgcccgggttcttccagtagacgtgccagcctggatccaaccggaagcgcacgcccacgcggaaggtgtctcccggcttcacctcggtggcgtccaccaggagggcaccctcgatgcgagggtcgccttcgtccggcgcgctcgatgccaccgccgacgcgggcaggtccgcccacgcgaccgccgccaccagcagcagtccgattccaccaacaacgccgagcctcttggactgctgatgcgtcatgcgactcccgttaacccagaggaggccggcccgccagcggcagacacgtgcctccgagcacagtgaaccatccgggcaggcgggcattcccctcgcatgacgcgccacgcccactcccaggcggacagtccgagcaggaggggttacagcgtcacagaggtaacgtcatgaacccacaagggcagccgagcgacgggcgtcagtcctcggtcttccagggcagcagcgcgggcgccgcggggcccacgcggctcatggtgatgcgggagacctcggagtgcgcgcggcgcatcaccagcgcggggagcttgtttgcccggcgctctatcacccggcgcaggtccgccagccgctccacgtggcgttgcgcgggcacctccgccgagccgagccgcgcgagtttgtagagggcgacgtccgcggcctccagcgcccgctcagcggcgtcctggtgacggcggcccagggccttccacgcggcggcttcaccggcgaccaggtccagctcggcggacacggcgcgcacgaagcggcccgcgtcactgtcgggcagcacacgcgtcactggcacgctgatgcgccgcgtatccccgcgctcggagtagaacgtggacacgcccaggttccactccgcatcccccaacatgcccgagaagaggacgcggcgcgggaaggcctgggagatggcgcccagggtggcgctcatggcgtcgccctccacgcgcgagggatagcggtgacgacagcggacgtcggcgaagcccgtgggcagcacgtgcacgcgcgcgtcggcgacgacttcaccgaagagctcggcgcccagttggcccacggccatgggcaaaccttccgggtcatccacgtgcacgaagcccgtgccggagggactggtgagggcctccaggatgtcgggcaggtagtggcggcccagccccagcgcgtggagcatgacgccggactcggcgatgcgggcgccctgggtcttgaactctgcgagctgcgacgggcctaccgagggctcgccatcagtaagcatcagcacctggggccgggcgccgggcacgagcacgcggcgggcggactccgaggcgcgctccacggcctcgtgcagggcggtcccctcgccggactccaggcgcgcgagcaccttgaggagctgcgcccgggcgttggggtccatggcgcgcatggggaggacctgctcgggctcggcgtcgaaggtgagcaggcccaggtagtcgcgtgggctggcgcgctccacgagcgcctgggcggcctgcaccgcggcgagcagcggcacgccccgcatggaggcgctgcgatccaaagcgaggttgatggccacgggcgcgcggggggcgtcggcgtcggcttccagggtgacgaggaggagcacctcgcggccatgttcggcgtcacgctccactgcccaggccgtctgcttcatacgtactcccccgtggtcgcacgaggcattgtgccgcgaatcaatctgcgggagcggaccgcccccgatgccggacgtctcatgggccacaacgcacgggagcgggggacgctcacgggcaggctgcggggtctgagaatgtcgggagtcgtgctttggagcaagggggcccgggggctcaccctgaaggagccaccacgcgggtatccattgccccggttaccgctagtgcccccgcgcgtccaccggccgcgggggccgcgaattactcggccgcagcccagccgccccacgactcctcggagtagccccaacggcggccgggcgcgccctcgtcggcctcagaagactccgcgccaccgtcctgccgcggatccacataaggcaaaccttcatcgtccatgtacgtggtgtcgtcgtgaaccatcgccggctcctctggaggccacccaggtgaaggggggcatcccgcttcggtcgacccgggctcgccccatgcgaggcccgctccattaatcgttgaccgatttaccgaccatgttggagatgtcgcctcgcgttgtaaagcccttggggtctcaaagttctgggggccgtgtagcccgtctgcctacctgcctgctctccaacgaagagtgttcgtagttacaggcagttacgaacagtcagacgtcagacagtgcccgtggtaatcgcacaaggtaagccctgggcccgagaaaggaacccctacagcggtttacttccgggtattttcaaagggtgcctgcctgccgtccgccactggtaaatccgtgcgatggccgctcactccccagaggacccgggccgcgttctccagtgaaggacacctggggcagcagggtgcttgattcgagaatcacccctgttagggttgaagtgcactcaagaattgccgcgacgcggcagcccgggcccatccgccgcgcccgagaggtcctcggagtcccatgagtcccatcatcaccggcctgttgctagccctcgccattcccatcttcgtgatgaccatgtccggtcgcgtgggcgtcctgctcgcgatgaagaaggagaaccggctcgacaacatccccttccgcgtggcgcagttggtgcgcttcggccttggccagaagcgactggtggatccggaggagttcacgccgggcctgttccacgtcctcatctacgcggccttcatggtgctggccctgcgcaccgtcatgctcttcgccatggggttttcgaccacggcgctggacgtgctgacagacctgggccacccgttctgggcggagcaatccgcgctgctcttcgtctacaaggtctacctgctggccaaggacgtggtcgccgcgctggccctgctgggcgtggcctactacatctgggtccgctggaaggtgaagccggaccgcctgacgccgtcgtgggaggcgtacctcatcctgtgcttcatcggcgggctgatggtctccgagttcctgttcggcggcagccacatggtggccgcgcacgccgcgcaggcgcaggtgggcgccgcgcaggtgccccagtcccccgccgcgctggtgtggtgggagccgttcaccagcctgacgggtctggcgatgatgccgttgggcgccaccgccgcgcacgtggtgggcgcggctggcttctgggttcacctggtcatcatcctggcgttcctgaacttcctgcccatcggcaagcacttccacatcatcaccggcctgcccaccgtcttcttccagcgcacccactccaccggcaagctgcccacgccggacctggagaaggaggagttcggcaccgccacggtgaaggacctgacgtggaagcagggcctggacctctactcctgtacggagtgtggccgctgccagacgcactgtccgacgtacatcaccggcaagccgctcacccacaagggcgtcaaccaggacctgaagcattggatctggggcaatgagcagtgggtggaggaaggctacggccccaatggcatcaaggagccgctgcccgaaatcgtcggcagcgcgctgtcggcggagacggtgtgggcgtgcacgagctgcggctggtgcgagcaggcctgcccggtgttcatcgaaaacgtgccgcgcctcatcgacatgcgccgctaccaggtgcaggtgaaggcggagttcccccccgaaatccagcgcgtgttcgagggcatcgagcgccagggcaacccctggggcctgggccaggaccggcgcgacgagtgggcggaggacctggcgctccccacgtggggtgacgacggcggtccctacgagtacctcttcttcgtgggctgcgcgggcagctacgacgacaagcagaagaaggtcagccgcgcgctggtgaagattctgcgcgaagcgggcgtgagcttcgccacgctgtcgaagcaggagatgtgcaacggcgactccgcgcgccgcatgggcaacgagtacctgttccagacgatggcgaagacgaacgtcgagacgtggaactcgatgggcgtgaaggccgtcatcacccagtgcccgcactgcttcaacaccatcaagaacgagtacccggagttcggcggcgagtaccgcgtcatcaaccacacgcagctcatcaacgagctgctgaaggagaagcgcatcaagctctccgcggtgatgaacagcaagctcacctaccacgacccctgctacctgggccgccacaacggcgtctacgacgccccccgcgaggtgctcaacagcatcccagggctcgaggtggtggagatgcagcgcagcaagcgcgagggcttctgctgcggcgccggcggcggccgcatgtggatggaggagcacattggcacgcgcatcaaccacaaccggttgaacgaggccgcgctcacgctgaagcacgccgaggacccgaacacgccctaccccaacgccgcggacaagaagaagccgggccaggtgggcgactacaaggagaagggcggcagcggcatcgtcgcggtggcgtgcccgttctgctccacgatgctctccgacgcggtgaacgacaccggccgtgaggagaacatcaagatcaaggacatcaccgagctggtcgccgacgcgctggagaccaagagcggcgcggtgggcaccgtggcccccagcgccacggtgagcgccaagccggagtagtaccagtggtgcggcgggcccgcagaagggcccgcccgctgcttcgcttcacgcaagggcccggaggcttccaccgtgaagccccgggccttcgccgtttcagggcttgcgctgcttctccgagcgcaggacgcgctccagccgcttcgtggcgccgtcgtctcccagcttgccggagacgtacgcccccgcggaggcgagcttgcggcggaagctgttgtcctgcggaggcggcgcgtccaagcgcaagtcagtgatgcccaggccggagagcagcgtgcgggccaggtcctggtcatccgcgcgcgcgtgaggcatcagccactgggcagacctcggtgtgcccgtgcgctgcggccatgatgagcgcggactcgccgatgctgtccgtcagctcggggtcccgctcccgcatccaggaggcgttgcaccaggtccgctcgccccgcgcgggccgcggccatcagcggcgtgcgcccctcctcgtcgaaggggttcgggtccgctccagcggacaggtgggactccacggcgtcacggtcgcccgccagcacggcatcgaagagggacatcgtcagacctccgcgcggcagcatcgcgcctcgcgcactgggacgccagttgcccccgggcgctcggcgccctggctcacagcacgctgctcggcagggcaactgcgccccccgcccttcggcggcccatgccgcgtcgtgttggacgtggcgtccacgcaggtcgccttacgtccggagcgtcagttgatttcgaccgtgccgcccttgatacggtgggtgccggaggcgcgcgactccaggtaggtgcctttcacgatgaccttgccgttgcggcgcaaggtgatgctggcctcaccgcacttgaggacgacttcgtcctggccctcgatgacgacgcgcttgccgtcgacatgggcctctgtcgggcgcagcgcggcttctggggggggggattccagcaacgcgtccaacagcggcgtcgcgctgggctcctggatgagccccatgacgaagggcaaccgggcgtctccattctcgaagaggagcaccgccttctgccgctgggcgacggcggcctggagcgccttcggttccacgacgacggcgagccgcgcggccaccgggcccgaggtgttccccggaaaatccacgagcaccgcgccactggcatcgaagcccaccagactaccggcccggctccccaggatgggctcctgggattgcgcgccagaggcaagggacttgctgtcgggtgactcgctcatgccggcatctccatgcgtcaggctaccgcaggcgccccccacggcgcgaatccggcccgaaccgcctcccctcagatgcccggcgggcggcgctggcgccaccccaccgggtccgaggtcagcggctccaggtcaaatcggcccgtaggacggttccgtggcgctgggcaccgccagcgacaccgagcccgtgctcaggttcgcgcggtagatgcccgtgtcgctcccgccagcgctgatgaggaagcccaactgactggcgcccgtccagctcggccacgactcctcgcccgccccgccgatggtgacgcgctggagcgcccccacgttcgagcccgacaactgcgccacgaagatgcgcgtaccaccggaggacaggcgtccatccagcgccacctgggagccgttcggagacaccgccacgcggttctccacgaactgcacgcccgcgctcagggaggagtaggtgatggtgcccccgttgagcggcacgtgcgcaagctggtcgagctggttcagcccgctgcccgcgcccgccagcaccgcgcccccattgggcacgaaggacggcgcgccataggcgatgacgttgttgggcgtgagttcctggaagccgctgccgtccgtgttgatgcgcgccagcgccgtctgggagctgttgccgggcgagaagacgaagacgacgctgcgcccgtccggactgaaggtgggcgtgcggaagttggagcagccgcgcgcgcacgtcgaatcattcgcccggaacagcgtggagggcgtgccgcccgaggtgggcaccgtcagcagcgtggtggtgccgccgctgcgctggacgaacaccacgctgcggccgtcgcgcgacacggaaggccagtaggcgccgcccacgttggtcagccgctgcgggctattggcgtcgccgccgtcgtccaccacgtagacgttgcggtcgtcctcgcgcacgaaggcgaagccgcgggtgaagaggacgcccccgatgccgccgccgccaccgtcgtccaggggctcgcagccccccaacatccccaccgccaagaccgctccgaggaacctccgcttgcccgtcatcgtcatcactccgcttcccggccgatagagagccccgtactacagagcgcaccgggactgacgtcaacgcgccacgggtgattcaacgcacggtcaatgtcagcggttgagcttctggagctcgttgcggcagaggttgcagagcgacagttgcttgcggtcgcagtcctgcggcgtctgcgcgaagaacatcacgcaccgagggtcctcgcagtaggacaaaccgagcaggtgtcctgcctggtgcaccacctccacctgcgcgcggcgccgcaacatttcgctggcggcgccctgggccaggcgatggaggctcatcaccgccgtcttcgactcgcggtccgcttccccgaagacgaaaggcgagtccgggacgaagaggtccacgtcggagatgcccaacacggcgaactggccgggctcctgcatcggcgtcagccgccgcatgatggcgttgcagtggtactggccacggtccttgttgaaggcgtaggcgggcgtcggcaataccgtcttcgacaccacggccgcgacacccatttgcgccgccagcgggtcctgcaagtccctcaagagagaggctggcgggctacccacggagaccagaaggagtgtcttctgcggcatcggcccaccgtccttcatgcacgggacggacgcatggctaccgcgtccccccggagcggagtggctggggcgcaaggattcgaaccttgatactcagagtcaaagtctgatgtcctgccattagacgacgccccagcaggttctctcgtgtacttctggtgtccgagtgtacggcatcccgacgggtgcgaggaactcccctgacgcggttctctgcaatgtcagccactggacccctcgcccgggccccgatgacggctggagccgggcgcattgtcgctctccctatacacccggagtaaagccgcccccggattttcgccaggagcggacttcccggtcagcccttgaggacggcgagcggtgtcaggcgcaggagcggccggacgaggtcggcctcgtcctccagcacctcggtgatgtcgcggtaggcggcgggtgcctcctctaccagggcggcggcgcgccccttgtcgtacaccacgcggcgcagcacgtgctccagcgccgccgggcggatgcgcgcccgtgcctccgcccgggtgaggacgcggcccgccccgtgtgagcaggagcggaaggcacgcggctcgccccggccctccgcgacgtaggacgccgtccccatggaacccgggatgagcccgcgttggccggattggagccccaccgcgcccttgcggtggacccacaacaggcggcccccgtgctcctcctgggcgacgtggttgtggtgcacgtccacgaccgacgtggggtcggcggccacgcccagggcttcctccaggacgtccagcgcgcgagcggcgatggcctcccggttggcgagcgcgaagcggcaggcccactgcgtgtcggcgaggcaggcggcgccctcggcggtgtggatgtccagggccggcaagccgccctccccgagcgcccgggccacccgcccatggtggtccgcgatggccgcgccgacgccccgcgagccggtatgcagcagcagccagagggccccgtccgcatcccggtccagttcgaggaagtggttgccgcccccgagcgtcgccaggtgcctgggcgccagccgctcccaggcatggcgcagcttctgggtggacaggggcggtgactccagcgccgggggcaagggcagcccccggccccggtggacggcgtcacctacggggatgcgctcggccaactgagacagcacgcgctccagcacgtcccgtccgggaaggcccgaggtgagcgggaaacgccaggcgctcacgccgcagcccaggtctccgcccagggcccccggtacgacgtggtgctccgtggcgaagacggtgcccactgcgatgccggaagcgacgtggaggtccggcatggcggccacgtgctccacgacatagggctgggaggcgatgtgacgcagttgtttctccgcgccgggaggcagcgctcgggcccagacgaggatgggcctgcagcccggcgcgggcggaaggagacggggcatcatgactcgccctcctccgccgccccgggcgtgtgctccgagacgccgatgtagatgaagcgaagctgcggcacgcgcttgaggtcgaggtgctccgcgagctgcgagcgcaggtagccgctggcgccttcgagcgccgcctgcaggggacgaaggccggcagccgcggcttcgggcgtgacggtgtagccgatgcgaacgaggcggccgtccggcgacagctcgaaggacgtcagcgcgacgccttcgagcctcgggtcggacagctccccccggaaggtgcgggagacttcttgggacagatgggactgcacgcgcagatggcgcgatgccgaggtacgtgcgattcctggaagaggacatgagaggacgaacggttcccagaaggccgcgcgtgcccctcgtgcgctcccggcttcaagccgtcagcgatgcgcgagacacacgccggcccattgcggggaggcaaaggctcagcgcacatgccgaatccaaggccgtggaagcgcggtccgtcccgctcagcgagggaggcggcccacccggttcagcacgttcagcgcggagcgacccgagactccattcaacacacgtcccatggcgcacctcccacagcgtgggtgactcccgcgcgggccgtgatgctgcgcaagcaagatccgaccaccacccagcccgcgtcaagcgacagccccagacggcaggacgcgggcaggcctgacagccaaccacccctcgggcccgtgccctgtgtccggtgtcggcgggtgaccaccctcactttccagcagcggacgtgcgtctcaacgcgaccgtgggcatggcccgccgccgcgctacgcagcgggcacgaggtgaaggcacatggcggaagcgttcgacgtggtggtgataggggcaggccccgcgggtgaggtcgccggtgcgcgcgccgcggaggccgggctgtcagtggcgttggtggagcatgagctgctcggcggcgagtgctcatactgggcctgcatccccagcaaggccttgctgcgcccgagcgaagcgcggtggctggcggagcatgccgccggcgtgcgcgagaagctccaggagggcatcgacgcgcgtgcggtgctggcccaccgggattcgatggtcaacaactaccaggacgactcccaggtgaagtgggccgagaatgcgaagctgaaggtggtgcggggcaccggcaagctcactggccctcgcaaggtgcgtgtggaggacaaggacggcgccgtgcgggagctggaggcccgaaaagccgtggtgctggccaccggcagccatccgcgcatcccggacatcccggggctgaaggacgcccagccctgggacaaccgccagggcactgcggcgaggcaggtgcccaagcggctggtggtgctgggcggcggcgcggtcggggtggagctggcccaggcgtggcgctcgctgggctccgaggtgacgctggtgcagcgcggaaagagattgctgtcccgcgcggagcccttcgccggagagcaggtggcccaggcgctgcgagatgccggcgcgcgcgtgctgcttggaatgaacgcgacgcgcgtccagcggcccggcggcaagggcgaggtgacggtgacgctgtccaatggcgagcaggtcgtcgcggacgaaatcctggtggccatgggccgcgtgccccgcacggaaggaatcgggctggagacggtggggctcgtgggcggcaagcccgtggaggtggatgaccagctccgcgcgaagggcgtggacggcggctggctctacgcgtgcggcgacaccaatggccgcaacctcctcacccatatgggcaagtaccaggcccgcatggtgggcgacgtcatcgcgggcaagcaggcaagggcctgggcggacgcgaaggccaccccgcaagtcgtcttcacccacccacaggtggccagcgtgggcctcaccgaggccaaggcacgcgaggccgggctgccggtacgcacggtggagcagcaactccaggacgtgtccggcacctcgctggtgggcaagggcctcactggcaccgtgaagtgggtggtggacgagaagcgccgggtgctcgtgggcgccacgttcaccgggccggaggtgggagagatgctccatgcggccaccatcgccgtggcgggggaggtgccgctcgacacgttgtggcacgcggtgccgtcgttccccaccatgagcgaggtgtggttgaagctgctggaggcgtacggcctctagcgcgccgccccctccgttgcgtgcgcgggggtgggcgtggaatggtgccgctgcccaccccaccccaccctaccgatgaccgccgtcgccccggggccctccggctccgaatcccccccaccggccgcgggtgaggggacatccattggagtgagcgcgcgctgggcgcgctgggcctggtggctcgtgctggccgtcctggccgtggccgccatcgccgtgggtcagcatccccgcaggggcgtggacttccgcgtctacctcatggcggcggagcgcttctgggaagccacggacatctaccgcctgtccgacggccacatgccgttcaagtacgcgcccatcaccgcgccgctgttccttcccttcaccctgctccccgcgcgcgccgccgtggccctgtggaacctgggctccatcgccgcgctcgccgccgtggcccgcctcaccatgcgcgccacgccttcgtcgggggaagccacgccctgggcctgggcgcccgcgctgacgacgctggccctgctgccggccttcaccttcgagctgttctacggccaggtggacgccgtcatcctgttgctcatcctcctgtgcacgctcggcgccgaacgcggacaggtctggggccctggcgccgcctttgacgaagccttcctgctcaaggcgcccgccgccctcgtcggcctcttcttcctgtggcgccggcactggcgcgtcatcggcgccaccgccgtggtgggagggattctcaccctgcccacgctcgcccgctacggctgggacggcacgctggtccaattccaactgtggagcgacacactggcgcgcaccacgccgccctgggcgctccagtccaacacccagggcctgcccaccgtactgctagcgctggtgtacccgcccgacaccgtggtgccccccggtgacatgtcgctggcgcaggccgtggcgatggtcctcttcgtcgccgccgtggtgtgggcaagacccgggccggcggacctcatcgccgtgtgttgcctgggtgtcaccctgctgtcaccgctggcgtggcgcgcgaactacgtgctggcctggccgttgatccgcgccgcggtggagagccgccaccggcccaacctggtgctggtggcgctcatcgccctcacgggtctcctggtctctgactcgggactgggcgcggaatggagccgccacgtcctcctgtggcgccccttcgcgctcgtctacaccgggttgctgatcgtcctgctgtcgcagatgcgccgcatgggcgcaccgcgagcggtggcggacgccgacgccgtgtcacgcctgccacgttgctttggtggcgggctcgcgccgtgacgcttccgtcaagttgatggaagcaaagtgtcacgggccccggacaggcccgacacatggcgtcgctatatgcgcgtccagtcatgttcgagaccttcgacagcggcccggacgtccaatcggcgcggcggttcgcgctctccactacggcatccgtcgccgtgttcgcgctgatgggcatcgccgccgtcaccgctgccggcaaggtgacggaagtcatcaaagagaagaagggcacggacgtggtgttccgtccgccgccccctcctccgccgccccccgtggtcgaggcgaagccgcctcctccgcccccgcctcctcccaagccaaagctggcgcccaagcccgcgccgcccgccgccgcgaaggcgccgccgccggccgcgcccaccgtggcgcccgcgcccatcgtcgttcccaaggaagtgccgctggagaagccgcccgaggccgcgacggagacggtggccgccgcgcccatcgccgtgggtggcaccggcgcgctcgttcccggcggtgtggtgggcggtgtccccggcggtgacacactcgccggtggtggcggttgc

SEQ ID NO: 1168 - DNA, 16720 bp, Myxococcus xanthus
  unsure (1)..(16720): unsure at all n locations
ccgcgcatttgtcgccgctgcgccctccgaaacagggcgggaggatttgaagaaggcggtcgtcgttcgcgtggcgagcaattctgcggttgcttgaattgcatggactggcgcggcggcctttggctttaccccgcacgggtgggtacccaaggccccacgtattgatgtgttcagttttgggtggtgcgatggtccgcccgtgcagggctggggtaaaggcgccggacgcggtcccgccgcgcatccccccgtcacacaaaggacccccacttatgtttgaacctgtcgggttcggccggaaggccgcgctcttgatgacgctcgtgttcgcaggatgctcacacgaggattttgcagacgcgctgaatgagccatggacccaggacgaagagctcgcttccgtcagttgggtaggcacccccagcatgtccactcagcggctggaccatacggccacggtgctgcccaatggccgcgtgctggtcgccggtggccagtcctccacgagcgccgagcaatacgacgtggcgaccgcgcggtggctcagcgcggggagcatgaatgtcatccgccggcgtcacaccgcgacgctgctgcccaatggaaaggtgctggtggtggcgggcgacgtcgccgccgcgaccaccggcaccgcggagctgtacgacgtggccaccgggacctggtcttccaccggcagcctggactcccttcgctcgggacacaccgccacgttgctgctcaacggcaaggtgatggtgatgggcggcgaggacggcacgggaaccgcgttgaggacggcgcgtctgtatgacgccaacacggggacctggagcgccacccacagcatgaccgccccgcgcatgggacacgcggcgacgctgctgcccaatggaaaggtgctggtgtcgggcgggcgctccagttcgtggggcaccgtcctccggaccgcggagctctatgaccccgccacgggaacctggtcctccaccgcctccatgagctcgccgcgcacggggcatgcttcgacggcgctgctgaatggcaaggtgctggtgtccggcgggttggtggatgacatcaccgcgacgcgcagcgcggagctgtacaccgtggagaccggtgtctggggttccgcggggggcctgatgcccgtcgagcgcgcgcaccacaccgcgacggtgctgcactccggcgaggtgttcatcgccggtggctcggacggcagcgagccctacctccagagcgctgcattgtatgaccctgtcaacgcgctctggacctccacggtttcgatgggcaccagccggctgggccataccgccgcgctgctggggacgggggatgtgctggtcgcgggcgggagcccggacggcgtcctgcgcaccgcttccgccgagcgctacgtcccacccacgctcccctggcgcgcggcgaatgccatgctgtccgcgcggtaccaccattcattgacggtgttgtcttcgggcgaggtcctcgcggctggtggcaccgcgaatggcagcacggcttcgacgggcgcggagcgctactccgaggccacgggccactggctgcagacgggcacgctgctcaccgcgcgctatctccacaccgcgacgttactgcccaatggcaaggtgctggcagcgggaggccagagcacgtcgtccagctatcttccctctgcggagctctatgacgcggccacgggcacgtggacttccacgggggcgctggctgcgccgcgtgcgcgccacaccgcgacgctgctgcccaacggcaaggtcctggtggcgggaggccggatgagctccagcttctctggcatgctggccaccgcggagttgtatgacgcggcgaccgggacgtggaccgccaccggggtgatgagccgccgtcggcagtaccacaccgcgacgtcactgccgtccggcaaggtcctggtggtgggaggcaacacgcaggatggagacacgtcctcggcggaactctatgacgtgtccacggggcagtggacgctcaccggctccctgtccggcccgcgttatggccacatggcggtggcgctgccgtcgggcaaggtgctggtggccggaggctggggcgcgcggggggcgctcgccacggccgaactctacgacccggcgacgggcacctggacctcactcacgtccatgcagcactcccgctacggaccgatgtccgcgctgctgccctccggccgcgtgctggtgttgggcggtgatggaggcggcaccgtgggcttgttggcctcggccgaggtgtatgacccggccagcggccaatggcacagcgccggaacgttgcctacggcgctcaccagcgcgggcgtggtgacgctggtgggctctggccgcgtgctggtgtcgggaggtctgggccccaacggctcactgtcctccgccgggttgtattcgcccgcgccctgattccacgtcccgccccgggggcttgtgtcaccggggcgggctttcggatgcggcccgcaagacagctcgaggtttggggtgtcgcctgggtgatggcggcgcgctttcgggtgacccgagccgcgtctccactgctccaatctcccagcggtgcattcgagggggacgcatgaatcggattcaaagggtggtcatgacggggttgttcgccggagtgctgggaggggctcccgcgtcctgggccggcgcagcgaagacgcaattccccgtggtgttcgcgcacggcatgggcgggttcgatgacctgctcggctacgactactgggggaacgacttcggcaccttcgtgggtgaggcctgtgagtcgcgcttcgacacgaactgcaacagcgacctcgacccgggacagcgcgccttcgttgcacaggtggcggcgtttcagtcctcggaggtccgcgggttggacctggcggacgacatcgaaggcttcatggcgacgacgggtgtctcgaaggtgagcatcatcggccactctcaagggggcatcgacgcgcggaaggcggcacgcgtgctgcgggagcgaaggggcgccacgtcggtggccgtgctggccagtgtgtcttcgccgcaccgcggctcgccggtggcgaagtacatcctcgaccagaaaccgggcgtcaccagcgtcatcgcggcgctggcgcgctactacggcgactccgtctatgcgccgggcaatgatgcctatgcggcggcgaagcagctcgtcttcaatgactactcatcctcggacggtgtcgtcacgggcatgaaggccttcaacgagaagtatccggtgagcagcaactacgcggagcgctacgtgtcactcatcaccgcgcagttcgggggaaatgtgaatccggcgctgtacctgttgaaggagttcctcttcgacatcgacggcaatggctactgcgtgggagatggggacaacgacggcgcggccggctgcggcgacggcgtacgtaacgaagcggatgacgatggcatggtgggcatcaactctcagcagatggggcgtcggctgcgctaccacgacgccttcttcggcttcgactcggtgacggatgacgcgtccattcccacgctcaatgatttgaacgcgccatcgcgcctacagagcacgtccatgtccagcgtggtccctcaggaccatgtggatgtggtgggggtcgggccggacgccttcgatgagccggagttctacgccgccctcatccattacatctcactgcatgattgacgtgccggcgcgtcaggccccgggctgcggggcttcgacttcctcggactccacgccgtagtacgcgaggcactccacctcgcgtccgcgcaccacacgtcggccgtcgagcggaccgccatgcgcggtgacgatggtgcattggccctcgtcgccttcctggtcgaagtagagcaccacccagtcatgggtggcgttctgctggtgggccagcgcggtgttggagaagagcgcgcggaagttccatcccgccagcttcttgcggagcacgggcagccatgcttcgccagagggattgaaccggcgcggtgcaatccggcgcagctcgcctgcgtccgcgcgccgccggtactcctcgtccacctggagcagcacgcccacgtccggccgggggccttcatcccgtccttcgctccggcgtgcggcgctgcgccgctccctgcccagccgtgcgcccagcagctcgcgcacctgttcgctgcgccgggggccgaagccctccacgcgctccagccgtccgtcgtgtgcggcctgctccaactcctccagcgtccgcacactcagctcgtcatggatgcggcgggccagccccgcgccgatgcccggcacgctggccaggagttgctccggagagtgctctgtctccagccgctggagcagggagagctgtcctgtgcgaatcagctccgccatcgccgcggcgatgctcttccccacgccggggagcttgcgcagccctgcttcaccttcctcggccagcagctccgccacgggttgaggccactgcgcgatggtgcccgcggccttccggtaggcgccaacccggaagggcatcgcgtcctgctcctccagcaggtccgcgacgcgctccagcgcgtccgcgacgtcaatgttgtccttccaggcaacgcccatggctgccttcaaggtggggtgcgccgaagacggtggccacccctgtcgctctggtcgcgcagtggcaccggctcggcgggcggccgacaaggcggccggcttgcagcccgcgctcacgaccgaagcgctcagcctggctcgctcgtggaggcgcgaggtccttcaatgacgaccttcaggccgcgcggcgggttgggcgcgaaggcgagtgagaagccgacgcggtggcacaactcgcggacgatggacaggccaagcccgctgccccgggtcgcccggcgccgcgtggcctgcgcgcgaaacccgcgctcgcccaggcgctcgagctcctcggcagagaggcctggcccgtcgtcgagcacggtgagccggaagcgcccgggttccgcatcctccaggagcgccacgacgtggccccccgcctcgccgtgcgtgacggcgttgtggagcaggttgcccagggcctgctccagcatcgtgggattgcagcgcacccagagcgcctcgtcgggccgggagcactccacggtcagccccagcaaccgcgcgagctgctggagcctgcgcaccacgcgctccacggtcagccccagctccacgcgcgggtcgcccgccgtcgggtcgatgccctctccgagctggcaggcgagatggaggttgtccaccagggaggtgagatagacggtgtcctcgatgccctggcggaggagcgccgcggtcggctcggtgggcgtcgtcgaggccagctccagcgacaattgaagcgaggcaatgggcgtcttcaggtcgtgcgcgacgtccgccaggtgtcgctccagcgcgtgtttctgggcctcgatgcgggtggcgtcctcctggacacgggcatgggtggcgtcgagcacccgtgacagctcgcccagctcatcgtcctggccatccgccgcggagtgataccggctcgccccgagcatccccgccgcccgatgcagacggcgcaggcgctggaggaggggatggacgacggcgaaggtggacagcgtcgccgcgagcatcgtgaagaggacggcggccacgaggacccacccgcccaccgtggcgcgctcgtccatgagcggccagcggaactccaggaggctgcaggggccggactccgcgagcttcagcagtgaggcccccgcccacgcggagtccggatggaagagcgggaggtagaagagggtgggctcacgctctccttgggcgagtcgcgcgagcagctcggggtccggccgtgcgccgggcgagcccgcccccacctgggcaaggtcgtacgcctccacctccactccgtccgggctccggaagcgccatcccggtgtcgtccggcactccgccgcctggggcgcgagcgccagggcggcggacatccgtacgccatgcgacagcgcggcatccacgcccaggacaatcgcgaggaaggacgcgcccagcgtgcccagcaggcccaggagcgcagaggccacgaggatgcgttgagccaggcggttgcgcagcctcaccgcggctcctcgtcggggacgaaccggtagccaatcccccaggacgtctggatgcgcgcgcccgctggccccagcttcttgcggatgcgcgcgatgtgagagtccacggtccggtcatcgcgctcctcgctgggcggcagcgcgtgctgggcaatctgtgcgcgtgtcagggcccgtcccgggcgctcagcgagataggcgagcacgtcgaactcgtggcgcgtgaagggcagggcgccggtgccttcgcggctcgcctcgcgggcgtcgaggtccaggctcacgtcgtcccagtgcagcacgcgtcgcgggcgctcctcctggagaagcagccgtgcgcggatgcgggcgaccagctcctccatccagaagggcttggggaggtagtccaccgcccccaggccgaaggagcgcagccgggcctccagttcctgtctcgcggtgaggacgatgacggggacacggagccggaagcgccaggcttccagcagctcgaagccgtcctgtccgggcaggttgaggtccagcaccaccaggtcggggtgctcgcgctcggccatctcgagcgcgagcacgccatccgtggcgagcaccacctggaagcccgcgagcttcaatccacgaacgatgcccgcggcgatgggggcatcgtcctcaacgaccaggatgcgcgccgatgggttcatggacacggtccccaggtgggtctcgtcgtgtcagcgctgtcgctcagtacacccaggtgtagccgccgccgaccgtggcgctcacgccgtctttggcgaaggtgctgacttccgcgccgaggcacatgacgaggcccgcgaggtcgagcctgccactcgtggcgaaggccgtccattccttctcggtgatgggcatcttgaagacgacctgggcgctgccgcaaaacttgccgacgccggcgccgaggctgaccgtgagcacggggccggcgagcttggagggcatgtcggcccacgcgccaaactggaagttcatcgagatacccttggtggcgcctgcgacgcccccgatgccgaagaagccccggacttgcgtctgccctgggtggtcgaaggcgatgccgacgtttccctcggggcccaggccgaaggtcgcgctgccgccgctgccgatggagagggtcccgagccccttgctccgggcctcgttaccagtgcgctggaccgactcgtcctgagacagcgagctgactgtcttgttcgtgtcctcgtccttcttcttctgggaggactggcccacgaggaagtccacctccttgcggcgggtgggattcgtcagcagcgcggagcccgtctcggccatgctctcgaggagggccaggtgcttgcggtagacgtcctcggccagcgcctcggcgacgtcgctcagcgcgtccgtgaggaagcgggtggacagctccaccatctcgttccaggcggcctccccggcggccagggactccgcatacgcctgctccgccagcttcgcggtgtcgcgggtgagggtgtccacctcccgggcgagctgctcggcctcgcggctcacctggttcgtcacggtgcccgccgtatcggtgacggtatcggccgccttgttggcggtatccaccaccgtgttacccgccttctttgccgtcttcttgaccttcttcaccgctttcttgaacgacttgctgatgctcgacatgtgaggaccccctcggctgcgttgagggacccaccttgcgggagaagtgttgagggactgtggagcgcgccttcagacgccgtccgcgacgacggcgtccgcttcaatctccaccaggatttcgggggagatgaggcggctgacctccaccatcgacgtggcggggcggatgtgggcgaagaactctccatgcgcccggccgaccgcttcccactgctggatgtccacgacgtacatgcgagtgcgcaccacgtcctccagccgggcgcccagggcctccagggcggattggatgttctggagcgtctgccgggcctgcaggtaggcgtcccccacgcccacgatgtgtccctgggcatcggtggctgtcgtcccggacacggagacgaaggggcccacacgcacggcgcgcgagtagcccacctggggctcccacggggttccagtcgaatgctgggtgcgcttcatggggggctccgagggtaggtgtgggtcggcagccttgcatgggaccctgcccggccggcaagcgccgcttgcaagctgcaaggaaataccgcccgtgatagttggccccgggtcatgacgaacgagctccatagggaggtcgcccggcggcgcaccttcgcgatcatctcccaccccgacgcgggtaagacgaccctcaccgagaagctgctgctctacggcggcgccatccatctggctggaagcgtgaaggccaagcgggcgcggcggcatgccacgtccgactggatggagctggagaaggagcgcggcatctccgtcacctcgtccgtcctccagttcagctaccgcgaccactcggtgaacctgctggacacgccgggccaccaggacttctccgaggacacctaccgcaccctggccgcggcggacgcggcggtgatgctcatcgacgccgccaagggtgtggagccgcagaccaagaagctcttcaaggtctgccgcctgcggggcatccccatcttcaccttcgtcaacaagctggaccgctacggccgcgagccgttggagttgatgaacgagctggagcacgtgctcggcatccgctcctatccgatgaactggcccatcggcatgggcccggacttccgcggcgtctatgaccggcaggcccgcgtcgtccacgtcttctccaccgagggttcccacggcgagtccgaggtgagcgagcgctcggtcgccatcgactcggatgaaatcaagacggtcctcaccgagacggagctggcgaagctgcacgaggaaatcgagctgctggacatcggcggcgacgagttcacccgcgagaagagcgatgcggggcagctcacgcccatgttcttcggcagcgcgatgaccaacttcggcgtgcgcccgttcctggatgccttcctggacctggcccccgcgcccacgtcgcgcctgacgacgcatgggccgcgcgagcccacccacccgaagttcgccggcttcgtcttcaagattcaggcgaacatggaccccgcgcaccgcgaccgcatcgccttcatgcgcgtggtgagcggccggtacgtgaagggcatgagcgccttccactcgcgcctgggcaaggacgtccgtctggccaagccgagccagttcatggccgccgagcgcacctccatcgagnacgcgtggtctggggacgtcatcgccctgttcgacccggggctgtaccgcatcggcgacacgctggcggagggcaccggcgtggagttcgagggcgtgccgcgcttcagcccggagttcttcgccgtcgtccgcagccgggatccgctccgccgcaagcagatggagaagggcctggagcagctctccgaggagggcacggtgcaaatcttccagcagctgcagatgggcatgaaggaccccatcgtcggcgtggtgggcgcgctccagttcgaggtcctccagtaccgcctggagcacgagtacggcgcgaagatcgcgctggaccggctgcccttcagccatgcgcgctgggtggtgggcgccaacttcgacccgaaggcgttcgactgggaaggcaaccgtcagacggtgcaggaccgggacggactgcccctggtgctcttccgggatgactgggcgctccagcacgccgaggacaagcacccggagctgaagttcgtctcggaggccccgcagttgcggcaggccacccccctggcttcgggcggctgaggcccgccggccgggtagtaccagcccctgggcgaatggactttcgccaggggcttcattaagcgaagggggctttccgcgtcgcaccgcagccggcccactgcatgtcagagcggcaccccctacctcacgaggtcgtgcgtgcctggcgtcaatgccagctgccgcgcccatcctctcccgcgctgttggacctgttcgagcgtggctttcaggcgctgtggcgccgtggccgttcggccctgggggaggtcaccctggtggtcatcctggagcgggtgctccagcgggtggtccaggcccatcctcacttgtcggcgctcgtcgtcacatcggagggtcttcgcttcgaggggctgcatccggtcgtggctgaattcgacccggaacggctggaggagtcgctggtggtcctggtcgaggagtggctgcgcgtcctcggggcgctgacgggcgaggtcctctccgccgcgctccgtgaggagctgctggccgtggaagggacgaggcccccccgatgaaggcgccgcggagcccagcgggggatgactccgcccacccggacgtcccagcctcccgccggcggccccgtcgcgcctggcgaaagcgggggcaggcccaccgccatctggcgcagctccatgaggtaggccagctgctctgcgcttccgagggtgtcgcggccagctttcccgcgctggtggaccgcctttcccgatggctgccggtccgcgtcgcgcttctgctggagggggtggatgcgtccggagtgcccgttccggagcggccctgcctgatggcgtggcattcgtccgtgggcatggagtcccctccgtcccaggccgtggcgcatgccgcctccgcgtacgcgtacctcgtgggcctggagcgtgtgacgctgcaagggcgtgacgtcatcgagggcgtgttcaaggcggaaccggcccgggttcccggggtggtcaccctgccgctggtggcgaaggaaggcgtcctgggcgtgctccacgtggagtcggtggggctgggggaggacgggctggtgctgctggacgcggtggcgaaccttctggccgtggccctgccgaaggagcatgtcctgcgccgcgaagttcgccggcgtgagcgcgcggaggcgctgttctttcaggcccaggaggccgtgcgctggcgcgacgagctgctcaccgtcgtctcccatgacatcaagacgccgctgctcgcggtgcggatgaacgcggagatgattctgaatgcgggcacggcgccggagaaggaacaccgccggcgccgctacctggagaacatcgtcctcgccgagcagcagatgagcagcctcatcggcaacctgctggaccgggcgcgtctgcgcggcatgcccattcccctgacgctccagccccttcccgtggacgccttgctggcgcagtcgctggaggtgctccggccgctcgcgctggagaaggggcaggtcctgacggtggcgcaggcgcccgagctgccgccggtgctcgccgaccgcgagcgaatcctccaggtgctggccaacctggtgagcaacgccatcaagttcacgccccctggcggcgtcattgaggtacgggcccgcttggtggagggggcgaaggtgtgcgtcttcgtgaaggactccgggcccggcatccccgccgaggacgcaccgcacctcttcgagcgcttctggcgggccagccattcaccgggacgcggcacggggctggggctgagcatcgcctggagtctggtggccgcgcacggcgggacgctcaacgtggagagccacgaagggcaggggagcaccttctccttcaccctgcccgtggccctgccctgaggcgccgcggctacttgtagggcaacaccgtgccaccgcggaaggcggagtcgcgcagcacgagcccttccttgcagagccgcgccgtcttggggcccacgaagaagcccttgggatcgcccttgcggtacgtcttcttgatgtactcctcgacctcgaggaacaggctccggaacttgtcgggcgccgcgttcttccggcccgtctgcgcggtgatgtccagctccgcccacatcttgccgctgagcagctcgccctcttcgttggtgcgacagcgctccatgaagatgacgggcgagcgcacctcgtcgatgcgccagtagcccttgtccgggccgcgcttcaccttgtcgacgatggccgcgcccagctcggaggccaccatgtagaggtcctccgggggcagccgctccaggttctccgtgttcgcgcggaaggtctcccaatcctgtgggacgcgccgggggtacacctccaggacgaagcgctccaggaagcggaagaaggcgagttcgtcgtcgggggacatgaagaactgaatgacgttggccatcgcgcagccctcatactcccgagtgcgtctttcgcgatagtgcggcgcgaagcgggctatgaatccgggcatggatacctggctgctgacccggatgcaggaacttcgcgaccttcagggcctcatcggcctggccacgtgggacatggagacgtacctgccctccaaggccggtcccgcgcgctcccatcagctctccaccctgcaggggctgcaccacgagcgcctggtggacccccggctgggggaggccctggcccaggccgcctcgcaggcggacctgtccgacgacgcccgggccatggtgacggtgctgacgcgggagcgggagcgggaggtgcgcgtccccgcgccgctggtgcgggcgctcgcgggagccatcagcgacgccatccaggcctggcgggaagcccggcaggcaaggcgcttcaccgtcttccagcccgcgctccagcgcctgctgtcgctgcgccgggagcaggcggacgcgtatgggcatgacggggagcgttatgacgcgctgctggaaggccatgagccgggcatgcgcgtggcgcgcctgacgccggtgctgtcggcgctgcgcgagcacctcatccccatggtgggcaagctcaccgcggtgagccggccggtggcgcccttcctgatgggccgtcactacgacaaggacacgcagtgggccttcaccctgcggctgttgaaggacatcgggttcgatttggaggcgggccggcaggacctgagcatccaccccttcacagggggcacgcacccgttggacgtgcggctcaccacgcacgtggacacggccacgccgttcccgtccatcttcagcaccatccacgaagccggccacggcctgtatgagcagggcttcgctcccgagctctaccgcaccccactggccgccgcgccttccatgggactgcacgagtcgcagtcacgcctgtgggagaacatggtgggccgcggcctgccgttctggcggcattacttccccgtgctgcgcgccgccttcccggaggcgctgtccggcaccgacctggagaccttccacgccgcggtgaatgcggtggggccgtcgctcatccgcatcgagtcggacgaggtgacgtacaatctgcacatcgcgctgcgctacgagctggagctgctcctggtgcgcgacgagctgccggtggaggacctgcccgccgcgtggaacgcacgcatggaaaagtacctgggcatcacgccgccggacgacacgcagggcgtgctccaggacatccactgggcctggggcgagctgggctacttccccacgtattcgctgggcaacctgtacgccgcgtcgctctaccgcgccgcgaagcgcgacctgccggagttggaggcgcacctgggccggggggagttgctgcccctgcgtgactggctgcgcacacatgtgcaccagcatggcttccgccactccgcggaggagcgcgtgaagcaggtgacggggcaggggctcaccgacacggacttcctggcgtacctgaaggagaagtacggcgcgctctacggtgtctcgctttgagaggctgatagcgcgtgcgtcagtcaggaggtggcattcatgccgcctcgtgcctgggctgtctgttctgtgatagctgaggagcaacacggcaaagggggacgcaaatcaaacctggaaaaatcatgctgctgggctggggcgcgggtgccatcggcgtgggcgcctacatcttcttgtccccgtacctgtcgccacccgcggagccagggaacatctcgagtccgacgctggcgaagctgctcaatgagagcatcgacgcggccatcgagaggatgaatcccacgcattcccctgggctgattccggaagcggcggccaattcgcgggcgttcttgaaggaagtctcggaggtggtggctcggtgcagcaaggggcgtttcgagccgggccagaagtacaacaagctggagtatcacctgctccgtaccgacggtgtccgctacgagcgcatctacacgggcattcggtgccacgaggcgacgctcatctaccgggccgtcttcaaggatgggcgtgtcgccgaggccttcacggacgggcgtgagcgtcagtatccggtcggccaggttcgtggcgcggtgggcgagttcgggaagaaggtgacctggtcggacagggattaccacccggcgcgctactacgttccgccacctgcgcagccgactcaggcggacatcgcgaagcagtgggagtagtccggaatgggcacaccctgcgttcccgctcttgccggagcgggccgtggcgtcgccgtttcagtgcccgccgccgttcgaagcgactgtagcggcgggaggagcgatggctcaggggagttcctactgcagacagacgtgtgccagggggcgtgacgcgaatcgcattcatggagttgcgcgggcaatgtccgcagtggccttgcatcaatgaatgcatgaggtcgtcgtgacccattgctaatgcgtggcacgctttcttgcgtcccagcgcatcggcggtcgccgcgaattcaatgggtgtgtcaggctttgcaggggctgccgtcattgcgtgaccgtgggctcgggagttccgagtccacgtttgcaacgcattgcgtgggagtcgcacttgtcgtattgggcccgcgcggagggggaacattcatgagaattctgagtcgagttgggctgatgtgggcggcctgcgcgctggtggcggcttgcaacagcgagggatcgtccgagaacgcaggtgaaaccgagtccgtccgaatggaaatctccctggcgggggatgtctgcggcgtcgtgtccgccgatgccgttgtttccggcctgggcatgcctgtcatcgggcctgttccgcttcacgtggacggcacggccatccgggggcaggtgtccgaggtgcctgcgggagccggtcgggcagtgcgtgtgattgcgtataacgcgtccatgctggaggtgtacgcgggcagcgctgtggtcgacgtcgtggccggcgaggtggtttcggcgggcctcgtgctgcagcgcaacccggtcaactgcccgggcacgaccaatggtggcatcgacatcacgggcgaactggagaccggtgagcccactccggatggtggcagtgatggcggcgtggacccggatgcgggcgtcgtgctgggcggggccgagttcgccttctcctaccaggacgcgacgctgacgcacgatggcgtcatccacttcctggacggcaacgcgaatcgtatccgtcgactcgacctgacgacccggagcttcctgtccgcctacgtcgggacgggtgatgcgacatcgatggcggtcgcttcggacggtcagaccgcatacctggcctacacgggagggcgtatcgacgccttcacttcgacggaggggggcacggcccgcttcttcgccgcggcgcctgcgtcggtgtcgcgcatggtggtggcggaccgatacctgtttaccattgatggctccggggcttggggtacgcatgcgctttatcagcgggccacgggcgctcgggtcgcggcggcggactggaggaacagtgcggtgagcctgctgttctcggaggcgaacaacaccatttacttcgccgacagcggcgtctcgccacaggatctgaaccgggtgcaggtggacatggaggcgggcacgctgggcgctgaaatcgactcgccctaccatggtgcctacaacctgagggcgccgctgcggctgtggccggatggctccgcggtcgtgacggggagtggcctcctcttcaacacggcggacctgacgtaccgcaccagcatcggcctgtcgttcgtggacatcgccttccacggtgagcgcctctacctcatcgacaccgtgggagacaggacgcagctgcgggtgctcaaccaccggttcgacatcctctcggcggcgtactacccgggcgcggcccagcgggtcttcgttcacaacggccaactggtgctgctcacctcgacggggagcaatgggttccaggcgcgcctgctggacctgtagttccggtgtcatcttgagtgctggtgcgtgatgccggggcgcggaangannnannntnnnnnnnnnnnnnnnnnnnnnnaccacctgcacatcctgcccgtgcaccagcacccggaacggcttggcgcggtaatggtaaaccagcacatacacgggcagggccagcctttggtgccc

SEQ ID NO: 1169 - DNA, 18538 bp, Myxococcus xanthus
  unsure (1)..(18538): unsure at all n locations
ggggttttcctggaccggcggtgctggtgatgctgtccgcgtgtggtcctgcggaagagcagctttctggcgatggtgaactctcctcaagcagcattgagttgagctccgtcattccggttcccgatgcggagatgttgcaggcgctgacgagttcatgccagcccgcgagcgaagggaactgcattggcgctggctacctggtctgtactgactggtctgctcaatacgagtgcgcaccgaagacggcttgcgacccgctgaaccctatctgcaagacgcgcgtcgacgggcagttggtgacgactggtaccgagtaccaggatcgcaacagctatcgcgtgtgctccaactcgcagggtggaacctgcacggaattccggtttgatcgcgccaggacgtgcgggtgcggtggcgggtatcccatctccgagacctgaggcgcggctcatccgcgacggggaggcgctagcgccactgttcgcttgatgcccagatagcattcggcccggcccctcatgtgaggagccgggccgtttttcttccagcgcccgcggacctcagtgggacgcggcgggcgtgggcaccgcttcgtcctcaccggtggcccgcttcgcgtcgccgcggagcttctgcatcagcacgtagagcccggggatgaacacgaagttcaccaccgtggacaccagcatgccgccgaacaccgccgtccccagggagttgcgggacgccgcgccggcgccggaggccgtcatcagcggcaccacgcccaggaggaaggcgatggacgtcatcaggatggggcgcaggcggacctccgccgcctccaccaccgcgtcgatggcgctcttcccgccctcccggagctgctcggcgaactccacgatgaggatggcgttcttgctggccaggccgaccagcatcaccagtcccacctggcagaacacgtcgttggcgaacccgcgcgccaactgcagccccaacgcgcccatgatggccaggggcacggagaagatgatgaccagcggcaggctgaagctctcgtactgcgccgcgagcaccaggaagacgaacagcagacccagcgcgaagatgatggccgtctgcccgccgctctccttctgttccaggctgatgcccgtccactccgcgctcatgccctgaggcaggtgctgcgtggccagcgtttccatggcctccagcgcctgtccggaggacacgtccggcgccggctgcccgttgatctccgccgagcggaacaggttgtagtggcggatgacctgngcggacacggtgggctccaccttcaccagcgactccagcggaatcatgtccccggtgtcgctgcgcacgtagaaggcgccgatgtccgacgggctgtcgcggaattgctgctccgcctggacgtacacccggtaggtgcggttggcgtagttgaagtcgttgacgtactggctgcccatgtagacctgcatggtgccgaacacctgctcaatcggcacgccgagcgccttcgccttctgccggtccacctccacgtcgagcagcggcgtgtccgcgttgaaggtgctgaaggcaccgcgcagttgctcgtgctcgttggccttcgccaccagcatctgcgtggccgcggccaggtcatccagcgagctggtgccgtcgatgtcctcgacgatgtactggaagccgcccacgctgccgacgcctcggatggcgggcggctggaagggcatcacgcgcgctccgccgatgcggctcagcggggcacgcagccgctccaccagcgcggccaccgactggtccttgcccttgcgctcctcccaggacgtcagcgacgagaagatggtgcccatgttggggccgctgcccatcatggagaagccgccaatggcgaacatggcgcgcacctcgggctgcgcctgtaggacggcctccgcctctgccagcaccttctccgtctgggcgagcgacatgccctcggggccctggatggagatgatgagatagccctggtcctcgtcggggatgaagcccgtgggcgcggcgcggaacagcagcgccgtgccgccgatgcacgccaggaaggcgagcaggaccaggaccggatgcttcagcagcttgcgcaggccccggccgtagagcgcctttgtcccgtccagcaccgtgtccacccagcggaagaagacccacttcggtccctcgtggtgcttcagcatcttcgcgctgagcgccggggtgagggtgagggcgcagaaggtggacagcgccacggaggcggcgatggtcagcgcgaactgccggtagatggcgccagtggtgcccgggaagagcgccaccgggacaaacaccgccaccagcaccacggagatggcgatgaccgcgccggtcacctccttcatgccctcgcgcgcggcctgtacgggggacaggcgccgctccaccatcaaccgctcgatgttctcgatgacgacgatggcgtcgtccaccaccaggcccgtggccagcgtgaggccgaagagggtgagggtgttgatggagaagcccatcaggtggacgaaggcgaaggtgccaatcagtgagacggggagggtgaaggcggtgatgagcacgctgcgccagccgtgcaggaacaggaagatgacgaggatgacgaggacgatggcttccaccagcgttttgatgacctcgttgatggaggcgcggacggccagggtggtgtcggtgcccgtctggaactgcatgccgggcgggaactgcttcgacagccgctcgagctccgcgtacacgccgtcgcgcacgtccagcgcgttggcggtgggcaactggaagatgcccaggcccacgcccgtcttgccgttgaagcgcaggacggagccgtagttctccgcgcccagctccacgcggcccacgtccttcacccggatgctcgtgccatccgtgtcccgcatcaggacgatgtcgccgaactccgccggctccaccagtcggccccgggcccgcaccgcgatctggtagggctggtcctcggtggacggcggctggccaatctgacccgcggccacctggaggttctgctcctggagcgcgcgcgtcacgtcctggggcgtgagcttgcgccgcgccagctccgtggggtccagccacaggcgcatggagaacttgcgctcgccgaagatgcggacgtcacccacgccgggcacgcgcttgatggcgtccttcaggctcacgtcggcgtagttgctgaggaacttggcgtcgtagcggttgtcctcgctgaacaggcccaccgtcagcagcatctggctggaggccttgttgacgacgatgcccgtctggttcacctgcgagggcaggcgcgccgcggcgcggctgacgcggttctgcacgtcgacggcggccacctcgatgtcgcgcgtggcctcgaaggtgatggtgatctggctggtgccgtcgttgctgctggtggaggtgatgtagcgcatgccctccacgccgttgagctcctgctccagcgggatggtgacggcgctctccaccacctcggcgctcgcacccacgtaggtgctcgtcacggtgacttgtggcggcgccaggtccgggtactgggcgatgggcagcgtggggatggcaatcagccccaccagcgtcagcaggatggagcagacgatggcgaagacgggcctacggatgaagaaatcgacgaacatggtgctctatccggcccttcgttcagcggctcccgccgacagtgccgccaccattgccagaggcccggggcgggccgctgccagtgggggcgttgggggcgttggcctgcttgggtttcaccgccatgccgtcacgcagcgcttgcagcgaggacacggcgacctggtcgcccgactggagcccgctctccaccacgtaggccatctcgcccagcgcgccgagcgtgatggggcggcgctccaccaccgtcttcccgtccttcgccaggaccaccagcgcgaagggctgaccgctctgccgcacgatggcgagcgcgggaatctgcagcgcatcccgggccgagtacacgagccgcgcgcgcaccagctcgctgggccgcaggcccacggtgttgcggaaggcggccttcacctccaccaactgggtacgggggtccgcctggggcgcgatgtagaagacgttgctggtgatcagcaccttgcccgtgctgtcgaggatttcgagcgcggtgtcgggcttcatcgaccgggcgcgcggcgacggcaccgacacgctcacctcgagcacgtccgactgcgccacgctggtgagcggcgtcgtcatgcccacgtagtcacccagccgcaccagcacgtcgcccatcgtgccggcgaagggcgcgcgcaccacgtggtactggagctgcacctggcgctgcgtcacctgcgcggcggatgaacgcgccgcggcctgggctgcctccacctgcgcgcggccctgctccagctcctgcgcgctcgcgagcccttccttgtagagcgcctcggtgcgctccagcgtgcggcgcgccagctccaggctcacctgggtggagctgagctgcgcctgcgcgctgtcgagcgcggcggtgccttcgcgcgagtccacctcgatgagcgcggcgccggcctccaccttgtcaccgggacgcacgtgaatcttgcgcacgtagcccgcgacctggggcagcacgttgacgctctgccgcgacatcagcgagcccaggtactcccccgtttcgcgcacctcgcgcggggtgagcgtcacgatttccacctcgcggggcggaggggccggcggggcggccttctgggccgaacagcccgccaccaccgccagcagggtgacaccccacatcgccttcatctgattcaccagtcgcaccgcgcctccgtcaggaatgcgtccaggcgcgcctggacgagctcgaattcacgcagcaccagggtcagctccgcctggcgcagggccgctccgctctgcaccagctcgaggctgctgccgcggcccacttcaaaagaacggcgggtgaggcggtcggtccggtccgcgaggtcgcgggacgccaccgccgtcgtcaccagggcctcggccacctccacggcgcgccgggcctgggccacctgaatcgacacgtcgcggcgggtgctctccagcgcctccgccgcctggcgctcgagcccctctcgctcgcgaatcaagccgccgcgcaggccaccttcccagatggggacggagagcaccgcggacacactccagatggccacgcggccgaagccggggtccgtggtgaggcccactgcggtgctcgacaggcccagcgtgggcaggtatccggcggtggcttgttggcggctgtcacgcgcggactccaactgcgcgcgcgaggccacgaggtccgtccgctcgttcatgtccttcaagggcgtgcaggcccgctgcgtctcgttcaccagcccctggaggttgaagtcccggctgacgccaacggcgttgccgaagcccaccgccagacccagggcctcacggctgcgccgcaactgctcgtctcccgcgacgagggcgctgcgtgccaccgccacgtcctgctccacgcgcaccacgtccaactggttgcccgcgcccagttcataggtgcgctgcgcgagcgcgaagcgctccaaggcctgccgcaggcccacgcggttgatctccgccgcccgctccgccgccaccgtggacaccagcacctgggccagcccccgcgtgagcagccgccgcgtctcgcccagcgtcgccgccgcgccttcctcggcggccacggccgaggcgcgcccgcgccaggcgctgacgtccaccagggattgcgtcacgttcgccgtggcggtgagcagcggcgtggagggaccgcgggtgtcgccgccaccaatgcccaccagcggcgtaccgccagcgcccacggggaggtcggggttgaggaggtccacaccgacactggacgacagacgtgcattggggagcagcgcggccagggcctgccgggagcggcccgcggcgcgttccacgccggcttcggcgcttcggaggttggtggatcgctcccggacgagcgcgagcgcctcgtcccaggtcgttacctgccgctgggcgggggcaacgggggtgagcatcgcgtcctccaccttcggctggaaggggacgggcgcaggaatggacggtgacggctcggtcagcgtcgacgctgcgacgagcgccaagagaatgacggaaggggatgccatacgaggaggaagaaatgagggaactgcgtgtgggctgaaaacttcccccccgttgtgaccaaacgcgtcgcgtcgatgtaattgacaatggttgatgtctgcaaccatctttagggggagatgactgtcccggagcaaatggcctcgctgcggcgcgccatccgtcgcctcctcaccgagcggctaggcgagcagaccagcagacccttcatgcagttgttggcgctgaaatccatcgccgacggtgtgcgcagccagtccgccatcgcggagcggatgctcgtggacgcaccctcggtgagccggctcgtcgcgcgcctggaggaggacggcctggtgaagcgaagcatcgcggaagatcgccggtgcgcgcgcctggagctgtccccggccgggcagacggagctgaacctgctgcgcgacgcgctcatctggacggacgtggagctgcttcgctacctcacggtgcaggagatggcggagttcaagcgcctcacggtcaagctcctgacgggcctcctccaggcccgggggccggtgccgctggaaggcggctgcggcccgtccgacacctgatgtggaaatgacgaagggcccggccctggaggtcctccaggatgccgagcccttcaatgtgcccatgggagggcgggtgcgtcaggcctgcgcgggcttggactccgcgtcggccggagcgctctcgggcgcctgctgctcggtgtcggccggggcctccgtcttgggcgtggcctgggcctcggcctcggcgcgcacgcgcgacgtctcctcggtgcgctggtcgctggcggcgacctcctcgggcgtcagctccgtgcggtctgcgagcatgcccgtcttcttttccaggtccttgatggcccggcgaatcaggtcgcgctccaggagcgtgcggttgaggcgcttctccagggccttgtacttgtcgcggctcaggtccaggtcgtgcttggtggcggcatagacgcgctgctgcgtctcgttgcggcccttcacccggcgcagctccttctccagctccactgcgcggaggcggtccttgttcgccgcctgctccagccgctccatcttctcgcggtcggcgtcgttcagctcgcggtagcggcgctggccacgctcctgcggcaccgtctccgtcgccgtgggcaccaccggcaccaccgcggcgatgacggcctcgccctcctgggcgggcgcggcgacctgcgtggcgggcgctgcgatgggggcggccggcgcgggctgcgggcggcggcccttggactccatctccgccttcagccgctggttctccaccagcgcgtgggacagctcctcacgggtccgctcgagctgcgtggaggcgttgcgctccacctcggcgcgcgccttggccaggtcctgcgcgctcttgtcggactccttctgctcgtagagcttgcgcttggcctgcttcagctgctccttcacgtcctgaagttgagtgcgctgctcgtccagctccttctgcttgcgctgcagctccgcctcggccttggcacgcgcctgggtgtccgtcaccagctcggcgcggggcgccgacgacgacgtggacgacgacggaagcgcggcgtgcttggggccggcgaagagattgaaatagagcgagatggcgagcccgacagcaagggcgaggaccaggaccagcacgggaacgacctccacggggaaatgcaaaaagcggggcagcctaccgtcagcccccggggcgtcaagggtccactgctagacgtgcttcggttcactccctgcgtcgccccggccagcggcccggcgagcgtccggggcgccgtccgtcgcctcagtacgcgtactcccagccgccgcgcccaccggtgcgggctcccaggcgggcgcccagctcccgcagccggcggacccgctcggggatgggcgggtgggtggagaacagggccatgactccgcctcggtggagcgggttgacgatgaagaggtgggaggtggccggggccttgtcgtagggaatggcctccgcgctgcgttccaacttcagcagggcattggcgagcgcgtccgggtcgcccgccagctcggcgcccgtctggtccgctccgtactcccgtgagcggctgacggcgagctggagcagcgtggcggcgatgggggccaccagcagcagacccaggttggcgaaggcgctgcccagtccgccgcgctcgtcgttgtcgccccggctgagcatggagccgccgaaccagaagagcatctgcgcggcgtagctgatgatgccggccagggtcgccgccaccgtgccgatgagggtgtcccggttgcgaacgtgccccagttcatgggccagcacgccttccagctcgcgccggtcgagcagctccatcaggcccgccgtcaccgcgatggcggcgtggctcgggttgcggcccgtggcgaacgcgttgggcgccgccgtggggaggatgtagaccttgggcttcggcatgcccgcgcgggaggccagccgcgccaccatgtcgtgcagccagggcgcctgctcgtagggcaacggcctggcgccgtggatggccaaggcaatccggtcgctgaaccagtaggagccgaagttcatcaccaccgcgaaaaggccggcgaaagagcagggccttgcgggccgcccagccggtcgccgatgacgagcaccaggcccgtgagcccggccagcagcacggtcgtcttgagcgtattgcccaaccggtgccaaccgcctccgccgtgcagtgctggccggtccgcgccggcgcgggccgtatcgtgggaagaattgagcgccatggccgcctcgtttccggagaccctgcggggccctctggaaacgtaaacaagcgcgagggctcggcaatgacgggggacggcgccccccggggagagggggcagggggcagggggcctggctgcaacggcgcaccctccacccagccccttgcccattaccgcgccccgctcctacgggcgctcggccgtcgcgccgcgcagcggagcgcgcaagcggatgggcggcgactccggcgcggggcggatccaccgcttgggcgcgaggctgtccacctctcgagcgaggtccacgtccgggtccaccagcagctccgcggggcggccattgagggacacctgggcgtcgacgtggacctggacgcggcccttgccctgcgcctcgaagtcccgggcgatgtgccgcgccaactggaggatgaggtccggctgcaccgacatctcccgctcctggaggcgggtgaggtactggctgggcgcgacgtgccattcccggtccgacgccgggtcgcggacgatgaatgtcacgctgccgttcttctcgcgcgccatcactcgccaggagaagcgcatgccctgctcgtgccacaggacgttgccgccgtagaggtgggtgcgcagcggaatggcgacctgcacgacggcgtaggtcagggccagtccgagcgccacctgtcccttccagccgggagcgctcggggcgggcgtcgcgggcgtttccgaggcggccgaagtcgcgacggacgtccgcgcgaggcgggcgcgcagcccgtggaacagccgccgtggccaggaggcttcgaagaagaccagggccccggtgaccatgatgaaggggaacatgccaatgggaaacagcgcggaggtggccgctgtggaacccgagcaccaccacataggcgaagggccgcagcttccgggtgaggaggaagacgacgatggtggtgtcgaagaggaatcccgaccaggccgcgacgtaggcgacccagggctcgtcgagcatgggaccgatgacgggcaggctcgtccgagccgacagccagatgctgagcggctgggcatggagcagccagtcaccggtcagcttcgccagccccgcgaagacgtagaccacgcccacctggaagcgcagcagcagcgtgcaccacgagggcagccagtcactgcgcagcgcgggcttgcgccaggcatccaccgagaaggcccggtgcgccggcacgatgagcatcagcccgaggagcaggctcaccaggtagtagtgattgaggtagttgctgacgtccacgagctggacgtaggagaaggcgacgaacagcaggcccactgtcacgcggtagaagaggcccgccgccatgcagagcccgagtatcgcgagcgccgcgaagacagtgtgcatccacggcgccggcagcgcgggcacccagccgaagccccagtaggtgaagtggaagcgggggccggtgaacagcacgtccacccagccatatgcgaggaaccggaccgccgagacgaagatgagcagccccagcgccacgcggaacgccaccagcgccgcgatgtctcgcggcgccagcagcaccttccagatgcgcccggaagcggggcgctcgccggacgccacctcagtcattgtccccctcgacggactggggcagctccaggtccagcacggtgacgagctccgtcttgagcacgtccgtcacgctcttgatgacgtcgtacatcgtacgcatcgcggccttgtcctgagccaggaccgtcgccaggtcttcacccggaacagcgtcgatgcccgctgccgccgccgcgttgcgctcgcgcagcttcgccgccagcgcgtcggcgcccgaggcctccagcaggtcgtcgaagcccgtgccggagaagttctcgccgcagccttccgtgatgcgccggtagcccaccaggttggcccggatgttcgccttcgagcgcgcggcgaactgtgactccaggtgttcggggcacgtcgacgtggcgcagtcacgcagcgccagcggccgtgccaccttgaggtccttcacctcgcgctcgaagtagaagatggcgtcgctcacggagttcagcgccgcctgcgtggaggggtacacggcattgccggagcccgccgtcgtcaacgtccggccgaaattctcctggtccggggcccacgcgttcaccagcgcgtccgcgcggcggtggacgtcggcggccaccacggcggcgtacgcccgcttgcgcgcggcccgctcgtccgcggacagcgccgcccacgtgccctgggacacgatgacggaggtgccagggcaggcggtgtcgttgccctcgaagaagagcaggtactccagcgcgtacaggccgcggcggctcaccagtgagctgtcgaagctctccgactcatagcttcggttgacgagctgctcctcgatggcgcaccggctgaccaggggccacgagtagatgttgtcgcgaatctccgcgccgcccgggaggctgcggggcgcggcgggaccgaactgcatcacctccgccatctgccacacgtccatggcctggtggtaggcctcgcgcgcggtgtctcgcgtggtggcatccggcgtggccgcgtgggccgcgacggcgctctccagcgcggtggccgcggtctggaactcacgtgccgtctgcagcacacaggctccggacgactccagcagcgcggcgcgcgtcgcggccaccgtgtcgcccggattgtccgtccctgcgtccggcggggtcaccttgtccgacttgcacgcggacagcgagaggagggcgggcaccgcgagcgcgatggcgcgcgcacgcaggacggagagggggcgcgatgactcggtgttcatgtccgggctcgctaacacgccgatgttgttaatgacaatcaacttcaaagtttgccggggaaacgtgcgagtttccacaggttgggtgttgacccgtcgcggtcttccggagtacgaggcggacacgaagaaactgataacgattatcgtttgcagttcgacaagttcctgagcgaggggaaacatcatgttgaagacggtgaagcaccgtagcttcctggtgcgtggagccgcgttggcgctcacgctggcgtgcatgacgggttgtggcgacgacgacgagcccactccgacgcctgacgcgggcaccaacacggacgccggtacggacgcgggcacgaacccgacgcctgacgccggcaccggcgcgctggacagcgacatcgcggtggtccgcttcaacgaggacggtacgcacgacacgacgttcggtgcgggcggcgtgacgcacgtggactttggcaccggccgcgacggcacgcgtgactcgctgtgggacgtgcgcgtggacggcacggaccgcatcgtgctgttcggcaacaagcgcgcggacggtacgcgcgtggacaccgaccgcgtggtggcccgcctgacggcgacgggcgcgctggacacgacgttcggctcgaccgagacgcccaacgggttcagcgtcctcaacctgtccaacctgaacgacggcatgcgctacggcttcatccagccggacggcaagatcatgacgtccggctacacctccatgcccacgggcgtgggtgcgcaggcggccaaccgcatcgtgctgcagcgcctgaacgacaacggcaaggcggacgactcgttcggctggaagggcgtcgtgacgtccgcgccgttccaggcccagagcgagaccaaccccgagtggggcatggccgaggcctacgccgcgggcatgcagtccaacggcagctacgtgacgaccggctacggccgctccgcgtcctctggcaaggtggacctggtgtccttccgctacacctcgacgggcgcgctcgacccgacgtggggcaccggcggcgccgtggtgctggacctggtaggtgacgacgaccgcggccgcaacctggtggtcctgaacgacgaccgcgtcctgcacgtgggcagcggctccctgggcgcgcagaacatccaggccctcctcctgatgcagacgcaggacggccagccggacacgaccttcgcgccggaaggctacaagaccttcagcctcgaccgcccggagcaggccttcttcggcgtggccaagtcgtctgacggcaactgggccgccgcggtgggttaccgcgcgggtggcaaccagaacgccgacggcatcctcgccatcatccccacgaacggttcggcggaggaggtcatcatcaaggccacgccgatctccaccacggagaacgaccgcttctggtccgttgccttcgactcgaccaaccgcatctacgcggcgggcttcgtgaccgagggtggcgacaacggggacaaccagatggtggtggcgcgcttcaccaccgagggcaacctcgacacgaccttcggcaccggcggcatcgcgaagatcaacgtcgcgaccgcgggcaccgaggaggccgctcgcggcatcgccatccagtcggatggaaagatcgtcatcggcggtcccattgagaagcggtaatcgctgacgcagtgtagaagcaggagccggggagggcggtccgcgcgcgggcgggcctccagccctggctcctggcttttgagtcgtcggacatcccggtcagacaaggtcgaaacgcttcagatggcactgttcgagcagaagctgatgtgggcgcggagctggacacttcctgcgctcttgctggcatgggcctccccggccgcggggcagtccgagccgccccaggacgccgccgccgtggctcccgagccgtcgcaggtgcaggacgccgccgccgttcctgaagcgccgcaggcgcaggacaccgtcgtcgtccctgaagcgccgcaggcgcaggacaccgccgccgaggaggcgcagcaggccgagccggcgcaggcgcccgtgggcgacgcgccgctggccatcgagccccccgcgggcgagccactggtgctggagccttcacccgaggcggtggagaagagattcgagagcgtggtggtgggcacctcggaggcgcgcacgagcggctccatccacgtgctcaagcccgcgcagttggagcgcttcgagcgcgatgacccggccgccatcctccagacggtgcccggtgtgtactcccgcggcgaggacggctttggcctgcggccgaacgtgggcttgcgcggcgtcaatccggaccgcagcaagaaggtcacccttttggaggacggtgtcctcttcggccccgcgccgtactccgcgccggcggcctactacttcccgctggccacgcgcatgcagagcatccgcgtgctcaaggggccctcggccatccagcagggaccgcagacggtgggcggctccgtggagttcatcacccgggacatccccgcgtccgagtccgcctggctggacgtggcgggcggcgagtacctctacggcaaggcccacggcgtcttcggcgccagcaccgagcgcgcgggcttcctgctcgaaggcgtccacctgcgcagtgacggcttcaaggagctggacaccgttggcggcaacacgggcttcacccgcaacgagtggatggccaagggcagctacctgctcgtccccgagggccccgtgcgccagacgctccagctcaagctgggctactcggacgaggactcgaacgagacgtacctgggcctgagcagcgcggacttcgccgccccgccgctgcgccgctacgtcgcgagcgccctggaccacatgaagtggcaccgcacgcaggtggtgctcagccacgagctcgaagcgggcgggctggccgtgacgacgtccgtctaccggcatgacctgagccgggtgtggcgcaaggtgaaccgcttccgcggcgcctccatcgccagcgtgttggcggaccccgcggagcgcgcgcaactccatctactacggcgtgctcacgggcgagctggacacgtcgtcgtcccaggacgcgctgctcatcggccccaacgaccgcacgtacgtgtcccagggactccagagcatcgcgcgttggacggccaccaccgggccgctgagccacaacctcgagctgggcgcgcgcttccactacgacagcatccgccgcctccataccgaggatgccttcctgatgcagggcggccagctcgtgtggaccagcgagcccacgtacacgacggccgacaacaaggactccacgcacgccctcgccctgcacgcgacggacgccatcggctgggggcccctggtgctgacgccgggcgtgcgcatggaaatcatccgctcggcgtcgcggaaccacatgacgggcaccgagtcgagcggcgcgctggaggtgctcatgccgggcatgggcatctacggtgcactgacgcgcgagctgggcctgttcgcgggcgcctatcgcggcttctcgcccccggcgcccggacagccggacgcggtgctgccggagaagagcatcaactacgaggccggcgcgcggtggacccgccgtggcgagcggctggaggcggtgggcttcttcaacgactactcgaacctcaccgacatctgcacgttctccagcggctgtctcaacgacgccctcgaccggcagacggacgcgggcaaggcctacatctacggcctggaagtcttcggtgagaagaccttccgtccgggcgggggcgtgacgttccccgtctcgctgtcctacaccttcacgcgcacgcggctgcgtgaggacttccagtcggcggacccgcagttcggcaacgtgcgtgcgggcgacgagctgccctacgtgccccagcaccagctctacgccaccgcgggcgtggagacgtcctggggcggcctggccctgagcgccttctatgtggacgccatgcgcgagcaggcggggcagggcgaggtgtctccggagctgctgacggacgcgctgctgacgttcgacgtcaacgcgagttggaacttctcccgctgggggcagctgtacctgagcgcgcgcaacatcctggacgagcaggccgtcgtgtcgcgccgtccctacggtgcccggcccaacgcgcctcgggccgtcatcgtgggcgtcaagctgggcatctgaagcccggacaccaccgcgggcggcgtctcgcttctagagatagaagcggtccgtcacgcccgcggtgcgctggaggatggcgctccagcccagccacagggcgatgccactggcatccgcccgcgcttccgctcccagggcgcccagcgagcccgtgcacccggccagcgtgaagcgtcctgaatcggtcaggtgtgtgaggagggcacgcaacgtgggcatcccacgcgactcgaagcggttggtgacgtcatcgcgacccatgaagtccgggtcgtcgagcgccccatcgaggaagcgctccagggcccaccagaagaggtacacctccgccttgcggccagaggccactgcggcggcggcgatggacaggccttggtgcacgcggtcgtagtcgccgctgtgcaggaagacaaccacgtgggtcgggggggcgctcacgcggcgctcataccgcccacaaggcgccagcgtccacccacacgccgggactgaccgcccgggccctttggcttgcgccttggccgccgggcttgctaggaaacctcggtcattcgggcacttacgcgccgtggcacccaggcggaccggacttcaacgagatgggcgacgacatcactgccagacgcaaggacgcgcatctcgacctttgctcgacgggggacgtcgaacccagcggaaacagcaccctgctggagtgcgtcaagctggtccactgcgcgatgccggaaatgtccgtggaggacgtggacctgtccacggccttcctgggcaagcggctgcgctacccgctgctcgtcaccggcatgacgggtgggacggagcgtgcgggtgcggtgaatcgcgacctggcgctgctcgccgagcgccacggcctggccttcggcgtgggcagccagcgcgccatgtcggaggacgcctcgcgggccgcgtccttccaggtgcggcaggtggcgcccacggtggcgctcctgggcaacatcggcatgttccaggccatcgggctgggcgtggatgggacgcgccggctggtggacggcattggcgcggacgggctggcgctgcacctcaacgcgggccaggagctgacgcagccggaaggcgaccgggacttccagggcggctaccgcgtggtggagctgctggtgaaggcctttggcgaccggctgctggtgaaggagacgggctgcggcattggcccggacgtcgcgcggcggttggtggacctgggcgtgcggaacatcgacgtgtccggtctgggcgggacgtcctgggtgcgcgtggaacaacttcgcgcgtcgggcgtacaggcacagttgggggcggagttcagcgcgtggggcattcccacggcggcggcgttggcctccgtgcgccgggccgtgggcccggacgtccacctggtggcgagcggtggcctgcgcacggggctggacgcggccaaggtgctggcgctgggggcgaacctggctggcatggcgctgccgttgttccgggcgcagcaggcgggtgggctcgaggcggcggaggcggcgctggaggtcatcctggcgagtctgcggcaggcgctcgtgctgacgggaagcagaagctgcgctgaactgagacagcggccccgggtggtcaccggagagttgaaggattggttggcggcgctgtagagggtggccgcgccgaagtctggaaggaagaacatgtctgacaccgtgacgtcccggcttcccgggttccacaagctgccgatggaggagcgccacgcgcacctctcccgcatgttccggctcacgcccgaggacctgcagcagctgctgggctcggaggcgctccagcctgtcctggcgaaccagatgattgagaacgcggtggggaccttctccctcccgctgggcctgggcctcaacctccaggtcaacggacgtgactacctggtgcccatggcggtggaggagccgtccgtcgtggcggcggtgtccttcgcggcgaagattgtccgggaggcgggcggcttcatcggcgaggcggacccgtcgctgatgattggccaggtgcaggtgtcgcgctacggcgacccgacggtggccaccgagcgcatcctggagcacaaggagcagattctcgcgctggccaacagcttccacccggccatggtggcgcgtggcggcggggcgaaggacgtcgaggttcgcgtgctgccggccccggaagggccgcgcggcgagccgctgctcatcgtccacctcatcattgacgcccaggaggcgatgggggccaacctcatcaacaccatggcggagggcgtggcgccgctcatcgagcaggtgacgggcggcaaggtgtacctgcgcatcctctccaacctggcgga

SEQ ID NO: 1170 - DNA, 17228 bp, Myxococcus xanthus
cccgcccgtagtgcctaggaggggagagccggtgaggctaccgtgccccaggtaagatggtggtgctttcccggcctccctcgactgctcgcgccatgtcccgtcttccatcgccgcgcccgcccaaggtgcagacatgaccgccaggctggacccgttcgtccccgcagcttcgccgcaggccgtgcccacgcccgagctcaccgctccgtcgtcagacgcggccgcgaagcgtgaagcccgccggctcgcgcacgaagcgttgctcgtccgcgcgaaggccatcgacgaagcgggcggcgccgacgactgggtgcaggcgcagctcgtctccaagggcctcgcggtggaggacctggacttctccagcgcctccgagaaggacaagaaggcctggaaggagaagaagaaggccgaggccaccgagcgccgcgcgctgaagcgtcaggcgcacgaggcgtggaaggccacgcacgtgggccacctgggcgcgggcgtgcactgggcggaggaccgcctggccgacgcgttcgacgtgccccaccgcgaggagcgcgcccgggccaacggcctgacggagctggactcggcggaggcgctggccaaggcgctggggctgagcgtgtccaagctgcgctggttcgcgttccaccgcgaggtggacacggccacgcactacgtgagctggacgattccgaagcgggacggcagcaagcgcacgattacgtcccccaagcctgagctgaaggcagcgcagcgctgggtgctgtccaacgtcgtggagcggctgccggtgcacggcgcggcgcacggcttcgtggcgggacgctccatcctcaccaacgcgctggcccaccagggcgcggacgtggtggtgaaggtggacctcaaggacttcttcccctccgtcacctggcgccgggtgaagggcctgttgcgcaagggcggcctgccggagggcacgtccacgctgctgtcgctgctctccacggaagcgccgcgggaggcggtgcagttccggggcaagctgctgcacgtggccaagggcccgcgcgcgctgccccagggcgcgcccacgtcgccgggcatcaccaacgcgctgtgcctgaagctggacaagcggctgtccgcgctcgcgaagcggctgggcttcacgtacacgcgctacgcggacgacctgaccttctcgtggacgaaggcgaagcagcccaagccgcggcggacgcagcgtcccccggtggcggtgctgctgtctcgcgtgcaggaagtggtggaggcggagggcttccgcgtgcacccggacaagacgcgcgtggcgcgcaagggcacgcggcagcgggtgacggggctggtcgtgaatgcggcgggcaaggacgcgccggcggcccgagtcccgcgcgacgtggtgcgccagctccgcgccgccatccacaaccggaagaagggcaagccgggccgcgagggcgagtcgctggagcagctcaagggcatggccgccttcatccacatgacggacccggccaagggccgcgccttcctggctcagctcacggagctggagtccacggcgagcgcggctccgcaggcggagtgacgctcagcgcgcgtccgtcgccgaggtgccgcgcgccagcaacgcggcattgaggaagtccgtcagccggcgcgggtacgcctctggctcggtggcgctgaagttcccgtgcccggcgccctggatgcgccatgtctgggcatactcgcgcaccttggcgaagagctcgtcggcgagcggctgtcctgactcctccgtccccatgacgatgagcagcggccgggggcggatgcgctccaccgcgtcgatggtgcgcacctcttccagggcgatgccgcgccgccagaagggcaccagcgccccggactgcgacacgaagccaaagcggcggaagtcatacgtggcggccagccacagcgtgttgaacggggacagcagcaccaccgcgcgcaccgccgggtcctccgccgccacctccgccacggccgcggagccaatcgagaagccgagcgcccctacccgctccgggtccacgtccggctgggcgcgcacgaagtccagcgcggcccgcacgtcccggcgctccaggtctccccaggtggagaaaccaccctcgctttcaccgtgggcgcgcaggtcgaagagcagcacgccatagcccgcggcccgcaggattcgcgcttcgggcagcaggtccgcgcgcgtctgggacaggccgtgcgccagcaccacggcggcgcggttgcgggacggcacgtaccagccccgcagcgtcagcccatccgacgtctgaagcgaaacgtcctttgcctcggcgaaatcagcggggcgctcggccttgggacgtgggtagtggaagtaggcctcggaatgacgcagcgccctaccgaacaccgccagcgcggccagcagccccagcgcgagcgctccacccagcagccaccgccacttcatcttcgttggacctcgttgaaggaagctggggtgtttgaaccccaggagtgcagacgggacccacgttgctccgccacgtactgagcagcttacactccacatagacaactcacagtgccatcaaagacggcactgtcgcgccaggaaacctgtgggcacatccaggacgatgttcgacgtggtggtggtgggtggtggcgcttgcggcggatggacagccaagcagctgacggaagcaggcttgcgtgtcctggtgctcgaagcgggccgaggcatgggcgcggaccggatgctgtggatgctccaccgcatgcgccaatcccttggctacctggcggagacggacgaccagcgcaaggtgcgccagtcggtgcagagcaccaccttcgcgtggcccttccacccgcacgccttcgtcgacgacgtggacaatccctacaccacgccggaggaccagcccttcacgtggattcgtgcgcggcaggtgggcgggcgcacgtccgtgaaggcacacgggcgccagttctaccggctgtctgacttcaacttcaaagcaggcacgcaggatggacagggaccggactggccgctgacgctggcggacctggcgccgcactacgagacggtggagcggtggatgggcatccacggcaacgcggatggcctggacattctgccggactccgtcttcgcgggttccatcaccatgacgcccgcggagcagcgcctgaaggaacaggtggagcgccgctggccggaacgccgcgtcatcgtccgccgcaccgcgggagcgcccgtgacgatgcccgccgcgttgaagacgggccggctcgcgctgcgcacgaacgcggtggtggaccaggtgctgtacgacgcggcgacagggcgtgccacgggggtgcactacctcgacgcgaggtcgggcaagtcctacgaagcccacgcgcgggtggtggtgctggcggcgggcgcgattgaatccacgcggctgctgctgaactcgcgatgcagcgcgttcccggacggattggcgaacacgtcggggcagttgggccgcaacctgatggaccacacgtacatgctgggcatcgaggcgaagatgaacctgcctcccgaagcccagcggcaggagcatagctgggcgtacatcccccagttccgcaacgtggccacgaaggagcaggacttcgcgcgcggctacggcgtgcaggtcttcacctttggagacaactgccacttcgtgcccttcggggagatggtgccgcgcgcggagaaccgcgtgacgctcagtccgacggtgaaggaccgctggggcatccccgccgcgcacatcgaatgccgacactccgccaacgagctgaagatggccgaggacgcgctggcggcttgcaaggagatgatggaagcagccggcttcaccgtcgagaaggccaacgccacgttgtccacgccgggcatggccatccacgaggtgggcacggcgcgcatgggcacggacgcgaagacgtcggtgctcaatccccacaaccagagctgggacgtgcccaacctcttcatcaacgacggtgcctgcttcccgtcccagggaccgcagaaccccacgctgacgatgatggccatcgccgtgcgcgccagtgcgcacatcgtgaaggagttcaaggccgggcggctgtgacggggtggcgagcgttgccgctccggcgctgcatgccgtagcgtgctcgcgatgattcaagtcgacgagctcggagaaaagacgacgttcgctgaggtcgccaggcgatttgctggggcgagctggctcgcctcgttcctcgagaccgagcagctcaacgacccggagaccaacggcatcgtcgtgcctcgcatcgtcaacacaggtctgcgcctcgacgacacgctcaaaagtgggcccggcccctgggctgtcatcatcgacggggacctcgagacgagcggcgatctcgtgtgcacgaccgacgattacctgacgagcacgctgattgtgactggcaacgtgcgcgcgaggaacgtgcgcttcgccgcgagcgcgcgcgtcggaatcgagggcgacctggtcgtcggcagagggctcggcatcgtgagcggaacgtggggtgacggcggcgcggtgctgtgggcgcgctcgtgcgaagccgcgctcgtgttgctcgacggcaacacgagcatcgacgcggaccggcgccggcggacgctggagtgtgggtcgaccggttggggcgaattcaccccggacatccacgaccacgcgacgttcgaagagatgttcgaacccgccgctttcgatgaacgcgccgacctcgattttggccgggcgatggcgctcgcgaatgaagggcgctcagcgctgcggcccgaggtcgagaatcggctgcgcggaagcaagggactcgcaacacgcgaggcgctcgcatggttgacgagcgacccgcactgccgcgaactcatggcgctcggcgatgacaggtcgatggcggtgctcgccgagcagttggctcagcgcggccacacggtctccatcgagagcctcactcgctcggtgcgcgccatgctcggtgcgcgcctcgcgtagaaatcgacccggcgctttcccacgcgccacatcgcgtcggtggatatgaacacgggcttcttgcaccgcctgagcctgcttgacggcggcaccgagggtccccgctacgtcctgaagcccatcagggccgagccctccgccgcgccagtgccgcacccgcgaggcccaccaccgatgacaccagcgcaattgggctcagccagtctccccacgccagggcgagtgtcgtcagcgcggtcgtctccggcacgcgcatggtgaggcccgcgcgctggttgtcgtccacctcggccaccaccgcgcccgtgatgtcgatgagcgcggtcacacccgagttcgtcacccggacctgtggccgccgcgtctcgatgctgcggaaggccgcgtgcatcaggtgcaaccggggcgcgggcgtgccggtgaaccacgagtcgttggacagcgtgagcagcagctccgcgccctgccgcacgccctgcgcgacatactcggggaagatggtctcgtagcagatgagcggcgccacccggagctggcgtccgtcgcgcagcgtgaagctcaccgcccgaggcccgggccctcgcttccagcgtcctgtccacggcagccactcgcgaagcgtgggggtgtcgatggcgtccggcacccactccgtcagcgggaagagcatcgtcttgcggtacgcggcgcgctcgaacgcgcctccaggtgacgacggccccaggaacatggccgcgttgaactcgcgctcgccctccaggtcatacgtgccgaacacaagcggcaccccgcgctcggagacgtagccggcgatctccgcgtccagcgccgcgcccgtctcgctgcgcggcgctccaaaaggagtggggtacaccgtctccggccacaccaacaggtccaccggtccgtcgcgcagcagcgcgtccgacatcgcgtagtgcgtgtcgagcaccatccgcacgacttcgtaggcgcccatctccgccttcagcttctcgtagcgggtgatgttcgcctgcaccgcgcccaccaccagcccgccctcacgccgggttgcctcgcgcacctgcgcatgccggaaggcgccgtaccccgacaacacgagcaccagcgccgcgagccctgccacgggccgccaggcagcacgcaaaccccgctgtgactgacgaagcgccgcgagcacgcactcattgcccagcagcaacaccagcgtgagtcccggcgcgcccgccacgtccgcgccctggcgtagccactcagaggcatagagcccatgccccaacgtgtccgcgaagagcttgggcgtgacgccctccacacccacgtatacgagcgtccccaccaggggcggcaaccagccctgcccctcccgcgccagacgccgcgccgcgtaccgggccagcgcggcggcgacgaactggagctggagcagcggcgccaccagcaggaacagcgcccaaccaaccaccgtgggcgcccgcgagtacgcctggagcgcgcccgggaaccagtgaaagacggcggcggtgaacgtcacactgagcagcacgcccaggctcagcgcctcgcgtgccgagcgggcccggtccaacgccgcgagccagggcaccatcgccacccagccgagcggccagccagcgcgcctccagccgcccgaacagcgcgaacaggaccgtggtccccaggacaccaagcagcgccgctcccaggtgccacccgcgtcccacccccacctggacgccggtcacggcgagggcgccccactctccgcgccctcgggcagctccaaccgttggataggcattcccggaggggccagctcctcgggcaccagcccgtcggcgggcttgggaatcggctgcccgttcgcatccacgggctgatggtcgggatggaacatcagcacggccgccacgatttcacccgagtccttgtactggaaatgacgcacgtacccgggcggcagctcgaagtcatcggggacgacgaggcctttcttgatgggcttcgtcccgggccggtagagctgcatgcccgtcagttcggagtccatggccggctcctggacatcggtatcggtggccagttcggcaacaggctcgggggcaggctgcggagctgaagcagcgacgggaggcggccgtgtccgcggcgcgcgggcacgcacctcggacgtgggaggcgggatgggcagcggcacctccgcgagcggcggcggcgcttccaccttgatgtcggtcgaaccccaccagacactcaagccaatgcacgcgagcgtgaagacacacgcgccgcccacgagccacacacccagacccttccccgttcgagcgggcgtgatgtgcgtgacgccgtcgctgtcgacgcgacgctttggtgcaggggactgcggcctcatgttctcgcgaagacctccgggctgcgtatgctacggagccactccctcctaggcaaacacagcgccttccgctcaccctcatgagctcttcgtccattctcgtcaccgatgcccccggcggcacgccacccgccaccacgcccgagcccgctcgcttcgcggtgcacgcctggacacccgggctgcgagggctcgcggtggtgacgcagctcgccgcgctgggcgccctgctccacttcaccgcgcagctctggatggaaatttccgaagggacccagcggatgcagcccgtgcccatcgtcgtcgggctggtgctgcgagtcgtgctaccgctcgcgttcgtctccgcgctgcgccgcagccgccgggccatcgtcgccgtggacacccaccagtggaccctgacgctgcgcggcggcgcccggatggagattcccttcgaagccgtgagcgcggtgcgcccctggcggctgccgctcccgggccccggcctggcgctgcggatgcggtcaggccgcgctttcagccacgcgctggaggtggaggacgccctgcccctgctgaactcgctgggccagcacggagcaccaggcgccgcgcaatcccacacactgattcgttacgcccatgcgcgccatgccctgtggcgccgccgctggtaccacctgctggtgaagttcgtgttcttcccgctggtgcccacggccatcctcttctactcgtaccaggtcatctcgtttggcggcgcgctgggtgagtacaggatgtacggattggacgcgtacctgcgttcgttcggccggtactacgcgccaatctcgttgtgcctgctgctcttcgcctgcttctggcgcgtcgtcgcagagggcgcgtcgctcctggcggcgtggcttctgccagcctgggcgcgcggcgtgcggcgtgcggcggagtggttctgctggctcgtctactacgtcggcacgcttgggttgatcggcgcgcgcttcatgatgtgacgtgcgcgccaggcgctggaaacgacaaggcccccggttcccgaaggcaaccggaggcccaagcaccgcgcccacacccgaggcgtgagcgcggtcgcagtgactacggcctggcggggttgaacttcgcgctctcccagcccatgcggtcgtggccagtcttgttccaggtcgaggtatcggtgggcagcgcgccggtgccgccagagctggaaatggtgccaccggtgtaggtcgggtgggtgtcgtcagactggaggtagtcgtagctggtgctcgcgttgacgaagtgcgtgttcgagtcgcgcagcgtggagcgcagcgtgacggagatgcgctggacgtacgccgcctcggactcgccctcgatgtagcggatggcctcggagtccaccttgccatcaccgttggagtcgtaatccgcggccatgtactccgcgaacgagtccgcgcacttgaagccgtggcgagccgccaggctgcacgcacgccagttgctcctcgccagcagcggcaggaacttctcccgcttgttcaccacctggcccgtggcggagtcccggcactgggtgttcacgttgtccgcgttgaagcccgggtagtagatgttggagatgatcttcgtcgcggtggcgggcgcgtactggttgatggtctgcatcgcccgctccatgtacgtggtgcaggtcgccagcgcggcctccaggcccgagtagttacaggtgcccgtctgcccagagaaggcgctgcgcgcctggaggtagtcgttgccacacatctcgaacatgacgacgcgggtgttcgccgcctgcatgtacgagcgctcagagacaatcttgttgttgtagatgtcgtccgccttcgcgccggacttggtgcggcggatgacctccacgtccgcgttccacttccgcgccaggtcctcgccctgcaccaccggcgccgcgcggcgagccacgttccagaagaagacggaaccgttgtagccggcgtagatagagtcgccgtaggccaccacgcggtacttcgtcgacgtcgacggctggtcgatggtccacgacgtgttctggttgagggtgctcgccatcgcgctaccaccgaccgtgaaggccgcgcacatggcgacgacggacatcccgctgtgacggaaagacatgccccgctcctttggattcccactggggggttgttgggggagcgcggaggctacatggcgtcgatttgcaaatcaccctgaaacaagaataacgcatcaagtcagaatagctggtgttgttatgacctcacccgtgtttggaccgatgtcgtaagaatgacgcggagcaaacctttgacgcggtgtttcatcatgtttcacccaggtccggagtgtttcacgtgaatctttcccgtggcacgagagcgctgatgcagtggctgctcctgggtgggctggtgggcgtcgtctgcggcgtggcatccgcggtcttcttgtacctgttggacgaagcgacgcacttccgggaggggcacccgtggctggtgtacgcgctgccggtggcggggctggtgctgggggcggtgtacgggaagtggggtaggcccattcgcgggggcaacaacctggtgctggacacggtgcacgcgagcgacgcgcaggtgccggtgcgcatggcgcccatggtgctggtggggaccgtgctgacgcacctgttcggcggcagtgcgggccgcgagggcacagcggtgcagatgggcggcagtctggcggacctggtggcgcgacgcttccgggtgggcccggacacacgccgcgagctgctggccgcgggcatcgcgggtgggttcggttcggtgttcggcacgccggtggcgggggcggtgttcgggctggaggtcgtggtggtggggcgcatgggctacgaggccctgctgcccgcgctggtggcatccgtggtgggagacatggtgacgcgggggctgggcatccaccacacgccgtatccggcgccgggggcgctgccgctgacagtggcggtgctggcgaagtggctggtgttcgcggtggcggtggccgtggtggcggtggtgttcgtggagttgatgcaccggctgaagaagctgctggagcagcgcgtgcaggtgttgccgctgcggatggcgttgggcggtctggccgtgctgctgctgtggctgctggccggtacggatgactacctgggcctgggggtaccgggcatccagcgagccttcgaggacccggcgctgcccgtgtcggcgttcgcgtggaagcttgccttcacggtggtgacgctggccgcgggattcctgggcggcgaggtgacgccgctgttcttcatcggcgcatcgctgggcaacgtcctggcgcggctgttgggcctgccgttggatttgggcgcggcggtgggcatggcggccctgttcgcggcggcggcgaatacgccgctggcgctgtccatcatggccgtggagctgttgggggcgaatgtgttgccccacgtggcgattgtggccacggtggcgtacctgctcacggggcaacggggcatctatccatcacagcggattgcccggatgaaacacggagggccgctgctggagaaactcgtggccctgcgggagctggcccgcgaggaccgcgccccgccctcagggcctgagggacggggcggcggctgagggttacggctccgggaagtggtagacgtttccatcgtcgccgacgatccagaagttgcttgaggaggtcatggcgatgtcgcggagcggcacgttcggtgcgcttggggtgaaggctggcgccttggcccatccgtgtggggtcagccgctgtagccgtcctgcattgccctcgttgccaatgacgtaggcattcatggtcccgggcggggcagccacactgacgtagttgagcacgggtcccgcctgcgggagcacccgctcccagtccctcgactggccactgcctttcaccaccaagccgccgtcgcccaccgcgtagatgagcgtcgcatccgcagcccataccgctcgcaagccgccgttgtagcccgcggtcccctggaggttgtgcgcagccggagtgccccaggtgatgctgcgggtatagagattcaccaccggcgtcagtggtgacaactctcctgtcgagcccactgcatacagcgcattctgaccgaatgcatggagcccccagtaccggccgggtgagtcgtggcgcagggcagcacctgtccactcgtacaactggcccaaggtggagaccgcgaatacctgagctggacttcctactccaacgacgcttgagaagtagtcgttcttgccagggaggtcgaactggaatgaggaacaggagccgccgttgtgctcgcctatatggccgtcctcgccggctatgagcacataactattattggggctaatccaggccgcgtgccagtccagcaggtttccggccggcccacaccgggtcgccgtatccccgccgtgactcacgaacgctgaagtcgcgtccatcttcaccgccagcctaccccccaatcccgccacccacaccgggtaaccactcgggtgcacggccaccgtcctccaattgccccctgccagcacggggtccaccaccttcttcagcgagccgcaggacatctcctcatccacctgcccgtcgcagtcgttgtccagcccgtcgcaaacctccgtcgccagggtgttcgtgccagggtcagcgtcatcacagtcccgcgtgttgtccgccatcatcgaaggcatgggcgcgtcagggcacagctctcccaccggcgcactgtccttctcgccttcaccgtcgctgtccgcgtccgcgtagagcggcgtcgaaggcgtgccgacgcagacagtccccgtctgcgcgtcgttgcatgcatacgtcccgttgcagaactccgtgcacgccgtccccagggcacccggcccctccgtgaacagctcgtcggcgcgcccgtcgcagttgtcatccgagccgttgcatgcctccacggcgtttggatggatgtcggcccgctcgtcgtcacaatcccccgtcacctcgacatgaagttcactcggcgggtcacaggcctccgtgccgggcccattgcgtccgaagctgtcgcggtcgcggtccaggtaccagaccttgttgacgacacccgtttcaatctggccgtcgcagttatcatccaggccgttacaaagttccggagcgccaggataggcctccgcgcgcaggtcatcgcagtctcccaaggtcgaggcgtagccagccggaacagcgccacagaacacgcgcgaaggcgcattcactgcggcgaaaccatccccatccgcatcaaggtatgccaccgacggcgaggctgaaccacaggggctcttctgacaggcacccaaaacacatacctgtcccgctccacaggcatgctgcgcatcacatgccaggggacgttcaccttggagttcctccaggctcgggacggagcacgcggtgaacagcagcagcaaagccacgctccagcgcatcatcgtgcccccccttgctgcgtgacggcctcgtcccgctctcccaacaagagccaggtcaccagggcacccgctgccgcaaccccggccgtaccaaagaggacgttggccgttctcgcactgcgctgcgcacggccgcgatgttccacgagatgctcgtggaacctcgcctcccgagcgtccgcgagctgccctcgggaagagacgccgaagacggttcccgtaccggttgccgcaatgccagcccccagcagcaccagactggcaagcggcacctgccgccccccgatgcgcctccaggaagcgctcgacgttgctgtccaggcttggacctccactgggctcgaagccgtggcctgttcggtaggcgtcagcgcggcgggcagcgctgaagaggcgtccgcaaccgactccgtttccacctcggcctgctcgatgcgggctgcttcccgcgtgggcgagtcccttcgtctacgcgccagttccgctttcgcgagtgcacgctgggcctcgaactcccgcccgactttgggggaaacgcgcaagggaaggcgtgcctctggctcaagcagaagggctgaacggaactcgtcacgcgccgcctgccaccgcccgaggtccgcgctgatgatgccgcgatgcaatgcaagcgtcactcgatcgcgcgaccctcggaggctccctcgggcacgatccagctgctcgagggctcgctcgtattcgagatcatcatagaggcgcacggcctccgcgacatgacgctcaaagtcgccatcagctctggccgcatgcactggaatgacaatccatatgcatgcggcgagcgacaggcaccgcctccaggtcatggcaacaagcatgcctggattttagttcagacagacaccctgggcaaaccctgccaactccaacccatcaacctatggcggagtggagggttacggctccgggaagtggtagacgtttccgtcgtcgccgacgatccagaagttgcttgaggaggtcatggcgatgtcgcggagcggcacgttcggcgcgcttggggtgaaggctggagccttggcccagccgtgtggggtcaaccgctgcagccgtcctgcattgccctcgttgccaatgacgtaggcattcatggtcccgggcggggcagccacactgacgtagttgagcacgggtcccgcctgcgggagcacccgctcccagtccctcgactggccactgcctttcaccaccaagccgccgtcgcccaccgcgtagatgagcgtcgcgtccgcagcccataccgctcgcaagccgccgttgtagcccgcggtcccctggaggttgtgcactgccggagtgccccagggggtctcgggggggggcgggcgggtgtagagattcaccaccggcgtcagcggtgacgactctcctgtcgaacccaccgcaaacagtgcgtcctggccgagcgcatggagcccccagtaccggccgggtgagtcgtggcgctgggccgcccctgtaatctcatacaagtggcccagggtggaggctgcgaatacctgagctggatttccgatcccgacaacacctgagaagtagtcgttcttgccagggaggtcgaactggatagggtagcaggtgctcccggtgtgctcgcctatatggccgtcctcgccgaccacaacaagattactattattgggattgacccacgccgcgtgccagtccagcttgtttccggccggcccacaccggttcgtcgtatccccgctgtgactcacgaacgctgaagtcgcgtccatcttcaccgccagcctgccccccaatcccgccacccacaccgggtaaccactcgggtgcacggccaccgtcctccaattgccccctgccagcacggggtccaccaccttcttcagcgagccgcaggacatctcctcatccacctgcccgtcgcagtcgttgtccagcccgtcgcaaacctccgtcgccagggtgttcgtgccagggtcagcgtcatcacagtcccgcgtgttgtccgccatcatcgaaggcataggcgcgtcagggcacagctctcccaccggcgcactgtccttctcgccctctccatcgctgtccgcgtccgagtagagcagcgtcggaggcgtgccgacgcagaccgtccccgtctgcgtgtcgttgcatgcatacgtcccgttgcagaactccgtgcacgccgtccccagggcacccggcccctccgtgaacagctcgtcggcgcgcccgtcgcagttgtcatccacgctgttgcatgcctccacggcgtttggatggatgtcggcccgctcgtcgtcacagtcccccgtcacctcgacatgaagttcactcggcgggtcacaggcctccgtgccgggcccattgcgtccgaagctgtcgcggtcgcggtccaggtaccagaccctgttgacgaaacccgtttccatctggccgtcgcagttgtcatccaggccgttacagagttccggcgcgccggggaaagccgtcgcccgcaggtcatcgcagtccgtcccccggttcatcggaccacccggtgagacgaagccgtcaccgtcctcgtcagcggtgtgcaggtcctcgatcatccactcctgccggcccgctgaggcgaagctgaaggtctgcttccgctcatccaccaactgctccgtcgcgcagcccttctcgaaagccctgacggtgatttcgacgtcccgcgcccagtccgccttccgaaagacggcgacgttcaacaccgggtcgttggtgtcgaactgaccgggctccttgaactccgcgagcaccgtctcaccggtgccaccatgggcctccaccgtgatgcagccctgactgaatttcgggtggtggccaatcttgacgtgaaccgcagcctgcttcgtgtccggctctttcgagtccttcttgcaggccagtatcaacagaggcaggaggagaatggcggattgacgcataggatgcactctaccccaaccccaggcgtgacttgcccagaagccggctcaccctgaagtccgcctgactgaaacaccatggacatcccacagccagaatggactgaggcacacccccgtgagccttcgccgtcacggctgtgaggccaaccgccctggaggcacggccgccgtcccgcgctgacgcaactccggcgacgccaccgcgaacccttccggcaacatccggagaatgcgctcacgccggtgcttggagccttccagccgccgctccagcaaggccttctgcgcgcgtgtctccttgtccagaggcgcggggcgcgccgccagcaacgccagccgcgccgtcacctcctccacctcccggtcgatgagcactggctggatgttccgcgactcatttcgcgcccgccccaccgcgttgttctcaatccacaccggcagcaccgccacttcctccagagccaccgacacaccgggcatgggccgcaccagcgacagccgcagcaacatcgagtcccgccggtcgccccccgagctcttcgtccccgctgcgtgctggtagaagcggtcctggttcgccaccaggttgcccagcgagtacgcgataagccccttgcgcccatccaccgtctggtacgactccagcggctggagcacgtgcggatggtgcccgatgaccgccctcgcccccgcgtccagcagcgcgcgtcccagctcacggtcctcgggccgtggctcccccttgtactccgtcccccagtgcgccagcacgatgagcgcgtcacattgcgccgccgcggcgcgcacggcttccacggcctgttcgggctgaatcccccggtgcgtttcgtgccccgaatagggcaccagcgcgacgtgcggcgcctgcgcatccttcggattgctgaagccattcagcatgcgcgtgaaggacaggaaccccaccttcacgcctcgcacgtccacgaaggcgggctcccacgcggcgtccttcgtcgcgcccgtgcccgtatgacggatgcccgccgcatccaggtgccgcagcgtctccaacatgcccgcggggtgctggtccctcgcgtggttgttcgcggtggacaccaccttcaccccggccgaggccagcgcgtgcaccatggccgacggcgcgttgaacaagagctcccgcgcgaccgccttcgtgttgtcggtgacgggcgtctccagattcacgacgcccacgtccgccgtgcgcagctttagagca

SEQ ID NO: 1171 - DNA, 19019 bp, Myxococcus xanthus
  unsure (1)..(19019): unsure at all n locations
ctcctcgtgtgctctcaagcgcccggtggcgaacagcaccgcgtccgcctccaccgtctcgcccccgcccgtcagcaggctcaccccaccctcggctcgcttttcgatgtcccggatgaaggtgtccgtcatcagctcgatgcccttcttgcgcatctcgtccgtgaggaaggagcggacgtcgtcatcgaacccacccagcacgctggcgccgcgaatcaacatcgtcaccttggagcccagcccgtggaagacgcccgccagctccacgccgatgtacccggccccgacgacggccagccgccgaggcagctcggggaaggacagcgcctcatcggaggtgatggcgtgctcgatgccggtgatgtcgggcggcaggtagggccgcgagcccgtggcaatcaggatgcgctcggccgtgtacagctttccggccacctccaccgtgtgcgggtccaccacgcgcccgcgcccttccagcagcgtcacgcccgagtcgcgcaacaagcgcgcatacacgccacgcagccggtccaactccttgtccttggcggccagcagcttgctccaggtgaacaacggctcctggaccgtccagccatagccctccgcgtcctggaactcctcccggaagtgtgctccgtacaccaggagcttcttgggcacgcaaccacggtggacacacgtgccgcccacgtcgcggtcctcacacagcgccaccccggccccgtgtgccccggccctgcggctggccgccacaccgccagagccgccgccaatggtgaacaggtcgaagtcgtatcgggccatgcgttttgactctcctcggtggcattcgcgaatgagcttgaagagatagcgctcggatggggcgtcgcgcaccgtcgacgtgcgcctccgccgcgtaatccgggccgccccactcgccgcgtgtcaggcgccggacagggccaggacgctgtcccgcaggcggcccagcaagagccgcgtcacttccagctccgcccggcaccgctcgagccgctcgggcatgtcctccagcagcccggagtccgcctgcaactcgatgtcgcgggcctgggactccagcgcgctggcgccgaaccaggccgcgttcgacttgagcgtatgcgccgcccggcccaggtcgtccgcgtgcccacgccccagggccgagtacgcgtcctccaggagcgccggcatgctgtgcagcgcggtgtcgatgagttcggggagaatctgcgccgcctgcgcccccagctccgcccacagccgggcgagcgcggcagactccaggcccgggatgcgcgccacgtccagcacgactctcatgaccgagtgctgcggcgtgagctcgaccgcgccgctggagacccgccgctccggtgccacctacgaacgccggggctggcagcgcatgagcgccgccatcagcgcctccacgcggatgggcttgcccaggaagtcatccatgcccgccgagaagcactgagtccggtcggagtccatggcgttggccgtcatcgcgatgacccagggctgcgccttgggcggcagttcctggcggatgcggcgcgtggcctccaggccgtccatctccggcatctgcaggtccatgaggaccgcgtcgtagcgcttctgggacaacgcctgcagcgcctggcgtccgttcagcgccacgtcagcgcggtagccgagccgctccagcaccagcagcgccagcttctgattggtggcgttgtcctccaccaggaggatgtccagcggcacggtgtcccccggccgctcccccggaaagggccccgctcgcgagggccgcgtctgccggggctccgggagctggggaaggtgctgcgagaagcacgacaccagcgcgtcgtagagctgcgagtccttcagcggacgcgacaacacgcccgcgaacaggccctcggggggattgccccgccggcccggcgtcgacaccagcaccaggggaagggcccgcgtctcctcgcgctgccggatgcgctcggccagcgcggtgccatccagccccggcatgtgatggtcaatgagcaccgcgtcgaacgaagcccccgcctcgagttgggcgagcgcgtccatccccgacgcggactccacgggcaccaggccccacgcctggagctgccggcccagcaaccttcgaaacagagcgttgtcatccacgacgagcacgcgccggccctggagcagcccctgctcctggcgcggctgcaccgcgtaggcttgtggcgcagcctgggcgcgcagggtgaagcggaaggtggtgccttgtccgggcacgccctcactctccacccagatggtgccggccatggcctccaccagccgcttggagatggccaaccccagccccgtgccaccaaagcgccgcgacacggaggcatccagttggttgaacggctggaacagcccggtgcgccggtcgtcgggaatccccaggccggtgtcctgcacgctgaaggtcagctcccagtccgccgcgccctccgtgccgcccagggccaatccctgcacgctcaccaccgcgccgcngtgttcggtgaacttgagcgcgttgcccaccaggttgagcagcacctggcggaggcgcgacgcatcgcccaccaacatctgcggcagcggcggcgcgaggtcacaccccaggtccagccccttctcgctggcgcgcacggccatcaggtccaggacggactccacgcactggcgcaggtcgaagggccgcagctccgcctcgaagcgaccggcctcgatcttggagaagtccagcacgtcgttgagcaacgtcagcagcgcctcgctgctctgccggatggtggcgacgaagtcgcgctgctcttccgtcagcgcccggtccaggagcaggcccgtcatgccgatgatggcgttcatcggcgtgcggatttcgtggctcatggtggccaggaacaggctcttggcctgattggccgcctccgccgccttgcgtgcccgttcgaggtcggtgatgtcgtggtagatggcgatgaagccaagctgccgcccgcccaccgacaccggcagcgcccgcagctccacgtccaccacgctgccatccttgcggacccgccgggtgacggagcgcagccgcccgcgctgcacgacctcgcgcgacgcctgctccgcttccgggaggacggtgggctcggtggcgaccagttcgaagatgtgcttgccgagcgcttctgccggcgaatacccgaacaggcgcgtggcctcggggttccacgacagcacgcggaactggcgggtgatggtgatgatggccaccgggctgttgatgaccaccgcctcgaagaactccttctgctgccggagcgaggcctccacctccaggcgggccgtcatgtcatggagctgcaagacccagcccccgtccccttctccgggcaggggcagcgtcaccacccgcaggtagtgcgcggggccagagccgcctgggcgatgcccggccagctccgtctcgcgcagggcggcatcggcgggagcgcggggctcgggaggacgccagccgggcaggagcagccccaccggctgccccacgagtctggtacgcggcccgaagatgcgttccgcggcgcggttgacctccacgatgcgctgcccagcatccagcacgagcaccccatcccgcgagtgctcgaaaatcgctgcatgtgcgcttgacgccaggtcagccacccttccccctgccacgagaatgaaggcccgctcggaccgcatcatgccagacgcgcgcgcggaccaggtccgtgttgcgacgagccgtcagcggctgttccaccaggccttgaactcgttccaggaaatcttcccggtgcggtccgtgtcgacgatgtcgacggcgatttccagctcctcgtcggagatgttctgccccagcgcctccagcaagcgcgcgaactccgcacggtcgatggtgccggtccggtcgcggtcgtaccgctggaagatgtcgagcacctcgtcgccggaactggtgaactcgtccaccgcggcgtgggtgggcgccaggggctggagccccgcggacgtcgtctccacctgctcgacgaagggcacccctgtcgtgggccgctcacgccgagacttggaggtccgccgcgtcgccgccttgcgcgtggtggccttcttcgcggtggtcttcttggccgctgccttcttcgccgtcgtcttcttcgcgggggccttcttcgcagccgccttcttcgccgtcgtcttcttcgccgtcgtcttcttcttcgtggtggtcttcttcgcgccgtgcgccttgccagccgccttcttcggcgtggccttcttcgccgtcgcggtacgccgggatgacttcttcgcaacagccgtcttgcgtgacttcgtcgccatgatgaacccctccctggacggcgcgcatcgtagcgctccctcgttcgggtccaagcatcggcacgcgccccaacccacccattatgcggtgcggcctccgtcccctggcgaacgcggacggtggggagggcctgaaatcaagtccaaaacatggtccaagatgacccacccagcggattcaaagcccaggctaccctggaaccccgggaggcaaactgctagcaggccgtccgccagccttcttgactgcttgccgcaccgtgttggtagcaagaagggcccgcgagatgttcacatgccgccgtgcgccgcgaacagggccgcccgcacgctcgctactgcgccgccaatcctgcccggcccccactggaaccccgcgtcggaatgaatgactcgctagagaccctcctggccgatggcatcatcgaagccatcatcggccagttgaagacgggcaaggaggccgaggtatggctggtccagcatgccggccaggtggtcgcggccaagctgtacaaggagcgccacgagcgcaacttccgcaacaacgcgggctaccgggaaggccgcgaggtgcgcaactcgcgcacgcgccgcgccatggagaagggcagccgcttcggccagaacgccgccgaggacgcctggaagagcgcggagtcggactcgctctacaaactgcacgcccagggggtgcgcgtccccaccccggtgctgttctacgagggcatcctcctcatggaggtggtgctggatccagagggccaccccgccccgcgcatggtggaagccccccccagcacccccgaggacgcgcacgccctctacgtggacctgcgagcgcaggtcatcaacatgctgtgcgccgacctcatccacggcgacctgtccccgtacaacatcctcatgagctatgcggggccggtcatcatcgacttcccgcagacggtggcggctgctcgcaacaaccgcgcggagttctatttccggcgcgacctggacaacgtccgcaacttcctcgcgagcaccgcgccctggctgcacagcatcgcgagcgacacgagcgaaatctggaatgcctacgtgcgccgggagctcacccaggacttcgtgccgtcgggcaatttccgggaggggcctcgccatcacggtcgcggaggtcctcggaaccaggggttccagccccagggtgacgagcgcagaggcgggttccgtccgccgccgcccgcaccggtcgagcaagccgccgccccccagcgcgacatgacgcccgaagaggccgccgaggccgagctccgggaactggaggcgctggtgctcaggcagggtggcggtgagcgtggcaagcccgcggtggcggcacctccgcctcggggcgggcgcaaccggggttttggaggaggtcggcctccgccgaggggtggaggcaacggagcacggccgccccagagtgggcagcggacgggcggcggtgcgcctgggcgcccaaacgaaccgcgtgcgagtggtggcgtccagggccggcccgcgcgcgaatgagcttcgtcgctcgcttggcggtccgcgcacgaatgagcctcgcagatcgaaaggcggtccgcgcaccaaccagcctcggcactcgaatgacggtctgcgtgctaatgagcctggttcgaccaccaggttccatagcggcccccgccagaatgacgcgcgtgcgcacggcagaggcatgggcggttcccagccgaatgagccactcgcgaacagcgcgccctcgagcggcccccgccagaacgaacaacgcaatggccggcctccccgcgccaacccgcgcggtggcaatccaagcgtgcccggcaatgagcagcgtgtgttcgacaacggccgtccaccacggaccgagcctcgtggcgacgccttcgcctcaccgacgaactcgaggggtcctcgcggtggaggggctcgctccgaccggaacgaccggcgcggcaatggcaggcccgagcctgtcgtcgagactcggtccataccaggcgctcccgcgcagaacaccgtccgggaatcccgtccgggcaatggcggcaacgagggtgggcctcgacagccgcgccagtcccagggccgcggaggtccgcgttcaccgcggactggcgggccccaggtctcctacgtggcccgcccggcctcatcgtccgacccaggctcgcacgaagcgggttcctgagccgtcattcggggctcccggagcgaactccggggcccgacttcgatgacctcgtgcatggcaccggcgggacaatgccggtgcccggacgaagcggcgtcagggatgcgcgcgtctggcgatggggactgcctcaccccacccggacgaccaccttcccgaagtgcgcccctctcttgaggtgctcgaaagcagcgcgtgcctcggagaactcgaagacgcggtccaccaccgggcgaacggtgtgcaacgcgaaggcccggttgagcgcgtcgaagctctgccggtggcccacgaagatgccctgcacccgcaggttctgcatgaggatgggcgtcagcggcaccgtccccgcaccaccgctgagcacgccaatcacagacaccgtgccgccgggccggaccgcgcgcagcgacttctcgaaggtccccgccccacccacttccaccacgtggtccacgcccacgcctcccgtcagcgcgcgcgccgccttgtcccagtccggcgtcgtcccgtagttgatgccttcatgcgcgccgagcgtccgggctcgcgccagcttggcgtcactgctggaggtgatgatgattcgcgcgcccagcagcctggcaatctgcaacgcgaagatggacacgccaccggtgccctgaagcaagacggtgtcccccgccttgagtgccccatgggtgaccagcgcgctccacgccgtcacggccgcgcacggcagcgtcgcagcctcttcatcggagagataggcgggcgtaggcaccgcgccgtcctcgtgcaacagcaccgtgtccgcgagggcaccgtccaacggtcctcccagcgtgctcacctgcgccgcccgcgtgggctctccggcgctccaggcctgggaaaagaggctcatcacccggtcaccaggcttcacccgcgtcacacccgggcctaccgcatccacgacgcccgccgcgtccgagttgggaatgagtggcagcttctgccgggggttgtaacgaccctccaccatcatcaagtcacgggagttgaggctcgtggccttcacgcgcacccgcacctgcatggggcctggagtcgggtccggccgctcgacctgcaccagcttgtccaacccaaaccctgcttggatttcataggctctcataggtgaggcgttgtatcgcgcccctcccaatcacgcctacagtgcgggccaccgtgtccgtgctcgtcctcttcacctgttcgctgctggccacagcccccacgtcgcgttttcccaaaggcaccgcgcgcatggacgtgggacccgcgccgcatggcctgccggactggaatgtccagcgctgcgcggaatgccacgccgtccaggtggattcctggcgacacagcgggcacgccacggcccgcacggatgacgtcttccaggtcgcgttgaccgaggaccggcccggctggtgtgtgcaatgtcacgcgccgctcgcccggaacctggagcggggcccgcttcccaaggacagtcctcccgaggagcacggtgtcacctgcgccggctgccatgcacccacggggaacgaaggacaggcgcctggaatgccctgtgcgggctgtcaccagttcggcttccccgtgctgacgagcgcgggccagcgggtgcggctgtcccccacgcagcttcaacaggacacggtgggagagtggcgccgctggcagacccagagcggtgacacgcgccattgcacgtcctgccacatgccccagggagaccacggcttcggaggcacgcgacgcaccgagtccctcaaggccgcgctccgggtcgtacaggcgagcgcatttctccgcatctccacgcgcgaggtgggccatgcctttccctcgggtgacgtcatgcgctgggtgagcgtggaagtctccgagggccccctcttcgaaacctcccgcaccgtggccacgttcggccgcagcctggaggtccgggagtggccccacgagcccctgccccacctgggcgcggtgaaggacacgcgcttgctgcccggagagacacgccaggtgctgctccccaagggggcacgctacgcgcgcgtcgtctaccacctcgtgtcccgcgagcaggaagactccgggctctacccgccgggcctgtcccagctcgtgctctgggccgagccccttcaaccttttccgtcgtcacacaccccgaaggaacgcacgccatgattctcctgtcgctcctcctcgccgcgacgccgcctgtcatgctcgaacccaatgcgggctcggcgaaccggctgcatccccgccgtgtgacggcctcctccttcctggagaacggctggaacaagcacgcccagaattatctgccgctctacatcgcggatgacgacccggccaccgcctgggtggaaggcgccaaaggccgcggcgagggcgaggccattgaatggtggggaccggagctgtcgcgcgcgaagacgtaccgcctgttccttcgcaatggcttccagaagtccgaaaagctcttccgcgccaacgctcggcctcgcaaggtgaagctggagccgctggtccagggagagacgggcccccagacgacgggcaccgcgctggagatggagctgaaggacgtcctcggctggcaggaagtccgcctgcccgtcccgaacaaggtccacggcgtgcggctcacgctcgtctccacctatcccgggacgtcctacgacgacacctgtctcagtgacttccgcgtgtacgtggagggggaagacccctacaagccggaggcggaggccgcggccttcgagcaggtccgcgccttcgcgctcgagcgaaagcaggccgccgcccgcagcggtagcgccgccaagatggagtgggcgccccgctacgaggtggagaagctgctcacgctggagcgctcctacgaggagggtgagcctcctcggggaaatacctacgccgtcggactgttctccacggttccggtgaaggacagctacaagtcggcgctggaccgcgcgaagaaggtggccgagctcttcgaccgcgcgagcctcgactacgagggccaggactccgaggcgcgcgcgaagtggacacgcgtcaagccggcgcagcccaaggcccagacgacctcggcgcgcacggccctgtccgcaatggagagcgacggcatcgtgcgcatcgcggggctgctccacctgggagacgcgtccttcttcgaggcggatgccagccaggcgcagatgctggcgagcatcgagaagctggacaagaaggaggcccagcagaccaaggcctgcatcagcaagtgcgagaagcgccgcgcggggacccgcgaggacagctacgattgctcctgcgcggacgagtgcatgggctgcgacgaccccaacctccccgcgtcggagaagctcaagcaccaggtcactggcggcgacttcctcctgggctcactcgcccgccccacggcattcctgcgtggcaagtccgagctctccgggagccgtgagtcctggtacgccttccgtcagacgctcgtcacctacgcgggcgagaaagcagatgtcgtgctcacgaacgaccacacagacatgatgatggagggcaccgtcgccctgcgcatccatgtcatcgactggggcgagtcgaacggcaaggcgagcccgaccaccatcaccagcttcctcgtctccgagacccgggtccaggtgctgcgctaccgcccggcgcctcgggcctgagccgcttcagcgtatcgacgcacacggcggacccgacaaccctgtccgggtctgccgtgtgcgcttcagccgccgtgctcagggctgcttctggagctgcaccgtcagcgacgtcatgccgccagaagcaccgatcgtgacggtgcccgcggcgaagtgctgctcggtgaagcgcatgcccaggacatcagtgatggtgtcgtcggacgccaggtcctcgtcccagaggcggaaggcccactgctccgccatcaactggcttgctcgcgccgtacacccggccgtggtccacgctggcgtgtagctctgcaccacgtccgagatgaacacggacgtgcctcccggacaggccatctcgacgaacacgtccggcggtgagctgtcggcgtcccacgccgagccattgttgctggtggcaatctgggcggagacgggctggacgcgccagactccctccgggtccacgccgcaggtctggtccgccttgcacacctgcgcggtgccacacgcccgacacgtggcccctgccttgccgcacgcggaggtcgacgtccccgtctgacagacattgttgaagcagcagcccgcgcagttcgaggcatcacactgcaccttctgcggcgtgccgtcagggttgtcgtcatcgccaccacagccaacgaaggtggacagggccagcgccacgaccatcgcaatccggaacatgttctctcgcttgggaatcgagtgaatgtgcagctcgacgcgaaagatgttccggagcgggcggcgtgtatctaccccctgggtggtaggcgggccacggcctgccgaggcgtgaggatggcgaaagacaggcccgcacggtccgccatggagagcacccgcttgtccttgctcaccagccacgccgctccggctcgcgcggccaggctcaggaacttctggtcgtcccggtcccggcagcggggcaatgacggcgtgggcacggactcggcggacggcgccatgtggacctgggcccggtagcgctcgaacgcagcggtccgatggggcgcccccaggccgggttgaaagttgcgcgaggccagcacgtagcccagctccgccagcgtgtccgcgtccgtccaggccgtcagcgtcctcgccgccagggcctcggccagcgggcgtgtgtaggggtcatcgaacacgaagaggtccaggaccacgttggtatccaggaccaccggcagcggtgtgaagggcatcaggtgttccaatccggccatcatgccctcctggcgggcgggaatcacggtgcctgccccgtgaggccctttcccacgaggcctcgcgacgtggtacccccaagccgtgagcgacaccttcgacaatctgggcctctcgcgggagacgctgggcgccctgcgccgcgcgcgtttcacgcagcccacgcccatccagcagcaggccatccctccagcgctcgccgggagggatgtcatcggctgcgcggccaccggaacgggcaagacggccgcgtatgtcctccccctggtggaacggctcgcggggaagaagggcacgctcgcgctggtgctggcccccacgcgtgagctggtccagcaaatcgcggagccggtgcgcttcttcgcggaaccccgccgcctcacgcacgccaccgtcattggcggtgaggacatgggcgcgcaggtcaacgccctgaagacgctgccttccttcgtcatcgccacgcccgggcggctggtggacctgatggagaacaccgccatccgcttcccacacctggaagcgctcgtgctggatgaagcggaccggatgctcgacatgggcttcctgccgcagctcgaacgcatcgtcgcccacctgcctcgccgccggcagacgctgctgttctccgcgacgctcgggcccgacgtcacccgcttcgccaagagccggctgtacaagcccgtgcgcctggaggtcacccgcagcggcacgcccgccgagcgcgccgagcaacggctgtacttcctccgtcccgaggagaagacgccgctgctgctcaccctgctggcccaggactcggcgacggcgctggtgttcacccgggcgaaggagcgcgtggacaaggtccagcgggcgctccagcgcgcgggacaccggaccgcggtgttgcacgcggaccgcacgcagaaccagcgcaagcaggccatggagggcttccggaacggcacctaccgctgcctcgtggccaccgacatcgcggcgcgtgggctcgacgtggaggacgtgggccacgtcatcaactacgacctgccccatgcagccgaggactacgtgcaccgcatcggccgcacggcccgagccgccgccagcggtgtcgcgtcgaccttcgccaccacgcgcgaggggcaggtcatcacgcgcatcgagcacctgatgcgctcggagattccccgcgtccaggtgccgcgcgaggaccccgtcttcaaggaggcgtgggaggccttcctcgccgcgcagaaggacccgggtcctccgcagaaggaccacgggcagtcgaagcgcgcgccggacctggcaccgggacggcacgcgcgctcgcacggaaagcgccgctcgtaggcggggggcggccctgcgtcaggccggcgtgcccggcgcctcacgtgcgagggcatcgcggaagaaggcgctgccccgggcgagctgcgccatgtagggccgcacgtcctcgcgcgcctcgggagagagcgcggcgaacggaatgacgtgttcgtccggcacgtagcggaacgtcaggttgatgcggcgggtgcggaagtccggcagctccggagccagcgtcttgcccgtgcgcgtgtccacccgctgcacgcggtggaacgtctggtccttccagcgcgcgccgccgaagagctggagcgagccgtcatccagccactgctccaacaccaccgcgtcacgttcgcctgggcgggaggacgtgacgaactggatgagggcacgctcaccgaaggacagcgaggccacggggcccggctcgaagtccttgtgctcgcccactcgggcggtgtccacccagcgcccgtcctccaaccggctcccgtagaagttcaccaggcaggtgttgaggtgccagcggggaggcatgtccggcccgcggtacatccgccgcgccagctcctcgattttcgtcacctggcgctggagcaccgccggaaagggctcggcctggacgcaccggttcaggatgcccttgggcgggtggtagtagtcgaggcacgcgaactgccagttgccgagccaatacaccggccgcagcagccgccgctgggactgccccggtggcggggggaagtgcttggagtagcgctcttcccacagcgggtggagcgtcgcgagccagctcagggcctccgcgcggtcggcggcggacatgaagctcgcgttgtagtggtggccgggggagcgctgacgggccttgtgggccagcgaacggcccttgtgcggtgaaaacgccatggacggcccgtgcctaccacactccggaacgaacgagccccgtgtcaccacatgggagacacggggcccaagcctgcatggccggtggaggacaggtcagcggccgtgagtgatgcccgcggcgccctcgcccttctcgcgcgtcggtacgacagtgggctgcatggccggagccgggctggacgcagcggtctgctccgccggagccgccttgacggaagcgggctgcgccaccgcggtatccgtggcggcaggcgtcgtcgccagggcaccttccgccgcgacgggaaccaccgtcgacgccacgttgacggcgttcgcgggcttcaccggcgaagccacattgacggacgtccctccagcaggcttcaccgcagccacgtccagagccccaccggccgcaggcttcaccgcagccgcatccacggagttccccacagccgacgtcaccacgggagccgactccccaacgggagcggaggccaacacagtcgatgccgcctcgacggaggccgcgcccaccgcgggaacgacggtggccgccccctgcgccacagccccctcagtccgaacacaaccattctccgccttcgccgcgggagcggcggcaaccatcgccggcgccaccacgttcgggggcaggcgccgggtgggcagcacgagcggcggcggcaccgggcagtgcgtgcagggcccgcgcaggggcacggacagccggttccccgcgcgcaggaagttgttccgcatccggttggccttcttgatcatcgccaccgacgacccgtacttgagcgcgatgccgcccagcgtgtcaccgttccggatgcggtgcgtcgtcacattgtgctccggctggagcgccaggaacggctgcacccgacgacccagctcctgggcacgcggattgtggaagcggatgtggaagtggtcgcggtggccgcgggcatgccggacgatgcccatggggccgtcattgaaaatcgagtccaaccacgccttgtcctcgcccgcgcgcacggcgtggtcgtagatgaccttccgcacgcgacggtcgacgagaatcatctgcacgtccgtcttcacgagcaccgagcggatgaactcccagttcatgcgcacgtcgatgacgtgctcgcgcgcgcgggtccggatggggtccaccgtcgggtagtagaagcccacgtccacgtcacggccgttctggtggctcttgtgagggcgcatgtggccgccctccttgtggctcatcccattgacccgcagcggaggcgcattcgggaagcgggcacgcacgtcgcggatggcgtcggccaggtagttgacggtctcctcggtggcccaggcgcccgcgggagtgacgacgatccagtcgtctccctgggggaactgcctggcgttcaccagccggccgctgtgcgcgaaacccactgccatggagcccagcgaggaaatctcgtccttccaccgccgcgccagctcctcatcggagatgtcagccgagtagagcggccctgtcgaagcggcgcccgcggccacggcgtccggcgtctccttctcgccgtcgtcgccctcgccctcggccagctcctcctcctcgggctccaggtcctccgcgctcaacgcgcagtcatccgcggtggacgtgggcgcggaagcagcctccgccaccggggccaccggctcggtggcggaagcggacgccagcggaggagcctcgggtagcggctcggcggcggccacggggacggagtcctgggcacgcacggcggcggccggcgcagtgccagcgtggggggaaatacgcgcggcacagccggcgcaaacgaggaggagccagattggataacgcaccgggccggaggatggcccggaatcccgctgggcacaaagcaccgtccgggaaatctggccgcccccggcgctggaaagcgctccgagagcggccctctcgtaccttcagagcggacaggccccctgcccgcctgcccaccaacaaggcgctacggcgtgggttcggcgtgtgcgacgtccagggcgagttcaatcatctcgtcgaacgtcgtctgccgctcctgcggcgtgagactctccccggtgatgatgtggtccgacaccgtgagcagccccagcgcgcgggcgcccgactccgcggccacgccgtagaggccggcgacctccatctcgacggccaggacacccatccgcgccagggtggcgttgagctgctcctgcgggtggtagaagaggtcggaggtgaagacggggccggcgcgcacaggcttgttgcgccgctccgccgcctccatggcccggcgcgcgagcgtgaagtccgccaccgcggcgaagtcatgccccatcagccgcatccgattcacgttggagtccgtgccggcccccgtcgcgacgatgacctcccggaccttcacgtcggtgctcagcgcgccgcagctgcccacgcggatgatcacgcgcaccccatacgtcttgatgagctcggtggcgtagatggagatggagggaacgcccatgccgtgccccatcaccgacacgcgccggccccggaaggtcccggtgaagccgagcatgttgcgcacggaggtgacctcgcgggcaccttccaggaagcggtcggagatgtaacgagcgcggagcgggtcgccaggcatgaggaccacgtcagcgaagtcaccaggggcagcggagatatgaggagtcgccatgggcgcaccatataccgcgtgtccgcccgggagtgccctcaccaatcaaccgccgcgcgtcgcccgagctcagggcccggccacccaggccacgtggaagtgggcgtccagcgtggcaccggggaaattcgccggcagcggcgggaagggcgccgccttcttcacggccaacagcgcggcggcatcccacgtcttcgaaccggactccgtggacacatcggcggagaggagcttgccgtccctgccaatcacggcccggaccaccgtcttcttccccaaaccgggcgtgcccttggcaccgggttgccgccacttccccgcgacgcgcgagtagaccttctgctggtagtcagcgctggtcaggtcctgctggaagaaggcctggagttgcggactgcccgcggcggccagggccatgggcgacagggccaggacgagcacggcggcgagcgccaggcgaccatttcggaacagggtttccaagaacgttccctcgtcaagaaaaggccaatggtagtccgccagcgtgcgccctccaacgggccggagccgggcccggatgcgctcgccgccggggatgaacaccccatgcccagcacgaggcttcgttgccaggaagggagctcgcgaccatgtccatccatccagcgggtgcgtcgaccgccgcgccccttccgcccctgtcaccaggagccccgctgatcggacatctacgtgccctgagaaaggacccgctccacttcctgcaagcccaggcgcgggaatacggcgacgtggtgcgcctccccatggggcccgccgacctcgtcctggtggcgcacccggatggcgtgcgccacgtcctccaagaccatgcgcgcaactacagcaaacagtcacgcggattcagggtgcttcaagaactgctgggccatggcctgctcaccagcgacggtgaccattggctgcggcaacgccgactcgcgcagcccgctttccatcgccaacgggtcgcgggcttcacgaggaccatggtggacgcggctgcggacctccccgccacgatggaggcccgcgccgacacgggcgccgcgttcaatgtggccgaggacttcacccgcctgacgcttcgcatcgccagctcgacgctgttcggcgccgatgtcagcagcgccacgcatgacatcgcgacggtgatgagccggctgcaagtgtttgtctacaagcggctcacacaacccgtgccgctttccttgcgccttccgcttcccgcccatcggcagttcgagcgagacgtcggcagcctcaaccgcgtggtgcacggcatcatcgcgaagcgacgacgcgagagcggcgagcaccacgacctgctgcagatgatgatggaggcacacgatgatgacacgggcgagcggatgagcgactcgcagctccgcgacgaggtcctgaccctgctgctcgccggccatgaaacgacggcgagcgcgctggcatggaccatcatgctgttgtcccagcacccgggcgtgcgaagggacatggagtcggagctggcacgtgaactgggtggccgcaaccccacgcacgaggacctgccccggctggaactcacccaccgcgtggtggacgaatccttgcggctctatccaccggcatgggccctctctcgaatcgccaccaaggaggacctcgtgggcggattccggattcccaaaggcgcccatctattgatcgccccctgggtgacacaccggcacccgagcatctgggacaatcctgaaggcttcgacccggatcgcttccttcccgaacgggagcaggcgcgtccacgcttcgcctggttccctttcggcggtgggccacgtcagtgcatcggcaaccagttcgcgctgatggagttggtgttggtgctggccaccctgctccaacgcgtccggctgaacctgacgccgggccaagtcatccaccccacgcccgccatcaccctgcgccccaggcccggcgtctgggtcaccgcctcgcggccctgatgacgacgggttgcagcagacgcggcaggagcccaagccgcgcggtcattgaggtatagcggccgcatgacgtcctctcctcccccgcccccgggcgcggtcgccttcgtggaccgctggcgcgagctgttcgatgcccgtgactggtctggcctgcgggcgcacgagcatcccgactttccggaggccggccctccccgtcagaacgacagcttcatccggggactcggcacgagcggctttcgagtcacgagcgcgacgctgaagcccttcgtgcagccccggtggtccatcttccgcacgcagcgcctgcacccgcaaccgacgtactggtgtgacctggtgttgaagaacgcgaagggccacgagaccgaggccttcatcgccctggctccgtgggagggcaccgagggtgccttccgcgcctcgtactacgtcgcgattccccttagac

SEQ ID NO: 1172 - DNA, 19394 bp, Myxococcus xanthus
  unsure (1)..(19394): unsure at all n locations
tctaaagggcgcgcaagggctaggtgaaggcgcccatcgtcatcggccgggaccacctggactgcggctcggtggcatcgcccaaccgcgagacggaggcgatgaaggacggcacggacgcggtggcggactggcccatcctcaacgcgctggtgaacgcggtgaacggcgcgtcgtgggtgtccttccaccacggcggcggcgtgggcatgggctactcgctgcacgccggtcaggtcatcgtcgcggacggaacgccggaggccgcgcgccgcatcgagcgcgtgctcaccagcgaccccggcatgggcgtgttgcgccacgcggacgcgggctacccggaggccatcgaggtggcgaaagagcgcggcgtgaagattcccggcatcaccacctgaagatgaagcaggaggccgcagtgaagcgcttgtgcgcggcaggggtcggactgtggggcgccgccgtcgtgggactgacggggtgcgcccccacggcgatgggccccatggtgatgcggatggggcccggggcgccggaccgcaacgtcatgcagatcggcatgcgctccggcccccggctgagcgcgcccatcgcggggacgcagggcggcctcggaacgggaaacagctttcggggaaacgagtcgagcttctccacgcagcagtggggcgtggcgttcgacgcggccctgaccgtgcccgtgtccgagcggctgcacctgcacaccgggcttcagggtgagttcctcctgcccatcccgctgcccgggtacgggctgtacgccggggcctcgtactacgtgggctcggagcggctgggcctggccccggcgttgtcgctgcgaggcgccagtgatttcggggtgggcaccccgcgcggcgggccgggcaccatcttcggcgcggaggtgtcgtgcgcgctcacgatgcagccggagaagaacgtgtccattggcctggtgcccttcgcgtcgtggcacacggtggcgtcgcacgggcgcaacgagcaagcgttgtattacggcggcgtggtggcggcgcgcgtctcctggggcggaaagaacgacttcgagctgtcgggcgggttcggccgcgcgaaggttggcaagggtgtgagctggaacgtgcccatcatgggcgcacgcggaggacgttgagccatggacgtgctggacctgctggtgcgcaacacctccgaagtgctgacggtggaaggctcgcaccgcgagcgcgcggaggacgccctcaccccacgaccaggtgcggttgtgggtgtccgtgaaggacgcatcgcctacgtgggccccgaggccggtctccccacgggcgcggtgggccctggcaccgaggtggtggacgcccagggtggcttcgtgggccccggcttcgtggacccccacacgcacctcgtcttcgccggtgagcgctccgcggagttcgacctgcgcaaccagggcgccacctacctggagattgccaaggcgggcggtggcatcgccagcacggtgcaggcaacgcgggccgcgagcgaggaggagctggtgcggctcgccctcccccgcacgaagcgcctgttggagcagggcgtcacaacggcggaggtgaagagcggctacgggctcgacctggcgacggagctgaagatgctgcgcgcggtgcggcggctcggaacgctgacgccgctggagctggtccccacactgctgtgcgcgcacgccgtgccggaggagtaccgcggcaagcgcgaggactacgtgcggctgtgcatcgaggagattcttcccgccgtcgcgcgcgaggggctggcgcgcttctgtgacgttttcgtggaagacagcgccttcaccgtggacgaggcgcgccgcatcttgagcgcgggccgggcactgggaatggtgccgcggctgcatgcagaccaactcaccgtgtgtggtgcctccgagctcgccgcggagctgggggccgccacggcggaccacctggagcaggtgacggacgcgggactcaaggcgctggcggacgccaacgtcacggcggtgctcgttcccacctccacgctgttcctgcgcatgcggccctacgcgcctggacgccgcatccgcgatgcggggctcaacgtcgctttgggcaccaacgtcaaccccggttccgccatgagtgaaaacacagcactggcgctgggacttgcgtgtctggaaaacgggcttactgcggcagaggcgtattggggagccacccgtggcgcggcgatgtccttggggctgcaacagcacggaaggctgaccgtgggtgacgcgggcgacctggtggtcttcagctgtgcttcgtaccgccacctgccctaccatctaggggtagcgcacgcgcgagtggtcgtgaaggccggacgcatcgctgtccggcagcagatggaaggctgcgcgtgaaccggcgtcgcagagacacagcggctccgagtggataaagacggaacgacatccgtcagggccggacgttaagaatattcgttgctagccatgtgccgactatttggatttcgttcagcgattcccgccgccgtacacccctcgctggtgacggagaagaactcgctcctcatccagtcgcgcgagcacaaggatggatggggcatcgcggcctacggcgccgagcaggcgccggtggtggcgcacggtgtgggacccgcgcacagcgacccggacttcgagcgggtgagcagccgggtgtcctcccacacggtggtggcgcacatccgcctggcctcggtgggcgcggtggagctgcgcaactcgcaccccttcctgcatggccgctggtcgttcgtgcataacggtacgctgcgggagttcgcgcagcaccgggctgccgtggaagcgctcatctgcccgagcctgcggacgaacatcaggggcaccacggacagcgagcggtgcttctacctgttcctcacccgcttgcatgcccgtcatccgattgaccggaaggtccccgtggaggccgtggcgcgcgcgctggcggagacgatgtcgttggtggccgccatcacggatgccgtgggacaggatggccgctcggcaatgaacttcctcgtgtccgacggcgagttgatggtggcctcgcggcgcaaccgaacgctgttcgtgtccacgggcccgtcgcgcgacgacgtgtcgacgctgccagcgccagggacgaagctggagcagctcgtcgtggccagtgagtcgctgtgtggcggtccgtactgggcaccggtggccgaagaggacgtcatcggcgtggacgcgaacctcgtgttccaccactggcgcgtgccggagctcgcgggcccggacctcttccccgcgtgaagccggccacgtcacccatcgtggcctgaggcctcggttgcgcgccgaactcatcgaacggtggaagacggccgacggtcagcggcggcgctcggagctcctgcaaatggggctgcggggcaactggcccgaggccttgagcggtttcgtggcaacctccgagctgggtgacaacccacgagacctccgaggcatcgacctgtcagggcaggacctggcatccgcagacttggtgcgcgcgcggctggacggggcgaggctcgatggcagcgggctggagtacgcccagctcgacctggcaacactcacgggcgcatcgctccggttcgcgcggctgaaccacgcgagcctccacgcgtgtgtcgcgcgaggtacccaatgggatgacgctcagctggaaggcacccggctcacggcgtccaacttgacggggagttccttccgccgagcccggtttcgaggtgctcagctcgaacagaccatcttgctgaacgcggaccttcgcaacgcggacctccgtgacgcgaggttgttcctctgcgacctggaaggcgcactcctcacgtgcgtccaatggaatccgccacgaacgtatcccgtcacgagccaacacctggccgagattgctcgtcgtgccggcttcccctcattcatcgagccgttcctgctacccggcggcatcatggaccttctccacatgtcgaacaggcaggttctgctccatgtggaggccgcgatagaggccagcacggacgtccagtcggagctgcgcgccattctgcacgagaagaactggcgcatcgtgctgatggcggctgcaggcatcgtgctagcgggagccgacgaggccacgctggcggcactctgggcgcggctcgatgaatggagctgggtccaccctcagctcatggtggccgcggtgctccgcgatccatcctgcgatgaccgggtgcgcgagcgactcatgcatcatgagttgccgcgacggaacaacatccgagagagcctggaatgggcggcgaccgttgggcgcaacgtgcccggcttacgcgagcctcactccgggcaccccacctgccaggcccaccgctggctgaggcaactgcaagccttcgcccccctaaaggtccaggaacaatggttacgcggaggcagcgccaaaacgtgaacaggccacgcgggcggcggggtcccgattgagattgagcagctcctgttcggaaatgtcgggacttttgccgccgctaaaacccccgacatttccgaacagcacgcgcccaaaccaccctgggaggcgtgaccaggccggtggcagtccggcactgccccttcgggtcagcccatccacgcatcgagcaacgccgcgggccgtacaccaaacgcctccgccatcagcacgcgtgcctcgccgcccgcgtgcttcagcgtgacgcgcaggtagtcgcgcggcgcggcctgcggaatcttgtccaaccactccaccagcatcgcgctctcggtgccttccaggtccaggaagcccgtggcgtacaggtcgtcgtagtccgtcagccggtacaggtccgcgtggtacagcgggatgcgtcccgaatacggatacacaatcgcgaacgtggggctcgccacctcggagcgaggaacgttcgccccgtccgccactccgcgcaccaggtgcgtctttcccgcgcccaggtcgccaatcagccccacgaagtcaccgggctccagcaactcccccaggcgcacccccagccggtgtgtctcttcgggagactccagccgtaccgtccgcacacgcgcagccgacgcttccgtgctcatcgttcccaccgcagccacacctcgcacagcccctgctccacgatgtcccctgcaaccaatcccagttgcccgcgcttcgccgccgccaggtccccagcgagcccgtgcgcgtacaccgccgtccagacggccgagggaaccggaagcgactgagccaggaacgcgccacaaatcccggacaggacatcccccgagccccccgtcgccatgcccgggttgcccgtggtgttgaggtacacgcgcccgtccgcgtcactcgtcagcgtccggtctcccttcagcacgagcgtcaccttcaaacccacggagaactgccgcgccacgtccagccggtgtgcttggacttccttcgtggacttgcccgtcagccgggccatctctcccgggtgcggcgtcatcaccaccggccccttcgcccggcgcagcaccgacaagtccgtggccaccgcattgagcgcgtccgcgtccagcaccgcgggcgcctccacgcgcgacaacagctcgccaatcagcgcccccgtctccgggccccgaggaatccccggcccgatgacgagcgcatccttcccttccgccgccgccaccagcgcgtccaggtcacccatgcccaacggcccggaagcctccagcgggatgcccatgatttccgctgaatgcgcctggatggtgtccagcgcatccgcgcgagcggccactgtcacgagccccgccccagagcgcagcgccgccttcgccaccagcgccgcggcccccgtctttccccggctgcccgccaccaccagcacgtggccaaaggtccccttatgagagtccgccttccgcactggcaatgtgcggcgcgcgtccgactcctccaccacgaagaactcgggaccggagacctccttcgaggactcgccccccatgccgatgtccacccggtgcacgcggccacacagcgaggcccccggctccagcacctgccccggcttgaggaagccgaacgccacggtggcatccgcctccacacacggcgagaacggcgctcccgtgtcgctctgaagcccggacggcacatccgccgccacgaccttggcccctgctgcccgccagccgcgaatcgccgacacggcgtccgcgaaggcccccgcgggcgcacgactcaagcccgtgccaaagagcgcgtccaccaccacgtcaccgcgcctggccggctccacggcctccagcgtgcgcggcgtcacaccgaagcccttcaccgcctccacgttccggcgcgcctcgggcgtcagcttcgcggcgtcgcccaccatcaccaccgacacgcaggcgccgccctcccggaggaagcgcgcggccaccagcccgtcccctccattgttgcccggtccacacaccaccacgaagcgcccacccgagccgatgagcccccgagccacctccgcgagcccccgcccggcattctccatcagcaacgcggagggcatgccgtggcgggcttcggcggcctgctcggcctgacgcatctgggcggcggtgaggacgcgcaacatggcttcaatcccccttcgattggagcaccaccgtggcggcggcgacgtccgcatcgtgggtcagcgcgaggaaggcctccagccctcgcgcctccatgacctccagggccacgccggacagtgcgaaataaggcgctccgccctgccgccggacctccatgtccttccagcggatgcccggcggggcgcccagcgccttcaccagggcctccttggcggcgaagcgcgcggcataggcactggccgcgtcactgcgccggccgcagagggcccgctccgcctcggtgtagacgcggttcagaaagggctccgcgcgaggcccgtccaggatgcgctggatgcgggagatggagcagatgtccaggcccaggccgcggattcccatggcgccctaccccgggttgcgcatgatttcgagcatctcacgcaccgcccgctcgaagcccaccagcaccgcgcgaccgacgatggcgtgcccgatgttcagctcgtcgatctcggagatgcgggcaatggggtgcacgttgtcgtagttgagcccatggcccgcggccacgcccaggcccagcttggtgcccgccttggccgcgtcgatgatgcgcgccagctcccgggcccgctccttctcgttgcgcgcctcgcagtagcggcccgtgtgcagctcgatgcggtccgcgttcaccttgtgcgccgcccgcacctggtccaggtccgggtcgatgaagagcgagacggcaatctcgccgtccttcaggttcttgatgatcttcgcgatgtgctcgcgctggttggcgacctccaggccgccctccgtggtgagctcctcgcggcgctcgggcaccagcgtcaccacgtccggcttgtgctcgtaggcgagcttcaccatctccgcggtggcggccatctccaggttcaggagcgtctgcaccgtctcacggaggatgcgcaaatcccggtcctggatgtgacgccggtcctcgcgcaggtggatggtgatttgctgcgcgccggcaagctccgcaagcgccgcggccgtcaccggatccggatacgtggtgcgcctcgcctgacgcagcgtcgccacatggtccacgttgacacccagtcgctgtcccatcgaccgcacctcgctcatgcgcggccatgggattgtcgaaaggccccggtgcgcgccggcccttcttcatgctggctgcgtccggaagtcaaccaccgttcgcagcggccctcagacgctgagggccttggacagcgcgtccgcgatttccttcgcgtaggcctggttgcgggcggcgtcctcgccctcgatgaggacgcgggccttgggctcggtgccagagaagcgcaccagcacccggccggtgttgcccagccgctgctccacgctcttgatgaccttcatcaccgtcgggagctcgcccagctccttcttctgcttcacgacgacgttgaccagcgtctggggcacgggctcgaagatggaggccagctcgctcaggggcttgcccgcccggcacatcaccgccagcaactggagcgccgccagggttccgtcacccgtggtggtgtgatccaggaagatgaggtggccgctctgctcgccgcccaggttgtagccattgcggcgcatctcatcgacgacgtagcggtcacccacgcgcgtgcgagccaccttcacgccccagcgcgccaccgcgcgctccaggccgatgttgctcatcaccgtggagaccaacatcttcttcttcagttgcttgcgggccaccagctcgcccgtgcagatggccatgatggcgtcgccgtcgacgaccttgcccttctcgtccacgacgatgaggcggtcggcgtcaccgtccagggcgatgcccaggtgcgcgccgtgcttcaccaccgtcttggccaggttctccggatagagggcgccacacttgtggttgatgttcttgccgtccggcgaaacgccgagcgcaatcaccttggcgcccagctcctccagcacggcgggcgccgtcttgtaggccgcgccgttggcgcagtcgacgacgatggtcatcccctccagcgtcagctcgcgcgggaaggtggccttcaggaagacgatgtagcggccccgcgcgtcctccatgcggaaggcccggccaatcttcgtggccgtgggccggatggagtcgatggagccgctggacaccagctcctcaatcttgccttccgtctcgtccggcagcttgaaaccgtcgcgccagaagaacttgatgccgttgtcctcgtaggggttgtgggacgcggagatgacggcgcccgcgtccgcccgcatggaggtggtgatgttggagatgcccggggtcggcagcggcccgacgagctccacgtccacgcccatggaggtgaggccggaggccagcgcctgctccaacatgtagccggacagccgcgtgtccttgccaacgatgacgcggtggcggtgcgggccgttgcggatgaggaacgcgagcgcccgcccgagctgcatcgcgacctcggcagtcatgggatagacgttcgccttcccgcgaacaccatccgtgccgaacagcttctgcgaagcctgcgcctccttcggaggcatgttcatcctgtacgccatgtgtgccgctccgcctttcccacgccgggcctgcgccggcctctcgacgtcggggcttataccccgcccaccacgcgggctcgaagttaggaacccactgctccctgggcaaccacccaggcatgcgggccgacgcagactaaaagaggttgcgaaatcagtaccaaccgaatcgccgccgtccatacacggcggctcggggggcggccagcggaaggtgaaggtaccggccacagcttgggggctgtaggccacaccttgttaccgggcgtagaacgttcctccgtcttcgcaccgccggatggcgtccgcgacggccagcgcgtcccgggcctcggtcacgtcatggacgcgggccacgtcggccccgcccagcgccgccatggaggccaccgagcccaacgtcgccgccagccgttcggaggcaggcttgccgcccgccaaccggccgaggaagcccttgcggctcgtacccaccagcaacggtagccccagcacgcgcagctccgggaggcggcgcagcaggaagaggttgtgctcgaaggtcttcccgaagccgatgcccgggtccaggaggatgcgcccccgggggatgcccgccgactcggcccggaggatagcggcctccaggaaagccagcacgtcctcgacgacgtcgtcgtagcgcggcgcctgctgcatcgtggccggggtgccctggatgtgcatcaggcagcaggcggcgccggcctcggccaccacgcgggacaggccggcatcagagctgaagccggtgatgtcattgatgaggtgcgcaccggccttcaacgcctcgcgcgccaccgcggccttggtggtgtccacggaaagaggcacatcggtccgggcccggaggccctcgatgacgggaatcacccgcgccagctcctcgtcggcactgaccggcagagagccgggccgctggactcgccgcccacgtcgagcaggtccgcccccgattcggccaaggccaacccgtgggcgatggcggcgtccgtcccggcatggcgcccgccatccgagaagctgtccggcgtcacgttcaccacgcccatgacgtaggtgcgggagccccactcgaagcgccgggcgcccagcgtcaacgccgccggcgccacgcccgcggccagcgcggacgccaccgccgatgccaacgcggacaagccccgggcgtcggtgcgagcagccgtcaccatccgctggaactgcgctgcgcgccccgtcagcagccccgtccccgaacgggaatggacgtccccgggaagccactcggggaacgcctcagacagcgtctggaggaaggcctcgtcctggggactcaacccggtgaggaggagccgagtgaatggcagcgtctccagcagggcccgttgcgtggactccgtcagccccatccgccggaaggccaggatgaggtcttccgggtgctctgaagtcaggggacgagcgcgaatcatcgggaggctccagggagggggccgcgtaccgccaccaggacgggacgcgcttccctaccctaccgctcccgagtgcgccgggggctcaggcttcgagcggctcggtcacgatgtccaccgtggacgtcgtcatcagcttgtggatggggcactgcgcgacggcgttgtacagccgctgcttgtccgccggcgacagcgccccgtggaacgccagcttcaccttcagcgtgtaggtgccctgccgctcccgcgaatcatcccgttcgacgtgcgtctccacacgctccagggccaggccgtgacgcttcgcgtaccacgtggccgtcagggccttgcatgccgccagcgcggcgtcgaagtagtcgtgtggaccgggcgcggagtcctctccacccaacgcgggggccacgtccgcatgcagggtatgggtgccggtcttcaggacctggcgaaacgctccgggcttctcggtctggctgtgggtcgtcatgggggctccgggagaagaaggtggaccggaggcccggtgaaggcgcctccggagcggtccgcgggggtggctcaggccgcctgctcggcctgcgccttcaccgcctggacctcgatggcgatttcaatcttctcaccgacgagcacgccgccggcctccagcgcctggttccacgtcaggccgaagtcgcggcggtccaccgacgtcttcgcctcgaacgcggtcttgacgttgccccacgggtccttggccccgccgagctgctcggcgtccagcaccacctcgcgggtgatgtcgcggatggtcaggttgcccgtcaccttcagcccgttgccggacgccttctccaccttcgtgctcttgaacgtgatgctggggaacttctccacgtcgaagaagtccggcgagcgcaggtgggtgtcacgctgctcgacaccggagtcgatgctggccgtctcgatggtgacggcgacggaggacttcgtgatgtcctgctcgtccagcgaaatggcgccgctgtacttgcggaagctgccgcgaaccttcgcgatgaccatgtggcggacggagaagtggatggcggagtgggtggtgtcgatgttccaggtcgtggtggccatgaggtgccttcctttttgtgtgaagcggtgtgttcgacgaggaggaaggtagcggtgtcccccgggcttgattagatgggccagactggaagaactgttccacccacggaacaacgctccgggaaggacgggagatggacctcaacgagctgctcgtcttcgcacgcgtcgtacaggcaggcagcttcaccgccgcggcgcgtgggctgcggatgcccaagtccacggtgagccggaaggtgtcggagctggagacgcgggtcggcgcgcagttgctccagcgcaccacgcgcaagctgcgcctcaccgacgtgggccggacgtactacgagcactgcgcgcgcatcgtcgcggaggcggagcaggccgaactggccgtgacgcggatgcaggccgccccccatggcctgctgcgtgtgacgacgccgctgacgttcagcttcatcgggccactggtgtccaccttcatcaagcagtaccccgaggtccagctcgagatggtgtgtaccgaccgcaacgtggacctggtggcggaaggcttcgacttggcgattcgcgccgggcggctggcggactcgtcactcatggcgcggcggctgggcatcgtggagcgcgtcgtcatcgccgcgcccagctatctcaaggcgcgcgggacgcccaaggctccgaaggatttggagaagcatgactgcctcctcttcggcgcgggcctggagaacaacgtctggacgctccactccggcaaccgctcggtggacatcaaggtgcccgcccgaatcgtcgtgaatgagccggacatgctctacgcggtggcgcgggcgggctccggcatcgccctgctccccaacctccacttcacctcggagctggccgccgggcgcttgcagcgcatcctgccggactggagctccacgggcgcgcccgtccacgccgtctacccaagcacgcggcaccactcccccaaggtgatggccttcgtggagtgcctgcgcgagcactggcccatccccggctgaacgggacatcgttccatcaacggaacgatgcttcccattgtccacgcctagtcccgaaaggccctcgcgcacatcatgactctcgaaacagcggccgccatccaggttctgccgcggaaaggaacgccatgattgccattcgcccctcggaagcccgcggtcacgccaaccacggttggctggactcccaccacaccttctccttcgccggttactacgacccggacttcatgggcttccgagccctgcgcgtcatcaacgaggaccgcgtcgcgccccatgagggcttcggtacgcaccctcaccgggacatggaaatcatcacctacccgctgagcggcgccattgcccaccgcgacagcacgggcggcgagggcctgctgcgcgccggtgaaatccagcggatgacggccggcaccggtgtgctgcacagcgagatgaacggcgcggatgagaacctccacttcctgcagatctggatcatcccggaccgcaagggcctgacgcctggctacgagcagaaggccttcccggaggccgagcgccagggccgctggcgggtggtggccagcccggacgcccgcgacggcagcctcacggtgcaccaggacgtggtgcttcacgcgacgctgctgggcacgggcgagcaggcgacgtacacgctcgctccgggccgccacgcctggctgcagttggcgcggggcaaggccacgctcaacggcgttgagttgaaggcgggggacggcgccgcggtggcggacgagtcgcagctcgtcctctccgccacggagccggtggaagcgctgctgttcgacctggcctgaggccacatcgctgaatgaaagagagcacgacatgagccgggacgacttgaacgcggagcagcttcctccttcgatggagacactcatcgtcgcaccctcacgcgacctgggcgacgggttcgaggtgcggcgcgcgctgccctcggcccgccgccggatggtgggacccttcatctttctggaccagatgggccccgccggcttccaacccggccacggcctggatgtgcggccccatccgcacatcgggctggccaccgtcacctacctcttcgacggagaagtcatgcaccgggacagcctgggcaccgtgcagcccatccgccccggcgcggtgaactggatgacggcgggcaacggcatcgtccactcggagcgcaccggccccggcccacgcgccgcgggcagcaagctctttggcatgcaggcgtgggtggcgctgcccaagcgccacgaggagacggccccagcgttcgtccaccaccccgaggaccagatgccctgccacgagggcgagggcgcgcggatgcgcgtcatcaccggcaccgtgcacggtcagcgctcgccggtgcagacgctgtcggacatgttctacgcggacgtggcgctggaggccggcgcgcgcttcgtggttccggccgagcacgaggagcgggcgatgtacctcgtccagggcaccgtggaggtggacggcatggccttcgagccgggagagctgctcgtcttccggcccggcggcgccgtcaccctccacgccaccgcggcggcgcggctgctggtgctcggcggggagcccatggacgggccgcgctacatcttctggaacttcgtctccagttcgaaggagcggctggagcaggcgaaggaggactggaaggccggccgcttcgccgccgtcccggatgagacggagttcatccccctgcccgaggcccccctcccagtgcgctacccgtaggcgcgcggactcccaggagcccgcaaagcagaaggcccttcccacgctgctgggaagggccttcttcatttcagctcaatcgctggaagggcgtgaagctcaggccttcttcggctccatcgccggcaggccctcgagcgcgtcgagaatcttccgcttgtccttcttctccgtcgccttcgggggcgcattcacgcgcgggggcggacgctcacgggtcagctgcccaccctggaggaggatgttgacgtcctcggcgtccagcgtctcgtactccaccagcgcgtcggacacgcggcgcagagcctcgatgttctccgtcagcaggttcttgccgcgctcgtagcagcccacgacgatgttgcggacctcggcgtcaatctgccgggcggagtcctcggagtagtccttggacgagttgaagtcgcggcccaggaacacctcaccgtcgctcttgccgaacgccagggggcccatcttctcgctcatgccccagcggcacaccatggcgcgggccgtctcggtggcacgctcgatgtcgttggcggcgccgctgctcatctcgttgaacatgagctcttcggcgatgcgcccgcccatggccatggagatctggtccagcatctgcttcttgtagccgttgaccttgtcctcggtgggcaggctccaggtgacgcccagggcctggccgcgcgggatgatggtgaccttgtggagagggtcgcagcccgggaggagcttggccagcagcgcgtggcccgcctcgtggacggcggtgttcttcttctccttctcggtcatgatcatggagcgccgctcggggcccatgaagaccttgtccttggcggcctcgaagtcgctcaggtccacgcgctccttgttctgccgcgcggccatcagcgccgactcgttgacgaggttctccaggtccgcgcccgtcatgcccggcgtaccgcgagcgatgacctccaggtccacttccggcgccagcggcacgcggcgggtgtgcaccttcagcacgcccaggcggcccttcacgtcgggacgcggcaccacgatgcgccggtcgaagcggccgggacgctggagcgccggatccaacacgtccggacggttggtggcggcaatcaggatgacgccgtcgttggactcgaagccgtccatctccacgaggagctggttgagcgtctgctcgcgctcgtcgtgtccgccgcccaggcccgcgccacggtgacggcccacggcgtcgatttcgtcgatgaagatgatacagggggcgttcttcttgccctgctcgaagaggtcacggacgcggctggcgccgacgcccacgaacatctccacgaagtccgagccggagatggagaagaacggcacgccggcctcgccggccaccgcgcgggcgagcagcgtcttgcccgttcccggcgagcccatcatcagcacgcccttgggaatgcggccgcccagcttggtgaacttcttcgggtccttgaggaaggcgacaatctcctcgagctcttccttgcactcgtccgcgccggccacgtccgcgaaggtgaccttgttgtggctctcgctgaggagcttggccttcgacttcccgaaggtcatggccttgccgctgccaccctggagctggcgcatgaagaagatgaagaacaggaacaggaagacgaccggcatccactgaccgaggatggtcagccagaggctgttctgctcctcccgctcgtacttcacgtccacgccgttgctgcggagctggttcagcatggccgcatccggcgccggccccgtcgtgcggaacttctccgacgtgtcggtgaacttgccggaataggtgttgcccttgacggcaacctcctggaccttcttctcctccaccttcgtcagcaactgggtgaaggacggttcctggacctggtcgttgccctgggagaagaaattgtagaaggcgacgaagaggacgatcaggatgacccagagcccgatggtcttgtaagtcgaacgcacgtgtcagctgccctttcggaactcgccgggatgagggccgcgctgggaagaaccccagctttttccatcacttggccgacaccaggcgagctacccagcgacggaccgtatcagcaacagcaaaaagccctcaactatttagggggccgcgcccatcccccgaactgcgactctgccactctataacgccgcggtccgctgaatgctcgaaccgggagggaccgcccagaggtactccctggcggccgcacgcggagccaccggagaccagaggccggggagccacaacacctgcccctcggcatccgccaccaccggccgcgtggcccgtgcttccgcgggcactcgaagatcaaccaacacatcttgaagcttgcgttgtcccccagcagtgcacacccgatcgccggggcggcgtgtccgcacggtcagcggccagcgcgtcccgtccccgagcgccagcccgagcacgcccgctggtggaggtgcgaactcgacggaaaaattccagcccgtccccgcgagcgcgccccgcgaacccgcgtgctccagccggagttccgccggtggggtggacggcacctgccgcacgcagcgcacccgtccgctggtcgcgcgcagcacgtagccccgccccagcgtggccgtgccgccctgggccaccgcgcgctgcacgcgggccagcgtggcctcatccaccgcggcctccgtgccggccaccagccgggcgagcacccgccggcgcagcgcgggctccagcgcgcgcacgcccacctgatgcaggggaccatcctgcaaccgcaggcgacagaaggccacgtaccgcatggacgccagctgagactttgcctgcgggaccacccgagcgaaggcggggcaggtgcacgttcaccacgaagccagcggcgcgcgacagggcgggtagcactccaaggcgaacgcgcgtccggaagtggacagggtcggtgttcatcgggtctgtcacataggcgacaccctgctccgccaggaagggcaccacctcctcccgcgtgcacgacagcagggggcgcaccagtccggggcgcgcttcgtggatgcccaccgcgccgcgcagggcggtgcctcgtgccaggcgcatgagcagcgtctccgcctggtccgtggcggtgtgcgcggtggccaccacgtccaggccccgctcgaggcggagtgcctccagcgccgcgtagcgagcctccctcgcgcgcgcctcgatgccgacccctggatgcagccgcagcgcctggacgtggcagggcagcccccgcgcggccgccaggaccgacacctggcgggcctcctccgccgcttcgggacgcaggccatggtccagcgaggccacctccacgcgaagccggagtcgctcggcgacgagcacggttcccatcaggagggccgtggagtccgcgccgccggaaacggcgagcagcaccgaacctccctcgagtcccagccgggtgtacgcctcttgaagcgtcgtcgtcagcagctgcgtggcggaatcgtgacggggcatcggaccgcggtggaatggagtgtcgggtgagcgggttacagaggcacgtgcggttgaaggcaggggggctgattcttatgatcgccacaacatcgaatcagcgttgatgcggtagcggaaatacacgcggccgcgaacgctgttcttgagacggtcgaattttgagctgttggacctaggggtcccccccctccccctctgggtccacgggcccgcctggagatttctctaggcggtccctctttccgaagcgccccggacttcctcgtggagtccggggcgtttcctttttcgcgcatggttgcacagcttacgtgcaactggacgagcacggggacggaccgtgcgacctcggaatgagtccttggaaaccgttgacccacttgggagtctgtcggataacggcccaggtgtgttcaggtcgtcaccccgaatccgccccggagacccaagtatggcaggcaccgacaagcgcaagcagtcgctgtacttccccgaggagatgctgaaggagatccaggaagaggcgacccgccaggaccgctccctttcctgggtcgtgcagcaggcgtggaagatcgcccgcgagcgcatcaagtcgttccccgccgtgaatgatgtgactggcgacgagcgccaggaccctcgggaggagtaacgacggatggctacgacggaccatcgtaaacagagtctctatttccccgaggacatgctggaggagatccagcgtgaggcgacgaggcaggaccgctcgctgtcctggattgtccagcaagcgtggaaggtggcgcgcggggacatccggaagatgccgtcggtcaacgacgtgctcagcccgcctcctcgtcccgcggcccccgcgcccgcccccgcccagccggtgacggccgtggcggtggcgccctccgaagagcccaagtagttccggagggccggcttcacgcccggtcccccaccctcacctgcccgcgggcctcgcgggcagggcgcagttctggaagacgactcgcgactcctcgcgcagcgcctgcacgggcgttgggtgcttggccttcatgtacgccgaagcgaggttggcttccgtaccgnccagcttccgagcctgcaccgggttgcggtccgggttctgt

SEQ ID NO: 1173 - DNA, 20113 bp, Myxococcus xanthus
cgatcccctgctccggaagatcggggcagacgtgaagctgttccccgcgcggctcggcgaggcgctccagaagctgccccgcatgcaggggggcgagagcgcgatgctgggccagcggctgctcaagactttcgacaaggccgaggacgaggccaagtccctcaaggacgagttcatctcctcggagcacctgctgctcgcgctcacgcacgacaagggcgcggtgggcgaggtgatgaagtcctcgggcgtcacgagggagcgcgtgctgtccggactcaaggaggtccggggctccgggcgcgtgacgagccaggacgccgaggcgacctaccaggcgctggagaagtacggccgcgacctcacagaggcggcgcgctccggcaagctcgaccccgtcatcggccgtgacgaggagatccgccggtgcgtccaggtgctgagccggcgcaccaagaacaacccggtgctcatcggcgagcccggcgtgggcaagacggccatcgcggaaggactggcgcggcgcatcgtcgatggcgacgtgccggagggcctgaagaacaagcgcctggtgtccctggatttgggcgccatggtggccggcgcgaagtaccgcggcgagttcgaggagcgcctcaaggccgtcctcaaggagattgccgacgccgcgggcgaggtcatcctcttcatcgacgagctccacacgctggtgggcgcgggcaaggccgaaggggccatggacgcgggcaacatgctcaagccggcgctggcgcgcggcgagctgcactgcatcggcgccaccacgctggacgagtaccgcaagcacatcgagaaggacgccgcgctggagcggcgcttccagcccgtcctggtgggcgagccgagcgtgcacgacaccatcagcatcctccgcggcctgaaggagcgctacgaggtgcaccacggcgtgcgcatccaggacaacgccctggtggccgccgccacgctgagccaccgctacatcgcggaccggttcctgccggacaaggccatcgacctggtcgacgaggcctccagccgcctgcgcatcgaaatcgactccatgcccacggagctggacgacgtgcgccggaagatgacgcagctccagattgagcgggagggcttgcgcaaggagacggacccgcactcgcaggagcgcctgggccagattgagaaggagctggccaacctgagcgagaagttcaacgcgctcaaggtgcactgggacgcggagaagacggccattggcgccatccgcagcctgaaggagaagcaggagaaggcgaagaacgaccaggctgcggccgagcgtcagggcgacctgaaccgcgcggcggagctgaagttcggcgtcatcccctcgctcgacaaggagctgaaggcgcagaacgagaagctggccgagctgcagaagaaccagaagttcctcaaggaggaggtcgacgcggaggacatcgcccaggtggtggccaagtggacgggcatccccgtctcgcggctgatggagggcgaggtccagaagctggtccacatggaggaccggttggcgaaccgggtgattggccagcgcagcgccatcgaggcggtgtccaacgccgtgcgccgcgcgcgcagcggactgcaggaccccaaccgccccatcggttcgttcatcttcctgggccccacgggcgtgggcaagacggagacggccaaggcgctggcggagttcctcttcgatgatgactcggccatggtccgcatcgacatgtccgagtacatggagaagcactccgtggcccggctggtcggcgcgcctccggggtacgtcggctacgaggagggcggccagctcaccgaggcggtgcgccggcggccgtacacggtggtcctcttcgacgaaatcgagaaggcgcaccacgacgtcttcaatgtgctgctccagattctcgacgagggccggctgacggacagccagggccgcacggtggacttcaagaacacggtgctcatcctgacgtccaacatcggctcgcaggacatccaggccggcatggcgggcaaggaggagctggacgagcgcacgcgcaacgaggtgatggacgcgctgcgcgcgcacttccggccggagttcctcaaccgcgtggacgagatcgtcatcttcgagccgctgcggaagaaggacatctaccgcatcgtggacctgcagttggcgcggctgtccaagctgctggccgacaagcggctgacgctggagctgacggagaaggcgcgcgagctgctcgccgagcgcggctacgacccgacgtacggcgcgcggcccctgaagcgcgcggtacagaagaacctgttggacccgctggccctcaaggtcctgggcggcgagttcgtcccgggcgaccacatccaggcggatgcgggcccggacgggctcaccttcgccaaggtgctggtggacacctcgaaggacgtgaagcgctcggcctagcccgggcgtccacggatgtgcctcggcccggcgtcatggcttgacgccgggccgcctccgcgcgaagagcccggccatgaagccctgggagacgctggagcgcgcagaagtcccggacgtgggggaagtcaccctggcccggcgcggggacgagtacgtcttccgcgtgcggggccagacgctgatgtccagccggcagcacggctccgaggaagcgctggcggaggccggctgtgaagggctggcgggccgaagcggcgtccgggtgctcgtgggtgggctgggctttggctacaccacccgcgcggtgctggaccggctgggtcccgacgcgcgtgtcacggtggcggagctgctccccgtggtggtgacgtggaaccgggggctgctcgcgccgctggccggggcgcctctggaggacccgcgcgtcaccgtggtggagctcgacgtgggcaagcacatggcccggcagtccgggacctatgacgccatcctgctggacgtggacaacggccccaccgccctcacccaccccgacaaccacggtctctatgggcgcgtggggctggcgcacgccgtccaggcgctgcggccaggaggcgtactgggcgtgtggagcgccgggccctcccccgccttcgaacgccgcatggagcaagcgggcttcaccgtccaggtgctgcacccggcggcgcatggcaccaaggggacgcggcatactctgttcatgggcaagcggaggccccaggggcggcgttagtaggggccccatgattcctttctccgtcctcgacctctcgcccgtcacgcagggctccaccgcggccgacgcgctccggaacacgctggacctggcacggcacgcggaggactggggcttcaagcgcttctggctggccgagcaccacaacatgacgggcatcgccagcgcggcgacgtccgtggtcatcggctacgtggccggagggacgaagcgcatccgcgtgggttcgggcggcgtcatgctgccgaatcacgcgccgctgatcatcgcggagcagttcggcacgctggagacgctctacccggggcgcatcgacctggggctcggccgggcgccgggcacggacatgctgacggcgcgcgccctgcggcgggacctggcggcgagcgcggacaccttcccccaggacgtcgtggagctgaagtcgtacttcgagcccaccgagccggggcagctcatccaggcggtgccgggcgcgggtttgaaggtgcccatctggctactcggctccagcctgttcagcgcgcagctcgcggcgatgctgggcatgccgttcgccttcgcctcccacttcgcgcccgatgccctgcttcaggccctggacatctaccgggagcgcttcaagccgtccgagtcgctcgagcggccctacgccatggcctgtgtgaatgtcttcgcggcggatacggatgcggaggcacagcgcctcttcacttcggtgcagcagcagttcatccgcctgcgccgcggcacgcccggtcagctcccgcccccggtcgatgacatcgactccgtggcttcgcccttggaccgcgcgagcgccgaccacgcgttgaagtactccatcatcggcgcgcccgacaccgttcaacagggtctggcggcgttcattcgactcacgggagtcgatgagctgatggtgacgggaatggtctacgaccacgccgcacggctgcgctccttcgagctgactgcgcaggcgcaccagcggctcgccgaggcagaagcggcgcagccggcctgaagaaccgcccgcgccctcctcccaggcggagcgtgaaacaccgcgtctgtggcaatgaacgacacacacgcctccgccctgtagcggaacgcgctacacggccacgcgcctcgtcctcgcgaacgccgtttctcccagcagcagcatggctgcgcgcgtcgtggcgcgatgggtgcacacctcgcggccgcggatggcgcttcgcctcgaagcgcgtcacgggaaacgagtaggctttccctcgggagacgttctgatgcgcaggcggcggtaccttctaggcattcccgtcggagccatcgctatcgccgcggtctgggcgagcacgcaccggctgccccggcctctcgagctgggcgcactgcccgccacgacggagcctggagaggagctgtctggcggacggggctccgtgccggacccgggacgcaacgcctttggacgcgcgcccatgaacatgccgcggacgcgctgggaggacttccacgcgggcaagcgcgtcttcggtcgcgattggacggacgtggacggccccatccaagtggggccgttgttcaacgccccctcgtgcatgacctgccacgtgaaggatggacgcggccagccccccgcctctccgagcgagacgcccatctccctcgcgttccagctgagcgggccagacggccgtgggccacatccgatttatggcgcgcagctcgacgttcgccatgtcgacggaaccggcgcggaaggcagcgtcgaggtgacgcacgaagaagtcaccggccggttcgcctcgggcgagacctacgtcctccaccggccccgctaccgattcacccagctgtcgaaggggcccctcggggaggagacccgcttctcccctcgtgtcgcgcccgcgaacttcggcctcggactgctcgaggccatccccgaggcggcggtactggcccacgaggattccgaggaccgtgaccagaatggcatctccggccgggccaaccgtgtgcgggacgcggcgacgggacagacgcggatggggcgcttcggctggaaggccaaccaacccacgctgcaccagcaggtggcacacgcgctcgtcaccgacatgggactgacgacggagctgtatccccgcgagcagggacgcgaggccggcgaggccgccccacccgaggtcagccccaaggaactggacgcgctgctcatctacgcgcgcttggtcgccgtgcccaagcgccgggactgggaagccgccgacgtcctgcccggcaaggcggtgttcggcaccatcggctgcgcggggtgccacgtgggcacggtcttcgagacggaagacgtgcccggcttccccgaactgtccggccagcacatccgcccctacacggacctgctgctccacgacatgggcgaagggctcgcggatgaccgtccggacgggctcgccaccggcaccgaatggcgcaccccgccgctgtggggcgtgggcctcgtgaaagcggtgaacggccacacccgcttcctgcatgacgggcgggctcgcgacctggaagaggccgtgctgtggcatggcggcgaggccgcgccggcccaggagcgctacacgcgcctgccgctcgcagaccggcaggcgctgctcgcgttcctcaactcactctgagccctcacctgctcaagaagcgctgacgccggggacacctccgtcgccagcgagccgccgcatgggctggacccttccatacgtgagcgagcgccacagccactccgcgggaccgaagcggaagcgcgccaaccacagacggctgaacaccacctgcgccgcgaagatgacgcagcagatgacgacgatgcgcgacgccggcagcttgccgatgaagcccaggccccaaccgctataaatccagatgctcaccgcggactgcatcaggtagttcgtcagggccatgcgccccacgggcgtcagcacgcccagccagcggctccagcgctcccgctggaagagcagcgcgaaggccgccacatatgccgcgcccatggcgatgtagccgggctcctggaagccgttgacgatcatcatccagggccccttcgggtcccactccagcacgccggctttgcgcaggcggaacagcagcaacccaccgccattgaggacgaggcccacgctcagcccccagccaagaatccggcgcagcaacgcccggtgacgctccacgtcctgcaacaggagcagacgccccgccagcaaccccagcaggaagcgccccaggatgaggctcatccagagcacgcgccggaagccgccgccgaggttctccaggaagaagcgtgcgttgcccacctgcgccgtccagaacgactcgctcgacaacgccaccagggtgtcggctctcaaggccatatccctggcatgactggccttcgccgcctcggccgcggcctccgcgccgtgcagcaggatgggcgtgtagcgaatggcggcgggcaccaggaacggcatcacggtgacgagccccagcgcccagaacagcaccgtgcggttggagcgagcccggaaggccatcagcaggaagcccaccatcgcgtaggtgtggaggatatcgcccgtccacaacagaagggcgtgcgccaggccgatgccgaagagcatcagcagccgccggcggtagagcggcgcggcggagacgccacgtgactcggcccgcgagaactggagtgcgaagcccaggccgaagaggaacgagaagatggagatgaacttctgcgtcacgaagagctgatagatggagccgatcacctgctccagcaggggggcatccagcgcggacgcagcctcacggggcatgaaggcccgtccactcagccacatgaggctgttggacacgaagacgccccagagtgcgaagccacggagggcgtccagcaagacgactcgctcggaggcatccactggacgcgccacgggcaggtcgtccgccacgggagaaccagattgggacatgtgtgaagcagacgcgctctgcctcctggccgtcaatcccgcacgttcgagggtgacgggacatgcgggcttgccccctcctggcatggcgggtgtgctgtagtggctccccgctccccgacggacaggagtccgccccgtgaagatttcccccctgcttcccctgctgctcatctccctggccgcgcccggcggcctcgcgctcgccgcggagacgccgcccgtcctgggtggcctcgatgccatctacccagagctcgacgcgctctaccgcgacctgcaccagacgccggagttgtccaaccaggaagccaagacggcggcgaagctggccgaccggctgcgcaagctcggcttcgaggtgacgtccaaggtgggcgggcacggcgtcgtggccctgctccgcaacggccagggccccacggtgatgctgcgcgcggacatggacgcgctacccgtggaggagaagacgggcctaccctatgcgagcaagcagaaggcgaaggacgccgcgggcgcgacccacccggtcatgcacgcgtgtggccatgacgtgcacatgacgtcgttgttgggaacggccgcgctgctggcccgttcgaaggaccggtggcgaggcacactgctgctggtgggccagccggcggaagaggtgggggcgggcgcccggcagatgctccaggacggcctcttcaagcgcttccccaagccggacttcgcggtggcgctccacgtcaacaccgccgcggcgggcacggtggagttcactcccgggtatgcgatggcgagcgtggacggcgttgaaatcaccctgcatggcaaggggggacatggcgcgtatccccacaccaccgtggacccggtggtgatggccggcgcgcgtcgtgctgtcgctccagacgctcgtcagccgcgaaaagaacccgctggagcccgcggtggtgacggtcggctccattcatggcggcgccaagcacaacatcatccccgatgacgtgaagctccacctcaccgtgcgctcgtacaagccagaggtccgcaaggccctgctggacggcatcgagcgcatcgccaaggcggaggccatggcctccggcgcgccccgtccacccgacatcgccatcaccgagggcacgccctccaccttcaacgacccggcactcaccaagcggctggtgggcgcggtgtcccgcgtcctgggcgaaaagaacctccaggaggcgcctcccgtcatgggcggcgaggacttctccgagtacgggcgcgcgggcgttcccgccgtgatgctctggctcggctccaccgagccgcggcaatacgcccaggcgatgtccgcggggacagcgctgccttcgatgcattcgcccctcttcgcgccggaccgcgagcgcacgctgcgcacgggcgtcaccacgctgaccaccgccgccctggagctgctcggcaagccgtgatggccgggaagcgcgcagcgccttgcacccgggccggcacctgttcggcggcggggttcgcgagacgcccacgctgatttgactcgggggaatgcgaaaccgtagacagggctcctctcgcatcgcgacaggatgtcccccttgctcaatcgcaatcattccctgcgagccctgctgggggcttcgctgtggtgggtcgcctccggcttccagtccgaggccatcgtcagtcacgaaggcacggtccgcagtggcacctccgtctcgctgagcctccaggtctcctccgggcccagccagacctccgcgcgcaccggccagttggtggcctgcatcgccctgcccgtgggctggcaagcgccgggcggcagctacacgcatgccggctcggcggccaccgccgcgcagccgggcgcctcggcgctctccgccgaggcccagtccgcctggcccgtcgacggctccacctggcactgcctggtgtcggaaaacgtgaccacaacgaaccaggaggtccaaacgaccgcgcagctcacgctccccgtgcccgcggcggcccagggggcctaccgggtgcggtaccagagcgggttccgcgagatgacgcctccggtcggaggggggcaggctccgacctaccagcccacggacttctcgggacgcctggagcgcctgctccacgtcaacgtggcccccgccaccaccttcgacgactggcaagcaggcgtcgccaccggcatcttggtgacgccgtccgtgacgcgcgcctggcatggcaacgggacgttcctggcggcggccacgggcaacccggagctgctgcgctcctcggacgggcgccagtggacgggcttcgttcccgtggcggaggggaccacgtcgcccctcccgctggagcggctggtctactcccagcgcagatggttcggcctgtcgagcgggcgcatcgtcgtctcgtccgacaacgcgcatacctgggcccccgcctaccaggacccggcgcccgggggccggcgcttcctggagctcgcgctcagcggaaaccggatggtcgcggtgggcaccgcgggcctcatcgccagctccatggacggccagcgctggaccgatgagagcatcaacagcgcctatgacgtcgtgacgctggtgcccggtcagagcagcttcctcgctgtggccaacccgatggcgggcgcgccctcccagcatcctgtcctcgtgcggccccagggcgctggcgccgcctgggaggtgttccagcccgccacgctgtccgggctcaccatcgcccggctcatcgccggaaatgggcgcttcctcgccttcgcccggcccaaccaaccgtcccctctggcgccccaggcggtggaaccgacgagcggattcttcctctccgaggacctcggcggcacctggacgcgcgtggagagcctccggcttcccgcggacgctccgctacccaccccgctcatgacgttcgtggaccagagcttcgtcgtcagctggacggccgtcgacccgcaagtcgtgggagtgctgccctcgttcgagctgcaggtgtcggcggatggcaaggaatggacggcgcacccgacgggcgcgggcggcaactatgcgtccacggccttcgccacgggcgacacctccgtggtcgcggtgagccagcggcgtctgctggtggcctcgcgccggccctggccgctgccggagctcctcacggagacgctgcccccgttccggctgggcacggccgccaacgtggaactgagcacgcgcggctcgggcaccctgacgttcgagctggagggcacgctgccctcgggcctgacgttcgcccccacgacgggtaccttcaccggcacgcccgcgcagtccggtagcaccgccgtcaccgtccgggttcgcgacgcgcgcggcggtgtggcggcgcgcacgtacagcgtggacgtggtgggcaccctgagcatctccagcggcgcgattgcgtccgcgacccagggcaccgcgtatgaggcgcgcttcacggtccagggcggccgggcgccgtatacgtggagcctggacggcggcaccgtgcccggaggcttgacgattcagcagcgcgacggcgcctacgtgctgagcgggattccgaccgccagcggcaccttcccgctgacggtgagggtgacggactcggcgaaccagacggcggcgcggagcgtgtcgctgcagatcgcgcccacgccgcccccgattgacgacaagggcgacgcgcccagcggctgtggttgcagcggcagcggcgcgggcgtccaggcactggggctggcggcgctggcactgatgggccgagcccgccgcaagcgctgaccccgcgatgccctgacgtcctctccatccatgagagggcgtcaggccaagaaacccctatcccttccttggggtatacacggcccgcgccgcggcgatgcggggcatgctgtcctcaatccaatccgcgagcgcctccacgcgcgcggcgacttcctcccccagcggcgtgaggctgtagtccacgtgcggcggaatcaccgggtggacttcacggagcacgaagccgtcctgttccagggcctggagcgtctgcgacagcatcttctcgctcacgcccgccaccctccggcgcagctcactgaagcgacgcgtgccttccagcagcgcaatcaagaccaggacgccccaacggctcgtcacgtggtccagcacgcctcgcgaaggacatgagggcacgtacaggttgccccgctccaccgccaacttcgccatcttccgcgccagcggccccggacgcttgttcgcgctcatgttagtagcttaccaaaaagtgggtacttactagaagttagtgacatcgttaggttcctctcgcgtctggaaaaccctccacgacaggagatgtgaaccccatgattcttgtgactgcggcaacgggtaagctgggccgtctggtcgtcgcgggcctgctcgaaaaggtccctgccaaggacatcgccatcgccgtgcgcgacccgagcaaggcctccgacctggcggccaaaggcgtccaggtccgtcaggcggactacagcaagccggagacgctcggacccgcgttggccggagcggacaaggtgctcctgatttcgtccagcgaggtcggccagcgcgcggcgcagcaccaggccgcggtggacgccgcgaagaaggcaggcgtccggctgcttgcgtacaccagcatcttgcacgcggatacctcgggccttctgctcgccggcgagcacaaggcgaccgaggaggcgattcgagcgtccagcatccccttcgtcttcctgcgcaacggctggtacacggagaactacacggagaacctggcaccggcgctggcacacggcgcactcatcggcagctcaggtcagggccgttccgccgccgccacccgggcggactacgccgccgccgcggtggccgtgctcaccggcacgggccatgagaacaaaatctacgaactggccggcgacactgctttcaccgccgcggagctggccgccgaggtgtcccgccaggtgggcacgacggtcgtctacaaggacctgtcacaggccgaccatgccggcgcgctcatcggcgtgggcgtccccgcccccttcgccgagttgctggcggactccgatgcgggcgtggcgcgcggtgagatgaacgacagttccggcgacttgcggcggctcatcgggcggcccacgacgccgctcgcggacgcggtggcggcggccgtcaagcgctgagcccgacgccccctgattccaacccggcccgcgtggacgcgcgggccgtcagttgcccagccgcgtcagcagccactcccggacgtaggcccagtcgcgcttgaccgtgacgggcgacacgctcagcaccgcggcggtgtccagcaggtccaggcccacgaagtagcgcagctccagcatgcgcgcgagccgcggctggaacgtgtccagctccgagagtgctcggtccaactccagcacctccaggctcaaacccgccgggacatccgcctccacgtcccccaggctcacccgctccagccgggcctctcggacctgcgccctgcgcagccgcacccggtccaccatcacccgccgcatggcctgcgccgcggcgctgaagaagtgacgccgcgcctccaccggagcccccgcgctgaacaggcgcagccaggcctccttcaccaacaccgcgggttgaagtgacggcgtcgacgccgcatcggacatggcccgctgaaccatgtcccgcagctcctggtaggccgccgccatcaacgcatcccgcgcgccctgctcgcccttgcgcgcgtggtccagtagctctgtcagctccgacatgcccacattcacctccaggccagacgggttcgccgccctcacagaaactacgctctcaacgagaaatcttggaaaactggggcaggtacccctcacggtgcaacgattcccccgaccggaggggttgggaaacgacagtgtcctacagcgggaggcgttcaccccctgacgccaggccgaggcgcgcccgcagacacggcggaagcaaggcattccggtatttccccgggtcgtgctagcgagccgctcgcgtccggtgggccacaccctccgtccgggcgccaccaccctccgtgcccgggagtcgccatgaagccgctgctgtccgccctgctgccgttgctgtgtcttgcctcctccgcctccgcagcgccgcaagcgcccgtcgccgtgcagtccgacctggccttcctgtccgggccgcccacgctgaccttcgccgcggactggagcgtcaccctcagcggccagccggaggcgggcggcgcgctggacatcgcctatgacacctcgcgcctgccgctgtgccggggcaccgggtggaccatcaccgggttcgccatgtcgaaccggggcccggtgcagggcttccccgtggcggatgccaccacggtgggcgccatcgcgcagacgcaactggccctggctcagggcggcacgttggagctgtggttccagaacacggacgccaccggctgctcccactgggattcgaacctccagtacaacttccacacgtgggtgacgcagaacccgacgatttcgttccaccccgcgccagcgtggacgtacacggtccacggcacgctccagggcggcaccacgctgatggtggactacgacctcggccgcatcgcccagtgccgggcgcagtacctgaattacaaggcctggggcaccacggcgcactaccgcatcaacggcggcccggtgacgatgctcagcctgacggcgagctggggtgaatgggacgccgagttctggaggcagatccccgccttcattccgctgccgcccggcccggcgacgctggagctgtggttctcctcccaggaccgcaagggttgccagcagtgggactcgcgccacggacagaactacgtcttcgccatccagtgagctcccgcgctccgacgcgtcgaacttgtgattccaagtgatgcccgtcgcggtccaactgtcgccggcaacgaaggccgtgtagacggcgcctgcgccagggacgcaaccccatgacgaaagtcccctgacggggcgcgcctctcacgcccccagcgacaggagccgctccaccgccgcgcgcacgtcgcgcagcagcgccgggtccgtcaccgcgacgaagatggtgtcatcccccgccaccgtccccgcgagccccggcagctcccgctccttgtccaacgccagcgcgagcaccggcgcgaaccccggcgccgttcgaatcaccagcaggttgggcggcgcttccaggatggtgacacggggccgctctggcatcaccgcgggcgtggccggcgcgcgctgatagcgcccacccaccttcaagatccccagcttcttcaggcgccgcgacagcgtcgactggctcggcgactggccttccgcctccaggagctgctgcagcacggtctgatcgccgatctcccgctcggcgatgagccgcaggatggcctcgtccaggttcattcccaccaacatgcatccctgtgaatattcatgcaagaacatgcatgcgctcgttgcgaataatccgcttgcgcggcgcgtctttctgcataatatccgccgccttttcgcggcgatgcacgcattttcacgcatattcatcacgaatatgcaggtagccgctgccggggaggacaggcccatgaagcacgtcacgcacatcaaggatctggggcccgagggcgtggaggcggtgctcgcgcaggcagccgcgtggaagcagaagggaccggagcacgcgctcttcgccaacacgctgctggggatggtgttcttcaacccgtcgctgcgcacacgcacctcgttcgaggccgtcatgctgcgcggcggtggcaacgccatcatcctggacgtgggctccggcgtctggaagctggagcaccgcgagggcgcggtgatgaacgcggaccgggctgagcacctcaaggaggccgcgcctgtcctgtcgcgcttcgtggacatgctcggcgtgcgcaccttctcgcaaggcggcggtgacgaggaggacgaactcgaccccgtcatcaacgcgttccgcaagtggtccaccgtgccggtggtgagcatggagtccgcgcgcgagcacccctgccagggtctggcggacatgctgacgctgcgcgagacgttcggcaacacgaagaagctgccggtgacgctgacgtgggcgccgcacatcaagccgctgcccaaggccgtgcccaactccttcctgctgagcgcggcggcggcgggctgcgagattcgcgtagcccaccctcccgggttcgacctgcacccggccgtccgcgccgaggcggaggcgtacgccaaggccacgggcggcagcgtcacctatacgcacgaccaggacgaggccctggccggcagccgcgccgtctacgccaagtcgtggggccccacggccgctgcggcgttttcgcccaatgacgtctccgcgctgctcgcgtcctactccggttggatgcccacccgcctgacgatgtcgcgcgcgcaaaaggacgcagccttcctccactgcctgcccgtgcgccgcaacgtcgaagtggccgatgaggttctggaccacccgagcagccgcgtcgtagacgaggccggcaatcgctaccacgtccagcgggcgctgctgcactggatgcgttcgcgctgagcggcccctccgcattcttcctttcctgacttcgaggtctcacgtgcccctttcgcccgacccctactccgcgcttcgccacgcggcgaagtacgtgcagcagttccgccgcaagacgttcgtggtgaagctcggcggcgccatgctcagcgacccgcgtctgcgccgcgccgcctgcgagcagattgcccttctgtggaccttctccatccgccccgtcgtggtacacggcggcggtccggagctggacacgctgtgtgacgccctccaccttccggtggagaaggtggccggccgccgcgtcacctccgcgcccgtgctggacgcggcgaagatggtgctcgcgggcaagctgcacacggacctgctggcggacctccaggcggcgggcgtgcccgcggtgggcctgagcggcgtggacgccggcctcatcaaggcacgcaagcgcccgcccgtcatggtgacggaagccggtgccaccgagggcaagctggtggactacggcctggtgggtgacatcgagcaggtggacacccgcgtggtggagcacctgcgctcggccgactacgtgcccgtcatcgcccccctgtcgggtggcacggacggcgccgtgtacaacaccaacgcggacaccgtggccgcggcgctggcggtggcgctgtccgccgagaagctcttcttcctggtccaggttccgggcctgctgaagaacgtgagcgacccgtcgtcgctcgtcacgctggccaacctcacggacctggccaccatggagagcaccggcgccatcgcgggcggcatgaagcccaaggcgcacgccatccgccacgcgctcgtgggcggcgtgggcagcgtgcacctggtcagcggcgtgcagcccaacgcgctcctggaggaggtcttcaccaacgagggcagcggcaccatggtcgtgcgggagaacgcgcagaagcccgcgggggcggtgggatgacggcggcggagctgctccaggcgctggtggccatccccagcgtgtcaggtgacgagggccgcatcgcggacacggtgtccgggtgggcggaaggctggggcgcgcgcgtccagcggcagggccacaacgtgtggttctccgtggggagcgggccgcgccggctgctcatcaactcgcacctggacacggtaaagccgtgcgccggatggacgtacgagccccacgcgcccgtgtggcgcgaggaccgcctgtacggcctgggcagcaatgacgccaaggggtgcgtgacgggcatgctgctcgccgcgcggaccctgctgaccgaaggcgcgcccacgggcgctgaagtcgtgttcgcgttcaccgcggaggaagagacgggaggccaggggctgggaacgctgttgcccaagctgggcccgctggacgccgccatcgtcggcgagcccaccagcctcaagccctgcaccgcccagcgcggcatgctgctgcttcgctgcaccgcgcacggcaagagcgcgcacgtcgcgcacgcgcacgccacggaggccgtcaacgccatccacctggccgcgacggacatcgcggtgctggccgagctgcgctttccgtcccacccgctcctgggcgaggcccgggcgcaggtgacgcaggtgtcgggtggcctggcgcgcaaccaggtgccggaccggtgtgagttcttcgtggacctgcgcaccacgccgggcatggagcacgcgatggtggcccggcaggtggcgggcgcgttgaagagcgaagtgaaggtccattcggagcgctacctaccgaaggcgacgtcggcggagcagcccatcgtccgcgcggcggtggccgcgtcgggcgcgcagccggtgggctccagcacggcgtcggactgggccttcctgggggacatccccgcggtgaaggtgggccctggcgacacgctgcgcagccacctggcggacgaattcatcacccgggcggagctggaagccggtgccggcttctacacgcaactggttcggggttacttcgaggaggcggctcgtggctgacacgctgtggggcaagggccttcccctggacgcggccatccatcgattcacggtgggcaacgacccggtggtggacttggcgctggcgccgcattacgcgctcggctcgaccgcgcacgcgcggatgctggcgcgcgtgggcctgctgaaggacgcggaggccaagtccctggtgacggcgctcaaggcgctgcacgacgaggcccgcgcgggcacgttcgtcatccgtcccgagcaggaggacggccacaccgccctggaggcggcgctggtggagcgcgtgggcgacccgggcaagcgcatccacctggggcgttctcgcaacgaccaggtgcagttggccctgcgcctgctgctgcgtgaagaagtgctcacgctgggcgcgcgggcggcggagctggcgggggccttcctggacttcgcgcaggcgcacaaggacgtggcgctgccgggctacacgcacctgcgccgggccatgccttccaccttcggtctgtggggcatggcgttcgcggaagggctgctggaggaactcgaggcgctgcgcggcgtgtgggctcggctggaccgctgcccgctgggcgcggcggcgggcttcggcgtgccgctgcccatcgaccgggagtacgtggcggcgctgctgggtttctcgcgcgtgcagcgcagccccatcgacgtgcagaacggacgcggccgtcacgagtccgcggtgctgggctgggcctgctcggtggcgggcacgctggagaagtggctgtgggacgtgcagctctacagcatggacgagttcggcttcctcggactgccggacgcgtacaccacgggctcgtccatcatgccgcagaagaagaacccggacgtcgtggagctggcccggggccgctgccgcgagctgcgcggactggcgcatcaggtggaggccgtcgcgggcggactgccctccagctaccaccgcgacttccaactgctgaagtcccccaccctgacggcgctgggctccacgcgggagctgctggacgtgctcacccggttggtgcccgcgctccaggtgaaggcggacgcggcggcgcgtgccagcgacgacacgctgtacgcggcgcaccatgcctatgcgctggtggcccagggacaggccttccgtgacgcctacaagcaggtgggccgcgagctggtggaaggaacgttccgtccagaccgcggcgccctgacggccacccacctgggtggcgccggcaacctgggcctgccccaggcccgggaagagctggccgcctcgcgcgcctggctcgatgagacgcaccgcctggtggccgatgccgccgggcgcgtctggacggtttgaaccgcatccccgcgaggagcgaatcatgagcaacaagaagaacgtggtgctggccttctccggcggactcgataccgctttctgtgccgtctacctgcgagagcagggctacgacgtcaccaccgtcacggtggacaccggcggcttcccgcccgagcagttggagcgcatcgccgcgctgtccaagcagttgggcgcggtggagcacgtgacggtggacgcgcgcgagacgctcttccagggctacctgcgctacctcatcgcgggcaacgtgctgcgcggccaggtctaccccctgagcgtgtccgcggagcgcgcgtgccaggcggcggaggtcgtccgcgtggcgcgcgagaagggcacccaggcgctggcgcacggcagcacgggcgcgggaaatgaccaggtgcgcttcgacgtggccttccgctcgctggcgccggagctggagctgctcacgcccatccgcacgctgtccctgagccggcagcaggagctgacctacctggccgagcgcggcgtccacatgccgccgaagctgggctcctactccgtcaacgagggcatgtggggcacctccgtgggcggcgccgagacgctggactcctggaaggcgctgcccgaggcggccttccccggcggcgagctgtcgcaggacctcaagccccgtcccctcacggtgtccttcgagaagggcgtcccggtggcgctggacggcgagaagctgggccccgtgaagctggtggaagcgctcaacgcgctggggcgcaccta

SEQ ID NO: 1174 - DNA, 18848 bp, Myxococcus xanthus
ccaccgggaggacgagcgcaagacgggcctcggtgtcgcgctctcccagtcgagaggccagcgcgcccgcgtgctcggccgcgcccgaacggccgacctccagcgccgcgcgctccagcattcgcggctccgccttctccatgcgctgcacccagcagcccgcgttgcccccgcacgcctgcgcggcctccagcagcttggactggcccgcaatctggtccgcgcgctgcttgcccagcgcggccgcgtcatcgcagccttcgtcctccgcctgcttgcagtccgccgccgtccgcgccggctcggccgcggcgagcttctgcaacaagggcagctcgcgcgcgtcgcccagcatggcgatgcccttcaccgccaactcgcgcgcgtaccagtctccggtgcccgcggccttctccagcgcgggcagtgcgtcgcgtccgcccaggcgcaccagggcgctcacgtaggaatccctcacggtggcgtccgtctccgacacgagcccggccagtggcttcaccgcctcctgtgcgcgcatgcgcgccagcgcgtccgcggcctgcatccgcaccagcgcctgaatctgcgggtccgtgttggtgaaggccagttgcttcaacagcgtggccaccgcccgcttctcccgcaggtcgcccagcaccgtcgccgccttcatcgcgtagctggccgggttgacgccgttcgaccgcgcccacttcagcaggtccgcgtcctggccctccaacgcctgaagcagcgcgtccgccgcgggcgcgcccagttggtacagcgcgaaggagctctccacgtagaaggacttgcccttgcgctccttggtcagcatccgcaccagcgcgggcgccgcgcggccgtcaccgatgtcacccagggcctcaatggccttcttgttgaggaagggctccacggtgtcgtccgtggccagggtgatgagcggctccaccgcttccttcgccttcatgtcgcccagcacctgcaccgcctcgatgcgcgtgtagttgtccttcgcgcgcagcagcggcaccagcgcggggatggcgcggcggtcaccaatggcccccagcgtcgcgacaatggccttgttcgccaactgcgcgggcatgtcgcccgccgccgggtccagggccttcgtcagcggctccaccgaagaggcatgcttcaagtctcccaacgcgcgggccagcgcggcgcgcacctccggcttgcgctcggtgccgagctgcccgtggagcatgggcaggaaacgctcgtccatcttcccggacgaacgcatggcctccaccatgcggatgcggtcctccgctctgcggctctgctgaatgcctgactcccagtactccggggtcgctgggtcccccttgcacccagccaacatcaggaacgagagcgcaatacacaacgcggtcagagagcgggtcatgcggtctccattgcgtctgcgaggttgtcctgtcttccgtgtaaacctcgcgcgaggaaggaagcaaaccgccccaggcacctggggtacgctggtcaacgacatgtccgatggcaatcaaaagacggtgcgcccgagccacgtccgccggacgtacatcctggaccggcctttccagctcaaatacatcctgctgttggcggggattggtgccggcagcatcctcgtgttcggactgttggcgcaccgcgtccacgtgtcgtccacggccctgggactggacggcgggcagacgctgctgtggctgacggcggtgggcgcgctgggcacggcggtggcgatgggtctcttcggcctcgtcttcacccaccgggtggcgggccccgtccacgtcatgagcctgtatgtggcggcgctggcggccggccgctatccccggatgcggccgctgcggcgcggggacgagctcaagcagttcttcgaccgcttcaccgaagcggtgacgcgcatccgggagcgtgaggcggatgaggcctacgcgctggagaccgtgctggaggccctgcgaccggtggccaccacgcccgaggccctggaggcgctgggcaccctgagcgccctgcacacgcgcaaacgtcaggcggtggacactcccaccgggagcaccttcaagtccgtggcctgagtcgcccggcgcaggagaagcgcaacaccatgagcagaccccgcatcgttttcatgggcacccccgagttcgcggtgtcctcactggccgcctgcttcgaactgggagacgtggtggccgtcgtcacccaacccgacaagccgaagggccgcggcaacacggtgacggcgccgccggtgaaggagctggccctgtcgcgcggcgtgcccgtgctccagcccaccaagctgcgtacgccgcccttcgcggaggagctgcgccagtacgcgcccgacgtctgcgtggtgacggcctatggccgcatcctccccaaggatttgctggagctgcccacccacggctgcgtcaacgtgcacggctcgctgctgccgcgcttccggggcgccgcgcccatccagtgggccattgcccacggcgacacggagacgggtgtgtcgctgatggtgatggatgaaggattggacaccggtccggtgttggcgatgaagcgcatggccattgccccggacgagacgagcgcgtcgctgtacccgaagctggccgcgctgggcggcgaggtgctgcgcgagttcctgccggcctacctgagcggggagctgaagccggtgccgcagccttccgagggcatggtgctggcccccatcatcgagaaggaccagggccggttggatttcacgaagcccgcggtggagctggagcggcgcctgcgggccttcacgccgtggcccggggccttcaccacgctgggcggaaagctgctgaaggtccaccgcgcgcaggccaggggtggtagtggggctcccggcacggtgctggcgtccggcccggacggcatcgaggtggcatgcggcgaaggctcgctggtgctgctggacctccagccagaaggcaagcgggtgatgcgcgccgcggacttcctgcaggggcacaagctggcgccgggcagccagcccttcgtcgcgggctgatgggagaacgggtgatggccatatgagactgctggtactgcacggacccaacctgaacctgctgggcgtgcgggatggctcgtccggggggcggctggaggacctggacgcggcgctgcacgcgcgggcggaggagctggggcaggcgctgacggtggtgcagtccaaccacgagggcgacctgctggacacgctcggcgcggagttggaggagctggacggcatcatcatcaacccggccgggctgttcggctcctattgcctgaaggaggggctggaggccgccgggctgcccgccatcgaggtgctgttcaagcccccggcccgcgaatccgtggtgggggaggcctgcgtgctccagattcacggcgggcccggcttcgagccctacctgcaggccctggagaccttcggcagcggcgtcttcacgacggagaagccggagtcgaagaaggccctggggaagaagaaggggagcagctccaagggggcgaaggtcacccccatcaccgtgctcgagcgcgccgcgcgcaaggagggctcgtcggagacggccaggtccctgtcccgcgcggcgaagacggcggggcccacgaagacgctgggccgcaagctggcgcccgtggaggacctgcgcgcggcccgtcaggcgaagacgctggggcgcggcggcggcaaggggctcacccccgcggcggacctgctcacgcgcgcgctggtgcgccagaagatttcagaccggctttcgggccggctctccgcctccgagctggccgcctgggcgcgttcccagtatcaggcggtgcagcgtggcgctccggcggagaatggccaccgtgagctgctggaggagagcctccagagcctcaccctctccaacctgcccgcgacgcggctctcggatgagcagctcgtggacctcttgacccggctcgacgaaggatgaacgcccgcgcactcgccatccaggtcctcgcgcgtgtccgcgcgacggatgcctacctcaacgtcgtattggacacgcagttgtccgagtcgccgccgaaggacccgcgcgacgcggcgctcgtcaccgagctgacctacggcgccacccggcggcagctcgcgctggactacgcgattacccgcttcgccgaccgcaagctggacgcgctggaggacaaggtgctggcggccctccgcatcggcgcctaccagatattccacacccgcgtgccggcccgcgccgcggtggcggagacggtgcaggcgctgaaggaagtggggctgacgcgcgcggcgggcttcaccaacgccatcctccgcaagctggcggccctgcccgcgccgccgctgccgcccgcgtccgacgtggcattgcacctgtcggtgcgggagagccatccccagtggctggtggagcgttggctgcgccagttcggccgcgagcgcgccgaagccatgctggtggccgacaaccaggcgcccgcggtggtggtgcgcgccaacaccgcgaaggtgacgcgcgacgcgctgctcgcccaactccaggagatgggcgtggacgcgaaggcgaccaccgtgtcgccggtgggcatcacgctgccgtccgtgggccgcgtggaggacgtgtacggctacgcggagggcctgtggcaggtgcaggacgaggccgcgcagctcgtgggcgtctacggggcgattccggagacggcgcgcgtgctggacgcgtgcgccgcgccgggcggcaagtcctgccaccaggcgcagtcacatgacgtggtggcggtggatctccacgcgcacaagctgcggaagattgaagcggaggcccggcgcctgggcctgcagccgcgcctgaaggcctacgcgcacgacgccgcggagcccttcccggaggagtggggagagttccacgcgttcctggtggatgcgccgtgttcggggctgggcacgctgcgccgccacccggagctgcgctaccgccgcaaggaggaggacatctcccggctggccacgctccagcggcgcatcctggagaactgccaggatgcggtgccgcccggggggctgctcgtgtacgcggtgtgcaccatggagccgcaggaggggcaggaccaggtggagatgttcctgcgcagccacccggagtggacggccgagccacccgtgctgcccggcctcaagctgccgatgtcccaggcgtacctgcgcacgctgccgggaccggagggcttcgacgggttcttcgccgcgcgcctccggaagctctactgacgctcaggcgttctcggtgggcggcggcacgttggaggcggccttgaacgcctccagcaccgcggcggacgcgcggtccaggtacttgcccttgcggatgagcaggccaatggggcgcgacaccggcccctccgcgaagggcttggcgaccagggagccgcccttcacctcgccctgcgccgtggacatggggaggatggccacgcccaggcccatctccaccgcccgcttgatggtctccacgttgtccatctccatcaccgggttgatgtcgatgctcttctcgcggaagagccggtccagcgccttgcgcgtgggcgcctcgcggtcgaacgcgatgaagggcacgcccgacagcgcggtgaggctcaccttctgcttcgtggcgaaggggtggtcgggggcacagacgaccgacagcttgtcgtcgcggaaggggaggatgtccacgcccgcgcggggctgcggataggcgacgatgccaatctccgccgcgcccagaatcacgtcgtcgtacacctggtcgttgcgccggtagttcaggcgcatgttcaccttggggtgcgacttgagcagttgcttctgcaccgagttcagctcgtgcaaccccaccgagtagatggtggagaccgtggtggtacccgccacctcggtggcctgctcacgaatctcctgctccacttcggcgaagcgggcgaggatttccttgcacccgcggaacagccgctccccggccggcgtcggcgtcacctggcgcgcgctgcgcgacagcagcttctgctcgtaccggttctccagcgcgcgaatctgctggctcaccgcggattgcgtgacgtggttgagctgcgcggcgcgggagaatgagcctgtctcgaccacgtcgcagaacatcttcaaggattcgagctgcataaggtcatctcctaccctcaaatccaatgattaggccagagataattagaatgcctttacttggctgccaaactacctaacccgccaggactgcctccggccactcatcggacgacaggaggattgcggacggggctcaggactgctcgggcccctcgggtggggccggagggcgcgggcggaacaggacgaagagggaggcggcgagcgcggtgagggcgcccccggcgagcaactgggtgcgaccgacctcccgagtggcgtccgtcaacagctggcattcggggccggtgaggccatcgcagctcggggcggcgaagctgttgctcaggcccacggcgagcaggcccaggccgcccaggaggaagccgcccagcaggcccgtcgccgcggagcggcccagggacggccgctggggggaggagggctccggagaggagggcatgcgggctgctatagccgcgagggtggggcgggctcaacggggggcgcggcgggcgcgtatgctgccgggcatgcgaatcctctacggtgtcgtcggcgaaggcatgggccatgcgacgcgctcccgcgtcctcctcgaggaactgacgaaggagcacgaggtccacatcgtcgtctccggccgggcccaggactatctggccaaacgcttccagaacgtgcacggcatctgggggctgacgctcgcgtacgagggcaactcggtgaagaagtggcagacggtgctgcagaacctcacgggcgccgtgaagggctggccacagaacatccgccagtacttcgagctggtggacggcttccgcccggacgtggtggtgagcgacttcgagtcgttcagctacatgttcgcccggaatcaccggctgcccgtcatcagcgtggacaacatgcaggtcatcaaccggtgcaagcacgagccggcgctgctggcgggccacgaggacagcttcgagacgtcgcgcgccatcgtgaaggcgaagctgccgggggccttccactacctggtcaccacgttcttctacccggagctccgcaagcggcgcaccacgttggccccgtcgattctgcgccccgaaatcctggaggcgaagtccgagcccggtgagcacctgctcgtgtaccagacgtcgacgacgaacacggcgctgccggacatcctcaaggccgcgggcatcccctgccgcgtgtacgggctgcgccgtgacatcaccgaggacctggtggacggcaacctcacgtaccggcccttcagtgaaaagggcttcatcgatgacctgcgcaccgcgcggggcgtggtggccagcggcggcttcacgttgatgagcgaggcggtgtacctgcgcaagccggtgctgagcgtgccgctggaggggcagttcgagcaggtcatcaacgcgctgtacctggagcaactggggtacggcatgtacgtgaaggcgctgacggtggacgcggtgaaggagttcctcacgcgcgtgccccgctgccagcaggcgctccagggctacgagcaggacggcaacacgcggatgctggccgccctgcgcgaacagctggccctggcctacgagcaccgtggccactgggccatggagcgggcgcaggactagcgcccgcgttcgccgccggggggccgtcagtgcagcggcacttcggcctcgttgttgcgctcggccgcgcgccgcgtcagctcggtgagccaggactgggtcagcggcgtttcgctctggctgccgctgtagcggtcctggctgctgtcctggggcatgaatcggttggcccaggaggtgagggtggccgtcaggttgggggccagcgtgcggcccacggcggccagcttcgccggtgcgcccagcagcgcctcggcgtcaccccgccggcacgcgtccagaatcttgcgcgcggcctgttcggcgctcagtgaggtgaggggcagggagtccccggtggcgaaccacgcgtactccgcctcgtggttgcccttgaagtacgcgttgcgtgggctgcccgtgcgcatcagccccgggcacaccgtggtgacgacgatgccgtcctggcgcaactccgcgcgaaggccgtccgacaggcccaccagcgcgaacttgctggccgaatacggtaccaggtgggggatgctcacctttccgcccacggaggcgatgttgacgatgcgcccctttccgcgccgcttcatctccggcagcacggccagcgtggtgtacagcggcgcccacaggtgtgtgtcgatggcttcctggaagtcctccagcgtcatggactccagtggccccacctggatgacgccggcgttgttgatgagcacgtccaccgtgccccagcgctcgtggatggcggagaccatggcctccacctgcaccggatctcgcacgtcgcaggggatggcgtagacctcgccgccagtgcgctccagctcctcgcgggcccgctccagcgtctgctcgtcccggccgcagatggccacccgggcctcttccttcaggagctgtcgcgccagcaccaggcccaggccgcgagagccgccagtgatgaggacggtgctgtccttgaattggaatcgggagcggaggatgcggcgcagtcccagcgccgcgccgatgccggccgcggccacggtgccgagcgagatgcgggacgagtcagaatccttgcggtgagctggcatggtggactcctggagtcagggggcgggagagggggccgcggcgctggcctggatgaagcgctccagcacctgccgcacgtggggggacgcgttctttccggagaagtggtggcgcagccggccggagtccgcgtcgaacacgagccacgcgggcgtgtccgccacgtcgtaggcccgcgccatggagccgtcgtccacggcgatggggtggtagagcccgtgctttcgcgcgaaggcctcccccgcgttgggtgtccccgcaactccttgtcggagtgggtgacatccacgctgatgaccttcagcccccgcgcaccgtactccgcgatgatgcgcttcaccgcgtcgatgtcctcgtcagcaccgcgctgcttgacggagaagaagtggaggaggacggggagctcatccagctccgagacatggacgggcgtgttgatccacccaccgtccgggtccagcagggtgatgggaatgtcgagcgtgggcataggggctccaacaagacctgggttcggaaaggacgcgactcaagctaggcacgcgtggccgcttccgggcgtcgctggacggcaggtcgcgaagcaggcagacactcacggcatgcgcatccccgacttcaagctggagcggtacttcgcgcgctgggagttcgcggcgccgtacctgctgtgttcctcggacatcgagggctggcggatggcggacttgctggcgctcgccggcccggacgagcgggcccgctgggaggggctgacgctgggctacaccgaatccaccggcctgcccgcgctgcgcgaggagattgccgccctgtaccccgggctctccccggagcaggtgctcaccttcgccggcgcggaggaggcgctcttcgtcctggtcaacgtcctgctgggccccggggaccacgccgtcgtcacctggccgggctaccagtccctgcacgaggtggcacgcgccacgggcgcggacgtgacactgctgcgcctgcgcgaggaggacggatgggcattggatttggatgcgctgcgccgcgcgctgacgccccggacgcggctgctgctggtgaacttcccccacaaccccacgggcgcgttgttggaccgggccgccttcgacgcgctgtgcgaactgtcgcgcgagcgtggcatccacctgctgtccgatgaggtgtaccggttgctggagtacgacacgcgcgacacgttgccgcccgcggccagccacacgccgcacggcatcagcctgggggtgatgtccaaggccttcggactggcggggctgcgcgtggggtggctggcctgccgtgacgtggagctcttgcggcgctgcgcggcctacaaggactacacgaccatctgcaacagcgcgcccagcgaggtgctgtcactcatcgcgctgcgcgcgaaggcgcgggtgctggcgcgcagccgggagttgctcgcggcgaacctctccctgttggatggcttcttcgcgcggcacccggacactttccagtgggtgcgcccgcgcgcgggcagcgtggcttttcccaggctgctgcgtgagacgcccgtggcccgcttcaccgaggaattgcgcgagcgcgaaggcgtgctgctgctgcccggagacgtctacgacttccccggcaaccacttccgcctggggctgggccgcacgaatctgcccgacgcgctggaacgattggagcgctacgtggtcgacacatcgcgttgacgcggctgtctcgagtgtcacctccccgcgggaatccacggggtgatgcgttgcgtcagtcctcgcgcgcacttcaaggtttccgtgacctcgaccttttacacatcgcgcctctacagtacgccccgccgcctggtcccccgccgggcaggtaccccctatgcagcgctggaggcgctcaacatgaagaagttcttcggtacggtcattgtcgccgcaacgatgctggcgggcacggaggctgccgcagccaactacacactgtggattcatggccgcaacggcggcacgacgcagcccggcaactacaatgacttcagttactggggctcggcgagcgtcgaggcgggcgtgaacaagaaggccgtcaactgggacggccgtcagcgcatcggctcgcagaactaccgcatccgcgacgcgctggactgcttctgcacgggggacaactggtgctacgtcgccgcgcacagcgcggggaacctccagattggctacgcgctgtcgatgtatggcggctcgcagcgcgaggtgaagaacgcgtcccccagcgccagcggcgtgtgtggcaacgtgagcagcggcgcgaagcagacgggctggaacatccgctgggtgaacgtggcgtcgggcgcgggcggtggcagcgagctggccgacattggcgagtgggcgatgaatgagccgctggtgagcgacctggtcaccaccaccgcgcgcgccatgtacaaccacaacaccacgcgcaacgtgtggttctacatgttcgcgggtgccaagggcacgctgtactccggcgtgctccccggccaggacgatgaggcggtgtcgtaccactcgacgggaggcgtgtcgggcagcgcgggcagctcgcagtgcaaccctggtgactggttctgtggcggcaccctgaacctgggcacggccgcgaccagcgacgggcgcgcgaagtggagctaccacacggtggagttgcgtgacgaccgggaggcgtacaaccactacgccggaggcaactggggtggcatcatcgcgccggtccgccaggacgtggtcaattacgcgtactgagccccctccattgcaagaagcgacatgactccgactggcaccgtttccgctcccgcgtcccggatgcgccgcgccctgtgggccatccccctcattccgttggtgctggggggcgtggggtggtggtggatggaagcaggtgccggcccggagtcctccggcgaggacggcgcatgggaagcgtcctcgccgtctggaatgccgaaccccgcgccgcggaagtcgggaggcggcatgggcaggccgacggggagcgtgccacgagtggccgtgcaggacccggctcgcagcccggaggaagcggagcgtgacgcgcggcgccagttgtgggagcagcggctggcgcgcgcgaagcagatgctggagtcgtacatgaaggcgacgcgctatccgccggagtcgcgtcccgccagtgagcacccggaccagatggagatggcggagccggagcgcacgcgtccgctgaacaaggacggctccgacatccagctccggctgaagcaggaccgcgtcttcgtcgtcggcgacgaggtggtgcacttcttcgtcggctgcgaggacgcgcgccgcatgcccaggccctgccaggtggtgtccgcctccgcgcacgaggccgagcacatgcccggcgcggggggcatgccggcggtccccctccacttctccgacgacggcgccgcgggcgacgcgctctccggagacggcaccttcaccgggcgcttccagccgtcgaagcaggggttccccatctattcgggcacgctgcgcgtggacgtgcaggtgcgctcgggaggcgaggagggcaccgcgttcttcgacatcatgtacacgccgtcgcctccggcgctcttcacgggccgggtgcgggaggtgctggagcaaggctcgcttcagctctacctcgggattcaggtccagaaggccggacggtacgtggtggcgggccgcgtggatgacgagagcggcatgcccttcgcgcacgtgtccttcaacgaggagctcaagcgcggcgagcaggaggtgaagctcaccatcgctggcaacctggtgctggacgaagtgcccaccttccccctgaagctgcgcgacgtggagggcttcctcctcaaggagcggggagacccggatcgcgagctgatgacgagcttgcgcgggtacgtgcacaccacgagtgactatccccccacgtccttctccgccgcggagtggcagagtccggagcggcggcgctatctggacgagctgaaccgggaggtcatcgaggcgcagacatacctcgacggcatcgaccaggaagaagcaccgcccaggccgtgaggggctcaggcccgcggattctcgggcgcgggtgcctcggtgatgctggggttcgcctcgggccgcagctccggctccaacgcctccgcgaccacttccacgccctgtgaagcgaaggccgctgccaccggcgcgctggctgccgcggggttggcggagatggagcccaggacgcctgccacggcggcatcgtccagggacggctcctccggcagcagcatgttcaagtcattcgggtccgcgaggaactcgtccggtcccgcggggctgaccgccgggtccagcgcttgcctcacggcgaactgctgcccgtaggtggccgcgtaggcgctgcccagcgcgtagcccgcgggcgcatcatccacgcgcgcgtcaccggccgcggccgtcatcatgtcggcgggaacggcatcgatgcccgcggcctcggtcgcgaagttcaccggtgcgccggagcgagcggcggcgaggctcggctgctggatttccgtggtgtcggagctggccgctgaagcgtcatcggctccagccatgaagagcgcgtcttccgcggcgtgcagtcgcggggcttcctcgaagatgtcctcgagtcccagctccagcggcggctccaggtcggccgcggcgccggggccattcagcatgaacagcacgtcctccgcttccatgggcgtgggcgcggtggaggtgtcccggttctgcaactcccacgcggcggcctctggcgagagcaggtcgctgcccatgtcctgggcgctggcccctcggaaggagggccggtgcgccgcgccactcaccggctcccggggcgcgccgagcgcggcgggaagctgcgagcccagcaactgcgaataccgcggcggagccgcttcgaaggagctctcgccggcgaacacgcgcaggtgttcgggcgcttccgcattcgcggcgtccacgcccgccagcattggcgcatgcgcggcgagcgacgtgtccaggtcatccacctccgcctggaactcgctctcgtcggcatagccacgccgcaccgcggggatcggctgcagcggctcgcggggcgcgagcggtgccaccgactccaggctggtgtcgagccgggcgcgggagatggcgctggagatgctcgcggtgatgcggcggatggacgacatcaagggctccctgcggcgcacactccgggccgcatcggaattgtcgcctcgtcactggagaagttgccagggaacaggtccgggcatgccgggttcctcgtttcgttgtcatggcattcgcgcaccctgacgggagcgtcctggcggacaagcgccccctcagggaacggggcccaggtgccaggtggaggtgtggggtcgtgaccccacgctctgggggctgttgacgggtggagggcacttgcagcgtctgccagtggacgggggaggggtggttgtcacggcgccgtggcggtcccttcccaggaatccccagaaccggagtatccgttccttgcgtccgttggggggaagggcgctggcctcccgcttgctggtgggaggcccgaggaggcagtcatgagaatggacagcgcgggacagacccacatcggtcggcggccgcacaacgaggatgcgttctgcgtcgcaccggagctggggctgttcgtcgtggcggatgggctgggcggacaagaggggggagaagtcgccagccggtgtgtcgtggacaccttcgtgggctttggcctgcgcctgggacaggaccgggattcgacgtggcccacggtgccggaccctcgccgcagccgtgaagagaacctgttggcggcgtgctcggcgctggcgcagcgcaacctccaggcgcagcgcgtgggccggctgcgggagatggcgtccaccgtcgtggcgttggcggtgagcgagcacggcgcggcggtggcgcacgtgggtgacagccgcttgtaccggctgcgtggcggaaagctggagtcgctcacgcgcgaccactcgctcatcgaggaactgcgggacgcgggcatggagccgccgggaggctcgggcaacttgcgccacctcatcacccgcgcgctgggcactgagaatgcggagcccaccgtgcagcggctccagacggagccgggtgatgtgttcctgctgtgctcggacgggctctatgagccgctgggcgtggagggcctgatgaagcgcctgacgatgtcctccgcgcgcgaggtctgtgacgcgctggtcgcggacgcctacgaggcgggcggcaaggacaacatcaccgcggtggtgctgcgcgtcgcggaagcgtgaggcgcgtcagaagcccacgccgaaggagaggctggcggacggcagccacgtgttcccgggctggatgagctcgggagcgtggggcatccacgccaggctgaagttgaagtcgcccaccagctcgaagcccgcggccagcgggcggaggaagcgcagcccgagtcccgcctcgggccctgccgtggccacgcggcgtcggtcggtccccttgaactggaacccagggtcgtcgcggcctacctgggcctccgcgaagcccccggcgaggaagggctggaaggtgccccagcgctccacgtcgaagctggccagccgcagcttggcgcggaagtgtgccacctccggctcggggtcgctgtgcaggaagccgctccccgtgccacagctctccacggacaggaacgccacgggggacaactccagacacaggtcgggtcggccattgccgttcgccgtggagccacccacgcgcaggttgccgaagttgcgcgtcgtgcgaggcggctcggccttcgcgcgcgcctctccggcggcctcctccgcgcgaagtccgctgggcgtgagggcaagcagggtcagtgccgctggaatggaggttgagcgcatgccacgcacgcaatcgcgccgcttccacaccggtcaatgcaacgccagggtgagtgtccatggccccgcgcgcgtcgacgccgaggacgtaggtgcacgacatcggtgtaggtctcgatttgtgtcatgcgagacaggctgccgggtcattcctgccacctgttgttcctcgctcaacagctgggcgctgtcgcggtaggctggccgtcccccactgggctccccccgcccatcccctggccttgtagcgaatgacgcacagccttgccgcgcgcctgaccgcagcgctctcccttgtcatcctctgtctctccacgctgagcgtcgcgctcacgggcgtgtcgcttcggacgtggtcgcacgaagccgtcacgtcccgtctggcgcaagacgaagccgcgtggagccgcgttctgtcccaggaggtgcgctcgctgacggccctggcccgcgtcgccgcggctggcacgcccttgctagccgtgttgtcgagcggctccgggggcggggcgcatctcgagccctcgctgcgtgcgcagcagtcgctgctgggcgtggacctgctgctcgcggtggacaccgcggcgggtgtgcgcgtgggcacgccacccggtgcactgtcggggatggaggccctggtgaaggagggcggcgcgcgcatcatcctggtggatgaggtgccccatcaggctgtggcgcagcccgtgatgacggccgagggccgcaccgtggggtacgtggtgctggggcgggtcctgggagaggtggagcttcaggcgctgcgtgacgagcgcggtgtggagggcgtgttgaccgtgggcgggaagccggtggcgcacgcgctgagcgtggtgcctgatgatgccttgctcgcggcactggaggggaaggggcggccggacgaggtgtcggtgaatggcgtgtcgttgcggctgcgccgggtggagatggggccgggcgtggagctgctgctcacgcgtgacggtgggaaggaagcggagcagttccgtgcgtcgatgctgctcgtggtgctgctgggcctcatcgtcacggcggcggcgggcacggccatcttcctgctggtgcggcggatgatggagcctctgcgcgagctgaccgtggccaccacgcggatggtgtcggagggtgatttccgaggggcgctggcggtgcgctcgaaggatgagattggtcagctcgccagttcgttctcggagttgatgtcgcagctgcgcgagctgttgatggcgctgcgccattcggccgagcagctcgaaacggcgtccacgcacctcaccgagtccgcgtccgtccagaacgaggcggtgtcgcagcaggcggtggcgctgcatgagacgcaggttgcggcgcagcagctccaggaagcctcgcgcgcggcggcgcggcgcgtggaggtcatcctgcgggaggcggacaaggccagtggctttggcgaggcgggcgaggccgcggtgtccggcagcgtgggtgggctcacgcacatccggtcgcatgtggagcagattggccgcaccgtcgcggagctgcaccagcgcacgcggcaggtgggtgacatcacccgcacggtgaaggacctggcggaccagtcgaacgtgctggcgctcaatgcttccatcgaggcggcgcgcgcgggagtgcacggcaagggcttcgcggtggtggccacggagatgcggcggctcgcgcagcagtccgtccgggcggcggggcaggtgagcggcatcctggacaccgcgcaccagtcgatccagcacgtcgtggagctctccctggtgggggcggagcggatggcgcgggacatcgaggtggtgcgcgcgtcgggagagcgcctgcgggggctgtccaccgtgctgcgcaccagcacggagggcgtgcagcagatttcagtggcggtggcgcgacaggccgcgggcgtggcgcggatctccggcgcggtggatgagctgtccgcgatgatgaaacagacgctggggcgtgtcgaacagacgaccaccgccgcccagacgcttcgcgtggtgacgggccgtgtccatggcgtcatcgacacctatcaaggcaccaggacggatgaggtgccgccagcgaacgatgcgggccgggtgattgcgttcagacgggacgcttaagcgggcgtccgccgcgtgtgaggttgccggccggggcgcgcggtgtcgccgcgccccggagcccgctccttcgcctcagtgtccgtcgagcatggactccagccggtcctgaagtccgaggtgggcggctgcactcaccagcatccgccgctccttgcggtcgatgcggccgtccaccagcgccatctccacgatgttgcgcaggaacacctccgcttcggggctgcccttctccacgaggcggtcgaagagctgtggccccatgctcagcgccagctccacgttgtcccacaccacgccccagcgctccgagcacagcttcagcagcttgcgctccgcggacgtcacctcgccgtcggcggcggcgatggcggccatcatgtacagcaggcgctgccgctcctggacgtccatcaccgcgtcctcgggctgcggcgtgtggtcatggccacccatgcgctgttgcggcgcggactggcgtggagggagggcccggaaccgcgcgtcctcggccgcgttccacgcctcgaacgtgcgcgccgccgcgagcacccaatcccgctcaccggtggccagcggcgtgccgcagtattcgcagtccgtggcggcgctgttcgtcagcggcgcgttgcactgtgggcaccggttcgtggacatgccgttggcggtattcgtctgcgcgccgtgcttgcgcgtcagcgtgaagatgtagcgctggggcacggtgggcagggagcggg

SEQ ID NO: 1175 - DNA, 19269 bp, Myxococcus xanthus
accgccatggccatcggccagctcgttcccctgctcaacacgctcgcccacggaaccacgcggtggcagttcgcgggcatggcctccgccacgctgcgactggagcgcctccagcacaaggagtacatggccgcgctcaaccgcttccctgccaccgtcaaacagggcctggcgaggctcgaggcggaccccagactcctgagcgtgccgatgaccaccctggccgcgtcctaccggatgcccgacatcggggcctacgtgatgacgctcaccgccgcggcctacgccacgttcgtgacggagctgaagaagctgctggatgaaggtgtgtcgctcgacgaggcgttcctggcgctgcggagctgagagatgattaccaagccgattgcggatccgctggccaacgagcatgtgctccgcgtggagccacgcatggcgcccttcggcgtggacgccgagtggaggaggagggcccacttcttcacgggacgcgccgtgtcggcggacgcgctcgcgctggaacaggaacatcgcgcggggaggctcgcgctcctgggccagcacctcacgccgggcatcgtcgccgggctggaggttcatctggagcgggcgggcacgcagaccttcattcatgtccggcccggcagcggcatcgccgtgacaggcgaggacgtcatcgtccgccggcagctccgcgccccgctgggagcgattcccctcttcccaggacaccgggacccttccacgttctccctggaggcactcgccaacgaggagccccccgtggacccgctgccatttcccaaagccgcggtgctggtgctggtccccaccacgtccgtgttgacgccaccggcctcgcagaccgacgcctgcgaggtggacccggagtcccatgcattcgaggacgcggtgcgcacggagggcgcggcgctggtgctctggggctggcccgagggctggtacatgccgcaggactactcgctgcgctggcgcagccggctggtgtacagcctcttcgaacgggaacgccgtcgccggggtggactgctcgccccctgggagcacgcgggcgttccacttggactgttgggcttcgggcagggtccggacggtccggaggcgttgttcgtcgaccggcatgcggtggcgcgggcgggtggactgccacgcgcgcgcacgccgttgctgaagtcccgcggctcgcccgtgctgtggcaggcgcgcatcctccagttcaacgaccacctggcggagcttcccccggagcggctcgcccaggacaaggccatcctctacttccgccgcctgccgcccgtgggcgtgctgcctccggacgccgtggactaccgcgcctggacgcggcgcttcttccccgaccggttcgagctggaggcggtccccattccactggagcagctcgacacggtggcgatggccagcgcggccctggagccgctggacatcacccgcgaggagcgcgttcgcatcctcgtccccgtgcctggcgccgtctatgagccggggctgctgcacgacgcaccgctggaccccgccttcctcgccgccatcgaagaaggacttcagcgcctgggcggatggctgaaacggcgcatcgtcgtgcgcgcccggatgagcaccctcaaggacaacctgtacggcgccaccggcaagcactatcccctggtggacccggaagccgacccggacgaggcgcgctacatccccgccgccgacccgatgaatcccaccgaagaggactacggcacgtcgggtgagacggtgccctcggccgaggcctacctgcagaaccacttcgagccgtcctgggggttggccgtcgatgcgcgctccgatttgctgcctcggccccagggagacccgacgccccggctggagttcgcaggacagctcacctccgcgcccgtggtcatctccaccgaggaccgggcgcatgtgttgttccggggaccgttctggacgctgggctaccggaccttcgatggccgggcgtggagcaaggtgacgcccgtgctccagggcaaggtcaggtcacgctccgtgcccgtcgcggcgatgtggccgcgcgggcggctggacgtctacttccgggacgaccagggcaacctgcacaacacctacctggacacccgggtcagcaatcagccctggagcagccctcgcatcctggcgagcgacgtcatgggagacgccgccgcggtgtctccctccgagggacgcacggacgtcttctaccaggccctccgagggcaggtcctctcgctctggtggatgaccgtcaccgcctcgcgcgtcatccggccgaagccctttgagacgccgctcgcgttcaagggcgagcccatctcggcggtggtgtcgcgtggccagctcatggccttcctcctggacgcccagcgcaacatccagcaggtcaccgtctccccggaccccacgcacggcgcggtggtctggacgaaccactcgctgggacgggaggtccgctggctcaaggcctgcgcctcaccggatgacggcaccgtggatctggtcgtgctcacgggcagctccctgctgcaccggcgattcaacggtttggtgtggagcgagtggaaggacctgggcaacagccattcactcaccgccgcgctgtccgcgccaggcaagggcgtgctggatgtcctgtcccgagcggtcaacggacgcatccggtacgcccgattcgatggcaccacctggacgccctggaagacgctcggcaccgaggtggcacgctccgcgcccgcggccatccggcgcggcgaccaactcgatgtgattgtcagggcgcgtgagaacctcctgtggcatcggccggtgcgctcgcccctccacaccacccagcgaaccctgggcctgcgtgggctgatgcgcgacctgtccaaccggatccagcaagtcgacgaggccgtggacgccgccttccttcaggtccagtcggaaatccatcgcgtccgccagctcatgctgggcagcaccacctccgccgtgatgacggcgtctcccgtactgaccgacgtcgcgcaggccgagacgcgtgtcgccacgttgacggacgtggagaagttcatcggggtcctgaacgcgaagcgcaaggtgagctggtccacggtccgctacctggatcaaaccaacctccgggaccggctcctcaaggtatcgcccgtcatcggcacgcttcactcggcgatggccatcaagcgagaggtgctcgggaagctgttcacgctgctctccggcatggagttcaacctcgaggccgtgcaggtccccaacgtgaaggtccccccgtggcgacggtcacgtgtgcctccggtggacggacagccaccgcccatccccaccccggagccgggcatcgacattccgttgagcgagctgcgtgccctgaccgcggaggattggaaccaggtgttcaccggttacgtggcgcccaaggtgcccacgcgggcggaagaggccacctacttctccatgtccgtggcccagctcgaagacgtgctggccgtgctgcggaacctcgaggaccgtgtcatgcaataccgggaggccctggaggaaggcgggcgcctggtgagcgtgctccgggcccatgaggcacgaggaggcgagcgcctgacagtgattggcacggaagtctccgagtcccgccaggacgtcatggtggctcgcgcactcctggccgaggagcagacccggctgcaacgcatcaacgaacgacgcgccctggtgctgcgcgagcacgttcgcttcctcgtctaccaccggccgagagagcaggtcctggaccgcgccacgcccgtccgcgcgttggacaccggtatctacgagtcggagctgcccgcggcgctcgcggagacacgcgccgcgcctccagaactctgggccctcatccagctcctgcgagacgccccgctggactggttcgcgcaggggccatcgctgttccagcgcctggaccggctggacctcgtccaccggaccctggaaggcgcacggcagcgcgccacggtgcgcgttcctcccgccctcccccagatcacccgcgcgcccagccgctcgggtgaaggcgtgaaccgtgtcttcaccgcgcagagccaggttgtctcccaggccagggtcgtcaccgcgacgctggagctggccagcctcgtccaccgcggctgggcagagctggtgaagattgcgttgcccatcacctcgttcggcgacctgatggacaccgcgcacgggcggccggacgtcgcacgagccgcggcccgtgagctggaaaacaccgccaaagtggccacgtacctctacttcctcttcggcgaggtgcctccacgcgtccgaatggaatgggcgtcgatgctcagcgagtatgacgcgccgtgggacctgagggacctggcccggctgccccagtggaacacgctggaggtcacgagccggcgccagcttcaagagctggtggactggctcttcgcgcagatgaacccgtcacgcacccaggccgtggcgctgatgaacgacctggtgcgctcggcgctgctgctcgcgagccacgcccccgtgggagaaatcgtcgccgggcacctgccgaagccagcccccgccagggtgggaacggtgctggacctgcaagtggacccatcgcgcatccgcgtgggcacccatgtgctgctcgcatccggcgttcacacggtccaggccgtggtggaggacctgggcaccggcacggcacgggcgcgcgtcttctccacgagcgcggccagcgtgaacctcgcggagaagacggtggcgaagttctccgagcccgagcagcgaggcggcctgctcccgacgccgcggcggacactgctccggtgaccgcggaacggcgagtgcgccaggtgaagctcgcggcggccagcaccgcgctcgtccggagaggggcggtcctcctggaggatgcactgcgcaccgcatcccttccggatgctcccggaggccgggtgctggtcatccgccagttgtcgctcggaacgattcacgcggaccgcagcccggccgcgctctcgctcgtcgtggagcaacgcgtgcgcgaggtggcgcggctcgcggtgcatgcgaggtcgcagtccgccgccaccgcgcaggcggtctacttccgggatgaactggaacccttcgtgctgctggccacccggcttgcccaagggctgcccctggacgcctggttctggcggttggccgttcctggactgcactcggggatgtcccgagacgacgcgctccgcctcgcgctcgccagcgccttgcggacgaagccgggccatgccgccgcggtgacgctcgtctccgaactgcacgcgctcggtgcactggcccccctgttgggcgcgctgcgatggcaggatggacccgcgctcgcccgagcctggtggggacacctgccgtcccgcccggcgccgcggctgcccctggatgacgtaggcccgacggagcaggtctccgaaccgctccagagtaccctcgcgggctgggcacgaacctggggggccggcgacgcccgtgccttgtggctggctgcggtggcgctctgcacgcacatgccatcccgggtagctgcgcccaatctcccatcgcgggcatggcgggtgctgggagcgctccaggcttccccgacgccgcacctgcccacgtcacgggaatcgcccgaacaagcccctccgaagccggacacgcccactgcccccgctgacacgggcgtggttccgggcatcgcagcgtcgtcgcatccatcggtgcgggcgctttccggcgccccttcttccgacaacgtgacgaagcccctggatgccacacccgcgtcccggtcgggggtgactgcggctccgcagccgagggcacgccccgcgcccgcggacacggacgaggcacctagagacactggaaccacgcctcaggatgctcgccagcgcgacgtgacggaggaagcgctccccacagtcgcagggggactcctcttcctcgtgcccatgctgaatgcactgggcctcggggagttcctggcgggccacccggcactcgccgaccttggaatcccggagcgcctcctctgtcacgtcgccgagcgcctgggtgttccttcgacggacccattgttccgcgtgctccaggaggccacagcagggccgttgcccgagcccagccccttcgtcctccctgttcgcttccaggcaggcgtcggcgcgcgagcaccgttccgtctcgtccgcgaacccacgggacgctgcgttgccttcgatgcacgaacccgggtaccgctcgcctcgacgtctcacggggaagcgctgcccccacccttcgaccgatgcctcacgacgcccctggcacatcggctcccctgggatgacgccaacctcatgctgcgcgcggccctcctcgcggtgggccgcgtcacgcgacggctggcacacatgggactgcgagcgctcgtcctccgtcccggctgcctcgtcgcgacccgcacgcatctggacatcgtcttcgccgcctcgctggcggacatccgcatccgccgcgcggggctcgacatcaatccgggctgggttccctggctcgcccgcgtcatccagtaccactaccaatacgacgagaccggagaatgacgacgtcgtccctgccccttcgcaccacggtcctcgcggcattggccctcacacaagaggactcgggggatggagaagccatcgagctgcgctacctgcgtcagcacctggatgcaacggggcgggactgggtcgctcgcgctcgggagcgcctcacacgtccaggctccgaggatgctggactcgtcatgctcggcgaagtgctcgggctctccctggtggagctcctggcagtggctctggtcgccgccgtcgagcaggacccgatggtgggccgggccgtcgcgtaccttcaagcacccgtggaggcctccagaccaacgctgggactggtttccagcgcactggcgccggccgcttccggaggccaggaggccctgctcctcctcaccgccggagcggccctgggcagcgggctgctgacgcgcctccgggaggaccttccactgtgtgagcaaacgctggccatgccgctgccgctcttcctggcgctgtccgggcacgacgtcacctggcctggggcaacgctcggctcggcccgcctcatggacgcaccgctgcctccctccatcatggatggcgtgcgccggcatgcgcgctttctcgcaggctcgcctcggtcgatgctcgtgctgcgcggcacgtcggtttctgaaacccgcaccgtggcggcggcggtcgccatgacgctcggacgagcccccctcttcctcggagcggagctccagcggggattggggcccttcctgattcagcgagggctgctccccattcatgtccacgacctcgcgcccggcgaacgaaaggtgcttcccaacgtgccgtactacgacggccccgtgctggccatcaccggacccgagggcacgctcgacgcgacggaccgcaccgtgttgcgctggtccgttccacgacctcccagcgaggaacggcgggccctgtgggagtcctcactgggcgcaccgaacctcgccgaggagctggcccgacggcaccgtcagggagcagggcgcattgcccagcttggccggctggcccggcagaaggcggagctggacgggcgaccggcgcccgagctgcaagacgtgctcgcagcggcctgggaggcggaatccgagggcatgggcacactcgcggagcccttgatggacgccataggcgacgacgccatcgtcctcgtgccccaggtgaaacgagaactggagcttctcctggcgcggtgccgtgctcgggacgatctggtccacggcctgggcccctccgcgacggtgcgctatcgcgcgggtgtccgggcactcttcatgggcgcgtcgggcacgggcaagacgctcgccgcgggatggctggccacgaaactcggactgccgctctaccgcgtggatctggcatccgtgacgagcaagtacatcggtgagacggagaagaacctctcgcagctcttcgcgcgggccgagcacgccgacctggtactgctcttcgatgaggcggactcgctcttcgccaagcgcaccgacgtgaaggactcgaacgaccggttcgccaacgcacagacgaactacctgctccaacgaatcgaggccttcgacggcgtggccatcctgaccagcaacagcaagagccggttcgattcagcctttacgcgccgcctcgatgccatcatcgacttcaccctgcccgggcccgccgagcggcgcgcgctctggaccacgcatctgggcatggcgcacgaacttcccgccaaggaattgaaccgactggcggcgacggcggacctggccggagggcagattcgcaacgtggtgctgacggccgcgctcatcgcgcgtgaggcgggccgctccatccaaccaccggacatcatcgaggcgctcgtgcatgagtaccggaagcagggccgcgagcccccctccgagctccgcaccacgcccctgggctccgctgacggcgcccgtgacacatggcgccgctaacgtggcagtccaccccgccccttctgctcatcaccttttcgattctgatttgcgcaccttgtacttcagccagagcatgtcgctcttccgcggctcgcaggagaccagcttgagatgacgggccgggccccttccctcgcccgcatcgaacagagaaggcgttccgatggaaccatccgcgatgggcgccaccaagacactcagctcgtcgatgaggtcctctgccaggaaggagccgttgatcttcccaccgccctccaggagcaaccgcttgatgccgaagtccttacggagcttttcgagcaccctcgtcaagttcagctccgtcttgccgccaaacaggtaagagacgcccttcgactggaggaaggccaggtagtcgtcagagacctgctccgtgagaatggtgatgacgtgctcgtcatcgatggagccaaacttccaggtgagcttgcccgtggggtccagcgcgatggcgtaggactccgcgtcacgcctcgcgatgaagtccgtccttggaatcggctggcctgacttgcgtaccgggaccttcgccttccccgcgtagggttccatcgaaatccgcccaatcatccagccatcggcgtcgaacgtctccgccgtccgctcgtactcggacagggcgcgcgacgagagcttccagttcctcgtgacaatgcgcccatcgatggagggcaccatgtggcaaatcacgtacgggcgcttcgctctgcgcatctgctgtctcctcggactctgggcgcggtcgtcagggtgacgtcttcctgacgagcccctgggaccgcctcaaacggctttccagcggcgggggtgccccatgcctgaatcgtgttcatcgtattgctcctgggagaagggagggattctccggtgaaggacagatcaatacggtccacgtttccagggcactaggcgccgtcgcgccatatgggatttgaagccatgcttgataatcggctaccacgcctacctgttagggactcacgcgatgaagacggcgcttctccctcagcttcagaccttcctcgtggtggcgcgcctgcgcagcttcagcgcggcggctcgcgaactggggctctctgcctctgcggtcagccagtctgtacgccagctcaaagcgcaactcaatgtagtcctgctgacccgcaccacgcggagcgtgtcgctgaccgaagtgggcaggcgcttggtcgagaaggcaggccccgccctgggtcagaccttcgcggccctcaccgaggtctcagcgaatccaggtgagccggtcggccggctccggctgtcggtgccccggaccgcggtgccctttgccatcacgcccgtgctgccgacctttcgcgcacgccacccacgcgtggaggtggaggtcgtcgtcgaggaccgcttcgtggacgtcgtgccgaggcctgggagctggcgcgcggccggcggaactggcgtgtgcccgtgcgcggaggcgtcgtcaccaatgaaagccggctgaccacgattctggcggaggagaacatgggactcgcctattgccttgagtcgacagtggcgaagcagctccggagcgggcggctgaggtgtgtgcttgaggcgtacgcgcccacggtgcctggcttctttctctactaccccagccgtgcgcagcgctccgagccgctgcgcatcttcgtcgagatggcgaaggagctggctgcgcgtgccttcgattagctacaggtcagcacgggcgcgaggggttgaatgacttgctttcgggtcaagaagacggcgaggacgcctgagccagggccctcaggtcgaactccttcactccccggagagtccggtagcgctccgggaaggccgtgaggatgagaatctgcaacgtgtcccccgcgctctcgatgacctccagggcgcgctggtgccgggccgcgtccgtgttcaccagtgcgtcgtcgaggacgacgagctgtggctccggccgcggccctttcttggccagcagctccccgagcgccagcctcaaagcgaacagggtctgctcccgcatcccccacgaaaagccctccagcggccaggggccccccgccgtctgcaaccgtgcctcgctgaactctgcgtccagcaagagttgctcgagccgccctcctccacggatatacgcaaggcgggagtggagctcctgctcgatgggcgccaggaacgtctggttcacttggtcctgccaggcctgggacatcgtgcggaggctctccgcggcccgggcccgtgtctccagtcgctggtacgcggcttccgccagggccagcttctcctccgcctcgcagagccgcgagtacagaccgtccgctgccgcctgctccagcagcgcctgcgcccggatgcgcttctcctggttcttcttctcctcgtctccgatccgctccaacgtgtcctgcagcttcttacgctcgaccgtggcgcgtgcttccagcctgggaagttgcgctcggagccccctgaccatgttctccagacggctcagctccgcctccgcccgctctacctccgcgcccagcccttcgagggacaagcccagggtgttgagctgggtcttcagctccaagcccagcgcctgggccgcagcctgcgcggagctgcgcccctgagtgacgaccttgaggtgctgctctgccttccggagagctccttccacctcctcccgcgccttgtcccgggccttcacctcctgcctgcgggccttgagttcctccgtcagcgccttcagctcgggaaatgggtgggtctgtagctcctcccgcgaaaggttgagctgggcgctcagtgcccccgtcttccgtgcctgctcacgctgctgttccttgagcacctcgacgctctcgactttgttgtcctccaagaactggctccgtgcctcctcgtacttcgacagctcctgaagcacgacctgctgggacgcccactccgcgcgcagacccaccacatcatcgactccgtgctcatggaggcggcgcgccaggtccttccggtgcttctcgacctccgcttcgagcttgccaatctcctcggccgcagtgcgcacgcggacttcacccactcccttgatgcgcagtgcaccagcacgcacccccgagaagaccttctgctcctcccttgtgagcttgtgcggtgtggtgtgaccctgggcctcccactcgatacgctgcgggctctcggcagtgaaggagacctcgaccccctgtgcgtccagcctgtccagggcctgattcagcttgcgctgcacctcctcggcgcgctttacctctgcgtctggaagcgccttcagcgccgcagtcttgcgtcgggcattctccactgcggtctccacccgcgtcccctgcttgacgagcccgtccaacttccgctgctccgccagggaagcgcgcgcatcttcgaggagtcgtcctcgttccacgcgctgctccgccagctccacctccccctgctgagccttgtgtcgctcgcgtgcttcgcgagccccgtcttcggcgcgccggacgagtccctgggcctcctgcaaggccggctcgttgcgagccagcaggtcctcctgctggaccaccttctgctggagcgcgagaagctctcgctgcttctggtccagcgcctgccactcttttcgctgacgctcgacgtccttctcccggagcgccgcctgctgctccagcttctcctcctccgcgatgcgctcctgcaagctagcgagccgctgctcataggtcctccgttcctccgccagggagagctgcttctggccgaggtccatgctctcgctggcaagctgctcgatctccgccaaccgctgagtcaaccgagctgcctcctcgcgcaactcccgcatgcgagcaccctcacgatcgaggtcgcttccggtgacgagctttcccgtcttgggcgtgaagaactggcggtaggccccctccattgccttcaggagggactgttcctcgttgctcagggcggcgactccaaccgtctcaaggaggcgggccttgagcggtgtatcgaggccgggcaggtcgtaccgctcttccgactgattcaaccagagcaaccgagccaagccccagttgcccaccttcgtcacgccgttgccgggcacgctggagacaaggaagcctcggagcaacgcatccgcctcctgcgattcagcgagccgctcgaaccgactccccgtccactcatccaggacgctactggcgtcgtccaggaaagccttctcaagccggtagcgcttcccccccgtctcgaactccagcttcactcgcggagagagcttggtctgccagggacgaagcaggttcatctctcggtccttcgtggagtggcggtcgaacagcgcccttgcgacggccaggatgaggctcgacttacccgtctcattgggcgcatggatgacatggatgcccgttcccagcccttgcaggtccaccgggctccggaagcagcgaaagtgctggacgcaaagcctgcgcaaaatcatttccacacctccatcaccagctctgacagcaactgtctggccgcggtcctgacgggctccggcgtggcacctggtccaactgcggccggtttgttcagcccatccagcaacgaggagaccagactgctcgaacctgcgatgtccgcgaggcgcccctctgccttcgcgcgtggtatgtcctcgcgctcgatgcagacatgaaggagccctcccccctgaagctcctcacggaacgcctccaaccctgatgaggcgtcctcggaagaaaatcccgtcgtgtgaatgcgcagcagcgccctttcggggcgcgccagctgcgccacgagctcccgagcccgagccacctccggctcgtggccctgactcaggtccagctccaccgtcctccaggtcagcgcccctgttgcaatcggctccagccggggcacggcgccccgcgacgagagttccaccagcagtgcctgccccgagcccacctcaccgaacttcgtcgtctcgtgggctcccgagtaggccgtacgaccgtcatggacgtactgcccatgccagtgacccaaggccaggtagtcgaggccagcgcggaccgccgcgtccagtgcgatggggaagtcgtccgcggcgtgcttgccttcgatgcgcagggagccatgcgccacgccgatgcgaatcacgtccaggccggacgccatctcccagccggcggtggggtccttcatacccttcttctggcggagtggcgcggggagcaacacggcatcggtgtgcgggatgggcaccgccgcattcccatccagcacggtgatgtgatccgggcgctgattccaggaggcccggcggaagacggcatccggcgtcagcgcatcgtggttgccgggcaggacgtacacgggcgcgagagagcccgcgagcaccttgatgaccgcatggacgacgcggtcctcgacgacattgtgctcgaagatgtcacccgccaggacgacggcatccaccttcgaccggttggccgcgctgatgacgttgctcgcggcctccagtctcgccttccggacgtcctccgcgacatgagccacatgacgggctcggaggcccatctgccaatccgctgaatgaagaatcctgaccatttaaaggacggtacagatgtgtcgcggagccgcacatacctccagggtggtagtactggcttcatgagatctgacgtggaggggccacgcctatccggcgaggctgacgcagagttcgagcgcgttgaaacacacaggggtcatgtactggctgggacctcgtcgagcatggcgatgagcggcgaggtggcccggcggaagtccgcgccgtagttgagcttggagatgaaccgcgcgctcatcttccgcgcgaagagacacgaagccctcgcatcctccgtccagttgtcgctggagagcacgccgagccgctgcgccccatcatcaaggcggcggaggagctggccatgcgcaccttcgaatagcgacaggccagcacgggcgcaaggggggagcgtctacctctccggaggtactgacagacagtgaccaggaacctattcaggacctgaacgtctatgctgtccatcggtgcatctactggccggggggatgaatggtcgcgtcaattcacttcagctcgcgtgagcgcatgctcatgcgcgatgtcgccgtcgcactcaatggttcgctgcacctgtcagacatgctgggacaagcgagaagattgctgacccagctcgtccccgccgattacacgggtctgtgcatcgtcagccgagggcgaccatcgacatacgagtgggtcgaggaggcaggcgcacccaacgccctgctggcccggtatgccgagctgcaacccgatgacttcgtgctcaaatccgtcgtacgccaacgcgacacggtgctccgggactcggagatgctgccgcgaaaggaactggagaggagcccgctctacctgcgcagctgtgagctgggtctgaaactggagcaggtcttggccacgctcatgacggtccagcatggcatgtactgcggattcaccatgtaccgggaccggcgacgccccttctctcggaaggctcaagcggcattgcagctcctctcccccagctttgcggccgcgatctacaaaagccaccacatggacagcctgctgacgggcgagcgcctcctggacgccatgagtcgacgtcagggcttccagttcctcgtcgtagcgccccccgcgttcgagacgcgtcgctccgagcgcgcgactgcgttggtggagaagtggttcaccaaagacgaacggactcgggcgggacttcccaagccgatgcttgagcacatcaagacgttgtcccaggtagacatcctcatgaggccgcgggagcaccgactgatcttcccgcgcgacgatgagaatctggtggtgatcttcatcgaacttcccgaatcggatgggccgaggcagtgggcgatgcttctgcacgaagttcccaagtccattccgcttccagaagagcttgctcagtatttgagtgcgagggagatgcaaatcgcgtgggggctcctcaggaactggagcccagagttgattgccaaggagttcaacatcactcttcacacggcaaaaactcacgtgcgcaacatctacaaggctctgaactgcgacaaccgggtcgacttcctgtaccaggccgcgcggctcctgcgacctatttgaagcacacggcatggccatcctcccttctgaagtgcccgctgatgaggaaggatggtccggtcaaggggagatgtctctacctctcgagaggtacgtgctctcctcgggtatgtgcgcgtcgaaccgctccagcgtactggagggaatgccatccagagcgccgatgatcggcaacgtgaagcgacaaaagctcgtgtcatagagcggctcggagatgaaccgcgcgcccattcgccgagcaacgagcgcgggcgaccgaggcaaccgcaccgtgtcccactactcttccagggcgcgtgcccgatcctcgggcgtgtagaagggcgtgctcgacacggcaggtgtcacggaatcttcgggagtcctcaccctccagtgggggctcagccagccgtggtgggcaatggcctgctggatgaggcgcgcatccacctccgagtccgtctccagattcgccctggcaagccagtggtgacgccgcgccgccggctctcagcgtagaaggcagcctgcagcagcaccaccgcatcggagtgccgccactgccggtgcacgcagaagcgcgctgcttccgccaccacctgtcctggttcaaccagacccgtcaggtccaagcgatgctccatctcgacgcccagcacgccgccggtcgcggatgccacctcgggattcggcagcagtatccgcacggtcgccacgggcccgtgctccacgtagacgaccaggtggacggtgctcgacaatttgtcgaagccattcacctcccgctgtgtcgggaactcctgtccggccatcaaccgcatctcgcctccgaaaacaacccaacggacgcgaagcgcgtcatccagctcttgctgagtcgtgacaacacggcaggtcatggacggcatggggcccccttcgacgtggtgaaggtccggcatcaagccggcctgcgccacgtgcgaagggctccgcgctgtcgaacggcgtgacctcagtcccgcagcgggccctttgtcggcgcgttccgattcaggttctggggcagcaaccgcttcttctcccactgctccttcaggaccttgtcgagcgcgtcacggatgtcttgcgacaagggctgcgccgccaccgcgctgcaccggttccgggtctccagcgggtcctccgtgaggtcgtaacactcgtactcacgaggaatgaaccgcgccgtggcgacctcgtccgtgttccccgccgcgcccacgaagaagcgcgggttgtccgaatagcaactgtacttccagggcgtgtctcccgtgagctcgggaaggcgggtgaccaccgtctcgatgtgcttgggctggatgacgcccgcgaacgcctggccggtgaggttgttggtcatctggagccctgactcgacgttgtcgtcggtcatgaaatagatgggctcatgccgctcggactcccggcccagcaccagaccggacaggtccctgcccaccagcagctgcgcctccgagtggtcccgtgccagctctcgccgggccgcatccgcgtcgattcccgcgagccccagcagcgtcggcaccaggtccacgtgcgacgtcaccacctccgtcttccggggctccggaaacagccttggatttgaaatgacgcacggcacgtgcagcgtctcctgataggcattgtaccacttctgcatcatgccgccgtgagccccgagcatctcaccatggtcggacgtgaggacgacgatggtgttctctaagaaggaggtctttttgagatgttcgtaaacccgttggctgtgtttactcacctccgccatgaggaagtaatagaactgccggtacgacgcggtatcgcgctgcggcaggtacatgcgcggatacgtgtagacgtagtccttctgacagcgcggcttgctttcgagcgactcacctgccgttggcgaaggggcaacgtccggcagcttccccgcttgcggaagtactcccccaacgtgggaacggtgttgggcgccagccagtacatgtccggatcgaacgaggacttcccgatgccgagcgtctgactcacgccatgaaacgacggacattgccccgtgtagagcgtggtgcggctgggcgcgcaggccgtggaggccgtgtggtgccggaggaactcgatgccatgcttgcggagctcctggccaacctggtcattctcgacacgaagcagacgggcctcttcgttctcgtacggaggcggagatcattcctcgtccgtggtgatgatgaggaagttggggcgcttgccagcaaccgtcatgtcacgacctcctgatggggatcgcaaactgtaacgcagaaggccgtgacgcatgacgacacccgcacgtctttctactgcagcgcgtccatcagcgccgactggagcgtcttccggttctgcgggaagccctgattgggatagggccgagccccgctcaagaactgcacatacttctgatacatcggatcagaacgcgcgggctcctgctgatagaaagcctgggtggcctgtagcagatagcgcggcgtcgtgccctgcggcgcgtccccgctgaaggcgatgaggctgcgcacgtctgggtccttcatgaagtcggtgaaggcgtgggcgtcctcggcacacgtccccgtgcactccgcactgaccaccagcgcatccacgaacaccgcgggcgcggagcccgtgcccagcggaacggagatgacttctggcagcgccatgcccgggctggccttccggacgaagaacaggcgctccgtgtagcccatgaagccgttggcctgccccaaggcgaacgcctcttccgccagggaactatccgcgtaggtgccgtcgaggcatgggttgacgcctgcctccagctcacagctcttcaccacgtcctcgaacgaagccagcgccgacgcgtccagcggcagcgacaacgcctgggacaacacgcccgtgggattcgtgtcggcccacgcgtccaagtaggacgagggcagcgtccagcttccgctgtaattggccgccaacgggcgcatccccggtgccacatccgtgaggatctggaccagggaatcgccatccgtggccgacgacaggtaggggctgttcgagtagacgacgtagctgcacagataggtcggcaccccgtagctctggccagcgatggagacggcttcttccgccgccggatgcgcggcccccgcctccagggcgacgggctgcacccagcccttcgacacgagctcacccatgatgagcgtgtcgatctccaccacctgcgcggcccctgctccaggcccaagaagctggttcagggtgcctccgtcgtccaggtcatagaggtccagcttcgcgtcgaacacgatgtccacgtcgatgtccgaatgctcccgctcgaaat

SEQ ID NO: 1176 - DNA, 16844 bp, Myxococcus xanthus
gctgtgagcggcagggtctccagcgcgaccagggcggcgggcaccatgtgctcgggcagccgctgttggaggaaggcgcgcacgccggccgtatccgctgccgtgtctgcgtgcgggatgacgtaggcggccagccgctggtccccagggaagtcttcgcgcacgatgacgaccgcgtcccgcacggacgcgtgctggcggagggtggcttcgatttcgcccagctcgatgcgatagccgcgcagcttcacctgtccatcacggcgtccgaggaactccagcgtgccgtccggcaggaagcgggcctggtcccccgtgcggtagaggcgctcacccgtccgagggtgcacggtgaacttcttcgagcccgctcccgcgcccacgtagcccagcgccacgcccacgcccgcgcagcacagctcgccgggcacccagatgggacgctcgtccaggtgctcgtccagcacgtagtacttcgtgttcgagatgggctttccgtacggaatgctgcggcgccgctcgtcggcttcgacgaccggatgggagatgttccacagggacgtctccgtcgggccgccgacgctcatcagcttcacgtcgccgaacttcgcccgcagccgtgcgggcatggtgacggggagccaatctcctccgagcatcaccagacgcaacgggcaggtcagccgggcgttgctgccttcgagatacgtcagcagcatctccatcatcgccggcacggtgctccagatggagacgccatgacgggacatcagctcggcccagtgggaggggtccctgcgcgaggaggcgtccggcatgaccagggccgcgcccgcgctcagggtgccgaagacgtcgtagacggagaagtcgtggtggagcgcgctgagcgcgatgacgcggtcttccggcccgacgccgaacttccggttcgtccactccacgccattgaccatcccggcgtgggtgagcatggccccgttgggctggcccgtggagccggaggtgtagaggatgtgcgccaggtcctcgggcttctgcacgggcgccagtggcgcctcgctgtactcactgaaggcgtccggcgtgacgaccagcacctgcaccccttcgggccaggactcctgggcgaacttcggctgcgtcaccgccagctcggccccgccgttccgcatcatgaagacgcgccgctcgtgcggcagccccgcgtcgatgggcaggtacgccgctcccgagctgagaacccccagcgcggccacgacctgctcccaccccttctccatcacaatcgcgacgatgcggttgggcgcggcgccacgctcgcgcagcgcatgtccgagccggctggagcgccgggcgagctcgccatagctcagcctgacgctcgacgaggccagcgccagggcgtccgggcgtgccgcggcgtggcggtagaagcccgtgtggagcagctccccgctccgcgggcgcgccgtgtcgttgacgcgggccagcagttccacctgccggaccggacgggtgtccagcccctgctggtcccacgcggcgtcgtcctccgccaggcgccgtagcagcgcgcagaagctggagaacatgtcttcaatcatgccggacgggaacagctcctccgccacgtcccagttcaggaagacgccgccccgctggtagacaatctgcaggtcgatccacacctggggcgtctgcgtcagcgcctcgatgagctcgccgaactcctccgccaggaagtcgacccagtgcgagtccttgctcttggagtgagacgcgaagctcgtcatcaccaccggcatgatggcgcccgcgatacgcccctgggccctgaacagctcccgcagcagctcgacgccgctgacctcacggtgctccagcgccaggaagagctggtcccggatggcaagggcccgctccgtgaacgtccgctccggccggtggtccacctcaatcagcgtgaagctggcgaaggtgccgacaatctcgttgacctggggatgaaggggcagccggttgaagtgcgggacgttgagcgtgaagcgagggctgcggctccagcgcgccatgacctccgcgtacgccgccagcagcagctccggctccgtcagcttgcgcgcgcgggctcgctgcttgagcggctgccagatatccggccccagccgttcgaacacgcgcccgaaacgaggacgccggagcgaacccgggtccttgtccagcgggaggtccggcgcgggcgggaggttcggaaggcgggagcgccagtactcgagcgaacgcgcatgacgagcaccgcgcgcatgctgcaccgccagcgcgtagtcccggaaggacaggtccagttggggaagcgcgggcgccccgcccaggtgtttgtagaggtggacgagctcccggtagagaatctggaagctgtaaccatcgatgaaggttccatcgatgctcatgaagaggcgcgagcggcccccgtcgagctggcacacgcggagctcgaacaacggccactggtcgagcgccagcacctgctgcgacagccgctcgcggatggcctggaagcgagcctccgtctcctcctgttcgcgcccgcgcaggtcctccacgggcaggacgtagcgcggcacgtcggggaggatgcgctgctggaagcccgggagcgccaccacccgaagcatctcgtggcgggcgatgagcaggttccaggcgtcctcgaagcgggccaggtcgagcgcgtggcagtcaatctcgttgtacgcgtgcatcgccgcgttcatctcgagctcggcctgccggcccacgctgtaggcctgctggatctccgtcatcgggaacggcgcgtgccgctcctcgggccggggcgtgatttgcggcagcgtctccgcctggggcatgcgctgctccgacaacagggtcagcagcgcggccttgttcgccacgagctgctcgcgcagcgctcctggaatctcgcccgtgggcgaatcgaccgccaggcggtccccctccaccgacagcttgatgccgtgcccagcgagggcctgaagaagctcattcaatgtcatagcaggacccgcttcgaatcatcgcgctccgaggaggcagcgccgagcacactggccacagcgagctttccgagaagctcagccgtcacctgctcaatggaactttcatcaacgaaactcttgagaggcatgctcacgtcgagttcgcccagcaccatgtcccgcaactcgagcgccatgatggagtcgaaccccagcgcgtcgaacgagtccgtggacgagagcttcgtcgtcggaatctttccaacctcgctgatcatctccttgagccgcgcctccaggacgccgcggcgagcggagccttccaacgcgagcaacacctcgcgcagcttgcgcggcgcctccatgacgtcagggacggcatcggtgacggactcggtccggaacagcgacgaagccacgatggaaggatggctggcagtccaacgcgtcacatcgaagcgcgcgatgccccgggtgacgcggttctccgcgagcaccagcgccatggccgccagggcttcatccacggacatgggcgacatgccccgctccgccagccggtcgccacgccgagcatccgcgacggccatgccgacctcgccccagctcccccagttgagactgatggccggcagaccccgtgcgcgacggaagtgcgccaacgcatcgaggaatgcattggccgcggcatagctggcctgccccggcgagccaatcagcgacgccgtcgaggagaacaggacgaagtgctcgagggtggtgtcggtggccagcgcatggaggttccacgcaccgtcgaccttggggcccatgaccgtctcgaagccctggggctcccactgcaacaacgagctgtccgccagcacacccgcgctgtggaagatgccccccagcggcgctccgcctcggcggacggcagccagcatctccgccaccgactccgggcggctcacatcgacgcggaaggtctccacccgcgcgcccgccgcacgcagcggcgccagggcctggcgggcctcgtcggtctcaccttttcttccacagagggcaaggtgccgcgcgccgcgctccaccagccaggaggcgagccgcagtccgattccaccgagcccgcccgtaatcagatacgtgcggtcttgccggggacgaaacgctcccgtgccttccggaatcgtttgggtctgcgtgagcgagggcaccagccgctgctcgccgcgcagcacgacctcgtcgtcgtcagcggaagcagagaccttgcgcgccagctccgtcaccagcgcaccgaaggccgcgggttcgatgtcgatgcgcttgcaggcaagctccgggtgctcgtaggcgacaacccgtcccaggccccacagtggcgcgccagcaatcgccgtgggtccagccgctccgtcagcggcttgcgagccctgggtgacgaggaacagccgaggcagcgttggcgccgagtgccgcgccagggtctgcacgagcgacgccgccgcgtggacctctcgctgaaccgatgtgtgcagcccttccagtgattcgggatgctccgaacccgacaggtagatgacgcctcggggcgccgggctctcggacagccactcccggagcaccgacgcctgctcggagcccacgatggccacgcgcaccgtgcctccggcggtggacagggattgccgcagcgactccgaggcagccggctgcgtgctcacgatgagccagcggccctccgcgtccacgggcccctgccccaccgtacgcgcatgccacgtgagttcgcagaagaggtcccggggggatgcatcccggacgggctgcacgctgctcggtgctggagcgaccgctccgtcccaccagtagcgctcacgctgccacgggtacgtcggcaccaccgtcttgcgcgcccccgtgaagagcccctcgaaacgaatggagccacccgaggagtacccacccgcgatgacgcccaggacacccgtccaggcatcatctccgggcctgctggcacgcaggatgacggccttgcttccacggctgcgtgcagtggcctccaacgccgccccaacggaagcctcacaagagacctggatgaaagccgaggcgttccgcgcacacaggttcgccacggacgacgccgggtcgatcaccgcggcgcgctgtctctcccagtacgcgcccggtaccgtggcgcccgcttcgacccaggcgccatcgacggtggagaagaatgggtacttcacgggttgaggacgcacgggctgcgctggcgtcaactgcaaggcgagccgcacggcgtcttccacgctgagtgctcccgcgaccactcccgcggagagcgctcccacgccgaagccggaaacagctgcgggggtcagaccgcacgcgcgccagagctccgccaatgcgagctggagcacgaggagagtgcccaccgggtgtccttcgcccgcctgcgctcccgccacctgttcgatgacggacccacctgccacctgccggaagaccgcatccaccttctccgcgtgggcgcggaagacgtcccggcccagcagctcacgcatcaaccggctggcctcgggctccgtgccaccgaagaggaagacgggctcgccctcgcctgaacctcgattgacacccggcgcatcgcgtccctccgtgacagcgtgaagggccgctcgaagcgcctcgggcgtcctcgccacgagcaccgcacggtgcgcatggtgtgagcgtccagcgcccgccatgaagcacgcatcctggagccgcgccccaggaccggcctccgacacgtactggagccatgacgccgccagtgtgcgcagcgcgggctccgagcgcgcggagaggggcaacacatacggcccggcgtccacggcggcatgggcggcctccgcgtacgcctcgacgagcgcatgcgcgttcacaccgctcatcccaaacgagctcacggcgacgcgatgagggccgtccttctccgccagggccgtgcgcgctcgaggcaccgcgagccctgagccctcccacgcgaactccggggtcgggtgctcgaagttgatggagggaggcacctcgcccgcctggagcaccaggacggccttgatgagtcccgcgatgccggccgcggcctccgtgtgaccgatgttcggcttgacggagccaatccacagcgggcgctccgaagtccgcgctgcgccgtagacgcgcgacacgccgtccagctcgatgggatctcccagccgcgttcccgtcccgtgcgcttccaggtagtccacctgcccgggctcgatgcccgcgcgctgcaacacgcgccggtacagcgcttcctgtgccccgacgttcggcaccgtgagaccaccgctggcgccgtcgtggttcatgcccgtgccacgcaaggtcgcgaggatgcggtcaccatcccgaacggcgtcccgcagccgcttcaggacgaccacgccacagccctccccctgcaccatgccgtccgcgtcccggtcgaacgtgcggcaatggccgctgggggagagggctcccgccttggacaggaacacgctgagttgcggcgccaggatgagcttcacgcctccggcgatggcgagcgtcgactcttctgtccgcaggctctgacacgccaggtgcacagcggacaaagaggacgagcacgcggtgtccaccgccatgctcggcccttcgagcccgaggaggtacgacagccggcccgccacatagctggcgtccacacccgtggagtagtgggcgctcaccttctccagcccgccccccgtgacgaacgcgtagtccttcgcgtggacgcccgcgaagacaccggtccgcgtcccctggagctggtgtgggggaatgccagcgtcctccagggcctcccagctcacctccaggaagaagcgctgctgcgggtccatgccctcggcttcacgccgggagatgtggaagaactccgcgtcgaaccggtccacctcgtccacgaagccggcgcggcgcatggccagcttcccgggcctggaggggtccgggtcatagagcccctggagcgcctgccggtcgctgggaatctccgtcagcgcctcccgtgccccccacagcaggtcacggaacttcgcggggctggtggcgccccccggaaagcggcaggccatgccgatgatggcaatcggttcccgctcaccattcgaggccgtggccagcttcttctgcagcttctcgatggtcagcaacgcctgctggagtggcgacaactccgccatgaatccgtccttgcggttcatcacgcgacctcgaggctgagttcggccaacgtccgggcgatctgctcgcgcgcttcgtcctcggacagcccggcaatgcgttccatcaggccctgctcctcctgctcgggcgtactcacctcgcccgggtccgacggcaggcggccacgccgcgcctccagcagggacagcagccgcttcgccagcgactccagccggggcagctcgaagaagagcgtcgtcgacagcgggagctcgagcgcccgcgagatgcgctccttcaacaacgtggccccaatggagttcaggcccagttcgaagaaggtccgcccctgcacatcgagcgtcgcgggctcgacctccagcacgtccgcgaggtgcccccgcaggaacgcccgcatctgggcctccccatgcacgtcgggaacgcgggaagcatccccggcggccaccgcggcggcctgaagcagggtggcggcgtccggccgcgcgtccttgggtgagcggcagacttcatcgggtgaaagccactcgggccacaggcgctgacgctggaaggggtagaccggcaggctcacgcagcgccctgcacgcaccgggaacacctcgggcggcaccgtcccatccgcgacgaagacacgcccggcctccacctgctccagcggcatgccctcctgaaccaggagcgccgtcccactcgacgtcgcgagcgaatccaggagcgccacgagcccagcccggtcgcccgcaatcaccacggcacggtgccggtggtgctgacgcttgagcgccgccgtgaagcagacgtcctccagcgtcgccaccgagtccggcgtcgtggcgaggaagtcccgaagctggagcgcccgctgacggagcgcgtcctgagagagcgccgagagcgccaggaaatggaccggcgcgggcgtccgctccagcaccgcagccggagctgcctccaggaccacgaagccgttggcaccgcccagggacgtggagacgatgcccgctcgcagcggcacgccaggctcccgcgcggcccagggctccagctccgtctggatgctcagcccgagcgcgtcgaacgaaaccagcgggttgggcgcatccacgtgaatcgtcggcgccaacgtccggtggtgcagcgacaggcacaccttgatgaactgcgcgatgcccgccgcggcgcccaggtaacccacgttgttgctgatggcgccgagcctgcagggcaccggccgctgcgtcccgagcgcctccccgatggcctccgcttcggccgcgtcgcccttgaggaacgacgagccgtgcatctcgatgtagtcgatgctcgccggagccaccccgccctgctcacacgcctgccggatgacgtccgcctgcgccgaggcgctgggcgccatgatccactcgttccggccgttgtgattgacggcgctgccccgaatcaccgcgtacacgcggtcaccgggctcaaccttggacaggcgcttgaggacgacgacgccagcgccctccccgcgcacgtagccgtccgcctgcgcatccagggtccggcactgcccccgctcggagaacacgccggcctgggacagcatgatgctgctgtccggagacagcatcagctcgacgcccccggcgagggccatctccacctcgcccagcgtcaagctgcggcacgcctcatggagggccaccgtcgaggaggcacaccccacgctcgacacggtgctgggtccccggaaatcaaaggcgtaggagagccggttggccgcgaaggacgccgtcgttcccaggacggaatagccatccagcgaggaccagtccctcgccagcatccgctggaagtcgctgaagttgacgcccatgaagacgcccgtgcggctccctcgcacggcgtcgaagggcaggcccgcatcctccagcgcatgccatgcacactcgaagaggagacggtgctgcgggtccatctgccgcagctcccgcttcgtcagccggaacgccgcggggtcggccagctccacgccttcaatcagtccggccttgcggttgcgaatcgtcccagggcgatcaggtgccgcgtcgaagagcgaagacaaaggccagcgcccggccgggatgtcccccgtcgcatcaatcccatcacatagcatttgccagagcgtacgcgggcagtccgacatgggcagacgcaggcccagtccaatcacagcaatgggttcacacaacatcaaggcacggctccgctggcgactcgcaagccgctcagactcatcacctgtttgaacttcattctcaaccaacaagaatcaataaagacatacgtccgaaacgtctttcactgcggccggcgtggcatcacgcggcccgaggcctccgtcctccaccacggacagatcgccaaaatcaaaaagggcgtgcttgtacagcttgagacgcggactcaatccttcgggccccacccgcaccgcgacgaacttcgcgcgatcggtctgcatcatccgctcgaagtcccgaacggattgcttcgaggacacgggatacccgaaccgggagatggcttccagaaccacagaggtctggatcccgcagtagatgaggttgacgcgcttgggctgggattggaactcggaggcctcgatggcgacctgggtcatcttatccgcggagtgctcccagagcagcgcgttcagctggcgaacccgctccagctccggggcggacacacccatttcctggaggaagcgccacagctccgagccaggctggaatggaggccgattcgcgtcgaagcgcaccaggtacatcttggattcgagtgttccgtcctccaggaagctcaaccccaggaacagcgggtagtattcggtccgcagcgcggaagcatgggtcttcacccgctccgcgaagggccctgcccggaagcgctccggcaggcggctcatcgcctcatcgaaaccggagtgcccgcgcatggggtcgaagtgccagctggcggcaatggaataccgggtggggcctccgggcttgaactccgcgcgcaccaggcccaggtccgaaggccggaacgtctcgcagatggccacggaccgctcgacgccctcgttggtgatgccgagctgccgcgtgtactcccggaaggcccgcgtgaccgtcccattgtcgccgtagagcatgaagcccaggccgggctcgtccgcgttataggagaactcaatcaacgccttcttcgcgatgcccaggccctgcaccgggagccagtactccaggaaccgccgcacctcggaggcctcgctcagcagaccttgggcgcgcagggcatcccggacgaaccaccccagcgtcttgtccggcttccacagcacttccgtgtcgaagtggcagatgcgatcacgcgggccgacccgttgaggaaccaccaggttggccagcatccgtcccgcgtagcgcgctcccagcgccacccggctggcgggccacagtgcctcggtgcccaagcccttctcggacttctgctgccaggcgcgcttcgcgagcctcaaggcgatgtccgggcgcaggaggaactccggccccgcctggacgtgcatcagcttgaggaactcctggtagatctccggatgctcgtggttcagcgcgtagagctcctcgacgtaccactgggccagcttgatgagccgcgtccgctcaccggggacgtggggatgccgcatggcctccgccgtcacgaagaaccagaggccctggagccactgcgcgcccgtgcggaggtaggacgccgtccaggcctgggtcaccgcctccaggctgtcgagttggtgcagcgcctcgttgaggaggttcgcctccagcatcgccaccgacatgccctggccgaagacagggtcgaagtagcaccacgcatcccccaggacgagcaaccccgcggggaagtcccggatgcgctcgaagtggcgccatctcacgtccggcacccggtacaccccgacgtccgagacgggcttcgcgtccttgatggcttcgtagatgtccggctcgcggaggctgcgggcgaactccacgaatccgtcctcgtcgcggggcgggtggtgtccttcgtagccgaacaaggacacaatccagcgattgccttccacgcccagcatcgccccgccgcgcggtttgtcgggcggcagcggggtgatccacagtccgcgccagtccctggctgtctccggctgctcgaagaggcgtgacacgtagcagaggttgatgggcagccggctctcctccggcgggctgaaacccaactccgacaaccacttgcccagttgcgatccgcgcccgctcgcgtcgaccacgatgttggcgagccggttcgtcaccgcgccgccgtccccatggcggtcatgcgtctggactccgagaatccgcctcccatccggcgtggccagcagcgcccgcacggaggtcgactccaggatctccacgttggaataggcgcgaagccgccctcgcaggtagcgctccagggagcagcgcgtctgcgggtacaggacgatgccgctgcggtggcgcggcatccagtcaccaaactgcaaccaccggaggtcctgggtgaagtcgaagggctcgatgccgtccgccgtcatctgctcgacgaggccggggaagtactgctccaacaggtccacaccctttcgcagcaggacgtggatgtgattggcctggggcgcgcccgggcgagggccatcctggagcacgtcccgttcaatgacggtgacgcgctcgaaatggtccgccagcacgcgcgcggcgcagagcccaccgatgctggcgccaatgacaatggcgctcccaggaagtttgttcatgccgtgtcccgcctcttgcagcgtcaacgctcgggttgctcgcggaagccgttcaggccgccgcctgctgtccggtcaggtgcgccaggatgaggtcgtggacttgcgtagcgtggagtgtctctgcctcgatcagctcgccatgtcgtgtcatcagcaccggcccatcctccgggccggtgggcaggccatgcgcccctttgaggagggagccgtccatcgagacgacctccagtcgcgagcgtacgcccagcttctccttcacgacactgccccccagttccagcatgcgcagacccagcttcgggtccacgaacatctccagcgggtcgtagcccggcttgcggtagatatcgacggtgcgcgcgtagtccggcgcacgcgcgtcatcgagccagtagaagtacgtgaaccaggcatccggttccgccagggccaccagctcgcccgagcgtgggtggtccagatggtgggcgcgcttgccctcggcatcgagcacctgggccaccccgggctccgcctcgaccagcgccttgacctcgtccaggagcgccgggttccggacatagatgtgcgcgatttgcatgtccgcgacggcgaacgcctcactgccgctgggatagacgacgtcacggccgccctcttcccggatcgccagccaccctcggcggcggaagaggcggttcaggtggacggcccgggacacggggaccgcgccgaactccgagaggatgatgacgcgcacgccgcgcgactcgtagaagccaatcagcttcccgacgacgtcgtcgatctcccggaggctcttgtggatctccttcgcgttcggtccaaacgtgtgcggcgtgtagtccaggtgcggaaggaagacgagtgagagcgtggggctgtgccgctgctccagccacatggcgacgtcggcgatccactccgaggagcggatgctgtagcggggtccccagtagtcatacgcggggaagttccccagcgcctcgacgagcggcttgcgcaggtggagcggctccgtgaacacgtcaggcaccacccgcccgtccgcggtgaaggacggctgcggcgtgatggcgtagtccgccttcgaatacatgttcatgaaccagcacacgcgggcgcaggtgaagctggggtcgagcttgcgggcggcgtcccagagctgcggcgtctgcacgagcccatcggattggggccagaagcggacctctcccaactcccggttgagccatccatctccgacgattccgtgctcgctgggatatcttccggtcaggaacgtcgcctgcatggtgcagttcagcgccggcaggacgggctggagcggcaccatgcgcccccgctccacgaatgcctgcatgtttggcgccgaggggccgacatacctcgcgctcaatccaggcaaatccaaaacgacgcaacgttccatgcccgaagcaaactgctcacgagcaaaccagtcaatcaccgaccaggttggcccataccctggtctgagatgagtgctcagccagttcgaccaggtcagccgcgtgtagaattttaccgcggccataggctggaaagcactggcgcgagcgctcgcgccgggaatgagtgacaccgtacccagtgcaatgggtagtgaaacgaaacggaatacatggtctggaggggcgggtcatgggcctcatttcagcccgtttccccgccgatcgcggatgcgcggccggccttcgcgaccacgtggtccgcggcagcggaaaatcgcgtcccggcccatttgtaactcattgagtccacctcgggccagacccagcagataggaattaccgagccccgcacttcaatcccatccagcgccacctcaaaagacacacttcccgaccaccatccccgaggttcttgacgactcgttcccgcgcacgcgagacttcgcctgactcctctcacgtctcaccatccatctccgagggccatgcagcgcgagcgcaatgcgttcgaagcgcgccccctcgttgctgtcacccgttggaacgccaggaaaacatggacttcagttggactcacgagcaggtggagctctatgaccgtgccctcgccttcgcgcgagcgcagttgcccgaggccgcaaagcccagcaaggaagccctgccacgcgatttgtggcaacgctgtggtgagttcggcttcttggggctgcccgtgcccgcggcgcatggcggactggggctggacacactgaccactgcacgggtgatggaggcgctggggcgtggctgcgtggacaccggactggtgttctccgtgggagctcacctcttcgcctgcgtgatgcccatcctggagagcggggatgacgcgcagaagtcccggtacctgccccgcctgtgctcgggggaatgggtgggcgccaacgccatctccgaacccgaagcgggctcggatgtgtttgccctgaagacgcgcgcggtgcgggacggcgacagctacgtgctcgatggtggcaagagctacgtcaccaatggcccctccgcggacgtcttcctcgtctacgccgccacgcagccggcccatgggtacatgggcctgagcgccttcctcgtcgagaaggacacgccgggactgtccgtcgggcgcgccttcgagaagatggggctgtccacgtcgcccatcgcccccatctacctggaggggtgccgtgtcccggagtccgcgcggctgggtgcggagggccagggcgcggcgatgttcaagcgctccatgcagtgggagcgcgcgtgcctcttcgccgcctacgtgggcgtgatggagcgggtgctcgaacagacggcggacttcgcccggacccgcaagcagttcaagaaggccctggggaagaaccaggccatctcccacaagctggcggacatgaagcagcggctggaggcatcccggctgctgctgtaccaggcctgctggaagatggaccgaggccaggacgccgtcatggaagtgtccctggccaagctggccatcagcgaggccgccatccagagcggcctggacgccatccagattcacggcggcatgggctacgtggccgaaacgggcatcgagcgcgtgctgcgtgacgccattcccagcgccatcttctccggcacctccgaaatccaacgcgacatcatcgccaaccagctcggcctatgacactcgaccaaatcgtcatccgtgcagcggcgaaggctcccgagtccatcgccatcaagggtcccgacgggaccctcacctacggccagttggacgcgctcgccaaccgcatcgcccgcgcgctccaggagctgggcgtgaagcagggagaccgcgtggggctgtggacggaaaagtccgtgcgcgccgtcgccgcgatgcagggcattgcccggctgggcgccgcctacgtccccttggacccgctgaaccccgcgacgcgaacgcggctcatcctcgacgactgcggcattgacgtgatggtgaccaccaccacgcgcgcgtccgagctccacaacgccggcgtgagccggctgcgctacctgctggtggacgacaaggggcccgagatctgctggaaccggctgtccggtttttcatctgagccgctgccgccgcacggcgcgggcgaccacgacctggcgtacatcctctacacgtcaggctccacgggaacgcccaagggcgtgtgcatcagccagcggaacgcgatggccttcatcgagtggtgccatgcgctcctgggcaccacaccggaggaccgcttcagcaaccacgcgccgttcttcttcgacctctcggtgctggacctgtatgcggccttcatgggcggcgcgtccgtcacgctcatcccggaggcgctggccttcgcgccggagaagctggtggagctggtcctccgcgagcggttcacctgttggtactcggtgccgtcggcgctgatgctgatgatgcaggaaggcggcctgctgaagcatggggcgctgcccttccgcgccgtgctcttcgccggcgagccgttccccatccggcacctgcgcccgcttcgtgagcacctgccacaggcgcggttcttcaacctctatggacccacggagaccaacgtctgcaccttccatgaggtgacggacatttcgccccaccgcaccgagccggtgcccattggccgagcgagctgtggcaaccgcgtgtggttggcccggccgccgccgggctcagaggaagcgcgggaggaaggcgacggcgtgggcgagctgatggtggaaggccccacggtgatgctgggctactggggccagccccgccatgggagcgggccgtatgccacgggggaccgctgccgcgaggtgccggacggcacgttcgaatacctgggccgccgcgacaacatgctgaaggtgcgcgggcgccgcatcgaagcgggcgaaatcgaagcggcgctgctcacgcacccggacatccgcgaggcaggcgtgattgccaccggctccggcctggaagcgcggctggtggccttcgtggtcagcggcgccagcaagcccccttccctgctcaaggtgaagaagcactgcgcggagcggttgcctcgctacatgattgtcgacgaggtccgcgtgctgcccgagctgccccggactcccaacggcaagctcaaccggcgcgcgctcagggaactgacgcaggcgccttga

SEQ ID NO: 1177 - DNA, 23847 bp, Myxococcus xanthus
ggggacgcacgtgggcaccacgcaggggtacctccacgcgctgggcacgggctccttccgcacgggggatgacccctgcacgccaggccgcgtggagtaccagggctacttcggccgggccggcaactgcgccagtggccaggactacggcgcgggcaacgagctgttcgcctacctgcccttcaagatgctgccctactacgtggagaactaccgccgcgccaatgacgcgtactccaccgagcgcgccacgatggacgccacgccctccgtggcggacgtggacctgcggagcgatgactaccgcccggacaccggccatgaccctcgggagaccgacgaggcctggcgtccccgccccccccggaacgaaggcgcgaagacggtgctggccagcgccacaggccccaagcagagcatcttcttcgcgctcgacgtcaccaaccccacggactcgagctaccccacgcccttgtgggagttcgacatgaagcgggaccgcttcacgtcagcgggcattccatgcacgagcagcggcaacggctgcaacccactgccggcgctcttcaccggcgccacgcccaagcccgacacacgcggttcgcgccatgccccctcactggtgcgcatggacttcggccaggcgggcggcaagaagtgggtgtccatgttcggcacggactactcgcctgagtccggcacggtgggcaccgtctacctgatggacctcaagacgggcctgcccgcgcaggtgacgggcaacagcgcgaaggcgcggctggcgggcgtcgtcacgctgggcaccaccgcggacgcaaatgaaggcatcggcggagagcccatcccgctggacgtgaatggcgacggcaacgtcgacgtcatctacgtcccgtccacctcggggaagatctaccgcatcaaccccacctactcgaacaccgggacgaacacaccgctgggcaaggtgctggcctcctgtgtcgtcgcggacgcgcaggccgtgcccggcatccgcaaccccaccagccagcgcatctactccaccatctccgcgtcggtggtgcctgacagcggctcccgccgggtgcggctgtacttcggcaccgccaacaacccggacatcgccaacgagccggacgacaccgccaatccgcggccccgctatcacctgatggccttcgaggaccgcgacccggtgcccgccacgcgtccaggcgccaactgccccgcgcacctcgaatggacacgcgagctgggcgagggccaggtcgtctggggcggcgtctccaccacccaggatggcgtcttcaccaccagcgccgtgggccgcgccgccagcgcgtgcgacctggacagcaccaccagcggcagggtctacgcctacagcacctcgggtaatgcgctcgcgggcaacgacacccccatcgacggacacggcacgcacgcgcccgtgctctatgacaatcacctgctcatcgtgaagaacggtcaggtgcgcgcgctggggaacgggacgtacaacaaccccaccgcggagtcgccgcgaagcagctcccgggtcctcatctgggacgtgcagtccggctcacgcgtccaggaggtggtgccatgaaccggcgcaggttccacacccatccgcgcggcctcagcatcctggagaccatcgccaccgccgcggtgctcatgctcggcatcctgggcatcatgctcacgctgggcgccgcgtcccgtcacaaccgccgcaacaacaacctgagccaggcgagcctcatcgccgaacaggaactggagcgcgtggtcaacctccgctgcgtgggcgagccgctgaacgacccctgcgtcaacatcaagcagctcgacaacacgaggcgcgacgtgtggtggtccgccaatggccgcatgacggagacgccgccccttccgggcgcgacgccgcaaatggcctacacgctgacgctggacgtggacccacccttcgagggcgccgagacaggcgagcccgcgctgaaccgcgccatcccgcttccccacgccagcaacctggccctgcaccaggtcgtcaacgtccgcgtcaccgtgagctggatggaagagcccggtgcgccccgccgcgcggtggccctgcagacccggatggcgccatgaagcaacttcgttcgacgacgccgcgcggcttcacgctcatcgagctgatggtggccgcatcgatgtccatggtggtgctcgccaccgccattggcgtgagcgtccatctccagcgccggggcctgctggaagagcgcatcatggagacacagaacaagggccgggccgcgcgtgacttgatggcgttcggcgtgcaacgggcgggcgcgggcatcggcagcgtctccctcaccggcggccggactcccgccggcgaagcagacctgttctacgccgtgtgggcccggccccaggccaccttcccggatgacgccaccttcgtcccacccaccaacgccgcgctgctgtcggatgccctggaggtctgggagacggacccggcgcgcatggtgctgctggagcagtgtcccttgcctgcgaccgcgtcctggttcgaggacacgctgtgcgtcggaggcctgccgcccgcctttctggacaacgcggtcatcgccgtcgtgttcccgggcacgaaagacgagcggggctgggcctgcgtggggcaggtgacgaacctcgttgcggaaggcgtggagtggacgcccgccatcccaggccggcccgcgcccgccgacggcaactgtcatcccgatgccgtgacgcttcccgagtcgccctggcttggcacacgggaaccgcgcgaagggggcatgtacctgctcccgctcaccagccgcagctaccgggtgaactggcccggcggcacgcccgtgctggagatggacgcggatgggcccatggggcccgcgggctacaccgcggtgtcccaggacatcgagcagttacaggtccggctgggcgtgaatgcacccaacgcgctccccggcgcccccgtacgcttcttcccggacgcggagaccgggcgcccctcgctggccacctgcacccaggccacctgcgccgcgcacatctcctgggcctgggatgcgggtgtgcccgttccgccggaccgcggcccgggcagcgcgggtgacgagctgatgcggcacatgcgcgtggtggagctgtccatcaccgcgcgctcgcagcgcgccgagctgacggggaacgaagcacccggagcgcgagacgacgaaggcaacctccgggatggctacaagcgccggcacagcgtcatccgcctggcgcctcgcaacttcgcgttcgtgggaacggggggctgacatgcggccacgcaaccgaggcatgacgctgctggaggtgatggtcgtggtggccctggttggcctcttcgccaccctctccgtgtccagcttccagggcatgacggagcgccagcgcctcagcgccgcgcagcgcgagttggtgctgatgatgcaggaggcccgtcagaaagcacgcgcgacccaccagcccgtgcggctgggcacgcgcgtcatggatgagcagggcgtccaggtgacgcgcatgcgctgggaggcactggcatgcagtgatgcctggggcacggtgtgtcccatgcccgcgtgccaggagaacgcctgcggcgtgggcggctgcgaatgcgcggagctggggccggagctggtcatcccgccgaagctcgacgtggagctgctggtgggcctgtgctggctgggcaaccccagcgccggcgcgcccgtcgtggctccgccggcgcccggcggaagggtgtgcgaacagaacgccccgctgcccccgacggagcggctcatcctcctgcgcaacagggggacgctcgaagcgccggactggaaaccggagctggtattccaggcggatggcctgacggcggccatacgccccttggattgtgacaagcacgcctccacgccaggctgccaataggcggcgtccgcaccgccgccgtcgcgcgtgcgaacggctcccttcggcgtatgctcgggggcccgggcccagggcccggcatgccgtccgcgaggagcccccgacgatgatgaagcggctggtcctgagcctgggtggagccaccggcgcccacgcggacgccgtggccgacgtgtggaaggcgaagtgcaccgtgtgtcacggcggtgacggcaaggcgcagacgaagatgggccagaaggagtccatcggcgacatgagccggcccgcctggcagcagtcccggacggacgccgacatccgcaaggtgattgccgacggcgatccgcggaacagcaagatgaagcccttcaaggacaagcttaccccagcgcagattgacgcactggtgggatacatccgcaccatgaaggcgccgacggccccttgaatttccgttcgaggccgcgcgtcatccccccgcaagagaaacggagccccccatgaagaacctcaccgttgccgttgtcttctgcctctccatggccagcctgttcacctccctgcgcgcggacgcgctctcgtcggtgcacatcgagaaggggctgtccccggcgcagtcgctgtccctccgcccggatgacggcaagggcggcggtgacgacaagggcgacaagggcggcggtgaggaggacgaggaggagtaccgcaagcgccgctacgccggcctgtcccagaaggcggcgatggagctggtggacccgggcgcgctgacggacgtcatccgcctgcaggccgccgtgaagttcggccagcgctagcagcaggccaccggccgggcctcaggcagtcttgcctggcggcccacccaacggccgggtgacgcgaggcagcgtcaccgagaagcacgtccccgtgtccgccgacgacgccacgtccagccagcctccgtgcgccgtgacgatttgcgacacgatgtagagccccaaccccaggccctggtgcttcggcttcggctgacccggctcggggggcaccccgtggaacggtgagaagagccgcgggcgcaacgactcggggatgggcggcccaccgttgtggacctccacgcgctggaagagcgagtccttcgccgccagccgcacccgcaccgagctcccctccggactgtgttgaagcgcgttgcccagcaggttcgacagcacctgtcccaggcgctcctcgtcccagatgccgcgtgactcgccgtccacctccagccggacgcagcactccggatgcgcgggctccaactcggagatgatgcgccggcacacgtcctccatgcacacctcatggggacgcagcgggatgccacccgccatgcgtgcgcgcgtgaagtcgagcaactgtttcaccagccgcgccatccgctcggcgctcccgtcgatgcgagccaccacgcgccggacctccgggggcagcgtgtcccgggccaggagggccgcggaggacagccgcaccgcggccaatggattgcccaggtcgtggcccagcacgccgatgaagcgctcctggaagcgcgcctcctcctcgcgctccagttcctggcgccgccgcgcggtgacgtcccggcagatggcgaacaggccgtacacggtgccgtctctcgcggcgaagcacgcccttcgtggtgtgccagatgcggtccgtccccgggccgccttccgccccttcgtacgtggccgtgtgcccggagctcatcacctcgcggtcgtgcgccagcgtcggcgcggcccggtcggcgcccagcagctccgcgtccgtgcggcccaggatttcgcgcggggcccggtggaaggcgctcgcggtggcgggattgatgaggatgtaccggcccgacacgtccttcacgtagatggcgtcggtggcgctctcgatgacggcgtgcagcaggtcatggtcgcgccgcagggcttcttccgcggccatgcgctcggtgaggtcctccaggaagagcaccacgccatcgtcacacggggatacgcgcgccaggagccacacggtgcccatgggcgactgccgagacacccgcgcgatttctggcgcgcggcgtgtcaccacgcggacacacgcactgaagaggccgccgtcccacgcccacggcgcttcctccagcagccggttgtgcaccaggctgccctcttctccgccgagccagcgctccgcctgcacgttggcggagacacactcgaagtcgacgatgccgccgaccgcggagcgcacgctccgcaagacgaccaccgcctcggaaagaggttcgtccccttcggtgccctggcacctgttgattccacggccagatgacatgtcggcgtggcccccgatgctgccgttgtgagccaccctaaccccgcagcagggggtggggccaaccggtccccggggtggcttaacagtgcccgagctaaccagagcttccgatttctcctgtttcgctcgacagccgaagtgctccgtcgttgacctgacagggtgagacttctaattaccctggggccctcagggtccactcatggacactcccttcatacagacgcaggacggcggcgcggcgggcgaccccttcgcccaggtggttgacgaacttcgggcggggcagcgcgtccggacgcaagggctcaagggggcggcgcgcggacatgtgctcgcccgcctgcatggcgcgctgagagcgccgctggtctgcgtggcggtggacgaggaggccgccgacgcgctcgccgccgacctgtccttcttcctgggcggccagggcagcctgctggcgccgcgcgtgctgcggctgcccgcggacgaggtgctgccctacgacgaggtgtctcccgacgcggcggccgtcacggagcggctgggcgccctcttccatctggggcagggcacgcgcttccccgcgctggtgctgtcggtgcgcgcgctgcaccgcaaggtgctgccgctggcggtgatgcgcgcgctggccgcgcgggtggccgtggggcaggacttcgaccgggactcgctggcgcgccggctggtgcgcatgggctaccagaacagccccttggtggaggacgtgggcacgttcagcgtgcgcggtgacctgctggacgtcttcagccccctctacgacaagcccgtccgcctggagttcttcggcgacaccatcgagtccatccgcgccttcgacccgcagtcccagcgcacggtggacgcgctgaaggaagtggacctggtccccgcgcgcgaggtgctgctcaccgacgagacgcgcccgcgcgccgagtccgccgcccgcgcggtggccgaccgcatcaacctgcccaccatcaagctgcgcgagcagttggacgccctgcgcgaaggcctgcccggcttcgggatggagggcctgctgcccggcttcttcgaggacgggctgtccacggtgttcgacttcctgcgcgactggagccccgaggcgcccgtcatctacctggacgacccgctgggccaggaccgcgcggcggacacgctgtgggaggagttggagcgctcacacggcgcggccgaggcccggcaggagctcatctgtccgccgctggagcacttcctctcccgtgaggacgtgaaccagcggatgcagtccttccgcgtgctggagggcggtggtctgtcgctggcgcagacggagcgcccgccggtgcacttcagcttcggcggcacccaggacctgcgcgaggccatcctggcgcaccacggtgaagaaggcgcgctgtccccgttggtggagcggctggagcgctggcgcgagctgcgcgtggcctgcgtggtggcgtgcggcacgctgagccaggcggaccggctgaagcggctgctaatggaccgcaacgtgatggtgaaggtccacacggagccgctggaagacgctgtggcgctgtacgagccgtccatccgcgcgcacctcttcacgggcgaggtgagccacggcttcgtggatggtcctggcgggctcgcggtcctggcggacgaggagattttcggcgcgcgcgcgcgccggcgtcccaagcgcagcaagaagctggacgcgttcggctccggcttcggggacctgaaggaaggcgacctcatcgtccataccgacttcggtatcggccgttatgcgggcctgacgaagatggaggtcaacggcgtgcccggggacttcctcgtcctggagtacgcgggccgggacaaaatctacctgccggtgggccgcatgcggctcatccagaagttctccggcggcgaccccacgcaggtgcagctggacaagctgggcaccacgagctgggagaagacgaagaagcgcgtcaaggagcagctgctcaagatggcggcggagctcctccagattgccgccgcgcgcaaggcgcaccccggccatgccttcagcgcgccggaccggtacttcgcccagttcgaagcggacttcgagttcgaggagactccggaccaggccaaggcgattgaagacgtgctggcggacatgcagaagccagagcccatggaccggctcgtctgcggcgacgtcggctacggcaagacggaggtggccatgcgggccgccttcaaggccgcgctggaccgcaagcaggtggcggtgctggtgcccaccacggtgctggcgcagcagcacttcttttccttcaagaagcgcttcgcggactaccccgtcacggtggaggtcatctccgggctgaagaaggcgccggaggtgcgggaaatcctcaagcgcgccaagaagggcaaggtcgacatcttcatcggcacgcacaagctgctgggcggcgaggtgaccttcaaggaactgggcctgatgattgtcgacgaggagcagcgcttcggcgtgaagcagaaggagtcgctgaagaagtggcgctcccagattgacgtgctcacgctgacggccacgcccattccccgcacgctgcacatgagcatgtcgggcgtgcgcgacatgagcatcatcgccacgccgccgcaggaccgccgggccatccgcaccttcgtgatgaagtacgaggacacggtggtgaaggaggcgattgagcgcgaggtggcgcgcggcggacaggtgttcttcgtccacaaccgcgtggagtcgctgccctccatcgagacgcagctgcgcgcgctggttccccaggtcagcatcggcgtggcgcacgggcagatgggcgaagggcagctggagaaggtgatgctcgccttcacggagaagaagtaccaggtgctgctgtgcaccagcatcatcgagagcggcatcgacatctccagcgccaacacgatgattgtgaaccgggcggaccagttcggcctggcgcagctctaccagctccgtggccgagtgggccggtccaaggagcgcgcgtatgcgtacctgctggtgccgtcacggcgcgcggtaacgaaggacgcgcagcggcgcctggaggtgctccagaacttcaccgagctgggcgcgggcttctccatcgccagccatgacctggagattcgcggcgcgggcaacctgctgggcgacaagcagtcgggcgccatcgcagagattggcttcgacatgtacgcgcagctcctggaggaagccgtcgcggagatgcagggccagccgcccaaggtgcaaatcgaacccgacgtcacgctgcccatgccggcgctcatcccggacgactacgtcagcgacgtccaccagcggctcgtcttctacaagcgcttcagccaggccagccacccggacgaagtcacggacctgcgcgccgagctggtggaccggtacggcgaagccccggacgaggtggaccacctgtccgagctgacgctgctgaaaatcgacatgcgcgacctgcgcctacgcgggctggaggtgggcaccacccggctggtggtcacgctgggcgcggacgcgctgctggatggccccaaggtggcggggctggtgcagcgctccaagggcgtctaccgcctcaccccggacatgaagctcatcgcccgcgcgccacagggcgccagtggccaggacctcatctccgaggccaagaaggtgctgagggatttgagccactgcgcactgccgcaggcgtagacgcggacctcggcggccgttccgccgccgaggccgtgcgcttccgcccaagcgcagtcactcaggctcagcgcccgccgcagaagtgggccacggcgcgagccaggacggcctcgcagcgcaccaggtcttccacgggcacgtattcgcccgtttggtgcgccacgcggatgtcgccggggccgaacaccaccgcctccgggcccagttccgtaatctgcggggcctccgtcccgaaggacaccgtctccggcgcgttgccactggcctccgcaaggaagcgcaccacctccgcgtacgcccgggtattcacaccccggtccgtgcgcaccacgcgaatctgcgcctcgaaggcgggctcgtcacgcaccagctcctggcggatggtctccagcaactgagacacgcgctccggcggctgcccgggaatgggccgccactccacgacgaatcggcaggcgccggggatgacgttcttcgccttgccgccctggatgacgcccacgttcacggtggtgaagggcggctggaagccctcgtcgaggtcctcgcgcagcaccgtcagcgccaggtgctccaggcgctggaggaagcggcccgcgcggaagatggccgacgcgcccgagtccgggtacgcgctgtgcccttccttcccccgcacctccacctccgtcaggcagtagcccttgttggcgcgcaccggaatgaggcgcgtgggctcgccgacaatcgcgtgccgcgcgcggcccagtcccgcctccaccagcttcttcgcgcccgtcaggccgacttcctcgtccgcggtgaggaccaccatcagcggggccttcaactgctcggcgttcaacgccgcgtgcagcgcgcaggcgatgaagcccttcgtgtcacacgcgccgcgcgcgtagagccgcccgtccttctccgtcagccgcagcgcgtccgtccaggccgcgtcgtacggcacgcagtcggagtgccccaccagggccagcgcggcgcggccggagccggaaccgcccttcaccgcgacgaggttcaccttctccacgcccgcgtcgtccaggaacttctggcgctccgcgctgaagcccgcggcctccaggcgcgcctgcgcgtagtcgatgagcggaacgttggggcggaaggacgtggtgtccatcgccaccaactccgtcagggtggcccgcagcgcgggcagcgtgtcactcatgggtaagacctccagggacgggtcatgccacggcacgccagcccccggaaggcccttccctcccccatgtctactcagcgaacggacgccacctggggcgcggcctcctccaacggagacagcgagttatcccccgccccaggccgtcccaggcccttgtgcaccgcgggcgccgccgcgttcaccgcccccacgtagaagacaccgtggtagccgtcatcgttcgttccgccccacgtgtgcacgaagaagcggtcgccgttgtcccgccccttcgcgtcacgcacgccgcaatccagccggtccttcacgccgttgcggtccaccgcgcaaatccacgccgacccgctgttgtacgccatgtccagcgccaccacgctgtcgagctcgtccttcagcaccagccccatcggccggaaggacttgtcccacggcaggcccttcttcgtgcgcgagtggatgttgcccgacaggacgatgtggaagcgccccgggcccgactccacatggtgccgaaccgtcgccgccatcgcagtctccctcgcctgcccctgcatcgtcgggtggtcgaagacgaacacatccacgtccagcccgcgcgagcgcagctggcgcaactgctccagcatgtttgccaccgcctcgctgctgcggccgtccgggtacgggctgcgccagaacggcgcctccatcaacttcagccagtcatcctccgcccccgcgctctccaggaacgcccccacgcgcgtctggctctccagcggcagctccagccccaccgtcaccggcatgccggccaccgccacctggcacgacgcctgcgccacgaaacgcggcacttcctgcgtgccgtgcatctcccccagcagcaacgtgccacctggcttcacctgcttgcccagccccaggatgggcaggccacattcaaaggccatggcctccgcgcccgcgttcgcactgggcgtcgtcgccacctgcaccggcttgggcgcgttctcttccttcatcagcttgggcgcgatggagcggaacacccgccactccatgaccaggtcccgcgagccctgacccgaacccgcgtagaaggagttctctccccgcggcgcggcgatgcgggcctcccagtcctccgcgctgaggatggggtcggaagagacagcacccgagcccgcgttgacgtctttaacgcggtccccgtggcccagccgtcctcccacgacacggctggatccccaatcaatctcacggcccggaggactcagcgcggtactggcgctcttggtgatgcggatgatccacagcttgctcttcgtcggcgtctcgcgctttcccagcaccatgtaccggtgccagaagctcgaaatcttcgaaccgccgaactcctggcgccagtccgtctccagcaccaggctccccttgtcctccttgaagggcagcttgttctccgtgaagaactgccgcacctcgggccagacttcttccaggggccgctcgtagatggcctcgccatccgggatgaacaagtcactgaaggtgcttccctgccgggccgcgcagcccacctggaagcacatcaacgtcaccaccgcgaaccacttcgcgcgcatcggcccctccgggaatgaactcccgggggtgaacgcgccgcgccccaatgccatatcggaggagaactgccgctcaggcgtacagcgcgcgagacaacacctggaacgcgcggccactctcctccgcgagcgcatgcctgccctcacggacgacctcgcgtccgcccaccaccacatcgcgcaccgccgccttctccgcgcccagcacgatggcgggcagcagcgatgccggcaaagcgcccacgagcgacggatggtgcaggtccaccgtgaagaagtccgcgggcgcgcccgcctccagggcgccagtggcgagccccagactccgcgcgccgtccacggtggccatgtccagcagccgcgccgccagcccatccatggcgcccccgcccgggtccagcacggcgcgccgcagccgagacagccgcaggtgcccttccagctgtcgcgcctcatccagcaggtccaccgtggcctggctgtccgagcccaggctgatgcgcgcgcccgccgtcaccagcgcatccgcggggacgatgccgtcgcccaggttccgctccgtggaaggacacgcgcacaccgtggcctcggcccggcccaacagcgacacctcctcgtccgtcaggtgcaccccgtggaccgccgtgaagccgggccccagcaggcccaggtccgccagcaactccaccggcctgcggccatgctccgccagacaggcttcgatttccttcggctgctccgccacgtgcatgtggacgggcaggctccgcacggacgcactcgcgagcgccgccagccactcccgaggcaccgcgcgcacgctgtgcggcgcgagccccacgctgaccgccccgtcggcgcgcacctcgcgggccagcgcctcaaccgaacccaggaacgtctccacgtccgggtcgatgaagcggcgctgccgcggattcgccgccacgccgaagcccgcacgggcgtaccccacgcgcagcaggcagatgcgcaaccccacatcccgcgcggcgcgaatcaccgcgtgcgccaacgtgttgcggtccgcgtacggcgtgccgtcggactggtggtggacgtagtggaactcccccacggtggtgatgcccgcgagcgccatctccacgaaggcctgccgcgaggcgacgtagaggtcctccgggctcagcgactcggcagcgcggtacatcgcctcgcgccaactccagaagtcgtccgcctcccggcccgatgccacgtactccgtacgcccgcggatgagccgctggaacgcgtgggagtgtccgttgacgagccccggcagcaaggcccttcccggcagcgcgacggtgcgcgcgcccgcggggacgcattccggggccaggatgcggccgtcggcgctcaccgcgagcccgcgcccttcgtggaaccggccgcccgtgtacaggagctccggctgatagacagtgatgtcgctcacgccagcaacttacgccagcgccacggggcgcgcagcagccgcggcgcgccccgtgaaatgccagacgtcagtggagcgcgagcgtcggagtccggtcttccgtcggaacacccgagttgtctcccccacccggacgtcccagccccttgtgcaccgccggcgccgacgcgttcaccgcccccacgtagaagacaccgtggtagccgtcaccattggtgcccccccacgtgtgcaggaagaagcggtcgccgttgtcccggcccttcgcctcgcggatgccacaggccaactggtccttcacgcccttactgtccaccgcgcaaatccacgccgacccgctgttgtacgccatgtccagcgccaccacgctgtcgagttcgtccttcagcaccaaccccatgggcttgaacgacttgtcccagggcaggcccttcttcgtgcgcgagtggatgttgcccgacaggatgacgtggaagcgccccgggcccgactccacctggtgccggaccgtcgccgccatcgcgtcctcgcgcgcctgcccctgggccttcgggtggtcgaagacgaacacatccacgtccatcccgcgagagcgcaactgacgcagttgctccagcatgttcgccaccgcctcgctgctgcggccatccggatacgggctgcgccagaagggcgcctccatcagcttcagccagtcatcctccgtccccgcgctgtccaggaaggtgtccacccgcgtctggctctccagcggcagctccagccccaccgtcaccggcgtgccggccaccgccgtctggcaggacgcctgcgcgatgaaacgcggcacttcctgcgtgccgtgcatctcccccagcagcagcaccccacccggcttcacctgcttgcccaggcccagaatcggcaggccgcattcgaagtccatggccgccgcgcttccctccgcgtcaggcgccatcgccaccttcaccggcttgggcgcgttctcctccttcatcagcttgggagagatggtgcggaacacccgccactccatgaccaggtcccgcgacccctgcccggactccgcgaagaaggagttctcccccaccggcgcatccagccgatcctcccaatcctccacggagaggcccggggccgcggagccacctcccccctggtcaccgatgacgcgcgccactccccagtccagctcacggcccgccggggccagcgccttgttgcggctcttggtgatgcggatgatccacagcttgctctgggtgggggattcgcgcttgcccatcaccatgtagcggtggaagaagccggacaccttcgagccaccgaactcctggcgccactccgtctccagcaccatgctgccccggtcttcgcggaagggcaggttggcctccgtgaagtactggcgcacctccggccacatctcctccaccggccgctcgtagatggcctccccatccgggatgaagaggtcgctataggtgccagcctgatgggcacagcccgtcatcaggcccgccaacacaaccgccgcgtagaccaccgagcgcattcgtcccgtctcctcgtagagccccagcggagcgtaaacgaggaccaggccccggcatatcgacccggcagggcggctcaggcgggggcttcggagccttcctcggcgatggcgcgtgcccgctcccaggggcgtgtccggacggcgtcgcgaatccacatcacgtggcgccgctcgtcctcccggtgcttttcgatcagctcacggacctcggggcgccagtcgaagcgcagggcgacgtcgtaggcgcggttggagaactcctcgttgccaagcatggccaccagcgcggcctcggtgcccatcatgctggacatcgccgtcaggcccaccatcgccgttcccttgaggtccaggcgcaactccagcggcgtcccgcccgcctcgtggatgagggcgttcaggtcctgtacgtgccggacgtggtcgattcggaatccgttgagccgctcgcggaccaactgttccggaatccgggccagggccgcgtcgtaggcacccacggcatccgcgtcgagctgggccaggctgcgcagccgggccacttccgatttgtcggccatgtcgaactcctgcgctgaaggggctcgggcaatgtgagaaggctgttcccgcaaaccaacccacctcctggacgcgctgactgcccgcccctggggcaggcggacagccagggcccaggtcctcaggcgtgcacggcgtcagagggcgcgcgcggctgggtggcgtgcttcctccgcgcgacccggcggtgcttgaggacaatcacggcccccagcaccgcgctcaacagcatcagcgcgttcgtcaccacgaagacccagttgccgaccttccaactgtagagcgtgaaccccacggaggccgtcatctgccccacgaagagccacttggacacaccctcgctcgagcctgacttccactgcttgtggacctggacagcgatggtcaacagcaggacgaatgaactgaaccaccccagggcttcggcccccatgcaccctcctggccacagacgatgtgcatgcgccctgccgtgtgcagcacgcccgtcaccccaccggaccgcccaccgcgctcagcctgtccgcgccgccgcctcgcggtgtcgcgcaatccatgcccgcgcctcttcggccgaatccacgtaggccgtgtcgagccgcatcccgccgctcagcatcgcgcccaccatgaggctcttggtggtggccttctgctccatcgccgcgccgatgtagacgacgcccaggaaccagcccgcctgcgcgtggtccaccagatagcggcgcgactccggactgaggtgcgagtccgtgatgtccgcggccaggtagaagcgctgcgcgtccgccatctcccggtacacgccacacgaccagaccgacgtctccagggtgatggcgccccggaagcgcgcccagaggatgtccggcgcttcgaaccacgcttgctgctcgccgtgacgccactcccggttcaggctcatgggcctcccacgctggaacaggcgccaggatagccccggccccagcgtggacccaacagactcccggtgcggaccgtcagaagccgagcggcaacacgaaggccgtgccgttctgcgtccccgtccggtagctgcgcggcgcgccgatgacgagcatgggcggcgagctgccgctgcccggcatcatcgacatcgcctgccccagcgccgagcgctccgagccatctcccaccaccatgaagaacggtgaaagcgcgccctgctggccaaccccgccagcatagagaaacaccgcgccaccgccgtcggacgcctcggaggcgcccggcgcgctcaccagcaggtcggggatgttgtcgcccgtgaggtccgtaccgcccaccaaccgcgcgccgaagttcacagcgcggtgacggtggaccaggacaatggggttgaggccgtcgcccagcgcgcccaccaccagcggcgagcccgcggactggagcgcctgcatccggttcaccagcaccgtcttgtcgaagagcagcaccaccggctgcgtcacgccgttgaagggcacactggtggcgctgatggccacgaagtcacgcgtgtcgcccaggaaccggcccgcgcgcgtcatgctcaggcccaggcccatgttggtgagctgcacctcgctgtcaccggcgatgcgccacagcgtggccgtactgcgcccgccgcagcgcgcgccgcccgcgtcgaagcccagcaggatggccacgcctgaccgcgacccttccgcgtagcgccaggccagctcgtcacagccatcaccgttgaggtcgcccaacgacaccggcgcgaacgtttgaatgtccatggacggcatcgtgtagatgggctcacacatcatgctcagcttcgccagcgacgcgtcctcgggcgcgcggcccaggaacacctccatgccgtcgttgcgcagcaggcccacgtcctggcggccatcgccgttcaaatcaaacccgcccaccacgccgcgcccgatgccggtacgccggcagagggcctccggctccaacgtgcagtccgcgatgacgttcggcgcgaacagccggtacgccggcttgaagctgccgtccggctgtcccagtgacaccagggcaccgcccaccgactgggtgccactggtgacacacgcggcgggcaccgacgtgtacgtgttgttgagctcgttgttggagctcgtggtgcccgtgcccggcacgtagaagttggacgcgcccaccaccaggtctggacgcccgtcgccgtaaattcgagaatggccacgtccacgctcaagttgcgcaccgcgtgcttcgacgagggcaggccctcctccaccacggtggcctgggcgggcgccgacacgtcgtgcacgtaggcacggccaatggtcagggagttcctgtcatagctggtgctggggctggaccagcccggtgtgcccgtgagcaccagcggacggccctgcgggccctgagcaatcgctaccgcctcgccgaagcgctccacgctcggcttcgcaggcacccggacgctggtgcgcgtccactccgtcaccgacgcgccttgacggtggtacagctccacgctgccggtgaaggccccctgagccgaagaggaccggcccgcgaaggccaccagcgacgggttcgccgcggggccccaggtcgccagccccgagcccagcgtgtccgacaccgccgtcccgttgatgaccgtcagcggccggttgaggatgctgccctgcgtgagcgtggccaggggatagacgagaatcttgccgctccagcgcagcgtgccgctccccacacccgatggcgcggacgcgtacggcgcgcccaggagcagctccaggcccggctcgccgtcgacgtccatcaccgcccagctccggcccgcgttgatgccgctggcctcgccgtagatgcgggcgaaggccgcctcgcgcgtcacctggggcggccggttggcgggctcgccggtggcggagtagcccgtcaaatcgaacagcagcgcaccacccgaatcactgccggactgcaggcccccgctcgagcgcaggtccggcgagtccgcccggtccgccaccgccagcagcagcggaggccgcgtgccctcggcggggatgacgcccagccgccacgtgccctcgttgctgtccgccgtgttggccggcagcacgtacacgtccggcgatgcccggaagcgcgcgccttgcgcgcgtgccaggaagacggagatggccatctgcgcgcccgacaccgctccggacgcgttgtaccgggacacccggctcagcgccgccaggtccaccaggccgtccccgttgaggtcgcccgtcaccagcgcgcggcccagctcggtgctgctgcgcgacaccagggcgccgtcctgcgtcaaatcccagccgcccagccgcaccgtggggaggtccggcaccggcgagctccgcgtcgacgcgtagatgtccaccgtgccgcggttgcggatggcgttggtgggggccaggtcgcccagcggcgagcccaccaccacgtccaggtcgccgtcgccctcgaagtccgcgatggccatgcccgagccgaacgccgcgttgcggagcaggccggtgagctgctggcgcagcggcgccggcgccccgcttcggaaggtgtagaggtacaccgcgccggcgttggtgacggccacgtccgcgcccggcgaggacaccagcagctccgcgcgcccgtccccatccaggtcgcccgcggccagcgcgtcaccgaactgcgccgtctccgtggtgccggtgagcacccacgtgggctccgtcggcaggccgccgctcccccccttgaagatgaacacggcgccgcccgacggctcgttcaggtcgctctcgcgctgccccaccgccaggtccaggtggccgtcaccgtcgaagtccgccgtcaccagggtggccgcgtcggacagacggccgtgcggcagtcccggccgcgtcagctcgtccagcacgcgcaccgacacccgcgccgtgtccccggtgaaggggtccgccgcattgagcaccgccacgccggtagcgccgggctcgatggtcagccggccgcccgccagcgtcccggggccggactccttcgtccagttcacccggtcactgccaccgcgcgtggccagcggcacggacgaacccgagggaacggcgaggaaggccggcgctccggtcaaccgggcatgagtgcggacctcgtactggagcaccgcctcgtcgcccgactgcgtgtcgcgcacggtgatgacgtccaagccctcacgcgtgccggccgtatagaggccgccaggcgacagcgtggcgccggagccgtcggccgacagcaggtacatggccgaacccagcacgccgtccgtcaccacctggaaggaggtgcccggccgcagctccgcgcgcacgggcgcgacgttgaacgtcgccgccacgttgacctgcgtggtggcgctcacgcccgggcagcgcgcgtcctccaccaccaacgtgtccgtgcccggcgtgcgccccgccaggaagcggctgcccaccagctcacccgaggagcctcccggctccagcaggtaggtgtaatgaccgctgccgccggtggccaccagggccacggggctcgacacacgcacgcgcgcgggctgcgcggtgagcgtcagcgcggccaggcccgtgcactggtccgtctggtgaggctgcgccacgcgcgcgggcgcaggctcatccgagcaggccgcggcaaggagcgcgaggaagggggccgcgcgggtcagtcgggacatgtcaggtacctcgagggagactgcgcgttgcttcagggcctggcgccagaggaggcccagcgctggatgcgggagatgagctcggggtccatgggaccatcggcgggcatccgctggtctctcacggctccagtgatgatgggcgcgttggcccgccacagctcatagctgtcgagcgagcgcgccgcgctggagctgttgtggcagttgcggcaccgcgcctcgtggatggggcggatgtccttgtcccagctcagcggccccgacgccaggggcgcatagtcgaacggcaccgagcgctgcgcctccgaaccatccgcgtagcgcgccaccaccgacaggacgtagcggccggcctccagcgacgcgaaggagtaggcgcggtgcgtcccgtcggcctccagaccgcccaggctgtagtccggcccctccgtgggaatctccgagttgcccagcttgtagacgacgctctcgggcgctccgcccggcggcatcaccgcgcgcaccaccaggccgtcattcaccaactgcatgccctggtagagcccccggaggcgcggcaccagcacgtggctcagcgcgacggacaccccgccctgctgcacccagacgctgccgctctcgtccgcggcgaggaaatggaagtccccggcgccggcgtccgtggccgcgcgccagacattcgcgtccgcatcgtactggagcagcgaaccgcccgtcttcgcccacaagaagcggcccgaaccgatcaacttctgcggctgctgcggcagctccacgcggcgccagccgtccttgccccggcgcagcagggcctggttggtgagcgcccacagctcgccagaggtgcccaccgcgggcccgattccggccagcgcttgcagcgactcgccttccgccaggggcgcgctcgtggtgtgcacccggtagtgggcggtgctgagggccaccgcgacgctcagcccgccttcgtgcaggaaccacacgccgggcaggttctccggtgagggcgccgccgccagcgaggtgatggccttcaccgacgcgccgtccaccttcagctccgccagcgtgccttcctgcaggcggaacaggccgcgcgtgtgcgccagccacaccgcgccgtccgcggactgcgcggtggcgatgacgccctgccccagcgcgtcccgccagggcggcgcgatgagccaccccgactccgccatgaagagcccggtctgcgtctccaccagggcgctgtgaggccccagccggaagacgccgaggatgccgcccgccgccgcctcattgtccgggtgcggctccagcgccccgtacgtgccgtccagccgcagccggacgagctcgcgcgaagcggtggcgaagacacccccgcccgcctggtccgcgaagccggagaccggtgccagggccgtgacggcggggacctggaccggctggaagggcgtcggctcgggcttgtcgagcggaagcgaacggtcctccccgcacgcccccaggaccacgagcgagagcagggagaggacggcggaggcggaagccctcggatggatgcgcatgcgaaatggacggctcaggcgagaatggggcgcagcggttcgacgcgggtgatgctgtagtccagccccgcggacgccagcaccgtggcgatgacgtgctcggggaggatgttctcgccgttcgggtccgacgcgccgttgcgcaggtcgaaggtgcccggcgccatgccaatgtcaccgctgcggccgaacacgaagttgtgcttgatgccggcccccatcagcagcgcggagttgctcaggtggtggtcacggccaccggagctgttgatgagcggcgtgcgggagaactcggagaacaccatgatggtggtgtggtccatgaaggtgccacccgcgggatggtcgctctcacgcaggtccttcaccagcatggccagggcgtcgaagccgcgccgctgattgttggcctgcgtgagctggctgccgaagtgggtgtccaggccgcccgtgaggttgatggtgacgcactgggcgatgcccttcttcagcgcggtcgccaccgtggcggcgcggccgcgctcgccgttcacgtcgttggcgctggtcaggttgtacttcgtgcggatgaccgccatctccgcgctgtgcggctggttggctccaacgaggaagtcgaacgacttgtccagtcccttggactggatgagccgcatctgctcctggctgttggagtaggtggtgcccaccccacgcgcgccataggccgcctgctcgcagttgacgggctggccgcggaagtcgagcagctgcttctcgagttcactgtccagcgcgtccgcgctgcccttcagcgtcaggatcaggtcgtcccggcggctgacgcgcagcgcgttggcatagccgccgtaccggtcgttgtacgactccacgttgtaggagatggaggcaatgggcacgcgcggcttcatctgccccacgatttcagtcgccgtggaggagccacgcgccgcgctgccaatgggcatcttcccggtgaggaagtagcggtagcccacctcgtggcccaacgtgttcatgttgatgccgcgcaccacggccattaaatcgtagtgc

SEQ ID NO: 1178 - DNA, 16924 bp, Myxococcus xanthus
  unsure (1)..(16924): unsure at all n locations
tggcggcccgcgcccaggggttcccatcaccgaccccgcaaagacgcagacggcttggggcctgtctttcaagacggtcgcgatggccctcgcgcccagtgcatgtgcggcggcgccttgtaccagtgtctccggcgtctcgtgctccaacgcgacgggcgtcagcgtgcccgcgaagtggaaggcgccgtcgagcgactgaccgaagtgcgcctccgcgtcgcgcacggcattccgaagcgcgacctcgttcgtgacgtccacggagacatacttcgcggtgcccagctcggactccagcgcccttgcctcgggaccatgagggcgccgccccacgagcagcagccgggcgtccaggccctgccgcagctgacgtgcccactcacgtcccaggccaccgagcgcgcctgttaccaggtagagccctccccgcttgaggcgctggggcgccgcgagcggtggcggcgtccatggggtgaagacgcgctcccaacgcgtgccttcccgccacgccacctcgcgcgcggcatcctgggaggcgagttcgcgggcgacagcatgggcggtggcggatgcatccggtggcgtccatgccacccgcgcttccagccccggaacctccgccgcagcggtccagagcaggcccggcgtcagcaaggcagccagcgaagccgcgtcgtcccctcccgactccggaagcaccgcgagcacgcgcacgaccggagcgccctcgcctcgcctggccagggactggagcgcatgaagcagtggcgccatgcgagaggccaccgccgcttgcggcacggcatccgaggccgtgccttgaaccggcacagccagatgcgcgaccggcgccgcctgcatcgcgccgtccgaggtcgtgccctggtcaggtgcggaaacgcccccggacacgcctccgccaggcgctctggcggcagcgtcctggaagcgcccatccgcagccgtcatctccccgcgaagcacagactcacggaccgcgggcacctcctgcgcctccggcagcagcaccaccacgtcgccacagggcacactgcgctccgcaagggcctcaatggcacgaacgagctcaccgttcgcctccggcgccacccgcaccacctggtagccgtcggcctgttcgcgcaatgccccggcgaaggcttcgtccgcgatgacgaccacggcaccgcgtgttcccaccctggtcgccagcggccgaggcacccaccgggacaccgccaggcacggcggcatcgtggcgggtccgcccaggacgctcagcgagcggtgatactcggcccccagctcgcccgcctcgaaacggcgccgcaattcggtgcgaccccgcttccccagctccgtgcgcggcacctgctcgcgcgccaggggcaacaggtgcgcgacatggaagccgagcacccggcccaccttctcccggatgctccgcagcaactccgccagcggcggcgcatccggcgtgggcacgaagcagacagccagttcatccgtctgtgccgcaccgctccgcgtcgggcaggccacggtgtacgacggcagcacgccaggcaccgactccaccacctcctcgatgtcctgcgggtagacgttgttgccgtggaggatgaggacctccttctggcgccccgcgatggacatctgcccgtcctgaatcacggccatgtccccggtgcgaaaccagccatcagccgtgaaggagcgcgcgttgagttccgcgtcatccaggtagccggacagcacctgctcaccccgggcctgcaggtggccgacctgaccttcgggaaccaccgcgtcggtgtcgtccaccacacgcagggccgcgcccaccggaggcggtcccagctccgtcgccgcttccacgggatgggtccgcacgccccgcgtcatcgagaagaaggacgacgtctccgccatgccccaggccgggcacaccgcgtcctcgcgcagtccgctgtcgcgcaggggctcggagaagcgccggagcgtcgcgggcagcacggactcgccaccagaggccagcacccgcacctgctccagccgccacgcgcggcgctcctcgcgctccagccgatccgccaccaggccgtaggcgaagttgggggcccagctcatcgtcccgccgaactccgagagcaaatccagccagcgcagcacgtccgccaggacgtagtcgcgcgccaccagcacatggggcgtgcgggtgcgcagcgcgagcaggtgggggtagctcgtccccgccacgtggtccaagggcatccagctcacgcccacgtccccaggcaggtaccaaccgccggccaccatcccctcgcccatcgccatcaggttggcgtgcttcaacaccacgcccttgggacgcccggtgctcccagacgtgaaggagaggatggcgggcgcctccgggtccacggccgcgaggggccccggctccgcgcccgacagggattgcagcgacagggcgcgcagccccgcctccgacagcggcgccgtggccctcgcctccgtgagcagccacggtgttcccaaccgctccgacaccgagatgagccgcgcgacgccaggctgcgagcgctccagcgacgccggcagcgccagcggcaccggcaccacgccgccgagcgtgcaggcccagaagccacgcacgaagtcgcccgggcgctccatcgcgagcatcaccctgtcacccgtcttcgcgccccgcgcccgcagacctccccacagccggagcgcctcgtcccagagcgcggcgaacgtcagcgtctcccgctgcccctgtacgtcgatgaaggtgatgacatgaccgggagcgtgcgccacggcctgctggagcagttcgacgagcgtccgcggcgctcccgcgggcatgctgcgcggtcctgaatcgatgagggaaggccggcctcccgcatcaatccgcgccggagcctgagccgaagacacgggcgccacgccccccgccttcagtcgcagcgcggcgggaagcaaggcgtccagcggcgtgtggacctccccgtcccgccgggtccccacgagcgccaccgcctcgatgccctgttgccggagcgcgtcctccagggcctgaagcctcgcgggcacgggcggcatgctctggcgcagcgccgccgcgtccacatcgccggagtcgagccggggcagcgcgtccaccagcgccacggcgggaacatccggccccaggcgctcgtgaagcagtgcgtccagttcagccgctcgcaccgcgcgccgaggcaccacccaggccacttcgggcgacacccagacgtcacggacgcgcgcttccgcacgcaggaactcctcgacgagttgcaccatcgacgcgcgtgattccatgtctcaagcgtatcagagccgctcccggccccgccgcgagggagccgggttgcacccggaggacgggtgggaacaagctgtgggttcatggccgccccccacgagcccgtctccctcgcacagtcactccacttctgggcgcgcaacgcctccaacgagtccgccctcttccagacagcgctccgggtggggctcttcgacgcactcaccgtggagggcagaggtgaaccactgccggtggagacgctggcggagcggctcggctgttccgcgcgaggactccgctcactgctggagctgttggtgtgcctggacttcgtccgcatggacgacacgcgccgcttcagcctcgcgccccacaccgccaccctcctgggcgactcggccttccgccagcagcttcaagccgagctcccctggtggggccccatggggttgctggccgacgccgtgaagtccggcgagccggtggacttcgagggacagcgctgggacgtcctcagccacctccgcgagcgactggtggcgcccacgccgttcgccactcccgcgcacgaggacttcttcgaccgcttcacccgcagcggcctgcgtacccaggttctcctggccgcgggacagagcgggttgttggcggcgctcgccgaggacgtccgcacggagcaggcgctgggcgagtccacgtccacgcgtgcccccggggtgctgctggaagcgctggccgtgctgggaatgacgcggcgtcaggaggatgggtgggcgctgacacctgaggcgaagacactgctggaaggaaaggccctggcctacctggtgcgctcgctgtccgtgtccgcgcggtactgggaggccctcggacgcctggacgagacggtgcgtcacgagcgctacgtgctcgacctgaaggaccccgaggtgagcgggcgcttctacgcggacaactcccagcaaatcaccgccgtgttcgccacccacttccaactcagccgccgcgccgcggccacgctcgcgggcgtgcgtccgctggagggcgccgcggtgctggacatcggcaccggctcgggcgtgtggggcgcggccttcgcgcgcacgtcgtcctccacacacgtcacgtacttcgaccaggccatcgtgctggagcaggtgcgccgcaacgtcgcgaagctggaggtcgcggaccgggcgcgcttctggccagggaacctcttcacccaggacttcggcgccgcggacttcgacgtcatcatcctcccccaggtgctcaacgtgctgagcccgaaggacgtcccagacatcttcgcgcgcgtggcccgggcactgcgtccggacggcatcctcgtcatcgccgagtacgtgctcaacgagcgccgcgacggccccctggaccacctctacttcggcttccgtcgcttcatgacgaacgagggcgacctgctgtccgcgtccgagtacgcgaagctgctcgcggacgtgggcctcaccacctccgtctgcatcccccttcccacccaggaactggtgttcgccgcgcgagacggcgtggccctgcccaccgcgctggccccaccgccccgaccgccttctgtctgacacagcgcgatacatctgacacagcgcgatacatctcccgcccctcgccttgcccggagaagggtgcccggttagcgttcccccagtccgccccctcgccccgaaaggtctcccgtgagcgccgcgccgcaggaggacagcgacgccctgccgtccccggccgcccggcccgtgcgtggcgtgcgcccgacctccgtcgccgcgaggctgcgcgccgaatacgcacgagaggtcgccacgctcggctaccacgcgcactccgtgcccggcgcgctggcccatctggcgctgcacctgggcctggccgtggccgccgcggcggccttcgagctgttgctgccacacgcaccacgtgccgcctggctcgtgtacccgctgctggccttcctcatcgcgacgcgctttcgcgcggtgggcaacatgctccatgaggcgtgtcacggcatgctcgtgcgcggcaagcgccacaaccggaacctgggacacctgctggcggtgctcgacctgacggccctggacccgtatcgcagggaccacttcagtcaccatctccacctgggtgacgcggagaaggacctggacttccagccgcgccgccgcttcggcttcgcggacccggaccagcccttcgtgaagtcacacctgctgcgccccctgctgctcatccacctgcccgccttcatccgcccggtgttattccaccgcgaggacccggtctgggtgacgctgctgcgctggagcttcatcggcggcctgctcgccgtggcgcacttcgtcgtgggctgggacgtgttcctgcgcgcctacgtcatcccctacttcgtcgcctaccaggtcatccgctactggtcggacgcggtggaccacgcgggcatcatctcctccgcggatgagttccaccgttcccgcaatcacgtcttcgcgtggggctggctcaaccggctcgtcttcccgcgcaacgacgagtaccacctcacgcaccacctcttccccgcggtgcccacgcccttccaggggcgcgtgcaccaactgctgctgcgcgacgcggactatgccgcgcgcgagcatgccttcgcgtccctgacgcggtagcgcgggcgctcagcgcgcggtggcgcgctcgatggcgtccagcgcctcggagaaacgctccggcgcgatgcccagtcccaaccggaaaccgtgcccgcgctccagcggatgtgctccgtccggcgagcccgcctccatggcgctcagcggcaggacgaacacgcccacatccgacagggccttgagcagcgtctccgcgctggcgtcgtcccgagcctcccgcaggccgatgcaggtgacgagcccgccctggggcgcgacgccatagacaccgcgcgagcgctccaggaaagcagagagcgtggcgcgattgcgcagccagtcctccccgagcgcggcgcaacgcaggactgtccaaatcccgcagcacctcgcgcgccacccactccgtcaccggattcaccgtgtgcgtcgtgtagttcttctcgttctgcatccgcgacagcatggccgtgtcgcccaccgtccagccgatgcgcagccccgggcagcccaggcacttgatgaaggagccggtgacgaagtgccgcgagcccggccggtacacggacgcgcccagcacggacgtctccgaggacaggaagcggtagtgctcgtcccccaccaccgtggcgcccgtccgctccgcccagcgctccaccgccgacagcagttccgccgtcagcaccaggccgctgggattgtgcgggttgttgatgatgacggtgtcgggctgctcgcgctccagccgctccagccacaggtccgcgtccacggacggcacgccgttcgcgtcccatttcacgggcaaccgcaccacctccgcgccctgacgctggggcagctcgtagaggagctggaacgccggccacgccagggccaccttgcgcgggcggagctggcggaacagcagcagcaacgcctcgctggtgccagtggtgatgaggacgttgtcccgcgtggcgcccgggtgcatggccgccaccgcgtcgcgcaggtccgcgcggccccagttggggctgtcattcaaaggcgtggagaggaacacctcggcggcgcgctcggcgctgacgcccgagccgaggagcagctcgcccacggtgacggggcgtccaccggactcccccaggttgaagcgcgcggtgaagcgcgagccctccaggtagtcctccatgaagaaggtgcgcagcggttccatgatgctcccgaaaaggaatcaggcggagggggcgacgtccggccacgcgacgtccccccgatgagcgatgacgacctgctgaatgggcatgtcgaagccgcgggcgtccgtgaggcccaccggccccagcagcgcacggaactccggcagggacagcacgtccccctcgttcgtcacgtatcggcgcagcgcgaagtagagcgcgtccagcgggccgtcgcgccggtccgtcagcaggtagccggagatgagcagcagcccgccgggacgcaacgcccgagccagccgggcgaagaagctcgggagctccgagggcggcagcgcggggatgatttgtggcagcaggatgacgtcgtagcgggactcgccgtagtccaccgagagacagtctcccgcccacagctcggagcgggcctccagcttcagcttcgccagatgggggcgcaccgcgtccagcacgtgcggcgaatccaggtacgtgacgtgcgtggtggggtccgccaacccgaaggccgcgccccacacgcccgagcccgtgccgacgtccaacacgcgcgcctgtgccaatggccgcatcgaccgcaccagcgtcgcggcctgccggctcagccgcaggtgcgaggcgaagatgctggagatgcgtgaagcgttctcctggtagatgcgccgcgccgtctccgggtcacgcaagtccaaccggaagcgctgctcgcgcaccgcctcatccaggtgccccagcgcctcccagtaggccatggtcgccggcagcgctcgctggaagtacggaaggctctgggcgtccagcgcccggcccgcggcctccgtgaagccccagcctgtctcctgtgcctggacgatgcccatcgccgccaacgcgcccagcaacacctccagcgcctccgccgacgcgcccacttcccgcgccagcacctccagcggcacaggcccgcgcaccagcttcaccagcacgtccagctccgcggccgtcaccaacgccagcgtgcgcgcggggttgcgggcgaagcggtcatggaagtcccgggcctcggcgctcgggatggatggcgcgggcgacaggaacagcgcgcggtaccatccgagcacgtcccacgactccccgccccactccacgggaccaccaccgcgcacggcctgggacagaagcgccagcggatgccaccaccgccgcgcctccttcagcctcgtggtgaacgcctcgtcccggaggaaggccacagtcgaggcgcgcagcgaatacccccgcccctcctccaggtggacgaagcccagcgcgaccagcggctcgacgacggagcgcgtcccccgccaggtgccgcccacccgcttcgcgagcgtctccagggacaccggctcgcccgagcccgtctccgggaggtgtccgaagaggccgagcgcgaaggctgcctgaagtgccgccgcttcgttgctggcgtctcgcgcgtggaagttgagctgctgaacgaaggcgggggacggcgcggaaacgggctgtgacacgaagcagcgctcctttacgtccagcggaaccaacgaagagccagcagcagcggcaccacggtccacgcggccagcaccaacatgggcgcacccagtgaagccaggcccgcgccctccagcatgacagcccgcagcgagtcattgatggccgtgagcggcaaggcgcggatgaccggctgcaaccaagaggggaagtttccggccgcaaagaagacgccggagacgaacatcatcggcagcgagacgaggttgacgagcccgcccaccgcctcctccgtccgcgcccggctggccaccagcacgccgagcgcggcgaagcacagcgcccccgcgagccccaccagcgtcaatgtgaagtagctgccgaacatcggcacgccgaagagccagcgcgcgaaggcacagaagaagaggatttccgccagcgcgaaccccgcgcgcgccagcatgtaggacaggaagaactgggagcgccgcatgggcgtcgcggccagccgcttcagcagcttgcctccgcgcatcgccaccagcgagcccgccaccacccacaggctgctggacatcaacgacaggcccagcaggccggggatgaggaagtcgacgtagcggtttcccggctccgacaccggcgtggccttcaccacggcgggacgcgcggcgtcttccggcgcggcgagcgcctgctccaccaggagccgcgcggtgcggccctccgcctggctggggtccaccagcgcctcgggcaccgcgcccggcagcagcaccagggagagctgcccgcgcgccagccgccgccgggcggacgcttcgtccacgacctcggccgacagctccggcacgccctccagcttcgccatcagcgccggcgcgcccgccccctccgccacggccacacgcaccgggcccagggagtcattccggaacgccagccccaggaacagcgaggtgacgacggggaagatgaacgtccagaacagcacctccggctgccgcatcaacatgcgcagccgcatcaacaccaactggcccagggcgttcatcaggccgccttctcttccgcggactcgcgcagggagcggcccgtcatgtcgatgaagacatcatccagcgtggggcgccgggtggacaggtgcagcaactggccgccccccgccgccacctcgcgcagcacctccggcagcgccaggtgcagctcccgcacccgcagggtgatgcggccagcgtgccgctgggcggccaccaccgacggcagcgggcgcaaccgctccaggtccggcgagggctccgcctccaactcgatgacctgctccgcgcccagcgaggtgatgatgtcccgcggcgtcccgcgcgcaatcacccggccccggtcgatgatgaccagccggtcgcacagcacttcggcctcatccatgtaatgcgtggtcaacaccacggtgcgcccgcgcgccttgagctgcgccaccacgtcccacaaggcgcggcgcgactgggggtccaatccggtggtgggctcgtccaggaagagcacgtccgggtcgcccgccaagcccagcgccaaggccagccgctgcttctggccgccggacagcttgcccacccgggcatggcgcttctcgcccagttgcaccagcccgatgagcgcctcgacctccagggggcgtgggtagaaggaggtgaacaaacgcaccatctcctccaccgtgagctggtccaccagccgcgtctcctggagcgtcatcccaatgcgctcccgcagcaccggcgcgtccgtctcccagcgcaaccccaggagccgcacctcccccgaggtggccgtctggaggccctcgaggatttccacggtcgtcgtcttgcccgcgccgttggggcccaggaggcccacgcactcgccacggcggatgtccaggtcgattccgtccacggcggtgacgtcgccgaaacgtttgaccaatcccttcacctcgatggcgagctcgtcctggtgtgtcatgaatggggggctggggggcgcgcgggcgagtatcgctcaacacccggcgggtgcccaaccaacccggtgtggaaagcggcggggccgggcacgtcggggtggtacggtgcccccgtggccctgaccgactcattggaagcccgggtggaccggctggaactgcctttcaacgaatacggcgtcgacccgtacggcatctccaagtctcacgtgaaacatgcgctgcgcgtctttggcgccatctaccgctactacttccgcgtgcgctgttacggggtagagcacatccccccgcggggccgcggaatgctggtgggcaaccactccggcggcgtggcggtggacggggccatggtcctgacgtccaccatgttggagatggacccgccccggctggcgcagggcatggtggagcgcttcctccacaacttccccgtgtcctcgctgtgggccagccgcaccggacagttcatcgggctgcccgagcacgccaagcggctgctggaggatgaccggctgctgatgatcttccccgagggcgcgcgcggcacggccaagctctacaacgagcgctactcgctggtggacttcggcaccggcttcgtccgcttggcgttgcagacgcgctcgcccatcatccccttcgcgttcctgggcggcggctcggccgtccccacggtgttcaacgcgtacacgctggggaagctgctcggcgtgccctacgtcccgttgacgccctacctgttgccgctgccgttgccggtgcagttggaaatccattacggcgagccgctcgtcttccatggcacgggggacgaagaggaccacgtcatcgagggctatgtggagaaggtgaagcagcgcatcgcggggctcatcgagcgcggccgcgcgcagcggcacagccggcggattgggaggaacctgttgccatgagggtgctgattccaggcatctccggaggcattgcccgccagctcgcgctgcacctgcacgcgcgcgggcatcaggtggcgggcatcgacacccgcccctgggccgaggccaaagaggccggcatccaggtctaccggggcgatgtgcgcaagcgcgccgcggaggacgtcttccgccgctggcgtcccgaagccgtggtgcacatggccaccgtcaccgccttcacggtgccgggcaaggagcgcgggcgaatcaacctggacggcaccaaggcggtgttcgaccactgcgcggcccatggcgtgaagcagatgctcttcgtggggcggcacaccttctacggcgcggcgccggactcgccgctgtaccactccgaggacgagccgcctcgcgcgctggaggccattccggagctggcggacctggtggccgccgacctgtacgcggccaccgcgctgtggcgcctgccgaagatgacgacggccgtgctgcggctgccctacaccctgggggcccccggcaccggcacgctgtcctccttcctcaagggccgtcgcgtgccgctggtgctcgggtacgaccccctgttccacgtcctccaggaggaagacgtggtgacagcgttgacgctggcgctggagaagcaggtccggggactcttcaacgtggcgggccctccgccgattccgctgtccgtcatcgtccgggagacagggcgcagggcggtgcctttgcccgcgccgctgctatcgatgctgctgggccgggccggcctcccccgcctgtcaatgggcgctttggaccacctgcgcttccccatcgtcgtggacaaccgccgcttcctggacgccacgggcttcgaataccgccacagcgtggcggactcgctgcgcatcttccgcgaatcctcgcccatcctccccgcggggggccaaggacgttagacttctccccgcagcggacctgcttccggggggaagtccatgtcggccgacatcgaggaagtggatgtggtcatcgcgggaggcgggccggtgggtgtgctcaccgccaacctcctgggactccagggcgtgcgcgtgctcgtcctcgaacgggaggccgcgccgcatggccaaccccgggccttctcctgtgacgacgaggccctgcgcatctaccaggccgcggggctgctcgacgtgctgaagcccgacctgcgccagggccgccacgtcaccttcaccggcgtgggcggccaacccattgcccaggtccaactgggtcaggtggacttcggctacggccacgcgcccatctggttcttccaccagccgctcctggagaaggcgctgcgcgaggggctctcccgcttccccgccgctgagctgcgcacgggcaccgaggtggaatcactggaacaggacggcgcgggcgtcaccgtgcggtacctcacgtccggagtccggcacggggtgcgcgcccgctacctggtggcctgtgacggtgggcggagcacggtgcgcgcgctgttgggcatccccatggaaggccgcggcggccaggagccgtggattgccatctccggcaccgtggccgaggaagacgcccccgccgaatgtcatgtcgtctgcgacccggtccgccccggcttcgtcgggcgtggtcccgtggggcggttccgctgggagttccgcctgcgcctgggcgagacgggcgaggagatgacgcagcccggcacgattcgccgtctgattgggccttatgtgaatccagaccgggtgacggtggagcgagcgcagctctatagctttcattcggtggtggcgcagcgctggcgcgtgggccgcaccttcctggcgggagacgcggcccacctgttgccgcccttcctgggtcagggcctggtgtccgggctgcgcgacgcggcgaacctcgcgtggaagctggcgtgggtcctccagggccgcgcccccgaggcgctgctggacacctacgccgtggagcgccgtccgcacgtgcgcgccttgctggaagccaccgcgcggctgggctccgtgttcaccgcgcgcagcacgcccatggcctgggtacgtgacaccgtgctccggggcctccaggccgttccggccgcgcgccgcttcgtggagggattccgcttcaagccggcgcccgccatcgaggaaggctggatgctgggcggccgccgctcgggtcggaaggccgctgaaggcagctaccttccccaaccgcgcgtgcgtcgtgcgtccggtgaggaacacctgttggatgacagcctgggctccggcttcgccgtgctgagccggggcggcagcccggggacggaggtggcccgtgagctggccgaatccctgggggcccgcgccgtcaccgtgcgctccgcgggtgtcccgggcctgggcgacaacagcgtggaggaccacaccggcaggctgtccgagtggttccgagagcacggcgccgacgtggccgtggtgcggccggaccgcttcgtcttcggcgcggtgcccctggcccggatgcccgagctgcgcgcggcgctgggcgtggaagaggcctgagccgttgcacagacgacagacattgcgagcacggggtccggaagacctcgggatgcaatctatgactcgcccaagcacaatcactctcagctgtccacacctccccagggggttgcatcgaagtccatgagaggagcaggcttccaaccctccgcgaaggcagaccatcgcgcgacctcgggggaaatggcttgcacccaccattggatgcagcgcttctcggctcactggaccggcatgcccggagacgcgcgcaaggcattgcaacgctgagcacgctcgtcgggccgccggagcgggcgctgaccgtctggacggagtggattcagcgccggggcttgagtgtcgttgtcgtggacggggatgacgtgcgcgctgtcgtctccgcgtgggcggcggcgctcgccagggaacgggacctgatgggtgacgcggaggtgttcgtcgttcgctcccagccccagaaccaggcacggacgctccagttccaaggcaagacggcgcaccagcggcgcgtgttgctggaaggcctgacgcccccgcagggacagtccgccacctgggagctgtgccgagccctgctggagagcccggccccgccgccgtccggtgtgcttccagacgcggtgagccaggccattgcgcgcgcgccgctgccggccctccaaacgctgatggcattggtccccgccggaagcacgccggccctgcgcgtgcgggccggtccctctgacttccgggcgctccgcaccgccgcggccctgtgcaccgcggcccccgcgctcacgacgggctgcgtgctcaccgccgaggggctcgccgagcacctccggagggaggagtcccacatcctcgccatgctgcgggaaggccggctggacctagccgagccggagctcgacgaagacacccgcgagttccccgaggccgcggtggcgtccacgcgcgcccggctccggcaggaaggctcgtccgaacaggtcgtcgcgctctacgactcggcggtgcgcaccatcgcctcggcctaccgggacgccaatggccgcgcccggagcgaggcggagaagttcctgcacgcccggctccaggaccatgcctccactcgaggcctcttcgtcctcaatggccatgtggatccggtcggaggtggccggaggctggaagtggacctgctctgcacggagctgaagctggctgtggaaatcgacggctacttccacttccgcagccccgacggcttccgccgagaccggcgcaaagacgttgcgctccagtgctcgggctactgggtggtccgcttcctcgcggacgacgtggtgacgcgactggaagagattcttgaaaccctcgacacgttgattgccacccgcaggggtgagctcagcgggaaggaagcatcgaatgggaagcgctgaccaccggctgtcaggcattgccttgtcctggctcatgacgcgcagcgagcggcgcggtacgcgcaaggagttggaggatgcactccggcccttcgtggagcatcagctcagccgtgcggaatggaagctccgtttcgaggcgctcatggaggcgctgctgggcggaggaaccgtggcggtgcgcgggcgcagcggcttggagctgacgcccaagggccggacagaggtgctgcgcttcctccaattggaccagccgccgcgcgggctgacgtggaagaggctgaaggccacgcacctggtggcgcgcagcttggacctgcggccatcgaaggcggtgttggcgcggatgaagggtgccgacggcgtgcgcgccgccgcgcttcagcgccagcatgggctggacaccgaggaaggcctcaccctggcgcagacgcgggaccggttgttgtggcggcagctcggcgtcgagacggaccggcccttcaccctgggcgcggtgcaggcccacctgctcgggaagatgctggacgcgaaaacgatggacccgcgcaagggcgtggagcagcttgcggcgcgtgcggcgggcgccccccgcgtggatgcggaggccgtgcgcctgtccctgatgcgacggtgggctgttgcgcaggacgccgacgcctccgaggacgcgccggcggaccgtgcatccacgagtccagacgcccctccctctccggcggccttcgccgagcgcgtgctgtcggtcgcccgcgccctccccacgggccgctttggcgagaacaaggtcttcatctcccacgtgtggaaggccctccagccggagtggagcacccgcgaggcattcgacgcggcgctcctggaggccaaccgaacccgcctgttgtcactgacgcgcgcggacctcgtgtccgccatggatccgaatgacgtcgccgattccgaggtccggtccttcggcgccagcttccacttcgtcgtcgtctagcccgaacccaggagcgccccgtggccaacgacccccgcctcgatatcttccttgatgactctcgcgaggtcttcaccagcgtcgaacagggccagcacatctggcaggcggacccattcgacgtggaggccctcaacgcgccggctcgccgctccttcaagcggctgctcgacaaggcgtcctcggacacgcccccgagcgccggaaagctgctgctcctgctcggcgaatcaggcagcggcaagacgcacctggtggcgcgcttccgaaccttgngcatggtcagcg

SEQ ID NO: 1179 - DNA, 18195 bp, Myxococcus xanthus
acagcacacgctggaggcgctgctcctgggcgcggggctgccgcaggactcggcattgaagtcgctcgcggtggcgcggacgctggggctcgtctcgatggagcccgcgacggatgaagacgcgggcgacctgccgccggagctggacgttcggcgcctggaagccaagttctaggagatccaggacgcggactacttgacggcgctggggttggcccgctcggcggggggcgaggaggtcaaacgcgcctacgagctgttggccgccgagttccacccgctgcgcttcgcggggcatcccgacccggcgctccagcaccgtgcgcaagagatccgcaccgtgctcgccgaggccgcccaggccctgggagacgaccggctgcgctcggagtacgcccgaagcctgctcgactgacgcccgtcggacggacggcctcccgggagtgcagggcggcccacccggggcggttgcccgtccgctccggggagattaagacggcgtccatggtccgtgagatcctcatctggcccgaccctgtcctgaaacagaaggccaagccggtggcgaaggtggatgactccacccgcacgctggtgaaggacatgttcgaaacgatgtactccgctgaaggcgtgggcctggccgccccgcaaatcggcgtgctccagcgcgtcatcgtgctggacaccacgcacagccagccggagctgaagcccgttgcgatgatcaatccggagatcatcgccatggaaggcgacacgacctacaacgagggctgcctgtccatccctggtgaggccgcggatgtcgaccgggccgccgtggtcaccgtgaagttcctggacccggacggtcaggagcagacgctgcgctgtgacgggctgctgtccatcgcggtgcagcacgagacggaccacctcaacggcaccgtcttcgtggaccacatttcgtccctgaagcgcgagttcatccgcaagcggatgaagcgcctcaagacttcgcgcgagcgcgaggcgagcgcgccggcgtctccgtagcgccggcgtccttctggaccttcacgcccttcttcgggcacaggtccgcgacgacgcagcgctcacacgcgggcgagcgggcaaagcaggtccgccgcccgtgccacaccaggagctggtggcccagggcccaccgctccgacggcagcacggcctgcatatcggcttccaccttgtccgggtccgccttcgtggtgaacccgagccggtaggcgagccgcttcacgtgcgtgtccacggggaaggccacgtcgcctcccaggtggatgcacaccacgcccgccgtctttcggcccacgcctggcagcttctccagcgcgtcccgcttcaagggaacctgcccggcgtgctcctgcaccagcgaccgggcggccgcgacgatgttcttcgccttggcgcggtacaagccgcaggtgcggatgaagggctccacgtccgacggttctgcttccgcataggcctgggcgtcggagaagcgctggaagagggccggcgtcaccatgttgacgcgcttgtccgtgcactgcgcggagaggatgacggccaccagcagctccaggggcgtccgatagtccagctcgatgcgggcatccggcatgtccgcggccagccggtccatcaccagcaacgcgcgctttcgcttctccgcgaccgtctcacgtccaggcacggcgccgttgtatgtcacaccggctgcgagcccaagcaccggttggacgcacccattcggggagattcatgaagcgcatcgacttccgttccgacaccgtcacccagcccacggccgccatgcggcgcgccatcgccgaagccgaagtaggggatgacgtttatggcgaagaccccaccgtgctccgtctggaggcacgggtggccgagcggctcggcctggaggccgccgtcttcgtgccctcggggacgcaggccaaccagttggccatcggcgcgcattgccgggcgggcgacgaggtgctcaccgaagcaggcagccacatcctccactacgaagggggcgcggtgcccgccttgtggggcgtgcagccgcagccactgccagggcagcgcggtctgctgtcgccggaggatgtgagcgcggccgtgcgcgaggacaacatccacaacccgcgcacgcgcctgctgtcgctggagaacacgcacaaccggggtggtggttcggtatggccggtggagcgcttccgggccgtcgtggaagcggcgcgcaaggcggggttggccgtccacctggatggagccaggctcttcaacgccggtgtcgccctgggcgtgccggtgtccgcctgggccgcgctgacggacacgacgtccgtgtgtttctcgaagggcctgggcgctccggtgggctcggccctggcggggcgcgcggacgtcattcgcgaggcgcgccggctgcgcaagcggctgggcggtggcatgcggcaggcaggcatcctggcggcggccgcgctgcatgcactggagcaccatgtagagcggctggcggatgaccatgcgaacgcccgcaggctggccgcggggctggcggagctgcccggcgtggaggtggacgcttcgcgggtggagaccaacatggtcttcgcggagttctcccggtccgctctggagatggtggcacgactggagcagcacggggtcctgacgaaccccgcgggtgctcctcggacgctgcgcctcgtcacccacctggatgtgtccgctgccgacatcgacgaagccctgcagcgcatccgccgcgccgtgggctgagcacagccttggagtgaaacgcgcgtccgtggacatccctgggcgcgcacacggggcggggaaggagcgcttcgggcgggccatggtaggctcgcaccgccgtgcgccgcctcagcatcctcgccttcgtttcagcttgtgcctgcgctacccgtggcgcggagccgaagatgagtttcgaggagctctacgccacctcggcttcacagtcacgcgcgccagatgcagcgccagcgccccgccgagtgcgaccgcccgcgccggagactgctccggagctgcatgccgtgctcgccgccttcgcgtcgcgagcacaaggcctccgtcaacaggtggcgcgaggcgggacgatgcccgccgcccaggtggagaattgggagcaggtgaccttcgcattggacggcttcctgtcgcgtcccgcggcgccgcgcgtcggctcgggtgatttgctgcaggcccagagcgtcctggaggccgagctggagcgggacggcttcacctatggcgacatgccggccccgctggccgaggcggtggtgttgcgcgtgggccgactggcgctgcgcaccgccgagctgcgccgcctggagcagccgcccgagccggccgaggatgcgcttccgcgcttctcctggccggtggatccggtgtccgtcaccagcctcttcggctaccgctggcaccccgtgacaggcgtgcaccggcgccacctgggcgtcgacctggccgcgacgcagggccagcccatctacacggcggacaagggcgtggtgctgcgtgcgggccacaatggcgaccatggcctccaggtggaggtccagcatgaggggcgctgggtgacgcgctacagccacctgtcccgcgtgctggtggaccctggcgaggtgctggagcgaggcaacgcggtggggctggccggggagacagggctggccaccggcgtccacctccacttcgagctgtggcgtgacggccagcccatggacccactggaggcgctgggtgacgcggagccgcctccggagcccatgccgtcagtggcccgtgggcccgtaagccgctagcccgcaatgcaacaggggcgccccctttcgggtgagcgcccctgcgcgaagtccctcggcgatggcctagagggagttcttcagctccttggcgggccggaagccgatcgtcttcgacgccttgagcttcatcatctcgttggtctgggggttgcgaatcttgcgagccttgcgcgaccgaaccgaccaggttccaaagccgggatagctgaagcgggcgtccttcttcaccgccttaccgatattggtgaagacgatgtcgaggatctgcgccgccgacttcttggtgagacgtgtctgcgccgccaccacctcgacgagttctgccttggtcattacgcccctccgtccgttgtctggccttgaagtgctttaacccggctggtggtaacaaatcgctcttttccctgtcaatgccggctgcggtttggagccggaaaatcggcctccagacgaaaagttggccctctgaaacaccgggcgtaggaagggtgtggagcgtcgcttccgatacatcatcgcgacccatccgtggtgaattggaaaatagctgtgttgtgatcgtgttttgaggaaagtctttggaatattgatcacttgcggagaggggctgatcgcggtcgcgtgagccctggcgggaaggcactaggatgcttgcttgcgtgcgttttcgaaccttcctgatcttgatcctgctgctcgccagcgcctgtcggagcccttcgcatcgcgaggcgcaaccagccgcgtcgtccccggcccccagcaccctctgggtggacgcggctggcgcggagcctggcgacggctcgcgtgagcgcccgctgcgccagctcggcgaggcactggcgcggcccggagccctgaccgtgcgggtagccccggggcgttacacagggccgttcctgatcccacccggagttcgggtggaggggcaggggccgggggtggtgctgcaagcggagggcgctgctcgcacggtcattcaggtgggtgaagatgcggagttgtcggattttgtcgtccagggtgggctctggggggtggagagcatgggcggcggccatgtccggctggcgcgagtgggcttcagggggcaggtgacgggagcggtgcgcgtggaggccgggcggctggatgtggaggacagccggttcgaggcggcgccagcggccatggtgggggtgttgctggaaagcggacgggccccgtctccggagagtggcgagcaatcggcaccgcgcgacgcctcgcccaagcccgaggtgctgtcgaacacggacggatccatgcactcgcctcaggacagcgaggccgccacgggcgctggagcgcagcaggaagacccgagacatgccggagccatcgtggaagcccacatccgcgggagcaccttcaccggcccctaccgtcgagccgtgcggctgcgcggcgcggacgtgcgggccacgttggaggacctccagttcacgggggccgcgacagcggtcggcgtggacggtgcgtacgccgaggtgcggcgctccaccgcggaaggtgggcaggcggcggctttctcggtgatggacggcaccctcatcctggatgaggtctccgtgacggggcacgagtacggcgtgtcctccatgcaagcacgcaggctcgacgtgcaccgcttcacgtcggtgcgggccattcgggccggcatgggactgctgatgtcatgcgtccggctccgggacatcgtggtgcgggacagcggcgcctatggcgggcttcagttctcgggcggggacctggacgtccagggcgttcgagtggacggcgccgccgagtacggggtgatggcgctgcgtgggaagctgcggcttcgtgacgtggacatccgccgggtgcgcacggcggacggtgtcaccggggatggcctgcacctgcgtcaggtcgaagcggacgtggagggcgtcgtggtgcgcgatgcacagggggcgtgtgtcctcgcggcgcagaatgcccgcgtgtcactgcggggcgcgaagctggagacctgcgggtacgtcggcctgctgacggacaccctggcgcgcatgaacgccgtcaacgtggacattcaaggggcggcgacggcgctgggcgctctgggaaacggcgagttgcgtgtggaatccctctccgcgagtggcctggagacggggttcgtccatgcggagtgcgagggcgccacgcaggtgcacctgaaggaattccgctccgaggacacgcgaggcctgtcggcgcgctgtgtccacgccagtccgaagtgaaccggcacgacagcaacggttgctccatcccgctggatgctcatgggacggagcgctccggctcgcgaggctcctcttccactggggcgggagcggggtcggtgatggcggcgggcagggcggaggcatgtcgctccagccactcgcggatgacgggatagacctccgacggggcgccggtgccgaagatgaggtccccgtgcccgtagttcatcttgtcgccatggtccgtgccgaagatatgcagcgtgcggtcgggcgcggtggcgagcgcgaactgcgactccacgttgcccggcgtggccagccggtccgaactgccgcccatgacgagcagcggaagctggagctgtgcgatgccagcgcgccagtccttcgtgcggtcaaaggagcggaacatgtcgtgctcaatccagtcctggaactgaagcagcaccttgcggctcatcgacgacatcatgttcgcgtagacctgccgctggatgcgcggggggatgtgctcggggttcaccagcaggtcggacaggggcagggtgatgtagcccaggaacggcgcgaggctggcgctcatccactcctgccggaagcgtgcgggccaggcggcacggacgcccatggagatgagcgtgcgcaggaagggctccgacttgaagtgcacgggagcgcccagcgcgagcaaccccgcaagcttctccccgtgcgggccttgcgcgacgccgtagcccaccagcccgcccagggaatggccgagccagaatgcgcatttcgcacccgtctccttcaacgccagctccaacagcgcgggtccatcctggaggatgtggtcgtcgatggtgaagtccgtgtacctccgtcctcggggcggccggcgcgagtgcccggtgccgcgccactcgacgctgaagcagtcgaaacccgcttcggtcaggtagtgcgcgacggagtaggggggctcgaagtcgaaggtgaaccggttcgccgcgagcccgtggcacagcagcacgggctcctcgaatcggcgcacggccgcgcgccgcgcgtgaatcaccagctcccatccgtcctcgcagcgggcgcggaggacctggggcagctccgccctggggcggtaccatcgtcgcacggccacgacccaaaggacgttccacagaacgagtgcgaccccggcgaccagtacccacaccacccaccgcgaagcatccatgcatcctccttttcaaaaataaaaccctgctaaggtcggttcacccgccgtcctgccgccgggaagtcacggtcatcagaggaagtcgagggaatgatgaagttgcggaaactgatgttcgtgctgccgaatctcttcaccgtcacgtccattttctgcggcttctacgccatcaccttgtgcacgggggacgccgaaccggtgcagctgtaccaggcggccctggccatcttcttcgccatgttcttcgacggcttcgatggccgggtggcccggttgacgaagactcagagcgacttcggcgtgcagctcgacagtctggcggatgtcatctccttcggagcggcgccctctctcctggtgtacaagtgggcgctcgagcccctggggttcatggggctgttcatcgcgttctccttcgcggcctgtggtgcattgcgtctggcgcgcttcaacgtgctggcggcgcgcaacccgcacggaggcggtggcagtttcttcgtgggcctgcccatccccgtggcggccggaatgctggtctccgtcatcatctcccaccatgcggcgacgcaggggcagcccctggccgagagcgccgtggtgcccatggcggtggcggtggccggcctggcgctgctgatggtgtcgacggtgcgctatcgcaccttcaaggacacgcggcccaaccggaagagcgcgctggctttcatgctcgtggtggtgggcggcacggtgatcgccacgcagttgcacccggcctgggtgctggtggcgtgctgcggcgcctacctcgcgctggggctggtggagtcggcggtgctggtccgcagtcggctggtcgctcgcaagggggcggccccctgcgcggtggccgcggtcgcggtggccacggtcatcgacgacgaggaagaagaggacgcggagtccaaccagggcaacgacgggcccgcgtacctctgacctggaggacgctgtttcccgctcggcccccttccagaccagggggcgttgctgcttgagtgcgcttcggtccgtgcccagccgtccggctgccgctaggatgcgcggcccatgcgcgtcgagctgctgtgcaccggtgacgagctcgtcaccggcctcattacggatacgaacagcacgtacctggaggcccgcctcttcgaccttggcgtcaaggtggagcgcgtggtcctggtgggtgacgtgcggccggacatcatccagtcgctgaaggaagccgcgtcgcgcgcggatgtggtggtggtgtcggggggcctggggcccacggcggacgacttcaccctcgaatgcgccgcggaggccgcgggcgtgccgctggaggaggatgcccaggtcctcgactggctgcaccagcgctacgccgcgcgaggcctgtcgcccaacccgagcgccctgcgcatggcccgcgtcccccagggctcggagcccgtgaagaaccccgagggctccgcgccgctcgtcgtgatgaagctgggtggcgcccagttgttcttccttccgggggtgccccgtgagttcaaggcgctcctggaaggcgaggtgctgccgcggatccgcgcgacgctggacgcccgccccgagcgcacctaccgggccttccggctgctgcgcacggtgggcatcccggagtcggagctcgacattgcggttgctcccatgggcccccggcatccccgcatcgtgttcggcttccgcacccacgcccccgaaaaccacctgaagctgatggcggaggccccctcccaatcggaagcggatgccgcgctcgccgccgtggaggtggagtgccgccagatgctgggcacgaagctcttcggtgtggactcggaagcgtacgccgcggtggtcctcgaaacgcttcgtcgggcgggcgccacgctggcggtggcggagagctgcaccggcggcctcatcgcccagcagctcacggccgtgccgggctccagcgaggtcttcatcggcggcgcggtggtgtactcggagaagatgaaatccgcatgggtgggcgttcctcccgacgtgctcgcacggcacacggctgtctcgcgggagacggccgaggccatggcggagggcgtgcgcgatgcctgtggcacgacctacggcctgtcggtgacgggatacgcgggccctggcggtggcacgccggaggaccccgttggcaccgtgtactgcgcgctgtcggcgcctggcgtgcccacccgctgtgagcgcatctctgtcaccggcgaccgcgaccgcgtgcgcctgttcgccgctttcccacacgcttgaaatgctgcggcagcacctgctcgccgcgcccgctaccccatgagccgttccaagtccaagcgcccccgtccgccctcctccgagccgggagcttccgaaccagccgcgtcaggagcgtccgctgtcgcgcccgtcgctccgcaccaggatgcggggcccgcagccgccagcgcgccagtcccttccgccgaacccgaagccgccccgccttcggtgccaccgcccgcgtcctcaccgggcacccccgtgtcgggaggcctgccgttgaacgtcgcgcgtgtgtggctgtccgcctaccgcgtggaggtggtgctgttcgtggtcgccttcgtggtgctcgccagcttcagctcccagcgcttcctgcgccagagcgccgcgcctcacttcgtctatcaggcccaggcgtggatggaggggcggctggacgtggacccgcaggtgctgcccaacatggaggactgggcctgcgtccgcatggtgaacggcgacaaggtccgttgcaccggacgcccgctcccaacggaccgctggttcgtgagcttcccgtccttccccgcggaggcgatgttgcccttcgtcgcactgcacggctaccagttcaacgacacctcgtttggtgtcatcgtcggtgcgctggcggtggcgctcttcttctcgctgctgcgcttcctggcgaaggaaggggagacggagcgcaaccgcaacgagaacgtggccctggcgctcatcctcgccttcggcaccctgttcttctactgcgccatccggggagaggtctggttcagcgccgaggtgatgggcgtggcgctcacctgtctctacgtacgcaacgccgtccgggcgcatcgtccgctgctcgcgggcctgttcttctccatggcgacgctcacgcggacgcccttgctcttcacggggctcttcttcgtgctggaggcgctgtgtcccgggccggagcctcgcctggcgcagctcaaggccctggcgcagaactggacgcccgccgcgaagaagctgggcctcttcacgttgggcgccgcgccgctggcggggctcgcagccgcatacaacgtctaccgctacggccggctgagcgagttcgggcacgcgtacctcttcaacaaccgcgtcaacgcggacatcgaccgcacggggctcttcaattgggagtacctgccacgaaacctggaggcggccttcttcaagctgccctcggtgtccttgtctccgctgaagctgggatatgacccgcacgggctgacgctgctgctgacgctgccgctgctcgtcttcctgttggtgccgaagacgcgcccgcgcctgcattggccggtgtggctcaccgtggcggtgtgcgcgctgcccgggctcttctatcagaacaccggttacatgcagttcggcttccggttcagcctcgactacacgccttatctcctcctgctcttcgcattgggggggtggtccctgcggaatcgggcggtgatggccgcggtggcgcttggggtgctggtgaacttctggggagcggtggctttccgcggctacacggaacttgtccggaactggtagcgccccacgtttcatgggcttgaatccttcgcgcttcacgcgcagatgagagacgtcatgcaaccacccactggacagccgcctcccggcaagcgctggcacacccgtgaggacagcggcatccgcctcgacgccaggatgcgctggtggcacgacgacgagcccatcctccatcccaagatcatcgagctcttcaacgcctcgctcgtgctggatgacgcggaccgctaccagctccgcattggcaacgactggtgcttcatccaggttgaaggcgccgcctacgaggtccggacagtggacgtcacccccgacgagcgggtgtccgtgcgcctgagcgaccgcaccgccgaggcgctggacgtcgccagcctgcatctggacgcggacggcgtgttgtcctgccgagtgaagcaggggcgggcccaggcgcgcctctcgcgcgacgcgcagtaccagctcggacagctcctggaagaagggcccgacggcgggctcgtgctgaatgtcggtcagcgcaagctcgccgtcccggtcaagctggacgtgttggcgtcctccgtctaggccgcgacctccaccggcgcgggcgaggagggcagggcggaagtccccgtaatctccttgcccagcgcttccagcacgtcgggatgttcgcgcagccactcggcggcgcgctcccggccctggccgatgcgctctccgcgcaggctgaagtagctccccgacttctcgatgaggcccgtggccacgccgaggtcgagcacttcccccacgcggtggatgccgctgccgtacatgaggtcgaactccgcttcctggaagggcggggcgaccttgttcttcaccaccttcacgcgcgccttcgagcccacgacggcatcaccgtccttgatgttgcccgtgcggcgaatctccatccgcacggatgcgtagaacttcagcgcattgccacccgtggtggtttccggattgccgaacatcacgccaatcttcatccgaatctggttgatgaagatgatgcacgtgcccgagcggctcaccgcgcccgtcagcttgcgcagcgcctgactcatcagcctcgcctggacgcccatgtgcgcgtcccccatctcgccctcgatttcggcccgtggcaccagggccgccaccgagtcgacgacgatgaggtccaccgcgccggagcgcaccaggtgctccgtgatttccagcgcctgttcgccggtgtcgggttgcgacacgagcaactcctccacacggacgcccagcttgcgcgcgtaggacacatccagcgcgtgctccgcgtcgatgaaggccgctacgccacccgccgcctgcacctgtgcaatcgcatgcagggtgagcgtcgtcttgcccgaggactcgttcccgaagacctccaccacacggccccggggatagccgcccacgcccagcgcgcggtccacccccaccgagccggaggggatgacggcgaccttctgttcgcgtgcttccccgcccaacgtcatcaccgagcctcgtccgaactgcttctcgatgctcgctaccgccgccgccactgccttcagcttctccgccagcttgctcatcgcgtctgtcactccctcgccgcccttgctgtgttggatgccgcctctagggacgccgtcatggcgccgccagcgcggcgggcagacaggtgagcaacacctgtgccgcccgctcctccccctgagagatgggagtacaggtgtccgggtacgtggctgtgtgtccaagagtgcggagtgtgcgcgtgccactccggcagtcggatgagaaacaagcatgggagcccacgcttggcggcatggtgattggcgctttgcgttgaagatgggctgggcagatatgaccttccctgcgtgagcccgaaatcaaagcgcgaagacctgccccacgtggtcatcctcggcggtggttttgccggcctctacgccgcccgtcatctctacagggcacccgtgcgcgtcacgatggtggaccggcagaatcaccacctgttccagcctctgctctaccaggtcgccacggcgacgctgagtcccagcgagattgcggcgccgctccgggcggtgctggggcaccaccaggtggcggtggtgctggcggaagtgacgggtgtggatacggctggcaagcgcgtgctgctctccgacggagagctgaactacgactacctcgtcatcgctacaggggccacacactcctacttcggcaatgacgcctgggctcagttcgctcccggcctgaagtccatcgaggacgcgctggcgattcgccggcggatcctggtggccttcgaactggcggagcgggagacggacccggagatccgccgctcgctcctcaacttcgtcatcatcggcgccggacccacgggggtggaactcgcgggctcgttggcggaaatcagccggcattcgcttcatggcgacttcaggaacttcgatccgcgggacgcgcgcatcatcctcatcgagggcatggacaaggtcctgcccgtctatccggatgacctgtcacagaaggcctgccgcacactcgagaagctgggggtggaggtccgtacgggggctcgggtcaccaacatcaccgagcaaggggtcttcatcggccaggagttcatccccgcgaggacggtattgtgggccgcgggcgtggcggcatcgccggtggcgaagtcgctgggcgtcgaactcgaccggtccgggcgcgtgctcgtcactcctgagctgaccataccgggccacgacgatgtcttcgtcgtcggtgacctgtccttgctcaaggatgcggagggcaagccggtgccaggccttgctcccgtggccatgcaggaaggcaagcacgccgcccacaacatccgccgccagttgcagggcaagccgatggtgcccttctcgtactgggaccgcggctcctacgcggtgattggccgaggccacgcggtgggcattgccttccgccgcttcaagcaggcgggcttcggtgcctggatggcctggctgctcatccacatcaccttcctcatcggcttccgtagcaggctggcggtgctgctcaactgggccttctcgtacctgacgtttggcaagtcggcgcgcatcatcaccggcccttcgcctcgcctggaccggctccagcccacccacgccttgccggagggtgggcagaccccgtccatcgcagagccccgcttccagacgacgacgtctcacgcggagtccgcgacgaccgggacgcactgacgcgcgcggcagccctcaaccatccaggtcctccagcgggctggccctgccggagggcccggtgttccgccaagcggcgtcctcgggcggaggggcagggcgggctccgtgaagcttgccttgcatcgcccctcgccggtccagcatgcggcagttgatggcgagctgcatgtcggtctgctcgatgcggtcgcgtccctcgaggtctgcccgtgtgagcgccagtttcatgatgcggtcatgggctcgcgcggacaggccgaacatccgcaccgcttgctgcagcatgtgctcggcccgttcgctcatggcgcagtaccggcgcagcaggtgcgcgggaagctgcgcgttgcagtggattcccggctcatcgcgatagcgggcgcgttgacgctcgcgcgcgacctgggcccgctcgcggtagtagcggctcgagggctcttggaccgtcgagcgggccatgtggtgatactccaccgggcgcgtctgcaggctgatgtcgatgcggtccaacaggggcccgctcacgcgcgtcatgtagtcgaagacgcgctgctcgccgcaagtgcaggagcggctggggacgttgtagtaaccgcagggacaggggttcatcgcggccaccaacatgacccggcagggataggtgatgttctggttggcgcgtgccaggtggatgacgccttcctccatgggctggcgcagaacctccagcacgttcctccggaactccggaagctcgtcgaggaagagcacgccattgtgcgccaacgagagttcgccaggcctcgccgagaggccgccgccaaccaggcccgcgtcggaaagggtgtggtggggcgcgcggaacgggcgctcgcgcatcaatgcgtggccttcgcccagcaagcccagcaccgagtagaccttcgtcacctccatggcctcggtgaacgtcatctccggaaggatgccgggcaggcgccgcgccagcatcgtcttccccgagcccggtggcccggacatcaagacgttgtggccccccgccgcggcgatttcgagggcgagcttcaggtcggcctgcccgcggacatcggacatgtcaggcgcctgtcccgtgggcgccagaagacggggttcccgctgccgcgtgtacggcgggatgctgcgggcccccgtcaggtggtccaccgcctcccgcagggtcttcacgggaatgacgcgcagttcttcgacgagcgctgcctccgcggcattggcccaaggcaccatgacaccttcgaagccgccgttgagcgccgccaccgccaacggaagcactcctttgatggggcggagtgtgccgtccagggacagctcgcctccgaagagaagccgttccagcggggcttcatccatcaacttcgccgccgctaggacgcccaatgcaatcggcagttcgaacgccgcgccttccttcttcaaatccgcgggcgccagattcacggtgattcgcttctggggaagctcgaagcccgtgttcttcagcgcggagatgacgcggactttcgattcccggaccgcgccctccgcctgccccacgacgttgaagtaggggaggccgagcgccatgtcgacctcacactccaccaccaccacgtcgatacccatcaacgcccccgaccgcaccctcgccaacatgtcccgtcctctcgccgtgccgcccgaagtccttgagcaatgcacgtaccggggcccaccccaggcgtaggcccgcgctcgccaatccgcgccggcggatgcccatcccagcctcgggagcttgaatttcagccccgtggtatttgtgaagccagggctagccatgccctgacgagtccggtagcgtttcacccaccttgggggacgctatgggagcagaggccgcagtggaatcgggggacgttcgtcagcgccggcaggttcgtatccgcagggcggacatcaagcggggccaacggatgaaggtggcgttcgccgtgttccgcttctgcctctacggcatggtggggctcagcgccgaaatcttcttctacaacctggtgcgcatcgcccagcacgtgccgttgctggaggcgctcttccgctttcaatggcgcgtggacgaccggttggggctcaacgccatctgggatacgcccatctccacggcgtatggacagtgctcgctgtggatgttcgtcatctacggtgtggcgtgcttcttcttcatcgagccgctctaccgctggatgctgtaccagcacacgggcctgcgagccgctgtgtacggcgtggtcatcctgctctttgaaggcttctccggtgtcatgctggagcggctcacgggataccgcatctggtactatgcggatgccggcgccattctctggcagatgacctcgctctacatcctgcccatctggatggtgacgggcctgctggcggagttcatctacagggagctgatggaccctgacctcctggcggccttggagtctccgctgcccgccacgccggaagagaccgaggcctcgttccagttgattcggtagacgcaggcgtggccgtcgtagccggacatctcgatgacgatgtcctgcgcaccggccacccgcagccccgcgtggatgatgcccgcggtgaaggcagggtaggggcctacctcgttcatccagagctcgaactgggtgggccccagctcacgcagcttggattccgtgtagttgttgccagcccggaagttctgtgtggcccgcatcagcgtcctgcggggccccagcacgcgaagcaatgagaggacggcgcgtcccagcatcgtctcacggaagccttcgatataggcctcacccagcttccaggtgccctgctcgagcgggagttggggaaagagctcctccgacgtgatgcgaaggaacgtcatccacgcgtcgaaggtgtaggctggccggagcttctgatccacatcgagccctgcctgccgcaggcgtgccttgcactcaggcgtcaggcgcccgtgcagtgcccgcaggaacagggcttcgatggtctgctcaaaaatgagaagctcgtcggccatgaggagtgaactctagccgacgagcttctcgatgtgaaccacgtacccacccggagcgtaggctccggaagaggagtttcagggcgtgggtgcggggggcggggtcggcgtatcgaccgaagtgccctggatgatggcgttctgcggcagctccgtggccatgcccaggactttcgcaccagcggtgttcgcgccgtccagcgcagtgatgagccgcccgtagttggtggcgtcatccgccatgaagaagacgactttgtcgtccgcttcttggccgccagcatgcgcttgagccgcgtcacgtagtcggcgggggcaatcttctccgtgttgatggagtagccaccgtccttgtcgagctggaccaccaactgctggtcgttcgggtcgggaggcgtcggctcctggtcgacctcggtgtccggcacgcgcaccacgatgtccttctcgaggagcggcgtgacgaccatgaagatgatgaggagcaccagcaccacgtcaaccagcgccgccacgttgatctacggagttcggttgcgcttgggcgtgtacgcccgtgtcgcttaccgcggggagccagtactgtcttgtcctcccctcgcagggatctccagctgcagaaccccgcgccgaccacgtccagagatagagc

SEQ ID NO: 1180 - DNA, 18031 bp, Myxococcus xanthus
tcacccgtgaggccactcacacgctggcgcggcgagctggatacctcggccacatcacacttcccgtccaccaccagcacgggcgtgcctcccacgtcacgcgtccaagcctccacctccgcctgtgtgacacccggcggaagcacgagcaccgccaggtccacgcccgtgagcaacgcccgcgttcgcgcgatgcccagcgcctcgacacgtcccggcgtctcccgaagccccgcggtgtcgaagagcgtcaccgccagcccgtcccactcaacccgggcctccaaggcatcccgcgtggtgccaggctcgtcatccaccagcgcgcgggcctcgcccaccagccggttgaacagcgtggacttgcccgcgttgacgggaccgaacagcgccacgcgagcacccctgcgcaccagccggccccggcccacctcggccagcagcgtctccgcctgggcacgcagcgcggtgacacgctcgcccacgtcctcgtccgcgccttccgcctcgtcagggaagctgagcacgccctccatgtccgcatgcagcgcgcgcagcggctcctccagggcctgcacgcgcgaggcgagcgcgccggagagccccgcagccgcggcacgcaccgcggcctccgagtccgctgccaccaggtccgccaccgcctccgcgcgcgtcaggtccaaccgcccgttgaggaaggcccggcgggtgaactcaccgggcgcggcgtggcgcacgcgcgcgtcctccagcgcccgcgtcaggagcagccgcagcagccgcggactgccgtgggcctgaagctccaccacgtcctcgcccgtgaaggactgaggcccgcggaagtagaggaacaggccctcatcgagcgagcgaccctccgcatccacgaaggacgcgaggtacgcatggcgcggcgtgggctgcgcgggcacacccggggccagcagccggcccacatccagggcctccgggcccgacagccggaggatgcccacggcgcccgcggcaggtgcggtcgccagggccgcgatggtcatggaagaagacgtcatacgcggccgctggagcgcatccagcctgaacagcgcgagacccgctgcttcagcgggtcccaatgggaggcgtggagccgcggtcggcattctcctcgtcctcgcggttctcctcgatgtctcgctccaccgcctcgtcctcgagctccaggtcccgtaggacacccgggtagacgaagcggaacgcaggggactcctcatccccgcgaaggcggaagctcatcttgagcaccgccgcgccgtacagcttgtccttgagagctttcgccttgcccatcccttgtctcgcttcgggagccccggcgcgcgcggcgcgcccagcggctcacgcgtcgaagtcgtcctcgtcgtcgtccggcagcatgctccgcttgggaagcggggcgggcttgtccggagtgaacaccacgcggcggtttcggccttcgccctccgccgacaccttcacgccacccactccttctactgacgtgaggacgcgcgcgcggtcttcaagcttcatggcggcaatcgcgtagaagcggcccaggctgcccgacttctccgcgagctgcctgatggccgccttcagcgcggcatcctcttccaccgtcaccgagcgctcatccccctcgcccttgctggcgggagcggccttggcggcgggcgcctgcgcaccccgctggcctcccttcgccggagcaggcgctggcgcctgggccgccgcggcacggggcgcggcgggggcgggggcgggggcggccggagccgcggcttgagccgccgcggcctggggctcacggcgcggccggggctccgggtgcacacccgcacccagcatcacccagcgccggtcggcgccagggcgatgcagcatcttgttcaacaggaactggagcgagtccaccacctgactgcgccgtcccacctccacaccgggaggcggtgcgggctcgaagtggagcgccaccgacaggctgccgtcggcggcgtccttcatgtccagccgcgccgggaagcccatcagcccgaggatgtccccgaggagcttctccacacggccccggaactctccggccgaatcgccggaggccggggtggacggcgtctgctggggaacctgctcgctcacttgcgtctgcctcccgcaccggccaccgccggcgtcccaccgcccgtctggggcttgttccggtccagccacttccgcaggccgtactgctgcgcgatggagaggatgttgttcgtgaagatgtagagcgacaggccggccgggtactggagcagcgtcagcgtgaagatgatgggcaggaaccaggtcatgatcttcgcctgggtcgcatccatcatctgcggctgcatcttctgggtgatgaccatggacacgcccagtgccagcggcaacaggtacgtggggtccttgtaggtcaggtcacgccagatgggcccgatgaagggctcgccgtagatgtcgaagctgttgcgcagcgcggtgaacagggcaatccacaccggcatctggatgaggagggggagacacccgcccagcgggttcaccttggcctcctggtacagcttcatgatttcgaggttctgctgctcgcggttgtccgcgtgcttcttgcggatctcctccatgcgcggctggagcttcttcacctcttccatgctgaccatggagcggtaggtgaggggcagcaggacgagcttcaccaccaccgtgagcaggatgatggccacgccccagttgccggtgacgccgtagaagaacttcatgacccacagcaggaccttgcagatgacggcccagatgccgaagtccaccgtctccgccagcggcgggtggaacgtcgcgtccgtctggccggtggccgcgcgcagcgaggcaccgggcacctgggccagcaggtccgtatccttggggccgaagtaaccgccgaagcgcagcgtcaccgtctcgcccggcgcggccgtaatcgggaaggacgccgtcaccttgcgcagggtgggcgtggcctcgaaggagcacgagccggcgcgcggcccttccagcgggtagagcgcggacaggaagtactgctggtcgatgccgaagaactgaatctggccgcgggtgtcctcggcgtccgggtggtcgtcgcccgggctcatcttctggagcttgtcacccacccagcaggcggagcggctcaggttgcccacgccgccgaagaaggacggcgcgtgctcgaagttggggtcgatggcgcggttgtggtgcacctgcagctcgccgctctgcggctggccggaggtgttgcgcacctggagggtgtagctcagctcgaacccgtccatgggccacttgaccgtcttcacgacctcccacggtccgcggcggccggtgaaggtgacgccgtccgcgttgccgggggcgccttcatccagggtgtagttcaggtccgcgggcagcgggctggcgccggtgatggacacggccaggggcaacggctggcccggggtggggcgcgccaggtccatctgcggcgcggggggaatctccttgccgaacagcttctggaagccctgggtgacggtgagctcctgctgctcccgcatcttcgcgcccttgagcacggcggcggtgaggccggcgccctcggaggagaaggcgtaggtggcctcgtcgcgctgcagctccaccttgcgcgccggaggcggcggggcctccgcggtggcgcccgtcccggtaccgccttcgggaggctggacggccgggggagtgccggcatcggcgggcgccgtggccaccacgcccgcgtcggggatttccgaaccgggcggaggcggagtgggcgcgaagaagaaggtgtagacggcagtggccgcgaacgagagggccagggccgccagcagtcgcttctgcgaatcgttcgactggggcgagagcggatcgttcatagactcccccctccacgagggagagggcggcaatgggtggaacccctcgtcacggcaccgggtcgataccgccggggtggaagggctggcagcgcacgagccgccagagagtgagccacgaccccttgaggccgccgtgcttctccagcgcctccatggcgtacgtggagcaggagggatggaaccggcacaccttggggagcagcggtccgaggaacttccggtagaagcggatgggcagcgagatgacgaaggccagggggctcatctgggcggctccttcggcttcgtctccgcggcgcggggcagtcgctgcagcttacgggtgacaccgtcaaaggcacgcgacaacgccggaaaggaagcatccttcgcggaggagcgtgccaccaggacgacgtccaggcctgacggccattgcatgcggcgcttccgaaaaagctcccgcaagacgcgcctcaagcgcgctcggacgacggcgttgcccaccttgctcgacacggtcaggccaacacgtgagtacggtcggctattgcgcttcacgagggccaggaggcagtccgaagggactttctgcccgccttcctggacctcgaggaactcgcgccgttgaagcaggcgcagggccttggggaagcgctggtctgccgggcgggactggcccggcgtcgcaccctcggccctcacacgcgaactcgcttacttcttgggagcggacacgacgagccgcttgcgacccttcgcacgacggcgcttgaggacatcccggccgcccttcgtggcgttccgcttgcggaacccgtgggcgcgattgcggcggaccttcgacggctggtacgtgcgcttggacacggctcttactccttggtgatgacggcggcgcctcctaccgctccggcgcgacctgaactagggaaaggggcgggtccgtacccccatttccagggtaagtcaacgttggatcaccctggcccacccgggaacccacgcccggaggcccgatcggaccgcctgaggtagggccatgaaggcttgggtgctactgacggtgccgaccaccgcccaacgcacggcggcgggagtctaaccgcgaacagcgtggacgtctgtttccctggcgcttctttcgagtgagtgcctgccagcccgggcgcccaacggcctcagactcgcaataactgagagcgctgggggtcgcggatacccatccagagacaccatcatttttttgcgaaggaccttttgaaggcccgttcttccgcaaaccccacacaaaggtgtccacatgtcgttgctcacgcggcctcaggtcgtcgtgctcggacttgtcatgtcctctgcgcccgccctggcccaatcgttcccccccgtcctcccgccgctgaaccccatcctcctctgtaattcctacgtccccacgctcgaagagtgccagaaccccgtcaccttctgcgcgaacatggcccggagcgcggcgaagaccaacccgaacgccgcctgcaacgtcctggtgcgcgacgccgcgctgaacgccgtggcgagcctgcccgagcgcaccgtgctggtgcccatcacccgcaacgcgagcggccaggagattgcgccagacgccgccaccaagagcgtggccttcgtcgaggagaacccgaacgcccgctacatgagcggcctctccagcttcatgctgggcaccgcgcaccgcgaccggacctacttccccgcgtcgaccaagacggccaccctcatgcgcttcgcgcgcctctcccagcgaaacgcgtggaacaactccggcaacaccgtcgactcctgccgcgagtacgtccacgagaagtactacgactacagcgtcttcgaggacgccatctcctccgcgggcaccgactaccgcaaaatcttcgacatcgcctacgcccaggcgcccagcggcggcagcgtgcccgcctccgccattggcacccgctcgattgcggacccggtgcagcgcggcaaggacggcacccctatccaacccgccatccagttccccgccggcgcgccgaagaacgagttcttcaccgtgccgcctcccgtacagggcaaggtcaccatcagcgccagcaacgtggaccgggtggtcgtggttccaggcgggaggggcgtggccttcatcgagctcaaggacctggaccgtccgctgaacctctacggcaccatcctgcccgaggcgacgctgtccaccctggcgaacggcgccagctactacaacgagagctgggcgtggcaccgaagcatgagcaccattcgcaacgccaacgtcctggatgagcggatgtacgaactggaccggctccaggaggagttcgccgcgctcgtccagcagcgcaaggacctggtcagctccatccaggtggagctggcccggcgctaccagcccatccaagggttcctgaaggccgagccggaaacgtccagcaacctgacggacgacgacgagccccaggacccggtcgtcacccagctctaccagttggcctcgctggatgccgtcatcgaagcggcgctccagcaggcccaggcgaaaggctgcctcaacttccagattggcaaggccgccgctccctgcgactggtcgcccaagcgcttcgcgcgcagggtgatgaacctctaccagggcgcgcgtgagcaggacttccagaagtgctcgacctatacccgcgacgacttcgcggacctcaaggccaggcccctgcagattggcaccgtcaactaccccgcgcaggactacacgacgagcccctcgcgcctggagacgtacttcacccgacgggaccagtacatgcgcgccctgtcctccacggtggggcccatgctggatccgaagacggcgcagccccgcctgcgctgggagtccggtgacagctacagcctgggcaatgacaccttcggcgccaccgcgaactaccaggtggccgtggccatcaacaacgtgaagaacacgcccgactgcggcctctccccggaggtgacgggcagcttcaccgccaccggcagcgccctgggcatcagcgccaacctcatcaacgcccaggtgaatgtgacgcagaagcgcgcggacatcgacctggacgtgctcgacaacaccgtgccgctggtggacatccacaagaacctgacgctgggccagttcaacatcgtgtccggcaagcaggagaagaaggccacgctggtgagcgcgcaggccaccttcgtcatcgtggtggtccccgtcacgatcggcgccaaggtggccggcgtggtggggctcgaatacgggttgtcggcggatcacaaggtgacgggcaccacggcgtgcagcgtgacgagcgtgggcatcaccggacacgtgcagccctacgcgcaggtggacggtgagctgtacgcgagcgtcgacctcttcgtcatcgaggcgggcgtgaaggggcgcctccaactggtccacgccgccgtcccgctcaacgccaacgtctggctgtcgccggtcggaggcagggtgaagctgcgcatggaggggaactccgacctgcgcttcaccttcctgtccggcagcatctccgcctacgtggaagtgggcatctggcccttcgaaacggagttcgaggagacgctcgtgagctggaacggcatcaccgagaacgtgaagttgttcgaccactcgttcaacgtcgacctcctcgacctccgctccctgctgtaatccccgtacctgctggagacgccccatgaacgcacgcaaggtcatcactggcggtgcactgctggcactgctgctcctgggagccgcctggctcttccacacccaggcccccgtcaccggggcgcctccagcggcgacgcccctccgcgtccacttccccgtgggggagcgccggacgtaccgcatggactacacggcccggaccgaggtgcgcctcgccgggtcgcaacagaaacccaccgccatggggggccgggcccacttcgttggagacctggtcctccgcggccaccccgcgcagggcaccgccctgcgcgtggggctgagcctggagaacctccacgagcacacgctcgagctgtttggccacgcgctgctgccagacgccgcggccgtcgcggccaccttcaccggccgcgaggccctgctggacctggacgccgacggcaccctgcgcgccgtctccttccaggaggaagacccctccctcttcaagaacaccgtgcagacgctggccggcgagctccagtgggtgctgcgcgacggcgccacctggcaggtggaggagctgacgtcgcgaggcacggccctcacggagtacgcgcggctggacgaaggcgccctgcccgcgcgcatcctcaagcggcgcctggcctacccggagccccgcggcatgggcacgggcagcggcgccgtggaggtggactcgcgcttcgagatgacgctggacgcggacggcgtcctggagcggctctccggtgaagagcgggtgctccgccgcccgaccggtggcggcgaacccaccgccacctcgcacatccagctccgcctggagcccggcaagcgggaccggttcgtggtggcgcaggcctccgccgcgcccgccgcgccgctccaaaagctcgcgccgggcgaactggtgacggacgcccacgcgcgggagcggatgctggagcagcaggtggatgggctcaccccggagcgcttcttcgagctgatggagaagtacgccaacggcggcaccttcccggaacacaaccacttcctcctccaagccacgggcctgctagagcagcagcccgagctgtgtgcgcggctggccgacttcttccagcagtccaccctgaagccgcggggccgggcgctggtgctggacctgctggcgggcacgggcacgccggaggcgcagacggcgctggtgcgcgccctgtccagcccccaggcgctggccgagcccggctacggcatgttgctcagccgcctgtcgctgctgaccagccccacccccgacacggtgcgcttcatcgaacgcacccaccgcacggcccgtgacgacacccgcgtggccaccgcctacgccctgggcgccaccgccggcgccctctaccggcagcagcaggacgcggagtccctggccgccgtccagcagctcggggccgagctgcgcgccgcgcgcacgcccgaggacaaggcccacctgctgctcgcgctgggcaacgcgggcctggaggagcaggtggacgtcatcgcccactacgcccaggacgcggacgcacaggtgcgccgggcctcggcccgcgcgctgcggaagattcagacgccccaggccatgcgcacgctcctctccatgaccgaggacaccgacgcgcccgtgcagtcctccgcgctgacggcgctgggccgccgggacctggacgaatcggccctgcgccaactgcgcgacctggccctctccggccgcgtgcccgtggaaaaccaccacaccctggtgacggtggtggagccctacctccagcgagcacccgaggtgcgccagctcctccagcacctgctcacccaggacgtgcctgacgcccagctccacacgcgcatccgaggcctgctcgggacgtgaccagggcaggaaaccaccgggccattcactgcgagtgaacaacctgatggtgtcccccagtccttggggtaggggaggggatgatccacaaccgggccgggctggcacgtccgttgcggatcatccgtgttgggaaaaacccttgaggctacggcggttttggccggttgcttgatccaccaggaaccgtctgttatcaccgccgaacgcctcgttttccccctgctcctgcacgtttgagtcccgcgtgaacgccctcgcccaagccgctacccccctcccaagtgctggaattctctgggctcggatgctggatgccatccgccaggagaagttcgactacgcgctgagatggctggagcggatgcgcccgctggaggtgcgtgacggtgccctggtgatgggcgttccggaccgcttcttccgcgactgggtggatgaccactaccgccccatgctggatgtccagctcgcacggatgggggagggcctgacctccatcgcctatgaggtagtggagggcctggagccggacccgcattttccacccacaccctcagtcaaggcgagcgccacgcgtccgggccggctgaacgcgcgcttcaccttcgacaccttcgtggtggcggacagcaaccagctcccggccgccgcggcgcaggccgtggccgacaagccgggccaccactacaacccgctctacatctacggcggcacgggtctgggcaagacgcacctgctccaggcagtgggcaacctcatctgggagcgagatccatcccagcgcgtggtgttcctctccagcgagcagttcaccaacgagtacgtggagagcgtccgcgagcaccgcatgggggacttccgccggaagttccgtgaggagtgcgacgtgctcctcctcgacgacatccagttcctcggcaagcgtgaggagacgcagaaggagttcttctacaccttcaacacgctctacgagatgaacaaggccatcgtcctcaccagcgacaccgtgcccgcggagattccgggcctggaggaccggctgcgcagccgcttcgccatggggctgatgacggacatccgcgagcccacctacgagacgcgggtggccatcctccagaagaaggccgtggccgaaggtctggacctgccggactcggtggcgcacttcatcgccaagcacatccagaagaacgtgcgcgagttggaaggcgcgctggtgaagctgtccgcggtgcacagcctgacgcgccagcccgtgacggaggacttcgcgtcccaggtgctgcgcgacatcctccccgcccacagcgcggtggacgtggaggccatccagcgcgaggtggcccgcttctacaaagtcacggtggagtcgctgaaggaagaccgccggcacaaggccctggcccatgcgcgccaggtggccatgtacctcagccgcaagctgacgaagagctccttcccggaaatcgccgcgcgcttcagcaaggaccactccaccgtcatctccgcggttcgcaaggtggaaggcctccgcgtgacggatgccaccgtgcagcgtgagttggcggagctggaattgaagctcggcaatccctgaaacagccgtacctttgtttcatgtcggacgacacgcgcccgcgtgaaacgggccgtgtccggctgacgcgcaaccaggattgacgctcgggcgcgtatgcgggggagtgagcccgcgcctgaagagcctggtccttctgctcgccgtgctcacggcagccgcgctgtggcgtgcgggccaggagacacagacgccggcttctcctgagacaccgccggctgtctcaccgtccttggatgatgaagccctcacaccggctcccgaggaaaaccttccaggcgtgaaggggcgggagcgggtgctcgtcgtgggccaccggcttcgttacacgttcgacctggacctccggacccacacggagaatcgggccggcgcgcgcgagtccctgcacaccggatggagcggcctgttcgagctcacctacctgggcgcggagggtgaacagcacctgttctccggccacctcgtgcccacgcgggtggccgtggaatccggtgagacgctggcgcccggtgacgcagcgatgcaggcgctccggggcatgttcgagcggccggtgtacgtgggccaggacgtgcggggccgggtgatggccgtgcacttcgatgcggcgcaggacgcgacggcgcggcggctcgtgcgcctgctgctcgcgtcgacgcagttcgtggcggaggacggcccccgctggagcaccgaggagccggactcgcgcggtgacctcgaagccgtgtaccgcgcgggtggcagcgcgaacacctacgtgaagacgaagcggcgctacctgcgcgctggctcggcggtgcttccacggctgcaagggcacctggacttcaccctgttcgcggatgggcacgtgaaggaagcgacgggctcggacgtggtggagttgggcggaggcagcacggggctccctcgcatccgcgaggaggcgagggtcgcgttgaccaacgtgggcgtggactaccggctttcgtcgctgaggccgtttgaggccacgcggacgacgttgcggtcggagcggctcacggattcggccgacatggagggggcttcgctggaggcgcgggacaggcagctcgtgaagggggtgaagctggatgacttgctgcgggcactggcgaagcgcgaggacctggacaccgcgcggctgcgactgacggccttgttccgacagaatctggcggaagtggaacgagccgtggcgctgattcgtcagggctccgcggacgcggtgcgctccgagcagatactggaggcgctggccagcgcggggacgccagaggcgcagcgggcgctggtgtccgtgttggagggagaacgggtccggccgaagacccgggcccacgcggcacgggcagcgggacggatggaacggccttcgctgctgctcggtgatgcactggagcgcgtgatggatgggacgcgggacgcgggggtgaggaacgcggcggcgctgtcgatgggggcgctgtcgaagacgttggaggtggcggagccgggccggagccaggcgctggtggagggaatcgtgaggcgctgccgcacgggtgctttggagcccgaggtctgtctggatgccctggcccgggcaggtgctccggtgggattggcctacgtgaagtcggcgctcgtgcatccggaggcggatgttcggggcgcggcgacgaaggcactgagtgccattcctggcgcggcggtggatgcattgttggaccaggtgatgctcgacgacccgagcccgcgggttcgtgcgctcgcggtgaaggctgtctctcaacgggtcactggcgcccacttggaagtactggcccgggtgctgcgctccgagcggagtgagcgcgtccgcatcgaagtggtgcggctgctgggccacctgcaagccgtggaggctcccgctgcggccctgcttcgcgatgtggccgcgaacgatgggtccgcgaacgtacgcgcgctggcggcgtcactgctcggcgaatagggcggggtgccgggcggatgagttcacctggcatccgttccacttcgaagcgctacgcgtccttgcggcgacggcccatgacgacccgcatcagtcccgcgagcattcacggaagcagtgcggaaggcacgctcagtgcgcagcggggggaggggcctcggagatgctctccagggtctcgccgacgtcctcctccgccagcgcctccagcaagtcgcccatcgcgacaatccccaccagcttcttgtcccggtcgagcgcgaggatgcggcggaccttcttctccttcatcttctccgccaccacggagatgtcctcgtcatcgaaggcgtattcgagctgccccgtcatcgcctccgccaccgtcgtgctgttggggtcctttccctgggacaccgcacgcaccacgatgtcgcggtcggtgatgatgcccatcagccggtcaccatcacacacgggcagcgggcccacgctcagctcgcgcatcttcaacgcggcgtccttcaatgaatccttcgcgttgatgaccgtgacgtccttcgtcatcacgtcttgtaccttccgcatcacacggctccttccttgggttcaggcctcgggcacccacaacgagcgcaggtctgcggggagctggcccatgacgtcgtcggcctcgccctcgctgatgtgatttcgcaccgtgacgaacacggcccgggccaggcgttcggcctcgttgggcgtggtgtcgagctcctcggccaccatggcgaggaactgctccagcttgtacttccgggcgaccttgccctcgtgccgaggacaccgcttcagcatgtccctcaccttccgcggaagctgggcctccaggtgcttcgcctcggtgtccatgaggcgttgctccagcagacacagcacggactgcgcggccttctccgccaggccacgaacgacgcccgcgttcgcttcgaggtccttcaagaaggccatataggtctgcgccgcgtgcgactcactgcgctgctccttgaggctgggcgtagcgctccggccctccgctgcctctccctgctcctcacgtatgttcgccatgacggtggcctccccggtgtcgggcttgggtctcttccctgagcgtgggcaccccacgttccccaggcaccggccgccccccgcgcgccgggacgccagggcgggaagcgagccaagcaccggcggcaccgtctcgccgccgtcagtccaccgcgccgccgagcagctccaccatccgagtccggtgcaacacgccccagagcgccagcgcgaccaacgccagacacaccgcgccgagcgcctcccaccgccggccaatgggcggccgtgcctccgggtccacccgccgcagcgccaccaggcccaggatgagggcgagcatggacaaccccgcgaagacgaatgtcagcgcgctccacaccccgaagtaggagagcagcggcgcgaacacgggcaggaacagcgaccccacgctcagcgacagcgcatgccgagcaagggggttgttgacccgcaggtcccatagctggcgtagctcgcgctcggggacatccaggcggaagaagagccggctgcgtgtgtcgcgaaagacgttcaccgcgaccatgaggggaatgaagaaaagcaacgcgggcgcgcccagggactgcgcggtgagcagcatcgccagcagcggcacggcgagcaggcccatgcgcgcccaccgcatgcccaggaagaacgccacgcccacgcccgagctgcccaggcacgccagcgtggtgccgacgtccccggccatcagcgccaccagcgccagcccgacgagcaccaccgtgacaccgaccaccagccaggcgctcgcgtccctccgtccccagagcttgagccggaaggcctccaggtagttcacctccggacgcaccgcgcaggcagggcagtacatgcggcccatcacccacgtcgtgcactcggtgcagacgaagctgccacagcgctggcaggtggcgcccgcgagcgcatccggatggagggcgcagcggggcagggccccggatgggacttcggcggacatgatttcagtctctcatgctgaccaggaaccaacatcccggggcacggtcctttcccgccaccattccctacccacggtaccggacgtgcgtgctaagcgcgtcacgtgagtcattggcatcgagacccggaggcaccttgttccgaatgaaggccctcgtcgccgcagccctcgtgttcagcgggccgccggcgcttgcccagacaccgacaccccaggaggcgaagccactggagcccggccgcgaggcgctcgccatctcgtatgagaaatacgcgctgcccaacggcctggaggtcatcctctccgtggaccggaagctgccagtggtggccgtcaacgtctggtaccacgtcggcgcatatcacgagcaacccggccgcaccggcttcgcgcacctgttcgagcacatgatgttccagggctcgcgcaacgtggccgacgacgtccacatctcccggctggagcagttgggcgccaccgacctcaacggcaccaccagcttcgaccgcaccaactacttcgagaccgtccccagcaaccacctggagacggcgctgtggctggagagcgaccgcatgggcttcctgctcgacgccatcacaccggagaagctggagacccagcgcgaggtggtgaagaacgagcggcgcgaatccattgaaaccgcgccgtacggcgccgcccgcgagaaggcgtggcacgcgctcttcccgctgccgcacccgtaccacggggatgtcatcggctcgatgaaggacctgaacgcggccaacgtggacgacgtgaaggacttcttccgcaagtggtacgcgccgtccaacgccacgctggccatcgtcggtgacttcgacgtggcgaagacgaaggcgctggtggagaagtacttcggcacgctgcccagccacgcccggccgcagcggccggaggtcgcgccggtgaacctcaccgcgcccgtggtgctgcgcgaggaggagcgcgtggcccggctgccgctcttgtccatccagtggctcacgcccgcgtacctggaagaaggggacgccaccgcggacgtgctggccaccgcgctgtccaccggcaaggccagccgcctctaccgccggctggtgctggacaaggagctggcccagagcgtcagcgccacccagcagagccagggcgcgcagtccgtcttctcggtggacgtggtggcgcggcccggcgtgtccacggacacgctgctccatgaggtggacgcggtgctggacgaggtccgccagcagggcatcaccccggcggagattgcccgcgcccgcacgcgctacgacacgcgcacgctggccggcctccagtccgtcggcggcttcggcggcaaggcggacgtcctccagagctacaaccacttcgtcggcgagcccaactacgtggcccaggacctggctcgctacgagtcggtgacgcccgaagccgtgaagcagttcgcccaggacacgctgcgccccggcgcgcgcgtcatcctccacgcggtgccgcccgcacgccggcaggcgcccctcgactcgaaggagcgccactgatgcgccgcctcttctccgccctgctcgtcaccacgctggccgcctgcgccagcaacccgaagcccgcgccggccaatccggactcgcccgcgctgggagagaaggcggctccggccgaagccacggctgacgccgagtccttccgcgccacgccgccccagcccggcaaggcgccggacctggtgctgcccaccttccagagcgcgaagctggacaacggcatcaccgtgattgtgagcacgcggcgggagctgccgctcgtgttcgcgggtgtggccttcgccgcgggcagcgcgcaggaccccaagggcaaggaagggctcgccgagctgacgtaccgcatgctgcttgaaggcgcgggcaagcgggacacggtgacgctggacaacgccttcgcggacctgggtgtgactcccgccatggacgtgcaggcggacggcgcgcaggtgggcgtgcgcgtgctgacgcgcaacctggacgcggccatggccctgctgtcggacgtggcgctgcgacccgctttcaacctcgacgccttcgagcgccgcaagaagcagcagctcgcggacctggcgcgcgcgatggggcagcccggtgtgctggcgcaactggcctacctggaggccgtgttcgggctgaaccacccctacgggcacctccccgacggcacgcccgcgtccgtgcagacgctcaccctggcggacgtcatgggcttctaccggaagcacaccggccccaaggcccaggcagtcatcctcaccggtgacatcagcctggaagaaggggtggccctggcgaagaagcacttcacctggtcgaagaacaaggccacgccgccgcctccgccgccggccacgaaggccccgccgcgtcagcaggtgtacgtggtgcccaagccgggcctggaccagacgctgctgctggtgggccgcgctggcatcgccgcggggaacccggacgagtacccgctggagctggccaccaccgtgttcggtggcttcttcggcagccgcctcaacatgaacctgcgcgagaacaagggctacagctacggcgcgggcgccagcctctctccgcgcctgggcgtggggccactcaccgcgtacagctccgtgcgccaggacgtgacgggcccggccttgaacgaagtgatgaacgagctgacgggcctgaagaaccggcccatcaccgccgaggagctggaggccgcgcgcgagggcctcatccgcgccttcccgggcgcctt

SEQ ID NO: 1181 - DNA, 19112 bp, Myxococcus xanthus
cgctctacagtgaggccactcctctggcttcagcccgcgatgcgcatctgctccgcgcccagcaccgcggggaacggcccgtaggccatggaccgctcaatcacgttgcgcagctcgcgcacgttgccgggccacgggtgtgacatcagcgcggcgatggcatccggccccagttgcggcggctccatgccctcgggcgtgagctgccggacgaagtgccgggccagcgccaccacgtcctcgcgccgctcgcgcagcgggggcacgcgcaccggcaccacctggaggcggtaatagaggtcctcgcggaagcggccctcccgcacgagctggcccaaatcccggtgcgtggccgccaccacccggacgtccacctccactggccgcatctctcccagcgggaagacttcgccgttctccaggaagcgcagcagcttgggctgcacctccagggggagctcgccaatctcgtccaggaagagcgtgccgccgtgcgcggcgcggatgacgccggggtggtccgtggccgcgccggtgtatgcgccgcgccggtagccgaagagctgcccttcgaagaggtcccggggcaccgcggcgcagttgaaggccacgtaaggccgctgcgagcgcgcggacaaggcgtgcagcgcccgcgccaccacctccttgccggagccggactcgccggtgacgatgacggtggcgcggctggaggacaggctcgccagctccgagcgaagccgccgcatggcggacgaggcggcgatgaagcccggcacgtccgcgtcccgcacgtccgtgtcatcactggcgagcgcggacacgtccacctgggcgaagccgcgcagggtggcgacctccagcgcgaagccgcccagccgggacagcgccgtcagcagcgcgcggccgtccggaggcaggtggcccgcgacacccaggcggagccgccggccacagccatccccgaactccacggcctcggtggcgggcacggtggtgtcgccgcccagcggcgtggcgcggccctgcgagtccagctcctccagccggggcgcgcagtgggggaagagcccctccaccacggccagcagctcgcgctggatgaggggcgcgcccataccgcgcaccgacagccgctcgaagggcaccaccagggcctccgcgcccaggcggggggcgccctcggcttcgcgggcggtggcgtggggctcgcgggcgacgtagtgcacgaagtgctgcgggtgcaccaccatgcccacgcggtgcagctccgcctcgctggcggccagcagctcaccggcggcggggtcgccctccatccgcgccagcaacgcgagcaggtggcgcgtgtagacggccatgcacaggtcgccggtgaggctgaaggtgcccagcgcggcctccagcagcgaccgggcctcggcggtgcgcccgtccaggacgtgcagcagggcctcgaagcggtggagcagggcggagtgccacgcggatggcatgcgctccaggaaggcgccagtgaggcgcagcagcaccaggccctcgtcgcgctggcaggcgtagacgcgcgcatacgtctcgtacagcaggcattcgcggcgcaggtagggccagccgcccagctccatggtgcgctgcccggccgcggcgaagccctccgccgcgcgatgcgtgttgccctcggcgaggtcggccagcgactccgcgaactgggcataggccccggtgagggcccgctggatggtgccgtcgtaggccgtcagctgccgcgccagcttgcgcagtcccgggtagcgcccgctgagcaggtacagccgcgcgcgcgtcaccgtcaggtacagcggcgtccagcgcagctcctccaccaccgcgtccgcttcatccagcacggcctcggcttccgcgaagcgcgccagccgcagcagggcctcggcctccgcgcgcgcggcgaagatgaaggagaagccgcgcaccattcgcccgccatacgcggcctcccgcgcgcggcgcaccatctgcagcgcctcggacggctcgcaggcctcgtccaaccggcgttgagccaggaaggccaggttgcgcgcctccaggaaggcgtagcccatccgcgccgcgccctgcgccacctcgcggaagcggcgcgtggccagggtggcctcgccgcgcagggccgcctcgtgggcgctggcgtcctcggcgagcagtcgcagggccgggtccttcaccctcacgagcgcatcctccagccgtccggacccgtgggtgatgcgctccgcctcgcccaggtagaagccgcaggcgacctcggccatgcgcagttggcagcgcacctccgggtcgtcgtggttggccagcagcgcttccgcgcgcgccacgtacgcggcggacttgttcgcgtcgaacagcttcccgtccggtgacgcgtagaggttggccgccatggcgagcacgcgcagctccacctcttcgggaaagatgccggcgtccgcgaacgccaggtggggcagcagcgtggtgaaggcgccccggctgtcctcgcggccccagcgctggagataggcaagtcccaccgcggccatggcccgcgcgcccggggtgcgcagcaggcccgacgccagcagtgacagcagctcctcttcggcggctcgccactcggcccgcgtcaggtgggtgacgctggggaggatgcgggccagctcctcgggatgcagctcctgccgccggggcgcggagacgacgggcgtgggggccccgcctcgcgcggcgagctggcggagcgccacggccacgcggcctcgtggacggcgggcctggggggcttcgctcggcagctcccagcggtagacggtgagaggggtgacgcccagcaggcgagcaaacgccgcgcggctctgctcacctcgcagggcgcggatggtctcgggttcccacccggcgctctcccccttcgcctccggtaactccacggcacctgccccctttttcgccccccgccagcgcacattctctacggagtttcccagggcgaatgcaaacggttgagcatttccgcttgttgcaccgtgcatatgcagcaggcgacgaatggtgcgcttcccctccctgagggggcgtgtcgtcgttatcgtcacctcgtgcctcgtggacgttcccagcctccggtttccccaccttcccgcatccaacatgaacgcctgctcaggttggaagacgcgctttcggagggccgtgcgcgtgaggacgcggcggtggaggcctgggtgcgccgcaccgggcagatgccgccccggaagattcgccggaagtgggagaagcagtggcggcgggaggcgaagcgcgccgcacgccgcgccgaacgggaggtgctgtccaaccgctctcgcaaccccgcgcggggcgccgcctacgtcaccgcgtcgataacgtgcgtgttgattgccctggcacagccccgccggctgtggtggctggtcttcgtggccctgggcttcttcctggcctcgctgaagcacctggagcgtcctcggcgtgacgagggccgcgcgcgcgacgctggagtgccggagcgggagcccgtgggtgtctcggagggggaggcggacgcccgggtggcgaaggtggacgccctctgcgcccggctgatggaggccctgggcgaggggcccgcggtgctgcgcgaactggtgcatgcgccggagcgcacggtggaggccctgcgacagggctgtcatgcactggtgcgccgtgagcgggagctgcgggcgctggcgccacccgctgagacccagcggctggacgccgagcgggacgcgctggccgcgcgggtggcttcggaagaggacgcggtggttcgggagcggctggccggagcgctggccgcgctggagtcgcagcggcgtcagcgcgcggagctggccatcgcggcggcgcggctcgaggcggagcacatgcgcctctactacaccctggagagcctctacgcgcaggtgctgcgggtgcgctcggcggacactgtgggagaggacatcgccgggctggggctgcggcagagcgtggagcagctcggtgcggaagtggaagcggtggcgcaggcgctggaggaggttcacgccgcgcccggcggtggtggccggacgcggacgcggtagaagtttggcgttggggcgtgggccacgccggggggctgtccagcgcgtccacgtgggacgcggttcgcggttggcgagggggacggtcggccccggtggcgacgcaggtcatgagcattgcctcgcggatggacccgtgccggatgcgagaatcaggtgtgaggatggactgcgacaggggcgggaatgtcaggcccagtcctcgcccccggcactcagcggacctcggggcagacccagacgttgcgcgtgcccagggtgcggcaggtgcagacgtagtcggaccagatgccatccgtacactgctgcgtcgtacccgggccggagcacgacgtgtagtggaggttccagcagaactggagcagcggcggtcggctggcgtcggcggcctcctggctcacgagctcctccgggtccacgtccaccgacaggtcctccgaatcgaagtcggacgaggcgaacgcgggcagggatagggacagggcgatgaggaaagccttcttcatgggacggactccatggggtgagagggattgcagctgaagacgaagcaactcgaatcctggggaggcacctctatcgttaccggtgtgaggcggcgagcgcctggggctcctcctgcggtgcctcggaggtggcgggaagcaacgggcccccctcgtattccacccccttggggtaggggaattccaggccattggcggtgaaggcctcgatcagcagccggttgagaagccgcttcacgtcgaagtgtgtccctggctgcaccttggcttcgatgcgcatggtcatccagctctcgtccatgctctcgatacccagaagcttggggatttcggacaccttcccctgcgacagcatgggcacctgctcgcacacctggcgaatcacatccatcaccttcttcaggtcgctttcgtaggccacggccatgtccacgatggccagcgtccagccgcggctgtagttgatgacattcttgacctcgccattgcggaggatgtgaaggcgcccgaagcggtcgcgaatgcgggtgatgcgaggcgttatctcctccaccacgccctctgtatcgttgatgcggatgtagtcaccgttcagtatctggtcctcgaagagcaggaagacgccgttgaccatgtccgtgacgatggcctgcgagcccagacccacggtgaggccgacgatgccggcgccagcgaggatgggggtggggtccacgccaaggtcgctgagcaccatcatccccaccaggaagtagaccaggtacttggatgcgctttggatgagggagacgaaggtgttgcgccgccgggccgcgtcatccaggttggagccgtccaccttgaatgcccgcgcgatgagcagccggacgaactccacgacgacgctggcggcgaagaacagggcgatgacgcggatgagcaccggcccgtagggcgcaaagaactccaggccctggaaccggcggatgacgagcgtcgccaccgagatgtagacgatggcctccaggctcttctgccccaccgggagcagccggccgagggccaggaagtactcctcgtacttcgtggccgtgctcttcgccgcccaggtcccgaccagccgctctgacgccaggtgcagcagggacaccgccagccgcccgccgctgatggccagcagcacgaagagggtggtgccaatgagccagtcgagcacggccgggagttgcagcgaggcgagcgccaggcccaccgcgaagtaggccagcagcagcttgatgaagccgggcccctgctccatcgccttctgggcatgtgccctgtgctccgggggcaactgccattcgttcaacctgcgttcgacccgcaccaggagctggctcgccgcgcgttccagcgccaggaaggccgccatcaacagcaccagcagccctgctccgcgccccacatccgccagcccttccgctgtcacccccccaagcaaggcattgaagtggggggccaggtctttcttcgcccacagggaaaagcccagcaccgcgatgccggcgaccaccaccacgaagtgacaggagggcggcgctcagccgggcgcgcttgcaaagggcgtctgccgcctgctccagcaccttcaggcccaccagccggatgccctgatacagcagcgcactggaggccaccagaagggcccagagcgcgagcagcatcagtgtcacgctcaggccgacaagccatgcgttattcaactcaacagtatccgcgagacggaagatctccatgcaatggttgcatatcatgcaaaacggcgcgttctcgcggatctgcgcttccgtcaggggcggctcatgcgagtggggcgcggtgaggcaacgccccggccgttccgctgaagggccgtctactcgctgatggtgccgcggggcggaggctgctgcttcgtctcctccgccgcggcgatgcggacggacttgatgttgacgaactcgtggatgcccacgtccgccaactcgcgcccgtggccggagtgcttcacgccgccaaacggaagcctggcgtccgatgccacaagcgcgttgacgaacaccatgcccgcgtcgatgccgtcgatgaaacgccgctgctcggcttcgtcttgtgtccacacgctggcgcccaggccgaacggcgtcgcgttggccagctccagggcgtggtccacgtcacgcgcgcgcagcagcgtggccacggggccgaagagctcgtcgtggaaggcgggggcctggggcgggggctcggccaggacggtggccgggtagaagttccccggaccctccagggcttgccgcccaggagcagcctcgcgccggccttcacgctcgcctccacctgggcatggagcccgtcgaggatgccgcgcgtcgccaggggacccaggtccgtcttcgcatccatggggtcgcccaccgtgacgcgcttcatccgctccacgaagcggcgctcgaactcggggtagatggcgtcggcgacgatgaagcgcttggcggcgatgcaggactggccgttgttgatgaggcgcgcggacaccgccgtctccaccgccttctccatgtccgcgctgggcatgacgatgaacgggtcactgccgcccagctccagcaccaccttcttgatggccttgcccgcggcggcgcccacggctcggcccgcgccctcgctgccggtgagcgtcaccgcgcgcacgcggcggtcctcgatgacgcgatggacgtcggctgtctcgatgagcagcgtctggaaggcgccgcgtgggaagcccgcctgaaggaagagttcctccagggccagtgcgcactggggcacgttgtgggcgtgcttgagcaggcccacgttccccgccatcagcgcgggcgcggcgaagcggaccacctgccagaaggggaagttccacggcatgatggccagcacgggccccaggggctggtagcgcacgaaggcgcggccggtgcccatgtcgacgagcctgtcgcgcaggagggactcgcccttgtccacgtagtagcggcaggccgtggcgcacttcttcgcctcggccttggcggcgtcgatgggcttgcccatctcctgcgtcatgatgcggccgtagcggtcggcctcggcctccagcaggtcggccgcgcgccgcagccaggtgacgcggtctgcgaaggtcgtctcgcggtaggtgcggaacgtgtcggcggcggtctggagcttcgcctccagttcctcggcggagaggggcgtgaaggtgcgcagcgtcttgccggtcgccgggtcgatggtggaaatggccatggaagtgcctccttggggccctctgatagcagccgggcgcggggagaccgtgccgctcgtggtccgagcgtccggccgttcactccagggctttcgcggccccggcccctcctttatatgggggtcaggactggagactgccatggccgacatcatccgcgagcgccgcttcaacttcctcatcgccggggtgctgtccttggtcattcccggcctgggacagctctacaaaggccagttcctgcgcgccgtcctgtggttcctgatggtgggggccggctactggttcttcttcatcccgggcttcgtcctgcacttcttctgcgtcctcggcgcggccttcggcagcgcgggcagcgaccgcatccgtcttcccggatagccaacgctccgcgcgggagacgtcccgccggacgccggagtgcatacagtcaccgccatgtggcggaggctctggcagtggatgtcgggatgggacgtggcggtgacgcggccattggggctgctgttgctggtgctggtctgctgtctgggcttcatcgccctgtcggacgaggtggccgagggcgagacgcagcagctcgatgaacgcatgctgttggcgctgcgcaaccccgaggacccggcgcagcctcgcggaccctggtggctgcggcgcacggcggaggacgtgacggcgctgggcggcattcccgtgctgacgctcgccaccctggcggtgtgtggcttcctcctgctggtgaggcgttaccggacgctgctgctcgtgctgggcgcgacgctggggggcgcgggcctcaatgtcttgctgaagcagttcttcgcccggcctcggccatccgtggtgccgcacctcaccgaggtggtcagccagagcttccccagtgggcacgccatgctgtcggccaccgtgtacctcacgctgggcgcactgctggcgcagctcgccgagcgcaagcgactcaagctctacgtcctcaccgtggcgctgctgctgtcgttcctcgtggggctgacgcgcgtctacctgggcgtgcactaccccacggacgtgttgggcggctgggtggccggactggcgtgggcgctgctcatggcggtctgtgcgcggacgctccgccggcggagccctgcgctgcgcgcggaggcccggcgcccggtggagtgacgcgcggcgggccgcgtcatgccgtccaccccatggcgccgttcactgcgcgaagctccaagctgccgtggtgcctgggcgtcctgtgggaccctggtcccagacctggcgccgtgagagacatgggcccatgagcctgcgggactggctgtcgcgatggcgttggggcggcgcgccggtgcccgccttctacgacgagtcctaccggctgcccctcaccggcatcgagtcctccgcgggcatcgagccgcgcggcgtggacttcaccacctggtatctcctggaggcccgcgcgctgcgcacccaggacgtgcaccacccgcagccggtgagcctcgccgagctgtcgcgcgtgcatgacgccgcctacctggagtcgctcggccagccggagacgctggcgcgcatcttcgccaccgaccccgccgacgtgccggtggacgcgctgctgtccaacctgcggcgggtgtgcggcggcacgctgggcgcggcgcggctcgcggtggcgcgcaagggcccggtggtgaacatggcgggcggcttccaccacgccggtccggcgcgcggcggcggtttctgcgcggtgaatgacatcgcgatagcgctcgccgccctccacgcggatggcttcgacggacaggccgtggtgctcgacctggatgcccacccgccggatggcacggcggagtgtctggcgggacagaagcgggcctggattggctcgctgtccggtagcgactggggcgcgttgtcgcccgaagtggatgagacgcgcgtccccgaggacacggacgacaggacgtatctggccctgctcgacggactcctggagcgcatgccccggccggacgtggccttcgtcatcgcgggcagcgacgtgctcgcgggagaccgcttcggccgcgtgggcctgtccctggacggcgcccgtcgcagggaccgggccctggcgcgcgccctgcgtggcatccccagcgtctggcttccaggcgggggctatcaccgcgacgcgtggaaggtgttcgcgggcaccgtgctcgtcctcgcgggtcagggccgtcgccgcatcaaggcgcgttatgacccgctgagcgcgcggtatcggcgcatcgcccgctcactgacgcgcgagggcgcgacgccgctggacgagcccatcacccaggaggacctggagggtgccctcggcctgagcggcggcccgcgccagccgcgcatcctcggctactacacggcgcaggcgctcgagtacgccttcttccgctacggaatcctctcctacgtggagcggctcggctacagccggctgcgcgtggaggtgggctccgtgggagagggggaccggatggaggtgcacggctgcgccgcgggccaggagcaccagctggtggactgtgtcgtggagcgccgcgtgctggcgggggagcccttcctcttcgtcaactggctcagcctgcgccacccgcgcgcccgcttcagcgaggggcgctcgcggctccccggccaggacgtgccgggcctgggcctggcgcgcgaggcgacggagatgctgctcgtgatggcccggcgcctcgtcctggcgggcgtggccttccgtcccatgtggttccacctggcggtgctggcgcgctcgcgcttccgtttcctcgacccggcgcggcaggggcgcttcgaggcgctgctgcgcgacctggggcagctgcccctcctggaggtctcccaggcggtggtggacggccacgtcctgctcaacggtcagccctacgcatgggaggcgaacgacatggtgtcgcgcctggagcccgaggccggagacttggaggccattgcccgggagcgcgagcgctgccgcttcacctgggaacccgcccggctggccaccggagcatgatagggaaggggcgtggacctggacgcgcttcgccgtgagcagcacaagcgccggctctcctggatgccgtggctctacttcgtcctcaagccccgccaccgcgaatgggcggacgcatggcagcgcgaggtgcaggcgctgctgcgcgaactggagacggtggaaatcgcggaggggtgcttcatcgccccggaggcgcgcatcttcgccgagcccggacgcaccgtctccatcggccccgggtgcagcatcgccgcggatgtcttcctccacggccccgtgacactcggaccccgggtgagcatcaacgcccgggcgagcctggacggcggctccgcgggcatccgcatcggtgagggcacccgcatcgccaccggcgctaccctctacgccttcgaccacggcattgccccggaccggcccgtgcgcgagcaacccgtcacctcgcgggggctcgtcatcggcgccgacgtgtgggtgggggccaatgccggcatcacggacggtgtctccgtgggggaccacgccgtggtggccatgggggccgtcgtcacccgggatgtgccggcgtgggccattgtcgcaggcgtgccggcccgcgtcgtaggggaccggcggcagcggccccgctcaggtgctccgggtggatgggagcccgaagacggagcgtgaacttctcccgccttcattgacttccggttattgagacccaatatgcttcgggtcgacgtcgccacgggaggggaaccgcagggtctggaatcgttcccggcagccgtaggtgctgtcagggctccagcccctctccgatgaggcgctagggaggccagcacgtggcagacgagcaacgggacgcggcggtcatggacgctcccgggaaggcttcagggacggctcccgccgacatggcgtgtgacctgctcccccccatgaagtcgcaggcgtcacacgctgggagccaggtggagtccgagcgcttccggcacctgtccgagctgctgcacgaggtggtgttccagctcgacgcgcaggggcggctcgcggtgctgggcggtgcctgggagcggctcaccgggacgcccgtgtccgcgtggcggggccgcgcgctcttggaggccatccacccggaggaccgcgagcgcgcccaggcgttgctggcgtacacgcccggcatccccgtttcgcgccaggaagtacgcgtggacacgggcggcggccatggcgtccgttgggtggagctgtccgcccgggccctggccaccgtgccgggcgaggtgatggggacgctcctggacgtgacgtcgcgacgcacggcggaggaggccgtcaccacccgcgagcgctacctggacgccatggtgcaggtgcagcggcggatgatggggcacgatttgccggacgacctgtacggcgccgtcgtcgagccgttgggccacgtgtccgccgccagccgcgtctacgtcttcgagatgcacttcgccgaggacggcacgctgctggcgtcgcagcgcgcggagtggtgcgcgccggggattcctcccaacctggaggaccccaacatgcacggcctgcccttcgacgcggccctgcggccccatcagtccgaacagttgcagcgcggcgagccggtgcagggccagccgcgagacttctcggagctgctggcgcccatgctggaggcgcagggcgtccgctccgtgctgctgctgcccatgcacgtccacgggcagctcttcggcgtcatcggcttcgacaactgccgcgaacccgagtcctggggccccatcgaggtgaacctgttgtcgggcgcggcgggcgcgctgtccctggcgctggagcagcgcacggccaacgcgctgcgcatgcgcacggagacgacgctgcggcgcaccgaggccggcgtccacctgctcatcgaggccttcccggacccggtgctggtgcacgtgggcgacggcgtgctgctctccgtcaacccggcgctggtgcagtacctgggcttccgcgacgcctcggagttggtgggccgccacatgctggacctggtccgccccgaggaccggggggccgcgcagctccacctgagccaggcgctggagggcaagagcgcggcgcgcgtggtggagatgccgctggtgcgcagcgacggcgaggtggtggtggcggacctggtgacgctggccgtggtgctggacggctcgcccgcgcgcatcaccgtggcgcgcgacttcaccgagcgcaagcgcacccaggcgcagctcatgctgaccgaccgcatggcctccatgggcctcctggccgccggcatcgcccacgagctcaacaaccccctggcctacgtgctgtccaacctggacttcctccacagcgccgtgggcggcgtgcgtccacggatgctctccccggaggacatggtggagctgcggcaggtgctcgacgacgcccgtgagggtgccgagcgcatgcgccagattgtccgccaactgcgcgtcttctcccgcgtggaggacggcaaggaagagtcggtggacgtccacgcggtgctcgaatccgtgacgcagatggccgccagcgtggtgcgcgcccgcgcccggctggtgaaggactacggtgaggtgccgttcgtccgtggcaacgagggcaagctgttccaggtgttcctcaacctcctcatcaacgccgcgcacgccatcgaagagggcgattcggaggcgaacgaaattcgcctcaccacccgcacggaggtgggcggccgggtgatggtggtggtgagcgacacgggccagggcatccccccggagcacctgcgccgcatcttcgaccccttcttcaccaccaagtcctccggcctgggcaccggcctggggctgtccatctgtgacacgattgtgacggcgctgggcggccacatctccgtggagtcgtcgataggggccggcaccaccttccgcgtggcgctcagcgccgcgccgcccaaggccccggcgaaccggccgggcgcgtgagcgctgagacggccggtgtcacctccggccctcgcgcggactgtagccctctcgacggctcgttcttccggtactgcgcgcccgccctgaagcgttatccacttccaccccaggggatgtcccctggcgccttggaggcaggccatgcgcacccacttcgtccggcatctgctggcgctttcgctcgtgcttgcgacgggcgcccaggcggccagccagccctggcggacctcccctcatccggagtcctccgcgtccggcctgacgggcgcgtgcgaagacgcgcgggacttcctgctgggcgcgggcagcgccgacatcaccggccccgccgccgaggtggggatgatgggctacggcatgctggaacagcagaccaccggcatccaccagcggctgcactcgcgcgcgttcgtcatcgcctcgccctgcaatggtaagcgggtggccttcgtcagcgcggacctgggcatggtgttccaggcggtgaagcagcaggtcgtggagcggctgcgcgcgcgttatggcgacctgtacaccgacgacaacgtgctgctgagcgccacccacacccactccgggcccgggggctattcgcactacaccctctacaacctcaccacgctgggcttctcgccgcagaacttcgaggccatcgtctccggcatcgtcgcctccatcgttcgggcgcatgagcggctcgccgagggcacgctgcgcctgtcgtcgggggagttgttcggggccagccgcaaccgctcccccaacgcctacctgctcaacccggccgaggagcgcgcccgctacgcgcacgacgtggacacgcggatgacgctgctgcgcctcactcgtgcggatggcaccgacatggggctcatcaactggttcgcggtgcacgccacgtccatgggcaacggcaacacgctcatcagtggcgacaacaagggcctggcctcgtacctcgccgagcaggcgcagggggccggggacacgttcgtcgccgcattcgccaacgcgaacgagggcgacgtgacgcccaacatcctgggaggcacccacggcggcggtgccaatgacttcgaggacacggacctctccggtcgcaagcagtacgacttcgccgcgaagctgtgggcggaggcgaagacgccgctcacgggcggcgtggactaccggcacgtctacgtgaagatggacgcggtggacgtggcgccagccttcgcggacggggcgccgcgaaccacctgcccggccgccatcggcgtgtccatgctggcaggggcggaggacgggccgggcgtcggcgtggagggcgtcacttgcgccgccggccagaatgcctgggggcagttcagttgctcgctcgccaccacgccgtgtcaggcggagaagcccatcgtcctggagatgggcagcatgcggcccttcccgtggacgccggaggtgctgcccctgcaactggtcaccatcggcaacctggcgctggtggcggtgcccttcgagctgacgaccatggccggacgccgcctgcgcgacaccgtggagacggcgctggcgcccgcgggcgtgacggacgtcgtcatcgcgggcctgtccaatgcctattcgggctacgtggccacccgcgaggagtacgcgcgtcaggactacgaaggtgcttccacgcacttcggcccgtggacgctcgcggccctccaacagaacttccacctgctggccacgtcgctgcgggacggcgccggtgtgcctcccgggcccacgcccagggacctgcgcaaggagcagctcagcctgcaacccggcgtggtgttcgacgacaagctcttgtgggtggacttcggcgaggtcgtcaccgacgcgcggcccacgtactcgcgcggcgacacggcgagcgccaccttctggggcgggcatcccaagaatgacctgcgcctggagggcaccttcctgcgcgtgcagcggcgcgagccggacggcacctggacggacgtggccaccgacgcggacccggccacgcgctaccagtggcggcgcgagaactgcgtgcccacgttggcgtgctcccacgtcaccgtgacgtggggcatccccgacgacacggtgccgggcacgtaccggctcgtccacgaaggcaactggaagtcgggctgggacggcaatgtgcggccctactccggtgcctcacggaccttcacggtgaagtgacgcgcggcccgcgtcacagcaccacctccgcgcgcatcaacgtggacgcgggtgtggtcagccggtggggctgcacgcggcggatgagctcgcacagccgggcggatgggttgatgaactgcacgcccacgcccgtggacaacatgccccacgtctgcgcctgggcggcgtccacgtgacgcaccacctcgcccgcgcactccaccaactcgccggccagcagcagggtgaactccagccggttgaacaggcgcgggaaggggtccgcgcagcacatgaagagcccaccccggctcaactccgtgcacagcacctccacgtcgcccgcgccggagcggcgccgcacccgcgccacccacgtcaggggtggggtgagcgcgttgggctccgtcgccgggtcctccgtatccagccacgccagggacggcaccggcgtgtggctgcgtggcggcggcgtctggggtgacagggcgtccgccagcggctgggcggcggccagcagcagggcctccttgaactccagcgcggtggcgtagcggtcctcgcagcggcgcgacagcgcgcgcagcagcacctccgacaatgcgggcggaaccccgggcaccagcaggtgcggcggcggcgcgcccaccgggcccgtgcccagcgccagctccaccatctgcccccgctcgaagggaagctgccccgtggacaggtaataggccgtcaccgccagcgcgtagatgtccgcgcgtccgtccaccggctgccccgcggactgctcgggcgccatgtacgccggcgtgcccaggacgatgcccgccgccgtttcatcctcacccgggtggggccggcgcgccttggccacgccgaagtccagcacgcgcagcgacggcggctcgcctgcgtgccgcaccacgaagaggttgtccggcttcaagtcccggtgcaccacgccgcaccggtgcgccgcgtccagcgcgtcacacgcctgcgccagcagcgacaccaacgtcgcgggcaccatgggccggggcaggtgcgacatgggcacgccttccaggtactccatgacgaagtagtggatgccgccgggcgcctcgttgatgtcgaagatgtggacgatgttcggatggcccaccacgttgaccgtgcgtgcctccgcgtagaagcgcgcgcgcaggctttcgtcccggcccaggtgggggtgcagcaccttcaccgccacccgtgcgccaatgcgcgtctgctcgcccaggtagacggtgcccatccctcccgcgcccagccggcggaccagccggtaacttcccaacgtctggcccgtgaggtccgcgggaggggcttccgcgtcgcccgtggacaggtacacctgcgtccagggctcgccgccacacgccacatcgtagggatgctcggtcagacagagctcgcagtgcatggttccctgaagcagacaccagggcggcgcccgggcgcgcatcaccccgggcacgcaccgtctgtcaggtggcactgtggcgccgctccgtcgaccagcggaccggtgactcctgccgtgggacggctggcctcagctcgcggcgaagggggcggcgtcgacgcgcacacccacgtacgacgggaagcgtggcacgccgtcgttggacagctcctggtagcggaaggtgatgatggcacccacgggtggcggcgatgcgcgctccgcgtccgacaggcccgtgcccacgctgaagcgcgtgccgttacgcagctccacctccagcgcgcccaggcggcccttgtggcggcccgcgccagccacgtgtcccaccacgcgcgcttcgtcgtccttgaagctcttcaccttgagcagcgtgtgggagcggcccgcctcgtagcgcgacccgggctggcgcagcatgaggccttctccacccagcgactccacgcgcgccagctccgtgcgcaggtgcggcgtgccgtcacagcgcgcgtgggcgtgccactgcgcatacgcgggcttcgcctcctccatccactgccggcagcgctccagccgcgcctcgaaggtgccttccacgccgggcgcgtcgaaggcgacgaaggccagctccttccaatcgtcgctgcggtcctgccggcggacgatgctcaccgtgcgctggaagcgcttgcgcccgccgaacagctcaccgtcgagcgggaagtccggcagccccgcggtgaaccactccggcgcgaggaacgcgttgcccagccgcgaccagaactgcttcccgtcccagtacgcgcgcacgccgtccagcttctcgctcatccaccagccggtgaggtccacgtcgttctcccacgactgggccagcagcaggggtggggccttggtgtcgtcgctggccgacgtgctcctcgtcggacgcgcggggaccgcgggagcgccggacccgtcaccgccgatgcgcgcgtcctccgcggcgtctccgcgcacgcggcgcaggtgcttgcaggtgcgccgctcgatggccaccgactggttgcgccaggcggggcatgaacacgaatacacaccgccggtgttcttgaggatgtagggcttggaacccgagccctgaaccgagacctgctccccgtccgcgatgtccgccatgaccgaccctccgtgccgcatccggagcggcgatgggatgaagcataccccccggggccgacgtttcaggacgtgatgcggtgggcattccgcctcggatggggtggcgcgaggccgttgggcaccccacgatggggagtgggccctggaaccaggaggagtcgcgtcaatggtcgtcatcatcatgggggtatctggagcggggaagaccaccgtgggccgcaccctggcggccgagctgggcttgcgcttcatcgacgcggatgacctgcacccgcgctccaacgtgatga

SEQ ID NO: 1182 - DNA, 17897 bp, Myxococcus xanthus
  unsure (1)..(17897): unsure at all n locations
gtgctctacaggcgctgctgctggccatgggcagcaacgcgctggcccggctgcgcaacaagccctccatcaccacgctggtgcccgggctcatgctcctggtgcccggcagtgtgggcttccgcagcctgtcatccctgctggagcgggacgtggtggccggcgtggacacggccttctccatgctgatggtggccgtggcgttggtggccggactgctgtccgccaacgccctggtccccacgcgcaaggtgctctgactcagcccaggcgggtgacgtacaccgccaccagcgtcagcaggaagtagtgcaccagtccgcccgcgccggcgtagtccttcgccagccgctggccgaagaagagcgccaccagcgacaccgcggagagcagcgcgccccagaaggccagcgtcgcgctgcccgtggccaccagcgacaccagccccgcggcgctgagcgcgcccgccgccagctccagcacggtgacggtggccagcatcagcggcaccacgccgcgcagggggctcttggaaaagtggcccgtgagccagcccaggttgcccttccagtcgatgaccttgtcgaggccagactggaggaagaggatggccaggaagacggcgcagagcgcctggagcagccagacagtgaattgggtggattcgaagggcggcatggcgcggccactctagccgccctggggccgggcccaagccttcttggcaggacagcaggcgggcaggcaaaagcgcctcccgtccctacccttctgtgatggccgccctaccttgacgggtatggcaaccgagcagaccgcccggcgggtgttcactggcctcatcatcctttccatcatcctgctcgccctggttgtccgcccgttcgccaaggccttcttcctggcggcggtgctcgcgggaaccttctacggcctctactcgcggctgagccggaagctccgcggacacaacaacctggcggcgggggtcatcgtctcgggagtcatcctggccctgctcctccccctgggtggtctcacggccttcatcgtcaccgaggtgtcggacggcgtgaagttcgtctctgacacggtgcagcgggaaggggtggaaggactgattggcaagattcccagccccgtgcgaggcccggtagagaggctgctggagcgcatccccctggagcaggcccagctcgacgagacgctccagcagcaggtgagcacccagggcggcacagcggcgcgggccgtcaccggcgcggtggccgcgacgggctccatcgcgttccagacggtgatgatgctcatcgccctcttcttcctgctgacggagggcgcgcggctggtgagttgggtggagagcgtctcgcccctgcggcgcggccagacgcgtgaaatcctgcgggagttccgcagcgtctccgtggcggtgctcgtctcgtcggtggccaccgcgggcgtgcaggcggcggcgggcgctcgtcggtttcctcatcgcccgcgtccccgcgggcgctcttcttcgcgggcgtggcgttcttcatggcgctcatccccgccgtgggcgccgccatcgtggtgctggtcgccgcggcgctgatgttcttcagcggccacccgtgggcggcgctgttcctcgccatctggggcacggtggtggtggggctggtggacaacatcgtgaagccgctgctggccaggcgcggcatgcaccagcacgcggccatcgtcttcttcgcgctgctcggaggcctggccgcgtttggcacggtgggcctgctgttggggcccctcatcgtggccttcttcctggccctgctgcgcatctacgagcgcgactacggccggcccacgccgcgccccggagacccggccacgcccggaggtccgagcggcgacgaaagcctcatcatccgcccgtccgtgctgtcggcggagacgcgcgagcgcgtgcccctgtcgcccacgccgccggagaaccactgaggctccgctgaaacaacacggccctgcttcccgcgcgaacgggaagcagggccgcgacacttcaagcggggaggctcagaacgccgagccgttgacgcgacggcccggcgaggactgcaggctggacaggctggtgtgcagcacgaaggtcgccgtggcgcccaggtccgggctgcggttggcggacacgccatccgtgccactcacaccggaggacaacaccgcggactccaccaccgtgccagtcgccgtcttcacggtgacggtgtcaccgctgttggacaggcccagcgtgcccgtggaggcggacaccgcgttgggcgtgccggccgggatgcccgccgcgccgccgaacaccacgatgacgccgcccgccgccagcgaggtgccaccggggaaggtgtgacgcaggctggccgcgtcggacaccgtccacccgctcaggtccaccgccccggtgcccgtgttcaccaactccacgaactcgcccgcgacgttcgagcccggctcgttgaccatcacctcgttgatgatgaccttgcccgtgccgcccgtcggcaccgtggtgatggtgaaggccgcgttgctgaggtcgctgacgctcgcgttggacgcgtcgctgatgcggacctgcgcggtggtggtggcgctggacggcaccgtccacgcgtagctgcccgcggaggcggccgtgctggcggccagcgtgctccaggtgctgccattgagcgtgtactccagcttcacgttcgtgacgctggtcgacgtccaggtgatgtcgcgcacgctcccgcccgcccagctctcaccgccgttgggcgacgtcaccgtgacggaggcattgttgccgggcgagctgtcgcccgggatgaggaagtccttgatgacggccatgtgctgcatgccagaggccccgctgtcaccggacagcgcgggcgcgatgtcgctcagcggcgagtagacgcgcgtatccaccaccaggccgttggtgaaggtgctgccaccgatgacaacgggcgtctggtacgcgaacaggtcgctgtccaccagcacgtggtcatacggggcgttgcggcccgcgttggtgttggtgttgccattcttgtccgccgggtgcgggcccgccgtgcgcaccacctgggacagcgtgctgaatgcggactcgttgcggctgccggtgttcaagtctccgccgatgacgaggtagtcgcccgcggggatgttggccttgatgcggctgaccagattgctggcctccgagttgcggttgctgctgcccgtggtgaggaagtgcacgctcaccgcccagaggtccttcgggcccggcacgtcgatgcgcgcccaggcgaagtcgcggttggagacgtacgggtcatcccactcgcccgaggcgatgatggggtagcggctgatgatgccgttgggaatctgcgccccaccctcgcggtagtagtggaactgcgtgccgaacgtcgtgtccacgaagccacggatgtccgccgcggagttcgacttgtagttgaactcctgaatcatcaccacgtcggcgtccgtgccctggaagatgcggatgccgtggcccgggtcgtagtcctgcccgttgccgctggacgtgttggccgccaccaggcgaagacggacctcacccagcgcgtcctgccgctgcccgacttccgcgccgtcgagccccacggactccagcgccgtgtcctcgccaccacacgccgcgagcaccgccagcaacagcgcggcgacatgtcgccgccagttcgactgcacatggcttgaaggagttgcgtcgtcacgcatgatgtccggtcctgccccctgacaaggagctgttgagtggtcggatgagacatccacacgctacccgattcacagggaatgcgatgctcacccgtttcctttatcgagcggaacgcagacacgttgcgtgaaacatcggtgaaaccgtctgggacgggcactacagcgtggcggcggcggacagggcgacggcgagataacgaaggcccttgccgagcgtgacgaagaagacgaaaggcagcgggcgcacccccagcatgccgccggcgatgacgaacgcgtcacccaccacgggcatccaggacatgatgagcgcgggcgcgccccacttccgcgtccaggcctccacgcgctgcatgcgaggcccctccttctcacggcgccgcgcgtaccagcgccccaaggcgcctcaccaccacccgccacccaccggcccagcacgtagagcgacagcgcgcccagcacgttgcccgtggtggccactccgatggcggtaacgggcgccgtcccgccgtagacgagcgcggccagcagcgcctccgacggcactggaaccacggagcccgcaagcatcgcgacgaggaacaaccccgggaggccccaggtggcgagtacggacgggtcgggcatcaacgattcgaaggtgagaggccccaagcctgccatgcccaccgccgcggcgcacgcattcagacacccagggcgcaagacctgcgccccctcccacccgcgcgcaaggattgcgccccatccccgcccgcggacaggtgccccaggggagaaaaggccacggcgcagcgcttgctaaggggaggggcatacacccgaaagggaaggaacgccgcgcccatgagcagcaccatcgccccagtcccaagcccgagccagagctccgacctccgcctcgtgccggtggagattgcccccgagacgttctgggtgggcaagcgcgagcccggcaacatcttctacgccaacccctacctgctgcgcttccgcggtacggacaagaagacgcagcggcccacggagttcaacctcctcatcgacccgggctcgagcagcgacttctccaccatccacaccaaggtgacgtcgctcattggtggcatggagcggctgtcggccatgttcatcaaccaccaggacccggacgtgggctcgtcggcgagcatcatctccgcgcgctacgcgccccgggccgggctgctgtgctcggaggacacctggcggctcatcgtccaccagaacctgccgcgccaccgcttcatccccacggagaagttcgcgcagggcctcagcgtgcccacgggccaccggttgctgccggttccctcgcccttctgccacttccgcggcgccgtcatgctctatgacccgcagacgcgcgtgctcttcaccggagacctctttggcgggctcaccgactccaacgccaagggcatctgggcggacgaatccgactgggcgggcatccgcgccttccatcaaatctacatgccggtgaactccgcgctgcaacgcacggtggcggccatccgcaagctggagccgggcgtggagatgattgcgccgcagcacggccgcatcatccgggggccgcctggtgcagcagttcctggaccggatggagaagcttccaggtgggggcctggaccatcatggacgaggcccaggccgcacgcactgcaggctggaatgccgtgctggaccgggtggtgtcgctggcgcccggctacctgggtgactccgtggaggcccagctggccgcgagcccggagctgtcggacacagcgcagtacgacggcacgcggctggtggtgagccgcctgggcaagtggacgctggagcacgtggtggacctgctgtgccacggcgagccgccggagattgccggccccatcatcgtcgaggccaccagcgccgcggccgagtacaacctgcccacgccgcacctggacatcgagggcgtgggggcaccgtcccacgtttcgctgctcgacccctgacagcgacgacgcagacgagggaggccgaggtgcactcgaccgacgacgaagaaggcgtggcgtacctggggggtgccgcgccggagccgcaattgcgggtgactccgccgccggccatcgtgaagccgccgccccgcgccggcctcccccctgtcccgcagcggatggaaacccctcccgacgcgacattccatccggtgacgccaccaccggccctgtcgctcggggagaccctgcggccagtgacgcccatgtcgccgcacggcacgatgctccagggcatcgtggtgcccgcgccctccagcgtcgtgcgaggcctggtgcccggccagacggtggcccagcgataccgcgtggagcgctggctgggcgccgggggcagctctaccgtgtacgaggccaccgacctccaccaggacatgcgcgtggccctcaaggtcctcgcggtgccccatgcggatgccgcgatggtggcgcgcttccgccaggaggtggagcacgcccgggcgctggagcacgtcaacatcctgcgtgtcttcgatgcgggcgtggacggcgagcggcacttcctcaccgtggagttgctggatggcgtggatttgcgtcagcggctgctggagcggcgcgccacgttggcggaggcgctgcgctggctcacccacgcgacggtggcgctggaacacgcgcacggccggggcgtgctccaccgcgacgtgaagcccgccaacctcttcatcacccgcaccggcgtgctcaagctgatggacttcgggctcgccaagagcacgcacgtcatggggacgacggcccagggcgcggtgctcggcacgccggagtacatggctcccgagcaggtgacgggcaaccccgcggtgtcacccgccacggacctgtacgcgctcggcgtggtggcctacgagctgttcaccggacagcttccgttccgccacccggagcccgtgccgctgatgttcctgcacgtccaggagcgccccgtcccgccgcgcacattgcgaccggcgctgccggagcccttcgagcgcgtcgtgctgcggctgctggagaaacgccccgacgaccgctaccggtccgctgccgagctccgcaccgcgctggcgaagctgtggccccacgcactgaatggtgatgcgtcggtggcggcacgagcaccggcgccgcccctcgcgcgcgcccgagcaccgggcccgggaggcggcacgggctgagagaaacgtgcccgctgtcacgcccccgatgccgctggctccgtcctgcccggagccaacagcgccaacccgagcgccgcgacggccgtgagtccagcggcgatgccgaactgcagggcgaagtgcccgctggccagcgcgagcaacgccaccgccagtgagccgcccagaagccgcgtggcgtagagcgcgctggtgacgatgccccggtggtgccagggcgcgcgggactgcggtccaatcagcgacgtgctggcggcgggccccagccccaggccgagcaccgccagccccatcagcgccgcgggcacaccccagccccgtgcggcggccaatgacagccacccggcccccagcgccgccaccgcgaagcccacgccggcgctcagtcgcatgcctccgcgcaccagcagcttcacgccgaaggtggagcccacggaccagcccagcagcatcggcagcagcgccagtcccgccgccagtggcgtgtgaccgccttgctccgtcatccacaacggcacccacgcggccatgctgtacagcagcgagccgcccgcgatgccgcccacgatgccgctgagcaccgcgcgatctctcagcaactccgccggaagcaacggagacaccgtcgtgcgttgctgccacaccagcagccagcccgcgcccacggcggccagcgcgcaggcccaccgcaggctcgcggcccccggctccaacgagaagaggagcagcgccgccgaggagcccgcgagcacgggcccccaccggtccatgcggacctccggacggcgaggcgggtcgcggtaggagaggtacagcagcgccgcggcgaacaggcccaccggcacgttgaccaggaacacccagcgccacgaggcgtgcatcaccagccagccgccaatgagcggccccacgacgttgcccgcgccccaggcccctgtgaacagcccctgcacggcgacgcgctcacgcagcgtgtagaggtcggcggagatggtgagcgtggtgggctgcaacgcgcccgcgcccaagccctggatgacccggaaggcaatgagccccggcaccgagtccgccaggccacacagcgcggagcccaccaggaacaaccccatgcccgagaagaagacgggcttgcgtcccagccggtccgccagcttcccggagacgagcacgccgacggtggaggcaaagaggaaggcggagaacacccacgagtagaggtgctgacctcccagctcccgggtgatggtgggcatggcactcgtcacgacggtgccttcgaacgcgctgaccaccagggccagcaacaccgcgcctgtcgctgtccgccgcgccacgcctggacgcgcgctgaccatgggctccgctgtgacgccgcttccgtccattacctctctgtacgccccaggcccccatgcggaaaccgcatcttccgcataggctttttgcggaatccgcatgacctccgaacagctccgagccttcctcgaagtcgcccgggcgggacgcctggccaccgccgcgcgtgggctgggtctgtcccagtccggcctctcccggcagctccaatcactcgaggccgccctgggcacgcgcttgctcgtccgcacgccagggggcacggtgctgacagacgcgggagagcgcttcctgcctcatgcccagcgcgccctggacgcactgacggcgggcacctcggagctggagcggctgtcggggacgccacacggcgtggtgtcgctcggcacgctgcataccgtgggggcgtacctgctgccggacatcatcccggccttcgcgcgccagttcccggaggtccggcctcggctgagcgagggactggcaccggccatggaggaaggcgtggcacgcggcgccctggacctggccatcctctccctccccgtgcggcgcgcggacctggtggcgcagcgactgtgggaggagtccctggtgctcgccgtcccgcgtggacaccggctgacgaagtcaggcaagcccgtgacgatggacgaggccgtggaagagccctgggtcgtcatccccggcatgagcggcacccgagcgatggaggccgcctgtgaggcgcggggcgtgacaccccgcctggcggtggagacggacaacgcggaggccatgcgccgcatggtggagcgcggcctgggcgtggcgatggtgccgcagttgatggcccgagaccaccatgcccagggcttcgatgtggtgcccctggcgcgcgccggggtgaagcggcaggtggcgctgatacaccggggagagggctacctcacggccgcggcgcgggcgctcaagtccttcatcgtggagagcgtgcgcgccatgcccgaaccctggggcacgaggaaggcggctccaggcgctcgggtgcgctagcgtgccgcggccgatggcgccgtcttcacgaggcgaggcccatcgggacacggagacgcacgatggcccggacggacagcttcgttgagtacacggtggaactgctggagaagctggggcccgtgaagtcccggtcgatgttcggcggctgggggctctacctcggcggacggatgttcgggctcatcggcggcggtcagttgttcctgaaggtggatgacgtcaccaagccggacttccaggccgccggatgccggccgttcatctacgaaggcatgaagaccccggtggagatgggctattggacgccgcccgcggacgcggcggatgacgcctacgcgctcctgccctgggcccggaaggccgtggacgcggcgaaccgggccgcgttgaagaaggcccagaagacggcacgaaagaaggcaccggcgaagaagcgcacctcgcgcgtcaagccgtcttgatggccgcggcgtcctccagccccagctccacgacggacgcctcgcgcatcttgaacttctgcaccttgcccgtcaccgtcatcgggaacgcgtccacgaacttgaagtagcggggaatcttgaaggacgcgatgcggcccgcgcagaaccgggtcagctcctcggcggtgagcgtcgcgccgggcttcacccgcacccaggccatgacctcctcgccgtacctcttgctcggcacgccaatgacttgcgtctcgctgacgcccgggtgcgcgtggaggaactcctcgacctcgcgcggggagatgttctcaccgccccggatgatggtgtccttgatgcggcccaccaccttcacgtagccctcgtcgtccatcaccgcgaggtcgcccgtgtgcatccacccggcggcgtccacggccgcggcggtggcctcggggttggcccagtaccccagcatgacgctgtacccacgcgtgcacagctcgcccggcgagccgcgaggaaccacctcacccgagcccgcgtcgatgaccttgacctccaggtgcggatgcacgcgccccacggtggacacgcgcttgtccagcggctcgtccagcgcgctctgcgtggacaccggcgacgtctccgtcatgccgtagcagatggtcacctcgcgcatgtgcatgcgcgactgcacctgcttcatcacctccaccgggcacggcgagcccgccatgacaccggtgcgcagcgtcgacaaatcgaactcaccgaagcgcggatggtccagctccgcgatgaacatcgtgggcacgccgtacagcgacgtgcagcgctcggcctgcaccgtctggagcaccgtcagcgggtcgaacgcctcggcgggaatcaccatggtggcgccgtggctggtacaggccaggttgccaatcaccatgccgaagcagtggtagaacggcaccgggatgcacacccggtcctcggggccgtagcgaagggcctccccgatgaagaagccgttgttcaagacattgtggtgcgacagcgtggcgcccttcgggaagcctgtcgttcccgacgtgtattggatgttgatggcgtcatcgaactggagcgacgcctcgcgggcggccaacgcgtcctccgaaacatcctccgcgccatcgagcagccgctgccagtcgtcctccaggacgagcgccgccgccaggccggcacagcgcggccggacctctttcaccatgccccggtagtccgtctgccggaagccccgtgcgtggagcagcaccttggtgccggactggttgagggcgtactccacctccgaggagcggtaggccgggttgatgttgaccaggatggcgccgatacgggccgtggcgtactggacggccacccattcgaagcggttgggtgaccagagccccacccggtcccccttctgaacgcccagggccatcagcccccgggccacctgcgaggtgagcgcccagagctgttgatacgtggcccgaaacccctgggacgccaccaccagggcctcccggtcgccgtggcgctcgacggtgcggcgcaggttctggccaatcgtctcccccagcagcggggtggtgctggtgccatgggcgtaggaagggaccgggttttgggacatgggcgtcatcgtcccgcccaggcggacacgcggcaagcgccgcgaaccaccgctgtccagcgcgtggcaggggggcatgggggaaggcggcatgcactgccagcgagggcccccggggggccagtcccctcctgggaaacgacagtcagccctgaaatcagccattacgccgtgcagccagcccacgcaccgcgttagaaaccgggactcatggatgactccaacgccaggctggtcgcggccctgctggaagcccggcagcgacactgcttccctgcggacgtacggcgcgctgcccccgaattcgtaggccaggtgctcggcctgctcttcccccacttcgccgagcgcctggagtgtacggccgcggccgtccaccgcgacgtcaccaccgtggaggccagcctccaccgcatccgggacacgctggcgcccctgtacccgggcattgaacgggacttgccggcgcgcttcatggagcggctgcccggcctctatgactggctgcgacaggacgcggacgccatcttcgaggcggacccggccgcgcgcaccgtggacgaggtcatcctcacctacccgggcttcaccgccatcgccatctaccgggtggccaacgcgctgcacgccctgggcttcccgctgctgcctcgcttgctcacggagtacgcgcaccagcgaaccggcgtggacatccacccgggtgccaccattggccggcgcttcgtcatcgaccatggcactggcgtcgtcatcggtgagacgacgctcattggcgacaacgtcaaaatctatcagggcgtcaccctgggcgcgctcgtcgtggagaaggggctgacggacaagaagcgtcaccccaccatcgaggacgacgtggtggtgtacgccaacgccaccatcctgggcggagaaaccgtggtgggccggggcagcatcatcgccggcaacgcctggctcacgcagagcatcccttctcaatccgtggttacccgccgcagcgaggtgcgtcagcgcggcgagaatggctcgctggacgcactcgaattccacatctgacccaccgacgaggcccccgacatgaaggtgaacaacatcctggagaccatcggaaacacgccgcacgtgcgcatcaaccggctgtttccgtcccgcgtgacggtccatatgaagctcgagcgcgccaacccgggcggcagcatcaaggaccgcatcgcgttgtccatgattgaggacgcggagcagcgcggcctgctcaagaaggacagcgtcatcatcgagccgaccagcggcaacaccggcatcggcctggccatggtggcggcggtgaagggctacaagctggtgctcgtcatgccggagtccatgagcgtcgagcgccgccggctgatggccgcctacggcgccaccttcgagctgaccccgcgcgcgcagggcatgaagggcgccatcgctcgcgccaatgaactgctgtcgcaggtgcccaactcgtggatgccgcagcagttcgagaacgaggccaacatcgaggtccaccgccgcacgacggtgcaggaaatcctcaaggacttcccggaagggctggactacctcatcaccggcgtgggcaccggcgggcacatcaccgcgtgcgccgaggagctgaagaaggtctggccgaagctgaaggtcttcgccgtggagcccaccaagtcgcccgtcatcagcggcggccagccgggcccgcaccccatccagggcattggcgccggcttcatcccgaagaacctgcacaaggacgcgctggacggcgccattcaggtgaccgaggaggacgccttcgagttcacccgccgcgccgcgcgtgaggagggcatcttcgtgggcatctccaccggcgccgcgctgtccgccgtgaatcagaagctgggcgagatgaccgacggcagccgcgtgctcgccttcaactacgacacgggcgagcgctacctctccatcgagccgctcttcccggcccagtagtcccggggccctcagccgcggtgcgtccgcaccagctccaccaaccggtccatctcctcgggcaggttgtagaagtggggtgagaggcggacgcgcccgcggcgcaccgagagggccacctctcgtccggcgagccacgcgccgagcgcgcgggcctcgccctccggaggcaggaacgtgaggatgcccgcccggtgctccggcgcgggccccacgtcgcagcccagcccacgcagccctgtctccagttggcccagcagttcgcggatgcgcgcggagatggcgtccacccccacctcgtgcagcagctccagcgcggcgcccagggcgtagatgccggtgtacgcggcgctgccctcctccagcttgcccgcgtccgggcgcagctcgaagtggctgcggttgaagttccaggcgtcggtggtgctgcgccagcccaccagcacgggccgcagcctgggcaggacgtccttggccacgtagaggaagccgatgccggcgatgcccagcatccacttgtggctgtccgcgctgaggaagtggatgcggctcttcttcacgtccacggggatgcagcccacgctctggatgccgtccacgcagaacagaacgcccgcccgctcgcacagggcgcccaccgcatccaggtccgtgcggtagccggtggcgaactgcacggaggagaccgccaccagccgggtgctcggggtgagcgcggcggccacggcttccggcgtgacgcccccttcgggcgtctggatttcgcgcacggtgacgccgcggtccttcaggtgcagccagggatagacgttggaggggtactccaacgaggatgcgacgacgacctcgtcgccgggcgtccagtccagcccctcggccaccaggcccaggccgtggctggtgttgcgcacgaaggcaatctcgccgggctcggcgttgatgaggcgggcggccaggccccgcacgcgctcgcagtgggcctcccagccgcgctcgtgcttgatgccgtggtggacgatgtcctccatccacccgcgcacggcctcggcggcgcgcaggctggtgggagccacaccggcgtggttgaggtagagctgctccttcagcacggggaagaggtctcggtaggactcgagcgagcgcgtcatggtgcccggagtgtagccacgtcgccgcgccgcgccgtacttcgtgaaggccgggtgtccgccgtggacagacgcggtggtttttccgtcccaccttgggatgcgatatgcgtcgggtcctgctcgccgcggaggacccatgcgccgcaccatcctggacgccatgaggaacacgttgttcgtgggcgccgccctgctggcgggctgcgcgggaaccgttcatgccccctacccgcccatccgcgcggacatgtcccccgccgccctggagcgaggggccgccatcttccacgcaagctgcgagtcatgtcaccgagggggcgacgcggagacggcatcgggcgcgccgctgcgcgaactgccctcgtacatggggcgcttctacgcggcgaatctcacatcacatgccgaggcgggcatcggcgccatgacggatgaagcgctggcgcgagccatccgctacgccgtgagccgcgacgggcggttgatggtgatgcccagctacggcatgggcgacgcggacctggcggcggtgctgggcttcatgcgctccgggcacccgctcttcacgccggattcagtgcccgcgcccctgtcgaagttcagcttcttcggcggtattggcttccgcttcatcaccgggaatgagccagtggaacggcccgcctcgggcatccccgtgccgcccaaggcggcgacccgggagtacggccactacatggcgcatgacgtctatgactgcgcctcgtgtcacacggatggcttcagtcctcggaagacggagggcgatgacgtgttcgcgggaggcatggcgttcgtcgacccggagggaaggaacgttcattccagcaacatcacgttccacgagacggggctggcgcattggacgctggaggacttcacccgcgcggtgcgtgacggactggcaccggatggctccgtgctgcgctcgcccatgcctcgcttccggggcatggacgaggtggaggcgcgagcgctctacgactatctgcgctcggtgccgcacaggaagaacgcggtgaagggcgcgcggccgcggctcaccgcggagtcagtccgcccggactggggcgcggaggagatggaggagcagagcgcggaggcactccctgatgcggtgcaggccagcgcgcccgatgagacgcgcacgggagctgttcccaacgccagctcctccgtgaagggagcaggggaagaaacctcgggtccgctggtttcccccgcgcaacctccggccaaccatgagggcacacggggagaagacgcccatgccgcagtgacgtcttcggcctcggcgaccgcttccggctcggcgatgcacacagcgcccggagccaccgacaagagcgcggcatcggcaccgtccgcgaaacacgatgcggccaacaccgctgcggccggtccctcgacgctggccagcaagcccacccccacccgtaagccgcgccccgctgcgcccaaggtggacgcccccgccctcttcgtgaagctcggctgcgcgagctgccacgcgcctggcgcgcggtatcacgaccggctcgccaaggtctcctcgcgcagcgaggccgagctggtccgatgggtgcgaaaccccgagcagttcctccccggcacgcccatgcccacctacgcggagttgattgacgagaagaccgcgcgtgcgctggtgcgctgggtgaaggcgggaggcctggccacgctgccctccacctcgcgctgagccgcgccccgacgcacgcggaaaaaacgacccggaaatgaccgaggaaaacccctgctggcgtatcccgtctggaagttctcagcgggcacctcgtcgaggcacccgctgggcgcgtaccaccccggtgccaaccggccccagccccggggtggtgcgtgggacttcccagcgcaccgtcggctggcacgccagcgtctccggctacagggacggctgcacccgcgccgccgctcgcgtacggtgcgccgcatgacggagtgcctcctcaacgtcgacctgggtgagcttcctggtgaagacgaacagctctacgcgctggcccatgtggcgaacatcgcttgcggcgggcatgccggggacgatgcctccatgcgccgggcgctggagcggtgcgagcggcacggcacgcgcgtgggcgcgcacccgtcctacgaggaccgagagggcttcggccgccgcgcgctcgacgtcacgccggagcacctccgggcgcaagtggccgcgcagtgcggccggctcgcaaagctggcggctgaccgtcatctgcccgtggcgtacgccaagccccacggcgccctgtaccacgcggccaatgcaacaccggccctggcccgcgcggtggtggcgggcatcgtggaagcgctggggaccgccgtcaccttcattggccccggcacgggcgcgctgcacgacgcggccctggcggcgggtctggcctacgcccgcgaaggcttcgcggaccgaggcacccggccagacggctcgctgattccccgaggacagcccggcgcggtgctgaccgaccacgcccaggcgcgggccaacaccgtgcgcctggccaccagcggcagcgtggacaccgtctgcgttcacggcgacacgcccggcgcggtggagctggcgcgcgaggtccgcgccaccttggacgcgctcgcgcttcgcgccgagcctctgggtgaaggcgccctgcgactggtccttcccgagggactggagcgacgcgccacgcgcgaggccctctgtgccatgcccggcgtcctcgacgccgtcatcaccgaggagcacgcctgcgtgtacttcgccccggatgcgccacccgaggagcctcggctcgcgctggcgcggttgctgcgcatccccgccccagtggccggccggcccctcacgaccatctccgtgcgctacgacgggcaggacttgcacgcagtggcggaacgcgcgggcctcaccgaggacgaagtggcgcggcgccacaccgcgcgcgagtacacggtgcgctgcgtgggattcctccccgggtttgcctatctgggcgaagtcgacccgagcatcgcggtccccaggctggccacgccccgcacgcgagtgcctgccctcgcggtgggaatcgcgggtgggcgcacggnggtgtatcccttcgcatcacctggaggctggaacctcatcggcaccgcgctggacttcaccgcttcacacc

SEQ ID NO: 1183 - DNA, 20303 bp, Myxococcus xanthus
cgatggggatacagcgcggccctgaccgagaatcttctccgtgatttccacgggctcgaacgcgacctggacgtctggcatcgcctcgcgcactcgctgccggatgcgctccttcaacgcgtcgatgtcgccgacgccgccctcgaaggcgacctgcaggagcgcctcgtgggggcccgcgttgtagagatagatggggctgatggcgaacgatgaggggtgctggcccacgtaggccgaggagattcggaccttcccggcgcccacgacttcttcgacgaggcccattgcctggtggacgacctgctcggtcttctcgattcgggttccctccgccgcgcggagccgcaactggagttggctggagttgactctcggcagcacgtccttgccaatgcgctggagcgagaccaccgccaggacgatgaggcctcccacgcctgccgagacgagcaacttcctgtgcggcagcatgccctcaatcacgcggcgcacgcgtccaggggaggggctggcgccctcaccgcccgggggcgggccgtgctgcttgagcatccagttcgccatcaccggcaccagtgattgcgagaggaggaaggagacgaccatcgagcacccgatggccagcgcgagcggtcggaagagcgccccggggattccgcccatcgtgagggcgggcgcgaagacagagaggatgcacagcaggatgagcagcttcgagaaggcgatctccaggcacgcgtcccacaccgccaccgccaccgtcttgcctcgctggaggtgctgatggatgttctcgatggtcaccgtgctctcgtccaccaggatgccaactgcgagcgccaggccggccaaggtcatgatgttgatggtctggccaaacagcttgaggaacagcacgccggagatgatggcgatgggaatcgtgatgatgacgatgatggcggagcgcacgtcacgcaggaacagcaggaccatcagccccgtcagcaccgcgccgagcacgccctccgcaatcagccccttcagagcccccaccacgtagacggactggtcgaactcgtaggagatgtgcacgtcgtcgggcaggttgctctggattcgggggatggactccttgagctgctgcaccacgtgcaccgtcgaggcattccccgccttggcgacgttgagatagacggagcgcttgccgttcaccagggcgtagccggtggcgatgtcggctccgtccttcacggtcgcgacatctcggacgtagacgttcgccaccgagcccttgaggagcgggatgttcccgaagtcctccacggcgcgaagggtgctgttggtcggggtgatgtaggtcacgtcgccgacgtggacgttcccggagggcgccgtcacgttctggcgagcgatggcctccacgacctgttcgggcgtgaggttgtgcacgcgcagcttctccggctcgatgttgatttcaatcgtgcgcgggctgccgccgaacgggggcgccgtcgtgaggccggggatggagatgaggaacggccgtgcggtgaagttggcgatgtcctggagctggttggtggtcttgctctcgctgcggaacaccagatgtcccaccggatgcgacgaggcatcaaagcggatgatgaaggggggaggcgcaccggggggcaggaacacctgggagcgattcgagagcgcgttgatctccgcgaccgcttgccccatgtcggtgccttcgtagaacgaaagcttcatcagggtcaggccctgggagttcttcgtctcgatgttcttgatgccgttcgtgaacagcatcatgttcacgtacatcttcgtgaagtacccctccatctgtgccggcgtatacccgttgaaggtatgcgcgatgtacacgacagggaggttcatctccggcaggacgtcgaccttgatgtctccggccgcacgcacaccaaagaagaccatggcgacgaccagcacgagtacggtgatgggccttcgtaaggagaccttcaggatgctcattgcttcttcactccacggacctgctgcaggaattcgttgaggtcaccggccgcggccgacttgaggagaagggcttgccagatgccgttctgggcgagctcgaggtcgacatcggcccgggtcgcggagaacgtcgcctgggtgagttcgacaatcgtcccgagcccactgtcgtagcgggccttgctctgccggaacccctccgtggcggcgtcccgttgcaacacggcgtggtgggtcacctctcgcgccaggtcgaacttgtgctcggcgaagcgcgcctgggcaaccagctcctgggtgaccaactcctgctcctggtggagcgcgcgggtacgcgcgtcccgcgccgcctcgctggagaagctgcgcagcacggaggccaggttccagctcaatcccaacccgacaagggtgttgccccgatcgatgcctaccccgccgaggtacccgctcgagaatgcgcccgggtcctgcgcatagttggagcgaaagcccgagccgcgcccctgcaacattccgaaggcgaagagcgtgggaaggccctcggccgcggccaccttcttttcctgctcgctgcggcggaccttcccttcatgctccgcgaggacgggatgtccgggcgcgacgtgcgctggctcgccggactcgggcgtcgactggtggaacgtcggctcgagctggaactcgcgaaacggaacgcccatcaggaccgcaagctccttcgatgccaggagctcggcgtcgtaggccttgagctggagggacctggcgttggcgagttcggcgcgcgcgaaggagacatccaccccggggaccaatccgttctcggcgtggctctggacggactcgagcacgacctcgaagcgcgccacgctctgcttctggatgtgggtgatgcgctgagcggtcgataggttgaggtacgcgtgggtgacgcgaaccccatgctggaaccgcgcgagttcgagctcgcgctgtttcagttcgtgcgtcctctccgacagctcaatctgccggtcgagacggccgaaggtggagacgttccagtggacgagcaccgagtacaaggcgccgaacgccgcgttccagttttgctccggcaacgggaggctggtcgatccattggagggtccgccaggagaatagagcgtcccatgcagggcattcacagtgccgaatgtttcgctgtgccgacagcacgacgtcagggagatagctcttccgggtgtatgacacatcatgctcagccgcgtcgcgacgagactgcttcgcgcggatgtcgccgtagttgtgaagcgcggtgtccaatgactcgcgcagggtcaacgtttgagccagggcttcggccggagataaggcaacggcgagcatggcgccgaagcctgaaatggcggcggcgccacgcgagagcaatgcaaacccgtacacgacatctccttgatgattcacgcacagcgacgaggtgcgccgagcctgccgtccgcggatgcgtgcgagcgaactggctgaatcgacgtgttcctaggcgcgtcaggtgtggagcgtgacaccttgagattcgttggggtccggcgggggcagcgcttgcggggactcacgaggccgcccacgccattcgagggccgcgtccgggactttccagcgggcgcagacctaccggggcgcccccgcagcctgacgcgagtaggcggcgaaggtctggtcgttctcgaagtagagcgcggagttgtcctgcgtgatgccgatgacggccgtcgccttgtccacgggccgctggctcaccgggtccgtcgcggtccggaacgtcgcgtcattcgcgagccggtccttgcacatctcgcagcagccgtaatacgtgcgcccgctgacctcgacgggaatctgtggctgtcccatgtgctggtcgttcaccatgcagacaaggctgcggtccgtgacgagggtgaggtggccttgctgccccgcactctgttcaagggctggaggtgctggcgtcaccttcatggcgggcgcggcctgctgcttacaggcccccgcgagcatcatcagtcccactacagcccagagattggctctcatcgtcatgtctccctttgaagggtctccgccaagccggagttaacgattctcgagcggccgaacgtctcatgaccaggcggaggccagcgctccgaggaaattcggggcgatggtgcgagtccgagcatcggcgagcgttcgagaatcaagagcgtttgttcaggattctttcttgctgaaagcgcgacgcaagaggccaggaacaatccctgctccgaagcccatgccaaggccgacgatacccgatgcgcccatgcacgcgcagcccatggcgccggtaagtagcgcgagtccggaggcagagacccagaaccaggggcccgcgcgacgctggaggctgacccccgacacggccatgcccgcgaccacaccgccgagcacacacgcagggatgcacaagaaggagcagttggctgtgccgcaagtgtgcagggtgccggtgccgagcgcgagcgcgagcgggacgagccccgcgatgacgccaggcaggaacgccttctgcggatcgcggccgtgccagagcatcatcgctcccatgagcgctgtcgccaggccgaacgtgagaggtggcgcgggccggctcgcgagaagggcggcaatcgcggtgacgacgacaatcgggagcacgcccacgagcgcgcgccgcagcctcgcgagctcgtaggtccggcgcacccgtcgttgaagcagttggatgtcagtcgagcccatagagcctcctgaaagtctttcggagccggtccagtgcgcgctcccggcgctttcgcagcgtggcgccagagaccgacgcggcctcgtcccagaacgtggcgatgagcacctcgcggtccaactccgagagctctcccagggcggccatcgcggcggcggtcaggtcccgctggaggaactcctcctccgcgtgaggtccggcgcacgagggcatggcgtccgcctgggattcgcgccggcgatctcggcggcgcgccagggtccggcactcccagcccgcgatggcgagggcccagggcatcgccggacgggtcttgtcgaagtcggaggcgcgttcgagaatcttgtgcatcgcttcctggccggcgtcagcggcgtctgcttcgttcctgagcaggctcaggcatagcttctggatggggccccagagcaactcgaagacacgcgtgaacgcgacccggtcgccctcggcgagccgtgccatcagcgcatcgagttcagagaccgtgcgcacgctcatgctgaatgcttccggttcaggcccgtacctcgagggaagtcaccctgctcccctgtgaatcggtcaacccagcgacatcggggcacgagcaggcgccctccggcccgcgcaaacgacctgttcctgctccggcgcgaagtcaacagcggcatgcatcaagaaggtcctctgggacgggcctcgtgccgtcctcgcgccttctaggcggcacggccgatgagcgtgacaggccttcgttcgaatttcccggacatggcgcaaggcgtcccgtcacccaggcgccatcctggcagaggcccggaccttccctcccagggcatccaggccacaggttgggtgagcacccctgggcctacccacagttcagtcgctgcgcctgggaggcgctgggacgctgtcacggaggggctcggtcgatttcctgcaacggtgtcgcccggcctgtctctccctgtcaggagggggtgttcattcccccaccgtgactcctcgggaggacgacatgaaggcgatgacgcggtacctggtgcttttctccatgctggcggtgggttgtggtgactcgagcgatggtgatggggactccgcactcaagtgcgacgcgatcggatggtgtacctcgtgggagtcggaccaggcgccggtgacggacgcccccgcgctgaagggaggctcggtgcctgaggggctgtatcgcctggagcgcggctcggaggacgcgcgcgccctgctcttcaagggcaagtccgtcctcaaggtgggcggcagctgggggaacatcctggggacctggaaggtggatgggaaccacctggtcatcaccacggcgagttcctgctacgggaccagggaggatgccttcaacgagaccttccgttatgcgttcgccgtcaagggggacacgctgtacctgcacgaggacgagttcgaggatatgcccatcatggcctggcgcaaggtggactcgctctgtcaggagaacgcctcgttcaactgcaaggtgagcaactgcacctgcaagtacgtggcgaactcgtccttcgatacctcggaaaggtgcttctgagccaggacgtcacgggcctcgggcaaagccggggcacgcgggtcggtcgagaagctgcatcaggtccgcgcttcttgtcctgaagcgaaggaaatggcttcggctcggacagcagcgcaggatgcctccagcgtgggtcaggcgggcgcccctggccgctcgcccgattcttccggacgttgctccgggggcgccatgaactcggggcctacgggctcgggcacggactcgttcaccaccgagtccgtgtacgtcagggcctcgtcgtcgagtctccagccaatcacgtcccgcagcggctccaactcgccggggtggcgggctccccacagcgccactgtgacgccgggctggtccagcacccagcggaccgcgaacgggagcacgcccttgtcgtagcgctcgcgcgcgaactgcgcgagccgctggacggcctgcaggtactgtgcgtagcgcggaggcaggaacttggggtcggtctgtcgcaggtcgtctccttcgaaccgggtgtccttgttcatcgtcccggtcaggagtccccggcagagtgcgccgtaggtgagggtggccacgccattcgtgcggcaccaggggatgatgtcttccaaggcttcccgttcgaagaggttgagcgggggctgcgccgaggcgagcggcgccacactccggaaccgctccatcgcctcgatggagtagttggagacgccgatcgcgcggatctttccggcgcgctggaggtcgagcagcgcctgggcagtctcctcatatggcgtggagaagtccggccaatggacctggtagaggtcgacgtagtcggtgcgcaggtgtctcagcgagacctcgagctcctggatgacctgttgtcgcgacgagttgcggatgactccgtccccgcgccgctccaggcccaccttggttgccacgacgaccttctcacgcccgcctcgttcggcgagcgccctgcccacgaccttctcggagtgaccgaagccgtatgccggcgcggtgtcgatgagcgtgatgcccaggtcgagcgccgcgtggatggtccgcaccgactcgtcgtcgttggtgccgccccactgcgacccgcccatggcccaggtccccaggcccacgcggctggcaggggccgaaatgccgagaatcgatgcgtactccatggctctcctccgtgtgcgtattgctgtgtgcgtattgctaccctcgtgcgggggctcatccggggggcggcgcggcttcggggctggtgttcaggatggatggtgcatcggcggtgtcgttccgcctcccgttggcagcgccttgattccagtcgaattgcagccgtgggtcgtcgatgcgggcgtcacgcatgcgtccgaggcctccggtttgaccggggggcctcgcacgcgcggatgagcgcccggccggtaggcgggggcctcttcgggtttgcatcgttgtcccaccatgcctggctgcgaaatgccccccttcgtgtcattcgtcgccctggcacatcggtgtgcaccgctcacccgcgaatcaagctgtcgcctggcgggggcagggagccgactcgcactgcccggctgacgagggcgtggaactgccgcacggtgcggccgtccggcccctgcattccgtcgcgagggcgtgcctatttgaaagacatacccgtcattgagcgaggtgcggcatgcatgcggtggcagtgtttccagggacgcgcgaggttcgcctcgtcgacccgccggagcctcggcccgtgacgggctctcaggtgctcctgaaggtcctcgaagtgggcatctgcggcacggaccgggagatcggtgcctttgaatacgggacgcctcctccggactccgaccacctcattctcgggcacgaggcgctcgcggaggtggtggagacgggcccggacgtcaccctggtccgcgagggagacctcgtggtccccaccgttcgccggccctgtccccatgcgcgctgccgtccctgtcgcgcggagcgtcaggacttctgtgtcacgggggatttccgggagcggggcatcaaggcggcgcacggcttcctccaggagtgggtggtggaagaggaggggcacctggtcgtggtgccccgcaagctctccgacgtggcggtgctggtcgagccgctctccgtggccgccaaggccgcggagcaagtacaggccatccagcggaggctgccctgggagcgcgcgcgcgtgcgagccctggcactcggcgccggaccggtggggctcctgggcgccatgagcatggtggtgaaccactttgacaccttcgtctactccctggagcccgcggccagcgagcgcgcgaacctcatccgctccttcggtgccacctacgtctccggacaggacgtgctccttggggagctcggaaagaaggtcgggacgttcgacatcatctacgaggctgtgggcatgtcgaaggtcgcgttcgcggccctcgatgcgctggggcccaatgggctcttcatcttcacaggcattcccgcgcacggcggcccgaaccccgtggatacggacaccctgatgcgcaacatcgtgctgaggaaccaactgctcctcgggaccgtgaatgcgagccggagcgcttacgagctggcgctccgcgagctggagcaagcgatgttcttgttcccgcagagcgtgcgcgccctcatcacccatcgggttcccatccaggaggcgcccgcgctcctcacggaatcaggtggcatcaagcaggtggtccaactggcttcatgagtgagaagtcctggggctccggcccggggcctgctccgccgccggcccggggccttttgatggcgggccgacgcggctgacgctcactccgctgcccgggcgcgtcggggcggagcgttgcgcgagcccgtctcacatcccaatgtccagacatgtcatcccccctcgagcactacggccttatcggtgacctgacgaccattgcgctggtatctcggagcggctccatcgactggatgtgcctgccgcgcatcgactccgatgcctgcttcgccaagttgctcggcacaaacgagcatggctactggagcctccggcccgcggtggaggtccgggccgtccagcagcgctaccggccggagacgttggtgttggagacggaggttacctgtgacggcggccgggcgcgcatcatcgacttcatgcctccgggggagactgagcacgacatcatccgcattgtcgagggactcgaaggtgaggtcccgatgcattccgacctcagggtgcgctttggttatggcaagttgaccccctggattcagtgcaacagccaccgcgccaccctgacctcggggccggacgcgctcgcatacatcagcccggttccgctcgtaccggactgggatgcgtcccgcctggaagcggactttgtcgtccgcgcaggtgagcggctcccctgctcgctgacgttctatgcgtcgcacctggctgcgccggggcaccctgtcgatgcggagcgggacctggtgcggactgagcagtactggcgtgaatgggcgagccggtgccgatacgagggctcttttcgcgacgccgtggtgcgctcgctcatcaccttgaaggcgctcacctatgagccgaccggaggcatcgtcgcggcaccgaccacgtcgctccccgaagaactcggcggagtccgaaactgggactaccgctactgctggcttcgagacgcatccctcacgctcgaggcgctgatgcgaggaggctacctcgatgaggcgcgggcctggcgcgactggctattgcgtgccgtcgctggcgctccggatgaggcgcagatcatgtacggcgtcgccggcgagcaccgtctccccgaggtcgagctgccatggcttcccggctacgaggagtcccggccggtgcgcatcggaaatggcgcgtacggccagttccagctcgacgtctacggtgaaacgctgaacgcgatgtacgaggcgcgcgtgtacggggtgcaggaggccggatcgctcccctgggacacgctgaaggtgctcgtcgacttcgtggagaagagctggcagcgtccggacgagggcatctgggagatccgcagcaagcgccagctccacttcacgcactcgaagctcatggcgtgggtcgcggtggatcgaggcgtccgcttcgtcgagcagttcggtgccaacgcgccggagaaactgaagaagcgcctgccccgctggcgcgcgctgcgcgaggagatccgcgccgacatcctggcgcgtgcctacaactcgcgcgtgggggccttcacgcagtcctatggctcggacgccctcgacgcgagcgtgctcctgattccgcacatgggcttcctgcctgcggatgacccgcgcatgttgggcactgtcgccgccatcgagaagggcctcaccaaggctgggtttgtggagcgctacttggccgagacgggcgtggacggactggcgggccatgaggccacgttcctcatctgcagcttctggctcgtcgacaactacaccatggttgggcgcctcgacgaggcgggggcgctgttccagcgcctcgtctccatccggaacgacctcgggctgctggccgaggagtaccaccccgggctgcaccgccagcttggcaacttcccacaggcgttctcccatgtcgggctcatcaacagcgccgtgttgctggaggccaagcgggcagggcgggacgtgtcgttcaccgccatggccgccgcgagcatgcactaggcgcccgaggtgcaaccactccccagccccacctggccagggcacgtgccccctgtgtcagggatgctgtcgcctcggcggacgtgccgagctgaccatcttgtgtcccacgtgacatgcagcgcttgtcgatgctgcgacctccggtggggtcccgctcatgtgttggcggtcgtgcgcagcgccgcgaggaattgctgcacgaccggcgagttcgcttggccgtcgtacacgaattcgacgtcgaagcggccgtcgagctcgtcaatcgggaccagccgcaccgtgcgtgggcacgtcggtgaaatgctctccggcacgaacgcgtagcccattccggctgcgacgagtccgatgagcgtcgggatgtcgctgccgacctgcgcgatgcgcggcgtgaagccggcccgccggcactgctcgagcaagaaccggtgatgcgctgcggaccggagtgggtcgaaccagacgaacggcgcgcctgcgagttcggccagttgacgaggcgcgcggaagcgctggcccggcgtggatagcatcgcgagcacgaatcggtcgcgtagcagccgcatgcctgacagatgcggtgcctcgctctgtcgccacgccatgatgccgccatcgagatcgccgcgtgatatcgcagtcgcctgctcggctgatagcattggcgtgatcgacagcatgacgtccgggcaggcgctccggaaggccttgaggacgttcgacaccatcggcaacgggaagtaattcggtaggacgccgagacgcagctcgccgagttggccggccgcgctgcgcagcgcgcgctcgcggctggcctgcagctcggcgagtaggcgcgtagcgtcctgcaggaagctcgcgccggctgctgtgagtgcgatacccgtcgagcggcggatgagtagcggggtgccgaccgcttcctcaagctcgcggatctgtcgggaaagcgcgggttgcacaatcccgagtgcgcgggcgccggccatcatgctgccggcctcagcgactgccacaaagtagcgcagatggcgcaattcgacctgtcgcatgagatgcctgtccgttccgtcgatatactcaataggcatgacgggctgcactgaagagtattagaaagtatgagtagcgcggcttaggttgtccagggtcacgacaactgtccgcatgttgcggacgtttgtcgcacttcgtcatatgccactccatatccagacgccctacatccgttcgcaagttgcatcccgccggctcggcaaagacgtcctgttcaagctcgaggcgatgcagccgtccggctcgttcaagctgcgcggcgtcggtgcggtatgtgacgcgcggcgggcggcaggcagccgtcgcttcgtgtcgtcgtcgggtggcaatgcgggcattgcggtcgcctatgcggggcgcgaactcggcgtgccggtactcgtcgttgttccggagagcacgtccgcgcgcgcacgcgacctgatccgcctcgaaggcgcggagttgatcgtccacggcgcgtcttgggcagaggcgaacatgtttgcgcaatccgtgctcagccctcatgacgcgttcgtgcatccattcgacgagccagagctgtggcaggggcattcaacgatgatcgacgagatggcggcagccggaccgaagcccgacgcagtcgtgctggcagttggcggcggcgggttgctgtgcggcgttctcgaagggctggctcgcaacggctggggcgatgtgccggttgtcgcggccgagacccaaggcgcagactgctatgcgcgctcgattgcgcaggggcggccagtcgaattgcctgcgattacgagtgtcgccacgtcgctcggcgcgaagcggccttgcgacgcggcggttgagtgggcgacacgccatacggtcgagaacatcgttgtgtccgatgcggcagcagtggccgcctcactgcggtttctcgacgaacaccggattctggtggagcccgcgtgcggggccgcactggccgcgctcgacgcggcatcgacggtgcttgccgccgcgtcacgcatcgcggtgatcgtctgcggtggcgtcacggcgacggttgagtatctgcaggcattgagcagccgggagcgatgacagcgggtagagcgcaactcatggttcgccctgagccttcgagggcgattccgcctccgcttcgtcagcacgggccttcgctagacccgtgcgcgccgtgacggagcaaccggattcaggggtggaatcgccactccggccattccttcactcaacgagtctcacaaagccttgccgagacagggaccacgtccctccctgttggatgggggactcgtactgattgaagagatccgcgtaggctcggtccgcaccgttgttcttggccgacatcgagagggatgccagccctggagggagtcgggttacaggcgacagctccgcgggtagctcgaacggcgtgaacgatgtcctgttgctaggggccgtcaatctccagacgagttggtggtcactgctttgagcgttgagatacgcatgcaccacctgcgcggtggggaccacgctccacgccaaggtgaagccctcggtccgagcgacggccggcgcctccatggtgccgagtggaatcgaggtgagttgaaggggaggggggattgtcacgacagaggacgagccgccctccgtgaggaccgttgcgctcgcggaggtgactccagccgctccatcggaacccacgatcaccgtcgtgaccacccggaggaggtcgaatggcggggtgagcaacatcgagggaagctggagcggcggagcgccggtcgccatgctcctgaagaggtacatggtgccgagtttgtaatccatcgtgacgagggcctccgtgccgtagggttcgatgttctccacgttgacctgctgaaactggtcctcggcgcggtctagggcgatctccacgtcgtcaagtgtctgcccggcctggagcgtgatgttgctcttgagtccgaagcgacgtgtcgaattcacgtactccatggcaaagagatgcacaggcatgactccgctccccgaaatatcaatttcgaacgagccgtctattgccgccctcgtggagttgccatggccctgctggtcggcgctcgcgacgatgacgtcctggatgacgctggtcctcccggtgatgcgccccttcagggtggcttgtcccgtctctcctccggtatcctctttcgtgtattgctggagccagacttctggttgctccagggcgaggtaggtgtcggcgaaggtcttctccgtggaaaccgccagcagggtgacatcctgtggaccctggatgtcggggtccacgaagcgcgcgacaccatcctggccgagtggctgccggaaccggctcccatccccaagcaggacatagatgccgatgagctggctcgggtcgccgatgtcctcccagagtcgcgagtggactgtcagcgagccctggatgggagcgttcgatggccctggctcggcaggtggcggcttgccaggtttgtcgccgcaggccatgaggaacagcacgatgagcggaagtagtcggtgcatgtgtcggctccgggatcgggatggtctgggtcggacgaggaggacgttggagtcgcccccgcaaaatcggacacggtcaagcctcgcgcggtcatcggctcgtggcctcgagggggcgtcgccggagccgtgggctcgcaacccactggggacagtggcaccggcgagactcccaggagacctcgcagccaccattcagagcgaatgggacatgagtcacctccgctcgcgagtctcgtcctgagggtgtgacccaactgtgacgacgcgggagccgtgcgcccatcgacgtgctcagatggagggcgtggtgagatggacgttcactctagaacatgttgccgaaggcgaggttgatgcgtgcacgagtacgatttgatcgcggactggtatgcatcccaacgcgcaggccgcatgggcgtcccggaagtgacagcgctcgcggcctcacttccggccggtgcctgggtgctggacgttggctgcggcactgggctgccgctgacgcgggtgctgctggagcacggctgccacgtgatgggcgtggatagctcccgcgagctgctggcgcgatttcaagtgaacttcccccacgtgccggtgagctgtgcgcccatccagtcgtgtgagcttcatgagcggacgttcgatgccgcgatcgcgtggggggtcttgttccacctgcgccacgaagagcaggaacaggcgatcgccaatatcgcgagggcattgaaacctggcgccgcgttcctcttcacctcgggcgacgcccacggctccatcgacggcgagccgatgaatggcgtgccgttccgctatcactcgtacagcgtcgacgggtatcgcgacctgctgcgcgcgcacaggctcgcgctggaagcgacgcacacggacccgggcgcgaacgtctactacctgtcgcgcaagactggataaggtggcttctcgcttcctgctggcgtcccgtacgttcccccagtggagggcccactctcaacccggtccatttttcgggagcatgtcacaggctcacagctcgaccatgaccccggccgcgatgacagccaggacgaacaccgaaatcgcggtatagatgtagtcgcgctcgcgcagggacatgaccagcatcagcgccacacgcgcgatgggcaagatgatgaacaaggccacaccggttttcatcacgtcgtagccgctgaggctgggggcgagaacactccagaagtcatgtgtcgcgcccaaggccatcccggcggcgacgagcgctgaagcaagccaagtgccgttccaaagcagtccggcgatgcgctgctcgcttcgatcaaggcgattggtcgtagacttcatgccgaccctccgaggaactgaacacccagggcgctcaggagcatttgaaccgcaagcagggtgaggatcaccacgaaggagatgcgaattttctcagcgggcagcctcatcagcaaacgcgccccgacgagcgccccgacgactgagccaagtgcgacaggccccgcaatgccgatgtcgatatcgcctcgcacgaagtaggcgccagcgctcgctgcggccgtcacgccgatcatgaagttcgatgtggcagacgagaccttgatgggcagccgcaaggcggtatccatggcagggattttgagcacgccggagccgataccgagcagcgccgagatcacgccagccccgtacatcagagccaggctgattggcacgtgaccaacctgataaggcacgtcgcggcccgatgcatggtcgggaaagctcgaatgcaggcgtagcaccgtggccagactcttcacgtttggcccgctggtagcgaccacttccacttcgcgccgccgcgctagcatctgctttgcggatagcgccaaaataaaagaaaacaggccatacagaaacgaattcgagacgatgccgatcaggaacacgcctgtcagcgcgccgagtgtggtggctgtctcaaggacgatcgcaagccgaatattggtcaggcgcttcttcaggagcggcgcagcgctgccgcacgaacaggcaatcaccgagatgatgctcgcgccgatcgccacgtgaatgtcgatgctgaagaacagcgtgaggataggcacgatgaagatgccgctggccatgccaagcacaccgccgagggcactcgcgccaaaggcggccgcgaacagccagaagaccatcgtggggttcattgacgtgtctccggctcatgaccgcgcgcgtggacgccgggacaagcgagtgatgaacctgatgaggtcgccgcgatagtggagcctttcgtagtcgatggggcgagacccttcggtatatgacgtgcgctcgatcaggaagaccgggttgccgggctccacggcgagggcctgtgcaacggtcggtgtggctgtgatggcttccagccggtattcggcctcaatcagtggcaggtggtatcgttcttcgagcagcgcgaagattggctcggtttctagatcgtgggtgacgatcttctcccctagctcgcgcggcaggtaggtttcatcgaaggacatggccaagccgtcggcgagccgcacgcgttggatacgcatgacgaggctgccgggcgacacggcgagttgccgggcaacgtcagcatcagctgggacgatctgactatccaggagccgagcggtcggggtgcggccgagtgcctgcatgtcctcgacgaagccagtcagctcggtcagttcttggatgatcttgggctgcgcgacgaaggtacctacgccgcgccggatctctaccaagccacgagccacgaggttctcgatcgcttttcggactgtcgttcggctcacgccgaaccgctcaatcaagcggtcttccgtgggaagttggctgcgaggagggaggaccccagctgcgatttcagacgcaagcgtcaattcgactttcgcatagagggggttggattcacgcgtggcacccatcgtgacatcacgacatcatgatgtcgtgatgtcaatgtcctctcacgcgagaagacgccctgatgtgcatggtcgcttcctgattcaggactcgacgagtccttctcggattcaccttgcgtgcgttggctggagctgagcggggagcagaggggcgagctcagggcggcacatggcgctggcaccaggggcggcccgtggccaggcagttcacagcgagcttgtcgtcatgggggcagagcgcctggcgtgccttctgtcaggatgccagcgagcgccgcgatgtgccgttcgtcggtgccacaacacccgccgagcacgcgtgtgccgagttccgcatggacacgagccatctcccgcgcaaaagcgtccgggggcgcgcagtcgagctccgcgcgcccgtcgagctcctcgggcgagagtcgagaggtgttggcctgcaggcccaccacccgcgcgccgagggagggcgaggcggccagttggtgcgataggccctcgcggaagacggaggggtggacgcaattcaccatgtacgcggttgggcgcgcgtcgggcagggcgtcgatgcgcgcgacggcctcggccagcggggtcccgtcgagcagcgtcccggtgggtcggagcacgaagctcagcaggaacggcgccccggtgcgcgccatcgccagggccaggccctctgcctccgagagggccggcagcgcctgcgccacgaggaagtccactccagcacgcgagagcgcctccacgtggggcgcatgcaaggctgccgcctcccggcggggcagtgcttccgcgggctggtatgcatccccgcggcaccctatgagcccgccgacgaagacacgcgtctcccgctcccgaggctcatcgcgtaggcccgccagcagcctccccgcctcggtgaacacgtcccggccagccaggcccgcgcgcgcgagtcgttccgcgttcgcgcgccaggtgggcgtgagcagcagggtggccaggccatgccccaggccgatgtcgcggtagtctcggtagatggctgcgagcgcctcgcgtccctccggctcaaggaggaggctcgcattggccacgtgcgggtccagcaggcccgcggggtggcggcgcaggcgctcgaccacggagccctcggtgagcatccgcggtgcgttgtgcagggcatgaaggaacgccgcgtggttcgccaagccacccatcagcgggcccccttcatcgtcagcaccatccgaaacctcgcctcgccggacctcattcgggaatatgcctcgcctgccttctcgagtggcatcgtttcaatgagcggccggacagtcgtgcccctcttctgagaacgtccccgacatgacgagaatctcctcgccgcccaggggcgtatgccgcggaaaccgcgagcacctggcgtaccgcacgatgctggtcgcacgcgcctgatctcctcccaggaggccgagcatcatccgctcgacaccgccctggggtgacgccacccaccgaattgggtctggcgtgatggccacacgtttcgagaagtctgggcctgggggcccctccaggggtcagctgtacttgttgcgtccagccatgacgccgccgtcgacatcccagattgcgccggtgacccaagaagtctcgtccgacaacagatggacgatggtctgcgcaacatcctctgcgcggcccacgcggccgagtggatggaacccgttgaacccctggagcgcaccgtgaacctgctcctttgggatgaagccttcgtagatgggggtctcgacgaccgcgggcgaaacagcattgacgcggatgccatgtccggccagctccatcgccaggtgctgcgtcagcgagtggagtcctgccttggccatcgaataggccgaggatggagtggcctggatggcctgcttggcccacatcgagccaatgttgacaatcgctccccccttgcgcagcgcgaccatggagcgggcgacggcctgcgtgatgaagaagagcgccttgttgatgtcgaggtacaagtcgtaatcgcgctcctcgtgctccaagaatgccttcggcaggaagacacccgctgcgttgaccagcagcgtcgcgtcggcgtggtccttctgcaactgggccaccagggcctgtctctccgtgccggatgcgatgtccgcgcgcaggccctccacagggccggacgcagccaattccgcgacggcggcctggagcttgtcgtctcgatgcccgatgacgacggctcgaccgccctcctcaaggaggatacgagctacggcctttcccattccgctggtaccgcccacaacgatgagcttctgattggcgaatcgcgcgctcattgaaaatgtgctcctttgctggtcctgggggaatgtcggccccatccacccacacgaaggtgaacaacatctccccctggaagccccaggcctgctggtaaaacaactgggcgccccctcccgacagggtttccacaagcggatccgtcccggcgaaccggaactcatgcacatctacctgcgtggccgcctgctggagatgggacaccttgttggatcccaccagcacgccc

SEQ ID NO: 1184 - DNA, 23233 bp, Myxococcus xanthus
  unsure (1)..(23233): unsure at all n locations
tctttcgcaggaagtccacggtcatcttgagctgatccactgtctcgccgggatagttgtggaacagcatcagcttgttcacgatccccttctggctgctgatgtcgaggatgttctgcacctgccggatggagacccccttgatcatcttcttgaggacttcctgcgaggcggactccaggccccattcgatgacgcggatgccggccttgtgccagagctccaggatcttctcgtcggtgaactggggctcgaagcgggcataggtgaggatgttcacgtcaaggtcgcgccggatcagctcctcggcgatggccgtgccctccttcacctccagcatgtcatccacgaagtggaagaagcgcgtgttgtagcgcttcgccaggagctcgatgatgtccaccgtcttcacggcatcgttgctgtagtagccggagtacgtcttgtagtggttgcagaacgtgcacttggcgaacgcgcatccgcgcgaggtggacaagggcaacgtcggcagcaagaacttgtcgaggtcgtagccatcgaagtccggccggaagatcgaaagctggatgtcgtggcgcggctcgttgacctggatgtttccttccgcatcccggaagacgacgccgtcgagctgctccacgggcttgccgcgcaggagctccaggaaggtggtctccgcttccttgaggaaggcgtagtcgatgcagtcgttgttcttgaggtactcttccttgaaggtggaggcgtccggtcccccgacggcgatttttccctggatgagcggcttgaggcgccgggcgaaccagagggtggccttgcgctgaatctggatgacggagaagcccaccacgcgcgggttgagggccgccacctcccgtaccttctggtgcaggaagttcgtcaccgggttgtcgatctctccgccggcctcgtcataggtcagcgccagatcgatgacgatgtgcagcatcccggtcagcacgaagatgagcgaggcgaggctgctctcctgctcgtcgcagaagacctcttcgtacttgcgggcctggagcttctgcttcacctgttcgaccctggcgaagccaatctggttgtcgatgtagtgcaggtagacgagcgcattgcgaatgcgatcgaagtccgccgggatgtcgatgtgtgccttggccagttcagggaggaaccggtaggccagatccttcagcatctcctccgtgaggaggaaatcccggagcagcacgttgacgtcctgctgcttcaccttgaagaagttcttcctcagtgccgccgtcaacgtgggcaccgccagatgcggatagtccatgttgtggtttggcatcttgaggaggaccgcgtcggtgcggcgctcgcgggcggccggcgtatcggcgttgtccttcccaggctgggcggcgttgtcgtcggccatggacggattgcttgccatcggtgtacccccgtgtgattggttcagctcttgcgacccttgtcggtcgcgagctccaacgagttgcgctccaggatccacctgttgtccacgaagacgggggactggcactcgtaggtgtcggcgatcgaatccagatcaaactccagcaccacgctgttgctgctgtgccgccactcattgtactggcccagcgaggcataccgctcgaggaaggcctggtcgaacgcggcgattcgggcctccaccgcggcctccaccccatagcctgtgcgcagcttcgcgatatcggcttcgacggactgctcctggttcatgatccgcgcgaggtgccacagctccttcagcgcgtagaagtgcttcacgaagccgccccggctcaggttcaccgagtcgttcaactgcggccagcgggaccagagttcggcgagggcgttcgccagttgcgccgagtcgtcgccaccggccgtgaaggggacttcgatcaccgggaagcgagacaggagggcgcgatcctccgggctctcggagagcttccgcagctcggagagcagcgccgggagtgtctggggcagccgctcggcggtgatacagaaccggaagtcgatgatgtagcgccgcaggagggcggccgtggaccggagactgtccgccaggccggagaagttgtcatggtccgtcaggtgcggcagcagcatgagcttcggcagccggcagtccaggcgggtgaggagatcgacgaacgacgcatccggttgcaccgggctcaagattttgaagttcgggtccggcttctgcgagtccttgcgatcccggaacacgccaatgatctgctcaagctgtgcgcgtacctgcgcgttgtcgtggggcaccccgaggaatgctgtcaggtgcgcgtagtgcgtgttgtggtaccagcgcagctcctgctctatccgcgcgaggaggctctgctcatcctggacagggaggacatactcgacgattcgcttacgcaatcttcctccaccttacagatggcgggctgttcacgattcacatgaattataacggtcggcgggcgccaacgctacccggggccattcgcgctgcgctgcgtcggcgccgggcctatccctcttctccggtgcgctgcggggtgacgggtttgggtttgatacggcgcagccgatcgaagtccgaggcgcggcgtgtgtctttgaggacgccctcttgcttacgctcggtctccgtctggagctccagacgggccaggctcctgtccgccccgctggcaagctgccgtaagagcagctcgtattgccggtgcatccgcgcaatggtcgcctcgtcgaagatgtcggcgtcgtagctccacgatgcctcgagcccgccgtcgtgctccgtgaggatgacgacgaggtcgaacttcaccgcgtcgaagttgggagtcacctggctcaagctcaggttcccgagccggagcggtggcagcggcgtgttctgcaacacgaagagaatctggaagagcgggttgtagctcagtgaacgctcaatcccgagctcgtccacgacgcgctcgaagggcacgtcctggtgctcgtaggcctcgagcgtcagcgtcctgacgcgctgaaggagttcctggaaggagagggcgccttgaacctggcaccggagcgcgagggtgttgacgaagaacccgatcaaatcctcggtgagcgggtgggcccggttggccaggggaacccccaccacgacgtcctcgctgcccgtcagccggtgaagcagcgtgtagaaggccgccagcgcggtcatgaagagcgtcgtcccctcctgtcttccgagcttctggagcgcttcggtgtcctgggggctgagccgtccaacaacgagcttgccgcggtggctcggaacttcgggccgtgggagcgcggagggtaacgcgagccgcgcgggggctcctgccagccgctggcgccagtactggagctggcggtcgaggagctcgccctggagccagtgccgttgccagtacgcgaagtcggcatattggattggcaggggcggcagcgggttctgcttgcctgcgctgaacgcctcgtagagcgctgtcatctcgcggaagagcactcccagtgaccagccgtccgagacgatgtggtggagcgtcaccagcaaggcgtgctcctgttcgtccagccgcagcaggcggacgcgcagcaacgggggctcggcgagttcgaacgggcggtccgcctccgtctttttgatctcccggggcacgcgcctcgcgctcgcccgcgggcaacgcgcggaggtcctcgaccggcatcttcagcgtcagcgacggcacgatgcgctggaccgggcgcccctcctgggactcgaacgcggtgcggagcacctcgtggcgctccagcagcgtctccacgcatcgctcgagcaccgccacgtcgagcgcgccggtgagccgcagcgctcccgggatgttgtacgtcgaggcgtgcggctcgagctgggcgaggaaccagagccgttgctgcgagtaggacagtggcaggggggcgcccctgtccactggggagagcggccgcgcggcggcctgccgggagcggcttgccgcctcgattcgctccgccagcgtggccacggtgccgccctcgaacaacgacttcaacggcagctcgatgccggtggtttcacgcaccctcgacaggagccgtgtcgccagcagcgagtgcccacccaactcgaagaagttctcgtgaatcccgacgtgggtccttccgagcaactcgcgccagagcgacacgagggtcagctcggccgcggtgcgaggtgcgctcagggggcctccagcctctgggctgtccagaggcgcctgggcaagcacccgccgatcgaccttgccgttcggggacaggggcagtgcgtggtggaacaccacggcggatggaatcatgtgctcggggagctgaggctccaggtagtcccgcaggtcgccggaggtgatggcggaggcgtcccggaggacgacatgcgccaccaaccgcttggtgtccgcgcgctcaccggccgccaccacggcggcgtcgcgcaccgccggatgcctgagcaaggtggcctccacctcaccgggctcaatccggaagccgcggaccttcacctggttgtcgacccggcccaggaactcgatggacccatcagccctccagcaggcgaggtctcccgtccggtacatccggctgcccggcttgcggctgaacgggtccggcaggaaccgctccgcggtcaagtcggcatgccccatgtacccacgcgcgagcccgtcgcccgcgcagtacagctcgcctggcgctccgagcggtacgggctcgagtcctgcgtcgaggagatggacccgagtgcccgtgacaggcgcgccgatggggaccggtgccgtgccttcgtccagcgcctccatggggtggcagcaggtgaacgtggtgttctccgtggggccgtactcgttgatgagccggatctggggcgcgtgcttccgccagaaggcgacggtggagggcggcaaggcctcgccacccacgacgaaggtgccagtcagcttcgacagtgcctccggcgtcatcagcccggacaacacctggaggtgagccggcgtgagcttgaccaggtcatgccctctcggctgctggagcgcgagtgcgagtgcttccacctcccgccccgacggcaccaggtgaacggctccccccgcgagcagcggcgtgaggaggctggtgatggtggcgtcgaacgcgatggacgtgtggaccagcgagccctggcccggcttcaccgcgtaggcgtcctgggcccacgtcaggtagttgagcagccctcgctgcgtgagcatcacgcccttgggctgtcccgtggtgcccgacgtgtagatgacgtacgccagtgagtccccagcggcggtcgaagccggtgcctccgtcggcaacgtcgccaggcgaaccgcttcctgctccaccaggagccgaggaacgctggcgcccgtgaacgtggcctcttgcgtctgcgtggtgagcagcacgacggcgcgcgaatcggacaacatgtaagccaggcgctcttgggggtagctcgggtccagcggcaggtaggccgcgccggccttgagcgttgccaggaggctggtgaccaactcgacggagcggtccaggccgagcgccaccacgcgctccgggctcgcgcccagcgacaccagatgatgcgcgagctggttggcacgtgtatccagctcccggtacgtcagcgtccgttcgccatcgaccacggcgagcgcatccggcgtggcggcggcgcgggcctcgaagcgggagaggaacgtgggctccgtgggcagcgcggcggcggtgtcgttccactccaccagcatccggcgctgcacgtcggcgggcagtgggctggaggtgtggtgcgcggcctcagcctccaaggccagcgcgtggaggacgcgcgcgaagcacgcgccaatttgctccacctgggcgtgggcccagctcgacggcgttgtagtccagctccagcgtgagctcctgcgtgtggggctcggtctggaagtggacggcgagggtgacgttggttccctcggagcgggatggtgctcagcgcctccagctctgcgagcgtgcccgcgatgtcgtggaggacgtggaagtgcatgtagttgaacatgacttcgtagagcgtctcgcggccccactgccgctgaatctccgccatggggtagcggcggtacggatagagcgcacgctccgcgtcgaaggcggcgcggaccagcgacagccagcttccgggggccagcttcaggcggaagggcaccgtgttgaggaagatgccgcgcagcttcgagccatcgccttcctcggggcggctgttgacgcccgtgccggtgatgacgtcctcctgaccgctcagcacgctcatcaccttgaggtgcgacgcgagcaggatgctcttgaagggcacgcccgcggtccgcgtcagggcattcaggccctcgctcacttcgggagagatgggcaccttcaccgtggcgatgcgtggctcgccctccgccagtggacggcgccagcgcggcacgcgcatgacctgtccgtcctccagcagctctcgccagtagcgttggtggtcctcggacgcgagggcctgccgctccatggccacgaagtcgcggtaggtgatgctcagcggttcgaagcgcggcggctcctggtggttcaccagcgcgtagtagtggttgaacatctccaccaacgtggagtggaggctccagccgtcgatgatggcgtggcactccgtgagcgtgaactggaagtcccgttcaccacggatgtggatgaagaagcgcagcagcggagggcacgcgaggtcgaagtgttgctgcttttcgtcctccagcagtttgcggacctcggcgtcctgcgcctcggtggacaggtggcggacgtcggtgatttcgacggagagctgggcctcgcggtgcaccaactgcaacggctcgctgtacgacgtcatgtcgaacgccgtccgcagcacgggctgccgtgccgtcaccacttgcacggcttccacgaagcgcgcggggtcgaacggcgccttcaggcgcagatggaagctgtccgtgttgtggtagatgttcgaggtgggcgccagctccatgtggaagagcattccggcctggatgcgggccagcgggtaggcgtcctccacgctttcgggcaccttcgcccggtcctcggcggagatgaggccgaagggctcggtgcgcgggaagacctcacgcgcgggctccgccttcgcggcggccgccgccagctccgccaccgtctggtgctggaagagctgctgcaacgagaagcggatgtcctgcttctgcgccagcgtgagcacctggatgctcaggatggagtcgcctcccagcgcgaagaagttgtcatggattcccacgcgcgggacttccagcacctgcgcccagattgcgcagagggcttcctcctccttcgtccggggcgcgacgtacgggtcggccaggtccgcgcgggcgccctcgggctccggaagggccttgcggtccaccttgccgttcgccgtgagcgggaagcgctccatcatcacgaaggcgctggggaccatgtagtccggcagcttgccgagcagatgctggcgcagctcgttgacgctgggcggaggctgttcggacgacgcgacgtaggccaccagggacttgttcccgggcgagctctcacgcacgagcaccagcgcctcacgcaccgccgggtgcaggctgagcaccgtctggatttcgcccagctcgatgcggaagccgcgaatcttcacctggtggtcgatgcggcccaggtactcgagctgcccgtccgcggtgaagcgcgccaggtcgcccgtgcggtagagccgggcaccgggctcgcggctgaaggggtgggggacgaagcgctccgccgtgagctgcggtcggcccaggtagccacgcgcgagacccgcgccaccgacgaagatttcacccgccacgccaatgggcgccggctccagccgcgcgtccagcacgtagagctggaggtcgggaatcgcgacgccaatggggctctgctgcgtgcgctccgcctcggcggcatccatgggacggtaggtgacgtgcaccgtcgtctcggtgatgccgtacatgttgatgagccgcggctgggtgtccccgtgcttgcggaaccagggcaccagcgtggctggctccagagcctcgccgccgaacacgacgtagcgcagcgacaggggcggcgcctccgcgcccaggcgctcctcggcctggatgagctgacggaaggccgcgggcgtctggttcagcaccgtgacgcgctcatcgctcagcagcctgaagaaggcatccggtgaccgcgagacgaggtacggcaccaccaccacccggccgccgtagagcagggcgccccagagctcccagacggagaagtcgaacgcgtacgagtggaacagcgtccacgcgtcgttctcgttgaagtggaaccagtgctccgtcgcctcgaacaggcgcatcacgttgccgtgcggaagcagggagcccttgggcaggccggtggagcccgaggtgtagatgacgtacgcaagctgttcccgcgtcgtcgccagtccgggcgcgtgggcgggctggcgtgcgagttcctcggtggcttcatccaggatgagcagcgccgtcccgtccgcgggcaggcggtcgatgaggggccgctgcgccaccaccaacgacatccggctgtccgacaccatgaaggccagacggtccgcgggataggtcgggtcgagcggcacataggcggcgcccgccttcaggatgccgaggatgcccaccaccgtggccagggagcgctccacgcagaggcccaccaatccctctggctggacgccgcgcgtgatcagcgcatgggccaactggttggcccgtcggtccagctccgcgtaggtgaggcgctctccatcggcgaccacggcgatggcgtcggggcgctggcgcacctgggcctcgaagcggccgtgcagggtgtccgcgcctgggaaggacttcagcgtgggccagacatcgaggagctggtgccgctcgggcgacgtgagcaacggcagcgcgtccaggcgcagctccgcgttggccgcgacgcccgcgagcagcgtctggaagtgcccggcgaagcgctccatggtcgcgcggtcgaagaggtcactgttgtactcgacgaagccgcgcaggccgtccggggtctcctggaggtccagcgtcacgtcgaacttcgacgtccccggttgcaggtccagttgctggagggtgacgccgggcagggccagcacctggcccgccatgccctggaagttgaacgcggcctggaacagcggcgtgtaggccaggttgcgggcgggttgcaccgcctccaccagtttctcgaacgggatgtcctggtgcgcataggcgcccagcgtcgcctcccgcacgcgctggagcagctcgcggaaggatggattgccggacaggtccgcgcgcagcaccagcgtgttgacgaagaagccgatgaggctctccgtctggacccggttgcggctgttctgcggcgcgccgaccaggatgtccgtctggtgcgtgtagcgtgacagcaaggcctggaacgcggccagcaccgtcatgaagagggtggcgttctcacgctggcccacctgctggagcgcctgcaccagcgcggttggcaggtgcaagggtagggcgtccccgcgctgcgtctggacggcggggcgcggacggtccgtggggagctgcaacacgggcgcgcccgcgagctgctgcttccagtacgccacgtgcgcgtcgagcgcgccttccgtcgccatccactcgcgctgccactccgcgtagtccgcgtactggatgggcagctcgggaagctccggctctcgttgggcgatgaacgcgccgtagagctgcgtcatctcgtggatgaggatgcccagcgacgccccgtccgagatgatgtggtgcatcgtcagcaccaggacgtggtcggtgtccgccagccgcagcagccgcgtgcgcagcagcgggcccttcatcaggtcgaagggctggcgaatctcctcggtggcgagccgccgtgcttccgcctcgcgctcgtcccgcggaagtgacgacaggtcggtgacggcgaaggacgcggtgccttcgggcgcgacgacctgaaccggctggccttcttcctgcgcgaaggtggtgcggagcgattcgtgccgttccaccaggacgtcgaaggcgcgccggagcgcggccgtgtcgagcgtgccaccgagccggaccgcgccagcgatgtggtagctcgggttctccggctgcattagatggaggaaccacagccgctgctgcgcgaaggagacggggaagacgaaggattcagcggtcatgtctgggtgagaaccggctggcgaagatttgagggcgaggaacggggcagcggcggaacgggccacgccagtcgtggcgtggacccgtggcgctactccttcttcgaagaagtcgagtcggggaggttcagctcggcgcgcgtcgcggcctggacccggcgggcctgccggggtcgggccaccaacggcggaggcgcggcgggcgcaccgggctgctggagtgtctccaggtgcttcgccaaggcgtccagcgtggggtgctcgaagaggacgcggagtgacacgtccaccttgcaggactcctggatgcgcgccaccacctggacggccttcatcgattggcctcccaggtcgaagaagttgtcacgcgcgccgacctgctccaccgcgaggacgtcgcgccagatggcagcgagctggacttccatgggcgtgcgcggcgcctcgtaggctgccgaggcgcgctggtttgccgacggcgcggggagcgacttgcggtccagcttgccgttggccgtccgagggaaggactccagcgtcacgaagtggctcggcagcatgtacgccggcaggtgagaagccaggtgctggcggattgtcagcgcctcgggggcgggcttggtgccggggcgcacgtaggcgaccagctccgcgtggcccgacacgtcccacagcttcacagcggcttccaggacgccaggcacctgcgccagccgggcttcaatctctcccagctcgatgcgatagccgcgcagcttcacctgtccatcgccgcggcccaggtactccagcgtgccgtctggcagcgcgcggatcaggtcacccgtggcgtagagccgcccgcccggctcctgtccgaagggatccggcacgaagcgctccgccgtcaggtccggacggtggaggtagccctgcgccacgccgtgcccgccgatgtacagcgcgcccgtcacgcccatgggcaccggctgcatggccgcgtccagcacgtacacctgcgtgttgccaatgggacggcccagggtgatgcggcgtcccggctccatgcgcgtggtggtggaccagatggtcgtctccgtggggccgtacatgttccacagggatgcgccgcgcgagcacagtggctcgacgagttcggagggaatcgcctctccaccgcagaggagcttcagcgtggggctgcctttccaccccagcgtcagcagcatccgccacgtggaaggcgttgcctgcatcaccgtggcgccactctccaccagcgcccgcatcagccgggtgccatccacggccgtttcgctactggcgatgacgacgctgccgcccacgctcaggggcaggaagagctccagcacggagatgtcgaaggccaccgtcgtcacggcgaacagcgtgtcctggtcggtcatcccaggcgcccgctgcatggacgccatgaagttgacgaccgcggcgtgcggcacggccacgcccttcgggcgacccgtggagccggacgtgtagagcacgtaggccaggttcgtgcccgcgagcatcacctggggcggcgtcgtgggagcgccggtggcctcggccagcaccatgcgcttgccacgataggcggggacctgtgcggccagctccggctccgtcagtagcagtgagacaccgctgtcatccaggatgtgcaccagccggtccggcggatacagcgggtccaacggcacatacgccgcgcccgccttcaggatgccgagcaaacccacgagcagctccaccgagcgctccaggaagatgcccacgcggtgccccggctccacgccgagctggcgcaggtggttcgccacccggttcgcctgttcatccagctcccggtaggtcagggcgcgcgactcgaagcgcacggcggtggcgtctggacggcgcgcggcctgccgttcgaagaggccgtggaggctgccgggcaggggcaggtcgagcgcggtgtcattccactcccgcagcagtcgcaggcgctcgggcccggtcagcaggggcaggtcgctcacggaccgggtggggtcctccgcgatggccgcgagcagcgtgagaaagtagccagacatccgctcgacggtggccgcatcgaacaggtcggtgttgtagttcagctcgctcaccagcccctgcgccgtctccgccatcgacagggagaggtcgaactgcgtggtgccgctctcgaactccaattgctccagcgtgaggccggacagcgagaggacctcggacggcgtgttctggagcgtgaacagcacctggaacagcggggagtaactcgggtcacgcgcgggctggagtgcttcgaccagttgctcgaagggcagcgtctgatgcgcgtaggcgctcagcgtgtcctgacgcacgcgggccagcagctcggagaacggacgcgcgccgtccacctggagccgcagcggcagtgagttgacgaagaggccgatgaggggctccgtctggggcacccggttggcgatgggcgtgccgatgacgaggtcctcctgccggctgccacgggacaggagcacgccgaacgcggacagcagcgtcatgaacagcgtggcctctgcctcgcggctccgctgcttgagccgggcggtcagctccgccggcacggtgaagcgatgggtcgcaccgtggaagcgctggttcgcggggcgcggccggtcggtgggcagctccagcagcgcaggggcgccggccagatggtcgcgccaccaggagaggtgcggctggaggtcgccacgagtggtgcgctcctgctgccagcgcgcgaagtcaccgtactgaagggtgggttcgggaagcggagagggctcgcccgtgctgaacgcgcggtagagcgccgccagttcgcggatgaggacgcccagggaccaaccgtcgcaagcgacgtggtggagcgtgagcagcagcacgtgctcgcgtgggtccaatcgcagcagggacagccgcaggggcaggtctcgtgacaggtcgaagggccggctggcctcctccgtcgcccgccgccggacctcggcctgacgcgcgtcggcggggaggtgctggaggtccacctcgggcatcgtcacggacgcaggcggcaagacgcgctggaagggcttgccctgatgctgcccatagctcgtgcgcagcacctcgtgacggcggacgatttcgtccaggctccgctgaagcgcggcgatgtccagggcgccttcgagccgcagcgccgcgggcatgttgtacgcgccgctgggcccctggaactgctccaggaaccacatgcgctgctggccggacgacagcggcagcgctccatcgcgagggccggcggggatgaggtccgcggcgccctggagtgactggcccacctgctggaggaaggagaccagctcctccttgcgggacttcatctctccgagcaggtcgggcgtcatcacgcccggaggggcgttgaagcgcaggcgctcgccttccatccacagccgtacgtcgtgctggcgcaaccgggtcaacagtccgtcgatcgtgttcacagctccccctcttcacggctcgcgccgctgacgctggtgtcctcggccgcacgcgccgcccacaggacggtgtccacgtgctccgcgagcccggcgatggtcgtctgcttgaagagccgctccaggggcagctccaccttgagcgcgtcccgcagtcgcgaggccacctgcgtggccagcagcgagtcaccgcccagttcgaagaagtcgtcgtggatgcccacgcgaggcagacgcagggccttcatccacacctccgccagcgtctgctcggtgggcgtgcgcggtgcgacgaaggggcgcgtgggcgcgctggcctccgggtcgggcgcgggcagcgccttgcggtccagcttcccactggccgtcagaggcatggcctccatgaggacgaagaaggcggggaccatgtagtccggcagcttctccagcaggaactggcggagcgcggcgggtgtcacgctgccctgcgcggagggcaccacgtaggccaccagtcgcttgtcatgtccggccagtgcgcccggctcctctcggaccatgacgaccacttcctggacgtgctcgtgcgcgctcagcgcggactcgatttctcccagctcgattcggaagccgcgcaccttcacctggtggtcactgcgtcccaggaactcgagcgtgccgtcaggccggtagcggaccaggtctccggttcggtagaggcgcgccgccgggtcgtcgctgaacgggtccgggacgaagcgctgcgcggtgagctccgggcggttgaggtaacccgccgctaccagcgggccgccgatgtgcagctcgcccgccacaccgatgggcacgggcgcgccatgccggtccagcacgtagcaggggcggttcgacagcggccggccgatggggacgcgcgttgcgctccagcccttggggatggcgaacgtggtcgcggtgatgagcgtctcagtggggccgtaggcattgagcgtgcgcacgttgcccagcgggccgtgctgccacagctccagcaccttgggcagcacggtgtcgccgccgatgatgaccagccgcaagtcatgggcaccgatggttggcggcgattcggcccagctctgcgtgagctgctgccagtacgccgtggggaagttcatcaccgacagccgctgttcaacgacgcggcgggccagctcctcgggcgtccagacctggttgccgcgcaggaccagcgtggcgcccgtcatgaacgtcgggagaatctgctccagggacgcgtcgaagttgaacgaggcgaactgcaacacgcggtcgcgctcggtcagctcgaagtggagctgcatgtcctggaagtgcaccgccatctggccgtggctgatgacgacgcccttgggctcacccgtggagccggacgtgtagatgacgtaggcgggcgacgtggccgtcgcggtgttgggcgggttctccgtggggcgagacgccagcgtgacggcgtcggtgtccaggtggacgaccttcgcggtgtgcgcgggcagccgctccgcgagggactgcttcgtcaccagcacggccgcgcgcgcgtcgtccagcaggaagcgcagccgctccacggggtgcgcggggtccagcggcacgtaggcgccaccggccttgaggatggccagcaacgtcaccagcatctccggcgagcggtcgatgaaggcgcccaccagcacgcccggtccgacccccaggccgcgcaggtggtgcgcgagctggttcgcgcgccggttgaagtcggcgtaggtgatgcactggccgtccagctccaccgcgtgcacgccgggcctcgcggcggcctgctgttcgatgagttggtgagtgaggaggtcctcccggtagcccaactggttctggttccacgccaccaggaccttgcggcgctcggccggggtgagcatcggcaggtcggcgacgcgagcttccggctgcgcgagcgttcctgacagcagcgtgcggaagccctgtgcccagcgggccagcgtcgccgcttcgaacaggtcggtattgtagtcgaagtcgaggacgagtccgtcctcggcgtcgatgacgttcaggctcaggtcgaaggcggcgtagcgcacgggctgcgggacgaagtgggtgcgaaggccgtccatctggaggttccccagggggcgctccaggttgaacgtgacgctgacgagcggggtgtggctcgtgctgcgcggcagtcccaggcgcttgatgagcagggcgaagggatagtcctggtgctcatacgcctcccagagcacttgtttgagaccctggacgtattcggagaacgtctgctcgccctgaacgtggctggcgatgggcagcaggtgcgagcagtagcccaccagcccctcgctgccctccattccccggcccgcggtggggatgcccaccaggacgtcatcctggcccgtaaggcggtggaggaacgtggtgtagacggagagcagcagcatgaagagcgtggactgctgctgcgccgccgcctcccgcagggactgggtggtggcgcggtccagtcgcagcgtctcccgggcaccccgatagctgcggtgcgcggggcggccatggtcgatgggcagctccagcgcgggcagcgtctccacgcgccggctcagccagaagcgctcgtgggccgtctgctccttggttccggcctgctgctggagccactgcacgtactcgccccactgcatcgcgggtggaggcggggtgctcttgcctgctcggagctcggtgtatcgcgcggcaatctcgcggacgatgacacccagcgaccagccgtccaccgcgacgtggtgcgcggtgaggacgaagacatttggggnnctttnccccttggttgggnccanccccagctttcnagcaggttgggccgcggaagggcgcaccgcggtgcaggtcgaacggcgtgttgttctcctgctcgtaccaggcggagaggcgctcggcctgctccggcgcgggcaggggggagaggtcgtgcagcgccagggaaagcgccagcgaagcggccgcggtctgctgctcgccggactcgtggatgtggatgcgcagggcttcatgccggtcgacgacgtgctggatggcacgttggagcacctcgggctggagcacgccttcgagccgcaggctcatcgacaggttgtaggagatggagccgccggcgttcatctgggcgagcacccacagttgccgctgcgcctccgtcatcggcagcgtgcgcgcttccacacgggtgggatcgggcggtgtggtgcgtggccagaatccgcccgcgcgcatgtccgccaccgtctcggtgatggcgcggacgatggtgtcgaggtcctcgtccgagtgcgcggtggagagcatgcacgtgcgcccctcccagatgtagatgccgcgctggatgaggtggcagaagaacaggtccatctccagcgactggtacaggtagctggtgttgcccgcggcggagaagcgcagcacggagccgccgtggaccgcctcgatgggcgcctgctcgcgctggaagatgtcgttgagccgagcgaccagccctgcggcgcggcggctcagattctcctggagcgcgggcccctgggccttgaggtggctcagcgtggccaccgtggtcgccatggtcagcgggtgcttgcagaacgttcccgcggagaaggtcgtctcgacagcggggtacgacgcgtcaccgtagttccagtcgcctccgtcgatgcggtccacgaatccgccgcggtccgcgacggcgccaatggccatgccgccaccgagcaccttgccgtaggtgaccaggtccgcctcgatgccgtaccacgcctgagcgccacccggatggagccggaagccagtgatgacctcgtcgaagatgaggggcactcctgcttcacgcgtcatcgtccgcaacgcctggaggaaggcccgtggctggagattgggacggcggctctgcacgggttcgacgaggacgcccgccagttcgtgaaggtgctcgcggatgagctccagcgtgcggtcctcaccgtagggcaacacgaggacgtcctcgacgaccttgggagacacgcccgccgccatgggcagcgactggggctcaccgttgaccatgcgtcccaccaccagcgtgccgtcggagtggccgtggtaggagccggtgaacatcacgattttcgtgcggcccgtcgcggcgcgcgccagccggagcgccgtcatcaccgcctccgtgccggagttgcagaaggtgacgcgcttcatcccggtcagctcgcagagcagttccgcggcttgcccgcccaggtccgattgggggcccaactccatgccctccgccagacgttgttgcagcgcctccatgatgaagggcgggttgtgaccgaacaggtgcaccccgaagcccatggagaagtcgatgtactcgttgccgtccgcgtcccagacccgcgagcccttcgaacgcacgctgacgatggggtagcagacctccttcagctcggcgcggaagttcatcagccaccgcacgtcgctccacttcgaccggtagcggacggctgcttccttcgagcgcttcgtgcgcgtggtgtacttcgcgatgagcgcgtccaggtgacgctgctgtaccgcggggagttctcgctcgggcgtgccggacttgggtcccgcgccaaagggtgacgcgcctcctgccttcgcggtgttcgtgggaactgccttggggacgggagcttcctgcgccgcgacgggaagctgcagcggcgcagagggacgtccgcccaggagcgcgagctgctgcgccatgagctgcaactgctgctggatgagctgctcgacggcgcttcccggcggcgcggagagcgcgttcgcggcggcgggaggcgtgctcatggggagcggcgcgggaacgctcgtcgcggctggcgcggaactcagcgcgaagctcgcgggcagtgtctggtcgaggtggctcgccagtgcgtccagcgtcgtcagttcctcgaagagctgacggatggccagcttcacgccgaagcgcttctccacattgcggatggcgtccagcaacacgagggagtcggcgcccatctccaggaaggacatgcgcgggtcgagcttctcgggaggggcctggagcagcaaggcgacgaccgcgcggagctcggtgaggatgcgctccttgcgtgacacgacgggcgctgcggcagaggtctgggtcatcatcgtcggcctatgggcaggggaggggagcgcggagtccagcaagtacctctggcgctcgaagggataggtgggcagcgggacacgccgtcgcggacggtccgcgtccactgcgcgccaggggacggtgacgccgcgcgtgtgcagtgcaccgaggctgtcgagcagcgtctcccaggcatcctgctgacgccgcaggctggggagccacaggctcgcgccctcgggaacgcagcgcttcgccatgccgagcagcgtgtcgtgcgggcccagctcgatgaacagcgcggggccggcctgtgtcagcgtctggaggctcttgaagaactggacaggagcgcgcgcgtgccgtcgccagtaggcggcgtcgggggcctgggacatgcgctcgcccgtgaggttcgagatgagcgggaggcgcggcgcgtgggcgggcaggacgcgggctacctgctcgaagccatcgagcatcggctccagcagcggcgagtggaacgcgtgggagacggtgagcggtcgcgactcgacaccttgcgcctgtagcgccgcggtgatgcgctggaccgcttcacgctcaccagagatgacgacgtgccttggcccgttgatggcggcgacgtccaccaggggctcgtcctccagtgccatgcgcaccgtggcttcatccgtcaggacagccgccatggcgccgttctggggcagtgcctggatgagccggctgcgcgtggccagcagggccaacgcctcctccagcccgagcgcgcccgccgcgtgcgcggccgtgaattcgcccacgctgtggcccatgacggcgtcgggcaccacgccccacgaacgccacagctccgtcagggcatggcccagcgcgaacagtgccggctgggtgtagcgcgtctggtggatgagctgcgcggtggcgtccgtcgtcggaaacagcaccgacagcagcgggacatccaggtgtggacggagaatcgcgtcgtagcgctccagggcttcacggaagacgggggtgctgtcgaacagttgtcggcccatgccggggtactgggtgccctggccgggatacaggaagacgattcgcggcgcggcgccacgctgcacctcgccctgatgcagcctgggaacggcgtgcccttgggcgaaggactcgagccgcgacgccatctccgcatgggagttcgcggtgagcgcgagccgatgcggccacgcattgcggccggtgttcgcggtaaagcagacatccgccagcgcgggggcgttcggccgtaggaggtgctcctggtactgccgggccatgttccgcagggccgcatcgctccgggccgacagcgtcaggacgtggctgtcgcgctcggggacgcgaggtgcatccgcggggcgcggcggaggctcgctcaggatgacgtgggcgttggttccaccgaagccgaaggcgctgactcccgcgatgcgcgcgccgggcgcttggggccacggctcggggcgcgtgggaatcggaaatcgggtcgcatccaaggcgatgtgcgggttgagtacgcgcaggtggacctgcggcggaatctcgccgtgccccagggccagcaccgacttcatcagccccgcgatgccagccgccgcttccaggtggccgatgttgctcttcgctgagccgatgaagcagcgctgctccgccgacctccccggagacagcacggcgcgcagtgccgctagttcaatcgggtcgcccagcggcgtccccgtgccgtgggcttcgatgtagccaatctgttctggcgacaggcgggcctgacggagggcttgctggatgacgtcctgctgcgcggcgccgctgggcgcggtgagcccgttgctgagcccgtcatgattcacggccgagccgcggatgacggccaggatgggcgcgcccgaggccagcgcgtccgacaggcgctgaaggacgacgatgccgcagccctccgagcgcacgtaaccatcggccgacgcgtcgaacgtcttgcagcgtccatccgccgccatcatccccgcctgcgagaaggcgatggtgagctcgggcgacaggatgaggttgacgccgcccgccatcgccaggtcgcactcgcggccgcggaggctctgacaggccaggtgcaccgcgacgagcgacgatgagcacgcggtgtccacggccatgctcggaccgcgcaagcccaacacgtacgacagccggttggccgcgatgctgtgcgcgttgccagtgcccgcgtacgcatccaacaaggagcggtcgccgaactgtcgctgcgcgtagtcgctggtgctgatgccgacgaagacgcccgtgcgactgccctggagtccctgcggtgcctgtcccgcgcgctccagcgcctcccacgcgacttccaggagcaggcgttgctgtggatccatccgcacggcttcgcgaggcgagatgccgaagaagagcgggtcgaacgcgccgacgtcttcgaggaagccaccccatcgcgtgttcatcgtcgcgggcgtggacgggtccggcgcgtagaggctcgccgcatcccaacggtccgcggggacttcggtgatggcatccccgccgcgctggagcagcgcccagaatgcctctggcgtcggggctcccgggaagcggcaccccagcgagaccaccgcgatggcttcgtcctgcgcggcctcggtgacgggcgtcgcgggcgcatgcgtcacgggctcggtgccacggccgagcgcctggctgagcgcgtcgatggtggcgtgctcccagaggatggtgggcgacacgtcgcggcccagccagtccgccaactcacccgacaagaacaccgcgtccttcgacgtcagcccgtagcgaacgaagggttcctgggggtcgacctcttcgggcgtgagttcggcggactcggcgacgtaggcccgaagccacgccgcgatttcatcgcgcgtgcggtctccagacacaccggagaccagaggggaatccacaggggcctgtgagacaccgaaggatgacttcatggaaaatcacggacctaaagtgtaatcctgcagatctggattattatgaaatcgttttgaatccgactagtcttgacggggttctgaggtaaatttctggtgccagcgctccggcaggggttggcgctttccaggtggggtctcggcgccaggagtccgggctgactcactgctgtgacgacaggtgcttgcagatggcgttcagcgagttcgagtgctggtccgaatcaggccagttggagtgcgtggcggtgttccggcccgcggcgctggacgtcaccagtgcggaggaggcggcggcggttggcttcatgcggcctgtcactcgcagtgaggcggaggacgcctttggccggctgcgggacacgctgacgcgcctcggttgccagacgattgacctgtgggagttgctaccggagcgcgagcgcgcggtgagcgacaccacggtgaaccgggtgtttgtccgcgacaccgcggcggtgctcgggcgtcagctcgtgacgggcacggcggccttccccgtgcggctggcggagttcgacgtggcgcaccgcgcgctgtcgcagctccagccggagctgtcgagcgacgaagtcccgacgtccgcgcgcatcgagttcggggacgtcttcgtgctcgacgcggagcggttgctggtcaacgtggggctgcgcagcgacgcgcgggcgcttcaacccttcctggagctggcgtggcgttcgggcttccgcgaggccgccgtcgtccgcatcccggagagcctgggcatcatccacctggatctggccttcaacgtgcttgggccgcgggccgtggtggcgcgggcctttcttcgccacacgcccatccaggtgttcgcacagggcgtggcgccgcactgggagccctttgacggctacttcgcccagcggggctgccgcgtcatccccttcgagccgaaaggggagagcggcttcatgtcgaacttcatctacgtggggcccaacctagttctttagagaacggg

SEQ ID NO: 1185 - DNA, 17247 bp, Myxococcus xanthus
  unsure (1)..(17247): unsure at all n locations
gctgcgcccgcgccctccaaccccaggagcacctccagcgacggcgcctcctcgcatttcggcagcaacgcccggaggtcccgcaccgccgaggccagcacctgacgcgactccgaatcaccgcgcgaggcgcgaagcaggaagcggagctgcccctccagcttcgccgccaccaagcggcgagcgagccccagacacacggacgcctgccgtagcgcctcgaactgccgcaaccgccggtggacgttgcccgccccaccacccaatccccccaagtagcgccccccggacgtgaaccagtgcacgccgatgtcgttctccacgcagtaagccaacgcctgcgcgctcacctgcaccgctccatgcgcgatgagcgccgacaccatgcgcccgggctgcctcgacggcgcgccctccccttcgggtggcgtcaccaccagctcctccgccgcgcgccccacccgcgtcccaggcgtcgcgacgtgcagcacctgccgcacatcatcctccggaaagagccggggccgctcctcccccaccacctgccgctcctcctccggcaggcacacgggcgccagcgagcacttcgcacacttgcgctcctcctgtgtcacgggcggcctctcccgcgacgcacgcagcagccgggcacgcgccacggccgccaccacggcgccccgcagcgccgcgtccaacgggaagcgcaccgtcgtgtccgtctggtggtagcggacccggcactccacgggcgcccccgggaagcgctcctccaccaggagcgcgtaggcccccgcctggagccgatcgctcggccacgcctctggcgcatcccctccaggcgcatggcgtccgcgcttgtgctcgtagacgaccagcgtcccctcccgcgtcttcaccgcgtccacccttccgtgcaggcccaatgcctcactcgccagttccagctcgacgtgctcgccttcctcctggagttggacgtgcagccgccgtcccgcgaacacggcggcgtccgccacgcgcaactcctccacttcctccaggtagaagagccgctcgcagtacgccagcgcatgcagcgcgtgcgtgcggatggacggctcgccgacgacaggcttcggactcgtggatgatgcgttcatgtattggggccccccgccccggtaccgcgtgacaacgacagacacctatccagcgccctccgcgagcgggatgcgcggaagccgttggacctcgggagcagccaagacctcttcgagccgccccacctcgtaacgagtgccacgagtgcccacgtggtccacccagaccggcagggtgagagcgccggtggacgcggtcaggaaggcccgacagcccgctggcggccgcccctccgggagcagacgcgcgtcattgatgaggtgcgtggactccccgagcgaccaccccccggcccgcgtcacggagccaggctcacgcatcgcccggacgacacggtcctccagcgattcacccgagtccggctcctcccggctgtcgcaccagaccaccaggcgcgcgtcgatgacgagctgttgctggtccggcgcggcgttctcgtcattccccttcgcgaccttcaggttcttcgaccgccagaaggtgcgaagcaccgtgctgatgacaggcgcgttcaacacacccgccgtcacgcggcagccccggtgccgctcccggtcctgctcacccacgagcgagagcaacgcgccgtagcacgtcgcgggcggcggcaggacctcggtctccaccagctcgcgcgcccggcccttgcgccagcacgccacgggcacggacagttcgagcgcgatcacttcttcctcacctccagccgcttgcacgccgcgcggcaggcggcgaccacgcccgtgtggagctccgcgcccgaaagcacctcgcgctcctcggcgcccagcccctccaccacctgcccgcccaacaccaactccttcgcggggacgtcgccgctcttcaccttgcgcagcagcgcagcgagctccacgccccccgcgcgggaggacggctcgaaggcatacaggatgcgcggcgcggcctcctgggtgagccggaagacgaccgacctcgagggaaggctcatgaatggactccgggaaagtgtgtggagctgctcaagactgctcggacgcgccagcggcctcgtccgcgtcctcaagttccgcggcctcgccccccttgccctggtagctcgccagcgccaccagcgcgaggtcgcgggccgcgcgccaccgctcgggccccagcagttggaggatgtcccgccaatgctcctggagctcacggttggtgcccgcgcggctccacaggtccgcgagcgccgcgcgcacctgctccggcgtcttggcccccgcgaagctcagccgcaatcgctcacgctcacccttgagccggttggagcgtgtggccggggcgctctccttcgtgtccgcataaatgctcttgaaccggctccggagcgcgaggtgaacgctctggacgagccactgctcggcctctcccaggtacggatgcatggcgatgagtcccttcctttcgtgccacagcagcgcgcccaggttgtcccggtcgcggtagtcgtgaatgaagcggccctccgccgtcgtcgcggtggcgaagtccgcgtaccaggggcgtgaagccgcgaggttctccgtgatgaaggcgcgcagcgcactgatcgcgatgaagtagctcgcctcgcccgtcgccttgccctcgggcttgcggactcgcagcgtgtgcggcagcgcggcggcggcggcctcgtagcggtccaggacctcctcgagcacggcgtcctgccgcaccaccgcgccgcgaatcttctgctgcgcgttccatggcatctgccgcagcgccacggcctcggtggtccccagcacggcccccagccgcttcttccccgcctcctgcgccatcaccaactgagccgcgagcaccgcgtccgacgcccccgccaccgccacgtcacggagccgcttgggcgtcagcccagggcgcagctccgcgaagcggaccaggttcgtcggcgccagcgccacgaaggccccgccccggagctgcggcagcttgtaggaaacacaccccaccagcgcgaagcacgcgcagagcgcctccgccgccgtgtattccaccttggtgacgcgcacaccgatgtgccgctcggccgcgcccggataggcccagctcgccaacgacgtcgagcccacctccagcgcctcgagcacgctctgccaggccgtctggtggacgaaggagtcgtagccctgggactcgacgatgacgggccgcgcgtccacctcgaaagtgacgcgccttcgcgcgcctccctgcgtcgacttgccatgctggaggaacgtcaccttgagcgcgtcgtggagcgcggcggccaactcgggcggtggctccggcgctccgggtggacgcgtgcccggcaggtcgatgaagccctgcttcacccggaatgacgcgccgaacagcgcccggagcgtggcctccggtgccttgccgccccagtccaggtggatggcctcctgctccaccgtcgccgtcccgggccccagccgcaccggagagggccacggcgcggcgggtgaagcgctcccgaggatggcgcggagcgatgccgccaacccgcccgcgcccgcgcgcagcagcggcgtcatccctggtgcgtacaaccggatggagagcggagcgggcaaggccttcttccgtgggttcacggctttcgccatcgcgcacctcgcaggccgtcgtagtccagcgcgttcgctggagggatggggtatggcagccggcccgcgcggggccatgcacgccacttgaaggactcgggtggcaggttcatgggcagggtgacccggtgagcgctcaccgctccgtccaggacagcacgggcgtcctcttccaagaggaccgtgaggctggggcttccgtctcggcacggagcgggccaggtgtcgaagcgtccatccagccaggtgctggactgccgccgcggcgcatccatcatcccgggcggcccccatgcgtccaccaggtcccgctggctcagcggccccgttcccagccgctccatccatgcacgcgcgtcgcgcaggtccggcgcggcgtagggcggcccatcgaaggggagcaccacgaaaggccgcactggcgcgggccgctccagagtgctgcggcggttgaggcgccccaagcgctggatgagcgccgggatgggcgccaaatccgtgacgagcaggtccgcagacaggtccaggctcatctccgcgacctgcgtcgtcgaagcaaacgccgcgcggccctcagtggcgaaggcctcgatgacgtcaccatgacgacggacgcggtcctcgtaacgaaagcggctgtggtacaacagcgcacgcgcaccgtgcgacgtgccggcctcggcggtccgcatgcagcgatccaccgtgttgctgacccacaacaccttgccgtggtcccgcaggcactccgccacgagggcccacggctccgcgacgtccagccgctgatagcgcggcagtgtctccaaatcctccggcccttcgacctccgcgaggctccggccatgaacgcgctcgcacatgccgcgcagcacgtcgagccgcgtggcgggcaggctggcggtcatcagcaacgcggggattcccggcagggcttccaggaagcgcagcaggcagccgaagagccggtcgtcataggcgtgaacttcgtcgaagacgacgcaggccgcacagagcccgggccaggcatagagcccctgccgctggctctggacaagcccgagcaccgtgtcggccgtgcagctcatcgcatcggcgccccaggagcggagcgcgtcgagccggtcctggtcgcgggagctcgtcccaggcgccgcgccgtcgcggagtccgaagatgtcgaagtccacctccgcgcgtgagtgctgcaatcgggcctccacgtccgcgccgtggaggtagtcccggaagccctccgtcgccgtgcccatcgtggggtatgtgagccacagcggacggcctgggtgctgtcttgcggcccagaggtacgcagcggccgtctttccactgccacagcccgcgcggaccagggtcagcggcgcggcgctgcgagccacctcctcctggaacggtcgcggtgtgtgtcccgcgaggcggcgctcgaccacggcgcgcagggcctctgcgggatggggcgccgtgagctgacgatccacccagtcctgcttctctccgctccggggaagcgccgagcccgcgacgtccgccgcgagcaccaacgccttgcacacggccaggagccgcgcgtccacggagccggcgggcaccgtccgctcgaagtcgtcctgccacgactggagttggtcgcgcgggtgctccttccgcgtggctcgaagcacgatgggcgccgtgaacagtggcggagcggacagcgccaactcctcggcgatgcgccccagcgtccgggcgaagtcttcatgctggacccgcaactccagcgacagccccgctccggtgccgtcgggcgcgaaggcctctgtctggaacttgcggtggtgtgcggccacgcagaccagcgccaggcacaggtccagctcgctcacgtcccgctggagccatgcggagagcggctgccctggccagcagagccacagcgagagcgcttcgtgacggacaagctgcggcgcttcgcgctggcggcgcagcatggattggaagtgctcgctgcacttgcccaggtcatggagcgcggcggccagcaggacgatgcgccgcagccggggctccaacgccgggtccaggcccgcggccagcagcgacgcgcgcccacggtgctccaggagccggcgcgcggcggacaggactagggcggtgtgtcccagcagcgtggcctcgccctcgggtctgtcgggcgtggccgtgcttttggccagcagccgcttcacgcggccttcccatgggactggacacgcgccgcccggccgggcgggaggaagaggccacatcccatgtgacggcggcctcccattccctgctcctgcacgcgcagcgagtgctcggccgacaagccatggagttcgagcgcgaagcccacgaccttctttccagttatgcgcacgatgcgccggcgccccaccttcagcgtcgcctggacgccaagcgcctccagcgcgcgggaggccgccgcgacgaatgcggcctcgtccatcgcgtgcttgaaggtgaccagccgcgcgaacaatgagggcacgggctccagcgcatggagcgagggcgcgcccagggacaggcgtctcccagcaatctccagcggcgcgctcaccagcggcagcaacgtggccacggcctcaatggggcatcgcaggcgcatcgtgcctcgccccaggtaaagcaactcccgcgtgttgctcacacctcgaagcgagaacacgcccatatccgagcgctcatgcagcgcgggaaggtgacgggagagcgcggagaacagcagataggcatggtcgagcggcaccgggccgccctgcacggggaacagcaggtcaacaaacaccattagatttccccaccagttcaaaatcacacatccagaaacagtaatcagcgcggagcgccgccaaccgacgctccgcgccaacgcctcgcagcatcacagcaacaaggacttccaagccgaacctgagcagacaccaattgctcaacaccgacgtatgcgacgtcgatcgtcactgcgaaaacccacgcaccagctaccgtttcagatcagtgtcgtgtccaccaactcaaccaacgtcttcgcaacaaccagagcgagcgaaacgattcgaagaccaacctccagtcgttccagcacctcgtacttcgacttccgaagagacacctgtaacgctcctgacctgagctgataccaacatgcgcaggtcgcctatcgatatgcaggcgaggaccagcgctcgtcaacgttcgctgatgcatgcaatcgtctcactttgaaccctgtattgccccaaaggctcaccccgtctgcaacgtgagcgcgggcgcgtacccacctgagccggtgcgctcgtaggccacgaccgggcccacggcgttgagccgctggcccaggaacaggcagcacgcagcgggggcatagaggatgagatgtgtgaccgccgtgcgcagctcgttgcgcgcgcgccggagttgctcacgcgcctggacggcgaacgcctccgcgtccgcatccgagccaacggcgccgtcgtggggcccgtcctccggctccaggtagagcacggcgcggaagtgccctggccgctcggccaggaagcgctctacgtccgcgcgagcatccccggtcatctggaacaccaccagcagccccgcagcgtccgagtcaccctcgtgccccgtgacacgcagtcggcgcggagacggcttcgcgtccgagcgccacaagaaggtctctccttgcgtgggctgctcgacgcggaagcggtagccgcccacctccgggaagtgaaagcccaccgccagcaccgtgctcagcggcagcttgccccgcaggtcaatcaacgcgccgtcaggccgcctcgatagccgctgtcgcacagccagcagcgaaggcagcaacacgtcccgccacaccgactccgacggcaccttccgcgtgtcgcggtcgaagtgaggcgtccagtccagctcctcggtgggaggctgctcccactcacgtcgcgcccacccatgaatccagaggctcacggcgggcgcgtcctcccgtgaggccagcagtccccacgcgcgaatggccccccgcagcgactccggggtgacgtgcttcctgccgccgccgacctcaatccactcccgaagcccgtccaccgcgatggcgcgcggctgccgtcccatgcgcaggccaagccgccccatccggtcatccacctgctcttccaagtcggcgatgccgcccacgccgagccgcaagcgcaagtccttgcagaacgcccgcagcatctcagccgatacaccgagccgttgttcccactccgcccagtgtttcttcagggcgcctcgtggcggctgctcgaagaacgcctcggtgaagcagtggtcccggccatgtagatagcggcccaggtccgccgccgacgcccagttgctcaacagccagatttcgacgggccccaggggccgcagcaccaaccagctctccagcagcttccgcagcagcgagcggcccacccgaggcggcgtcaccagccccgccagggagtagctatcccggtggtcgacgtgccacttcacctgcatgtatcgactggccacacccgcgccgggccgggcgtgcagcgtcacgtcatccgccgagcccgccgccgggtgctcgacgtagccgtaagagaagggactgcccgcgtcgagcagccggagcagctcgtaccagctcagcaagtgctgatagcgatcgccctccaggcgagacgcgctctgctctcccatgacgctccctcatagcgacgccagggacggcggtggatacctccccaggggtatggaaggcggcgctcgaaaaggaagacgccaaagcgcggggcaacccatcgcgggcccggtgatttttcttccggcgcgtggcgggagtgctcccgacgaccgctgaacgtcctgcgcgaatctgactacctttcaggtagacatcgcccattccgaggtgccagacggaggcgcgttcttcctcgaagaaggcgggacattcgcgctcgtccaagcgtcccgccgtgtcatccccatcgagtaggttagaaccctggaggttgcccctgcgtgttcccccctggctcgttggcaatgacggcggtggtgctcctgctgggcacggcggcgctggcccagacgccggacacgaagcgttggaggcgtatcgagcgggccatggtcctgagcgcgagcgcgggtgagcccgtccagcgactcaggctggcgcccggcgtggtgacgacggtgctgctcgactcggacgccgtgctggaaggtgagctgcccgaggccctgcacgggctgttcacccggctggacgtcacggagacgcatctgctgctccagcccgccgtcgcgatgcccgcacggggcgttccgccgctggttctgcgcttcacggacgcagccgcgccacaacggctcgtcctggagctgaccaccgaggccaacgtggtggactcggtcatcgatgtcaggcgccaccccgccaccgtgacgcaactggaggctgaactggtggccctgcgtgagcgcaacgcactgctggaggcccggctggccactgcgcgtcggcaggtgccacacccgggcctcgcgggcgccattctctctggcgccatcggcatcacgggtgttctcggcacgtggatggataccccagccagcgaggcggagctcaaggtccgccagcttgatagctatcgctccggctcgtgggtagcgctcgcggtgaatctggagaacccgccgggcgaggcgccctggcaaccgggcattgcgcggctgacctcgctggactcgaacgggcggccaacaggcgagccgatggagctgcccctgttgctgcaggagccgcgtctgttgcctggtcagagcgcggtcgccgtcgtgcagtggcccgcccccacgcgccctccccccgcctacgcgctggagctttgggacacgggccggcgccgcggcgtgcgatgggcgcgactgaaaccgtagacgtgcgacagccccgaaggaatccgtcatgcgactggagccgagcgcatcttccccaggtcccctcgtaatgtctccacaggctctgcctgccggcacgcgcgtggaacgctggcgcgtggagcgccgcatcggaggcggcggcaacggcacggtgtacgaagtgcgctcacgctccgaaggccacagctacgcgctcaaactggcccactcccccggcgatccgcgattccagcgcgaggcgcgaacgcttcacctgcttcgccaccctggagttgtgcggctgcaagcaacgggaacctggcgcgcagggaccgccgcctacccatacctcgtgctggagtacgtgcgaggcagcacgctgtatgactggtctcgggcgcgcaacccaacggcgcggcacgtcgccggcctgttggcgcaggccgcgtgggccttggacgccgcgcatcgcaggcaggtgcttcaccgcgacttcaagggagagaaccttcgcgtcgaggaacacggaagactggtggtgctggactggggcgcatgctggcatccccgtgccgcgcccatcacctccgccgcacggctgccgcccgggaccgggccctatcgcagcccccaggccatcctctggagcatgcaggctccacggcagaccgcccgctccgagaactacccctacacggtggcggacgagctgtacgcggtgggcgtcacctttcaccggctgctggtggagcagtatccgccgctcgtcctggacaaggcgaactccccacggacctctgccaccttgagagccctcaacccgcgagtgcccgagccgctcgcacgctggattgagggactgctcgcgttcgcccccgaggcccggccgcgcagcgcgggggacctcgcccgggatgtccaacatgcccaggcgcacgcggggccggactgggatgtcccgctgttcggctggtacgaggggcccgccacggcgacccgcacgacactcgaagaagaggccacctgggggcccgtggcaccgggagaagaagcggcccttctccacgcgagagccctgcgcgcggcccgggttcagcaccatcgcatggaccgctggctgcggcgccgggtgttctcggaggtccagacacaacccctcacggagccagcgagccagccagagccgcgacacgcgggccggtggatgcgcatcgccggaggcctgatgttggttgcgtgcatggcctggggactggtgctcgcaggcccgccacatggcccccccatgccgtcccatcccgttcagcaactggcgcggaccgacgggccagccgacactggctcgcccgccacggcccttccgttttccaccgccgagcagccatggccgggagatgccatgtccacgaccaagccacacgcgcgctgtgtcccccgactccaccgctacctgatggctgcattcacagcggccagtctcaatgcctgctcaggcactcaggtccggcccgagcccgcgcgctgcccttccgaagccctggagtccatgcgtcaactcgggctcgacctgaggtcccgcgggcacatccagctcgacatccagcagccggacgactcgaaccagacgaactacagcatcgtcgtcagtgacggccccatcaccagccggctcgatgggcccatcgaccgcctcccggccaacacgctcttgtacgggcgcatctggaccggcggcgagaaaatccagggccgctatacgcgagtgaggacgccggacggcagcgagtacccggtgtgcttcatcctgggcaacgagacgggcatgtccaagtaccggggctcacggcccggccacacccgcgcgcatccctggtccaacgcccaggtggtggaccacttcccctgatgcagcgccggctcacggcggtgaactcgccgtaggcttctccaggacgcgcgcctcgtcgcgcaggcgcagctcgttgcccgcggcggagaggaccgcggcgacgggcacggagaggaaggccccggccacgccgaagagcacgcccccggcggtgatggacagcaggatgaccaccgggtgcagcggcaccgcgcgccccatcaccacgggctccaggacgttgctctccagttgctgcacgcccagcaccacggccaataccaggagcgcatcgagcggcccgttggtgatgagcgccaccagcaccgcgaccacgcccgccagggtggcgccaatgacgggaaagaacccgcccacgaaggtgagcgccgccagcggaagcacgagcggcacgccgatgatggccaggcccgcgccaatgcccaccgcgtccaccagcgcgacgatgacgacgccacgcaggtagccgctgagcgttccccaggcgcgcaggcccacggcgcgcaccgtgtcacgccgcgacggagacacccgggccagcacccagcctccgagccgctcggtgtccttcacgaagaagaacagcagcgtcactgtcagcagcccgcccgccacggcctgcgcggcgaagttggcgcccgcgaggacgccggtggtgatgcgccccaggttcgacttcaagaagtcgagccccttctcgaacaggccgtcgatctgctcccgggacacggggagttcctgcgtcatccacccgacgaggccctccattccctccttcacgttcgagcccgccgcgccgacctgctggacgatgcggggcacgagcaggaacaccccggccgcccccaccaggagcagcaccagcagcgccagcaccgtcgcgagcgctcggggcacccggtgggcggacagccaccggacgggcgggtacagcaacgtcgccagcagcagcgccgccactgtcggcaggacgatgaggtagagccgcgccagcagcagcacgagcgccaccactgcggccgcgaccacgagcagcttgccgctgaacagcgcgcagcgcgtgagccaggaggcagcgggagggtccagggtggccatacgtcgtgcgcaccctatgcacgaagcggcgcatggcaccgggaggccacctgtcggtgtggcctcatgaacggacgcggtggacgcgcggctggaatccaacggatggccagggcgccccgtccttcagcggcgcgcctcgcggaagctcaaggcacgtccaccgggatggtctgcatgaggggcacctggaggtccgtggggcgcatcagcgcggggcggccaccctcggcgccaccactcttgaaggtgttgagctgaccggcgatggtccactgccccggccggtttccggccccctgggagtagtggatgaagggcgtggcgcccgtcgggtcgttgtacttgccggtagggtgcgaatagtcgctgggcgtgaagctccccgccggcttgaggttcgggtgctgcgagaggaagccgtccagctccgccttgccgttcttcgagtagtccgcgtggtggagaaaggacaggctgttgttcttcgtgtcgtgcagggcatggatggcgcaaccgttgagcgcgcccgtcaccaccgtgtgcggctccccaggacgcggatgcagcggcaccccctggatgcccgcgaacttgccctcgcccgtggagaggtagtgcatgtagtgcgccgggatgccctggccaccggcgggcgagacggacaggttcgtgttgccctggtgctggtgggcattgagggtcaccaccgcgtcactggcgttgacgaagggcttctgggcggtggggagggccacgccctggagcgcgccgcttggggacatgttgtaggcgttcaggacgttctgccccgagtagcccagcgggttcgcaccgaacgacgaagtgacgtccttgcccggctgccgcgtgggctgggggttcaccgtgctcgtggagggcttgctgccctgcgcgtcgaacccgtccttgacggggctcggcttggacgcaggcttcgactccacgggcggaggggcgctcggcttgttcggcccgctgctcttggggatggaggggctcttgaagccgccgaacttgatgcctttcatgggagggactcctgtcgtcgatggggttgagagcgtatcgggggagactggctaaaccccacagcaactctcaggccatgcgaagagccaggcggccccaccagggatatcctgtcaaaaccagcgcttgcaggccgaggatggagacaacgccccgcccgagcccgcgcgcactggtgacgggagttcgtgccctggtgagtccagtcaccaccccaaggcctcaccgcgcccgggcgtcaactggacttacggatgcagatcttcttcagggtcgccgcgtaggtgtcctccaaggccttgtcgctcttcttgtcaccgaccaggacggtgtacttcagctcgtactcggcgttcatcatgttgaagcggacgctgcccgtgtacgtttttccccgtggatccgaggcggaatcgccagtggacatgcccacgctcctggcccaggtccacttgctcgcatcacagccaggatgccgggagaggctcttgttcgtttcgccgtagggcgtgtagtccacgtagcagcccccgttccgggggcggaagtggatccggcagtcgagcttgatgccgtggcccgttcccagggcgtcgttgtttcggatggcgacgcagtccgtggcggcgtgcgcgctctcggccttgatcttcatgtacttcttctcgaggctcacctgccccttggcgggcagcgcttcgcaatccgaggcgaaggccgggctgacggcgaggcacatgaccgcagtggccatccagacgtttctcatgatttcgcgttcccctcaggtcgattccccatgcgtttacggcgcccccacgggcgaccgtttcgacctggccccaccatcgcgtcgagatgttgagggagtgtggagaggctgctgagacggctgcgttgggggcccacgcttcgcgcgccgggccggctgcttcgcgcggctccggccacgcggcgccctgtctggcgcgctcgcctcccccggctcccgaagcgcgatgcgccgcgccacctccgccgccgcgcggaccggcggcgcgagcacgtcctccggcgaggccttcgcgccccatgacgccggcgcccccaactgccgcagcaccgcgccatgggtggcgggcgcgtcgaacgagaagctcagcgccggcagcggctcgcgagggacgtcgtagctgtcccgcgtcagcttgcccggcttcacgctcgggacctcgggcgcctccgccgtcgcgccccgcgccgcccgcttccgcttcgccgcgccgcgcggctcgagcgccgccccggctgagccagcctcacgcgcggcccgcagcgcgctcagcacctgctccttcgtccggccgcgcagctcgaacaggaggaacgggtcgcgatccaacgcctcgcccaggacgtagtgcgtggcggcgacgtgcttgcacgggtctccccagtccggacacgagcagtccgtcacgagttcctcgcggctccgcgggaagaggctgacacccgccgcgcggaagacctcgtcgatggcctggggcatcgtcccagcgagcaactccgccgtgtactgcgccctgccagccatctccgcgatggccttctcccagacggcctcgccgtgcggcctgagcgccagcgagacggcgtagggcgtcgggcgcgagcccgtcacccgcgcggtgaccttgccgcgccggatgaccaggtcatgcgtgcgccccgcccgcgcatacgtccggccccgggccagccgtcccgactctcccttcaggacgtgctcgagcgcctccagccaccgctgcccccaccaggtggcaccagccttcttcaccttgatgccatgctcgggcggcggccgcttcggcgcggacgtccagccccagaactcccggtagctcatcgcgacaccgccttcgcgctcgcacggccgcgccgtcgcggggcgcgcacccgcgcgtcgtcttccccttccgcgtcgccatcgtccgccacggcgccctcggacagcgagaacagctcgcgcagcgccgtcgtgtccagctcggtcacccagtgctcgcccgcgcccacgaccttctcggcgagctggcgcttctgttcgagcagccggtccaccttctcctcgacagtgcccgcacacaccagcttgtggacctgcaccgcgcgcgtctgcccgatgcggtacgcgcggtcggtggcctggtcctcgacggccgggttccaccagcggtcgtaatggaacacatggctcgccgccgtcaggttgagccccgtgcctcccgccttgacggacagcacgaacacacgcggaccgtggacgtcctcctggaagcgccgcaccatctcgtcgcgcgccttgcggggcgtgccgccgtggaggaagagcacctcgtggcccaggtactccgacaggtgcgccaccagcttgtcgcccatctcccggaactgcgtgaagacgagcgccttgtcgccagcggccagggactcctcgagcatctccaccacgcgcgccagcttccccgagcgccccggcaggggcccggactccccgaggtactgcgccgggtggttggcgatctgcttcgtgtacagcagcagcgcgagcacgcggccccggcgctccatgccgtcggcctcctcgatgcgccgcagctcctcgtccaccaccgccttgtagagcgaggcctgctcgcgcgtgagcgtgcagacgaccttcatctcattcttcgcgggcaggtccgtgatgatggtcgggtcgctcttgaggcggcgcaggacgaaggggctcacgagccggcgcagccgggccgaggcctcctgattgccatggcgttcaatgggcagcgccagctcccgccggaacgtctccagcggcccgagcaggcccgggttggcgaactcgaggatggaccacagctccgccaggcggttctccaccggcgtgcccgtgagcgcgaagcgctggctggcgcgcaacgcccgggccgcgcgggcggtagccgacgccgcgttcttgatgttctgcgcctcgtcgagcaccaccgcgccccagtccacgcgcgcgagcagcgcggcgtcccggcgcagcaagccgtaggtggtgagcacgacggcgccgggcgcgcgggggaagcggttcgccgcgcgggcgcgctcggcgccgtagtgccgcgtcaggcgcaaggtgggggcgaagcgggcgagctcacgctcccagttgcccaccacggaggtgggggccaccagcagcgtggggcgcgcctcgtcaggcgcctgctcgagccgccgcagcaggaaggccagcacctgcaccgtcttgcccaggcccatgtcgtccgcgaggcaggcgccgagccccaatgaggccagcgtgtccagccagtgcagaccgcgcgactggtagggccgcancgtggcgcgcagcgcgcggggggc

SEQ ID NO: 1186 - DNA, 20187 bp, Myxococcus xanthus
  unsure (1)..(20187): unsure at all n locations
tcctggcgcggctaagctcgacctgcacaccaccgctctcagagcgccaggggcggggcaggctacctcagcaaccggtgggggctaagcggacacggacgtgttcaccaccttcgagggcgacaacacggtgctgatgcagttggtcgccaagggcctgctcaccggctaccggcagcgcttcgaggacgaccgcgtcttcgccgtgctgaagctgctggcggaccgggccaccgccgtggtggaccgcaaccccttcgccgcgcggcgcaccgacagcgaccacctgcgcgacaacgactaccacctgcgcgcgctgcgcttccgcgaggaggagctgctggccaccgtgtccaagcgcatccgcaagcggctgagcgcgggcgtggaggccttcgaggcgttcaaccaggtccaggtccacctgctggagctggcgcacgcccacgtggagcggctggtgctggagcagttcctcaagggcgtggcggacgtgaaggaccccggattgaagacggtgctggggcgcctgtgcgacctctacggactgtcctgcctggagtccgccaacggctggttccaggagcacgggtggctggagggcaccaaggtgaaggccatccgcaaggaggtgacgcggctgtgcgccgagctccgcccggacgcggtggcgctggtgaacgcctttggagtaccggacacctgcctcgccgcgcccattggattgggccacctgtcgccatgaggtgaacgtttgaggccggcggcactgcccgcctgcccgccccatgcacagcatcgtggggccatgacacgacacacgacgattctgatgtgcgccctcgggtggctgtcgggctgcgccacgatgtctcccgtggagcgcgcggccgccctggaggcccagaacaaacagcgggtgcggcagctcaccgaggagctctacaacctgcgcatgctggaccgcatcccggagttcatcgccgaggacttcgtggaccgctcccaggacgcgcccctcaacgccgtggggcccgccttcatccgtcagcaggcggaggccagcttcaaaacgttccccgagctgaagttcgacatcctccacctggtggcggacggcgacctggtgctcgcgcactggaaggccaccgcaccggccccccagcccctcctgctgcaagggcactccctgtaccggctgcgcgacggcaaggtggtggagtcctgggacatctccgaccgcctgtcgccgctgcttcagcgcggctacaaggtggtgccgcccacgctgtagccctcggctcagccgccgggcgcgcggaacaccgcgccgtcctggccttccaccaccaggctggcgccatccgacggcgacacccggagcgccacgcgtggcagccccttgcggtccctcagcaccagaccgggagagccatgctcgtccgcacccaggatggcccggggccgtccgtccgcgtccgacagctccagccgcgacgagccatccacctgaaggcccaccgcgaacaactccccgccgccgggcgtggacagcgtcaggcgtggcgcctcgtcggagtacaccatcagctccgccagggactggccctcggcggtggagaagcgcagccggggcgagccgtcctcgcccacgcccaggagcgcccggggccggccctcgccgtcgcgcagcaccaggcccgcgttgccctggtcatcggtatccagcgtggcccgtgtctgcccgcgcgcgtccgtgagcaccagccgggaggccaccagcgtcccggaggacacgtcttcgccccggagcgccgccgcacccagccccagtcccgccaacgcgagcgcggtgaacgtcagtccctgccaccgccggcaactgcgctccagccgcgccatccgtgcttcgagcgaatccgaatccattcgaacgcctcctcgcgaagagaagctaacggaagcgggccggatgcgcgcgcccgactgtccagcagtgacggcccgcccacacccgccgtggtcgcctcgccgccgctgacctatttgcgcatccaccactaccaggaaggccccatgacttcacgactccggctgctgccgctgctggccctgctctcgctgacaacctgcgtgcgcaaccccgccaccggcaagcgcatgctgtcgctcgtctcccaacaggacgagattgccctgggcaagcagagcgcggaggaggtgcgcgggtccattggcctcatccaggagcccaaggttcaggaatacgtcgcccgggtgggcctgcccatggcgaaggcctccgaacggccggagctgccctggacgatccaagccgtggatgacccggtggtgaacgccttcgccctccccggagggcccgtgttcgtgacacgaggcctgctcaccgcgatgaactccgaggcggagctggcctccgtgctggggcacgaaatcgcccacatcaccgcacggcactccgtggaacagatgtcccaggcgcagctcgcccaggcgggcctgctgctgggcagcgtgctcagcgaggacgtggcccgcttcgggggcctggccgccgccgggctccagttgctgttcctcaagtacggccgcgacgacgagcgccaggcggacgaactgggcttcaagtacatgctgaaaggcggctacgacgtgcgccaggcggccaacgtcttcgccaccctggaccgcgtgggcaaggccgcgggcggacagagcctccccacgtggctgtccacccaccccgacccgggcgaccgcgtgaagacagcgaaggagcgcgccgcgaaagccaacgtggacttcaaccaactcaaggatggccgggaggaatacctcgccatgctccagggcatggcctacggcgacgacccgcggcagggcttcttccggggcaacgtcttcatgcacccgggactgcgcttccagctcaccttcccccagggttggaagacggcgaaccagccgcagcaggtggcgggcatcagcccgcaggaggacgccatcgtcgggctggtgcccatcggcaacatcgcgccgcaggaggcgatgcggcgcttcctcgcgcaggaaggcatccagccggtgagcgcggcgcccacgggattcccgcagggcaccgcgttcttccaggcgcagacggagcagggcgtcatcgccggcgtcacggccttcgtgtcccagggcggcaccacgctgcagctcctgggttacaccggcgcgcagcagcttcccgcctacgaggacgccttccgcgccaccttctccagcttcggcgagctgacggatgcgtcggcgctggccgtccagcccgcacggattgaactggcgaaggtgacgtcacccatgacgttgcagcagttcaacgagcagcacccgtccaccatccccgtggaggagctgtccatcatcaacggcgtgcagcccggtgacacgcttcccgcgggccgcacggtgaaacgagtgacgggcggggtgcggtccacgcactgagccgtgctccggcagggtgcgccggaacacggtgcgtctctcagtattcgatgtcgctgtcgtcgcgacgcgacacgaccgcaacagaacgacgaagcctgttcccctccgaagccgttcattccgttccggaacgaagcgggggcatgggcgtcgaacggaatcgaacattcacattgaatcatccgaaacccgattttccccggagggcacgcggcgcatcatgagcggaatgagccaccacgaacgcgagcggttggcgacggcctacgcggcgacgcgctacatcatccggccccattccagcacgggtggtgtcgagcaaatcctgcgggcgggcgccttgcacccggcgctggacgcaacgcttgcggcgcgcggccaccgcgagtgggccttcctgacggcgtggaatcccggctcgcagtggcggagcggcgaggagaaccgccgcgcgcaggagcgcatggtcgcgcagctcgtcgccgggggttggggggccgcccccgcgctgggcgaggcggatgacggcagttggtgcgagcagagcctcttcgtccccgggcttccccgcgaggaggccggacgcttcggccgcgcctacggaaaggtcgccgtgctcgtgggacgcacgggaggccaggcggagctgctgttctgcgaggaagcccgcgcctcacccgccccgtgaagcacgcggacagagtgcccccgcgccgcccgtgaggaccggggccgcggggcgacgtccacgctcagggaatggggcctcggggctgccccgccgccggcacggggccgctgccgcccagggcggagtcccccggattctccgggatgacttccagctcgcgggcattgacgaccctccgcgccagctcatcgaactcgacctccagcacgcggccgggtcggtccgcgaggccaaagcggatgcgccagaagttggggcggatctccaccgcctccccggcctcggccagcaccaatgagttgttgcgggcgtattcctcgccggcctggaccacgtcccgagcgcccagctccgtctgcacggcggccgagctgggaggggcgggggggcggccggtgggccccgtcgcgcaggccatggaggccaggatggcgccgggcaagaggaaccgggggacgatgcgaaatcggatcggcggcatatgcccatggtgagcacgccgcgtgccacccgcaggcagggaagccggaaacgtccagtgcaggacctgcgtccggcgcggcgcccgtgtggcaccccgccgggaggagcaccccgccccggcatgcgtccggggcgggaagggccctacttcgccggagcgggcgtcggggcgatgacgcgctgcttctccaccacctcgtcgatgaggccgtactgccgcgcgtcctcggcgctcatgaagtagtcgcgctcggtgtccttctcgatgcgctcgatggtgtgccccgtgtgcttcacgatgaggccgttgatgtagctgcgcaggcggaggatttccttggcctggatgtcgatgtccgtggcctggccctgcgcgccgcccagcggctggtgaatcatgatgcggctgttgggcagggcgtagcgcttgcccttcgcccccgccagcagcagtagcgcgcccatggaggccgcctgccccacacagatggtggacaccggacacttcacgtactgcatggtgtcgtagatggcgaggcccgccgtcacggagccacccggcgagttgatgtagaggttgatgcccttgtccgggtcctccgactccaggaagaggagctgggcaacgatgatgttggccacgtcgtcattgacaggcgtgcccagcatgatgatgcggtccttgaggagccggctgtacaggtcgtacgcccgctctccgcggtgcgtggtctcgatgacgaaggggacgttcatgacgcccctaccctaatcgcccttccgccgccgtgcccgtcccttcttcctggagcgtacgctgccccacgcttcgacgccggagcccccttgctcccctggtgacctaccccttgtggcccgtcatgtcctccgggcggacccactggtcgaactgctcgggggtgacgagccccagcgccacggccgtctccttgagcgtcgtgccgtccctgtgggccgtcttggcgattttcgccgcgttgtcgtagccgatgtgggggttgagcgccgtgacgagcatcaggctgcgctccaggttctcctggatgcggggccggttgggctcgatgcccaccgcgcagtgcaggcggaagctgcgcatgccatccgccagcaaccggcagctctggagcaggttgtgggcgatgagcggcttgaagacgttgagctggaagttgccggacgccccacccacggtgacggcgacgtcgttccccatcacctgggcgcacagcatggtgagcgcctcgctctgggtggggttcaccttgcccggcatgatggagctgcccggctcgttctccgggatggtgatttccgccagccccgagcgcggccccgaggacagccagcgcacgtcgttggccaccttgaagagcaccgccgccagccccttcagcgccccgtgcgcctgcaccagcgcgtcgttggcggccagcgcctcgaacttgttgggcgcggtgacgaaggggtggccggtgagctgggccagctcctgcgccacccgctcggcatagcccttgggggcgttgaggccggtgcccaccgccgtgccgcccagggccagctccagaagatgcggcagggtgcgctccaggtggcccttcgcgtggtccaactgcgccacgaagccgccgacctcctgccccagcgtcaggggcgtggcgtcctgcaggtgggtgcggcccaccttcaccacgtcatggaaggcgcgggccttctgcgcgagcacgtcgcgcagcgccttcagctccggcagcacgtgctcggtgatggcggccacggcggccacgctcatcgcggtggggaagacgtcgttggagctctgccccttgttgacgtcgtcgttggggtggaccttgcggcgctcgccgcgctcgccgcccagcagctccgaggcgcggttggcgagcacctcgttcgtgttcatgttcgtctgcgtcccgctgcccgtctgccagacgctcaaggggaactccgcgtcgtgctggccggccagcacctcgtccgcggcccggatgatggcctcgcccttctccttcgccagcgagccgttctccacgttcacccgcgcggcggccttcttcaccagcaccagggcgcggatgagggccagcggcatgcgctcggtggagatggcgaagttctggaggctgcgctgcgtctgcgcgccccacagccggtcggcggggacgtcgatgggaccgaaggtgtctttctcggtacggacgttcttcgtgctcacgcgcggggctcctcggaaagaagggtgggccccatcgaataacaggccggagccttcaggcacggctccggcgtgactttctccgttggacgctgagcactacacccgacgctcgacgcggggcgtgcgctccgaattgcccaggccggacagccagttgtacgtgcgccgcaggggcgcggtgcccgtcgccgacggcggcgtgaaggcccacagcagcaggtacaccatcagcgcggtgcccccggacaccgccagcgccaccacgaagcccacgcgaatcagcgccgcgtccacgcccagctcccgtcccagcgccgcgcacaccccggtcagcagccgcccatccacgccccggtgcatgggctccgtgcgcgcgccgcagcgcgggcacctccggacctccaggctcacttcctcggtgcaggtggcgcagcgtctcttggcgtccatcacatctcccttctggggccgctcccacttggcgtccgtggccctcattcctacctacgcgccctggcgcaccccattgcacacgccctggggacgattcgctgatttacagatttaacacgccggctgttgacacagttacaggcaagcaggcaaagattcactccgcacttcctttttgccctcgcaggactcattttccgagccgttccagtagatttacaacgcacctagccaaaggagctcagatgtcggaccaagccccctctgtgaaacccccggcgttcggaccgggagtggtggtgaaggggacctggcaccccgactacgccgaggtcctcacgcccgaggccctggaattcgtggcgaagctggcccgcaacttcggcgagcgccggctggccctgctggagcgccgcaagacggtgcaggcggcctggagcaagggagcgcggccccacttcctgccggagacgaaggccgtccgggagggcgactggacggtggctcccctgcccgccgaccttcaggaccgccgcgtggagatcaccggcccggtggaccggaagatggtcatcaacgcgctgaactccggggcgaatgtcttcatggcggacttcgaggacgccaacagccccacctgggacaacgtggtgcgcgggcaaatcaacctgcgcgacgccgtgcgcggcaccatctccttcacggcggagaacgggaagcactacgccctcaacccgaagcgcgccgtgctcttcgtgcgcccccgcggctggcacctgccggagcggcacatcgaaatcgacggcaagcccatctccggctcgctgctcgatttcgggctcttcttcttccacaacgcccgtgagcaactggcccgcggcaccggcccctacttctacctgccgaagatgcagagccacctggaggcccggctgtggaacgacgtgttccacctggcccaagcggagctgggcatcccgcgcggcaccatcaaggccactgtcctcatcgagacgctgcccgccgcgttcgagatggacgaaatcctctacgagctgcgcgagcactccgccggcctcaactgcggccgctgggaatacatcttcagcttcatcaagacgctccagtcggacacccgtgtggtgctgcccgaccccggccaggtggctatggacaaggcgttcctggacgcctactcgcaagtgctcatccagacctgccaccgccgcaacgtgcacgccatgggcggcatggcggccttcatccccatcaagggggacgcggcggccaacgacgccgtcatggacaaggtccgcgcggacaagctgcgcgaggtgaagaacggccacgacgggacgtgggtggcgcaccccggcctcgttgaaatcgcgcgcgacatcttcgactcgcacatgaagggccccaaccagctctccaacaagcgcgaggacgtgaagattggcgaggcggagctgctcaaggtgccgtccggcacgcgcaccgaggaaggcctgcgccacaacatccgcgtgggcatccagtacaccgccgcgtggctgggcggcctgggctgcgtgccgctctacaacctgatggaggacgcggccaccgccgaaatctcacgcgcccaggtatggcagtggatccaccacggcgcctccctggaggacggccgcaaggtgacgctcaccctcttccgcgacgcgctgggcgaggagatgggccgcctcgagaaggaaggcgccaaggagcgctacggcgccgcccacctggagcgcgcacgcgtcctcttcgagcagctctccaccgccggcaccttcgaggacttcctcaccctgccggcctacgacgccttggaagcccaacgctgaacctttctgaatctcgcagcagcaacccatcacttttaccgtagcgaggagcccacgatgtacgacgccacgccgacgaccgccgatacctcccctcacgccaagctccacgctcagcgtttcgagggcatcaagcgcaactacaccccgaaggacgtggagaagctccgcggctccatcaccgtcagccacacgctggcggagctgggcgccaagaagctctgggagctgctccacaccgaggactacatcaacgcgctcggctcgctcaccggcaaccaggccgtgcagatggtgcgcgcgggcctgaaggccatctacctgtccggctggcaggtggcggcggacgcgaactccgccgggcagatgtacccggaccagagcctctacccggtggacagcgtccccaccgtggtccgcaaaatcaacaacgccctgcgccgcgcggaccagattgaccacgccgaaggccgcaaggaccgctactggttcgcgcccatcatcgccgacgccgaggccggcttcggtggcccgctcaacgccttcgagctgatgaagggcatgattgaagcgggcgccgcgggcgtgcacttcgaggaccagctggccagcgagaagaagtgcggccacatgggcggcaaggtgctggtgcccaccagccacttcatccgcaccctcaacgcggcccggctcgcggcggacgtcatgggcgtgcccaccctgctggtggcgcgcacggacgcggacagcgccaagctgctgatgagcgacgcggacgagtacgaccacgccttcatcgacaagaagtccggccgcaccccggaaggcttctaccgcctcaacggcggcctggactgcgccatcgcccgcggcctggcgtacgcgccgtacgcggacctggtgtggtgcgagacgagcaccccggacctggcccaggcgaagaagttcgccgagtccatccgcgcgaagtacccgaacaagcttttggcctacaactgctcgccgtccttcaactggaagaagaacctggacgacgccaccatcgcgaagttccagcgcgagctgggcgccatgggctacaagttccagttcgtcaccctggccggcttccacgcgctcaacttcgggatgtacgagctggcgcggaagtacaaggaccgtggcatggcggcctacagcgagctgcagcaggccgagttcgcggcggagaaggacggctacaccgccacccgccaccagcgcgaggtgggcaccggctacttcgaccaggtggccgaggccatctgcggcggcaacgccagcacgctcgccctgacggagtccaccgaggcccaccagttctaggcaacggcgcctcctgaagtcccaagaaggccgcggctgacggggagcacgcccgtaagtccgcggccttcgggcgttttcggccttccgcgcaacttcgccggcggccgggcgataatggggtttcgagaggtccgacacgtgcgtggtgcgcgtcccgggccgagacggaggcgccatgacccgcatcaactccttcaccggtccgatgattcagcccgccaccacgcaggcgcaggcccgcgccgcgagcacgagctttggcgcgctggtgaacccgatggcccctgccaaccggcctggggacccgctgatggtatcggggggcgcggtggtcgcctcggcgctcgcctcggtgggcagctcgccgaacaacggcatcctgaactcctacctgtccgccgtgggccgcgggcccatctccgaggacggctcgcggggctcggtgtcccaggctccggccggctcggagcaggcgcagcaggagcaggtcctgatggagctggcggagatgtccgccgcgacgctgtcgaactccatcctgcacatgggcaacaagatgaaggtggacctcgaccgggagtaagggtcaccccttcttcttgtcgctctccgcgttgtaggcgtcgcgctggcctcgttgcagctcggggcccttgcgccacggcacgtcgacgtcggtgcgctgaccgccgttgtgctcggagacgtcgttgaggaactcggcgcgcccctcggcggggacgcgctcgccgtcttcctcggggtccttctgcttcttcggatccagcgggatgcccgcgctgcgcttgaggtagtccttggggtccatgtctccaaagtggagacgcccaccgtccgcgagcaggggcggacaggcgggcgggcccgcgcaggctcagttgaggtacttgggccggggcggctcggcgggctgctgcttcatcatctccaggccctgccgggtgaggacgaagcggacgacgccggagccccgctcggtctcgatctccgcctcgaaggccggcccggcgatgccgccgaaggacacgtccttgcgcaggttcaccacccggccgctcaccatgtccccggccacttccttggcgccctcaccgcgctggtggagctcataggccacctggtgcagcgtcatcgccagcgagggcgacagcggctggttgctgaagaggacggagatgaggagccagtagggaggtgcctggtcggtggacatcgcgcccccatcctaagcgcctggcggagcggaggcccgtggaagtgacgggcccccttgcgagcgcctagcgggtgggcagctcacggaaggtgatgccctccagctccaagcgctgcaccgcctccttgaaccgctcggtgcccaccatcacggtcgcgaaattgcccacgcggaaaacgtcgcggtccgtgggcagcgaggccgcgtcgaggatgggctcgtcgggcaacgtgagtttgaatcggccgcagacgtcacacggtggaggcaactccggcggatagcagtccgggtgcagttgtcctcgaggttcgagctgaagctccaagagctccggcgggtccttctgccgaaagcgcagctccgtcttgcagcccacgaggccacgcacaccttccacctggagccgttacagcgcttcccggcgaaccaccagcaacatgctcccttgcgtttcgaagtcggcgaatcgtcccgaggcagttccaaccagcgggccgaacaatgtccctggaggcagcagcgcgcctggcggagccaaggggcggaccaactcacgcagcctcacgaactcctcgaatggctcgggccgggccttcaggaattcgaactgcgcaggcaggttcgacaaatcgacagcggggtactgatggcccgaggaggcccaggtcaccccacagccagggcaccccgccagcccaggcagtccccacttgtgcgcggcgttgaagctcccattgattcggggccacatcgcgctgtcctgggagagttcaaacacacgaagggtcatgttccgggcctggaatagtacggtcgaatcgggccaccaagcagctcgaagcggtagatcaactccccggcgtgtttgaaaatctcttcaggactcgccccactgttccgccgcatgtacgcgcgccaggcttcgttccaggcaccaccggctcccgcaccaccgggaatgcgtcgatggagctctcgcggtatcggcatcgtgtagtcgtgaatcttgacgccccgctgcgtgaaccattgggcaagctctggtgcctggggaaagatgtggtgcttctcccagcgtccgggcggcagccgatgtgacggcgggatgactcgcccaggcgcaccaccccaactggggaacaccatgacagcgccccgaggcaactgctggccgaggccccagtttcgccggggacctcggccaggcgccgcggcagccacgggtggacgggcgggcggaaagcgcgccagctccacctcccccggcaggtccgtgcaacggtagaagccacacgcgtcgcccagacacagcaaggacacacactggtcctcgtgcggagtccagcactccagttccgcgtcatcccaggcctgctgcatgggcggcttgaccgaggtggaacaccccagccaaagcacagcaagcaccggaagcattcggagcagacaggttcgcattccgcgaatcctagacttcaggtctgtcttgcccgttccgcgctgcccttaccccgcgcgcgggcgacggcgtgaggcaatgccctcggcgagcgcgacctgctgcttccagtgcccatacagggcgcccctgcgaggccagccggtccagcttgcgctgtgtgcgcctcatccaccgacccgggcggcgcatcgcggaagggcgtccccggcagcggcatgaatgtatgcccatgcacgcgcgcgcccaggcccgccaacttctccatcagcgccaccgtggcatccacgtcctcgggctcctcgccgggcagcccgaggatgaagtccacgttgggcacgaagccacactccaccgcgatgcgggtggcgcgcaccaccgtctccacgtcgtgcccccggcgggtgctctggaggatgcgctcggagccggactggccgccgatgatgaggttgtcgttgtggacgtagcgcttgagcaactccagcgcctcgggcgtgacgtgctcggggcggacctccgacgggaaggtgccgtagtagacgcgcccatcgggcgccatggcctccttcaccgcggcgagcagcgcctccaccgcgtccaggttcaccgactcgtcggcggtgccgtaggacatggaggtgggcgtgatgaagcggatgtctctccgccccgagcgccgcagctcccgcgcccagtgcgccacgttggccacggagcggtggcgaaagcgcgccttgctcatgaacggcgtctggcagaagcgacacgcgtagatgcagccgcgcgtaatctcgatggcgccgtactgcccgttgcgcccggagaaggggggatagtcgtccagttgcacgccctccccccggccgtgctgcaccagcttcccatccttcagatacgcgacgccgtgcgtctcacgcggcacctcgccgcgcagcacccggctgagcaaggcgcgcagggagtactcaccctcgcccaccgccaccaggtcgaagcccgcctgaagcgtctggagcgtctccgccgtggcgtgcacaccgccggcgatgcacagcacgtcccgtccctccaaccgctcacgcacccatgccagctcctccgccgccggggcgaagctggccgagtaaaaagaccacgccgccaccaccgtgtctccggcgtccacgcgctcgcgaatcgtgtccagcagcgtctcgcggctgcgcggaaagtgcagcgtcacgtccgccagcgccgggtccgactccacggcgcccgccagcacggtgaaggcgtacttacctgggtactggtagctcaggacgagcgaaacacggcgagatggctgcatgctggaagcgctttatgccacagggccggcggcgcaggcacacgggcaggccgccgggcccgccgcgtgcgcctttggccagtcagggagaaggcaccagcgagagggccagcgtgttgaatgcagggaactccatgacgtctggaggaacccgcccgtccggcacagccatgcgcaccaccaccaggtcctgctctggcaccaccagcaggagttgcccgaaggagcctcgcgcggagtaaccccggggcgcgccctccacgtgcgtgcgcaacgggatgcgggcgctcttctccatgaacgccatgacgcccttcatcccgccgagccgctcggagagcacctgcatgaagtccccggcgggaatcggcttgtccaccacgtcccgcaggcgagacaacgacgcctcgggcatgccgttgcgacgcgcctcgttcaccatgtcctggcccagcacgcggaacgccttgtcgtagacgagccaccacaacaagcccgccgtgggggtgtgggcctgagatgccgcggcggtacattcctgaatccaggcctcgctcaggatgcgctggccctgccagacgcctcgctgaagcatcaactggcccaccttggcgaagtccacggggtgcaggcgcaggccggacatgcccagcggattgccggacgggtccttctgccagaacacgtcacggatgccgagcggctcgaagaggcgccgcatgagataggcgtccagtttctcgcctgaggcgcgctccaccacgcccgcgagcaggttggtggccttgttgttgtagaagaactggctgcccggcacgtccaccacgtggctgtccagcgcgtagcggacgaagtcccgcgactcgtagatgtccatcgcgtgggcgttcgccgccagccccgaggtgtggctgagcaggtgccgaagcgtgaccttccccttgaggccgtccttccactccgggaagaaggtggagacaggcgcgtcgacggagggaatgcggccctcatcgatgagcagcccgatggccagcgccaccacgcccttggtggcggacatggactcgatgcgctgcgtctcgccgccgaagtaccactcccccaccaacttgccgtggcggagcaccaccagggccgacgagcccgattcttcggccgccttcacgaaggccgcgagcgccggctccgacagccccgcctcggcgggcgtcgccttctccagccccgccccgacgttgccctccgcgcgcgccttcagtgcgttctctctcgcccgcgccaccagcgcgtcgtaacccggcatccgccgcaacggctccagggacttgtcgtgcagcagatcgcccggcgagcccatcccccgctcgacggcgcgctccagccactggaaggccgcggcgtcgtcgcccacgcccaacgaggcgtaagcggcaagccatgccacctcgtccgtctggcggccgccctcccacagccgctgcatctccgagagcgcggcgtcgaagcgcccggcctccatcgccctgccagcccgctgcaacgcctcgcggagctgggactcagggtctgctggcgccggctgcacggcagagactggagacgaagcgggcgcggccacgggttgcgtgtgggcacaggccagcaaggtacagagcgggaggtagagactgtgtcgcatgggcgttccccgggggcggacctgctcgaactacgcaccggaagcgccgatattgcatggcccgcacgccatgacgaagcggcatcaatcccctgcgagggcactggcgccgggccggagagggacgaggcatgcggccgccactcgagcgcccgcgccatcaaacggcgcggggccgccgctggccgcccgggttccatcgagtcccggacggcagcggtggctttctgcgcggcgtcgtgcaagtccagtgtcatcaacagcaaccggcttgcgcgggcagcgcgtacgctgaagggattatcagctcgacgaaccgatcttgaggaaggggtcgaagtagaagtactggacgttcgctccgtccttcgtcagcgcgaacaccactccgtactcgagcaaaccgctcacgagcttactggcattgaacgtgatgtacggaacgaaggtgggcgtccagcccgcccggagttgctggtcgatgagcggctcgttgggccagttgctccaggaggggggcgtctgggtccacttcgggctatcgccgacgaaaccgatgaagtccggaatagggcccagatccaaatcgaagttggggatgtcgatgggccgcttcgtggcgtcattcatgatcgcgtccgagaccggagcgccgttgaacgcatgcacgatgatgccattgggcgcgagccccacggtcgaggcgtagttcgcctcttggatgtagatgcggacgctctccccactcgggacgggcaccgcatagtcggggtcattttggttgggatgggggttgtcgttcacgaggaacgtctgatggctaaccgcgaccgcggtactgacggaggatccccccgtgggaagcttggtggaatcaatcaggaagctgatctttaccatgtcgaaccaatcccttcgtgtggctgctgtgtgtcgttgctgaaccctcacatcgggctcacggcaaggagtccatcccgcctgaggaccaccaaagcaacgcacatgccatcgactacccaaccattgcctcctctgaagctcgcatcgagcctggaattgcaccctgcgactgacacgtcagttccaatcaccgacgcgccacgtcttccatgcaattcattacccccaagcgcttggatctaccccaatcccagacgcaatccacccctattccagccacagcacatggaatcgtttggatgcatggacccgccgcatcaggtcgccacctcccaccgcgaggccaggcagcgccacgacgcgggccgtgacgggcgagtccgcacccgacaggcccctttcagacctgtcaggtcattggccttgctgctcacgagcagaggaccggcacggagcgcggctgacacgtcagacgcactccgagtccgtcagaaatgaggctggatttcacgcctggagtagcgctccaccggccgcctcggcttcgatacggcgaagcatgagacgtatcacgtcgggttcatggctcgaacgagagcggcgcaccgcttcggagccggacggaccttcccgggcgagccgacctcgcccgtgggtgcgagcgctccggacacgtggagcgcgccgcgtctctcactttttcccacgnagccgcgcgagcccgagggcccgcgcgccccgggaggctcagcccttgcggcggcggtagcccgccaggcccatcagccccagcagcgcgaaggccgccgcggagccaccggtgctgctgcaccccgactgtgccgcggcgccctcatccgaggagatgcctccaggcgggggcacgttcggcccaggctccgtgcccgcgtcccaggctggcgtccccgcgtccgcctccggctgcgggcccggctcctcggccccacccgcgtccacggggtctgggtccacgcggcccgcgtcctcgggcgagccggcgtccatgggcgagcccgcatccatcggcgtccccgcgtccacgggtggcggctccggcttctgctcgagcacgtccgacagcgccgtcgcctggatgaagccgtcgtggtagacgacgcccaccggcttcacggtgtcactccggtagaggccgagcttcaggtagttgcgctgccccgagtacatcgtcatcgcgccgcgcttgggcagcaccagttccttgttgtgccacagctcgacgaagccaaccttcgggtcggacgaccacttcgcgtgcaggatgaactcgtgccacacgcctcgggtgagcttcgtgcgccagggaatctcgctggtgccggggagcgacagccggatttcctcccccttcacgtagaactccaccggcggcgaaccacagcatccgtcgtggtgccactgggtgaagagctgccaggtgtccacgctggggaagtcgttcgcgaacatcaccttccagcggtagtagtactccgagcccaccggctcgttgctgatgtagaccagctcgttgcgattcccgctggcgttgatggggtcgtcgccctgatgcaccgtcgccttcagcgcgtatttgccctcggccacgggtgacgtcaccacctgcagccggtccgcgttcaccatctgcgcgcgggagtactgcgagcggtcccccgtctcgaagtccccccgccacacgacgcctgccatggcgagcccggggacgcaccacatcacaagccatccggggataaaggctctcaaaacacatcctcgcaaaggtttggaatgcaacaaccggcacacggtaccgcaaaccattcactgcttcattcccccgcgaaatccttcccgctgggccggcaagtgggcaggcgggcatgcaaggccttggatgtttcacgccatgtttcacgtcgagcgcagggcggctgacacactccgggcgtcctggcaagccgacagcaacacgtcgcgtcatcaacacgccggacaaccttcaagctgactggcggcaggtgtggggtatagtccgcactttccggcgctccgttccgggggcgccccgagtgtcccaatgcttgtcctgcgtgacgtccagaagaccgacctgcccgggctcaaaaggctcgcggccgtgctgaacacggtgaacctgccgaacaacgaggaaacgctgtcggccatcgtggacacgtcggtgaagagcttcgcgggcaaggtgaagaaccccttcgagcgcgagtacctcttcgtgctcgaagacgtgcgcaacagcctcatcatcggcacgtcgatgatcatcgcgcagcacggcacctatgaggctccgcacatctattacgaggtgagcgagcgcgagcactactccgcgtccctctcccgtcaccttcgccacaaggtcctctccatcgcctacaactacgagggccccaccgaggtgggcggcctcgtcgtggacccgccctaccgcgccacgccggacaagcccggcaagcagctgtcctacgggcgcttcctcttcatcgccatgcaccggcggctcttccgccctcgcgtgctggcggagctgctgccgccgctgctgccggacggccgcagcctcttgtgggaggcctgcggcaagaagttcaccggcctcacctaccaggaggcggaccgcctcagccggcagaacaaggagttcatcaaggagctcttccccgcctcggacatctacgcgtcgctcttccccgcgcgcgtacagaaggtcctgggcgaggtgggcccgcagacgcgcggcgtgcagcgcatgctggagcgcatcggcttcaagtacatggagcgcatcgacccgttcgacggcggtccccacttcgaggccgacaccgccgacatctccctggtgcgcaagttccgtacgctcaaggtggcggaggaggacttc

SEQ ID NO: 1187 - DNA, 18551 bp, Myxococcus xanthus
ggtaggttgtcgccgccgcgccgaaggtctccacgttgacgcggctgagcagatggtccacctgcgccttggacatgccatcttcgatgcgcagcccgctgccgacatccttcagcgcgcgcgaggtgatgaggccgccgcggctgtagcccatcaggtggatgtcacggcccgccttcagctcggagtagacgatgtccgacagcgagtcgaccgcgggattcttgcccttgttcagcttgtccttcgcggcctggatgacgtcggcgagcattccggacgtggcgttgtgcacgccgatggcgcgcatgccggtgctgttcgcgagggcctgcagctcgcgcgcctggccgtccttgttggtgctgatgccgttgacgtagacgaccgtcgccgtggcgttcgggttgttcgccggaacgaaggcggggacctggttgagcggcgtattcggctcgaacgtctggccgccggcgcccaccagcttgccgtcgaagaccttgtccttggagcccgcgggcgcggtgaagacgccacccaccgcgcgcgtctgcgcggagcggctatcgaagccatccaccacgacgccgcgctgagcggcgccacccgtcacgggaggctgcacggtgttggtggcggttgatccacttccacgaacgcggtcggcggtgctgcgggaggtctgcgcgatgctgttccgtccgcgctggatggtgctcatggggtgggggctcctgcggaaactgggggtgtttccgcattgtcctcgaatccaccaggaagtttcctgtcggagaagattcgacgtgaaatcgtgtgtgggttcgtgtcggacggcgcgtgtgggcggccgcgcgagggtgtaggggtttatggtgaggcatggttcagaaaggtcagttcctcgaacgcgcgacgctggtgccggtggggtcggaggtcatggagggcaccacgcaccggggaagccgagcgccgccgctgctcgtgattccgccccggccggacgaagggggcggcatggaccacgtcatcgcggcggagctcgtctgggcggcggcgaacgcgggctttccgacgctgcggttcaatcaccggggcgtgggggccagccagggcaagcgggggcgggacttggagctgctggcggacgcggaggccgccatgcagatgctgctggagaacgcgggggccaacgcactggcggtggcgtcactccacgggggcgcccaggtggccctggcgctccaggcgaaacaccccgccgtgggaggcctgtgtctggtggccccggccctggtggcgccggaagtcctgtcccgggtgacgtgcccgctcctggtggtacagggggaggaggacacccggctgccgcgggccgccgtctccgccgctatcgctcggacgggaggcgacttggaggtcatcgacgatgccggacctaccttccagcggaaccttcctcaggtcggccgagctgtcgcggcctggctgcggcggctctccggcggatgaccgttgtatcgcaaaccatcgtacttcttcacgtttctcctccttgccgcccttgcacgcagggagaggggacatccagactgtcggtgcagacccaatcgttgtgacgttcgttcgtaggggtcttccagacgcgtgtttcgtttctcaaggagtggcctgatgcggaaggtgcgatggaccctggggggcgcggcgctggccctgacgctgtcggccgcctgtgcgtccgcttctcgtgagcaggacacgcctccccctgcgaatctgcgggcgctcgatgcgcgggacgtggtggcgggcgccatcgtcgtggacttcaaggacggcacgacgaaggcggagttcgacgcctgggaggccgactggggcgtcgacctggaactcaactccgtggagagcgccgacgaggccctcacggtggcggtgggcgtggacgacgtggacggggtgctcgagcgcatccgccagcaccccgccgtggaagccgccgagccgttgatggaggtccgcgccagtttcacgccgaacgacccgcatttcgcgcagcagtggaacctgcggatgatcgacatgcccaaggcctgggagcgcaaccggggcaagggcgtggtggtggcggtgctggacactggcatcgcgtacgaggaccacggcgacttcaagcaggcgccggacctcaagggcgtgaagttcgtgaagggcttcgacttcgtcaacgacgacgagcacgccaacgacgaccacgggcacggcacgcacgtggcgggcaccatcgcccaggccaccaacaatggcgaaggcgtggcgggagtggccttcgaggcgacgctgatgcccgtcaaggtgctcaaccacttcggtggcgggaacacggcggacatcgcggacgccatccgcttcgcggcggacaagggtgcgaacgtcatcaacctgtccctgggcggcggggcgtactcgcaggtgatggccagcgcggtcgagtacgcgcgcaagaagggcgtcaccgtggtggccgcggccggcaacggcgggcgggcgacggtggaattccccgcggcctacccgggcgcggtggcggtgtcggccgtggggccggacggtgtgctggcgccctattcctcctacggcaaggagttggacatcgccgcgccgggtggtgacaagcgccggggcgaccaggggggcatcctccagaacaccctcgacccgcgggacgtctcgcgcttcgtctacgcgtcctaccagggcaccagcatggccacgccgcacgtcgcggcggtggcggcgatgctctacgcggccggcgccaagggaccggacgaggtggagcaggccctctacgcgggcgcgaagaagtccgcggaccaggcgtggagcgagcagtacggccacggcctgctcaacgccgaggcgtcgctcgcgtcgctgcgcggcggcggcttggcacagtggccgccgctgtactgggcgctggcgctgctggcgttcgtgctgctgacgctgcgaggccgtgcgcggccgggctacctcaacgtgctggtgcggcccgccttcctcatcccgctgctgctctcgacggtgggggccttcttcctgcgcggctggttcgggggcgctgagggggccgcaggagacgtggtgcaggtggcgtcgctgcccctgccggattgggagcgcatcatcttcggccggggccggacggtgaacccgctgttctacagcgcgctcatcccgctgctcctgtcgctgccggccatcaagtggcgggggctgcggtcggccatggggggcctggcgctcggcttcgcgggcttcctggcctacacggcctgggccggagcgccggcgctggcgtggctgcccttcgcgttccttgccaagccctggctgggcttcaacaccgtcatctgcctcgtcatcgcccgcgcgatgctccagaaggaggacgcatgaagctcactggccgcgtcgtgttccgtgacatcgaaacgggggtctgggtgctggagggagacgacggcaccacgtaccagctcgctggcggggaccggaagctgaagaaggacggtcagcgcatcgaagccgaaggccgcgtggacggggacacactcaccagcgccatggtgggtcccatcttccacgtcagcacgtaccgcttcgtctgaagcggcactgcgcgggtcagggcttcagccctggcccggtttggatgcggtgcgcgcgaatctgccgctcccgctcctcgtagtaggcctccatgggcagctcccctcggcgcgccgaggcgcggagcgcgctcaacgccttacgctccgcgtgcagcgcgggggcctggggggactccagcgtcggcagcgggtgctgcgcgtcgtagaagttgagggccaacccccgcgagtccacggccaccagcaggcccagagacaccgtggcccccaccacccagggaagcatcagtcgcaccagggaaggcgtggggccgggctcctgggcctcctcgtcgctggcgcgtgcgccgggaccccagacgccaggctgccgtcgcgcgtaggcgagcagggcgctcatgcccgcccagcccgccgcggcgagcacgagcaccaagcgggggtctgtcgcttcagacgtcgcttcggaggcatccgtgcccagtgccttggcggacaggaagagcaccgaggacaccaggttgttggccgcgtgggcgccaatggcgggccacagcgagccggtgcgcaggtagagccaaccgaagagcaggcccagttccgtgcgagccaggaagcccaccgggtccaggtggaaggcgctgaacaccacggcggagatgaccaggggcgcggtggtgggcgcgggtgccggtggggtgaggcctcgctggaagatgccgcggaagaagaactcctcgcagaagggcgcggccaccgacacacccgtgaggatgatggccagctccagcggcgtctgatccgcgaacagcttcgagctgtcgaacatccgcgtcagccactctggcgccaccgactgggccaggaactggatggggaccaccaacgcgaagaagttcgccacgcccaggaggaatccgaagacagtggccgctcgcggcgctggcagcagccccgtgtagaggacagggcgccagcccgcgttgcgcagcatcacccagcccaggcccaggaacacgaccagctcggtgaaccagatgccgaaggctgggttcgcgagctggacggtgccgcccacgaggatgaacgcgccgagtgcaaacgcggcgctcaccaccgcgagccatttggggcttgtgctcaagcgggtgccagagggcggccctggtggagggggcgcaacatcgctggggggggcgtcttccaacgggctttctcctattcctctcgtgctcgaaccttgacgcccttcatcctggctcgaacagcgcggtggcgggcgcggacggggccagggagggctgctcagccgcgcttcaggtacccacggatgtcgtccacgagctgtgtgcgggcctgctgctcggtggcggcggggcccagcgtcagcttcttgtcggcctcgatgagcagcttctggtccaggaggaacgccaccgcgttctccagcgtcaccttggccagggactcggaggcggtgatgcggccggcgtggtactccgcgcggcccgtttccagggccatcttcacgaaggacttccggtcctccgcggcgccggtggccacatcctggagcgtcagggccgccagcaggtaggcctccaggtagtcgcgcagcatgtcggccaggaactccaggtccggacgcgcgtgggcctcgggggccacgcggagcgtctcgttctcctcaagcaccaggcccatgcgctccagccgctccaccgtctccgcgaagatagagtcgaacgtggtgcccacccggtagatgaattccaccttgaagaggcgggacaggaacagcgcgcgctccttcacggtgtcgtagggcgccgggctgccgctggcaagcatggcgttggccacgaggctccgggaggccaccaggttcatcagcgtgttcttgtagaaggacagctccgggcggcgtgcctcctcgacctggtagatgacctcgccacgcgcttcctgggtgcgcaccatctcgtcggagatgaacgtgcgcatggcgtcctggatggggcccatcgtctccgggttgctgggggcgttgcgcatctccaccgactgaggcgagccctcctccacggcgatgcggcgcaggatgttgatgcggtctgccatctcccgctgcgtcaagccgcggcgccggtgcgagagcagggcggtgctgaccagcgcgtgcggcgtcaccgtggacaccttgctgatgccgtacatcacccggttgcccagcgcgcggacgagccccttcttctgttcgtccgacaccggttcgtccgggttgatgccacgtgcctgcatgaacgcgcgcagggagatgggctcatcgaagcccaggtggatgcggccgtaccgcgccgccagcaccttgggcgtgctcaagagcgccttgaggtcctcgggcttcttctctccgccagccagctccttcgagtagctgctggactcgacgaccttctcgtagtcgatggccaccggcacgaagatgaggtcatcgcgcgcgccctccagcacggactccacctgccaggtgaacatgcccagcttgggcaacaacagcttgcccgtgcgcgaacggccgccttccgggaagaactcctggtggatgccgtcgtgcaccagcttgcgcacgtaggccttgaaggacgcggcgtagaccttgtcgcccttgaaggagcgccggaggaagaacgcgccacagcggcggaagaacgtgcccaggggccagaaggagaggttggcgcccgcggccaccaggggcaccgcgtagccccggttccatagcacccagctcattaccaggtagtcgacgtggctcttgtggctggggcacaggacgatgggcgcgtggctcgcggccttgagcgcgcggtggaggccggcctcgtccacgtgcatgccgtcgtagatgcggttgaacacccactccagcacgggggaggtgaacgccagcgcggtggggctgggtttggcggcaatggcctccaggttgcggcgagcctcgcgcaggacgctctccggcttgcgcccggattccgccgcgcactcctccaccaccttgcgcagggacctgtcgcgcagcgtctcctcgatgacgcgcgaggcgggcttcaccggcggaccgaacacggcccgcgtttcgcgcgcgaggtggacgtggagactgctacgcgccttgcgagcgagcagttcgtccgagtcgcgagggttctccgcgacgaagcgctgcaggtcgatgggctcgcccacgcggaactgcgcgcgcttgtagttgcggaagaaggccagcatcgagtgcaggaatcccggtgcctcggggctgccgaacaccacgtccacccagttgggcttcaggcgcgcggggcgcttctcccagacgaacaactccggcaccaggtacacgggcttgtcggactggcgggccatggccaccagggcggggaaggggtcctcgcgcgtctctttcccagacggacggagcagggcggtgcggcgcaggaagaccagaccgctgccccccgtctgccgggcgtgctcgaagcgctgcgtgaagtcaccgctctgtttcgcctgtcgccagggtcgggtgaaccatggccgcaggttcaccacggcgcgcacgggcggcagcgcccggcgcaccatggcccacgtcaggtagaggaagttcacccaggcggtggtgcgcatgacgtgcaccacgaagcccttggcgtgcaggttccggagctctgtttctgcttccggcgggaagtgcacgctctccaggtagcgcgttcccagcgcccggcccatggggccgaattcgtccttcagcgaggacgctccctgattcgcagtcggtgacagcgcggtctccaagaatgctcccggctacatgttgtcgggcgtgggaatgcccagcagcgtcagtcccgcggccagagtaacccgggcggcgtcgatgagggcgagtcgcgcggaacgcagcgcgtcattgccttcgacgttgatgcgcttgtcgcgctcctgattgcccagcgtgtagtagcggctgagcgccgaggccacgtcgagcagcagtctcgccacgaggctgggctcatactgctccgccgcgtcgcgaaccacctcgggcaggcgcatgatttcgcgcagcagggcctgctcctcggggagcgtcagcagggccgcgtcgtagctggccggcgcgccaccgtccttgcgcagcacgttgacggcgcgcgcgtgggcgtactggagataggggccggtgtggccctcgaagctgagcacctcgtcccagtcgaaggtgtagtcgctggcacgcttgtgcttgaggtcgccgaaggcaatggcgcccagggcgatctgctcggagagggcgtccgcgtcatccgtctggatgcggccggcctccacgttttcccgcaccttgacggaaacgcgctcgcgcgcctcgtccagcacgtcgttgagctgaaccacctggcccttgcgcgtgctcatgccgtggatgcggccgaacgcgacgtggacggtgcggtccgcccagggcaggtccatctccttcagcgcgcggaacacctgccggaagtgcaacgcctggtcctgcgcgacgacgtagagcgacttgtcgaactggaagcgctcgtacctgtcttgcgcggcggccaggtcacgcgtggcgtacagcgtgctgccgtcgtttttcttcagcaggatgggtggctcgttctccgcgtaggtcaggtcgacgatgagcgcgccctgcgactccttcacgccgggcttcttcgcaatctggtcgatgaccgcgtccatctttccctggtagcggctctctccctcgatgtgctcgaactcgatgcccatccgcgcgtagatcttcttgaagcccttgatgctggtgtcccggaactggttccagagcttgagggcctcggcgtcaccggcctccatgcggcggaagaaggcgcgggccttctcgtcgaactcgggctcggcctcggcgcgcttgttggccttgacgtacacctccaccaggtggcccatgtcgtcgatgcgggccgggtcgccgtactcctggaagcccacggccaccaggccgaactgtttgccccagtcgcccaggtagttgatgccttccacccgccagcccagcgcccggtagatgttggcgatgcagtggccgaggaacgtcgtgcgaatgtggtggaagccaatgggcttggcgatgttcggcgacgagtagtcgatggccaccgtcttgccgcggcccgcgtcctcgtcaccgccgtagcggatgcccgcgcttcgcgcggcgtcgatgacctccgccgtgaagggcagggtggggaagcgcgcgttgacgtacggccccacggccttgatttccagcccggggacgctgagcgactgcgccagcccggcggcgatggcgggtggggccttcttctgggccttggcgagagggaaggtggcgaagctgaggtcgccgtgcgccggctcggcgggcttgacctgggcttcgatgtcggcggccggcacgcccagggcattggcaagagcctgggcgaaggcggcgcggtaacgggagtagacggatgtgctcatggggctgcggggatactagacaaaccgaggtggcttccggccacctcttgttcgcgcccgcggcgaatcccccagtcacggcacggcgggggctcgccggctgggccggaccaccgcagagacggtgtccagcagcttgggcaggttgaggggcttttcgaagaagccgtcgatgcgctccagcccctggcccgaggtgagtgacgccacctcggtggctccggagatgatgtacacgacgatgtccgccagcgactcgttgccacggatgtagcggagcaccgattgcccatcctcctcgctcagccgcaggtcgagcaggaccatggctggccggatgtgagagagaatggaccgtgcctcggatgcgcccgaggtggccatcacccggtagccctcctgctccagcacctgctgcagcacctcccggcagtcggcgtcgtcctccaccagcaggatgccgccgctcttgggcgccgcctgggccatctccggcgcgctgacggcgccggcgaacatggggagcaccatctggaacgtgctgccctcgcccaggacgctggcgctctccattcgtccgccatggagggcgacaatcttccctaccagcggcaacccgagccccgcaccaggcggccggggcatgcccggggtggcgcggtagaaggcgtcgaagacgtgctccagggcctcgctggacatgcccgggccgctgtccttcacggtcagcatcgccaggccgtcctcggcggagacgcgcacctcgacggtgtcgtccgcctcgctgtggtggatgccgttctccacgaggttgtggatggcctcggcgatgcgctcgcggtcgccgcggacgaacacctcggggcaggggggaatcaccacgcgtaccttgcagtgctccgcgagcgcccccagtgagcgcaccacttcctccgccacggccttgaggccgaagggacgctgattgagctgcatcttcccggactggagccgggacatgagcagcaaatcgttcaccatgcgcagcatccggtccgagttccggtcgcagatctgcaccgcgcggcgctgggcatccgtgaggggccccagcttctcgcggcccatcatcgccaggtaggacttgatggtggtgagcgggttcttcaggtcgtgcgagacgttgcccagcagctcctcgcggttctgctccaggctcttgaggccagcgatggccgtctgcaggtccttgttgcggcgggcgctgtcgtcacgcaggcgcgccacctcgtaggcggcggtgagctgcgccgccagtgactgcaacagcgtgtcggacggctcgcgccgggagcccagcaccaccaggacgccaccgacgccttgcgggccctcgagtggcacggcgactgtgtccccatcacgcagcagcgccttctgggagaaggcccggcccaccacgccctcaccggggacggcggcggtgacgcggtcgtcgtaacggcctcgcacgtgctcgacgtggagctgctcccgggatgggaagtagcgcgccacgtagcagaccttcggcttgaggagtgtgtggatggtctgcaggtgggcgcggagcgcttcggtgggccccgcgttgtccgtcaggtgccgcgacatctccagcagggcgcggtgagcaacatccgcttccaccgaggggagcggcttcgcgggccgcttcggagtcttcttggccgccttcgcaaccggacgcagcggtacgacttccgccagcgtccccttcttctttgagcgcacggggtgaatccttgctcaagttccgcgcgcctgtgaacggcctctgccttccgaggccttccggaggacagtgtccgtgtcggctggccgacagccgggctcaggcccggcgctggatgcgctggtcgttgcccagggcgtagggctccaccagcagcggctccaccttctcccggtagccctccacggagaagccaccttccgccagcgcgctgagtacggacgtctgcacccggcgagccgtctcgtcggcggtgagcagcttcagcatgggctcgcgcgccggctcgtacttgaagacgcccagcgccttgagcgcggcgatcttcacgtcgtccgacatgtcctccaggaagggcaccaccgtgggggggatgcgggggtcctggctgccggccacgtggtgcagcaacaccaccttcttctccggattgcgcgtgtagtgggcggacaggtgctggagcgcgctcacgcaggcggtgatggtctcctcctcggaggtcagctcaccgagcagccgcagggcccacgaggcggcctgctcgctggtgcgcaggaactccaggatgggcggcacggcgacgtccttgccgaagctcttcaccagctcgaacgtgtgctccttctcatccgcgtccgtagtgagcgggtccacggtgagggtgaagcggctgagcagcacggacacggcctcggggaccttcatctcccccaactgctggatggccttctgccgggtcgcggggtcgccgtacttctgggtgaccttgggcttgagcttgagggctttctcggggcccgagccgcccgtgaagatgtctaagaggcccatgtgcgcgtgtgctccgtatggttcggcggcgtgagaaggtggggcgcagtccgtctatgacggtgcgacgcccaggacaagaggcaagaggctagagcgtcagctcgcggcggacgtcgccctggtaggcccgggcgagcgcctcggcggcggcccgagcctcggcggttgtttcctcggggaccttcacctggaggtggaggtacaggtcgccctgtgctccgcccttgagcgagggaacgccgcgccccttcagccgcatgcggcggccggattgggagtgggggagcaccttcacggtgacttccccctggaacgtggggacgcgcacgtcggcgcccagcagggcctcggagaccgtcacgggcagatcgaggtgcaggtcgtcgccttcgcgacgcacgaggggatgttcggccacctcggtctcgatatagaggtctcctggggggccgccgcgtgtccccgccgcgccctggccggagagccgcacctttgagccggtgtgcacgcccgcgggaatcttcaccgtcagccgggccagctcctccttcacacccgcgcccccgcactgggggcagggtggcgcggccttgcccgtgccgtggcagttggggcacgcgcccgcgccaccgaacaggctcccggaacgccgggctcggcccgtaccgttgcaaacgttgcaggtggacaccggtcctgatgtgcctcggccactgcacgtggagcaccggcccggacggttgaaggccagggggcgctcggttccggagacggcttcagccagggtgagctggacgcggaccgtcaggtcctctccacgctcaggcccggcgttgcgaccccgacgcccaaacatctcgccaatgtcgaagccccccggggcgccgcccgccgcgccaccgccacggcctccgaacaggtcgccgaagaggtcacccaggtcgaagccctcggcgccatagggaatgcccccggcaccggcgctcccggccgaggctttgtaggcccgataggcctccgccttcttttcgtcgaagccaatcttctcggcgtccgggccgaactcgtcgtagagcttgcgcttccgggtgtctgacagcacctcgaacgccgcgctcacctgcttgaacttctcctcggcggccttgttgcccgggttgacgtccgggtggtacttgcgcgccagcttgcggtacgccttcttgacgtcctccgctgaagccgaccgatcgacgccgagggtctgatagtagtcgtccgccatttgttcccgccgtggtgtacccgattcaacgtaaccagccggtaggcacgcgccagcaaggactgtccggaccgtgcgagatgtataacgtcgccggaggatgagggagcccatgtcaccgcctcgatggctcggtgcggataccctgtggcttgcgggctggctctcgctggcgccagccgtgggggctgcggcgactccgccggccaccgtggagggccgggtcgcggaccaggtggtggcgatcattgagggccaggtgctcaccctgagcgagctgcgcttcgaggctcgggtcgcgctcctccagcgaggcggcgtgcaggccctggagctcccgctcgacgaggacacgctccggggggccctggagctcatcatcaaccagcgggtccaggttctgaatgcggaccgtctgcaggcattccctgccgagcccgcggaggtccaggcgcgggtggacgcattccaggcggtgctaggaggggaggcggcgttgaagcggttcctgtcccgccatgacgtggacgtgcaggggctggagcgggtgctggcgcgggggcttcgggccgagcgcatcctggacagccgcatccggctgcgggcgcaggtgggtgagaccgaggtccgccgccacttcgagcagaacgcggacgaatatccggaaggctacgaggcggcgcgcgccgccatccgggagaagctggttcgggggcggtatggggcgctggcggcggaagagctggcgcaggtgcgggcctcggcgcaggtgcgccgcgtggcgccctttgcccgggaggcaagtcgatgaggcggatgcgcgaggagtcggcgcccgaggcccggcacggctacaccatccggcagatggcggcggaggacctgtccgcggtcatgctgctggagcaggcctcgttcaagaacccctggtcccaggacctgctcaagcgcgagcttcagcacgaatggtccaccatcctcctcgtggaggaggagcgggaggcggacgggccggagctgctgggcctggccatcttctggatcgtccatgacgaggtgcacgtgctgaacgtggccaccgcgcccaagcaccggcgccggggcgtggcgcgcgccgtcatggacgaggtcctggcgcgggggagggccaagcgctgcacgctggccaccctggaggtacgcaagagcaacgaggccgcgctccagctctaccgggcctttggcttccgccccgtcggcatccggccgaactactacgtcgacgagggggaggacgccgtcgtgatggtcctcgacttctaaccgcacgcggagtagaggaccgccccgttgtagaccagccgtgcgcggaagcgccgaggcggggaatgggacctgggaccctggccggttgtaggcaagggacaggccgtgcttgacacggataggccccttcctatactcgcgcgcctttaccgttgtcttgtaggtagatatgcgccgcctggtgtctctggcggcgacgaacccgaagaagaggtatcagtgccgaccattagccagctggtccgcaagggccgcgagaagctcgtcgtcaagggcaagagccccgcgctcaaggagtcccctcagaagcgtggcgtctgcacgcgcgtgtacaccacgaccccgaagaagccgaactcggccctccgcaaggtggcccgtgttcgtctgacgaacgggatcgaggtcacgtcctacatccccggcgtgggtcacaacctccaggagcactcggtggtgatgattcgcggtggccgtgtgaaggacctcccgggcgtccgctaccacatcgtccgtggaacgctggactccgtgggtgtcgcgggtcgcaagcagagccgctccaagtacggcgcgaagcgtccgagctgatcgctcgtcacgcggatcaccttctgtagcgcagagtccggacgcatcgccccgcaccctggggagcgtccttgtgaagttcctcctgcagtgcttgaagccccgtggatttctcccaatgggagtggggcgtaagggaagagagaagagatgcctcgccgtcgcgtagtcgccaagcgcaagattcttccggatccgaagttccaggaccggctcgtcaccaagttcgtcaacgacctgatgcggaagggcaagaagtccatcgcggaaggcgtttgctacggtgccttcgccctcattgaggagcgcgcgaaggaagaccccctcaagaccttcaagaaggccctcgacaacgtcaagccggtgctcgaggtcaagagccgccgcgtcggtggcgccacctaccaggtgcctgtcgaggtccgtcaggaccgccgcgtggcgctcggcatgcgttggatcatcacctactccaaggcgcgtggtgagaagaccatgcaggagaagctggccggtgagatcatggacgccgccaacaaccgcggcaacgcggtgaagaagcgtgaagacacgcacaagatggcggaggccaacaaggccttcgctcactaccgctggtaggccctagaggcttcgcggtgaccgcccgggtgcagaggatgcatccgggcggttttgttagatgaagcaggttctctgaatccgtccggccggcaggtgtcgaggcctcgggcccgcccttcctccctggagaggtattgagtcatggcccgtgagtaccccctcgatcgctaccgcaacatcggcatcatggcgcacatcgatgccggcaagacgacgaccacggagcgcattctcttctacaccggcgccatccaccggatgggcgaggtgcacgaaggcaacaccaccaccgactggatggtccaggagcgtgagcgcggcattacgatcacgtccgccgccatctccgccttctgggcccggcacgaccagcgctaccgcgtcaacatcatcgacacgccgggacacgtggacttcaccatcgaggtggagcgcagcctgcgcgtgctggacggcgccatcacggtgttcgacgcggtgaacggcgtggagccgcagtcggagacggtgtggcgccaggcggacaagtacaaggtccctcgcatctgcttcatcaacaagatggaccgggtgggcgccgacttcgagatgtccgtggggaccatccgcgagaagctgggcgcgcgtgcggtccgcatgcagctgccgctgggcgcggaggacaagcaccgcggcgtcatcgacctgctgaagatgaaggccctggtattccaggactcggagcagggcagccactacgaagagtcggacatccccgaggagttcaaggaggcggcggatgctgcccgcgccgagctgctggaggccgcggccgagcaggatgacgcgctgacggagaagttcctcgagggcgtggagctgaccgaggacgaagtgcgtggcgccatccgcaagggctgcctgggcctgaagctgttcccggtgttctgcggttcggccttccgccacaagggcgtgcagccgctgctggacgcggtggtggactacctgcccagcccgctggaggtgccgcccatccacggcaagacgcccaacggcgaggatgccgtgcgcgagacgcgggacgacgcgcccttcagcgcgctggcgttcaagatcatgaacgaccccgcgttccagtcccagacgctgacgtttctccgcgtgtactccggcaagctggaggcgggcactgcggtgtggaactcggtgaagggcaagcgcgagcgcatcagccggctcgtgcagatgcgcgcggacaagaaggacgaaatcaccgagtgctatgccggtgatatctgcgccgtggtgggcctgaagctggccggcacgggcgacacgctctgcgacgacaagcagcccatcatcctggagcggatggatttccccgagccggtcatcgacatcgccatcgagccgaagtcgacggcggaccaggacaagatcctccagtcgctgcagcgcctggccatggaggacccgtccttccgcgtaaggacgaacgaagagacagggcagacgctcatcgcaggcatgggcgaactccacctggaaatcatcgtcgaccgcctcctgcgcgagttcaaggtcgacgcgaacatcggcaagccccaggtggcctaccgcgagaccgtcaccacgcaggtggagatggaagggaagtacatccgccagacgggtggccgaggccagtacggccatatctggctgcgcgtggcccccaatgagccggggaagggattctccttcgagaacaaggtcaccggcggcgtggtctccaaggagttcgtcgacgcggtgaaggccgggtgcgccgaggccatgcagaacggcccggtggccggctaccccatggtggacgtgaaggtggaggccttcgacggctccatgcacgacgtggactccagcgagattgcgttcaagatcgccggctcgctggccttcaaggacgccgtgcgcatggccacgcccgtgctcctcgagcccatcatgaactgcgaaatcgtcacgcctgatgacttcatgggcgacgtcatcggcgacctgaacgggcggcgtgggaaggtgcaggggatgaccccccggcctggtcgtgtgcaggccatccaggcgcaggtgcccctggcggccatgttcggctactcgaccgacctgcgcagccgcagccagggaagggcgacctacaccatgcagttcagtcactacgcgcccgcgcccaagacggcgctcaaccgctgagtggcttcggcccggccgtggaccggtcgggcgatttcagttgacgttgtggcaggtttggagcaggacgcagcaccttcgcagttgttttccgcgagtcgagacgtgccgggctttggaccggcaaccccgtgaggagaggccatggccaaggaaaagttcgagcgtaacaagccccacgtgaacatcggcacgatcggacacgtggaccacggcaagacgtcgctgacggccgccatcaccaaggtgctggcgaagacgggcggcgccacgttcctggcgtacgacctgattgacaaggcgccggaggagcgtgagcgcggtatcacgatttccacctcgcacgtggagtaccagacgtcgaaccggcactacgcccacgtcgactgtccgggccacgccgactacgtgaagaacatgatcacgggcgcggcgcagatggacggcgccatcctggtggtgtcggcggcggacggcccgatgccgcagacgcgtgagcacatcctgctggcgcgccaggtcggcgttccgtacatcgtggtcttcctgaacaaggtggacatgctggacgaccccgagctgcgcgagctcgtggagaatgaagtccgcgacctgctgaagaagtacgagttcccctgcgatgacatccccatcatcccgg

SEQ ID NO: 1188 - DNA, 21010 bp, Myxococcus xanthus
  unsure (1)..(21010): unsure at all n locations
tacggccgcacgctggagtcggagatggcgccctacctggcgcatggcctgctccacctgctggggcacgaccacgagcgcccccgggatgccaagcgcatggcggccctggaggaacagctcctgggcgagcgaggcatggtggcggactcgctccaggtggatgccaaggcccgccgcgctcgcagcctcatgtaggccctccgccggctccccgctggacaatccagtatccatcccgttgagccgggcggcgtgcgtgataggtaggcggcctcccgcgtgttggaccaagccatgctccgcccatcactcatcgcctcctgcctgctcggcctgctgctcctggcggcgcccgcgcgcgcggcctccatgccgccgtggggcacgggagaaagccagggcgaggacctggccatcctcctggtgacgttcagtcccggggatgacgtgccgtcctggtggggccacggttcgctggtggtggaggaccggcggcggcagatgtcgcgcctctacaactacggcatgttctccttcgacgaggccatgctcgcgcgcttcgccatgggccggctggagttctgggtgggccagtcgtcggtggggggcaccttccgcttctaccaggccgaggaccgcgacgtccgcgtgcaggagctcaacctcacgcccgagcagcgcgtcgtcgtggcgaagcggctggcggagaacgtgctcccggagaaccgcgagtacctgtaccaccactacaacgacaactgcgtcacgcggctgcgggacatgattgatgtggccacgggcggccagctccgcgaggcggaccgggcaccggggcggatgacgctgcgcgagcacacccgtcgctacacctcggtgaacgcgcccatgagcgtgctgctcgacttcatgatgaacgacgagatcgaccgtcccatcacgaagtgggaggaggccttccttccggatgagctggagactcaggtcgcggcgctccaggtgaagggcgcggacgggcagacggcgtcgctcgcggcgaagagctggaactactacgaatcctcccgacgtcagcgtccgccggcggcgcctcccccgtggggcccgtggatcctcgcgttgggcctggccctgggcggcctggccgtcgggctggcggtgtgggagcgccagcggggcagccgcgtggcccgcctgctgctcgggctggagaacgccgtggtggggctggcgctcgggttgccgggcaccgcgctgttcatcatggggttggtgacggaccacacggtgacgcaccgcaatgagaatctcttcctggccaacccgctgacgctgctggcgctgcccttcggcgtggcgctgacgtggggcagccagaaggcccgcatgcgcctgttcaaggtgtggacgctgctggccgccctgggggtgctgggcgtggtgctcaaggtgttgccgcccttcgaccaggacaactggcggctcatcgcgctcatcctgcccatctccctgggcatggcgggcgcattcggtctggaccgagtactggcgcgcctccccagggcggaccgcgcgtcagccggacggcgggatgccgtcgcatcgctgaagactccttagaggacacggaaagaagccatggcgaacgattcgatggagaagatcaacggcctcagggagcgtgtgttggcgctccgggggcatctttcacctcgaccgcaagcggtcccgcatcgcgctgattgaacgcgactccacgctgcccaccttttgggacgacaacaccaaggcgcaggcgctcttgaaggagaagtccacgctggaggccagcgtcggcgcctacgacaaggtgatgcgcggcctggatgacgcgcaggtgctcttcgagctggccgtcgaggccaacgacgaggccaccacccaggaggcggaaggctccctcacggggctggagggtgacgtcgccaagctggagctggcgcgcatgctgtccggcgagcaggaccgcagcagctgcttcatggacatcaacgccggcgccggtggcacggactccatggactgggcggccatgctcctgcgcatgtacacccgctactgcgagaacaagggctggaaggtcgaaatcaacgacgaggtgccgggtgaagaggcgggcttcaagaacgtctccctgcgcatcgaaggtgacttcgcctacggctacctgaaggcggaagtcggcgtgcaccggctggtgcggatttcgcccttcgacgccaacgcgcgccggcagacggccttcgcgtccgtggacgtctatccagaggtggatgacaccatccagatcgacatcccggagaaggacatcgatttgaagttcatccccgccgccggcgcgggcggccagaaggtgaacaagacgtcgtccaccgcgcagctgcgccacctgcccaccggcatcatcatcacctgccagacggagcgctcgcagtcggccaacaaggacatggccttcaagattctgcggggccgcctgtacgaactggagatgaagaagcgcgaggccgcgcgcgacgccgccgaggcgcagaagaaggacatctccttcggctcgcagatccgctcctacgtcctggcgccgtaccgcatggtcaaggacctgcgcaccggcatcgagacgggcaacgtggacgccgtgctggatggggacctggaggagttcgtcacctcccaactgctgggcgtgaagaaccccaaccgcagcgcgggcgcggactaggcgccgggcctcaccatttcctcgccttcgcccggaaccttttccgcggccctgctgtccgagggccgcggggcaggggaccaaggtaggctgagggacggtggcacctcctgcggaggggctgtcgcgggaggacacgcgtgtcatcgggcggcgtgctcgaaatcggacaggaagaggccgccgcggacgcgcccgagtcgcgccgtcaggacgcggcgctgctggcccggctgcgccggggggagccggacgccttcgagctgctggtgcgcacccaccaggaccggctctacgatttctgcgtccgcatggtgggagaccgtgaggaagctcacgacctggtgcaggaaatcttcgtcagcgtgcaccagaacgtccgccgcttccgcgaggactcgaagctgtccacctggctgttccgcatcacccgcaaccactgcatcaaccggctcaagtacctgaagcgccggggccggggccgctccgaagtgttcgacgaggccgcggccctgctctccgaaggtgggggcaccgcgcccggcccggatgcggccctggaatccgcgcgtgagcgcgcccgggtgcagtgggccatctcccaactggagccggacgcacgcatgctggtggcgctgcgcgacatcgaaggcctcagctacgacgaaatcatcgacatcaccgagctaccggagggcacggtgaagagccggctccaccgggcccgggaaaagctggcggacctcctggggcggcttgagccatgaacggcattcatcgcagactgcgggacgtggaaccgcggatgaaccatcgcgaggcgagggccctgttcctcgcgctcgccgacgacgagcttcccgcccccaaggcgcaggaggttcgcacccacctggacggctgcgacgactgccgccagggctggcagcgctattccagcacggtgcagcggctccagcgcgtggagcgtgagaaggccccacccgcgctcgcctccctggtgatgaaccgtgtgcgccgcaagcgccgcttcggtctgcggggcctgcacaccctgcatatgaactaccggctcccggtggaggtcctcatcccgctgttgctggcggccgccgtggccgccttcctggtgatggtcgatccctgagcggccatccgctgtgttgcgttgcttcccgggggaggcttggctacggtgccgcgcctttgggaaagcgcgtcatggccgagaccgaaaacaagagcgagaagagtgcgggcgagggcgacctcgggacgaaggaacaggaaatctacgaccagcggctggagaaggccgcgaagtggcgcgaggccggcttcaatccgtacggcaacggctaccgtccccagcaccaggccgccgaaatccacgagaagcacgccgctcagtccgccgaggaaatcgagcaggccgcgcctccgccctatgacgtcgccggccgcgtcgtggccatgcgctccttcggcaaggccgccttcatcaagctgcgcgaccgctcgggcgaaatccaggtccacatgaagaaggacgccttgggggactcctatgagaccttcaagctctgtgacttgggcgacttcctggccgccaccggtccggtgttccgttcgaagacgggcgagctcacgctctccgccacgaagttcaccccgctcaccaagtccctgcgccccctgccggagaagtggcacggcctgacggacgtggaggtccgctaccgtcagcggtacctggacctcgtgtccaacccggacgtgaagcagaccttcctccggcgcaacaagctcatccgcttcatccggaacttcctcgacacgcgtgacttcgtcgaggtcgaaacgccgatgatgcacccgctcgtgtccggcgcggcggcgcggcccttcaccacgcaccacaacgcgctcgacattgacctgtacatgcgcatcgccccggagctgtatctcaagcgcctggtggtgggcggcctggagcgcgtctacgaggtcaaccgcaacttccgcaatgaaggcatcagcacccggcacaacccggaattcacgatgctggagttctatcaggcgtacgccacgtacgaggacctgatggacctctccgaggagatgatttcggaggccgccaaggccgtcaccggcgacacgaaggtgaagtacggcgaccacgtgctcgacttcggcaagggctggaagcgcatctccatgacggaggccatccgcgaggtggtgagcggcctgtccgacaaggacatggcggacgcggaccggctgcgccacgaactgctcaagacgagccactcggaggccgagcggcgggccatcgacacgatgaaccacggtgagctggtgggcgcgctcttcgagcaccacgtcgagcacacgctcatccatcccaccttcatcacccatttccccaccgccgtctcgccgctggcccggcgcaatgaccagaacccggacgtgacggaccgcttcgagctgtacgtggcgggccgcgaaatcgcgaacgccttctccgagctgaacgacccgctggaccagaagggccgcttccaggctcagctggacgcgaagcagcggggccagcaggagaccatggactacgacgaggactacatccgggccctcgagcacggcatgccgcccaccgccggtgaaggcatcgggattgatcggctcgccatgctgttcacggattcgcagagcatccgggacgtcatcctgtttcccctcctcaagccactggcgaagtagccaggaggccgcgtgcactccgccgaacggcagaccgtccatcgctggaccttcatctggattggggcgctggtcgccctggtgggcttcagcctgctcggggtggcgctcacgtcctctcaagcttggctggagaccagctcctccctggggctgtccctgctggggtggggcgggctggtccaggccctcaacgcgctgctgctcgtgtccgagcagcccgtcgcgacggtgcccaacacgggcctcctcgtcgcgggctccgtcgtctggctcgcggggtgggcgctcatcgccgccggcatccgccgcgcgccggagcccaccgaagggcccagcccggctgcgggcgccacgctgtacccgcgcctggcgcgctaccgggacttctactggagcaccctgggcgcctacggcggcggcatgctgctggcggaggtggtcctcgtcctcctgcagacggtgctgtccagcggcgtgtccgccacggagctgggctcggcggggaagggcgccagcggcggtttgtcgctgccgcccaccggggccttcgccatcgcgctgctcgcgggtggcatggtggccttcatctccggcttcatcggcgcgtcgcgcgcgcagcggctgtcgctgcccgaggccaccatcggcgtgctgtacctgggcctgcccatccccatcatcctcacgttgatggagcggctgcccgggctgcagctcgcgctgggctaccggctgcgcgaggtgacgtacgtcgcggggctgattggccgcccggagctggggtactggctcgtcttcaccttcctggtgctggcgctggtgctgggcatcaacaccggcttcatcgccgccggcagcggccgggtggacctgaagctggggttcgagctctttgtcgcgcgccggcacgtggcggtgttccggccgtcgctgctgctggggacgctggcggtgctgatgctcggcatcatccccccgctgctcatctacttcatcattcgctcggcggaagcggccgtggagcgcacccgcattcgcgagctgggcctgaaggacccgttggcggccgcctccgacctcaaccgcctcaagcttcgggagcagtcgcccaccatgatgatgaccgccctgtccgtgggcggcgtgggcgtgggggtgatggcgctcatcatcgtcctgtcggtgatgagcggcttcgaggccgacctgcagcagaaaatcctgggcaccaacgcgcacgccgtggtgtccaagtacgcgggcgacctgcccgagtacgccaaggtcatggagtccgtccgcaaggtgcccggtgtcgtgggacagacgcccttcatcatcaaccaggtgatgattgcgtccgagggcaacgtggacggcgtcatcatcaagggcatcgacccgggcacggtgggcgaggtgacggacctgcccaagaacatcctcggtggcggctcgctcgacatcctctatacgccggagaagatcgtccaccgcggcctgccggacgaggagcccgcggaggagagtggggtcgaggaggacgacatcatccgccgctccgggacgcccaagaaggcgccggtgctgccgggcatcgtcattggccgtgagctggcggcgtcgctgcgcgtggtggtgggagaccgggtgaacgtcgtctccccgctgggcaccgagctggggccgtccggcccgattccgaagagccgcgccttccgcgtggcggccatcttctactcgggcatgtacgagtacgactccaagttcgtctacatcctcctcaacgaggcccaggacttcttcgacgtgaagggggccacgggcatcgaactgaaggtggcggacatcgacgatgcgcggcgcatcgcctcgcaggtggtgaaggtgctgggcggctatccctaccgggcacgcgactggggagagatgaacaagaacctcttctccgcgctgcgcctggagaagctggtgatgggcatcatcctctccatcatcatcatcgtggccgcgggcctcatcgtcgctaccgtcatcatgctggtgctggagaagcggaaggagatttccgtcctcaaggcactgggggtccccgatggcggcatcgtgaagatattcctcgcggagggcctgcagattggcgtcgcgggcggcttcctcggtctgatttccggcctgtcctggtgcgtcttcatcgagaaggtcggcatcaagctggacccggacgtctattacatcccggcggtgccggtgcgcgtcgagccggtgcagaccgtgctggccgtcgtcatcgcggtgctcgtcacctacctcgcctccatctacccggccctcaaggccagcagtgtggagccggtggaaggcctcaaggcggagtagccatggcgctcttgtccatccgcaacgtcttcaagagctacttcctgcacggcaagcgcatcgacatccttcgaggcgtctcgctggacatccagcggggagagctcgtctcgctggtgggcgcgtccggggcggggaagagcaccttcctgcacgtcctgggcacactggatgccccggccgccggcgaggtgatgttcgaggaccgctcggtgttctccatgaacgacgcggagatcgccgagttccggaaccagaccatcggcttcgtcttccagagccacttcctcttgccggagttcaccgccctggagaacgtagccatgcccgccctcatccggcgacaggaccgcaccgccgcctacgcctacgcccgtgaactgctggagcgggtgggactgggacaccgcgtggaccaccgtccaggggaattgtcgggtggtgaggcccagcgcgtggccctggcgcgcgccctggtgctcaagcccgcggtgttgctggcggacgagcccaccggcaacctcgacccggcgacgggcgagggcatccaccagctcctgcgggaggtcaaccgcgagcaaggcatcaccgccgtggtcgtcacccacaacgagacgcttgcccgctccatgccccgccgcctcaggttggcagggggcgaggtgtcggaggcgtgatgtcctggcaattttgcattgaggccctgctgggccttcccgtagattgccccgccttttcctggccggtctccccttgaggcaccccgttctgtcgcgcaagtcactgctcccgctgctggcggtcgccatgtggtccctcgtgcccggctccgtgctggcgcaagaggatgagggcgccgccgcgccttctgccgtgcccgaggtgaccgctcccgctgctcctgccgacgtggcctccgagcccgcgctccccgatgacgccccggtgtcgccggaggatgcccgccgggtggtggaggtccgcgtcgaaggcaaccggcgcgttgaggccgaagccatccgccgcgccctccgcacccgtgtgggggacgaactgagccccacgcgcaccgcccaggacctccgggcggtgtgggcgctgggctacttccaggacgtggagctgctcgtccagcggctggcccgcggcgtcgcctacgtggtgcgcgtggaggagcgccccaccgtccggctcgtccagctcgtcggcaacgaggagctgagcaaggacgacctgaaggaggagattgacgtcaagccctccaccatcctggacatggagctggtgcgctccagcgtgcagaagatccaggcgaagtacgtggagaagggctacttcctcgccgaggtcagccaccagctcaagcccgtcgagggcggcgccaacgtggatgtggtgttcaacatcaacgagcgcgccaaggtgatggtgaagcagatcaccatcctcggggcggagaagctgtccgcctcggagctgaaggagacgatgatcacccgcgagggcgggttcctctccttcttcaccggtgagggcacctaccgcgaggaggccttccagcgcgacctggccgtcatccagatcgcctactacgacaagggcttcatcaacgtccgggtggacaagcccaccgtccagctctccgcggacaagcgcttcatcttcatcaccctccgcgtgacggagggcgagccgtacgacatcgggaagatcgacttctccggggacctgctcgacgacgtcaccaaggagcagatggcgtcgatgatgaagtccgccaccggcgggcgcttcaaccgctcgcagctgtcgcaggacatcctctccgtctcggacgtctactacgaccgcggctacgcctacgcgaacatcaaccccatcaccagcgtcaacgcggacaaccgcacggtggacctgaccttcgacgtgcagaaggggccccaggtcaccatcgagcgcatcgacgtggtgggcaacagcaagacgcgtgacaaggtcatccgccgcgagctgcgcgtctacgaaggagagctctacagcggcaccggtgtgcgccgcagccgcgagcgcgtcaccgcgctgggcttcttcgagacagtggaaatcacccagcgccccggctcggcggacgacaccatcgtcctccaggtggaggtgaaggagaaggccaccggtacgttccaggtcggcctgggcttctccaacgtggagaacttcatcttcacggcgcagatcgcccagaacaacttcctgggctggggccagagcgtctccgcgtccgcgcagatttccggtctgcgctccctggtgcagctgtccttctacgacccgtacttcctggacacgcgctacctgctgtcggcggagttcttccgcatccaggcggactacgaaggcttcatccgcaattcgaccggtggcacggtgtccatcggctaccagttcatcgacgacctgctgggcaccattggttactcgcgtgagtgggtcaacgtggaggccgggcagaacctgggcgcggtgctgctggccaaccagttcctgtccggaacgaccagcgcggcccgccctgtcgctgtcgttcgaccggcgcgacaaccgcctgttcccgtcgcgtggcttcatccactacggctcggtggagctcgccccggacttcctgggcggtacgttcctctacaaccggtacacggcctactcgcggctgtacttccccatgccgctgggcttcgtcttcaagacgaacgccaccattggctacatccagcaactggaccagaacaagccgctgcccatctccgagctctactacgtgggcggcatcaacagcgtccgcgggtacttcctgcgcagcatcagcccgtccgtgaaggttccccgctccggcagtccggacgcgaccgtcaccgatttccgggtcggcggtaacaagcagctcatcttcaacttcgagctggagttccccatcttcgagaaggccggcctgcgcggcgtcgtcttctacgacgcgggtaacgccttcgcggcgaatgagcgcttcttcgaggaccgccaggaccggctgccggccggtctcttccatgccgccggctttggattccgctggttctcgcccattggccccctgcgcttcgagtggggcatcccgctcaccaagcggccggaggacgacaacattctgttcgagttcactatcggcaacttcttctgataagcccttggcccgtcgtccggcgtccgcgcccacgggcggagggaattgaagatgcccgataggcgtacgtcggagcttgtacccttcctgaggagttgctgaacatgtcgcttcgcaccaccatcgcggccacggccgccgctctgtcgctcgccctcccggtggccgcctcggccgccgagctgaaggtcgcctacgtggacctccagaaagtcatgctggaggtggatgacggaaaggccgccaagtcccgtctccagaagtggctcgacgaccgccagaaggaaatcgacaaggagcagaacgcgctccgcgccgagaaggagacgctcgacaagcaggccagcgccatgagcgcggagagcaaggcccagaaggaggccgagctccagcgcaaggtgatgttgctcgcccagaagtgggagaagagccgcgccgaggccgccaacaaggagcagcaggagatgaagccgatcatcgacaagatcgactccatcatcaacaccatcgccgagcgcgatgacctgggcttcgtcctcgagcgccgcgactccggcatcgtctacgcccgctcgcagcacgacatctccaacgaggtcatccgggcgtacaacagctcgaagaagacggcggcgaaggacgccccgacgaagaagtagccgtcactcccaactcgtgcagaccgctcccatgccccgccagctcggggaactcgccgcccacgtgggtggagagctcctcggtgacccctcacagctcattcacggactcaacgggcttgaagaagccggcccgggagacgtgtctttctacggaaacccgcgctatcggcgccagttcgaggccacccgtgcctcggcggtgctggtgggcgccgacgtgcccccccgcgagggcgtggcgctggtccgggtggccaacccgcatctggcgtacgcgaagctgctgcgcctgttccatgcgccagagcgtcccgccgcgggcgtgaggcccggcgcctgggtccatcccgaggccaccgtccatccggaggccgtgctgctgcccggcgcgtcggtggaccggggcggacgggtgggcgcgcgcacggtgctgtacccgggcgcctacgtgggcgaacaggccgaggtgggggaggactgcgtcctgtaccccaacgtcacggtgcgcgagcgctgcatcgtgggcgcgcgcgtcatcctccacgcttccagcgtggtgggcgcggacggcttcggcttcgccttcaacccggaaggcgaggcggggccggagcacttcaagattccccaggtcggcatcgtccgcatcgaggacgacgtcgaggtaggggcgtgcacctgcatcgaccgcgcgacggtgggcgagaccgtggtggggcgcggcgcgaaactcgacaacctggtgcagattgcccacaacgtgcgagtgggcccgctgtccctcatctgcgctcaggccggtgtgtccggctcggcggaggttgggacgggcgtggtgctcgcggggcaggttggcgtggtggggcacatccgcgtcggtgacctggccaaggtgggcgcgcagtccggcgtcgcgcacgacgtgccggacggccaggtggtgagcggtagccccgccgttccccaccgagagtggctgcgggccagcgccgcggcgggccagatggcggacctgctcaaggaagtgcgcgccctgcggcgccgggtggagacgctggagaaggaaaaggggccgtgatggacatcggagagattctcaatctgctgccgcatcggtacccgttcctgctggtggaccgggtggtggagatcatcccgggccagaagctgacggcctacaagaacgtcaccatcaacgagcccttcttcaacgggcacttccccggtcacccggtgatgccgggtgtgctcatcctggaggcgctggcgcaggcgacggccatcctcgcctacaagagcgagaacatggatccgtcgcgcaagctcacgtacctgatgggcgtggacggcgcgcgcttccgcaagccggtgttgccgggggatcgcctccagttggagatcgaggtggtgcgtcacaagggcgctgtctggaagacgaagggcctggcgacggtcgacggcgcgcgtgtcgccgaaggcgagttcctggcaaccgtcgtggacaaggacgccgacgcggctgagagcgcggcatcctgattcgcgccccgcgagcacgaggagacttcatggctcaggttcatcccaccgcggtggttcatcccgacgcccgccttcacgaaaccgtcgaggtcggcccctattccatcatcggtccccaggtaacgattggtgcaggctcccgcgtggggccccacgtcgtcatcgaaggccgcacgacgctgggcgagcgcaatcgcatcttccagttcgcctccgttggcgccgacccgcaagacctcaagtacgcgggcgaggacacggagctggtgctcggcgacgacaaccagattcgcgagttcgtgtcgctgcacaagggcaccgccggtggtggcggcgcgacccgcgttggcagtggcaacctcttcatggccaactgtcacgtcgcgcatgactgcgtggtgggcaatggctgccgcatcggcaatggctccgcgctcgcgggccacgtgacgatggaggaccacggtataattaccggccttgcagcgcgccatgagataacccgattgggcaagcacgccttgatgtccaggggagccatggtgaccatggacatgcctccgtattgaatcgcccatggagatcggagggagctggtgggcctcaacacagagggcctggtgcgcaccggtttctgcaacgagcagatccaacgggtgaacgaagcgcaccgcatcctgttccgctcgaagctgacgctccagaaggccatggtgcgnctgcgcgcggagctggcgggccactccgaggtggaccacctcatccagttcatccagcagagcaagcgcggcctcacgcgctgacgccgtgagcgacggaggggaatcggcggtggatcggattggcctcatcgcgggcaatggtcggctgccttttctcttcgcgcgcgccgcgaggaagaagggcctggaagtcgtggccgtggcgcaccggggagagacggacccggcgttggcggcggaggtggaccggctgacgtgggtgcgtgtcggtcaggtggaccgcatccagaaggccttccgggaagcgggcgtgaagcaggcggtcatggcgggcggcatcggccgcgtgcgggcgctggcggaagcccggccggacctgggcgcggtgcgcatcatctcccggctgcgaagcttccgggatgatgcgctgctgcgcgcggtggcctcggacttcgagtcgcgcggcgtcaccatcatcgctcccacggacttcctgggtgaggtgctgtgcccggagggccacctcgcggggcctcggctgcacccggcgcaggagaaggacgtggccctgggccgagaggtcgcccatgctgctgggccaggcggacgtggggcacacagtggtggtgcacaacggccacgtcctggcgctggaggcggtggagggcacggacgaggccattctccggggcggcaggctgggtggcaattcaggcactgtggtggtgaagcgctgcaagccgcagcaggaccgccgcttcgacctgccggccgtgggccctcacacgctggaagtcatgcagcaggtgggcgcgcgcgtgctggcgctcgaggtgggacgcacggtgctgctggacgccccggtcctcttcgcgggcgccgagtccaggggcatcaccatcgtcggcgtgccctgagccccggcggcgggtgacggagcgggacctgcccgttcaggtgtgggacggactgcgaccagcagggcctcgttcccctgtccgggctcccctgggatggggggcgattgaataccgttgcacctccaacgtcccccacggggagcgtttccctgcacgccacctcgtcctaccctcgcggagcagtccatccacacgtgccgcggttggtcgcggcccgtgacacccgaggcctacaccgcgccatgaacgcccgcctgctgctcctcgcctttgtcctgtcttcgccgatgccggtgctcgcggacgccgttcgagtctccctggaggggcgcgccgtgctgggggagaagctcccggcgctgctggtccacatcgaggagcccatcgcgggcttcgaggtgaagctgaagcgcagcgacggccaggacgtggaggtgaagggcggcgggagtccgggcctcacgcgccgcatcgagctgaatcagccggaaggccgcttccgctacgagggagcgctcacggtgcgcttcccggatgcggaatccggcgtgatgccgttgtctttcgacacggagctctacggcacgctgaagctggacgtccgcaaggaggacgtggacgtggccgcgcgccggctgcgcttcgtcctgtcccggcccgcgaagcgcgcggagttgacggtgttgatggacaccgggaagaaggccttcgagggcgaggtgccattcaagggggaggcgggggggacgccactggagctgacgtggccggcggcggaggggcgggtgatgaagatctccctccgtgcgttcgacacggcggagttctacacgggcgtcgacctgtatccgtggcaggtggacattccgcacgaggaggtgaacttcgcctcgggccaagcggacattccggcgacggagcggggcaagctggacaagagccacgccctcatcgtggacgcgctgacgaagtacggtcgcttcgcgtcgctgcggctctacgtgatgggacacacggacaccgtgggggccgcggcggagaacctggacctgtcggtgcggcgggcgaagagtctggcggcctatttccggaagaaggggctgcgggtgcccgtgtactacgaagggctgggagaagaggccccggccgtcgcgacgcccgacgagacagcggaggcgggcaaccgccgcgcggaatacatcatcgcagtggaggagccggtgcttcagcacgcgcctcgccccccgcggtggcggaagctgtagcgcagtcatcgagggagaggaaaggacgcatggaccgattccaccagaaggcatgggcgttgctcgggctgggggtgctggggagcacgggatgcgcgcaccaggcgcgtctcgcggagcgtcagggcgtggaggctgagaagtgtgagctcgtgcaccggctgctgcgggagccggtgccatcccaggtcgtccgcgaagtcgtcgcggccggtcgcgatgagcccgcgccggtggtggtgtacgtacgccgtccggaggaggcgatgctggagcgcttcttctccggtgacgcgcccagttgtggcgacgccaccttcaaggtggtgcaggagaacgtgctcgacgcggtggtggtgtacctgcaggagatccaggacggctacgcgtacgacgcgcaccgcgccagccacgacgagctgtcactggagggcaagccgcagggcctgctgaagcgcaagggcccagagtgggtggccatccccggacctacttgaacagctccttgccaccgtccgcgatgaactgcaccgcgatggcggccaggatgagtcccatcacccgctcgacgatggccacgccggattggcgcagcacgcgctggatgagcccggaggcgcggaggatgaagtagctggccacgaacgtcagcacgacggcggccagcacggggatggcggagacgagcgtgtcgcccttggccatcagcaccatggcggtggcgatggcgcccgggcccgccagcagtggaatggcgagggggacgatggccacgtcctccttcaccacgccttcctgttcctcggacggcgtggtgcgcgtctccgccgggcgggcgcgaagcatgtccaacgcggtgatgagcagcaggatgccaccggccacccggaaggcgcccagcgacacgccgaacaccttgaagatgacgccgccgaagagggcgaagaacagcatcatcccgcaggccaccaggcaggcgcgcatggcagtgcggcgcaccttctcctgcgagtccccggccgtcatcgccaggaacagcgggacgacgccaatggggtccaccacgaagaagatggccgacagcgagacgaggaacagcgacgcgtattccggcatgacagcctgggcttacaccgtgagccgcagcttccacaccatggtgagagcctcggcgaagattttcttgctcatcttggagtgacccacgcgccggtcctcgaagacgatgggcacttcgcgcacggtgaagcctttgcgcagcgtgcggtaggtcagctcgatttgaaacgcgtaaccggtgctcttcaccgaatccaggtcgatggcctccagcacccggcggtggaagcacttgaagccgccggtgaggtcctggatgcccacgcccagaatcgaccgtgcgtagaggctgccaccgcggctgatgagctgccgccccacgccccagttcaccgtgccgccgcccgtgacgtagcgcgagccgagcaccaggtccgcgccagcctcggccgcatccaggatgccgggcaggtagcgcgggtcgtggctgaagtcggcgtccatctccaggatgtacgtgtactgctcggccagggcccaacggaacgcggcgaggtaggcgcggcccaggccctccttcttctcgcggtggaggacgcgcacgcgcgaatcctgtgcggcgagcccatccgcgagttgccctgtgccatcgggcgaattgtcgtccacgatgaggatgtcgacccgggggtcggtctccagcaccgcctggacgatggcctcgatgttttcccgctcgttgtacgtggggatgcagaccagggctgggttcatgacccggccgacataccctaaacgcggcccgggggcagcagctccagtacggactccgccgcccgggtggccgcgcccgtctcgcccagccggccgcgcatctccgccaacccctggagcatctcctcccggggagcaccgggtatccagacgcggcggacctcctcggcgatgcgctcgggcgtcatctccccctggagcagctcggggacgacgcgtcggcccgccagcaggttgatgagggacacgaaggccaccttcagcatcaaccggcccacccagtacgtgatgagtgacacacggtagacgaccaccagggggcgctgcatcagcccggcttccaggacggcggtaccggaggccaccaccgcggcgtcactggcgcccacgacctcgggtgcccgtccctctaccaggatgggcgtcacgccactgccttcgaagcgggacgtgatttcctcccggtcgatggtgggcgcgagggggacgacgacctggagtccgggccgctcggcggagaggcgtttcgccgcctccaccatgtcgggaagcagacggcggatttcgcccatccggctgccgggcagcagcgcgagtgtgggggcgtccttcgacagccccagccgctcgcggaaggccgtggccgtatccggtgagggaacctgctccaccaccgggctgccgacgtagcgagcgctgacgccggcctcccggtagaagtcttcctcgaacgggaggatgcagagcatccggtccaccaaccgtttgatggtgcgcacccgaccccggcgccaggcccagatcatgggcgacacgtagtaggcgacggggacccccagcgccttgagtttcttggccaggcgcaggttgaagtcagggatgtccaccaggatggcgacgtccggtttgcgctcggcggcggcctcggccaggcccttcaggatttgaaggatgcggggaatccggggcaggacctcggtgatgcccatgacggacacctcccgggcgtcgaagagcagctccactccctgggcggccaggcgggcaccgcccatgccaaagaaggtgaggtcgggacggcgggcccggagggcggcgacgagctcggcggcgtgggtatcgcctgacgcctcgccggcgacgacgaggatgcggggtggattcgtcatgtgagagtcgcgcatcgtacctgatgcgggcgcgggtgaaggtgtagactgtggcccccttgaagacgcttctgctcgccgagagccatccccccacgctcgagcacctcaaaggcctgctctcccaggctgggtacaccgttcgcgcggtgaacgatccggtgacggcgttggagcacttcgcggcggacaacccggacgtggtggtgctgtcggtggaccttccgcgcgtggaaggcgcacacgtggtgcatctcatccgaggccacggacagggtggcagggtgcccattgtcgccatcgacaagggacacctggggcgcgcgcggggcgtgagctcggtgctggacctcaaggtgaacgcctatgtgtcggacccgctcaagccgggcgagctggtgccccagctggaggctctggtgcgcgcagcgcaggcggtgcagctcaccaggctggggggcacgctgtgccagcccagcatcaattcaggcgcgctgaagggccaccccctgccggcgctgttccactccatctatcggttgcgccgggatggtgtgctcgtggtggcgcaccggggcttgagccggcgcgtgtacttcttgcgcggcgggtccgtgagctatgactccacggcgaaagcggactcgctgcctggctacctgcttgcccggaacgtgctcaacccgcagcaggcgcagcgggtgacggaggcgctggactccggtctgcgcatcggcgcggcgctcgcggacgcgggcgtggaggcggcgggcgaggaactgctgcagctcttgcgcgactacaaccgggacagggtggagcgggtgctggggatgcgcgagggccgctacgccttctacgcgggagacgaattcacgtcggaggtcgcgtcggtggaggttccgccgctggcgccggtgctggatggcgcgcgccgctgctttaccatgagggtgatggcgggcgcgctgcgggcgcacatgggcgactacccagtgcgctcacaagagttcgggcgcgacctgcaggccatggggctggacacggacgacctgaagatcgccatgcaggtcaacggccgcatcgcgctgaaggacctgctggcgcacgggcgtggcgagctgcgcatggcgtactcgctgctgtggttcctgaagctgacgggtggggtgacgttctcctcgacgcccgtggccacgggcacggacgtgctgtccgcggcggtgctgccggaccggatcgcgccgcgcaagcgcaaggccctgccgcccgagacagcggcctcgctgcgtgaggaagcgctgcgcatcatcacccgcagctacttcggagggctggggctggacatcgcggcggacgcggaggcggtggagcgcgcctatcacgagacggcgatgcgctttcatccggacacctacgccgagttcgacatctccgacctgaaggacctgctggagttggtgcaggacccgctgtccgcgtcgtaccgggtgctgagcgtggaggagaagcgcaaggcctacctccagtacctcttcagccggatggaacgtgggggcggaacgcggcggtggtcgtggatgcggaaatcgcgctgcgccggggcgagtccgccctgaagcgccgcgacttcccgctggcggcgaaggccttcgaggaagcggtgtcgctcaatccggacgagccggagtactaccccttcctcgcctgggcgacgtaccggatgcccacgggggcgccgatggtgcgggctttagagcacaca

SEQ ID NO: 1189 - DNA, 20757 bp, Myxococcus xanthus
gcacaactgcgctggagacctctccacgaacagcggccccctccttccgggccgccggtcaggattcgtacgctcgtatccgcggcttgagtggcgcggagggtgggacgtgtctgtccggcggacggaagtgcccgccagacgcgcaccaggaagccaccgtcatggacccaacccgcaatgcctttcccgagaagaaccgcaatctcgccgtgggctccgcccggctccaggaagtccagaaggcggtccattactacgtggacaaccatcactgtgacgtcattggacgggtgtttcacgggatgccgggccgggaggcgcgcgtcagcttcagtccgacgcgccgggatgtgaggctgaacgcggagggacctcgggacgtcctccacttcggctcctacaactactccgggctgaacgggcacccgcgcgtggtggccgcggcggaggcggcgctgcgccgctacgggacgacggtcagcggcgtgcgtctgctcaacgggacgtgtgagctgcacctggagctggagcgcgcgttggcggagttcctgggcttcgaggactgcgtcacctacagcagcggctacgcggcgaacctgtccgtgttgtccgcactgtgtgctgagggcgacgtggtgctgtcggacatgctcaaccaccagtccatcatcgacgggctgaagctgtccggcgcggacatccgcacctaccggcacaagagcctgcgcagcatcgagtccacgctgaagaagctgccatacgagcagcgcaagttcatcatcaccgacggcgtgttcagcatggacggcgacgtggcggacctgccgggcatcgtggcgctggcggagagctacaacgccttcatcctcgtggatgacgcgcacgccaccgccgccatggggcccaacggccgcggcaccccggcctatttcgggctccagtcgcaggtggacgtgctcaccggcagcctcagcaagggcctgccgggcatcggtgggttcgccgccggctccaaggccaccatcgacctgctgcgcttcggctccaacggctacatcttctccgcctcgctgccgccgcccatcgccgcgggcctgctggagggcatccgcatcctccaggagcagcccgagctccaggagcgcctgcaccacaacgagaactacctgcgcgccggcatccgctccatgggcctggactgcatgaacagcgagtcccccatcatccccatcctgatgcccgcctacgagaagacgttcgagctgacgcggctgctccacctggagggcatctacgtcaacccggtgggctaccccgccgtgagcaagaaccgcacgcgcctgcgcatcaacgtcagcgccaacctcacccaggcggacctggaccgattcctggacgcgctggaccgctgcagccgcaaactcaacctccaggacgcgccgccgctccagcagaccggcacctgagccggcgccctacgccacccacgccactggaagacccgccatggacctcaaggaacagctcctctacggcctgcccgtgttcctcgctcccatcctcatcgagctggtggtggggctcttgcggcgcaagccggcctaccggctcaatgacctgctcaccaacgtgacgatgagcctgctcaccgtcctgggcagcgtggtcatcgcgggcgccaccttcgtcttctacggctacgtctacaagcaccacgccctcttcagcctggcgaaggactccgcgtggacgtgggtggtggccttcttcgcctacgacttcttctattactgggcgcaccggatgcaccacaccatggcgtggatgtggggcgtccacgtcgcccaccactccggcgaggacatgaacttcggcctcgcggtgcggcagagcgcgctgggtgagctgaccacgtggcccttcttcgtgcccatggcgctgctgggcatcgcgccggaggtgttcctgggcatcaccggcatccagctcatcttccagtacgccatccacaacacctacgtgccgccgctgggctggctggagtacgtgctcgtcacgccctcccagcaccgcgtccaccacagccgcaacacgccatacatcgacaagaactacggcaacatcctcgtcgtctgggacctgctgttccgcacctaccagccggagctgaaggaccagcctcccgtctacggcctgcgcagcagcctgcgctcgtggaaccccttcaccgcgcacttccactacttcgtggagctgttccagaagtccgccgcctgcgcgcggctggccgacaaggtgctgtgcttcatcaaggggccggactggaacccgccgtcgctgcgccaggagcgcttcaccggccccccggatggcggcccgtccgccaccttccagaagtacgacccgcgcctgcccttgcccgtcaccgcctactgcgtgacacagttcttcagcctggcggccagcatcctgctgctcgcgtggtacctggacacgctcagccccggggcccgcgccgtaacgctggggctggtcctcttcggtacctggagcctgggcgcgctgatggactcgcgcgccttcgcgtggcggcaggagttcgcgcggctggcgggtatcgcgctgctgggtcccgccctggcgctgatggagggcgttccgctggtcagcgcgctccccatcctgctccaccccgccctcagcgccgcgtggctgctgcgcttccgcgccgcgttccacgaaggcgctgacacctccacgcgaggctccagcgccctggccgcctgaaagccccgtcccctgtttcgacgtccccaacccacccgaaagacatgaccgcgtccgcacccgtcaccggaagcgctcccgccttccacaccttcccgcgccccctcgacgtgcgttgggtcggctccatcaacgacatcggccgggaggactggcacacctgcttcccacccaccgacgtgatgcagtccttcgagctgcaccaggccaccgaggccgccagcatcgaggacgtgcggttccactacctggtcctccggaacgagggcgcggtggtggccatcgtcccctgcttccgcttccggatgtcgctgacggtcatcgccccggagaacgtcaacaaggtggtgtcccaggtccgccgcgcgttcccggacttcctcttcctgaacgcgttcgtcatcggaacgcccatcgccatctgcaaagacctgctgggcgtgcgcgcggacctgccgaaggcgcggcgtgacgacgtgctgcgcgccatctcccgcgaggtgattgcccgcgcccggcacctgaagctgggcctggtcttcatgaaggagttcacctcccagaagctgcccgaagtgaaggacgtgctgtccccgcgcttcaacttcgtggagagcgcggccaccacctacctgtacctgggcgagcccgggaagagcaccttcaaggagcggctgcgcaagaagtaccgctccctgatgaacaaccgcatggcccgcgtccaggaggcgggcatgcgctgggagaccgtctccgacttctcacgctacgccgcgcagatgcacccgctgtacctgcaggtcctcaaccgctcgaagattcgcttcgagacgctcagcgtggacttcttcgcccagctcccccagcgcctgggcgaccgcgtcttcgcgctcctgtgcttcaagggcgagcagttggtgtccttcgagctgttcctcaaggacgcggagtgggtccaccccatctacctgggcctggactacagcctccgcgacgagggcgcgctgtacttcaacagcatctacaaaatcgtggaggtgctggagtcccagggcaagtcggtggtgcagttgggacagacgagctacgcggtgaaggccagcatcggcgcggtggtggaccggctgtacctggccgtgcaccacacgaacccggtgctggaccagttgctgaagcgcttcggcgcggagctcttcccgcccacgcccctgccccgctcgcagcgcgtgttccgggacatgaaggagaacgacgacggcctggcccgccatggcatccacttcgagcgactggacgcggagggcgacgaatgacggcgcaggcgggcatcaccacgaaagtcgtccctcgcatccaggacgtgccccaggcgctgtgggacgacaaggtggcgcggggccaccccttcaagagcgccgcgttcctctcctgcctggaggactcgttcccggagcggaagttcggctacctcatcgtgtcgcaaggcgcggacgtcgtcggactggcggtcatcaccgaggagcgcctggacttgagcctgctgctgccggagcaggtgggcacgctgaccaagggcgtgcgcaaggtgctgcccggcttcctgtcgctgggcctgggcatggtgggtaccttcgaaacggcggagcggcactggtggtacgacgcgcagcgcgtttccgagcacgacttcgcgcgggcgctgctcgccgcttgcgacgaggtgtgtggcgacgccgcgctgctgctggtgcgcgacttcatggaggccctgcccgaggacgtgcgcctggagtcgtggttcctccagcggggcttcaagcaggtggccaaccaccccatggccatggtggcgctggacgggctgagcagcgaggcccacttccagcggctgaagaagaagtcgcggcagaacctgcgcaagaagctgaaggacgcagaggcgctgggcttccaggtggagcgggtgcgggacttccgccccctcatcgacgagtgctacccgctctacctccaggtccacgagggcgcgtcggagttcaagcgcaacccattccctcgggccttcttcgagaccatcgcggagcggatgcccaccaccagcagcttcctcacgctgcgggattcggccgggcacctgattgccttcatcctcacgggcaccgggggcggcatcaacaaccccttctgcatcggcatggactacgcccggacggaaggcacgccggcctactacctgatgatgtggaaggaaatcgagcacgcggcccgcacgggatgccgcgtggtggtcctgggcctcaccagctacttcgtgaagcatacggtgggcgcggagctggagggcatgacgatggccgcccgcatccagtccgcgtggctgcggcccctgctcaatcccctgctgcccgcgctgctgagcgagaagcagccgcaggagcgacggaagttccgcgtctccaccttcgacgacgactcgcagccccccactgaccaggccgcttgaccatgctccgcttcgcctacggctgcattccctccgtcatgtccctgtacttcgccaacaccctggtgcggcgagcagggctggcgcccgcgtgcatcctcctgtccgcggggggcctgcgcttccagaagaagcgctacaccccggcccaagtgctgcctgtcttcctgaagcagtttggcccgcgcttcaccggctacaacgtgctcgccgggctgagtggctcgctgcccttcagcattcccgcctcggggttgatgagcttccaggcgctctcccaggcgtatggcattccgctggtcatcagtgatgacttctccggagcggccacggtgagcgagctcgagcggcacggggtggagttgttcctcaccagcatgtgcgatcaaatcatccgggagccactgctcagtctgccgcgccatggctgtttgaacatccacccatcgctgctgccggagttccgcggcgtggactccgtcttccaggccatgctgaacggcgtgtctgagattggaacgacactccaccgcaccaccgggcgcatggacgcgggcgacgtgctggcccagagcgcgttcacccgtacggccgccgattcccacctggcgttgacggcgaaggcgaccgccgcgggcattgccctgctcaagcggcacatggagaccctggagcgcggagagacgccggacgcgcgccccatcgacgtgagccgggcgcgatatccctaccgctcctggccggaacgggaggagctgcgccgcttccacgcccaggggaacaccttctggcgggcgtcggacttccgccgcctcctcgccttcgaggacgtgctggcgacatagcgcgacacaaacgacacgccgggcgggagaggctcccacccggcgtggatgcttcggaccgctgactacttgccgcggctgatggactcgctgtggatggtcagcgcgctcgcggcggccgtcaggtcgatggccgagaagctggtgtacgggtagtggccatcgcccagctcctcgacgaactcgacgtggtcaccgctgacctcgcggccgtcgaagtcgaacgtgaaggctcccggcgtcgcactgcggaaggaccacacgcaggcgcccgtggggatggtgtcattgaacccgaaggtcatgtggttgcggaagccgatgtggatgggcgtgaagcggatgtggatgtcgtaccaggacgcatccatcgggaaccagaggccgcggttgatgtgccgaccctggaactgaccgccgttgtacacgtacacactgtaggtcgaaccgcccggcgtgccggtgaactgcggctggaacgtcacctggcccggctcacggccgatgccgacctggacggtgctgaccacctggtcgccatcacgcgccgccagggcgaagccctgtccggccttggcgaggtcctggaagacggccttctgctcccactgcgtcgcggcggcgaagttgctggagacgccgtcgttggcggccttctccaggccggtgacgttgaggcccttctccgtgcgctcgagcttcgcgttgcccgtggcgcagttcgtgatgccggcgaaggtctcaacgcactgcgccttcacaggcgcttcctgggccgaaagcgcgtcagcctcggcaggctgcgactcctcgccctggcaacccgcggccgtcagactcaggagtgctgccgccatcaggcggcccgtcagcttgatgctcatggatgaaaaacctctcgttgggggatgacgacttccgggtctccggtgaagacccggagaccgcgtttgcacccagcgcgccagcggtggcggacggcgccgccgctcggtgcgggctcaccggccaccccgctcgcgagcacgcgacgtagcgcgcgacgtcacaaaaaccggctcctgtggcgagccctgttacaccccaggcagccaaggagcgcctttcatgcggcttcatgaagctcggggtacgggtccaacgagacacctgccggcagtgtgtgccacgggctggctgggttctgggatttcgtaccaacccgccatatcccctatgcttcgtcaccgtcgcccgggagcccggccggacttccccccggagaaggctggaacatgaacagcgccagcgtgaatgaatcccccacggatcgtcgtcgctttcctcggctcgaggcgccgctctatgcccggcccgcgcgactgaggcgcgtggacaagcagcaggtgctggacgccagcctggggggcatccgcatctactccgacgagcagtacacccaggactccgagttggagctggacctgttcctgcgtgacggcacttcgctggagtgcaaagcgcgtgtggcctggatgcgcaagcttcccaaggacgcggtggcgccctttgaagtcggcctggccttcacggacgtaccgccgctggccatggacaagctcaagtcggtgctcgtcgtggatgacgagggcggcccggccgactcatagcttcccggctgcggggacgcccgccagcacttcctccaacacggcccgcagctcctgctccaaccctggcaccgaggccctccggagcgcaccgccgcctctgaagagggacagcccctccaggaatgcgaccaccaacgccgcgcgacgctccaggcgagacgggctgagcccgggcgccagttcacgcagcagcgccacgacacccgcccggaagcccgcgtagaagacggcgagcgcgtccgcgaccatttcatcccgtgcggcgagcgcccacagctccgcgaagagctggcaatgacgcggcgactcctggtcctccagcagggcctccaccgcgcgccgaagccgctccatcggcgcacggccgccttcctccacccgcgcatgcacccgttggctggcggcttccaggtagcgcgcgagcagcgcccgcaccacgtcctgcttcgcggggaagtagtactggaggttgcccacgctgagccccgccctctgagccacccggcgcagcgtgagccccgaatggccctcctccaccagtgtgtcggtggccgcatcgaggatggacgccacccgctcggtccccttggcgtgaacggcggtcccctcgcgaggcttcgacgacggcagcttcccccgcgtggcgcgtggcatcaggccgcctcccggcgcgattgttcctcgaagcggacctggacaccgcacccgcgcagggccgccagggcctgctccggacgcgcgtcgtgctccgggaaccacacgcccgcggcgggaggcggcgcgccatcccatcccagcagtcgctccgtccccagcaccgcgcccacggccgtgaggtgggcctgtcccttcgggtccaccacttcgattcgcagcgctccgcgaggaccttccacgtccgccacccacgccgcctcaccgcccgtgccgctgctggccatcagcgcgcgccgcacggacgtcagacggggatgctggagcagccggagcagccccacctgctggagcgccgcgagcatccaggtgacggtgcccgaatcgaaccccagccgcgtcgacaccgtacgcgcgcccagcaccagcggcagcgtggcctgctcgggcgtgtcgagccggaagacgcgcgtgggccgcccatccgggaacatcacccggcggccgtccgtcagcggcaacacctgccgctccttccctccctccgtgatgtcgaaggccatccccagccggtccatgtactccaccgagtccggacccgcctgatccgccagggcgaagcggatgcccacgtcgacgcgctcgacgcctcccacccgctccgacgcgcccgcgacgagcctgggcaccagtcccgccatccacgcggagctgagcaggacgggtgcccgtgggggcgtccccgacagccgcagcaccgccgacttcacacgcgacgtccagcgggtgatgtcgagcaccgccacgccttcccggaccgccgagcgcagcaccgcatcgtccgggtcattgaccagcgacaccacggccctgggccgtccggacaggcacgccagcgggtcgggcgccgtcacatccagcaccacggcttccgcattccccagccgccgggccaacgcctccgcgggctcgcggcggcggccagcgatgaccagcggaaggtccggatgccgctcccgcagcaactgcgcgagccacgtccccaccacgccgtagccccccaccagcacgacactgtcctcagccaccattgcgcgctccacccgccggcgtgggccatccacgccgcctggagtctttattaggtcgattgacctatattttcacgacaatcgtcctgaccgtgcggccggggggcccacgtccctggcgtcgtgctccaggtcacccaggacttgggcgtggacgcagtggcccagcgcatcctcggtgcgtggcggcagcgcactggcgcccgggcatcctgagaagccacacgtccgctcgcgacggtgatgaaccgccgcgagcggactcgcaacatcacctcgagcgcgtcagcggctcggccacatccacggtggtggtgccgtgccacacgagaccgtactcgtccttgtagatgtccaggtccaccgtgtggctgccgccgcgcgcctcccgtggaatggacttcgtcatcgtgaaagtgaaggcgccacccggcggcaggttcacaccccagtcggaaaaggcggtgtcccaggccgacggcaggttggaatagaagtcgtaccagacccaatcacacgacgcggagtcgttgttggtgacgttcaccgtccaggtgacatccgtgcccggcgccgccgtcactgtctgcggtgacagtgtgacggtaggcgatgcggtgacacaacgctcgacgatgtcgatgtccgctgtgccttgcaccgtgtggccgtctcgcgtggcggccaggcccacggcgtacgtgccgggcgccgcgctgtagggcgcatacgcctggaggccccatgacaacgaggcggacgcggcgacagtgacttgcgcgggcagacggtcggagccccacccctgcggaaggagggcggagacctggaaggtggacggcgaacacgtaggcgagtcgtggttgacgagaacgacctcgaactccggccggcctccgggccaggacgtgggggcgaaggacgtcacctgcacctcgtggggtgcgcggacgcacgcggattgacggtgcgcgatgctcacgacgagtcccgcggacgtcgccgcgttcacggtcacggagagggtgctgtaggggtcgtcccacgtcgtgcccggaagcagggccgggtcggtccacgatgccgtctgcggcgtgaagtcgagcaggtgcgagccactcagcgtcgtcgcatccgcgtagtgcacgagcgctccgccgaacacctgcggcgccagcgtcgcctcatagccccccacgggctggcggtactccaaccacagccagtcattgctcccaggccgccgccgcaccttgagcgccttcagcccgcccgacgcgaccacgggcgcgagggtgaaggtgccgtccacaccgtccacaccgtccacttcggccaccgcggacgcgtccagccagccgatacgtgccttctgcggcgccgcgtagtggcccaggttccaccgtcccatcgtcgagaagacatccccgtactcgtcgatgacacccgtcgcccccggcaggcccagggcctccgcgccgaagtcgcgcgagctcgcatggcccaacgtgaggttgtgccccgcctcgtgcgtcaccaactccacggcactgtcgtggaccatcatggactccgccacgagccacgaagtggaggccatcacggtaccgtccgccgtctgcacctgcccgcaggacaccgtggcctgaccggcgtaggaacagcccgcctgcggccgtgggtggacaatgaagatgcggtcgtactgcgtgaagtccacgtccgcgtccgccgcccgcaccgcggcctcacgcatggccgcgccttcactgcatgaataggcgcggtccagcgtgtacccgctcaccacgtcgcccgtggtggtggtgcgaccctcggacacctcgctccagtaatccgccagcgaacggcgcgtcgtggagaagaacacgtcgtggaccgcctgcggggtgaggccgggccgggccatgccggggaactccgtcatgatgaccaggctgcgctgcacgccgctgacgccacacgcgctcgccgtgctcagcgaggacgcggcatgggtgtccacgtccacgccctgggcgatgagctggccgccctgctcgcgcccacgtaccttcacctggagcccgctgcgcagtcccggcggcgcgccgtgttcgaagcgcacctggcggtgctggttcccctgcttcacgaagtactcttcccacgacgcggcgggcgcgggcggatccaccaccacgacctccagttccccctcccatgactcctggcggctcaccgtttcgtgtggtggcgacccgtcctgcgcttcatccacgtcggaaacctgcgcgctacaggccgcgagccacacggccgataccatgctccacgtgcgggacatttcccctccggaaaacggcggcccggaacggggcgccgcgcgccttgtgcacggagcgattcactcgcgcaacgcatctccgacggagccacgaggaattcacgcgaaacgattggagacgcggcgcggttcgctcgcgaggtctagtcgctcacggagcggaggctgcgcgctcgtggattcgaagccaagctgccgcgctcaacgccctggcaggtccaccgagctgccgtggttcacatccctgtcagcgtggcccaagatgtagagctcgccacccagccgcaggtccagccccaggggcccgaggtcctccacgtcgggcgcatccttgagggcgcatcaatcccaatcctcaccgtcgaatctcggaatgacgacggccgagtattgagcctctgggaggtagatcacctccagctccgttcctggcgcgagcaggtggccgtgctcggcccccagggtccgctgttgcaccagcatccagggcgctcccccgtccacgccgtcgacctggaacgtcatcacggtggtgcgctggcggttgcggtccaggacaccggcctccgctttcaccagccgggcccgtgcgcgcagcccgtgcgtccagatgctcctgcgcttccggcgcgccagcctcaccgggacgatgacgagcgccatggcggcgacgaatccgcccgcccagacaatccaccccgtgacgtcgtcatggccagtcatgcaagcgggagcctaccgccagcaccgtggcggcgggaggctccgcgccatgctgggaatgagcgggctccccctagactgcgatgcctgcccaaggctgggacccgatggggcgctggcacgcggccgcgtgactgcaacggagggggcgcctccccgtccgccgcccaggctgagggaaaggcacgatgggcactccgccaggtccgcccccaccttgtgaggcatgggttcaatggaggaggacgccccggaggtgtcggccgccctgctggagggcatccgagccgccgcgctccccgtgtcgggccgcgcttcggacctggacccgctcatcgagagcatcggtgatgcgcggttcgtcctgctgggcgaggccacacacgggacacacgagttctaccaggcacgcgccaccctcacccgccgcctcatcgccgagcagggcttccacgcgctggtggtggaggccgactggccggccgccctccgtgtcgacgcgttcgtgcggggtaacgggcaggacgcgacggccgctggcgccctgggcaacttccagcgattcccgcggtggatgtggcgcaaccgggagatggaggagctggtcacctggatgcgtgcccacaacgccacggttccgccggagcagcgggcgggcttctacggcatggacctgtacagccttcacgactccatgcgggaggtggtggcctggttggacacggtggacccggatgccgcgcagcgggcccgcgagcgctacgcctgcttcgaccacttcggccccgagccccacgtctatggccagtccaccacgtcggggcaggcggactcgtgcgaggagcaggtctgggcccagttcgtggagttgcagcggcggaggactcgggggcccgaggacgcggacgcccgcttccacgccgagcagaacgcccggctcgtcgccaacgcggaggcgtactaccgcgccgtgtatgcgggccggcacgaaggctggaacctgcgtgacacgcacatggcggacacggtggacgcgctcgcggcgcacctgtcacgcagcggtccaccggcccggttggtcatctgggcgcacaactcccacctgggtgatgcccgcgccacgcagatgggtgaccagggggagctcaacgtgggccagctccttcgcgagcggcacggcgcggccacctacaacgtgggcttcaccacgtacacgggcgtggtcatcgccgcgcacgaatgggacgagcccgggcctgcgacgccgcatccagcccgccatgtccggcagctacgagcgcctgttccacgacgtgggaatgcccgcgttcctgctgcgcatggccgagctgggcgaagcggcgggcggcctgcatgagcgccgcctggagcgcgccatcggcgtggtgtacgcgccgcgcaccgagcggtggagccactacttccacgcgaacctgcccgcgcagttcgacgcggtgctgcactacgacgagacgcgggcattgcgcccgttggactcggatgccgggcacggggaagaggacgcgcctgacacgtatcccttcgggttgtgaggagactagttcgcctgagcgggcgccctctccttgatgggcggcgtctgcggcgagggcaccttcgccggcggcgccctccaggtcgaggacttcccgggcgtcttctggctccgggccagttcccgctcgatgcgccgcttcacctccggcagcacgtcgttggggatggggatggagaggttgtactgggcaatcttccaggtgccggcgtccttcaccagcacgccgctgccgcggctggggcccaggttgggcgtatccaacgcctcgtcgaaccaggccaccgcgccatccttcgagaggaagatgtggcgtgacgtcgccttgaagttccaggccttgcccttggagaagtacggcttcgcccaggcgcggaattcatcacgggtccaacgctcggtggcgtcggtgcccaggtacaccgcgtcgtcggtgaagtggccgaagtagcgcgcctcgtccgcggcggcggcggcctggtgccagtcatccagcacggcggtgatggctgccttcgagtcggcgggggccgtgttcgcgggagcggaggcgagcacgaagagcagcaaggaaacggtgggcacgcggaagacctcgtcaggcagggcgttcaaggtatgaagcggcacggcccgccccgcgtcaaggcgaacggggtggagagaaaggcacgaatcgcatggtcctcgagagtttcctggtgggtgagggcgatgtgcccacggtgatgctgcacggcttcctgggcacggggcgcaatctgcgctcactggcggcggcgtggagcgcggcggacccgagccggcgcatcctcttgccagacctcaccggacacgggacgtcccctgcgctgccagcgaactcggacctctacagcatggcccggtacgtggtggacacggcgcgtgcgcagggcttccagggtccgttcgactgggtggggcattcgcttggaggacgggtgacgctcgcggcaagcctcaatgtcccggaggccgtccggagcgtgtcgctgctggacatcgcaccggggcctgtcccgggagacttgtcggagagtggcaaggtgctgggcatccttctccaggcaccggctcaggcggagaaccgccgggcgatgcgcgcggagctcacgggccgcggcttgtcggagccgctggcggactggctgctgatgaacctggtgacggaggagagcggcgtgcgctggcgcttcgaccggcagggactggcgggcctgcactcgcgcgtgaatgacacagacctgtggacagcggtggagcgcaaggaccggccgccgatgcggtgccttcggggtggccgctcgaagtacgtgagtgacgcggacgtggagcgcctggtggccgcgggctgcccggtggagacgctgccggaggccgggcacttcgtccacgtggacgcgccgcaagcggtgttggcgtggctgcgctgagctactgctgaacctggaggatgcgcctcagatgcgcacgcccagcagcaggccgggccacatccggacgccgccggggccgcggcccagcttccactgcggcagccagctcacgtcgcggtactcgtcctgggacgacgggtcgtacgcgttgagggacacaccaccgaagagcgcgaagcgccgcttgagctcccaccccagcgtggcgcgcatccggaacagcgtgttcttgggccccgagccatagaagttcggctgccagcttccgtacgacaggtccacgtccagcgagtagcggtccgccgcatccagcgggacgtgcacgcccaggcccatgttgaggaaggtccgcagcgagtccttgccaatccccacgcccgtggtggccagcacatagactgtccggctcccatatttgatgcccaccgacaggggcatgacgtcgtcagcggagagctccagcacgaagcgccccttgcgcacgatgctcaagaagccgatgggcaccgacacgtcatccgcgatgttgatgaaccccagttgcacgccgcggacctcggccgccacgttgatgaggcccacctgcgcgcccgcgacgtccccggagatgttgatgaggcccacctgcgcgcccgcgagccgctccgccaggttgatgcccacggccgcctgcacgccacggaggcgcgccgccgcgcggttcgccgtggtgctcacctggaagcccgtgaagtcccgctcggccatgttgaagacggcggacacctgcccgcccgtcccgccaccgaaggcgaggttgccgccgaacgccgtctggagaccgaaaatctccccgcccgccacattcgccacgcccgacacctggaacccctccaccgtcccgtccacccaccccacgccggcggacacgcccaacccctgaagctgcatcgagcgcacgcccagcacacccagcgccaggtggttgcgcccgacgcccccccacagcgaggtggtggccagcggcggcaccagcgacaggttgaagggcacggagggcatgtcgccgaggacgaccggctcgccggtggacagggcctcggcccgcatgtccgtcccgcctcgcgccgccgtgcgcgtgagtgtcatgggaacgaagtgctcggcgcgcagctccgagcccccctttggcgacaccgtcaactccgcttcgaaccgctgcgagggacgctccagcacgacctgatagcgccccgcctccagccccagcgccaggcgccggcccgcgggcttctgcagctccgcgaccaactggttgccccagtcgcgcacgaagaggcggccttgcacgtcctccgccaccgtgagccgcacgcgcgaggtgcgcaggtccgtcagcaccaggtcgccgctacccgccagttggatgtcataggccgcgtgctgcggaccgccctgcgagcgctccgtgcgcgccagcgtttcatggaaggcgaactggtaggcctcgtgcagggtgacgcggccgtcaccgctggcgtccgccgcgccgcgcaggcccgtcaccaggaagtgcgtgaagaaggacgcgccaatggtgtccgactcctgcgccacttcatccgcggagctggaggcgaggtacgcgtggccccgcacctgcgacgccgcgtccatgaggaagcccggccggtgcaccccacccttgaagcgcgtcaccgcgccggagccgcacgagtccagaatcgcgatgcgcacgtccacgggcaccgcgcccagcccctgcttcagcgccgcgtaggtcagtcgctcaccgcgcggcagcagcccctccgcgtccgaatggcccgagtagtagagcaccagctcgctgcgaacgccatctgcggccgcggcctccaccagcacccgcatccgctccagcgcgcccagcaggcccttccggtccgcctccagcagcagcacgcggtccgccaccgccacgccgcccagctcccccaacacgcgggacatggccagcgcatccgagcccgcgtagcgcagccgctcgcgtccctcaccgccctcgctggagcccacgagcagcgcgaagcggcgcagcgtcaccgggggctcttccgccgggggcggagtggccgcggcggacaccgtggcccacacgcccaggcaggccgcggccagcagaccgcaccggcggccccattccccagcagtggtgcgtctcatcatccgcgttacaccccacgcgtcaggcccggcccggcctcaagcgagtcccctcggcatatctcgactggaggccggcgcgcgagcccggctcacgggctccagagcgcccgccgcaccaaccaggaactgccgccccggccgtcccgcaccaccgcccagaacgtcacctcttgcgcctgcgcgccctccggcggctcccactccgtgcggtgccggccttcctgcccgccgaaggacgagccgcccgtctcctgcggcgagaactcgcccagcgtcgcgtgccacgaaatctcccagctctcccgcagcgtcaccgcctccagccgcagcccgggcaccacgtacgtctcctgcaaggccaccacgtcctcggacgtcaccacgaagggcccggcgccccgaagctccagcggcgcctccgcggcccaggccacgtcgtccacgcgcaggcccggaatcaccggctgcacgttggcccgcatcccctccaccgccgggcaccagaagaccatcagcttctgcgcgtacacccgctcctcccccgcctgcgtgaagaggaccagcggcatgcgcaggccgcccagccccaggtaggggtccagcgcctgcacccgcaccagcagcggcgtgtcatccgccagcgtggccgcgcccggttggatgctgagcgtcagctcaccgggcgcggtggtgccctccgcgagcagtacgcggttggcctcgttcgcgcacgtccggtcctcggggtccgcgcacgcccacagcgtgtactggatgggacggccctcacccgccgggtccaccagcagcgcgcggtatgtcacgggctcggagagttcatccagcgtcgccgggttgagctcgcaggcggacgccatgaactccggcggctccgttgcgagaccgagcacacggaagtcgtggacgcgcgaaggctggtcctcgacgtcgacacacgcggtggcgcccagcagcagcaacaggccgccatactcgagcagggtcttcatctcagaagcttcctttcacacccaccacggggaggatggggatgcccggcacctcgtactcccgacggaaccggtagtcgttgaagacgaactcgacgttcttcgcgttgtagaggttctgcacgtccaggtaggccgtgagcgtccagctctggaaccgccagctcttgtccacgcgcacgtccagctggtggaagccgcccgtgcggtcggagaagtagggaccgaacgtcgcgttgtagcgattgcggtccgcgtcgtagacgtcatggccgctcgccagcggcgtcatgggccggccgctggtgtagcggaagcggccacccagctcccagccgttgcccagcacatagcccgccaccatcgtgaggatgtgcgtctggtcccaggggctgaggccataggtggagtcgtccggcacgctgccgccaccgaaggcccctccgccctggggcggcggccccacgcgcccgtcctccgcgcggctgaaggtgtacgagagccagccggaccacttgtccgtcgcggaggcgcgctccttcttcagcatcacctccacgccatacgcgcggccgatgccgtcgttggagtacggcagcgtgaagacgccgccgccctcgttggcgacgagctggccgggcgacacgatgttgttgaagcggcggttgaagaagccggtgacgtccacgttgagcacgtcggtgatgcggtgctccacgcccaggctgctctggaacgcgcgctggtaggcgaggtccgggttgccgtagggcgcggtgatgaagcggaacgtctctggcggctggctgtagaggcccagcgagcccttgaggttggtgcgtgaggtcgccgcgtagcggacccagagtcgcgggtccagcgccaggttccgcgtgttgcccaccgtctggaggttgccgcgcacgcccggcgtgaaggtgaagcgccccaccagcaggtccgcttccaggaagagcgcgccgtcgaaggcgctcagggcaatctgctcctccaactgctggcccaccggctcggccccggggaagggcacgtactcgatgccgcccggcgcggggaaggacacgtcgtagcgctcgtgctcgaagacgaggtccagacccgtgcggagggtgagcgcggaggacagctcgatgcccagcacctcgcgggcgcccagcgtgtacgtcttgccctcctgccgcgcgagcccgaagtcgatgttgttgcggtccatgccgacgaagggcgtgaagacggaccacatcgcgcccttgcggtaggtccagtcgcccttcacccggtggaagttcatgcgcgtgtccagctccaggtcccgctccgtctcggggccggtggacaccacgcggagctggtcatcactgccgaaggccatgatgtagccggagctgcgcgcgccccccgccgtcacggttgtgtcgtcgttgggcgtcccgcgcttcgcgccgaagtccacgcgcagttggtagtcccaataacgcggcaccacggagagcgtgcccccctccgtcttcggcaggacggcgggcagaatcgcgtcgatgtacgaacggcgggcggccgcggccacgctgatgccgtccgtaatcgggctctccaggaagaagcccgcgtccagcaggtccaccttcaccgagccgtgcagcgtgtccgaggcgcccttgcgcgtgcccacctcgacgatgccgcccaccgcgcggccgtactggctgccgtaaccgcccgggaagaagtcgagctggtcgatgaactcagcgttgaccaccgagggtccgccgagcaggtggaacaggagggggatttcgaccccgtccatcatcgtcgacgtctggcccgggttcgagccacgcaccagcagctcaccggagatgaagggcgcgcgc

SEQ ID NO: 1190 - DNA, 21964 bp, Myxococcus xanthus
  unsure (1)..(21964): unsure at all n locations
tgctctacagagcatttgcgccgcgcgccgtgattcagcgcagcatttacccggcgcggctcacatcgccgtcgtggtgaacacgccacggccaatggccatgatgccgccgatgatgaagatgatggacaccaccacgcccaccaacggcagcacgaaggccggctgcggcttgcggcggttgatggacagcgtcgcctgcgccacgccggcggcgagcaccatcatcacgatgtgcccgatgagcgccgggtaatagaagcgcgtcaccagcacgccgacgcccagcagcacctgaagctggagcagcccggagtaggccgagcccaggatgcgccccagcttgtcgaagggcttccgggtggcgagcccgtaagcgaagtacgcgagggccaggattccagccagcagcaccagatagcggagcccggagtgggcgtagaagagcattcggtccatgggcctcgctgcttagcaacgcgcggggcgccgcgcacgtttcaagacgggtccggcttgggggtcttcgcggtgctggggggaagctccggcggagcgatgaactccgcggggggcagctcccccgtgaggctcttgaggaaggcgaccaggtcgtccacctccgggtccgtcagcgtgcgcgccagctggtgcttcgccatcagccgcaccatctgcggcagctccaccacgctgccgtcgtggaggtacggccccgtcttgtccacgttgaggagcgtgggcacccggaacttgccccggtcatcctcgttcttcgtggcgtcgaagcggcccgcgtccttcaggcccgggtagtcctcgatgaggcccagcttctggaaggaggtaccgcccacggcggggccgttgtggcaggtggtgcacccggtggtggcgaagagctgcaggccccgctgctcctgctccgtgagcgcgtcgtgcttgccgcccacgaaggcgtcgaagcgcgaggtcgtgacgagcttgcgctcgaaggcggcgatggcgcgcgcggtgttggccatggtcaccggcttcttgtcgcccgggaaggcctcacggaaacgcttcgtgtactccgggatggaggtcagcgtggccagcacgcgcttctcatccggcatggccatctccaccggattgaggatggggcccgtggcctgcgcctccagcgtgtccgcgcgcccgtcccagaactgcgcgatgtgcccggccgcgttgtacacggtgggcgagttgcgcgcgcccttcagccccttgtggccgtccgacagcgccttgttgtccacgccgaaggtcgtcaggccgtgacaggtgttgcaggacacgtcgtggttcttcgacaggcgcggctcgaagtagagcatccgccccagcgccacctgggcgtcggtgtcctcggggggaggcggcgcgtccttgcgctggggcagcggcttgaagaagtgcgcgagctgttcggccgtcatcggcttgggcgccggcagcttctgggcttccggcgcggccacgggcgcctcggcggacggcggcgtccgctcacaccccgtgagcgcactgacgcccaaagcggacagcgacagcagcgagacccaccggttctgaatcatggaagccctccatggccgcttcgatagcgcggcgcaagctaccagcaatcagcccgggaggaatgccgcgtcgtgatatccctgtacgtccgctttccggacccatcagccaccgggccgccttcccgctccggaagcactcgaacgaccagggcggcctgcgggactcccgacagcgcgctacctcccagtctcaggtcgccgtgcgtgcttcagccaacagggcccctgtgcctcagggccgggcgcgcggcgcatcgagcggcatcgacgagacgatggaggacggatgcgggacgacagcggcggtggaccggtggaggacgtagaggtgctcgtctgccggaagtgtctgatgaagggcggcacgcgtgccggaggactggacctgccgcgctggctccaaggcacgctcaccgaacgcggcctggggggacaggtccgcgtactcccctccggctgcatgaaccagtgcccgcgcggcaaggtcaccgtgctcgtctccagcgactccggccgcggcggcgccctggtgacggtggacccgaggctgcatcgagaggagctggtacagctcgtcgaacgccatgcgcgtggcgagcccacccgggaggcccccgtccccggcgacgtggaggcggagcgcgagggggcgacgtagccgcacccggcgggccacctcggacggcgtgtcgtcacggcggaagacgagccggtccaccacgtacgacaccgcgagcccggacgccgtgcccaccgcgtcccacgccaggtccttcatcgagaacgtcgtcccgcgccccaagtcatagagttccttgcccacccccgcgcccatcgcgagccccgcgccggtgagccagcgcgcgtggggattgtcgaagagcagcgcacccccggcgtaccccgcgcccgcgaacacgaaacacgccgcgaagtgcttgggcttgtctggccccagccactcatcccccgacgcggcgcgcgcgccgagaggagccaggaagacaagcaacagcgagctgggcagcagggcgtgcaggcgcatgtctttccctgtagcaccacacgacgcgtcagggtgccctgtctctccgtgaagtgggggctgacgggttcatgcgttttcgagacgtggcccgagtcacggcctatgctggagacctcgtgagtcaactcggccctaccttcaccttccagaaacgagacacccggcaccccgggctcgactgcgcgcgcgggctcgcggtgatggcgatggtcattggccacacgctggacgcggtgttgtcgccggtcgtgcgcgcggatgtgtgggtccagcactactggacctgccgaggcatcaccgcgcccctgttcctgatggtcgcggggtgggcggtggtcgcggcgctgggctcgaagcccacggcggcccgggacacctacggcaagcgggtgcggcgcgcgctgttgctcatcttcctgggctacctcgtccactggcccgggtggtccacggtcatccagatggggctgaccgagcggatgctgacgaaggtgctcgtcttcgacgcgctccagtgcatcggcttcgccctcctggtgggcgccaccctgctggcggtgacgccgggccgctggggacgcacggtgatgctggcggtggtcgcggtgggcctgccgctggtgagcgcgaccctgtggaccctgggcgaagggttgcccgggccgctgacccagttcatcggcagtggcggcgccagccgcttccccttcttcccgtgggccagctacttcttcgcgggcgccctggccgccagcctgctgggcaccctccgccccggcgtgccgcaggggctggcgctgctgattctgggcggcggcctcttctggttcatgcgcggacagaaccaggactggggcaccgccagcgcgtggctggtggcgtaccgcgtgggccaggggatgatggtgctgggcgtggtcaacatgctgccgcgcaaggtcagcggcctgctggcgcccctgggccgcctgtcgctctgggtctacgtcctgcacctgcccatcgtgtacggctggtccagctacgcgggcctgtccagccgcgtgggccccaccctgacgcttccggagggactgggcatcggcgtatcgctgctggtgggctgcgccctggtggcccgcattgggacgtggttgagggaccaggcccggccgtggcgcaccggctccaccacgctggaagccagcgtgggcagcctgggttcgcgcgggaactgacgtccgggcggcgcgtcagctccgcctgggctcctcctcggtgaactcggcatccacctcctgctgcggcccctgaggccggcgggccacggtgccgccggcgtccggctccagcgcaccagtccgcggagaacgcggcacggggcctccgggaaaagggcttcccatggacgcgtggaagccgcccccaaacgccccgccaccgaaggtggtgacgtgcatcgagccctcacgcaccttgcgctccagggtgcgacgcacgcgcgcggagatgaggcgccgcacgggcggcagcaggagcagcagccccacgacgtcggtgatgatgccggggatgacgagcagcacgccgccggccagcaccagcacgccactgagaatgccttcctcgggaacctggccgcgcgccatggactcacgccagtggcgcagcacccgcctgccctcccgccgggagagcgcggtgcccaccaggccggacaccagcacccaggcaatcgtgggcatgggccctatctgccggccaatggccaggagcaagtagagctcgaggaagggcaccacgatgagggcgaggaggaggtagcggaacacgcccccaaggtaactcttcgagaggggtcgtgctcgtcttccgccgccgcgtcagcgcccgccgagctgccccaccagggtgtccaccaccaggtacaggaccacgaagatgccaatggcgatgaggaccatgcgcgtggagagctggaagccgcgggagccctccgtctccagcgcgtagctgcccgcgcccatcgcctcgggcacgccggccacctcgcccgcgtagcgcgccgtgcggacgtactgctccagcactccggcgtcgtcattgccggtcagcgagcggcccagctgcgggtccaccagccggacaccagcctcggaggccagggccgccgcggcctccacggcctcgcgcatcaggtcggggcggtccgacaacggcacgcgcagctcggtggccaccacctgtccgccctcacgcagctcgccgatgtcgacgtcgccattcttgaaggaccacctgcgcacgccgtccggccgggcgaccacaccccgctcggaaaggagggcatccacccgtgccgcctcataaggcgagcccggcgtcatcgtctggaggagcaactcgtatctcacgcgggttgcgagtatacgccgcgaacgccatgtccacctcttccaagcccccctacccgcgccgaagcggaaaccggccctcgggcccctcctctcagcagcagggccggggccgtccccacacccgccccgagaagcccgccccggaccgcacctcgcccgagctgggcccggacggccttccccaggtgtcgctgttgcgccgcggcgtggagcgctggcagggcggccacccgtggatctaccgcgcggacctgaatggcgaccccgggctgcccggcggcgaggtggtgcgcgtgacggacacccggggatggttcctgggcaaggccttctattcgaagcactcgaagatttccctgcgctggctctccttcgacgacgtcgcggtggacgcggacttcttccgggagcggctcctggccgcggaccggctgcgccagttggcgctcccgggggagaagacgtaccgcctggtgcatggcgaggcggacgggttgcccgggctcgtggtggaccgctacggcgacttcctcagcgtgcagttcctggtccccgccatggagcagcgcaaggcgctcatcgccgacctgctccaggcgcagttcaacccgcgcggcatcatcaaccgctccgacgtgggcgtgcgcaacctggagggcctcaccccggagaagggcgtgctgcgcggcgaacatcccggcccggtggccttcgacgagggcctggtgaagatgcgcgcggacctgctggagggccagaagacgggcgccttcctggaccagcgcgagaatcacgtcatggccgcgcactatgcccacggcgaggcgctggactgcttctcctacgtcggcggcttcgcgctccagctcgccacgcgggccaggcacgtcacggcgattgaaatctccgaagcggcctcggcgcagcttcgggagaacgccgcggccaacaagctgaacaacctggacgtggtggtggccaacgccttcgacttcctccgcgacgcggtggacgagggcaaacgcttcgacaccatcgtcctggacccgccgtccttcgcgaagaacaaggacgccatcccagccgcggtgcgcgggtacaaggaaatcaacctccgcgccctgcagctgttgcggcccggcggcatcctcatcaccgccagttgcacgtaccacgtggacgaacaggccttcgaggacatgctcgcctccgccgccgcggatgcccgccgccgcgtgcaaatcatcgagcgccgcggcgccggccgggaccaccccgtgctgctcaacctgcgtgagacgcgctacctgaagtgcttcgtgctccgggtgctctgaggactcgcccatgcggacgcgggactgggacgacgaggcggacgacgcgcccctgggtggcacccgcgagagggagcgcgcgctgaaggaagtgcgcgccgtctaccgccaggcggacgcggcctacgccccctactcctgcccggccagcggcgagtgctgccagttggccgtcaccaagcgccagccctggctgtggcagcccgaatgggagctgctgtcccgaggacgcccgctgccgccacctcgcgcggacggcggctgtccctacctggacgccacgggcctgcgctgctcggtgtacgcggaccggcccttcggctgtcggaccttcttctgccagcgcatccaaggcccctcacgccaacccgcggagacggtggccacgctgctggagcggctggagcgtgtgtctcagcgcgtggccccttcactgaaggctccgcgccctttgcttgactggcatgcggaggcctggcgcgcggcaacgaaagcttgaattgccatttttcaattcaagtctttataggaactcgcggcgctaacgtccggttgatacacagaagtgatgaaacacgcatcaccccaggagtgggaatgacgctgggagtggtatgccaggggtgggggctctcgcaggtagaggacgcggtacaggtcccctggccttctggagttccctggacacctcagaaagcgccaagcccttcaccgtgatttctcctcgctggctcgtcgcaccgcaagaattcaagggaacgctgtccgccgcggaagcggctgaagccatggctcgaggcctccgtgagtcctcgccggaagtggtgctggacgtggcaccgctcgcggatggcgggccagggacggtggaagcgctgctgacgggcctgcgcggcgagcgtcgtcagcaggtggtgcgtggaccgctgggcgcgcccgtggaagcacactgggccctggtggaggacggacgcacggcggtggtggagatggcctccgcgtccggcctgtcgctgctggcgcccgaggctcgcgatgcgctgaaggcatccacgtatggcaccggcgagctgatgcacgcggcgctggagtcgggctgcgaacgcctcatcgtctgcctgggtggcagcgcaaccacggacgctggcaccggggcgctcagcgccctgggcttccgcttcctggacgcgcggggacagcctcttcccccgggaggcgcggcgctggcccagctcgcccgcgtgggcgcgagtggccgtcatccccgcctgggcgccgtggagctgctgggtgccacggacgtcacctcgcccctcttggggccggacggagccgcgcggctctttggtccgcagaagggcgcggacgaggccggcgtggaagcactggaggcggcgttggcacacgcggcaacggtgctgggggatacgtccgcgggctggcccggcgcgggggcggcgggaggcttcggctttggcctgctggccctcgctggcgcgcgactggtgcccggctacgagctggtgtcacgcgcgctgggcctggagcggcgcgtgctgatggcggacgtggtgctgaccggtgaggggcgcttcgaccggcagacagcgctgggcaaaggcccgggcggcatcgcgaggctggcccgcgagcacggcacgccggtggtgctcttcgccggacaggtgcagcgggacgaaggcctggcgctggacctcttccacgaggtggtggagctgagcgccaacgcccagccgggcgaagcggcctcgaaggtgctgtgcgaagccgccgcgcgttgggcggcccagcgcctcaagggacgctgagccgtcccctcacttcccgtctggcttgggcggcgccgcgggaggcttctccggtgccgccgcgcccgccagcttccagtgaaccagcgcgtccttcgtcccgtcatacatgacgagcgacggagccccgcccgtccacagcagcgccgcgcccttctccggaacagcgcccagcgccaggggcggcttgaaggccgcgcccacctgctgcacgtagagctgcgggttgcggcccgcgctgttcaggacgcggtagtagagccagtcaccctcgggcgacaacgagcccagcgtcaccgactccccggaggcatagcgcgctagccgcaccgtcaccgcgggcgcgccttcccacgacacgcgccagatgccagggtcctcgggcttctccttcccctcctcccgcttcggcgtcacgtcacggcccagagccacgagcgccaccggcaacgagggatgcaaacgcagcgactgcaacgtgaggccatccaccgtcagcttgcgcagcgcgagcgccagcgggtgctccggctggggcctggccaggtcaggcccgtagagctccagcggcacgccgggcttctgcaccgcgaccagccccgcccccgcgtcccacttcaccgcgccgacgacggagcccagctccagcgagcccaacttcgcgcgcttttcaccctccagccgccaggtgcgcagccggaaggagatgcgggaggtgcgggcataattcgtggtgtcctccagctccgccgccaccaccagcggggcgtgagaaatccacgcgccgcggatggcgacctcctccagtcgctcgaccatgaaccacgtcttggccagttgccacttgaggtcgtacatcaccaggcttcgactctggaggtacgccaggtgcgtgggtgacggaggctgcatcccttgcagctcgcctccggagacctgctccaggtactcgtcatccacctcgacgcggcgcacctcggagccggacagctccagccgccagagcttgtcattcagcgtgagcaccgacaccgaatccggcgccggtgatggaaacacgagcgccacctgattccaggggaacggtgagggatgacgcacgggcgccgcggccgcgggcagttgaggcgtcagcaggaaggggtccttgttgggctccatgggcggggctcctacttcgccttcgtggtcgcggtgaacaacatgggaccgctggccaggccgcccgccttgtcaatctgctccagcgggtgctgcagccgcatcagcgtcgtgaagttgtcctcgagcttgtccaccgcggcgcccgtcacgttgaggtccgtttgaagcttcttgaggccctccttcatcttcggggcgacctccatcatgcggtagtagcgcatgggattgacgatggcgaactgggtgaagaggttcacctgcgtcggcagctccttctggatgaactccagcccgcggatggtgcggctgtaccaagccgcgtacgccacgggctcggcggtaatcatgtaccagtcggtgccgaacatgatcttcttcagcatccacggactggacttgaggatgtcagccagcagcttccacttctgcttctccatcaggtccagataggagatgtccgtgtagaagttggggaactcgttgcacagctcgacgatggagccaatccagctcttgtcgtactggaccttctggccatcctgcttgacggtcaaccccttgcggatgtcccagaaggtgccgtcgctggcgaagtgcgccaggcacaagcgcagcttcggattgtcattgagcaccgggcgccacgcttccgggtgcacgtagttctcatagaagtaacgcatccggcccgggttcagcagcttctccttggcctcgatggcgtcctccacgccattgcgcgcgcggcggagcacgagcgggatgtggctcttccagctcgcctccagctccgtcacgtagtcgcgcgccttggtgatgttcgcgtccgcggtggcgatggcgtccttcgagggccagtacttcgggtcgtttcggatggcctcgtccggctcgtggtccaggtagaagcgccgctcgtgtgtgtagaagccggacggcgtgcagtgggtcatcagcgggatgtcgttcgacgcgcactcggagaagaaccagctcaggatgtccttcaccggcgcatggcgctccttgggcatgtagccctggggcgtgtacatcttgaagccgatgtagggagccgccttggaggccgtcaccaccttttcgaaggggaacgacttgtcctcgttcttgatgaagcggcgcggttcgaaatgaaacatgggcagcaaccggaagggattctccgcgaccacctgctcggtgtgccggagctgccggtcccacgtctcgtgaagccgtatctcatcggacttcgcttcaatcagctcgccagggtcgtcggacttcgtgcgccagcgataggtgaagcggggctcggccccatcaaaatccgagctgtagatagggtccccctggtagccagccaggtggcagtaatccatgtccatggtgaggacgatggacatgcccatgtaggaagcgctggcctccgcgtggccctgcgtggacgcataggctcgcaggggcgcggggatggtgtactcctccacgttgcccattccatccgaggtgtatcccgtccggtcctgggcaaggctgtcattggagcgcacggcctcttcaccaatgcggtgcgtgtcgcggtgggacacatcaccgatgtcgggcgcgaacgggattttcgccgcccagaagcccaggcggttgattttggtgcggctggtgcccgtgccgatgagaaagcccaggcccttgtccttcatcatctgcaccagcgcgggcatgggcgtgcagttaccgctcatgatgtgcatgtgtgcgtcgaagtggacgggcggcaaggtgagcggcgttcccggcgtggcgatgaggttctgcggacctccggcggacacctggttctctggcaggtccgggatgatgacccggtcatccgccttcccttcattggcgccgcgagtggcgcgcaggcccccgttgtccggatgctcgtagatgagcttccattccttgaacccgtacttatgcgcgattgagtcgggggagtccccgtccttgacgacgtacgtttccatcgctggcctatccgaaatggcgcgtgtgcccgcgcgggcgggtacggctcaggaacccttgttgatgcggcctgacatctccgggaagacgacgcggtagtcgccgggcggcaccttctccaccacgcccttcccgctcccgtccacgcggcccttcttgatggtgccgtcgggcatgtgcagctcgaagggctggtccttgatgggcttgccgtccatgcccttgaggttgaactcgacgttgacggggtctggctccttgaagtgctccagctccttcgccttgcgcgagtcgctcttgagcgaaccagccgcctccatcttcaccttgccgcccttgatcttcacttccttgccgtcgacggtgagcgtcttgagggtgaaggtcaccttgccggacttctccatcttcaggatgaggttgtcaccgacgagcagcgagaaggtgtctgccttcagctcgaacttcttggccaggcccgccatggcctcggtgatgtagaggctggtggtcttcccgatgtcctcttcccagtccttgccgatggtcagcgtgagctggcccttggtgcgcaagtcccagtccatgccgacgtccaccgtcttgtccttgccgaccgtctcctgccgcgaacccagcacgtgctcggtgtgcgcggcggcgacctggaggccgcgcgcgccgccggtggcctcgttgtaggcaagcgccacgttgacgctgtagacgccgccaatggtggtggccttcgcggcccctacgttctccatggcgccctggagcaccagcccggtgaggttaccgcccaccgtcatcgtctggttgccctccacttcctcgtcgtgagacagcgtcgtccgggtggagcggttgccctgcaccagcaacgtctggttctgctcgacgacgcccacgtcgtccacgcccacgcgcagctcctggtttccctccaccgtgcgcttgcggtccttcttcaccagcaggtcctcgaagcccgtcacctgctggtccttgtcgttctccgtgagcaggtcctcgtccttctgcgcgtgggtgaagacctcctcctggcccaccgcatcctcgacgcggacctcgttgaagccgtcgctgcccaggctggaggcgctcttgcgcgtggacttcgtcttctcccccggcaggccatacggcacggtgttggtgccgttgtagacggcgcccgccaccagcggccggtccgggtctccttccaggaagcgcaccaccacctcctggccgatgcgcggcagccacacgtcaccccaggccgggccgccccacggctggcccacgcgcacccagcacgaggccttctcgtcgcgcttgccctcgcggtcccagtggaactgcaccttgatgcgcccgtgctcgtcggtgtgaatctcctcgcccgcggggcccaccaccgtggccgtctgcgggcccgcaagctgcggcaagggcgtcaggcgccggggccggaagggcacggccttgggcaacagctggtactgatttcggtacaggccctgaatcgcctcgctgcccgcgctgacgtccggctgcgtgcccgaatgcaccacctccgtcaccaggtactcgcccgcgaaggtgccatcctccggggactgcacctccagcaggtacccgggcgtgaggcgcggcgccacgccctggcccatcagcgtgcgcccgcccatgctcgccgcttccgtgcgcacgttggtcgccgccttgcccacgcccggcgccacgtagcccgccggatagtcgtagagctccagctccgtgacaccttcgggcgcctgcgccttgccggagatatccaggcctggcttctcgaagtcgaagtccttcaggtgcacggcgccggggcgcagccggtgcaccacttccagcgcggagaggtactcaccctccacgacctccttgcccaggctgggacgcagcgggagctgctggccctgcggcaggggcgcgtgcgcgctgggcttgtcccccagcaccagggtgtgcccctcctcggtgtgctcgaagaagtagaagatgccctcccactccatgagccggctgaggaaggcgaagtcgctctcccggtactgcacgcagtactcacggggggcgtagctgccggacagggccagccgcgtcttcacgcccgccgcgtccaggacgtccttgaggatgtccggcacggacttctgctggaagatgcggctgcggtggtgctgggtgagccgccacagccggggcaccacgtgcgcccggtagcggcggcggcccgtcttcatgcccagcgattccacctcgcggacccagccgtgcacgtagcggggcgcactgtcgcggatggagagggtgagcaacgcgtcctgctccagcagctcgctggtggcgatggggttgccatccttggcgaagaagtccacccggaagtcgaacaggtggctcaacgcctcggtgccggaaatgctcgaaacactcagcgcatccgcgccgtgtgagccgacctgcaccgtgaacgcaggcggattgaattgagcggccatgactcccccttcaccgacgcggaggtccccagcctcgccgggaacgaacgggagattctaccacacgctgggtacgtgggcgcactcgcccggaatgccgccctgctacccttccagcgggtccgaggtccggaccacccgcatccccgccgcctggaagtcccggagggcctccttcgccaaccgggggaagtccaacgaggcgggcagcggctccaggggaggcgccggcaccggactcatggcgtcctccaggatgtggatgcggcccatcttcgacgggtccgtccgctcgatgtgacgccgcaggtccagcagcgtgttcagcacgcagtgggagctggcctggccgaacacgtagacgcggtcgaaggacatcaggtgctcgaagaggcgcgtgttgaaggccccgacctgctgccccttcagctccgtcacctcgggtgagagcacggagtagttctccgtgagcgggtgctcccccttcagctcgaagtgcgtgggtacgtcgcgcaccagggcgtggaagaggctcgcctcgaagacggacggcaccagcgcgtgactcagtccgcctagcatcgcgtggaagggccagacggtgagcacgtaccggccgctggactccagttgctcgcagtaggccagactctcctcgtggaagcgcgtggcccgccagcggccggagcgaacgtccgccgcggtgatggccgtcaatggcggcggcggccggccttccgcgtcccgccaccaggacggatggaacacgtggtacgcgcggtgggtgtccagcgagaacaccagctccgtcacccggtccaggttcgcgtagagccagcgcagcgcgcgctgggtgtcctccaccgcgccgggcacgaagagactggcgcctggcgtgcagaaggccacctgcacgtcgatgccgaacgcggcgatgcgcgtcgcgtcctcacgcgcggggcggatgcggtgctccgccgcgtagcggagggcctcctcggccacctccgcgccacgctccaggtagagctggctgacgcgggcgtcctcgtgaaagcggggaatgggcaagggcatgtcggcctcagcggtgctgctgcgggaagtgacggcggtgcagcgcatccaccagcgcctgcgtcgcggcggtgtaggcgacacgcgcctcggccgccgtctcctgcgcgcccaccagcgatggggtttccggcgcgctctccatgagcgggaagtagccgtccgggacgggctctcccacctggccgaccagtccgatgggccccgaaccatggcggcggcggaagaggacgggctcgccggggatgctcttcttgccctcggccaactcgttgccgaacttcatcaccggcgtgttgcccgtgcgagacagcttgtagatggcggccaccttgtcccgggtgagcgggcagtccatggtccgcgcgatgatgtggccgccgtagccgtagaactgggccgacggctcccagcccacctgccgccgcagctcctcgaactcccgcgtggcctccgcgtccagtccgtcctccaggatgttgacgggccgaatccccaggtcccgcgcccgcgtcaccgcgtagaggtactggagcttcttgttgccggagtcgaagcggatggagtcgttgttgccgggctcctcctggatgagctggaaggccgcggggattccggacgtaagcgtgtcgaaggtgtccagcaggtagctggagcgctgtggccggcgctcgcgcatggcccggaacgcggcctcatccgagccatagcgctggatgtgctcgtgtcccatggtacccacggggaccattcccagcttcgccgccccgtccacgttggaggtgcgcgtgacgcccgcgtccttgcagcttcgcagcgccacctcgtgctgctccagacaggtggccgcgcgcaggcccacctcgaagatgcgggacgggtcctcgacgatgtccaccagctccttgacggtggcgaagacgcgcttggcgtagccctctgtgtccacggtgatgggcaccgccttcacgcccaccgagtcgagcgtctccagcgcgatggccttctgctcgtcgcacgtcacggtggccagcgcgcgggccagcgcgtcccggtccgacagcgccagggtggcgacctggatgcggaagttgagctggagcagcagtggctccacccaggacaccagggcggacggccctgtcagcgtgaggatgggctcgcgcggatagaagagtgcgcccttggggatggcgcggatgctgagtttctcacggcggaggatggccgccttgaaccccacgcccatctcatagtcgtaccggctgaggtagtcgtagtcctccggtttgggctccgggatgagcgacttgacgaaggccgccacgtcgagcggcatcacctggagaccaccccgccggtgcgagtagtagaacgtttcccgacgaagcggccagncggcctccgncatgctgaacttgtagcctccgtcggtgcagcgaggaggaatcttggggtctttttttcgatgacgccaagagtaagcgcgtcaggggtgggtttcctatcctcccctcgcggattcccagggcatgacgtgaaagcggggttaaatggaggcgcatgcctcgggagcccaccagacgcctgctgccagcgctcgccgccagcatgggcgtacatgggctcttgtggctgaccctggagcgcgaggagccggtcgcgaggccccctccggcgtcctcgccgcctgccctggaatgggtcgatgtggaggtggcggaggcccgtgtatcgcgagacacgctgatgccggacaagggcccggtcgccggcgccgcccagccggtgccacccaagcgttcggacagcgtccatgcgccccctgcgccccgcacggctgcgaagcaccgggctccgtcggggaagccggcgccggagcgcgacgccgcgcccgctcaagcggagtcccggtccgagcgccacacggaacccacccacgcgagttcccagcccgcccacgacacgcaagtcgcccaagcggacgcgcggcctgaacgccacgcggaggcccaggactcggctccggcgctgctccgcttcgcggacgcgcccctgacggggacgccccccacggacatgccccgcgcggagcccggcaccaacgccgtcccgggctcgcggctgttgctcgcggcccgtcaggtcaccgcgctttcaggaacgcatcgcgatgtggcggcggagctcgacggcggcgtggacccgcatgcgcctccttcagcccagggcctggtggaagagctggtatccgaaagcgtgggccgaggccgggtggaacgcgggctggtgcacccgtattacggccagctcggcaaggcgttgatgaaggcgtgggacgccgaccgctccgtgaaggcgcacggcctccagggctacttcgacatgggcatggagcgcggccgtgcgtactcgcgcatctgggcggagcgcgcggcggactacggcgcgtcgggctcgttcgccgcgaagaacggcccgggcgaagaccggcgcaggccgctcagcaccgccggagaccccacgctcaatgcccgccgcgagctgcgccagcagatgcgtcaggagttccgcaccacgcgccgtgccctcatccgcgtcgtccaggacgcgacgggccagctcgtggacgtgcaccttctggaacccagccaccagcccgaggtcgacaaggaggccctcaaggacgtgcgcgccacggcggagaagctgcccccgccgccggacgaggccgtgggcggccgctcgcgactcaccagcgtctgggagttcgagctgctcatctccatcagcccgcccatccccaccttcagcttcgagttcgatgaagcgctcggcttcatcgacacccgactgccgctggaccgccgcatctacaagcgcgtgcggctggtcgaggtccgctgagcgggctcaggacgcgcgcgacttgcgcgccgccttcgtcttggccttcgcgggcttggcgatcttcgcctccaccgccgcgccacgcgtacggacagcgcgcgccttcgtggtgacctgcgggccgtagatgcgctcgtagtccttcatgctgcgcttgatgacctcgagcgcctccggctggtcgtagacctcggcgatctccacgctgcgcttcccctcaccgggaatctgcttgtaggtgaggaagtagtgcttgaggcggtcgagcagcgcgcgcggaagctgcgcgaggtgctgcagctcgccgtacaccaggtcggactccagcaccgcgatgatcttgtcgtcggcctcatcaccgtcgaccatgcggaagccgccaatgggaatcgcgcgcaccagcaggttgccgctggagatgaccttctccgtcagcacgcagatgtcgatggggtcgccgtcgcccttgatgtccttcaggcccgtacgctcggcgcagcgcttcgccaccagctcgtcgcagtacgtctgcggaatgaagccgtagagcgtgggacactggctgctgaagcgctgcggacggtccagcttgaggatgccggactccttgtccagctcgtacttcaccgcgtccgtggggacgatttcgatgtacgcggtgacgatttcgggggcgtcctcgcccggggtgattccgtgccacgggtgcgcctgggatgtggtctggattggcttcttcatggcgtgtctcccgagcgcttgcaggcctcggcatagagttctgcgaccgcgtcttccaactggcgcgtgagcgcgtcgcggtcctgcatcgtcagtccctgggtggggatgggctttcccaccaccagcgccacgcgctgtccccaccgcacggcccgaccccccttgggaagaatgaggcgcgtccctgacacggccaggggcaccaccggaacgcccgcctggatggccagcgtcgcggctcccttcttgaacggccgcagccgcccatccgtgctgcgcgtgccttccgcgaagaagagcacgctcacccgttcccgcagcgccgtgacggcttccgacaggcgggccctgtctcccgcccccccggtgcgctccactgggatgttgcccgcgcgccggagcgcgggcccgaagacggggatgcggaacagctccgccttcgccacgtaacgcgtgtgcttgcggatgtgggcgaagttcaccagcgcgtcgtagtgcgactggtggttgctcacgaagacgacgtgggtgtcggtggggacgttctcgacgcccaccgcctcgtgccgcacccccgcggacgccagcagcgagcgcgcccacagcaccagcacgccgtccgcgtccttggcgtcgcgcagcgacagcgccgacaccacgggagacagcacaccggtgatgcccaccgccgccgttccagcaaaggccgtctgcaggagcttgcgaatcaaacgaactcgtgggcggggaaaaggagcacgtccgagatgcgctggaccccgagcagcagcatcaggattctatcgagcccgacggcgatgcccgccgagggtggcattcgccctaccgcgtcaaggaaccgctcgtccagaggatacacggcccggcccaattggcgcctgagctcctgttcttctgtcaatcgtgcccgctgttccacggggtccgtcagctcggaaaacccgttcgccagctccaaacccttggcgtacaactccacccgctccgccaccaccgcgtcaccgggcttcagccgggacagcgccgccatggacgccgggtactcaatgaggaaggtgggccgctcgtggcccaagccggtctccaccttctggaggaagaggtggaagaagacgtcgtcgaacgtctccgcgttcccggtgcgcaccccggccgcctccgccgcccgcttcaatgatgggccatccgaatgctggcggatgtccacgccggtggcgcgcagcaccgcgtcacgcaccgtcaaccgctcgtagggggtgcgtgtgaagaagagcgggtccgccccgggctccccttccgtcgcgccgcggccggcctccgccagcgccccttccaggtcatccatgatggcgtggtagtccgcgtgaggccggtagaactccagcatcgtgaattccggattgtgggtcggggacacctccccattccggaacaccttgcacagctggaacaacggcccggcaccgtccgcgagcagccgcttcatggcgtactcggggctggagtgcaggtagagcgtccgcgcggagcccacatcggtctccgggatgaagccggcctcgaacgcgttgatgtgcggctccatccccggagtggggatgagcagcggcgtctccacctccaggtagccgtgggcagcgaagaaacgtcgcagggcggagtagagggactggcgtccccgggcggcccgccattgagaaagattgggcatgggcagcgcgcaagtaacatgaggagccacatgcacccaaggattcccctgctgctggccttcgcctgctgcctcactgcctgccccaagggcccgcccgccgatggccggcaggtcctttccgagaagcagcagctcgaggcggatgtcagcgccatgtcctcgaaggccgaaaccctcctcgaagcccagagccgcctggtgtgggacttctggacggagggccgccacgtggacgtcgccgccacctacgccggccaggaggcgctcttcaccatcgagaacatccgcagaatcgaccggctgcgccagctcacggacgacgcccgcgaggtgcgtgccctcaccgcgctgcactcgcacttcgccggcgagtacctgtcccacgcgctggccgagttcaacgacgcggccgccaatctggaagcatccctcaccttccccgtggacgggaaggacgtgcgctaccgggacctggagcggctgctcgccaacgagcgcacggtggcgcggcgccgggccctgtacgccgcggccacgcccgcgattgaacgcctcaaccagacgctgcgccgccgagaggagcgcgcggacgagctggtgcgggagctgggcttcgcctcctacgaggccttcggcagcgagctgcggcagtcggacctgggacggctgagcgtgctggcggaggaaatcctccaggcgacacaggctccctaccgcgtggtgatggagcgactgagccagcgcgagctgggcatggcgttcaaggacatcacccgcgcggacatcccccgcctgttccgctcgcgcgaggtggaggacgccttccccaagggcgagtccctgctcaaggcccacgggacgctggcgggcatgggcttggacctgggtgagctgccccacgtcaccatcgacgcgcgggacgtgaagggcaagagctcacgccccctggcgctggcggtgcgcgtgccctccgacgtgcgcatctccttcaagccgggcacgggcgtgctgcaccaggcacgcgtgctccacgagttcggccacgcgctgcacgcggccttcaccacggagacgcgcttcgaactggcgcgcctgggcaaccccaccgtgggcgaggcctactccgccctcttcgaggacctggccgaggacccggtgtggctggaggagcacgcgggcgtcagcggcgagcagcgcgcgcagtacctggccgcgtccagcgcgcataagctgttcctcatccgccatgccgcgggccggctgctctaccagttggagctgcaccgccgcgtcgaggccgacccgaaggcgctgtaccgcgaaatcatgtcgcgcaccgacgacatcccgatgacggacgaggacaccgagcgctacctcgtggaccaggaggacttcttccaatccgcggacagcttccgcgcctggttcctggcgggtcagctccaggcgcagctcaaggcgcgcttcggccccgcgtggtggcgcacgtcgcaggcgggcgagttcctcaagacgctgtgggccaagggcaacgcgatgt

SEQ ID NO: 1191 - DNA, 21143 bp, Myxococcus xanthus
  unsure (1)..(21143): unsure at all n locations
gggtcctcggtgcgggggttgtcgctggtgacgacggccaggtcggcgccctcacccgccaccgcgcccatcagcggacgcttgcccttgtcgcggtccccgccgcagccgaacaccgcgatgacgcggcccttggccagcgagcgcgccgcctcgatggagcgcttgagcgcgtcatccgtgtgcgcgtagtccaccagcaccgcgggggcgccagacggaccgtagttctccacgcgctccatgcggccggccaccggcatcatccgctcgatgccttcctgcacgtcgcgccgcgcgaagcccgcgcccaggccaatgcccaccgccaggaggatgttctccaggttgtggggccccaggagcttgctcttgagcgggatgtcgccggcgggcgtcttcagcacgcccttgatgccctggagcgagaagctcacgtcggccgcggaaatctccccggagccctgacggctgaacttccacgccatgcgcttctggccgcgctgctcgttgtagatgcggctggcgtaggtgtcgtcgccgttcaccaccgccacgcccgtggcggacaggttctccgcgaagagcttccgcttggactggaagtagtcctccatgtccttgtggtagtcgaggtggtcgcggctcaggttggagaagcccgcggccttgaaggtcaacccgtgcacgcgctcctgcgcgagcgcatggctggacacctccatgatgaccgtctccacgcccgcctccaccatctcccggaggatgcggtgcagctccagcggatccggcgtggtgttggcgcactccaccgtgcggccagcgaacttgtagcccagcgtcccgatgacgccggtggacgcgtacgctgcggtgctcatggcctccagcaggtagctggtggtcgtcttcccgttcgtaccggtgatgcccagcaacgtcagctggtccgccgggcggccgtagaagttggccgcgatgagcgccagcgcctttcgagcgctgctcaccttgaagaagggcacctgagaggacggcaccggcttctccgacaccaccgccacggcgccacgggacacggcctcaccgatgaactgggccccatcctccttcgtgccaggaatggcgacgaacaggtctcccggcttcacgcgccgcaagtcgtgcgtcacgccggtgacgtcaaccgcggaacggccgcccgaggtctgctcggcaccacatcctgcgaggacatccgtcagcttcatctcttccccttcacacgcattgcaagagcggggcctggagcggacgcggccttattgccgcgcggcgagctccagcgtcacccgggcccccttctccaccagtgaaccggcggcgggggtttgagataccacgcgtccactgcccaatacctgtggctccagcgccgcggcgagcagcttcaccacggcctcacgtcctacttctccctgaaggtccggcacacgcaccgtgccgggttcaggggtctccgtcaccgcgtccgccagtgccgtccgggcggcaccggaggcattcgcccccggtttcgccgcggcaggcgcaggggactcggcggccacggccacctcgggtgccaccgtccgggacgggggcacggccaggtgagccatggcggcggtcgcaatctccttgaaagcaggggcagccacggtccccccgtatacgtccgtcttgggttcgtccactacgacaagaatcactgctcgcggagactcggccggtaccaccccaacaaaggaggcgatccgcttgtccgaatacccccgcgccaccgggtctgccttctgcgcggtgcccgtctttccggccacccggtagtcctccatggcggccttggtggccgtccctcccttgaccaccacgctttcgagcatgcccacgacctgccgggcgaccttcgcggagaccgccctgcgcagctccgtgggacggttttccagcagaacgacaccgtccgggtccaccaccttcgacaccagatagggccgcatcagcaccccatcgttggccagcgcaccataggcggccgcaatctgcaccgccgtggccgtcatcccctgtccgaaggactgggtggccagggagacttccgccttcgggaacggcaggacgccgcgcccctctcccggcagggacaggccggtgcgctcggcgaagccgaaggactggtagcccttcacgaacttctcccgtcccatggcctgggcaatcttcgccatacagatgttggaggacttctggaggatgccctgcggggtgagccagccgtaggaatgggtgtcgttgatggtatggcggcccacccgccaggcgccattctcacagaagaagaggctgtcggcggtgatggccttctcttccatcgccgcggccaccacgaaggccttcagcgtggagcccggctcgaaggtgtccagggcggcgcggttgcgcatgcccgagcgcgagctggactccggcgtattggggttgaagcgcgggtggttggcgacggcgagcagctcgcccgtgcgcggatccaacaccaccgccatgccggccacggccttggcgtcctccaccgcgcggctgagcgccttctccgcgacgtactggaggtggcggtccaacgtgagggtgacggcggcgccctggcgctggagcggatccaacgcgccctgcaccagcagcttgcggcccttggcgtcacggaagccggaggtggaggagttctgcccggacagctcgtcctggaaggccaactccaggccctccaggccgcggccgtccatgcccaccgtgcccaccacgtgggcgcccagctctcgctgggggtagaatcgcttgggctccttggagaagcccatgcccggcagcgccagcgccttcaccgcggcgacctcggcgggcttggcctggcgtttcacccaggcgaagcgcttggcccgggccaggcgcgcgcccagctcgtccgggtccagcttcagcgccttggccagcgcccgggacgcggccttcacgtcgggcagcatggaggggtccacccagatggagtccacctccacgctctgggccagcggcgtgccgcgccggtcgaagatgtcgccgcggcgggccggaatctcgatgtgccggacgtactggtcctgcgccatgccgcgcagcttctcctgctcgaagacctggagctgcaccgcacgaccaaaggcgacgccgagcagcatcaggaacagcccgaacagcagccgtacccgcagcttcagccacttcgcgttgggctcgggagcccgcgccgccttgaaatccctcaccgactggctccggctcggcccgccacgcggacggtgggctgcgtggcgtccgggacctccgcgcgcgccccgctgtcacgcgccggcttctccgccgacagcgacaccacggcgccgccgcgcggcatggccatgttcaactgctcgcgcgccacgcgctccagccggcccggcgccttgagcgtggccagttccagcttcagccggtcattctcgcgcgtgaggatgcggctctccgcctcctcgcgcgacaggcggtagcccatgtccaccaccagcacccggctggtgacgtgcaggatgcccaccgccacgaagagggcgaagaggcacacggccggcagcaggtgcagcagcacgccgcccaccgtcacggaagaacgcaacgccgacacccgggagtgcaccttgctcatcggagtttctccaccacgcgcagatgcgcgctgcgtgaacggggattggcctcgacctccgcctcggaggcgggcacggccttcttcgtcaccagggcaaaatcacccaccccgctgcatacgcacacgggcaggcccggcggacaggtgcagcgccccgcgagcgcgcggaacgccttcttcaccttccggtcctccagggaatggaaggcgatgacggcagcgcggccccccaccttgaggagcccggggatggcggccagcagcgcgtccagcgcctccagttcgccgttgacggccatgcgcagcgcctgaaaggtccgggtggccacgtggatgcggttgggccacgccttgcgcggcaccgcccgcttcacgacctccgcggcctccagcgtgcgcgtgggcagggccttcttcagctcgcgggcaatgggccgcgcgaagggctcttcaccgtagtccttgaggatgcggaccagctcgcgctcgtccgtggtggcgatcagctccgccgccgtcgggccgtccggccccatgcgcatgtccagcgggccgtccttggagaaggagaagccgcgctcggccacgtcgagttgcggcgacgacacgcccaggtccaccagcacgccatccacgggcagcaggtccgcggcgacgcggggcagctcggcgaaattgccggcacggccctggaagcgcgggttcgcgcccaggcgcgcggtggccgcggcgagcgccaccggatcccggtccacgccgaccaccgtggcgcccgaggccagcagcgcctccgagtggccaccgccacccagcgtcccgtcaatgatgacccgcccatccgccggccggagcagatccactgcttcccgcaggaggacggtctggtgctggaagtccgaagccgtcacgggccgtcagacgaagggggcccgtgccagcgcgaaggcggctcgggcatcgttcatgtgcgggtagatttcgaaacagtcgtgcgcgccggccgcgcggaagatggcggccaggtacggcgacagtccggacagcttcacgtccccgccggcgcggcggaaggcatccgtgcgcgccatcagcggcttgacgccgcggtagttcaggtgccccacgtccccgaagtccagcaccacctgacgcgtgccgcgctgcagcttgcggcccaggtcgtcgcacagctcgagcaggtcctgctcgctcagctcgccctccagcatgagcgtctcgacacggccggcggcaatcgccgcgcccgccaaccctggccgaacctccagaacctggttcatacgcttgccaccctcccggtacttcggggtcctgtcgactttcccgtcacgcttgccgcagctcggcgagcaccttcatcacatccgcggaggtcgcttcctggcgcgcttcttcctgcgccttcgcccacccctcccggctccacagctcgatgaccttcaccatccccgcccacaccacttccttctccagccccgcataggagcggagcgtcggagggatgagcaggcgccccagcttgtccagcgggcactcctgcgcgctggccacgtacaagcgcatcagcgtcttcaccccaggctccatcgggttgcgcttggccaacgacagctccagcgcttcccactcccgcaccgggtaggcgtggaggcatcggtcgagcgccgtcgtgaggatgagcctctcgtcgtaggcgcccaccagcgtgtcccggagcttcgccgggaggctcgtccgccccttcgcgtcgatctggtgctcatagacgcctcggaacactcgggacgatccaccttttcagcccgctgagggatgaacctccactccttcccactccttaccacttccgggcggcatacatacgcgccccacctgggggggtcaagaaaccgcaacaggttgaaacagcggtttgtccgcgccggacgtccggaaaggccgtcacacctggaaggtccagtggttggcgccgtacgacgccctacctattgcgctggggtaaacttgagttcccccctgacccaggcgcaaagtgtcagtcgcgtgaacacgaacgttcggctgaaggtggcctacaagacgccgcagtccctggtgggggagtacacgcgcagtgtcggactggggggtgtcaccctggagacgcgccgcagcctgcccctgggaacccgcttcaccttcgaactccatgcgggcggtgtgcctcggcccgtggaagtgctgggggaagtggtccaggtcgtcccacacgaggagtcccagcgcttcctcctcaccgtccgctatggggtcggagaagaccgcagcgcgttggacgccatcctccagcgcatctactccgccgatgaacactccggcctgcgccgcttcccacggctgcccctgtacctgcgcgccgtggaggcggcccccctgtccccgggcttcgtcgtccgggacatctcccggggcggcgtgggcctggaggtgcaggccccttccttgccgcgccaggtgaaggtgggcacgcccttcctgctggagatggacttccgggaggggcccatgatgctgcacggcgaggtggtgtggacctccacggtgccccggaagaactcggggacggtggcgccgggcttcggcgccaccttcggccggctccggccggacatgcagcagcggctggaggggctgttgtccctggccacgctgccgcccgtcccctggaaggcccgggtgagcttcggcatggaggccgtcgcgcggatgccgtgacggctcggaggcccccgcgggctacaccgcgcccagggggtagccgcccgcggactcaagggccgccaccaccgtctcccgcagcgccgcngggtcatatggcgtgaagacgtccagcgtgcccaggcgctcgagctcctggtcgagcgcgccccccttcaacgtggcgcacagcgcgcggcgcgtcctgtcgtaggcgcgggggatggcgtccagtgcgtagagctgcgtcatcgccacccgcaccgggtccaacgcgccggacgtggcggcctggcgcgtgcgcgtcaccatggagtccagggcgaaggcgtccatcaccacgtccgacagggccgcgagcacctcctggtgctgctccagttccgggccgaacgtctccgccgccacgcgcaggccgtggagcgccaggtgcttggcggcctcggcggcgacctcctgcggggccagggcgtcctgcacgcgcgcgcggggccgctcgccccgggacagctcctccgccacgttgccggccatggcgaacagcggcaggtcccccctcaccgcgcgcttgaggagcatgccggtgatgagcatgcggttgatttcgttggtgccctcgaagatgcggttgatgcgcgcgtcgcggtacgagcgctccaccgggtactcctcgatgtagcccgcgccgccgtggagctggacggcgtcatccacgaggtggccgaaggactccgagccgtgcaccttcatgatggaagactcgatggcgtactcctccaccgcctccaggaggcgcgcctcgtagtccggggcgtccttgtccccctgccccaggcgcgcatccacgagcccggcggtgcggtacgtcatgctctccaccgcgtagacgagcgcggccatgcgggccagcttctcgcgtgacagcgggaactggacgatgggcgcgttgaactgcttgcgctcctgcgtgaagcgcagcgcgttctggagctggagcttcatgccccccagcacgcccgcgcccagcttgagacggccgtagttgaggatgttgaaggcaatcttgtggcccttgcccacctcgcccagctggttctccaccgggacgcgcgcgtcctcgaagtagagcgggcacgtggaagagccccggatgcccatcttgtgctcctccggccccacggtgaggccgggcgtgtccttctccacgatgaagccggtgaacttgtccccgtccaccttggcgaagacgacaaacacgtccgcgaaggccgcgttggtgatgtagagcttggagccgttgagaatccagtgcttgccgtcgggggacaggactgccttcgtcttcgcgcccagcgcgtcactgccgctgccctgctccgtgagcgcataggccgccacccattcccccgtggccagcttcggcaggtacttcgccttctgctcggcgttgccgaaccagacgatgggcaacgtaccgatgccggtgtgcgcgccgaacgtcaccgaccaggagccgttgaggctcatggcctccgccagcagcagcgacgtcgtcttgtccaggccggtgccgccgtaggcctcggggatatccacgctcagcaggcccagctcgccggcctgtcgcagcaactggcgcaggagcgcgttgtccttggcctcgattcgctcggacagggggaggacctgctcacgggagaactggagcgccgtcttgaagaagaggcgctgctcctccgtgaaggtctccggggtgaggatgcgggccgagcccacctcctcgaagaggaacgcgcccccgagagcaagcccctgctgcgaagtggccttggatgccgcatccatgagtatccctccagcgggggagcgcaccccgccctgggacctgaatctaatcctccgggtggaagacgcccgcgaagacccggcgagtcctcgccagtccactgccctgcttcgcttcagatgaagttcgctgtccggcaggcagcgccttcccgtaagcaaacgggcgagcggtgcccttcaagtcagccgaagcaggcggtcctggacaccgcgcacgccaggctacgggccgccgccttcgttgtcggccttggcccgagcccgcttgccccgcgccacctcggtggcgagcgcctccaggcgcggtgtccagaacacgcggaactgctccagccacgcgtcgacctgctgcaacggcgccgggtcgacgcgatagaggcggcgggtcccttcggcgcgaacctccgcgaagccgctgtcgcgcagcaccttcaggtgttggctgaccgccggctgactgatgccgaactccgcctggatggactcggtcacctcgccagaggggcgttccccctcggccaggagttcgaggatccgtctgcgcaccggctcacccaggacgtcgaaggcatgcatcgtggctatcaggtccccggatgccgcacgtcgggcggcggcgctccagtatagaaggccgtcgtccgcgccgcgcgtgccttcgccgccgcggcgtcctctccccgcgtcacatccgcctggccccagccctcgctgctggccgtgatgaacgccttgccttcatccgaggtcgtccaggattccaccgcggcgctgtcgacagcggcgccgccggactccaagtgcatgcccaggcccatcagccccagctcccagccgacgccggttgcaccagggccgtagtcgtcccagaaggggctcacatgggccatgtgctccagccgcagccgggtgccaccgccaggcgcgttggccaggatgacctccaaccagctcacgctccctccgaactcccacgtcaaccccaggtgccgcggagcctcgcaacgggtgaccgagccgctggcattgcccttgagctcgtaacgcccacccagcttcaggtcgccggacaccggaaggaaccagcgggggatgcgctcggggttggtcagcgcgtcccagaggtcctccaccgtcgtgtcgtagtcgcgcgtggcgacgacgacgcgtgcgggcttgccctcatgctcacggctctccacctcccgcacgacggcccccaggtaccgcttcacatcaatcatgtcgcctccatcaataagcatggacttatataaacggcgacttatcgacgatgtcaatgcacaaggcgatgacacgagagcgcggccacggtggattccacacagcgggttcatcctccgtccggggccttgtgcggcgtggggtagacgaagcacagggtgtcgaacagcggctcacccggcgcggtgaaatttccgccgagcgcccgcgccgcctgcgccacctccgtgccgaacgagggcacgaggcagatgtcctcggacgtcttgaagcgccccttgagcaagcccaggccccggcggagcgtgacgatgtcctgccgccccgcccgtactggcaccgagggaccattcggatccggccccggcaacttgcccacgctggtggtcagctcgaagccgtccgcgcgcatgatgatgcgcagcttgcccggcgcgacctcctccagccatgcgcggaagcccgcttcgtcccgcagcaccacgggataggccacgggcccgtccgggtgcgccagccacacggactccgccgagtcccgcagcacggtgaacagctccgacgtctgcaccaggaacgtgtccgcgtccggaaccaccaacaccgtgtgccctttcacgcgccgcgccagccgcgcggcgtcatccgggcgcgctggctcgaaggcctcctcgcccacgcgcacgcgctcccccgccagcgccacccggagcgcggaggctggaagcggctcgccatggatggggcccgccacctccacttcggacggcgacgcgggtcgcggtgcttccggagccgcttcgcccggcacggtgagcgagggcaagggctcgggcttcaatgacttgagcggctcggcctgcttctcctcacgacagccggcgcccaccacgacgagcagcaccacggcgagcgcctgggtggccgcatacatgccccgcaccatcctcacgtggcgctccacccaagtggccgccatccaacgtcgctggtgatgacgcatcgataagtggcgcgccgagcgggcatccttcggcgtccggccctgccccccggcccccacaacacctcgggcaccgccatggtggtggatgtcgcgagacgtaggaagaggcacacccatcgtcgaatcacagtcaacggatttttcccgtaatggcgttttacctaccccatgatacattcaggtgcccctgccaagacagcacgggcccccttggcgcagcggccacctgcacccgaaggagccggaacgaacgtgcagcagctttccgaagggcttcatttcggtaaatacaagctgctcgagcgcatcgcgacgggcgggatggcggagatctaccgcgctcggatgactgcggcggcgggtgtcaccaagccggtggtcatcaagaaaatcctcccgggctatgcgggcaacagcgccttcctgtcgatgttcgtcaacgaggcccgcatcgccgcggggctgagccacggcaacatcgcccaggtcttcgacttcggcgaggtggacggcgagtacttcatcgccatggagtgggtggacggccgcaccctgtcgagcgtcatgcggcgcgcgcgggagaagggcatgtacaccctgccccagccgctggcgctgctcatcgccgtggagatgctggaagggctgggctacgcgcacacgcggctggatgaacgcggccgaccgctccacatcgtccaccgcgacgtcagcccgcagaacgtgctgctcagctacgaaggccaggtgaagctggtcgacttcggcatcgcgcgggcgcggctggccggcagcgccgagccggtggagtacgacctcaagggcaagtacacctacttcgcgccggagcaggtccgcgggcgcgagcccgacgcgcgctcggacatcttcgccgcgggcatcgtcatctacgagatgctgtgcggccgcctccccttcgaagggaagatgccggacgtgctgcgcaagctcgccctgggcgacttcccgcggccccgcgacctcaacccaggcatccccaccgcgctggagcgcatcctgctcaccgcgctggccgtggagcgcgagcagcgctacgccaccgcggaggccttcgccgaggccctcacacgccacctccacacggccgggcccgacgtgtcctccagcgcgcgcgctcacttcatgggctacctcttcgaggcggagctggtgggcgaaggccgccccgtgctgctgccccgcgagttcctggcgcagatggcccggtggacccagtcccccttggagcgccgcgccctccgggagatggcgccgcccgtccgtgagccgcccgatgatgaggaggagcggacccccatcgccgagttcgagctgcctccctcccaggccgccgcgcccgtcgaagggcggatggagcgcacgacgctgacgctccccgcgctgcccggccccggagcgccgcccgagcccggtgtcccgcccctggacgcggcggcatcgcggacgatgggcatgccccgggccgtcaccctgggcgcgcccatcatcgtggcgctgacagccacgctggccctgctggtgtcgaacagcacgggcaccttctccgtggagctgagttcctcccctccaggcgccgccatccgggtgaacggccagccacagaccgcgcgcacccccgccctgctcacgcagctccccgcggacgcggagcacctgctggaggtccaggtcccgggcatggtggcgtggagtcagacggtgcgcgccgagcgcggcaccaccctggccgtccatgcccgcctgctccccaagcggattcaaggccccgcccagcagccacaccgcgccccgccgcctcatgaggtgcggatgcccgccgagcggatgtccctgtccagcgtggtgcacgccttccgcgtgccctacctctccaccgcgcagatgcggctggacccgtcgcgcacctacagcgtccgggtggagggttcggcctcgctgggacatgccaatacggtggaacacgccgggtacttcctggagggagacgcgcgtctggcggcacgcgagtccttcggcgtgctggacggcgaggagcggctggtgcgccacgcctcgcgcctccacgtcttcctgctggacgcgaaccgcacggacaaccacggcacgctgatggtccgcgtgcgcgaatgggacaacgacggcgccgtcaccaccctgcgggtggacgcccggacgcacgcggtgaagctgtcgcgcgtcgaccgcttcctgctgcgcgggctggagccggacacgcactacgacgtcgtgctgcgggacaccgctgagtccgcgcgcacacggggcttcgacgggggaccggtgggccgcgtgctgggcctgtacggcgccggcgagggcccggagaccgtgtccggcctgctgacgctgctggaggtgggccgccccctgcgcctgcggggcgccacctggttgcagctcgcgttccccgacgaccacctggccgacaacaccggcagcctggtgctggaggtatcgcccgtgacggcgcccggcacctcgcccgctcccccaccagggccgcccgctcccgctcccaaccggtaacgggccgctacagcggtgcagcgacctgttgccgaaaagttgatcaccggaggctgccccctaccctgggcgccacggaggactcaccatgaagaagctggtggcggtggccgtgttcggcctgatgggaaccctggggatggccgcgcgcgtggacgcccggccgggagtggacgggatggagccaacggatgcacaggtcgaggcggcgctggacgcgcggcagaagctggtgctgggcaacctcctccgggttcagcaaacggacgcacgcacggcggcaatccaccggtaaactcgtggcgtccgacgtggctcggtgctaagcccaggcctgttccgacgttcagcccaccaacctcacccgtgagggggacatgcctgaagggtccgcgtcactccagctcgcggttggcgaccgggtcgtctatccgaaccagggggtctgccgcgtctccgccatcgatgtgaaggaagtggcgggacagaagctcaccttcgtcacgatgcgccgcgaagaggatggcgccgtcgtgatggtccccgagggcaaggtgctcgccatcggcgtgcgcaaggtcgcatccgccgaggacgtggaggccatcttcaccttcctccgctcggacagcgacaaggccgacctcgactggaagcagcgagcccgcaccaacctggaccggatgacccaaggcggcatcatgggtctggccgaggtggtgaaggggctccaggttctcagtgagctgcgcccgttgccgaccaaggagcgcgagctctacgacaatgcccggcacctgctggtgacggaggtcgccgccgcgctgggcactgccgaggtcaacgccgaggacgccatcgacatcgtcctcttcccgcccggccgcgagcgccccaagcgcaccgcagccgagttccagcgcgaggaaggcgacctggacctggacagcgatttgctgggcctggacagcgacctggacctgccgtccgacgaggagccctccgagccgtccgaggaggagtccagcgaggaaggcgagtccgaggaggccgcgtcctccgaggagagcgcccccaagaagcgcggccgtccgcccaaggccaagacggaggcgcccgagggcgccgagccccctgctccgaagaagcgcggccgtccgcccaagcccaagccggaagccacggcggagggcgccgagccccctgctccgaagaaacgtggccgcccgcccaagcccaagccgcccgaggtggaaggcgccgcgcccgccgcgccgaagaagcgcggccgtccgcccaaggtcaagccgcccgagggtgagagctgacagccccatggaccgacgggcccctgcacatggggcccttccgccgaggtgacgccccgtgattcgcgtcgtgacgctggaccccttcgacgacaagcagctcgcgaagttcaaccgcacgctctacacggcgttcggcgtgggcagtgagcactccgacagcgtggaggtgcccgcgggcatgtccgagccgctggatgcggagaagctgattgatgaggtgaagggcatccgttcctacaaggacgacaaggtgctgctcctcaccacgcgcaagctgaaggaccgcgagcttcccagcggcgtggcgcccacggcgggcttcgcgcgccaggggaaggaccgcgccatcctcaccatcgcgccgcacaaggatttggagagcgccttcaaggccgtctcccgccacgcgctccaccagttggggcacctctgggagctgcaccactgcctggacccgcgctgctcgatgtacccgccctggacgccgtccttcgcccagggtgaagccatcttctgcaccttctgccgcgaaaagagcgagcagaagattcgccttgcgaagtcctagcatcacgcgcgcgctgcccctcgtggagttgggggggctgctcctggtcgcgttcctgtgcctgctcttccacctgcgcctgccgggccgcctcccgtcggaggcggactaccgcgcggtggcggagcgcctccaggcggaagcccagcccggcgacgcggtgctgctcttcccgtggtggacggagcgcgcccgcatcttcgtcccctccacgctgccggtgtacggctacctgggctcggaccaggatgacttgtccgcgcacccgcgggtctgggtgctgggccagccggagctgccccgctcggacgaggcgggcttcctcgaaaccttcctgcgtggccgccgcgcggtgggcgccccgtcgaggcatggcacgctgacgctggcgctctatgagaacggccggcaccgtccccggcgcttcaccgccacggaggcctatgcgcgcgcccgcgtgtacctggagcaaccggatggcacgcgccgcgactgtcccttcgacggcaaggtgcaccgctgccccgggcccgcgcacctgtacgtggcgccggagtggcacgaaatcctctacgagccgcggcgctgcctgtggatgcacgcgccgggcggcaagcagcggctggtggcggagttggacggcgtgcccggtggcctgggcctgcgcctggagggcggcatcatcttcgagcacgccttccccaaggactcgcgcttctccaccacgcacctgggcgtggatgacgcggcgaacggtgcgcggctgctgtcgctggcgataccgccgggcctggagggcgtgcagaaggccgaggtccggctccccgagggcgcgccacacacggtgaaggtctgggtgcaggcggacaacgcggaccggcggcaggtgtgcctggacgtgctggccgtggagcccgaagtgggagtgcagggatgatgcgaggacgcgcccccacgcgcgacgagaagtccctggcctgggccctgtgggtgctggccttcgcggcgctgtggctgacggagtccgcggtgggctacacgcgcgacgaaagcgtctacttcatcgcggcggagggctactcgagctggttccggcagctcttccagtcaccggcccgggcgctgacggacgcggccatcgtgcgcgcgtgggactacaaccacgagcacccggtgctgatgaagacgctgttcggcctgagccacctgctcttccacacggagctgggatgggtgcgctcggcgacggcgttccgcatacccgccttcgccatggcggcgctgattcccgcgctgtccttcctgctgggcagcgccatgtacggccgcctcgcggggctgttcgccgccttcgccttcatgctggtgccgcggcagtacttcaacgcggagatggcgtgcttcgacgtccccgtggccgccatgtggctgctcgtcgtgtactgcttctggcgcgccatggaggacgtgcgctggggcctgtggtgcggcgtggcctttggcctgacgctggccaccaagcacaacgcgctgttcctccccttcgtactcacgcccttcgcgctgtggcgcgcctacagcgccagcgagggtcagccagaggcccgcgcctggctgggccgcttcgtgggcgtgttcacggcggtggccgtgttctacggcctgctggtcctgtcgctgggcggcggtgagggcttccagcggaagttcctgctgctcagtccgcacacgctgctgttcgccgggctcgcggtgggcggcgcctgggtgctcaagggcgtggacaaggtgaacgcgcaggtggcgcgcgcgctggtgcccatcgccgccatggcggtgctggggcccgtcatcttctacctgcactggccctacctgtggcaccagccggtggaccgcaccgcgtggtacctggcctttcacgccaagcacaaccactacgcctggttctatctgaaccagttgctgcgcgagccgcccttcccgctcgcctacgtcgtcgtgaagacagcgctgacggtgcccaccagcatcttcgtccccatggtgacgggcctggcggcgctggtggcgcgcatggtgctgggggccttcacgcggacgcgcgcgtgggtggagcgcccggtgacgatgacggaggcgctggtgtgcgtgaacgcggtggcgtccatcctcatcatcagccacccgcaggtgccgcacttcggcggggtgaagcactggttcccgtccatggtgttcctgggcatcctcgcgggcgccgcggtggcccggggctgcacggcgctgtgggagcggctgaagatgaagtggccctcattgccgcaggccgtggtggccgtgccggtgttcgccatgctgctggcccccgcgctggtgtactcggtgcgcgtgttcccctacgggacggcggcgtactcggagctggcgggaggactgccgggcgcggccacgctgggcatgcagcgccagttctggtccagccatgtcaccggcgtgctgccgtggatcaacgcgaacgcgaagcagggcgcacgcctgttcctgcacgaggtgcacggcggctcgttccgcgactaccagcgcaacggcatgctgcggaaggacctgcgcgcggtgggcagcccggcggacgcggacatcgtcgcgtaccagtaccaccaggagttccgcgagcacgagttcctcacgtggcaggccttcggcacgcgcacgccggtgacgggcctctacctggatgagacgccccaggtggtcgtctacgtccggccggagacgcggtagcccctcgaggccaccgcgtccgccgggacgcggggctcaggtgtctccgccgctgctccccgccttcttgcggaagttcatcaagtgggcggccccacgcaggagttccgcgtcactgagcggcgccacctgttccttcagttgcttgtactcgctctgggtgaccttgggccggtccccgtcgatgcgctgctggaagaaaggctggtcggggaagtccttgtggaagaagcgctggtccacgtactcggcgcgctgcgtacccgggcgcatggcgaacttcgtgtccacgatgacgtccgggttgccggagatggccttgtccggaggaatcatggccgtgttcgcgccatgggacgccgaggccaggttgttgggcgactgcgtcttcttgccaccctcgccgtggcccatgccgtggaggatttcgtagtccgttcgcggctccgccgtgccgagcttctgctggtacttcgtggagctcgtctccccgcccgtcatcttcccgaagaccttggtgtgctcgcccttgtcgcggtccggcaccgcggtctgcacctgctgcggccccaggcccctggggtcgagcggccccgaggcgaagatgcccttcttgctcgccgcctggctcccgtagtgcgccagcatgttcaggttgtcattgggaccgtccttctccgtccggagcgcctccatgttggccggacgcgccgcgtgcgtatcctggagtcccgccgcctgcgactgcttgaagaggtccgcattggaggggcgtggccctcctgccgccgccgcgcgctggggccgcgtcctcaccggcccgccgtcaaagccatccgtcggagacggcgtgcgattcgaggacgaagccgatggagacggcgaggccgacgtcttcggcgggggcttggggtacggcgagtagcggttcgaggaggaagtgctgggtttgaggcttcgggagccgactttcttcatggagaactccttcggggggtgaggaattgaatccaaatccctggcgccgtcgagcccgcctcccagaaaggctacccagcgggcggcggcgaaaggaatatgtctatcattgaccatttcccctccccgccgacaagcccgcacaaccgttcacttgctttctcaaatcctgtcgaattcccatctcaagatgcgaatcccactccatgccttcatcgcagcaatgctcgtggcctctgcttgtggaggcgaggcaccgtcctccgccgattccagtccggacgaagccctcgcttcacgggagcaggcggcgttctccggtgtgaatggcacctactgtctggtcagcccctacaactgcaagctgcaagcgtctggcggaaaccgcgtccccaccaactcgcccgaggacgacaactggggtctggtgacaggcgttcccatccgggacggtcatggcacggtggtaggcaccaacacgcggacgagcgcggccttcaactatggccagacgcgcaccttcgcgggcgagaagcatgccttcgcggtgtcgacgtccaactccagcgccgggtggctccccatctccagcatcctggggaggacttccttcgagcagaaggtcggccacgtctccgcgctcggcgcgggcctgggcaacctgggctgctacgccgtgcgcgactggcacgacaccacgctcgaattcaagaaggtcgtctacgacagcacggcgacgcacgagcgggccggggactacctgccgttggtgcgcgccaatggcctgcgctcggcgaacctggtcttcaacgtgccgggcttcgcgctgggcgggcccgcagtggaccacttccccgcagggacgaagttccagcgcctggacgtccccaccgagcacggcgtgccgtccatcgacattcccctgtgggtccaggacagcgccggacgctaccgtcagcagtccggcaccatgaaattcctctacggttacgtcatcgccgccacgggaacgaagcgcaacgggtggatggcctatgacgccctccaggtcagctctggctgtccctgagccccgtcaggagcgcgcccacgtcgcgcgcggaggacatgacgccgtgcatgcgcgcgcccgcccggtcgcggtgtgcactggcggtcgttgtagctggcgcgacctgtcacaggacaacccctgacctcccctcaggacgaagctccgaagtaggctggagggaggcaggtgaaggctcttccacaccccgggagggacacatgaggcgctggactgggttgttggcggtggccgcgctgtgtggcgcggcttgtgacgggaagaagtcgacggacaggcccacgcgggccgagctgcggaagacgggcggggccacggtggaggtcatcccctccgacggccagcttccctactgcatgctgtacacagtgtccgagaagggcgtcatccggcagctcacgctgacgcgggagaaccgctccatccgctgtgatgcgaacaagcccgtggcgcacacgagcttccgcatccccgttcaggaggggaaggtccgcatgtacatcttcttctccgacgaccgcatccccgcgggcccggtggcgcagcagctctacgagcttcggagccaggagcgcatcaacgccatggacctgcgcctgcccggccgcgtgttcgtggagacgttggagttcacccccgaggaaggcggcacgcccgtgacgggcaccgtggtgggcgcgggaggcgacaccgaaccggagggcacgggtgccccggtgctgtcggatggtggcaccgagggcagcggcatgggcgccatggacgaagcgccctgagccatgaagcggcgcgccgggggaatcccctcccccggcgggcggcggctcagtaggcctcgcgcgccagggccagcaggtccgcctgcgacaccttccgcgggttgctcaggtgcgaggcatcctggaaggccttctcggcaatccgctccaggtccttctcctggacgcccgcgtcgcgcagccgcgagggaatgcccaccgccgcgttgagcttgcgcacccggtcgatggcgttgcccgcgagcacctcttcgcgcgcctgcgtcgtgtcccccagcgccaccgcgacccgggccagccgcgccgtgcagaccgcgcggttgaactccatcaccacgggcaggacgatggcattcgccaggccgtggtgcacgttggacacaggcgtgagcgcgtgggccagcgcgtggcaggcccccaggccctgcggaaggccatcttagagca

SEQ ID NO: 1192 - DNA, 19222 bp, Myxococcus xanthus
gccctcgcgtcggtgagcgggtgcgcttcaacggacgtcgtacaccgccctgacgccagcactcgtccccgcgaagcacctgggccgcgccaacggcctcgtccaggcgagcgatgccgccgtgcccctgatcgcccctcccttggcggggttcctgatgagcgccaccagcctgggcacggtggtcttgatcgacttcatcagctgcctggccgccatcaccacgttgtcgctcattcggagcctgcccacggggagcggggcctcctcggatgcgagcacatccgcgctgcaacaagccctcgaagggtggaactacctcaaggcacgccggggtctgctcggtttgctcgcgttctccgtcaccaccaactgctcgctctccgccatgcaggtgctgcttcctccgctggtgctggacatcgccaacccggccgttctcgggggactcctgtccacggggggtctggggctcctgatggggagcgtcgtgatgaccgcgtggggcgggccgaagaaccgcatccatggggtgctcggagtcggggtgggcctggggacggtcatggtgctcgcagggctgttccccaccctgaggatgctcgggtattgcaccttcatggcgggattctgcatccccatcatggatgcaagcagccaggccatctggcaggggcaggtccccgccgcactccggggacgcgtcttcgccatgcgcgggatgattgcctggtccgtccagccgctggcgtaccttgcggcgggcgtcatcgcggaccacctggacggcgtctccttctccatccccgcgctcttcgggccgctggaacaactcgacgcgcgcagccggggcatcgccctgtgcttcatcgccgccggcctcttggcgctcatcgcggcggtgcggggctataccgcccgccacgtccgcgaagtcgaggagatgccaccaggcccccccttcaccggggccgtgtccccgccttcgcggtaaggggcctcagttccgcgtcagcgtcaggtcatccacctgaatccaggtgtcgccggtgttcgcccacattcccgcgaacacctccacgctgtgctgggcgccggagttgaacgacaccgacaactgcgtgtagttgcccagcggctgggcgaaacgcacctcgttgaggatgggcccgctccggagcagccgcgcgccgaagtagccatccgcgtggttcgtggacgtcttcacccagcccgtcagcgtgtactgggtgttcggcgtcaccgcgacctcctgcttcacggcattccaccccgtgtcgttccgcgcccaggcgttgttggcgcccgtgcgcgcatagccgagtccccggtcaatgcccgccctgccttcggtgtaccagggcgacgtggcgttgttcgtggactgctgctcgaagcccgcctggtggatgagattgctcccacgcgtcaggctgacgtcatcgagctgcatccaggtatcaacgttgtcggcccagaggccgccatacacctcgatgagcgcgttcggcccggagttgaagtggaccacccgctccgtgtaggcccccagcgcgccgaagggcacctcgcccaggatggggccattgcccggcccgcgagccccgaagtagcccgcggtgttgttggcggagctgcggacccagccgcgcagcgtgtagtccgtgtaaggctggacgacgacgctctgcttgagcgcattccacccgctgctcgcgttcacgaagccgttgtcctgcccactgcgcgcgttgccgagcgcccggtccacgccgcccgagccttgcagataccagggcgccatcaccggcgtggccgcctgtgtctcgaagccaggctcggagagcaggttgtcgctgtgcgcgtcgtgggccagcgtggcccgcatgaggaaggtgttgtacggcgtccactgggacatgacgaagtacagcgagtttccggtgttgccccaggggtggatgaacgcgttgtagaggcccgggtacacggctccactggcgagcaccttctctccgctccagggccccgtgggcgtggcggcgtcacgcatcaccaccgcctgccggtgctcgttcaggtacgtcatcaggaagcgcccgagcggcgcgtgatacgagacggacaactcacccgcgataccaatggcgacgggccgcgccgccgcctgcgacacgctccatccgtttccatcccagtagcggtagccgttgatgtccagcagcgccgtctccggcacgcgggccaggtggacgttgccgaagcggccgttcggcgtcgcgtacatgtagacgaacccgccgttcctgacgaaggccgccatctggaagttgttcgtccaggccggcgtgttctgccaacgcgccgtcgggtgcttcacccagttctgcccctggtcatccgagtacgcgatgcccgcgtggttcgtgaaccacatgcccgcctccccccagtggtggatggacatgtagtggatgtagtgccgcgagccgatggtgacgcccgcggtggggatgacggtgatttcgtcgaagttgaccttccgggacgcgaggatctccttcgcatgccgaggcccgtcctgaatcatggaggagaaggacaagccgttggccaggttcgtatcggacgaacgcgccaagacgttgctgcgccagccgcccccacagccaccattgccacaccagcccgcgccgaaggtgtccccgaacaggacgaacacctcgccaccgcccttgtcccagacgatgcccaggtccgtcccatggacgtcgtggttcgtgtgcgtctggttcgggttcggcagcagctcaccggcgggcgtcgcgcccgtcacccgggagaccttcgtcacgttcgacggcgttacggccgccgccggggtgccccacaggagcgcccacgtggcgtgcagcagaaacgtccgcttccatgtcgtcatgcgcttcatggccacctctctggttgtcacggtgcaacccggacgggagaggcgactctagtcgcataacgcgattaacctttaaatcaaggcgcgacggacgaccggagtgtcagccctgcgccagcacgcggacgagcacgtcaatcatggtggcccagccctgctccgtccggctcgcgtagtcggcccacttcgcgtccatctcgtgggtgagcgtcagctcgcagccggtgtcgcgcggtgtgatttccaccgtcacccggctgagctcgtccccctccttgtcgatgtgccaggtgaagacgagccggcgcggccggtcgatctccaggtacgtgcccacgtggtcgatttcttctccggcccgccgcacgaagaaggagaacttgccgcccacgcgcgggtcgatggcgagccgcagcacctcctcgtcccggaccgtcggcccagtcatccactggccgaccatctccggattgagccaggcgtcgaacacccgctcaggcgacgcgctgaaacgccgtgtgacgcgaacctggacgctctgtgctgaagacatggcttttcctttcaatccgagggttggcgcccttgctaaaccacatggttcaacatattcccggccgaggcaatgaacaaccacttggttgaccttcgtcacgggtgagcccgaggcgtttctggtagagccgggggaatgcctcagcgccccaccgtgcgggaagagaaatccattctccgagcgccagtccgccagaactgggagcagttcaccaagacgctcaagacgctgccagcggatgtcgaccccgacattgcgtcacacgccgcgttgagcctcattcacggacagcccgcgtccctctggtcattcgggcgtacctgccagcagctcccggcccctgtcatccgcgcgctcctgggtcggctcgaagccgactcccggccccacgcctacttcctgcgcgaagcggtcccccaagaagcctccgatgaagagctccgagcagcctggaaggcagcactccagggcctgctcgacctggagacgacctatgcgtggggctcgaagcagcgcaaagcaaagttccaggtgctggcgagcaccccacccttgctccaggccatccagaccgctgtcgtggcctgtgagcaggtgtcgctggacatgctggccgtgctgacggtggatgcatcggacgcctcggtcgatgcgctcattccccatgtggagcgggccgtgcagagccagggctgggagttggaccgtctggaggacttgcgcaagcacgcgcgctccacccccgtgatggacgacctgttcgcgcgaatggaggccctgctccaagggcgtcgcgcgcgctcgcccgcgctcgacctggcgcggcacctgggcttcggtgagctggatgccatctggttcagaacctaccttcttgctggggacacccatgcgacgaactccctcgtccatcattgcaacatcaacgtggatagccgcacccctcgctggttcagtgtctggcagagatcccgaatggatggccacgatagaaacgcctggagcgacacccgcttcgacaacgaaaagctgcacaaggacatccggggacttggcgcatgcgagttgatgcaacttcctgattgggttgcgcgcacggccaggcgcctcggcacagcgtggaacatcagcgacagcacgttgtttacgaaccttcgcgggaagaaacgcgcaagactcgcggagtggcttcgctcgggcacatgagccgctcggctcaccccaccctgcggcccccgatgtgcgccccggcattgggcgacaaccggcgatagagcggtccggccagcgacgacatgatgcccaccgcgatgaacggcagcacgaagcggtccggcgtcaacggcgcctcgccagcgccgcgcgccaggtgcagcatcaacccgccgaagctgatgcccaaccccagcgccatctgcatcgtcaccacggacagcgtggacgcgttgctcaccgtgtctggggggatgtccgcatacgccacggtattgatcgcggtgaactgcatcgagcgcatgaatccgctgaccatgagcacgccaacgatgagcggaatcggcgtgctgttccggaagaaggccggcatcgcggtcaggacagcggacgtcaggttggcgaagatgagcgtttgccggaagccgaaccgccggatgatgtagggcgccaccgacttgcaggcgagcgcgcccacgccgccgccaatggtcaccagccctgcctcgacgggcgtccagcccaagccgacctgaaacagcagcggcaggaggaagggcgacgcccccaggcccatgcgcgtcagggttccgccaatcatgctggcccggaaggtgtcgatgcgcagcaaccggagattcaacacgggccgctccacgcgcagcgcgtgccacacgtaggcccccagcgacaagaacgcgacggccgcgagccccagttgcaacgacagcggcatcagcccgatgcccaccgtctccgccgcgccaatcagcgtagtgatggcgacggccacgagcacgaagccccgcgtgtcgaagggccccgggtccggctggtgcagcggcggaacgaagcgcgccaccgcgagcatgcccaggatgcccacgggcacgttgatgaagaaaatccacggccagtccgcgacgcccaggatgaggcccgccaacggaggccccaccagcgggcccaccagcgcgggcatggtgaaccagctcaaggcggccaccaggcgctctcgcggcgccgagctcaccacgatgatgcgccccacgggcgtcatcaacgcgccgcccagcccctggagggtgcggaagatgaccaactgggtcagcgactgagagaagccgcagagcaccgagcccagcaggaacacgctcatcgcaagcatgaagacgcgacggggcccgaaccggtccgccacccagccgctcgcgggcgcgagcaccgccaacgccaggatgtacgacgtcagcgccagcttcagatggatggggtcggtgccgaacgccaacgacaaccggggcaacgcggtcgacagcgcggtggagtccacgaactccatgaacagcgcgctggccacagcaatcgaggccagccgcgagccccttggagcatctccacctgcctcagcgctgctggaagccggatgcccaggcacggttcagcccacgtactccggaagcaagggtgcgtcgcggagtctcggggcctgggcatccttgggcgacaacaacggctcgctcaccggccagggaatcgccaggtccggatcattccacacgacgctccgctccgtctccggcgcgtagagcgcggtgcacttgtagtggaagtccgcggagtcactcaccacgcagaagccgtgggcgaaacccggcggaatccagagctgacggcggttgtccgaggacagctccaccgacacccactggccgaaggtgggcgagccgcgccgtacgtccaccgcgacgtcgtacacggcgcccgccagcacctgcaccagcttcccctgggcctgcggctcctggaagtgcacgccccgcagcgtccccttcgccgagcgcgagtagttgtcctgcacgaagggcccggggatgcccacggccgcttaccgagccgcatggaacatctccatgaagaagccgcggtcatcaccgaagaccttgggctccagcagcagcacgtccggaatctccagcggcgtcaccttcacgaaacggccccccggttctccgcgagcgcccgcaggtactggccgtagtcgttcttgagcatgggctcggccagcgtcagcagttgctgcgcgccgatgtatcccatgcggaacgcaatctcctccgggcacgacaccttgaggccctggcggcgctcgatgatttcgatgaagttcgacgcctgcatcagcgactcgtgcgtgccggtgtccagccacgcgtagccacgccccatgagctccacgtcgagctggccgcgtcgcaggtactccgcgttgacgtcggtaatctccaactcaccccgcttgctcggcttgaggcccgcggcgatgtccagcacctggttgtcgtagaagtacagcccggtgacggcgtagttggacttcggcttcagcggcttctcctccaggctcaccgctcggttcttcgcgtccagctccaccacgccgtaacgctccgggtccttcacgtagtacccgaacaccgtcgctcccgaggtacgcgacgccgcgcgcttcaccagctcgctcaggccgtggccgtagaagatgttgtcgcccagcaccagcgacacgctgtcagcgcccacgaagtcccggccgatgacgaaggcctgggccaggccgtccggcttgggctgctccgcatagctgaaacgcatgccccactggtcgccgctgcccagcagttcttggaagcgcggcaggtcctgcggcgtggagatgaccagcacgtcccggatacccgcgagcatcagtgtgctcagggggtagtagatcatcggcttgtcatgcacgggcagcaactgcttgctgaccacgcgcgtcagtgggtacagccgcgtccccgagccaccggcgaggatgatgcccttcatgtccacctcggcacgtcagtgtccccgagccgcgagccaggtcgcatggaagcgcgacaaggactccgcgagcgccaagggaggaacggaaagttcggcacgcaccttgtcggtgcgcagaccactcttgagcgggcgggggctggcgagcttcagctccgccatgcgggtggggacgatgagcttcgcatcgaacccgaacacctcgcacagcgcgcggccaaagcccacccggtcgatgaccgttccgccgcaagtgttccacacgccacccagccgccgcgtccccagctccaccagcatggcggccacgttgtccgcgaagctgggcgacacaatctggtcctcgaagaggcgcacctgctgccccttctccagcgcggtcaccagccaggcaccgaagttgagccggccctccaccggaggccagccatacaccacggcggtgcgagcaatggcgcagccgggcgcgagcatgcgcgcggcttgctcccccatgtgcttcgtcactgagtacacgccgcgaggattcggaatcgcgtcctcggaatagggcccggcctcgccgtcgaagacgtagtccgtggacacgtgcaccaggtgcgcaccggccttgcgagcgctccgcgccacggcggcggccgcggtgacattccccgcgtacgcggcctccgggtccttctcgcaggcatccacctccgtcatggaggcgcagtggatgaccacctcgggcgcggcggtctccacggcggcggcgacgtccgcctcgcgcgtgaggtccacgctcgcgtagccatacgctccgcccgtacgccgggcaccgcggcccaggcccaccacctggtgcccgccctggtggagcaaggaacacacgcggctgcccaccaacccgttggaccccgtgacgaggaagcgcatggctcaggccctcccctgcaggcgcgttcggtactgcgtttcgaagtactggcgataggcgccactcgtgacgcgctgccaccacgcagggtggtccacgaaccagcgcaccgtctccgccaggccttgctcgaaggtgtgcgcgggcgtccagcccagctccgcgcgaatcttcgacgggtcgatggcgtagcgccggtcatgccccggccggtccttcacgtactggatgagcgactccggcttgcccacgaggcccagaatcgccttcacgatgtcgatgttccgccgctccgccccgccgccgatgttgtagacctcgccggcccggcccttctccagcgccaatagcagcgcatggcagtggtcctccacgtggagccagtcgcgcacgttgccgccgtcgccgtacaccggcagcggcttgtcgtgcagcgcgttcaccaccatcaacggaatcaacttctccgggaactggtagcggccgtagttgttcgagcagcgcgtgacgacgacgtccaggttgaacgtgtggtgatacgcgagcgccaccaggtcggagctcgtcttgctggccgagtacgggctggagggctgcaacggcgaggactcggtgaaggcgcccgtgggccccagcgagccgtagacctcgtcggtggacaccatgaggaagcgcctcacgccgcgggcgcggctggcctccaggagctgctgggtgcccagcacgttggtggtgacgaacacctccggcccgaggatggagcggtcgacgtggctctccgccgccaggtgcatcaccgcgtcgatggcgtgcacggacatcaggtgctccaccagctcgcgattgccgatgtcgccccggatgaagacgtgctgggggtcgccctccagctcggacaggctctccaggttgccggcgtacgtgagcttgtcgaggttgaccaccgtccaggcaggccgctcacggcgcagatacttcacgaggttggacccgatgaagccacagccacctgtcaccagtacgttcattgtcccgtggacctcatgcgctcggagcgagcgcctgcgtatcgaaggggtccacgaccgtcaaggcgcgagggaagccaggcttgtgggcggcccagcacgggggtaagggagccggtcgtgagcataccgcgcccccctccccgccggaccgggcttcccgccatccaccaggtgctccctcggctcgcctggggcgacgccgtgggcaatcaggtgcgctatctccagggcctgctgcgccgctggggccatgcctccgaaatctacgccgacgcctgggacgacgcatgcaaggaccaggtccgcccgatgcgcgactccgcgcgagaagcggaccgcgacgccgtcctgctggtgcatcacagcttcgagtcgcggatggtgccacgcatcgcgaagagcccaggccgcaaggtgctcgtctaccacaacgtgacgcccgcgaggctgttcgagggcttcgagcggaaagtcgccgccgcatgtgacgccgctcgggatgaactgctggcgctgcgtccccacgtcgaagcggccttcgcctactcgcgattcagcgccgaggaactggtcgccgcgggctacccgaacgtcgcggtgctgcccttcgccatcgactgggcggcgttcgacacggcgccggacccggcgctccaggccgagttggacgacggcatgtccaacatccttttcgtgggccgcgcggtgcccagcaagaaggtagatgacgtgctgcgcgtcttcaccgcgtaccagcggctctaccagccccgcagccggctcgtcgtcgcgggctacctgcaccgggatggggcctacggcgcctatctgcacgggttgaaggacgtgctgggcgccgagcaggtccgcttcctgggacgcgtcagcgccgcgcagctctccgcctgcttcgccacggcgtccgcatacctctccatgagccgccacgagggcttcggcgtgccgctgctggaagccatgtaccggggcgttcccgtggtggcctatggcgccgccgccctgccggagacgatgggcggcgcggggctcgccacgcgctcggacgagcctcgggaggtcgcgaagctgctcgccgtgctggaccgcaacgccgggctgcgcgcgcaggtcatcaccgcgcaacgtgaacgcatcgccgagctgtcgcaggaggccgtagccgaacaggtccgcgtggccttcgaagacatctgctccagtacggcgccgcggcccccggtggccacgacgacgacggccaccgtggaactcgtctgcccaggcttcaccgtacggcccgaggagccggcctcgcgtctggcccgccgggtggcggagcgcctgccaggtgcccgggtgcttgccctgcgcccgtggggtgaggacgcgtccctgacgctggagcccatcagcgacgatggagtcgcggtgacgcacttcacgccggaccaaccggtggactcgaaccccaggacggccctaccggggtcctccgcgatggagacggcggtgcgggcttcgagcgcgcctgtggtgctgttgagcgcggacacggtgtctgcgcagacactgctaccccatgtctccgcgcgagcctggggcgtctgtgcacctgccagccagtcggccctgctcgcatccgcccaggagcacctgggtgacaggttggtggtggaggagccggctcaggtcgagacggcattgcaggcactgctcacgacgctggcttcaacgggagtcctcccacgtgcgacctgaagacctcatcacgcgcagccccgcggccgaagccgtggcacgccgaaacacagcatctggccacgccccccgatgaagcccaggaagcgcttggccagacgctggaggcggcggcccgcccacccacgcccgcgccctggcccgcgctgctccaggaggcgcgtgggaagatggacagccgctacgcggaaccggcgacctcccaccggggaggcttcacaggcacggcgctcgtcctggccaagcgcgccttccgcctcaccttccagcccttcatcaacgaagtgctgcgcaagcaggtggagttcaacgagtccatcctcgacgcgctggccaccctgcacgacgttcagcgtgagcaggcccgtgcccaggccgcatggcgcaaggagttggagcgcaggctggcgaagctcgaagccacgggcacccgcaccgaacccgtcaagacagagcagcaagtgcccacgcctgccgcgtcatccaagcggacacgcaagcgcggccggtgacgaccagggcacgggacctcggcacgtcatcctcgtgaacccgggtcccgcaggaggatgcgcgaacgcctccggcctcgacctgcgatgagcatgtgactcaggggcagcgttgaggcaggcggccgttcgggtgtattccccagccgttcgacgctttcctctgtccagggtccggtccttgcgcatctgcctcgtctccaaagaactcgcccccttcgacaggggcgacatcgcgacctacgtggcaaccatgagccgggcgcttgcggaggccggacatgaggtccatgtcttgacggcggcgcatgccgactggcagcgggccgtgtcctacctccccggcgtgcacctgcacgcggtggatgagcgagaggtggacttcaagggtgcgtttccacacgccccccttcggcatgcgtgggcggcgtacagaagcctgctggaactcaacgcgcgtcatcccttcgacgtcatcgagttccccgacgacgcaggcgagggctatttcgcgatgcgcgcccggcggacgctggggcacttcgagccagcggtcctcgcggtgcgcttgcacgactccacccacgaccgcctgctgctcaacagagtggccacgctcgacatggacatcgcccagcgcgagcacatggaggacacgtccatccgtgaagcggacctcgtgctgtctccctccggaccagccatggagcgagtccgcatcaggctggagctgaagcgcaccggcgtcgtgattccacctccgttcgcgtcacgccgggagcaccgctcatccccgcgttcccacgaaggactgccccaggtgctgtacgtcggagacctggagtaccgaaagggcgtgcatcttctcgtcgaagccatgcaggtgctcttcgagcaaggcgtcgtcgcggaggtccggctcatcggggctgacacgcgcaccggcccgttcggccgctccctgcgacagtggctggaccagcgcatcgcccccgcctggcgaaacaggttccacttcgcacctccgctcgagggggcagacctcgcgtcggcgctcgccgaagcaaccgtgtgctgcatcccctctcgctgggagcacttctcccacgtgtgcatggaagccatgtccgcaggagcgctcgtggtgggcagcgatggagggggcaacgccgaactcatcgaggacggccagagcggcttgctgttccggagcgacgatgcttcgcggcttgcccgcgcgctcgagcgagccctgtccacaccggcgctccaagaagccgtccggcagacagcgccagcgcgcatcgctgcctattgcgctcccgccagcatcgtccgccagttcgaagcggcagtggcggatgcgcggcgccatcgtcacgtgggccccatcagcgccgcgaccaggaagaaggactcggccacaccgtacgtgtccatcctcgtgccctactacaacatggggcgctacctccccgagacgctgcggtccattcgcgcccagaccttcacggactacgaaatcatcctcgtggatgacggctcgacggattcggagagccgggccgtgctggagacgctccacgagccagacctccacatcctccgcaagcccaacggagggctcagctcggccaggaacgccggtctgcgcgcggcacggggccggtatgtcctcccgctggacccggacgacctcatccagcccaccttcctggagaaagccgtcgcggtgatggacagcaccccagggctggcctacgtcacgtcactcgtctcctatttcgtcgagtcgccggaccagcccgtgggcggatggattccctggggcaccgagcgtgacgcgctcctcgcggagaacgtggcctcgacctgcaccgcgctgatggagcgacagcgcatcgaagaaatcggcggctacgacgagtggcttacggcctatgaagactgggacgtcttctgctccctggccgagcgagggctcgcgggctccgtcatcccggaaccactcttcctgtaccggctgcgtccggactcgatgacccgcagcatgcgagtgaatgaccgtcatgcgcagatggcctacctgtgccagaagcaccctgcgttgccgctccacccggagcgcgcactccgcatgcagctcggccgggcccacaggcaggaactccatcttcgcgcgacaggctcggcctccccaccactcctgaatcgcttcgccgacaagatgaacgccacgctcaagcggttcgacttcgcccatgccaccttgaggcgcgccgcgctttgggtcgcgggagcagacgacgactcccgcccactgcgtcatcaggtcatggagcggttcttcaggcgccgcaattgaagcgtcggccgctccatgcggcggagccggccccatatacgtgcgctacccgcccaaccgcccctcctctgccggtggaagtgaagcgggctctcgaggggtgagcgacaccacggggggcgcgacaccttccgccgccggcacgagtgcgctcggctccttgcgaatcaacgaccgcagccgcaacccgaacagggcggaagccaccttcgtcatgaactggaaccccttgagccccgtcaggctcgaggtccccgtcgtgcgtgggcgcatcgcgaccgagacctctccgattcgaagcccggcgagcgcgacgagcgcgacggactctggctccgggtactcatccggcatgaggcgcaacaacgtggccaccgcccgaggcgagtacaccctgaagcccgatgtcgggtccgtcacctgggcccgctggccaaacatccccagcagcatgctcacgacgcgacctcccatccagcgaagcggcgtcgtgctgaccaacgtgtccgtgcctcccatcgcgacatcgcagaaacgggagccaatgagcaggtcggtctgcccgctccgcgccgagcgaaccaggtccgggatggactcaacgggatgttgtccgtcggagtcacactgcacgacgtagctgacctccaaccgctgggccaggaggaaccccgtccgcagcgccccggacacgccgatgttggtgtgatgtgtgacgtggttccgtggagccagccgccgtagcaccccggccgttccgtccaccgacccatcattgacgatacagaaatccagctcccagtctggcgtggcgcgagtcagcgccgtgaggcgcggcaggagcgcaggaaggctttccgactcgttgtagcaagggagaaccaccagcacgcgggggcgaccaccttcggacgtcgctggcgcgtcgggaaacgtttgagcggcaagggctgacacgacctgccccagttgccgctgcgcgcgtgtgctctccgcgtagtgagccagcatctgaacgaacaggaacatggtgagcccagccaggaccatgttgctgaccaaactgatgcccatcagtcgagccacgggcagcaaccaatccggacggatggccgccacgagcacgaagccactggcaaggaaccacgtcacggaatgccgtgccgcgagccgcgcgccgaactgggaaatgaccacgaagaaaaagcccaccaccacggtaatgaatggcagcgacattccggagtccccacagcaatgccctgacgcacgaacacgcagagaagcactcacacttctcaggtttgcattgcccccccctccgtacggtactcacgccatcaatgcaatcccctgaagcaccggtgccagtccttgacgtacgccccgacccgcggcgctggcctcgcgccgcgatgagcatgttgctcgcgctcagtaccgcgggggtattgacgatgggggcatgggtcccctctttccaatccctgagctcccgcgtcgtgctggtcctggggtgcctggctttgggagtggtgctctaccgcttcctacttccgtggctgcacagttggctgacgcgctactcgcccgctcagcagcggacctggctgggggtcgtcgccctggtcaccatgctcgtgatggtagccaccccgctccacgtcatgatgcccgcggaacgactgcccgtgacggtccgtgccacgggcgagcggaaccccagttcccagggcagcgaggtgtgggttctcggattgctcgacgcctacggtagcccactgccttccgatggctggcgttccgaaggaaagtgggaacgccgtgatggaggcgcctggctttcgcacctcgaccagccggcgcgcctgcattgggaagcaggcggtcacaagcccagggtcctccaattgttggcgcacgggcactccggcatcgtggagtacaccgtgaacggtcgaaccgagcggctcgacctctattcgccgcccgggacggacgcacgccgagacctggtcctccaccctcctcccatcgcattgacctccattgccgggattcgaatcaccgtcatgttggcggcccacgcactggtcctcggcaccctcctgctcctgatggggctctggctcacgggccgtccgccaccacccctcaagcccatgccacggcgctgggtgggactgctgacggccatccccaccgtggtggtggctggcatctggctgctgactgtctacccgggaatgctgagtccagactcgacatcccaatggcgtgacgccctttccgggtccatggatgatgcgcatccactgttccacaccgcttccatccgattcctccagaagctctgggaatcacccgcggcggtggcgctcgcacagattgccggcctgggggtgctcgtcggctggggctgcgcggcgctcgcgagggcaggtgtctcccgaggcatcatcgcgctcaccgcgacggtgttcgcgctggcgcccgtgaacgggacgatggccgtcaccctctggaaggacgtcccgttcagcctctgcatcctggccctgtgtatctgggtcttccgctccgcgaccgacaccaccacgcgctgggacgtgccgttctgggtgagcatggtagtgctgggagccatggccatgttgttccgtcacaacggcctgcccgcggtggtcggaaccttcctggcactgggtctcctccggagggagcgctacaaagcggtggcgctcgcgctcgtggccacgtttgtcgtcgcctcggggacccgctgggtgctgagccagacgtacaccatcaaaccctttcccaaggggatgacgctgatcggattcctgggcgcccatgtggcggcaggaacgcacctggagcccggcgaacgagccctcctcgaggagctccacccgctcgacgacaagtggaactaccgctgcttcagcaacgtgttcaccatctgggacggacgcttcgacatgaacgcgctgacccggcacaacaaggcgttgcttccgctcctcgtccgcctgacacaacgagacgcagcgccagtgctctcacacgtgctgtgcagcagttcggtgctgtggaagctctcgcaaggctcggaccacatcaatggtcctcccatctggagggggccccacggggaactggacaccctcgagcccggagcgcgacaccttcggtccgactcactccttccagtcctgcgtgagccccttctccggtggaccgtccggacgcttgagccagacctggcctggctgctctggcgcccggcgctgccgctctacctgctgctgctcgcctgcgcggtggcatgcatccgccaccggacctggcggcttgccgccgtggcgctccccgtcgtcttgcacacggcggcgctcgccgcgctcatcccgtcacccgacgtgcgctatcagtaccccgtgttcctcgtggccctgatgttcgttcccgcgtggctcgcggggatgcgactgaatgcggcgccggcgaccgaagcgccgcggcgcgcgccttccgtctcgcaggacgcgccgacgctcaggtcagccggctgaccgtgctccgaatcgcgcggtgaatgacgggcatccgcttgaagagcgtgttcgcgcggtccacgagcacgtaacgaagcggaggcgcatccccgggattcacgctccccaccgctccgctggcgggagcgggtttgcccgcgacggcctgcttgagcaaggggtgcacgaggggcaggcgcttcaaggccgcgttcatcaaatccaccacgtcgtagcgcagcgggcgcgcggcctcggccagcgcctgggcggactccagggacgcggacgccgcggaggacggccgacgctcatgcgtgtctagcgcgccatatgggtcgaccatggcctcgcgggagtgcgcgagcagtgcgaagagccgcgtcgacgggtgcagtggcgcgggcacgccttcgaagagccgcaccagccagcggaagtgctggcgctgctgggacgcggacggggtgatggcatgcccccgccgcgagaagaagtggacctggttcgtcaccaggaagcggtgtcccccctgcgcgagccgcaggaagaaatcccagtccgcatagccggacagggtttcgttgtaggcgtgctgctccaggacggttcggcgcagcagcgccgtgggcgcggagacctggttcgcggccagcgcgtacgtcggacaatcccccaggtacgtcatgaaccctttgaactggcggttggccagctcttcgctggagtggaagcggcctccggtggggaccacccctgagaactcctgtcgcgcttccagcgcggcgacggcgtgctggatgaagtccggggacaggctgtcgtccgactccaggaacacgacgtattccccgcgtgcggcgcggacacccaggttacgagcccccgcgaacccgcggcggatcggggagcggacgacacgaagcccctccccttcagccgcggaccgctccaggcgctgcaggacctgcatgtcgaaggcgctcgtggacccatcgtccacgatgacgacttccacttccgggtacgtgctggcggcgacaccttgcagcgcgatgggcaggaagatgccctggtcctgattgatgatgaccacgctgaccagcggcgaccgagggcttcgcgtgggcagcgcctcccgcgcgtggcgctcccaatagggacggtccaccgtccagcggacgggggccagctccgggccttccaacgccttgcgcatggccaccaccagcgcgtccaggctgccgtcatacttgtggcagtggaccccgtcgacgaaggggctgtcgtcaccgaaggccaggcaggccgagttgagcaccagccgggtgcccgcgacggaagcctcgtaggccgtgagattcagcgactcatagctggaggtgatgaccaccacccccgcgcgcatgtgcgcttcgcggtcaggacctggcttgatgaagacgaagcggtccgtcaggtccgacg

SEQ ID NO: 1193 - DNA, 21375 bp, Myxococcus xanthus
  unsure (1)..(21375): unsure at all n locations
cagcgtgcgagggtgtaggtacgcggtggcactgccgcgcacgcgccgcaccttggagaagaaggtgttggtctgcgcctccacctggatggggagatgcccatccttctgcttgtggacgcgcatcgtcatggtgcccgcctgagcgcccatggcgtcgaggtcgaactcgagcacctcacccggcatgaacgccaggggcgtgcgcagcgccggcagcgcggcgttgcacggtgccacggtgaggggcgcctcgggctcctcggccttggcgctctcagcctccggcgcgtccgcctccgcgtccggcagctgggcccaggcgctgacgctggacagtgacaacagggccgcgaagagggtgcgcagggggctcatccttttccttccagagactacggggtgctctgcggcgtctgacggtccgtgcgcttcgcatattcggactccgcccagcgcttccggagccgggtggtgacttcctcgcggaccgcctcccattctcccgcatccgcgttgatgtcccaaccggtgcgcgccaacttgcgcgcggccgtccgggcgaaggtggcgtcccccagctcagcgagcaaccggaggtactcgtagtcctccagtccgtcccggatgtgcttcagccgcagcgtgaggatgggctggtggccagaaggacccaccctggcgggtgtccccggatagaagagggtgccgtcgccgttgccgccgaactcgaagacgtccttccaggggtccttcttcgtgttgtaggcgaagacggtgtcgaaatagagctcgccgtccacgccggaggagaaggcgagcacgcccatggcccggttgagcggggcggggtggtccaccatgtacgaagcccagccgctgtaggccgcgtccaccgccttgtccgccggggggccgccgttgcagccgtgcgaattgcagctctggtaccaccacacccgggtgtcacctgccagccgtttgcgcagcgcgcgcgcctccaccacgctgcggcacgtctgcggcccggggcgcgggtagaagcagttgagcgtgggcgtgaggatgtccgccgagccattcagcgcgtcatccagcgggctggtgacgagcacgggaatcttgcccgccgcgcgcacccgcgtggactgggccttcaccagcggcacgtcctcgggcttgggttcgtccttggcgtagaagaagagctgcgcgggccagcccttctcgcggaagtgctcggcgaaggcgcggtagtacgccgtcttctccgcgtccgtcttcgcctgcttgctgtcacgcacgtcggtgctggtgaagcgggcgccggagggcagcaggctgccgtccaggaagggcgccatctccgcgtcgtactcgcgccagtccagtaccgcgcggcccttctcgaagcgcacgggaggtggcgtcatgctcatgccgtgggcactcacccggtgctccaggagcgcgcgtccgtagtcacgcaacagcttgcgtgactccgccgactccggcgccacgccgtggccccgggcgatgctgtacatcgacaccccgaagctgttgggcagcgaggacgtggcgggcagggcgaagggctgcacctcggcggtgaacggcactggccggaacttcgcgccacccgccttcaccagcagctgtccccggtacgtccccggctcctgcttctccggggcgcacacctccacgtagaagacggtgggcagcttcgagtcatgtcccggcgcatccaccggaaccagcgcgtcgggccacgggcccttgtggccctggccgttggacggcgtcttcacgtcgatgaaggcctcgcgccagacgctggccttcagcgccgcgcccgggcccttcaacgtcagcgactccacgggggggcgctccacccggccgggaagcaccacctgcactgcctcacactcaccgcgcgcgaggctgaggcgcgcctccttgcgtcccttcactgcttcccccggccggaccttgaccaggggcgacaccacctgaggctcctgcgtggaggacatcgccgccaccaccgcccacgcccatcctgcccccatccgcccccttcactctccggcgggtgctacccgccattctcggcgcgggccaccgtcatgctccggcccggcttgtagtcggttatctccgcgacgatagtgcccagcgcgaactccgcctccacccgcaccggcacgtggctggagtccgtggtgaagtagacgaacatgtcccgcttcgaggcgaggttgccgccaaactccgtcttcacgctgagcttgaagacctctttgtcgcccatcgccgtgcccaggacttcacgcccttccaccttcgcccgaagggtgaactgcttgctgccggtgaagacgggataggcatactcctgccccacgaccagctcccggttgcgcaatgcgaacgtcgcaccggtgacatccagcgtgccctccatcacctcgcgggtggactcgcgcggggactcgccttccttctgcttcaccacgaaggccgtcttgccgtccggctccatcttgatgcgctgccggcggcgtgagccgttctcatccgcgtgcaagtcactgcccaccacacgctggctctccggctgccagtaggacacgaacttgtccttgataggccacacgcccagcatgtcgttggagcgtgccaccgcgacgatgggccacacgtcctggccccactgcttcatgtgggcacccaccgtcacctgcgcggttcccgcggtgatgcccaggtacctgacgcggtaggagctctgctccccagggccgaacgccgggttcacggactcctgggccatggccgtcgccgaccagaccagccctgcgagcgccgccgcgaacccccacttggactgcgtttgcatcgggtgagctccctcgcttggaaattaggtagccgggccgcaccgcgccagacccggcttggaaccattcccgccaccgcccatttccactgacgcggttgttgaccagccattcaaatgctggccgctcacttcacggggaggcacactttcccacgtcacgctcccgcacgcctcttcccggccggggcctgttcgcccggcaggcggcagtgccgcgcagtggcgtgtccactcgacgacaccgctggtagcctccgcgcggggcagcccgcggtgtcgggcgccatcccgcaggaggggcacatgtctggtggtggcggttcgttcgacttcgacgatgacgagaaggagtccacgcgcggaggtggcaaggcgcacaaggacttcgactgtccttcgtgcaacgccaacaaccccgtggatgaagcgctcgcccagggggacgaggtgcgctgcaactactgcggctccgagttcaaggtcagcgtgaactcggaggggcgggtgaagttcaaggagatttgagcgcgcgctcaccgaagatggcggtgcccacccggacgacggtggcgccttcttcaatggcccactcgaagtcatgggtggtgcccatggacaggcccggcagcccgtgcacacgggccagctcgcgcagggcctggaagtccgcacgggcccgggcctcgtcctccgtggggggcggcagcgccatcagccccaccgcctggaggccaggcagggcgcggacctcatccaggaaggcgccgagcgcgtcgggcgccaggccgctcttggtggcctcgccgcccacgttgacctcgacgtagacgggcaggggcggggcgccctcgcggcgcttcgacagctcgcgagcgacctccagccggtccagggcgtggaaggccccagccgcccgcgccacgtacttcaccttgttcgtctggagcgccccaatggaatgccagcgcaggccctccaggtccgccagctccgcggccttgtcccgcagttcctgcgcgtagttctccccgaagtcgcgctgaccggcggcataggcctcgcggatgaggtccgcgggcttcagcttggacaccgccaccagcgtcaccgactccaccggccgccccgcccgggcacaggccgccaccacccgctcccgcaccgacgccagccgctccgcgacgcttccgctcatgaggccctccagggcaaggggaggccggcccgctccagcagggccactgtctcgcccagcggcaggcccacgacgttggacgtgctgccttccacgcccgccaccaggaaaccgcccttgccctggatggcgtaggcaccggccttgtccaggggctcgccgctgttcgcgtaccaggacatctccccggagctcagtgcgcggaaggtgacgcgggtgcggaccaccagcgtctcctcatgccggccggccagggccacgcccgtgtagacgtcatgcgtccgcccggacaggcgcgtgagcatggcctgggcttcctcggcgtcccggggcttgcccagcagctcggcgcccagggcgacggtggtgtcggcggccagcacccaggcgcccgggtggcgggaggccaccacgtgggccttctcccgggcgagccgcccgacataggcctccgctgcctcgccggcgtggggcgtttcgtcgatgtccgccgcggaaacggtgaaacggatgtccagctgtgccagaagttccctgcgtcgcggcgacgccgaggccaggacgagcaacgtttgatctgcgttcatgtgcatgttacggctcggcccggccttaccagacttgtgccccggagtggactctacggatgaatcccgcggacctcctgtcggccatgaagcggacagtggagcagttggccgccttcaatgagatggcgaaggccctgacgtccacgctcgagctccgcgaggtgctggcgctggtgatgcagaaggtcagcagcctgctgctgcctcgcaactggtcgctcatcctccaggacgagcgcaccggaaagctctacttcgaaatcgcggtgggtgacggcgcggacgtgctcaagggcctccagctcaacccgggcgagggcattgccggcgccgtcttcacgtccggcgcggcgcggctcgtccatgacgtgggtggggaccccagcttctcgccacgcttcgatgaagcctccgccttccacacccgctccatcctcgcggtgccgctgctggcccggggccgggtcctgggcatcatcgaactggtgaacgggcccatggacccccccttcaccaacgaggacctcaccattctcaccgccatcgcggactacgcggccatcgcgattgagaacgcgcgcaacttccggcgggtgcaggagttgacgattacggacgagcacaccggctgctacaacgcccggcacctgcgcgccttgctggaccaggaggtgaagcgctcggagcgcttcagccacccgctgtcgctcgtcttcctggacctggaccacttcaagagcatcaacgacacccatgggcacctggtgggtagcgccaccttgaaggaagtgggggacctgctgatgaccctgggccggcagaacctggacgccgtcttccgctacggcggcgacgagttcgccatgttgctggtggagacggacccggagggcgcggccgtcatcggccagcgcgtctgcgaggcctttcgggggcggggcttcctcctggagcagggcctggacgtgcgcctcaccgccagcgtgggcgtggccacctacccggaccatgcctcgtccgcgctggacctcatccgcgcggcggacttcgccatgtacgcggccaaggcccggggccgggacgcgctctgcatcgccgagcccattgctccgaacggcggcacaggctcccacgagttcccggagcggtagctggcgcttcggcgctgttggccgcgaagcccgcaatgagagagggccggggaggggagtaccctcggcccggccctcgggggcgtcacggttggacgccgggactcacccggtgcccaccacggagtcgatggcggcggtgttcgttaccaccgagccctgctcacgcagcgccttgaggaaggactccgtcagctcaatctgcttggcctgacgggcctgggcgcgcagttcctccttgcgcttgtcaaagccctcggcgtccggcttctggcgctccaccacctgcgccaccacgaagccctcacccagggggaacacgctgtcgagcggctgcggggcgctgacggcgaaggccgccttcaccagttcgggcgcggggcccaggtgaggcaccgcctcaccctcggcggtgaagctgtccgtctccacggcctccgggcgcgtctccgtctcgaagcgcagcagcgcgggctgctccttctccggcgggaagagcgtcttcaggtcctggcccgccttggcggaggccaacgccttctccgcctcggcgcgggcctgctgcttggcgcggtcctgcttgtagagcgtggtggcaatctcgtcctggacgtcctcgagcttcttgtcctgggcggcctgcttctcatccaccttcaccaggtgcacgccgaacttcgtctccaccggctgcgtcacctcgccctgcttcagcgcgaaggccgcgtccgccagcgccggttcccagctgccgcgctccacccagcccaggtcgccaccgcgcgccttgctgcccgggtcctcgctgctgtcacgcgccacctgggcgaagtccttgccgccctcgatttccttgcgcagcgcctgcgccttctccagggccgccttcttctggtcggcggtggcctccgggggcagcttcaccagcacctgccgcgcacggatgcgctccggctgctggtacacgaagcggttggcctcgaagtactccttgatgtccttctcgtgcgccttcttccactcggccagctgcgccgcggtggggctggggaccttgtcggcgtacatggccggcaggaagcgcgcgaagacgaccttcgcctggttgccttccttctcgaagcgggcgcggacctcgtcgtccgacaccaccgcgttgccgcgcaccacgtccatcatcttctgggccgccaattgccggcgcagctccgcctcgaagtcctgcggggacttccggtagaagtcgcgcagcacctgctggtagcgctcgaagtcgaactggccatccttctggaagtccgtgttctggtggatgagcttgcgcagctcatcgtcggacgcggcgatgccgtggcgctcggccgcctgggccagcagctccgtgttcaccaaccggtcgagcacctggttatgcatgccgaactggcgggcgagcgactcgggcaccgggctgccctgcgagcgcaggaagctcatctgctgggcccaggccgcggcgaagtcacgcagcgggatttccttgccgttcaccgaggccaccgaaccgggcgccgtcgccccacccgtggcgccgaagccagaactgcccgggccgaactggagcgtgaacaccaccgcgatgccgatgatgaacaggagcgaggcaaccttccggggattcagaccgtccattgtcgtcacttctggggcaaacgcgccgagaaaagccgtgcggaaggactcgcgacgcggtgttgttggtagcccggccggtgggtggtggaccaggaaccgccccccatgcaggccttgactgcctaggataacgcaccggaaaatgcaagcgatttagagcccttagccagcccctgctcccccattacacccccggaaactcctgcctgtgtggtcgctcctgaagcggtattanccgcccccctcatcgtggggctttctgctcctttcgccgcctggtggccttcctgctcggtggccggaagggcagggaacccaacttcgtcgaccgggcgatcatcgccgtcgcgtcccccgtgcaacaggggctgacgtccgtcattgagggtggggtggctggggtccagaactacctggacctccgaggcgtgcggcaggagaatgacgcattgcgcttggagaacctccaactgcgcgcggcggtgcagtccctgggggagtcgcggatggagaacgagcggctgcgcaagctgctcaactacgcggaggccgagcccgggccggaaatccccgcgcgggtggtgggcgtcaatccggtggcgaagctgctgtcggtccgcatcagcagtggtgagcagcagggtgtgtttcgcggcatgtccgtggtgacgccggatggaatcgtgggacaggtcatccgggcgacgggcgggtatgcggatgtggcgctggtgacggacccgcagagccgggtggcggtgcgtgtgcagcgctcgcgggcccggggcacggcggcgggaacgggaggcgggcccctgaagttggagaacatgctgcgcaccgaggatgtggaggacggtgacctcatcatcaccgcgggcacggacggcatctatccgcccggcgtggtggtgggacgcgtgacgaacctggagaagaaggagcacggcatgttccagggcgcggacatcgtcccggcggtggatacgagcaagctggaagaggtgttggtggtgggcagcccctacagcgccatggcgccgggcagcgccgcggagggcgcgtcgaaatgaagttcctggtgtccgtcgcactggcgctggcgttgctcacgctggaatcggtcctggtgaagcaggcgggcctggagctcggccggattgacgtcaccgtggtgttggtggcgttcctggccctgcgggcttcgctgctcgaagggaccttctccgccttctccgtggggtatctgctcgacctgatgagcgggcagcccacctggctctacaccttcctggccgtgttcatcttcctggtgggaaggctggtgccgaccttcgtggaggtccggggtccgctggccttcgccttgttcgccatgggcgcggacgtgggccattcgctgctggccaccttcttcacctggctgacggtgaaggaggacggtccgggctcacagttggcggagatgccgctgcaggtggcgctcacgggcatcgcggcgctggcgctctacccgttgctgcggcgcttcgaggcgtctcaggagcggcccacggggttgctgcggtgaccccacccaccttgggcaacacgacgccggggcgcgagctcaagcggcgcttcctgtggctgggcctggccatgatggcgggcctggggctgatttccatccagctctaccgcctgcaaatcacccggggcgaggagtacgccgccaagagcgtggccaacttcgtcaaggaagtgcggctgcgcgccgaccgcggcgtcatcaaggacgcgcgcggcaccatcctggtggacagccgcccgtccttcgacgccttcatcaccccggccttctgcacggactgctacgagcaggtcatcccccgcctggcggagctgctccagtgggacccggaccagcgcaagaaggtggaggacatggtgcgcatggggcggcgcaacgcccccttccagccggtgccggtgcgcgtggacctgtcgcgcgacgagtacgaccggctggctgcgcgccgcgacatcctggacggcgtggaggtggcgcccgtgccgcaccggcactaccgcaccaactccgtgctgtcgcacgtgctgggctacatgaatgaaatcacccaggaggagctggagcgcctcaatggcgacggcgcccgctacgccctgggggactacattggccggcgcgggctggagcgctacttcgagcagcggctgcgcggcaccgacggcgtgcgcaaggaagtggtgaacgcgcgcgggcagaccattgaagagctgaacgacaagctgggcgacaacgctgtggtgtcgccgcgtccgggcaacaacctggtgctgtccatcgacatgcggttgcaggaggaggcggagcgggccttccccggcgtgacgggcgcggtggtcgccatcgacgccaacacgggcttcatccgcgcgctggtgtcgcgaccgggcttcgaccccaacctgctcactggccgcgtgacgcccgcgcagatggcgctcctgtcgagagatccgctggacccgatgatcaaccgcgtggccgccgagcactacagcccaggctccaccttcaaggtcgtcaccgcgctggccgcgttcaagtccggcgccttccgcccggagacggtggtgaactgccccggaggctaccgcctgggcgcgcgcacctggcgttgccacagggacgccggacacgggctcgtggatggcttcacggcgatgaagtcgtcctgcgacacctggtactacaaggtggcggacaccatcggcctggaccccattggagagatgggcaaggccctgggcctgggcagccccacgggcgtcaacgtggtggccgaggtcccaggcatcatgccgaccagcgcctatcacgacaaggcgtcgcccggcggctacaccaagggcatggcgctcaacagttccattggccagggcgacaacaacgtcacgcccctccagttggcgctggtgtacgcggccatcgccaacggcggcacgctctacaagccgcagatggtgaaccgtctggagaacctggacgggcagaccatcgagtcgttccagccggaggtggtgcggaaggtggacctgccgcccgcgcacctcaaggcggtggtggatagcctggtgatggtggcgcacgagccgggcggtaccgcctatcgcgcgcgcatgaatcacatgcgggacaaggacatcctggtggcgtccaagacggggaccgcgcaggtggcccgcctgggggcaatccggctgcggacgcaccagatgagctacttcgagcgcgaccacgcctggtacgcggggttcgcgccggcggacaagccggagctggtcatcgtcgtgctcaacgagcacggcggccacggcggttcggacgcggcgcccaccgcgatggcggtgttccagaagtacttcgatttgaagaagctggacgccacggctccgccgccgcgtcccaaccagccctacacgccgtcctccgtgacgcgcgcgccctcggccgacgaggcggcgctgacgcgaagggtacggccaccggcccggcttccgggcgatgaagaggaccgcacgcgtgcaactgcggattgagcgccggatggtgccccacatcccctggggcctcatcttctccgtgctggcggtgtgcgggctgggcatctggaacctcgcctcggcgtcacggccgccgcactcacccgtctggggctcgcagatgggctacctgggcatcagcatggtcgccgtgctggtggtgtgcctggtggactaccggtggattcagcgcatggcgctgcccatctacgtgggcaacatcttgctgctcatcgcgctgcgcttcttcggccacacggccaagggcgcggagagctggttcgtcatcggcccgttccgcatgcagcccgcggagttcatgaagattggcgtcgtgctgatgttggccaaggtctatcacgacgacttccagcccaacgcgccctcgtacaacctgacgcggctgtggaagccggtgctcgtcgtcttcgtgcccttcgcgctggtgctggtgcagccggacctgggcaccgcgctgatgattggcctgtcatcgctcaccatcgtcctcttcgggaaggtgcgctggtatctggtggccacgctggtggcgggcgtgttcgccgcgggcatcgtcatctggaacgactacatccgtgacgtgccggagcctcggcccaccatcgtccggcaccacctgaagaagcaccagagccagcgcatctccggttggctggaccccgaggcggacctgcgcggcagcggctatcacgcggcgcagtcgaaaatcgcggtgggcagcggcggcgtgtccggcaagggctggcgtgagggcacccagacgggcctgcgcttcctgcccgagcagcacaccgacttcatcttctccgtgtgggcggaggagcatggcttcgtcatgtgcatcgtcctgctggtgctctacggcgccatcttcatcttcggcctgggcgtgggtttcaacgcgcgtgacaggttcggcgccttcgtcgcggtgggcgtcgtggcgatgctcttctggcaggtgttcgagaacatcggcatggtgattggcctgctgccggtgacgggaatcaccctgccgttgatgagttatggcggctcatccctgctttccgtgatgctcagcatcggcttgctggtgaacatcagcatgcgccgtcacatgttctgagaaattccggatttatcctcgcgagacgggcgcaagcgtttctcggcgcgcggcatggggtggtgtatgaatcaccccaccaacgcacgtggagggcgagtcctcccgggcagatgaggacgcgtcatgcagaggaagggtggccagaaggcagtcgggagcacgcgggtggaggcgccggtgcgcgcgcccgcgcgagcgccagtgcaggccgcggcgctggcgaaggaggtccgccccgcggtggttccggcgcgtcctggcggcaacgtggcggcggtgagccccgagccgaggccgaccttcacgccgttgattgagatgaaccagggcgaggcggagcaccgtcactttccccgcgcccagctcgccacgcgcttcgaggtgtgggtggatgacgaggcgggcgagcgtcgcttcgaggcgagcctcgtgtccgtcaacgtcagcgtcagcggggcgttcctggagagcaccttctacttgccgctgggccccgtgctgggcgtgcgcttcgcgctggagccgggcgccgcgcccgtgcaggcgcgcgcggaaatcgtgcgggaggagcggggggacgggccggagggccgcagcggctttggcgtgcgcttcctcgacttcagcggtcagacggaggtggcactggcgcggctcttcgtggggatgcggctgagggccttcgcggaggactatctcaagtcccagcgggctcgctccctgcccaacgaggtggaacgcgtggtggacgtgctggcggcctgggagctgctcaaggcgacgtcgtccgtttccgacccttggcagggctgatgcgttggaccggtcatcgcccagggccgtgggcgggtgtccggtgtgcaggcactcaggccgacttgctgcccgaaatctggcggcggcgttcggcctggtagtgcgcggagcacagacccttcgagcgctgctcgcgactacagccctccatggtgcaacggcgatccagtgacaccaggctggcgcccgccatcaccttcggcggacggccgcggcgtcggcccgcggtgagcgcggtagagctgggcgaggtgctgcccagcctgggcatcccgtcgttgagcgcgcgcagcatgccgcggccaatggcgtctcccaaggcttcggcccagttcaccatggccggcgtcagcgggacggtggacaattctttgcgtggacgtgccatgaatactccaagtgaaaacagtcagccaacacagacactgctatgtgcctatttggcggttgaagtcatcgctgtcaatacaaccttggagggtctgtcttgactcgtaaacgatctcaaaaaattgatgacaagactgcaaatggatacgtgtttcccgtatgtcctcacggcactgtgacactcgcagcggtcgacccgtctgtctcggcgggtgaacacgcgaaatatgagaagacgctcaaaacgctccaggagcgcgtcttcgaactgcagatccagaactacctggcggggcggaaggccgtcatcgtcttcgagggctgggacgcctccggcaagggcggcgccattcgcaggctcaccacgctgatggacccgcgtggttacaaagtctggcccatctcctcgccgtcagaggaagagcgcagacaccattacctgtggcgcttctggcgcaagacgccgggcgcgggcgaggtctgcatgttcgaccggagctggtacggccgggtgctggtggagcgggtagagggcttcgcgaagccggcggaatggcggcgcgcctacgatgaaatcaatgcttttgaacacatgctcaccgcggacggtgtgcggatggtgaagttcttcatccacatcgacaagaagacgcagttgctgcggtttcgcgagcgcgaggcggacccggccaagcgctacaagctggggcccgaggactggcggaaccgggcgaagtggaagaagtacgaagcggccatccaggagatgctggaccgcacgcaccgccccgacgcgccgtggcacgtggtgcctgggaacgacaagcgctactcgcggttggaggtgctccgccgctgcgtggagttgctgggctgagacaggaggaggccgcggggaggggcgcggaagagcagcaggggctctctcgcgcgtccgaccccgcagcgcggcgcgtctacgtcagggccttcttcaccgcctcttcgatgcgggccttgggcaccgcgccgacaatctgctccaccacgcggccgcccttgaacaggagcagggtggggatggaacggatgccgtactcctgcggcgtgtcctggttctcatcgatgttgagcttggcgaacttcacctgccccttgtactgcgaggccagcgcttcgatggagggcgcgatggcgcggcacggcgcgcaccacgtcgcccagaaatccaccagcacgggctcctgggagtccaggacctgctgcttgaaatcgccatccccgatgttcgtcacgtccgcgcctgccatggtgtctcctcgtgccctgtccgggcacctccgccgcgtgtagtacgcgtccggtgggcctgcaaggatcggccggccatcagccaatctggcggctcagatgcggatggatggcgcctgtttcaaccatttcccccaagcgttccccctggggaggggtggctggtgtaagctggaaggcgtgacgaagctcttcctgccccagacccagctcgaggagtgggcgctggcggacaaagcagacctgcgcgaaggccggctggtggtgatggcggaaggcggcgtggccttccccctcatgcccgcggtccacttcgtccaactcgtgtcgggcgaagacacccaggggttggtggcccgggtgaagaccgaggagcaacttgcccgactgggtgccgagcagatggccgactcggtgctggtgggggacaacgcctatgaggttgttccagggtatgtagcggaggtcgccgccggcgcgcccaggccagagggcgcggacaagaaaccggactctgaagcagaccttctggctgccttcatcctcaacaagatgggctgattcgcccgtcttccgtggttatgagcctgcccctatgagccacacgctcgtctcgctcgcctgccacgcgtatggcatcgccgctgtcgtctacctggcctacctggtccgccagtccgaggccctggccacggccgggcgcgtgctggtgggcggtggattggcgctgcatggcgtggcgctcttcgagttgctcggggtgcagagcgggcggccggtgggcctggcgcaaggcttctccgcgctggccttcctgctgctggccatcttcctgttcctggacgtgcgctaccgccggcccgtcatcggcgccttcctcacgccgctggcgctggccgcgttgctgcccggtctgctgttgcagggcgggcaggcgccgctgcctcccggggtgcgtcagccgctgttgccgctgcacatcaccctggcgctgatggggctggccgcgttcgcggtcgccgcgggagtgggcgtcatgtacgtgctcatggagcggcaggtgaaggcgaagcgcttcggtttgctgttctcccgcctgccctccctggagttcctggacacgctgaaccggcgcctggtggtgtggggcttcctggcgctgtccatcacgctcgccacgggggccttcttcgtgggcaccgcgccgggcccctggaccgtggatgggaagacgctggccaccctcgttgcgtgggcggtcttcgccgcgctgctggtggcgcgttccgtcgcgggctggcgggggcggcgggtggccttcctcaccatggcggggttctgcctggtcatggtgtccttcctgtcctcgtatgacgtgtcgtcgccctcggcggccatgaggatgccctgagtatggagctcatttgcattggcctgtcccaccggacggcgcccctcaccgtccgcgagcgactggccttgccggagtcgcgtcaggtggacgtgctccagcggctggcccaggcgcccgtggaggccctctgggtgtccacctgcaaccgcgtggaggtgtacctgttcgcgccggacgcggcgatggcgcggcagcgcgccttgatggagctgcaggtgctgggcggggtggaagccctggagcacctctacgagcaccagggcgaggcggcgctggtgcacctgttccgcgtggcgtgcagcctggactccatggtgctgggcgaggctcagattctgggccaggtgaaggaagccttcgagcggggccagggcgcgggcgcggtgcgtggtgagttgatgcgcgcgtgcgcggcggccttcagctgcgccaagcgcgtgcgcacggagacggccattggccgcgcggccacgtccatggcggcggcggcggtgcaactggccagcaaggtgttcgatgggctcgcgggcaagacggtgctggtggtgggcgcgggggagatgggcgagctggcggcgcgccacttgaagcaggctggtgcgtcgaagctctacgtcaccaaccgcaccctgtcgcgagcggaggcgctggcggcggaggtgggcggacaggcgaggcccttcgaggagctgctcggtctggtggccgcggcggacgtggtggtgtgcagcacggcgtcgcaggcgccgctcttcacgcgggacaacgtgggcgccctggggcgcggacgccgggggcggccgctgttcatggtggacctggcggtgcctcgcgacatcgatccggcggtgggcacgctggactgggtacatgcatacgacgtggacgacatccagaagttcgtcgcggacaacgccgcggcgcgcgcggaagaggcgcagaaggcgggcgtgctcgtcgcgcaggaagtagcgcgtttcgtcaaggagcgtgcgctgcgtgagggcacgccggtgctggcgcgactgcgtcagcgcgcggaagccattgcccgctccgaggtggagcgcacgctgggcgccctgggcgacggactcaacgaaaagcaacgcaagagcatcgaggccatgggccgagccatcgtcaacaagctgctgcatgagcccaccgcgcggctgcgcgccgtggggccggaaggggagggcaaccgcctggcgggtgccgccgccgagctgttcggtctcctggaggaggaggtcggcaccgccgccgccgcgccctccgtcatggccgcgccagtccaggtcgccacggggggcaagtgatgacgcacgtgcgtatcgccacccggcagagtcccctggcgctctggcaggcgcgtcacgtgggcgcgctgctgacctcgcggcatcccggtttggaagtgaccctggtggagatgaccaccgagggagaccgcttcctgtccgcgccgttgtccgcggtgggcggcaagggcttgttcgtgaaggaaatcgaacaggcgctgctcgacggccgtgcggacatcgccgtgcatagcctcaaggacatgacgtccgtgttcccggaagggctgatactcgcggcggtgccggagcgggaggatccgcgcgacgtcttctgtggcctgggcgggctgacgttggacacgcttccgcagggcgcgcgcgtgggcacgtcgtcgctgcgccggagctgcatcttgcgctcgcgccggccggacgtggacatcgtcagcgtgcgcggcaacgtgcagacgcgcctggcgaggacgcgggagcaggggctcgcgggtgcgctgctggcctacgccggactcaagcgcctgggcctggaggacgtcatcacccaggtgctgccgcccgaggtgagcctgcccgcggtggggcagggcgtgttggccatccagtgccgcacggacgatgcgcgcgtgcgcgcgctgctggtgccgctggagcacgccaccactcgcatcgccgtcaccgccgagcgcgcgctgctggcgaagctggaggggggctgcaccgtgcccctggccgggtatgccaccgtgtcgggcgacaccgtcttcctgcgcggactcgtgggccgtccggatggcacacacgtggtgcggggcgaggtgcgcggccccgtgtcgcaggcccatgcactgggtgaatccctggcggatgacctgctttcgcgtggggcggcggacatcttgcgtgatttcgcgcgccgcttcgaggcgcgggagtcctagactgctgctcgcgtggaacggcgacttgaaggcaagagagtcttggtgacgcgcccgcgtgagcgggccgaggagttgtgcttcctcctggaggatgagggcgccgaagtgctgagcgtgccccttctggaactgcatcctccggaggacccacgtccgctggcgtctgcggccgagcacatccagcgctacacctgggtggtgttcgcgagcccgaccggcgtggatgcgctgatggaggccctgcgcgaggcgggcacccaggaccggatacagcgggtgaaggtggccaccgtggggccgcgcacgacgcgcgccgcggagggctacggcctggtcgtggtggccgaaccttccgagggcacgggcgcggccctgctcaacctcatcaaggatgcgctgcaaccgggtgacgaagtcctgcttcccgccgccgaggaaggccggcgtgagctggaagacgggctgagagagtacggcctcctggtgacgcgggtgacggcgtatcgcgccacgcccgcgcccctgccaccggagtcgctggccttactggatgcctcaccgccggacgtcgtgctcttcgcttcgccgcgcacggccgaggccttcgtggaagaggccggacgcgagcgcctggccaccgctcgggtggtggcaatcggtccgacgacggcgtccgccctggagcggctgggcgtgcccgcggcggccgtcgcggagcggccgacgccagagtccctggtggatgccgccgtgctcgcggtgacgagcaccgtgcactgacggtggcgcggcgccgtgcccgcacggccgcacgacgtgcctgacagcggctccatgcctggctggtggagcggggggcgcaggggtgttttccgctcggtgcaccaccgtgtgccggagtccgtctggtacgcttcggggtcgcactccggcgggtggccggggtgaaaggagacgcgcttggtacagccagtgagcggcgtgggtggcactgctccgaagagccgggatgacttcaccacgctgttcgtgctggaggcgctcgttgcccaggggctgctgcaaccccagcaggcccaggaggtgctggcccgcgagggcgccgcgcgcgcccgggtgctcaaggcccaccagggggccacggggggcagcaaggaggccgcgcggtacgacgtatctccggtggaaatcgtggcggcgttccaggtgccgctgtccaacggccgaggcgtgctggacgaggaccgcgtcacggaggctgccgcgcgcgccgccggcatgacctaccggaagattgacccgctcaagctcgacatggcgctggccacgcgcaccgtgtccaggccctacgcgcagaagcacgtgctgcttcccctggagcgcaccccgcagggccggctgctggtggcggtggccaaccctttcgaccgggaactcttcgaaagcttccaccgcctgacggggctgccggtggagcccgtcctcagcgcgaaggcggacatcctcaagtccatcagcgacatctacggcttcaagaagacgctggcgcgcgccgccgacgacttcagcgccgccgccggagcccaggtcgccaacttcgagcagctcgtctcgctcagcggcacccaggagttggaggcgtcggaccggcccgtggtgcaggcggtggactacctgctgcgctacgcgttcgacaatcgcgcctcggacatccacattgaacccaagcgcaccaccagcgtggtgcgtctgcgcatcgacggcgtgctgcacccggtgcacacgctgccggcgccggtgcatccgcccatcgtctcgcgcgtgaagatgctggcgcgcatcgacatctccgagcgccgcaagccgcaggacggccgcatcaagacggagcgcgacggccgcgaggtcgaactccgcgtgtccacgctgcccaccgcgttcggcgagaaggtggtcatccgcatcttcgacccggagacgctggtgcaggacatcgcccagctcggcttcgagcccgacgagaagagcgccttcgagtcctggattgaccagccacacggcctcatcctcgtcacgggccccacgggcagcgggaagacgacgacgctctactccgcgctcaaggcgctggcgggcccggacgtcaacgtcaccaccatcgaagaccccatcgaaatggtgtgggacgccttcaaccaggtgcaggtgcagcccaaggtggggctcgacttcgccggagcgctgcgccacatcctccgccaggacccggacgtcatcatggtgggcgagattcgcgacccggagacggcggagaacgcgattcaatccgcgctcaccggccacctggtgctgtccacgctgcacaccaacgacgcgctgggcgcggtggcgcgcatgcgggatttgggcgtgccgtccttcctcctggcgcagagcctcctgggcgtcatggcgcagcggctgctgcgccgggtgtgcagtcattgcgcgcaggagacgacgctgacaccggatgagctgctcgcgctccaggcgcccctgccgctgctgcccggtggtgtgcgcctgctcaagggggcagggtgcgtgcgttgccgtggcaccggcttcgtgggccgcacgggcgtcttcgaaatcgtcaccagcgcgggcgagctgagagacctcatcgcccgcgaggccccctattcgcagatggtggacgcggcccggcgctccggcatgcggacgctgcgcgaggccgccgtgcgcaagctggcccagggcttcaccgccttcgacgaggtggtgcggatgacgaccgtctgacgcacgacggcccggcctcccacgaggagaggccgggccgcggagtccttctggctgccccggtggggcagggcggtggactagaagcgcgcctggagcatcgtgttgaagctttagagc

SEQ ID NO: 1194 - DNA, 21295 bp, Myxococcus xanthus
tgcgcgcggggcacgcccgcggccacctcgtccaccgggtagatgcggtccgcgtcgcgtccggcgagctccacctcggaccagcccgtgaggcgctcggcgcccgcgttccacgccgtcacccggccgtgccggtccaggaagcacagcgcatagtccgtcaccccgtccatgaggaggtgcaggtgctgctcgctggattggtggcgcgcatgcagcggagccagcgcgcggtggagcacgaagcccagcgccgccacgcaggccagacccagcagccccgccaggacggcctggggctgggcgccgtggcccgggggcatgctggcttgcgcgtagacggcggacagcagcgtcgcgagcagcagcaacccggcgaacaggcaggcggacaagccggcgctcactcgctgggcgaatgtccaacggcgcatcatgtggtgactcccccccaaggcacccttccgggcgtgccgtcggtgaggaaagcatcacccagactgcctgctggaagacatcgtcctggtggacggggtgggtccaccccaggggcgctcggacggcgcggtgcgggcctccggagggcgcttcgtccgacgaaagtccgtcatgggaggccgtcatggaatggccttcgtctggacagggggttatgagcggacgctccatgtctctagtcgaaggttcgaaggtccgttacctcccgcagcccgaatggggtgtggggcatctgttgtcgctgcaggaggagggcgccaaggcgctcgtcgcctttcccgcccgggaagacgccccggtgctggtgtccaccaagggtggagccctggtgcagtacccgctgcctcctggtgagccggtcatcacctacaagggccgcctggcgctggtggtgcgcgaggagccgggggcgcgcggcctgcgccgctacgtgctgcgctacgtggagaacgacgaggaggacgagctccccgagtcctcgctgcgcgcgctgccgccccgctccgacctgctgtccaccctgcgcgagggccgcgtgggcgaggcgcgggccttcacgctgcgaaagcaggcgctggtgctggacgacgagcgccgctgcgatgcgctgggcgcgctgctggccagccgcatcatggtgaagccgcaccaggtgggcgtggtgcagcgcgtgttgtccgccagccgtccgcgcttcgtgctggcggacgaggtgggcctgggcaagacgattgaggcgggcatggtgttcagcgcgctgcgcctgtccggactggcgcgccgctgcctggtggtggcgcccagccacctcaccgtgcagtggctggtggagctgttccacaagttcaaccagctcttcacgctgatggattcggaccgctacgcgcagtccctgaaggaagcgccggaggtgtccccttgggcgcgcttcccgctggtggtgaccagcctggagatgctccagcgcagcgaggagcaccgccgcgcgctggccggtgaggacgccttctgggatttggtcatcatcgacgaggcgcaccacctcaagggcgagcgcgccttcgaggccgcgcaggtgctggcgaagaacacgtggggcctgttgctgctcaccgccacgcccatgcagttggacccggcggagtaccacggcctgctcaccctcatcgacgcggccacggcgccctccgtcgcgggattcgaggagcgcctcaagcgccaggaggagctgtccgccgcggtgcgcgcgctgatggagggcggcaagccgtccgccgcggtgcaggcgctggcgaagcgcttccccgaggacgcgaagctgtcctcgctgaaggaccgcgacgcgctgctgcaacacctgtcggagacgtacagcctcagtgaccggctggtgcgcaaccgccgcgcggtggtgggcggcttctccacgcgccggttgcaccgccacccggtgacgctgcccgccgaggagctgacggtccgcgacgccgcgctggcagtgctcgccggggccagcctgcgcggcgcgccgctgggcaacgtgctgcgccggctggagtccagccccgccgccttcgcgggcgcggtgcgcgccaaccctgtgttcaaggggcatgcggacgcgctgcggttgccgtcgcgcgacgcgaagttcggcgccttcctgggcgtgctgcgcggcgtctggaagacggagccggcggcgaaggtgctcgtcttcacggagagccgcgacacgctggacgcgctccagtccgagctgggccgcgagggcgtggaggcgctggggtaccacggtgacttgcccctggtggagcgcgaccggcaggtggcgcgcttccgtgacccggaagggcccaaggtgctgctgtgcacggaggtgggcggcgagggccgcaacttccagttcgcgcaccacctggtgcactacgacctgccttggagcccggccacggtggagcagcgcattggccggctggaccgcatcggccagacgcatccggtggagattcacgtcttcgacccggcgggcacgctggcctccgacgtgctgatgctgctggcggacgcggtgggcgtcttcggcgagacggtgggcggcctggacgcggtgctggaagaggtggaggcgcggctggccgagctggcgctgatgccgcgcgaggcccgcatggcctacgcgcaggagctgaaggcccgcgtggaggcggcgcgcgcccaggtgaagcgcgcctatgacccgctcctggacgtgcgcagcttcgaccggcccgcggtggagcgcctggtgaagcgcgcccaggagcgcatgggcatcgaggccgacgaggaggacgaggacggcgaggcggaggcgtccggcgtggaggatggcctgtggggcatcgcgcgcgacctggacgagcggctggaggagacggtgacggagctggcgcgccgggtgggcatcggcgtggacaccgacgagcaggtggaggccttccaggtggccttccagttcggccacgcgctgaaggtggacggactgccgggcatcgacgtgatggaggaccgcacgcagctgggcaccttctggcgcgacaccgcggtggaggcggaggagttggagtacttcgccaccggccacccgctggtggaggcgctcttcggtttcctgcgtgacggcccctatgggcgcagcgccttccgcttcatcgagcggcgtggaccccagaagggacgcggcgtggagctgctcttccacgcccaactgccggagccagaggacacgtccccaggcgcccgggtgcccagccgccaactggcgcgcttcctggaacgcacactgctgcacgtggccgtggtggacggcgccggcggccccaagtccgaccccacgctgctgcccgcgctggagaaggaagggaagtcgctcaagggcgacgaggtgtcgcttgccttcccgggcttcgcggacttcgtggacgcggcggtgcccgtgggccagaaggccgccgagtcagagctggcgaagctggccacccgggcgcgcaaggccattgaagccgagcgcgacgccgccgtggcccgcctgcgcctgtccctggggcaccagggcctctccaccgaggccgtggaggcgcaactggacgcggagcgcacccactacgcccggctgctggacgcgctggcgggtgccaaggtggtgctcgactccgcctgcggcttcgtcctcaaccgctgaaggcgcccctgcccaaatgtccgcctgttgacgcgtgatgtcgtgttgctaggacttcaagaattgctgattttgttctcctagtgaaatcgcgcgttttcaggatggcgggccatttgaccgattcctcaatcaacgagaaataggatggtggaggctcgtatgatccaccgaggcaccccacgcacacgacgtcagtcgggacaggccgcggtggaagcggcgctgacccttccgctggtggtgttccttgtcctggggacactgcagctcttcatgatgctccaggcccgcatcctggcgcaggtggcggcataccgggcggtgcgcgcgggcagcatcaaccacggcaactgcctgccgatgatgcacgcggcgctggtgaccatgttgcccacggtggcgcgcacggacagctcggagaccctggctgcggccttttccccccgccgtcacaaccaattccgggtgcgtagctcctacgggcgcgacttcaacgagccgttgattgaaatcgtccgggagtcgccggatgccggctgggcgcaggagctgacggggggcgaggacctgctctttgatcagcccacggacaacgcggcggcgctgcgggcccgcacgttggagatacgcatggtggcctggtactacatgcgcgtccccttcgcgaactgggtgatgagccgcatgctgctggcccacttccggctccggcgctacacggcggccaacccgctgatgccggtgcagcgccgctccgcgtggtggggcgagacgagcgccacgctggggcgcgacggctggcccggcggtgatttgggcacgcgcatggtgcgctggagcgaccaggggcacttcgtgttccccatccaggtcaacgcggccatgcgaatgatgacgcccgtcatgtccgagtacttcatgggaggtcccgcgtgcaatctccacggctcgtgaggcactcgcggcgaggccaggcgctggtgctgttcgcgctgacgctgctgctgctgacgttgatggtgctgatgacgctgggcttcggcatgcgcgccaaggagcgcgtcgaaatccagatggccgcggacgcggccgcctacagccaggcggtggccacggcgcgcgccttcaacgccatctcggtgatgaaccgcgcccaggtggcgcacatggtggccatggccggcacccagtcgctcatcagccacagcagccaggaatacgcggcgcacgacgtggcctgccccggctccatcccgccgccggtgtggttcgccgcggacgctgccgccgccacgcaggtgcggcagctccagggccgggccggcaacatgttccaggccgggctcaacatctacggcaagctcctgagcgagcacatcgcggagcaggagctcacccggcgtgtcgcgcaggcggtcaacccggagctccgcgcgccgtccgctggcgcggccaagagcttctccgagctcaatggtggcaacgacgtcccggagcgcgacgccgtcatccagtccatcaaggcgggcacctatggctgcggcgtgggggacggagcgctctgcccttcgggcggcggtacccccgcgctcaacgccaccatggggagcatggggtggacgtgggtccacaaccgtccgggaggcaccgctggtttcggcaccggcggcgccgccatctccaccagctttcgccgctacggctcggtgtcgcagatggacccctcgacgtaccacaccgtgtcgggccgcaactcgacggcgcatgaccacgggcgcgtcgtcatccccacgcgctgcacccgagcgccgacgcttccacccatcgcgacggatgcgtgggtgatgtccgacgaggagcagacgcacgaggaccagcacgtctacggcgcgcgcatgcccccgggccaggcgccggaggacggcaagcccacctacgagacgcatacgctgggcgcgtgcgtggtgtgccccggcatctggccctactccgttggctacaacgtggacgaactgcacgcgggcgcgtccaaccactacggccagcccaagctgtacagcatgctgtaccgggactacgcgagcgcggagcgccgggcccgcccggacccgtggaacctcttcttccgcttccgcttcgcggggaccgaaacagagttcgacaacagcagtccgctgggccgcatccgccccacgggccgcgaggacgtgcaccgcaaccaggtggccctctccgctggcatggtctactaccaccggccccagcccgcggtgcagggcggcggctggcgcgaaccccccaacttcctcaaccccttctggcgcgccacgctggtgagcgcggagggcgcccgggatgaccggcccgcggacagcctgtccgccgccggcttctccgggcacgcgcgggcgctgcgagagctgcactccgtgggctaccggggcggtggccccggcgacaggggctactgacatgcgggttcgccatgcacgaggccagtcgctggtggagacggcgctgggggtgatggtgttcgtcaccatcctgctgttcggcatctacttcgccgaggtgggcgcgctgacgctcaaggtgcaggaggccgccaacttcgcgatgtggaacgccaccggccgggtgatgcacgacccgcaggacaacgagtggggccgacggggcacggtgctcgccgccgaggcggaggccaatggccgctacgcggacttcgacgggcgtcagcgcatgggccgcacgggcgtggccgtccagcaggccattgcccgcgcgcagcccatccaggtggattgccgcccggagctgccgggcaccgtgcgcggcctctccatggcggatgccgacccggacctggccggcaccatcgccatggggacgcagggcatggggtgcaccgcgtcctcgagcattcgcggcgtccggattggccgctatctggagaatggccgggaggggttcttcaaggtgtcccagcgccgggccgccgatgccttcacggtgtgcgccgccgggcgcgcctcgggtggccgctgcacggcgcgcttcggcatgctgctggatgactgggggctgggcggcgtggaggagggccgggcttgcgcgctcaacatcaacggcgcgcgccggtgcgccaacccggactactacgagtgggcgcagcgcgtgtaccgggccaacggtgcgggggggaacgccggctccgcgctcgcggcaatcaccggcgcggccggcgtcaacgaggaccagttcttcatgagcttccgcggcgaggaggacaactacgaggagaacctcggctccacgcacgccggcggccagacgcgctgggaggtgacgcccttcgacgcgcccaacatccgctcgtacaaggtgggccgcgcgagccactggctcggggtgccgcggtgacgtggcgccgggggctgctcgtcacggcgtgcctgctcggcgccgcgccggtggtggcccagggcacggcggcgaaggcacccgccgcgtccccggcgcagcccgaggcttccgcgcggccgcgctttgcctggccccgcgtgcaggtcatcgacaccgtcgagtcgaatgaaatcgtcgaggcagggggcatccccgtcgcgctgcgcgccgtgcacgcgaaggagcggatggatgacctggtgcagcgcttcgcggacgccttcatccaggcgggcctgcacctgccaccgggccatgagcagccgcagctcgccagcggcgcggtgatgctcaccgccatcgacgggcaccggggcatcacctacaccgtcatcttccagccgcagccggaccgcaccacgctgatgtacctcggtgaggccaatcacgccctgcgcagggacccggcggcggcgggggacttcgcgcccatgccgccccaggccagccaggtgctgcgcgtcaacagcgagagctcacgcacgctcgccttccacgtcccattgtccggcgaggccgtggacgccttctacgcccaggcgctcacgcgcgcgggctggaggctggaggaaggggagacgtccttctacgtgcgcacgggcgaggagctgcgcgtggtgcacgagccgggcgaggggaatcaacgggccgtggtgctggtgtatcgcggcgggcggagcgtgccaccgccgcctcctgggcccgccgctgtcgtgcgctgaagctcaggcgcgcagtttctcgcgcagcgccttggcgcggccctgcatgtcggggtccatgctcgtcagctcgacggacttcaggcgctggtccaggctctgcggcaccttggtcttcagcttgccttcatccccgagcacctccagcttcgccagcgccttgtcgacgatgcgctcgcgcgggtggtccagcaggctgtcgaggaagtacgcgtcctcgggcagctccgggtacttctccaggtagtccaccacggccttcacccagtcggcgcgcgtctcggactcggtgaccttctgcatggcctgcttctgggccttgcgcttgccctcggggtcgaacgtcttcgccagcccttcgggcagctcgccgccggtgaagagcgcgtccgcggcggccttgtacttctggtagctcgcgctgcgctccagcttctgctgcgcggggtcgtcctggcgggaggcgtacttgctgcccttgccgcgccccgcgtcgatttcgcgccagctcttgttgcgcttgccggagaagccgccgccgttgtcgtccttgtccttggccatccttcatctctccttgcgagcgccccacagcgccgccagtccgcgatggacgaggcgccgcaccgcctccagttcctgggaggacaggggctgctcctcgtcctgctccgcctcgaagagcgcctcgtccgcgtagtccttcagcggctgaggcactggcggggcatccgtgtccgcctccaacaccgccggcttgacggacgtgagtcccggcggccagcccagctccagcatggcgtacagctcgaggagcaggtggcgggcgacgccatatccttcgtccgtgagcgccgccgcgtcaagcgcgcccagcagcgcgtcctgccggttttcgaaggcatgggtgaagcgcgtgcgcgtcttctcgtcgtcctccagataacgccaggcggcctccacgaattcgcccgtgggcgtccccgggtggaagggcgcgggcgcggaggccttcaccttcttcgggcggggcgggcgggcctcgtcttccagccgcacgcgctttccctccgccaccaaatcccagaggcccagcaggttctggtacaggcgccgggcgatttcgggggaggggaagcgcggctcttcgtcgaacagcgcggggatgacgtcgctgggcggcgtgccttcggcgcgggcgtcccgcatgcgttcgagcacctgggcgctgtccagcccgctgtcggccaggtccagcaggccatcaagcgtctgggcgccctcgaagtggcgttggaagtcatcacctctgtcgcgggagcggctcatgtgggcaggcacgctaagcacagcgggcgggcgggcgcacgcggcttcatgactcgccgggccattcgcccatcagttcgtcctggcgctccttgggattggaggtccacgcgtagtcttccgggacgtggccgcctccgtgcgcggcccagccatcccagctcacctgcgccttcatgaaggcgtcggtgggttcgtccgtgacttcggggcggttggcggggacctcgaagggcgtctcgatgggctcatcaggaagggtgatggccatggctcaatcctcctggtgtgaacagtagggaggctccaggtgcgagaggagcggggccgacaggcaggcgagcggtgggtcgtcttttgttttgggaccttcgcacctagtcttcgttcacacatggcagaaacctccgtggaaacgttgaagactgcggtgcaggcgctctatcgcgtccacgcggtggaaggcccgcccggcgagaatgggctgcgcaccgtctggcacctgtgcccggacggcgcggagctgatgtccctggtggattcagaggggcgcgtgcgccggcaggagctcacgctgctggaggaccactacgtgtgggccagcggtgagggcgtgcgcaccggctacctggagcgcggcggcggcaagcccacggccgcggcggtggtccagacggacccggagctcgtgccgcagcggctgatgcgcgccgcgctcgccatgggcacgtacacgggacaggaccgctacctgctccacatgcagcgggtgctggcgctggcacgcgaaggcttggagatgaagggcggcctgacccgtccctccgagcccacgctgcccgccgtggaggcgccagtcgtgtcgacggctcaggccgccgtcttcgacgtgccgcccgctgcggtggcggtggtggaggacgtcacgcctccggtggtgcggcgcggtgagggcgtgacgatgctgctggtgctcgccctggggttgctggtggggttcgggatgctggcgttcatcttgatgggctgagcggggctcacgtctccggagggcggctgcggcatgctccccgaggggctctcgccgtgttcggcgggaatggccaccggcgcgtgttccgtggcggagctcaccgggtgcgcatccagcaccagcagcacggccaccgcggtggcgggcaccagccgggcggaccagcccagcggcgagtgggagtcttctccggcgcgccgggccatcagcgtcagtcccagcaccgccagcaccccggtgcacgtccaccgcagcgcgcgcaggttcgccgtcgcggcgagccccgtggcgatcagctccgagcgctccgcgtccggcatccgcgccaggctggtgaggaagctcagcaggtggcgggcctcgagcgcgcccaccatggccaccgaggccagggacgcggagacgccgctggccagcagcagtccgcggttgcgggagcccgcaggctcccggaagcccgtggggccgaagtgcgccagcgccagtcccagcgccagccccagcagcagcgcggtgctcgtccaggcgcccagcagccgcggcgccatggcctctcccgtgctggtcgcaagcaccaggcccgcctccaccgtatccagccggggcagggaggccagcacccggtccatcaggacctcggtgcccatcaaccccagcatccacggcagggtggccagtcccagcatcgcggacaagggcacccgccgatccatgccggagccgaccagcgccagggacagcagcggcacctccagcgccagcgccatcgccaccagcgcggcgaatggcccggccgcctggaatgcgtgcgacaccccggccatcccctccagcaggggacccagtgtgaagcaccacacgaacactgtgatgggcacggccagcgccacggccaggccgggcgcgagacgaagccggagcggaacgagcatttcaggagagagtagtctctccggttaagcctgtgaaattagaccgggggacgacccacgagccagtagatgacgctcgcgagcactcctgcgatgggagaaacgagcacacccagcaggtagagcttgggacacccgccgccgttgcaaccgatgcggccataggcgaggacgccggccagcagcaggggcacgtgcatgcccatgaggaagacgcccacaccgcgcagcacgagcccgcggtaccaggtgcgtgtccacaaccggaagacgacggggagcagcagcagcgtcagggtggccgcggtggccagggtgccctgccgagccgacaccgccacacacgccagggccgcgagcgccagggcggggacgagcagcaaggcgttgagggaatggggctcccggggacgcatcgaagtcagctagggacgctggcagagcgacggtggaggtgcaaggacggaagcgggagggatgtccggcatcagccagggccgcgcgccgccttcacgccgcgacggcgccttcgcccaggagctgcgtgtaccggccccgcagggcgagcagctccgcgtgggtgccggcctccaccacgcggccggcctccaccacggcaatcaggtccgcgtcacgcaccgtggacagccggtgcgcgatgacgagcaccgtgcgccccttcatcagggccaccaggccttcccccaccgcggcctcgctcgccgcgtcgagcgcgctggtgggctcgtccagcagcagcccgttggcgccctccaggaacaggcgcgccagcagcagccggttgcgctcgccgcccgacagcgccttcaccttcatgcgctgcatgggcacggggaagagcaggtcgtccaggtagtcgcgtagggcaatcttctggtcgcccagctccacccagtcctcgccctgcgaggccgcttcgtacacggtggcctccaggtcgagctgcgcccggctctggtcgtagtacgccaccttcgtgttcttcccgatgacgagcttgccgccgtcgggctccacctcgcccaacagcacgcgcaggaaggtcgtcttgcccacgccgttggggcccaccaggcccacgcgcgcgccgcgctggaggcggaagtccacaccgtccagcaccttgcggtcgccaaaggccttgttcacgccctcggcctcgatgacggtgtggcccagccggggcgccgccgccacgcgcaggtccgccaccttggggcgctcgaagcccttctccgccatcagcttctgcgcgcgctcgatgcgggccttgctcttggtgcggcgggcttccgggcccttgcgcagccaggccacttcctgggcaatccagcgctcgcgcttgtgctgcgccagcgcggcgttctcctgcgccaccagcttctgctccacgtaggcctggtagttgccggggtaggacgtgacgcccgcgccgggctggatttcgacgatgcggtccaccagcccgtccaggaagtaccggtcgtgcgtgacgagcagcagcgccccaggcagcttgtccagctcctcctccagccagtccaccgtgtccgcgtccaggtggttggtgggctcgtccagcaacagcaggtccggccgcgtcagcagggcccgggcgatggccacgcgcttgcgcaggccgccggacagctgcgccacgggacggtcccagtccttcacgcccagcctgtccagcagcgtcttcgcgtggtgctcggtgtcccagccgcccatctgctcgatgcggtcgctgagcgcggagaactgcgccatcagcttctcctgctcttccgccggggccgactccatccgcttcgccagctccgcgtgggcggccagtgcctccttcagcggcccctgggacacggacagctcggaggccaccgtggcgccttcggggaactccggctcctggggcaggtaggtgacgcgggcgccacggcgcagttggagctcgcccgtgtcggcgcgggcggccccggccaatatcttcatcagcgacgacttgccggagccgttgacgcccaccaggcccacccgttccccctcctcgatggtgaaggtgaggtcctggaagacggtgcggcttccgaagctgagctggacgttggcggcgcggagcagcgtcacgggattggactcctgaaaaggcgaaaggcgcccctcattgaagagggacgccttccttaccgccagagtgcggcggatgcgcggactacttgcgcgcggcctgctcggcggccagcttcttcttgtacgccgcccttcagggcctcggactcgttcccgggcaccggcgtgtagcgggagaactccatcgtgtactcgcccttgccctgggtggcggagcgcaggtccgtggagtagccgaacatggtgttcagcggcacctcggccaccgccgtgacgtagccctcggccgtctcggtggagaggatggtgccacggcgctggttcagctgacccacgacggagccctggaagtcctcgggagcctggacctccaccttcatcatcggctcgaggatgatgggcttggcggcggcgtagccctcacggaagcccatgatggcggccgtcttgaacgccatttcggacgagtccaccgcgtggaaggcgccgtcgttgatgaccacgcgcacacccaccacggggaagccgatgaggctgcccttcttcacggcctcggtgaagcccttgtcgcaggccgggatgaactcgcgggggatggaaccgcccacgatgtcgtccacgaactcgtactgctgcaccgcgtccgagggcagcggttcgatgtagccgcacacgcgggcgaactggccggagccacccgtctgcttcttgtgcgtgtacgcgaactcgcccttctggctgatggtctcccggtacgccacctgcggcttgccggcctggacctcgcagttgtactcgcgcttcatgcgctcgatgtagatctccaggtggagctcacccatgccgcggatgatggtctgcccggactcctcatcgcggtgcacgcggaaggtggggtcctccttggtgaagcggttgagcgccttggagaagttggtcaggttggagcggtccttgggggccacggcgagcgaaatcacggcgtccgggacgtgcatggacgtcatcgtgtagttcaccacgccatcggtgaacgtgtcgccggacgcgcactcgatgccgaacagcgcaacgatgtcacccgcggtggcctcgttgatgtcgttcatctggctggagtgcatgcggacgatgcgcggaaccttgaccttcttctggttcgactggttgatgatgaagtcgcccttcgtcacccggccctggtagatgcgcatgtacgtcagctgcccgtagcggccgtcctcgagcttgaacgcgaggccaacgaagggcttctccgggtccgagtcgaggatgaccttcgcctcgttgttcttctggtccagcgcctcgttcgtcgcctctttggggttgggcaggaacgcgcagacggcgttcaggagcagctgcacgcccttgttcttgtacgcggagccgcacatgaccggcgtcatcttcaggccgatggtggcccggcggacggcggcgatcagcgcctcgttggagatgggctggtcggccaggaacagctcgccgagctggtcgtcgacctcggccacgccttcgatcatctgctggcggcgcgtcttggcctcctcgagcagctccgccgggatctcctcttcacggatgtcctcgccgctctcgccatcgaagtagtacgccttcatttcgatgaggttgatcagacccttgaggcggtcctcggcgccgatgggcatctgcatctgcaccgggtggtggttcagcttctccttcagctgggcggccacgcggtcatagttcgcgccggagcggtccatcttgttgacgaacgcgatgcgcgggacgcggtagcgcttcatctggcggtccacggtgatggactgagactgcacgccagcgaccgagcagaggaccaggatggcgccgtcgagcacgcggagcgagcgctccacctcgatggtgaagtccacgtgtcccggggtgtcgatgaggttgatgttgtactcgccccacatcgcgaacgtggcggcggactggatcgtgatgcccttctcacgctccaggtccatgttgtccatgatcgcgcccacgccgtccttgccgcggacctcgtggatctcgtgaatccgacccgtgtagaacaggatgcgctcagagagcgtcgtcttgcccgagtcgatgtgagcggagataccgatatttcgaatcttctcgatgggtgcgttggcggccacgatccggtccttcttctcttgaaagtgcctgacggaacagagcaggcggggcctctacttcccacaggacgtagtttccagccaaatccgcatggaaattgacccacccgggcctacctccacctactcaatgccgttttcagttggggttttttaacgatgagcgcgacaaaaaacttctccctcgcccgagcctggctggacgctttcaacgcctatgacgtggacgcgctggtggcgctctatgccgaggacgccacccacacgtcccccaaaatccgggtgctgcacccggagacaggcgggcggctggtggggcggcaggccctttccgcatggtggaaggcggccaacgcccggctgccggggctgcggtacgagctggtggccctcaccgcggacgaggaccgggtgttcatggagtacctgcgccatgcgccgggggaggcccccatgccggtggcggaggtctttgaggtgcgcgacggccggattgtcgcctcgcgggtgtaccacggctgaagtccccccaccgtccgtgaagtgggctagcgtggccgccaatggcgaagaactcgaaccccagcgcattcgacagggacttcggttacctgatgccgttcctggaccgcgtggcggcggccgcctctgacctggaggatgcgtccgcgcgcgcggagctcacccggctgatggtggaggagaaggcgcgctggcagcgcatccaggagctgctcggaggggcggggggccgcggcgcagccgcgcccacgccggcccgggaagcgcccgccgaggcaccccggctggcgcggggctcggcggacgagctgcacgaagcggcccctttcgccacgggcctcacggtgggcagcctcaggggcagccgctgagctgatccaacgcgtcgaaggtggccgccttgtaggcctccgacagcgtcgggtagttgaagcacgtctccacgaagagccgggccgtggagccggtgagcagggcggtgaggcccacgtgcaccagctcggaggcctggggccccatgacgtgcacgcccagcagcttgaggctctcccggtggaagagcagcttcagcaggccgtgcgtgtctcccagaatctgaccgcgcgggttggtggcgaaggcggcgcggccggccacgtagggcacgttcagcgtgcgcagggcctcctctgtctcgccggccatcgacacttcggggatggtgtagatgccgtagggcagcaccggcgccatggtgcgcacgccgcccaggtcgaacgcgtgctccacggcgatgcgcgcctggtccatggacgtggaggccagcgccgggaagccgatgacgtcccccacggcatagatgtggggcagggccgtctggtaggtggggcccacctccacctggccgcgcgggcccacctgcacgcccagagcctccagccccaagcccgccgtgttggcggtgcggccggaggcgaccaggacctggtccgtctcaagcacggcgccggaggagagcatcatccggatgggagtgtccgcgtcccgcggcacgtctacctgctccaccacctgcccgaagcgcagttggatgccgagcgcctccatgcgctggcccagcagcgcggagaactcgtcgtccaggaagggcagcagctccgcgcgcgcctccaccagcgtcaccgggatgtccatggcggcgaacatgcaggcgtactcacagccgatgacgccggcgcccaccaccaccagcgagcgcggcagcctttcgagctccagcacctcgtccgagtcgtggatgcgcgggtcctcgaaggggtacagcggcggccggtacggcgacgagccggtggccaccaggatggtgccgccggtgaggcgccgctccggggcgtcctggcgccgcacgacgacggtgttcgcgtccacgagcgcgccggtgccctggatgatttccaccttgtggcgctggaggttgcgggcgattcgctcgcgctcgatgtccttcacccgccgttcgcggaagaggaagtcggacaccgtggcctcgtgccgcagcgtcgtctccacgctgtacagcccgcgcgcccggaagccggacaggtgcagcgccgtctcgcgcagcgtcttggagggaagggtgcctgtgttcgccgcggtaccacccagcacgggctcccgctccaccaccgctacgcgcttgcccgccagcgccgcttgtaccgcgccccactcacccgccgggccggagccaatcaccaccaggtcgaagtccgccatgggcgcgaaggtacgcgaccccgccggtcgtttgaaggcaatcccccgtgccgccggggcggatgccgcgccgccgttccgtgccgtgttgcgtccggcgcgacgcagcccacgttcctggaggacgcagcctgaaacatgtcacgcgtgtgtccgcatgggattcctgcgggatgtgcttcggtacgtccctggccctgatgttgctaggcccccccgtgattcgccaggccgcttcggcggacctggccccggtcgtcgtcggtctcacggctcggagtcacgttttgaatcatggcgactgagacgccacgtcggacgtgggcgcgacgatgcgggctttgccaggcggcagtctcctgactgctgcctcattcttggaaggaacgatgggagacgcgctctttggttacgacatggtcctgcaggtcacccagaatgaaatcaactcgcagttctccaggttgatgcaacaggggtacatccgctccctgctgaagacgaacgggctggccaccgctggcggtgcctttggcggcggcgagatgaccttgacctcctacatgaggggctacatcgcggcgcccagcgtggcgcagccgatggtcatcctggcctctggtgacaacccccagcagtgcctgtttcagttcgccctgcaaagccagccgctcacgcagacggtcatggagcaactcggtttcacccaggcccaggtggacgccgcgttcgcttcccctcagccaggccctgataactcgcagtacgggctgctggtgaatcatgaggacatcgcattcgggagcaacggcgaggcccagacgctgccgaatcagacggtctactactggctgaagcggacgtcggtcacggtgggcaccaccacgacctattcgaactacctggtgccggcgttgttctacatgtcgggaggcctctaccccaccctggtggacctgtctggcctgccgctgcgcttcacggtgaacctggattccatccccaccacgccgcaaggcatcgccgaactggtcgacaaaggaatcatgccgccgcaggtgttggacaccatcaacggcagcggcttcaacagcgcgtatttctccttgaagcagttgttcctgaacttcgacaccaccgacttcacgcagtggagcacgaccgcgccgcctaccagcaccgcggtgacgggggcgtcgatcaacaccgccagcaacacgttctccgtctccaccaccaccctggcgcaactggtagcggacccgggcttcctcaccgaggtgagtgtcgcgctgcaatacgccttcggcgtgggggcgacctacgacggcaaccccgcgtccacgccgtacatcatcggcgtctcggtgacctcctccaacccggcgcagaccgaccccgacagcacccccctcctggtgcccacctcggtcggcttctccagcctccgcaacaacgccgacagcggactgtccgtcctgaactaccaggtgatggggcggcggcaacgtcaatcccatccagccggcgcccagcgtgggcacgaacttcgtcgcctctaacgactattcgggcgagttgctgttttccgaggacgtgttcttcaggccggagctcttcaaccccctggtgcaggcgctcacctcggtacacgcccctcctgcctcgtggcggcagaacgggatgaccttcacctatcagacctcctatgagtggctggtccgcagcacgccgccaccggacaaccggctgaagacgggcacctatatgaaggtgacgcagaaggagagcccgaactacaccatcgcggtcagcggcaatacggtcaacgtctcgggctcgctgtccatcacccagaagctcgcggccacgctagaggtactcagcatcgaaatcccccttgtctggagcgtgacctgccagacctcgttctcgcaggcgctgactctggcggtgggcggaaatggctatgacctggtggtgaatcactctcaggccactttcagcaagccggtgaacggcccgctcgaatcgaataactgggaggcgggcctgagctccttcgtggtccagaccgcgtgggccatcatcgaccagttgtttcccacgtccaagttgattcaagagctgaacccggctcggtacacggtggatgtggtgcatgcgcagatcaacaacaccttcaacaagctcaactcccagttgaacaaggggctgacgggcggcgccaccggcaacttcatctcgcccacgggggccgtgtttctgctgaacgcaccgcgcttcaacgacgcattggcactgcaaatggacgtcacgtacggcgtttgacggaggaatcttcccatgactacgacacctcgctcgtccaccaccagcgtcgtcatccccagcacgctgccgaagaacccgtcgctgactgtcagcgccagcggctcgttgatgaagaattacctgccagcgctgccgattgcccccggcggccaggtcaccgccgcctgcgactccaacggctaccccatcgttttctcctttggagccgacagcggggatttctatgccatcgtcaacacgcgcaatgactccacgggctggagtcagattgacttgctgccaggggtgtccgcgctgggcaagccggtctatttcgccagcgggcaattgagcaacggcaacctctgcctgttcctggcttgccaggatgctgcctccggcgcggtgaatacctatgtggccggaccgctgtccaacaacctggaggtgaccgacctgtcgcagttggccgcgctgtggacccccaccggcaacccgctgtctggcgcgagcgtgagccgcgccagcatcagcccgctggacgatggcaagggctttggcatcccgatgatcgccgtggggctggtcgcccccggcgccacggacgtgctcacctacttgatgcaggccacggtcaacaccacgaccggcgccatcacctggaactggacctcctttccctcgcccaccgacgcccggacggtgctggactccgcgcccggagcggtctccgacctggggcagggcctgtacatgctgtacgccggccaggacggcagcacgcacctcgtcttcaagacgctgctcaacgagttcgggcgggactacgtgcgggcgctgcccgtgcccgcgggccagaacagtctacagaccaccgcgggcagcggcggcaccagctatctctatgccggcggcgcggcgggaatcgtgttctggagcgccagtgcccagctcgaatcgaacgcgccgggctggacggccgcgcagaccgtcgccacgggcgaacagctgccgggcatggccgctggtgggctcgtggtcccgcagagcttcagcaagtccaacgcgctctccgcctgggcgctctccggcagcaacctctacctgctcagccagttcgagtatcagggggccctgcactggac

SEQ ID NO: 1195 - DNA, 22156 bp, Myxococcus xanthus
ctacaggaagcgcggcgtggatacccggcacgtccgcgagttcctgtcccgcaagctgcccgaacacctggtcccagcgacctacgtcgtgctggaggcgctgccgctgacccgcaacgccaaggtggaccgcaaggcgttgccgcatccggaccacgtcgcgcggcccacgcagcgcgaggagagcaagcccgctgccgccgcccgtccaggccgtgaggcccaggcgcttcagcagtccatcgcgaaggccgtggcggaggtgctgggggttccagaggtccacccggaccggaacttcttcgagctgggcgccaactcggtgcacctcatcaagctccacctcgagctcaaggagaagctggggctgtcggttcccgtcacggacctgttcggcaggcccaccgtcaaggtgctcgcggccaggctcgcggcggcgggcggtgaggagaagcccgaggtggcactcgcgccgcgggaggagacgccgcggacgcaggatgcgcgggacatcgccatcatcggcttgagctgccgcttccccggggcgtcgacgcccgagcagttctggcagaacctgatgcagggcgtggagtcggtgggcaccttcaccgatgacgagctgctggccgcgggcgtcagtccggaggcgttccggaatcccgggtacgtccgctcgtcggcggtgatggatgactttgacgccttcgacgcggagttcttctcgctgacgccccgtgaggcacgcgcgttggatccgcagcagcgggtgttcctggagtgcgcctgggaggcgctggagcacgcgggctatccgccgtcggggcgcaacgggctcgtcggcgtgtatgccgggaagagcgtcagccactatcgctatccctacccggacctgacgcgccccatcggcttcttccaggacctgatggcccaggacaaggacttcctggccacgcaggtgtcctacaagctcgacctgcgcgggcccagcatcaacgtccagacggcgtgctccacgtccctggtcgcggtgtccgcggcgtgcgcggcgctgaatgagggcagttgcgacctggcgctcgcgggtggcgtggccatcaaggtgccccaccgcgtgggctacttgtacgaggaaggcagcgtcttctcgcgcgatggccactgccgtcccttcgacgccggggccaacggaaccatcccgggaagcggcgctggcatcgtggtcctcaagcgcctgagccaggcgctggcggatggggaccgggtgctcgccgtcatcaagggctccgccatcaacaacgacgggcaccgcaaggtgggcttcatggcgcccggcgtcgagggccagacggacgtggtgcgccgtgcgcatcagcacgcgaaggtggacccgcggaccatctcctatgtcgaagcccatggcaccggaacggccattggcgaccccattgaggtctccgcgctgacggaggcgtttgggggacaggtccaggcgcagtcgtgcggcctgggctcggtgaagggcaacatcggccacctcgacagcgcggcgggcatcgctgggctcatcaaggtcgtgctcgcgctccagcaccgcaccttgccgcccacgctccactatcagtcgccgaacccgcggctggagctcgacaagacgcccttctacgtggtggacaaggcccggccgtggaccgcgacgcagggtgtcctgcgggcggggctcagttcgttcggcatcggcggcaccaacgtccatgtggtcgtcgaagaggcgccgccgcaggcgacgccagcgccggacgtgcagccgttggaccgctcgcggcacctcctggcgctctcggcgcggagcccggaggcgctgcggcagctcgcgggccgctaccgggcggcgctcgaagcaccgggcgcatcgctcgcggacgtgtgcttctccgcgaacactgggcgtgtcgccttcgaccaccggctcgcggtggtgggggaggacgccgcgcaggtggccgccgtcctgggcgcggcggagcggaaggacgagcacccgggggtcgtccagggagaggccgacacgaagcaggcggtgaaggtcgcgttcctgttctccggtcagggctcgcagtacgtcggagccgcgcgcgagctgtaccagacgcatccgggcttccgccggcgcatcgactcgttcgaccagatgctccgtgagtattgggaccgttcgctgatctccgtcctctacgcggagccggggacgccatcgcccatcgaccagctcgactacgcccagccggtggtcttcgtgttggagtacgcgctggccgagctgtggatgtcgtggggcatccagccggacgtattgctgggacacagcacgggcgagctggcggcggcctgcatcgcgggcgtgttcagcgtggaggatggcctgaagctggccgttcaccgcggacggttgattcagcagcttccggagggcggcaacatcgcggtctccgccgcggagccggagctgcgccagttcctcgcccagggcggttgggccagctccatcgcggccgtcaacgggccggacaacgtcgtcatctccggcatccccgcggagatcgtggagataggccaggcgctggacgcgaagggctacaaggtcaagcggctgaacattccgcgcgcggcccactcggtcatgatggaggccatcctcccggagttccgggccgtcgccgcgtcgctgcgttattcgccgccgtcgattccgatggtctccgggatgactggcgagctcatcacggacgggctctgcacgccggactactggtgcagccagcttcgcaacccggtgcagttcggccggggcgtggaggcgctgtaccgcgacggcatgagcgtcttcgtcgaggtcggcccgaaggcgaccctgctcggcatggcggcgcgctcggtgcccgagggcgcgggcacctggctgccgagtctgcgcgccgatgatgggggctggcggcagatgctggagagcctggcggcgctgtacgtgcgcggcgttgcggtggactgggcggcagtggatgccggctacccacggcgcaaggtggaagtccccacctatgccttccagcgtcagcgctactgggaggagggcgcgggcctccagcgtcccaacgggcgaagcgtttcccgcgccgagcacccgctgattggcgagcgcgtgcccctggccgtcctggaggccggtgagctgctgttcgaggccacgctggggcctgcctcgcaggcgttcctgggccagcaccgcgtcttcggaacgcccacactgcctgcgactggctacgtcgagatggcattggccgctgggacccggctgttgggcacgaccgcgctggagttgaccgacctggccatcctcaacgcgatgaccttcccgaaggatgccgagcggaaggtgcagtgcgccgtgcgccgcgacggagagggcagggccgctgtgcgcatcttcagccggacgggtgagggctcggagcgcgcgtggagccttcatgcgacgggcacgctcgccgtcctcggtgatgatgcaacggccaccgaggcgcacgacctcgacagcgtgttgagggacctgcagaccccgcttcccgtcgaggactactaccagcgggcacggaacgcgggcgtcgacttcgggccggagttccagggcatcaccgagctgcgccgggaaggcgagcaggtcctggcgcgcatcgagcgcccggcgggcctcgggagcggcggtggctacctcgcgcatcccgccctgatggatgcctgcctacaggtggtgggcggcgcctatccggacatggatggcaccgagctgtacgtgccggtgcacatcgagcggcttcacgtgctgggcagcatcgaagacggcgtgtggagccatgccgtggtgcggccggtggatgaggctgggaagcggttgcgtgcggatgtccgcatcttcggaagagatggcgcgctgcgcgcctgggtgcgtggcctggagcttcagcgcacgagccaggaggcgctgcgtgccgcgctctccacctcgctggatgagtggctctacgagcggcggtgggagccgctcgcattggaggggactcgtccggagacgctggtgcccgcgagcggcgcgtgcctgattctctctgagcgcgacggcgcagggcagcagctcgcacaggtgctgaagcgcgatggccgcgcctgcttcgtcgccatccgtggcacacggtcgcaccgtatcgatgagaccaccttcgaggtccccgacgcgcccgacgcgctcgtggaggccttgcgcgaactgccgcttccggcggcactgtccgacgtcatcctgatgtggggctcccataccgaggaagcggagacgctggatgcggatgcgctggggcaggcggctcgggtgacgggggggggcgcgctgggactgctccagttccttctggaccgtgggtactccggcaccgtgtggctggtgtcgcgtggcgcgcagcccgtgaagccgggcgttccgttgaccgggatcgcccagtcgttgctgtggggcatggcgcggcccctgaccatcgaggcgtcggagttggattgccggtgtgtcgacctcgatgcccagggcgaaccgagcgcccaggtggagttgctcgcgcaggagattcgccgccgcgcggaggtggcggaggaccaggtggcctatcgcgatggccgctacgtcgcgcgactccggagggtcgagtcacggaagctcgttgaagcatccgcggagcgagtcgaagccttccgggcggaccgaagctatctcgtggcgggcgggctcggacgcctgggcttgctgacggcggagttgctggcgagccggggggcacgaaacctggtgctgacaggccggggcgctccggggccgcagacggcggaacgtctggagcacctgcgccagcagggtgtccgtgtcgagtaccggcaagtcgacatcgcggatgcggagccgctggccgcgctgctgaacgaggtggcgcgggacatggcccctctgggcggcgtgttccactcggccggtgtgctggatgacggcgtgctgcggcagcagcgctgggagcgcttcgagaccgtgctgcggccgaagttgcgcggcgcctggaacctgcatcgtctgaccgcgggcctgccgctggactacttcgtgatgttctcctccgtcgcatcgctcgtcggctcggcgggacagtcgaatcactgcgcggcgaacgccttcgaggatgcgctggcgcaccaccgccgtgccctgggcctgcctgccctgagcatcaactggggcatctgggccggtgacgcgggcgcccaggtgtcggtgagcgaggaggctcggacgccgggcttcggtgtcattccgaaggcgcagggcctgcgcgcgctggagctgctcctcacatcgcgcgttcctcaggtcggcgtggccgccatcgactgggccgtcttcggcagcggccggtccacgccctacgccgcggagttgcgcgagcgggcagggggcgagcgcacggtggagcgcgcgtcgttcctggacacactcacggcggcgcccatcgagatgcgtcggcagttgctgatggactacgtgcgcgagcaagtggcgtggatgcgaggcgtgggctccagcgagtccatcgacccggcgcgtgggttccacgagctgggcatcgactcgctggcggcgctccagctcaagaaccggcttcagagtgggctcggcgtgtcgctgccggccacgctcgtcttcaattacccgacggcagagaagctcgcgacgcagctcatggacgcgttcatccctctggagttcacggaggaagcgcgcgtcacgtcgaagtcagacgccccggtcgagagcccactggaagggctggctgaagcgaacctcgcgcacctgctctccgagcagttgtcgaagatgaactagggacggaacgatgtcagcgcaaggaagcgatacgagctacggcgagctgatgaagcgcgcacttctgaagttgcaggagacgcagtcgaagctcgatgcccatgagcaggaaaagcacggggccattgccattgtcggcatcggctgccgcttcccggggggcgttaccagtcctggcgaatactggcgcctgctctccgagggcgtggacaccgtcaccgagattccatccgaccggtggaacgcggacagcttcttccaccccgacccggaccatcccggtggcatctacacgcgccacgggagcttcctgagggacatcgaccagttcgaaccgcgcttcttcggcatctccccgcgtgaggcggcgcggatggacccgcagcaccggctcttgctggaggtcgcctgggaggccgtggagcgtggcggccggaatccgacgagcctgagcgggacgcggactggcgtgttcgtcgggctgatggggcaggactacacgcaaattgccacccagtccccggagctcatcgacgcccacaccggcgcggggaatggcgcgagcgtcgccgcgggacgcctgtcgtattccttcggactcgaagggcctagcctcacggtcgataccgcgtgctcctcgtcactggtcgcggtgcacctggccatccgcagtctgcgtcagcgggagagcgacttcgcgctggcgggcggggtgaacctggtcctctctcccgtcgcgacgctgattgagtcgcgcacgcacatgctgtcggccgatggccggtgcaagaccttcgacgcctcggcgaacggcatcgggcgaggggagggctgtgggctcgtcttcctgcggcgcctgtcggacgcgatcgcggatggggaccccatcgtcgcggtgattcgcggctcggcggtgaaccaggatgggcggaccagtgggctcacggtgcccaacgggcttgcccagcagcgcgtcatccgggatgccctgcgggacggacaggtggagcccgcgaaggtgggctacgtcgaggctcacgggacggggacgtcgctgggcgaccccatcgagctggaggccctcgcgtccgtctactgcgccaggacgggacggcagcagcccctgatggccggctcggtgaagacgaacatggggcacctcgaaggtgcgtccggtatcgcggggttgatcaaatccgcgctgtgcctggcgaacgaggaggtcccgccgcatctccacctgcgcacgcccacgtcgcatgtggactggaagcagttggccatcgaagtgccgaccgcgcgccgtccgtggcaggggacggagtcgcgcttcgcggcggtgagttcgtttggcttctcggggacgaacgcgcacgtcgtcctggagtccgcgccacggccgaagtctccggtccgggatgtggaacgctcgcgtcacgtcctggcgctctccgcacgctcgaacgccagtcttcgcaggctggccgggtccatcgcggaggagctgtcgctgggccccgcggaagggctcgcggatatctgccacacggcgaacaccggccggagcgccatggaagagcgcgtggccttcacggcttcgacctccgaggagctgaccgaggcgctgcgtgcgttcagccgtggagcgcccacggtccgcgagacctgcgtggaaggccgccgcgacgccgaggcaccgcgcgtcgcgttcatcttcacgggccagggttcccagtacgcgggcatgggccgggagctgttcgacacgcagcccgagttccgccgggaactcctgcgcttcgagggcatcctgaagccgcacctggagcggccgctcaccgaggtgctcttccaggacacggaaggggcgctggacgagacgcgatacacccagccagcgctggtggcgctggagctggcgttggcgcacctgctgcgagcgtggggcctgcgcgccgacgcggtcctgggccacagcgtgggcgagtacgcggcggccatgttcgcgggcgtcctggagcccgaggccggcttgcccctggtggctgagcgcgctcggctgatgcaggcgctgcccgagcgcggcgcgatgctggccgtgttcgccgagtctgcgcgcgtgctgccgctcatcgccgggcatccccgggtgacggtggcggccatcaacgggccgcggaacaccgtcatctcgggggacagcgcggccatcgaagccgtggtccaggcgctcgtggaggcgggcatcgagagccggcgattgaaggtgtcacacgcgttccactctccgctgatgcagccgatgctggcggagttcgagcgggccgcgagccgggcctccttccagaagccgcgccttcccctcatctcgaacctcgacggacgcgaagcaggcgaggccatcacccagccggcctactggtcccggcatgtcctccagcccgtgcgcttcgaggacggcatccggacgctcctccagcgcggggtgcgtgtgttcctggaggtgggcccgaagccctcgctgtccaacctcgcgcgggacgtggttgcgggtgaagaggcgctgtggctggagacgcttcacccccgccgctccgactgggccggcctgctccgggcgatgtccgagctgtatgtgcgcggcgccaggctggactgggagcgcttcgatgcgggctatgcgcggacccgcaaggccctgccgacctatcccttcgagcggcagcggtactggctggatgtgcccgcgccgtggacgcgcacgtcgcgccgtgcgtcgactcacccgttgctggggacgcgtctggagtccgccgctttgaaggaggggacgaccgtcttctccagtgagctgtcggcgggaaccgtgcctttcgtggcggaccatcgggtgtacggcaaggcggtggttcccgcggcggcctacgtggagatgctggcctcggcggcggcgcaggtgctcggaacggagtcgctgcggctggaggacatctccctgcttcagccgctggtgctccccgaacagcagacgcgggtcgtccagacgttgctggaggaccagggcgaggcgggccttgcgtgcaaggtggtgagccggggggacgagcgctcggaggagggcggcggcggatcgcgcgcggcctgggtcacccatgtgacgtgccgggtgtcggcactgagcaccgtggccccatcggtggatcgggaggcgtggggtcgtgactgcgcgacgcctgtttccattgatgaactctccgccgtcttcacgcaccacgggctcgactatgggccgtccctgcgggtgctgacgtcgctgcatcgggggactggggccgcgctgtcgttgggccaggtggaagaccggagcgggcactaccgcgtccacccggcgctcttcgacggctgcttgcgcacggcggcggcggtgtcgcggctcacggaggaagacgcgctgcacctccccgtggccttgcagacgctggacctgtaccggccgctgccggagcgggtctggacgtatgcggcgcagcctccccgggagggacaggagggcttctccgcgacggacctgaccctgtgtgacgacgatggcgccgtggtggctgtcgtgtcggggttctcggtgcgcaaggccgaacgcgacgtgttgctgcgtgggctcgaaaacgacttccaggactggctctaccgcctcaactgggtgtcgcgtgccgtcacggaggaagcccactccgcgaatcagcattgggccgtcttcgccagcgaggacgacttcgcctcggacctggtgcaggtgctttcgcagcgtggcgagcgctgcacgttggtgcgcaagggggagtcattcagcagcacgccagagggcttccgcatcaatcccgccaacccggaggaccatgcgcggttggtcaaggcgtgggcgaatcagcctcccacggggctgttgtacctctggggcctcgatgagggaggccatgcgggtgacgcgggcgccaggctcgacgcggctcaggagttgggatgcctgggcgcgctgcggttgacgcaggccctggcgcatggacagggagcgtcgccccggctggtgctggtgacgcggggcacgcaaagcctgccctccgatacgcacggcgcccgcgtcgcgcaggcgccgctgtggggcttcggacaggccgtggcgacggagttgcccgaactgcggtgcctccgcatcgacctgcccgcggagccccggtccgaagacctgggcaccttcgtgcgggcgctcgcgttgccggatggggagtctggcgctgccattcgtggcggcggtctctacaccccccggctcgagcgggcccgttcacggtcggtcgcggcgaagaaggtgtccatcatcggggaggccacctatctcgtcgcgggaggcctggggggactcggcctgcgtgcagccaactggttggcggcacagggcgcacggcatctggtcctgatggggcgcagtgctccgtcgcctgaagcccgcgcccagctcgatgcgctcgagtcccagggcgtgaaggtgcgggtcgcacgggtggacatcgcgtctcacgacgccatggcggacctcttcgcgagcctgcgcgaagccccgcccgtgcgcggcatcattcattcggcgggcgtcctccgcgatggaacgctcgccaaccagacgtccgagcagttccgggaggtgctggcccccaagcttcagggcgcgtggaacctccatgcgctcagccagggcatggcgctggacttcttcgtctgcttctcgtccgccgcgtcgctcatcgggtcgccgggccagtcgaactacgtcgccgcgaatgccttcctcgatgcgctggtccatctgcgccacgcggaggggctgcccgcgctgacgctcaactggggctcgtgggctgagacgggcatggcggcgcggctggagcgggcagcctccgcgcggccgggggcgcagggcttcggcgccattcccgtccagcagggcttcagcgtcctggagcggctcatcgggagcgcgcaagtccagtggggcgtcttccccgtggactggacgcggctggcggagcagttgccagggctcgcgcggcaggcgctcgtccagggcttgctggggagcgtgccacagcgggcgcaagcgccggccttccgcgcgcagttggacgcggcgccgccgaatcgcaaggcggagttgctgcgtcagcacgtcgcggggcaggtgtccgcgacgttgggcatgccggagtcggagcggctgtccggaaacgagcgcctgttcgaactgggcgtcgattcgctgctggccatcgaaatcaagaaccggctcgcgagcagtctcgggcgaagcctgcgttcgacgctgattttcgacttccccaccgtgaacggactcgtcgcgcatctggccgaggagctggagctggggacagaggttcagaagaagcaggaagcatcgcgggaggcgcagggcgcgctctccgcggagattcaagggctgtcggagcaggagctgacgtccctcatcgaccaggagctggagagcgcgctcaccagatgagaccctgatggcgaaactatctacacgcatttccgaattgcctgtcgtcaagctcgcgtacctcgcgagccagctgcgctcgaagaaggagctgctggcggccgagcccatcgccgtggtgggcatgtcctgtcgcttccccggcggaggtgacctgccagagacgttctgggagctgctcgccgagggccgcgacgcgacacgggaggtgcccgcctcacgctgggacgtcgacgcgttctacgaccccacgcccggtgtcccgggaaagatgtacacgcgccgaggcgccttcatcgacggcgtcgacctgttcgaccctggcttcttcggcatcacgccgcgtgatgccaagggcatggacccacagcagcgcttgttgctggaggagtgctggcgagccttggagcgcgccggcatcccacccgccggcctcaccgggagccgcaccggcatcttcctggggctgatgcacaacgactacaacctgctgggcatcgccgagaacatggagttccactcggcgtcgctcaattacccgtccgtcgccgcgggacgcatctcccacacgctgggccttcaggggcccgcggtctccgtggacacggcgtgctcgtcgtccgcggtggccatccacctggcctgtcagagcctccgcaacgacgagagcgacctcgcgctcgccgcgggcgcgaacctgaacctctctcccgtcacggtgatggtggagtgccagaaccgcatgctggcggcggatggccgctgcaagacgttcgacgcctccgcggacggcttcgggcgcggcgagggttgcggcgtcgtcgtgctcaagcgcttgtcggatgcgctggcccatggcgatgccatcctcggcgtcatccggggctcggcggtcacacatgacggccgcagcagcgggatgatggtgccgaacggacgctcgcaggagcgcgtcatccgggcggccctggatagctgtggcgtggagccggaccaggtgggctacatcgaggcccatgggacggggacactgctcggcgaccccatcgagatggaggcgctgcggtccgtcttcgggcgcaagggcgctcgcggtgagccgctgtacgtcggctcggtgaagacgaacatcgggcacctggaggcagccgccggtatcgcggggctcatcaaggtcctgctcgccttgcagaacgaggccatccccgcccacctgaacttcgagcggcccaatccgaacatccgctgggacgacctgcccgtcaccatccccacggccacgcggccctggctgcgcggtgacaagcgccgtatcgcgggcgtcagcagcttcggcttcagcggcaccaacgtgcacatggtcgtggaggaagcccccgtgctggcgcggccccgcgtggacgcggagcgcccggcccatgtgctgacgctgtcggcgaagagcgaagccgcgctcgaagcgctgatggaagcgcaggaacgcgcgttgccggaggacccggcggcgctgggagactggtgctacacggcgaacacgggccgctcccagttcgagcaccgcgccgctgtttcgggcgccacggccgcggagctgcgcgcgaacctgacgcggctgcgcgaagagaagctgcgcccagcgcgcgaacccctgcgcggaacggagagcccccggcctgtcttcctcttcacggggcagggcgcgcttcgccctggagtggggcgggaactcttcgagacgcagccggtgttccgggcagcggtggagcggtgctcgaaggcgctggagggcctgctcgattgcagcctcgaagcgctcctcttcggtgagtcttccgcgatgcttctggaggacacgcgccatgcgcagcccgcgctggtggctctggagtatgcgctggcggagctgtggggcgcctggggcgtcacgccagcggccctcatcgggcacagcctgggagagtatgccgcggccgctgtcgcgggggtgttcagcatcgaggaggcgctgcgtctggtcgtgacgcgtgcgcggctcatcggcgagctgctgggcccaggcgcgatgctggcggtctctgctccgctcgacacggtgaaccgggccatcgcgccgcacgccggctcggtctccctggcggcggtcaacggccctgatgacgtggtcatctccgggacgcccgacgccatcaccgaggtggagcaggcgctgtcgagccagggcatccagacgaagcgtctgcggatgtcctacgccttccactccacgcagatggagcccgtgctgaagccgttcgccgaggccttccaagggctcacgctgtcggcaccgcgcatcccgctggtgtccacactggagggccggcgtgtcggcgacgaggtctcccggcccgagtactggtgccgtcagattctagagcccgtcgccttcgccaaggcgctggaggcgtcgcgggaggacgggcaccggacctatctggagctggggccggcgcccatcctggctggcattggccgcaggacgttccagtcggaagagctgtgctggctccccagcctgcgtccgtccaccggagagacagcgcagctgctctccagcgtggcggagctgtacatgcgtggcttcgacgtggattgggctgcgttcgatgcgcctttcgagcggcgcccgcgctgcttgccgacgcatcccttccaacgtgagcgctactggatggacttgcaaagccccgagaatcgccggggctatgcggcgcgtgacgatgccgcgcgaggcgatgcgcactccctgccggggacaccgctgtcgctcgcgggggcgaaggaaacgcgcttcgcggcccggctgagcaggcacgagcccgctttcatcgaggagcatcgtgtgctgggcaacccagtgctgccggccgcctgctacgtcgagatggcgctcggcgccgcgcaccacgcgacgtctggcgggaaacctctggagctcacggccatcgagctggagcgggcgttggtcttcgccgagggacagtcacaggacgtccagacggtgctgacgcccgaggagcagggctctcgcttcgaaatcttcgggcaggcgacagggacggcggatcggaattgggcccggctggcgcagggccgcatcaccgagggccgcatgaacccggagcacgtggccctggagtcggagctgttgcaggcgttcccccggcagggctccgtcagcgcgcactacgacatgatggcgcgcggtgggttggagtacggcccttcgttccgaggcatcgatgcgctgcggttcggcggggagggatgcctcgcccacgtgcggctgcccgatgcgctcgtcatcggtttgggggactactggctgcatccgttgctgctcgacgcatgcttccagacggcggcggcggcgttcacggacggcggcgcgcaggtggcgggagaagggcagggacgcattccggtcgccatcgagcggctgcgttggttcaagcggcctgggagcagcatctgggtgcacgcccgaaccggggcgcgcacgtcgctctcggagggactggcgagcgccgacctccgcatcctggacgaggacggcaccgtcgtcgccgaggtggaaggcctgctgctgaagcaggtcgaccgccgcgcgttccaggcggccttctcgggggcgatgcaggaactcctcttcgagctggcgtggcgggagcagcccgcgccctccgcgcgtgaccaggtggcttcgcagtccgggccttggctgttgctggtggactcggatcgcgtcgcggacgaagtcaggacgttggcgcggcaacgcgcttggatctgcgtggtggccacgcccggtgcgtcctacgaacgcgtcgacgcgaaccactaccggctgaacccccatgacgcggcgggctttgaccggctgctccaggacgtctccgctccagcggcagtggcctatctgtgggggctcggcgaccgttctcccgaggccctctccggcgcggtgacgtcgagcaccttgggcgcgcttcacctcgtgaaagcgatggcgcgtgccggctgggcgcagccgcctgccctctggatggtgacggagagcgcggtggccgccacgcccacggatgcggtggagggctttgctcaggcctccctctggggcttcggccgcgctgtggccatcgagcacacggagttcatgtgccgcatggtggacctggagccgggctccgaatcgctggagcgcttgttcctcctcatggcgcagccgccgcaggagaacgtcttggccctgcgcggcggccggatcctgggcgcgcgcctcgtgcgtcctggcaagccacctgaacgcgctgcccccgtgcgtatccgccccgatggcgtctacctcgtcacgggaggcctcggggcgctggggctcgagactgcggagtggctggtgggggccggggcgcggcacctgctgctggtgggacggagcgagcccacggacgcggcgaacgctcggctcgcggcgctgaccgcccggggcgtcggcgtcaccgtcgcgcgcgcggatgtctcacgacaggaggacgtgcagcgactggtggcgagcgtgtcagagcggggcctgtccctgcgaggcatcatccacacggcgggcgtgctggaggacggcgtcatcctgcaccaggatgcggagcgcttctcgcgcgtgttcgcgcccaaggtgcagggcgcgttgaacctgcaccgcgccacggccgggatgccgctggacctcttcgtcatgtactcgtccgcggcctcgctggtgggcgtggcgggacagtcgaactacgtggcggcgaacagcgtcctggacgcactggcgcaccaccggaaccgcctgggtctgccagccctcagcatcaactggggacggtgggcgggcgcgggcatggccgcgaagagcgcggaccggccggaagcgtcggatgccgccagcctctcacccgaagtggcgctccaggtcttcgaacaactgctggagcagggggccgtgcaggtgggcgtcgtgcccttcagcgtctcctcgctggaggcggggccttcgcccggccatggccccttgttctccgagctgatgctccgtgagcaggcccggtccgcggcggcttcgcggatgcatgagctgatggaagagctgaagcgggcggacggggagcgccggcgcgcgctgctgacacggtacgtacagagccggctggggcccttgctgggcttcgccccggaccacgaggtcctccagaagaggatttccttgaacgagatggggctcgattcgctgcgcgcggtcgagctgaagaaccgcattggccgcgagctgggagtggacctgctcatggcgcgtttcatcgacggcaccacgctcgacgggattgtggatgcgctgagcacccagctcgagctcaaggagctgctcgcgcgtgctcccgcggcggaggccgcagccgacatcgaggagttgacggtatgaatctgggggaactgctcgccgagctgaatcggcggggcctggaagtccgggtggaaggcgacgcgctgaggcttcgcggaccgaaaggcgccgccaccgcagagcttcggcaggcactggcggaacacaaacccgagttgctcgaactcctgcgtgcccatgaccgggggcaggaggaggcgcccatcgtcccggttcaacgcaccgggcccgcgccgctctcctatgggcagacgcggctgtggttcctcgaccgcttggagcctgggagcaccgcctacaacctgatgctggcgttgcaggtcgaagggcacctcgacgtagccatcgtgaagcgctgcttcaccgaggtcatccgccgccacgaggtgctgcgcacgcggtatgccgagcacgcgggcgtcccggtccagattgtcgacccggagccccggttcgacttccgcgtgctcgacgagcgcgaggtgctggcctccgaacccgcgggcgtggaggccttcctccagcgagagggcaagcggcccttcgacctgtccacgggccccgtgatgcgtgtgctcatcatcgagcgggggccccaggggcagtacctccagctctgcttgcaccacatcgcggcggacgtgtgggcgcaggccatcctcgtccgcgaaatcgtgacgttatatggcgccttcgccagcggccaaccttcgccgttgccgcccctgacgctccagtactccgacttcgctgtctggcagcgggagtacctccagggcgaggttcgccagaagctggtggactactggcgcaggaagctggagggggcgcctccgctgctcgagctccccacggaccatcctcgccccaaggtgcagtcgaaccgaggcggcgaggtccgcttcgaagtgggcccccagctcaccgccgccctgaaggcacagagccacacggcccgcaccacgcccttcgtggggatgctgagcgcgttcttcgtgctcctgcaccgcctcacggggcgtgaggacctggtcctgggcgcgaactccatcaaccggacgcgtacggagctggagccgttggtgggcttcttcgtggacaacctggtgatgcgggtggacctcggtggcggcccggggttcgccacggtgctggagcgcgtgcgtgagacggtgctcgatgccttcgctcaccaggacctgcccttcgacctgctcgtggaggagctgaggcccgcgcgcagcctgggcttcaacccgctgttccaggtcgtgttcgcctgggtccgcgcttccggcgaggcccaggacgagacgggcctccgcatgcggccgctcgagttcgaggcggaatcatcgcgcttcgacctcaacctcttcgtggatgaccacggcgaccggctgtcggcgcggatggtgttcaaccgcgacctcttcgagcagggcaccatccagcactacgtggactgcttccaggtgctgctcgaagggctcgtggccgagccccagcggccggtgggcgagctgcccgtgctccccgcggatgtccgcgagcgcgtgctccggcagtggaacgacacggggacgccggaggcggaaggcgcgtgcctccatgcgctcatcgaggcccaggcgctgcgcacgccggatgcggtggccatcgtcgtggacgactgggagctgacctacggcgagctcgaccagctcagcgaccgggtcgcagcgtcactccaggatttggacgtgggaccggaggtggtggtcggcgtctacctggaccgttcggcggagctcatcgtgagcctgctggcggtgatgaaggcagggggcgcgttcctcgcgctcgacgcagacgagcccgtggaccggctccgccacatcgtggcggatgcccggccccgggtggtgatttcttccgcgaagctgtccgagcgcctctggggcatggggggcttcgtcacgctccacgtggacgaaggctaccgggacatgcccgccgcgccgggccagcagctccgccgcgacgtcctccccgaccacctggcctacatcctctacacgtcaggctcgacgggccggcccaagggcacggaaatcacgcaccggagcatcgtcaactacctgcgctggagcgtggacgcctaccggcttcgcgaagggacggggagcccggtgattggctccgtcagcttcgacggaacgctgacgagcctcttcgcgccgctcctggcgggccgcgcgctgttcctcgtgccacgtggtcacgaaatcgaccagttgacgtcccgggactaccccgagcagggcttcagcttcatcaagatgacgccgtcgcacctgcgggccttcaacggcctggggcgcacgcgcgaggtgctcggccgcacccatgcggtggtgctgggcggggaagggctgcacggcgtggatctggccccatggcgggagcagggcctccccacgcgcgtcatcaacgagtacggccccaccgaggccgcggtggcgtgctgcttcgagacactgctgccggatggaacacctcccccggagcgggtgcccattggccggcccatctcgcacatgcggttgtacatcctggaccggtacctccagcccgtgcccgttggcgtacccggcgagctgtacatcggcggcgtcggactggcccgaggctacctgcgccggccggacctgacggcggagcgcttcgtccccaaccccttcgacgggggcctggagggctcgcggctctaccgcacgggggaccacgcccggtacctctccgacggctcgcatcgaatacctgggccgccaggacgaccagctcaaggtgcgtggtcaccgcgtcgagacgggagaggtggaggtggtgcttgcggagcacccggccgtccacgtcgccgtggtggtgtcgcggaaggacgcttcgaatgagacgcggctcgtggcctacgtggtgccaggcgatgcgtcaggcgcggtggatgccacggcgctgcgggctttcctggcggagcgtctgccttcggccatggtgccctcgtggttcgtggtcctggagtcgctgccgctgctccccagcggaaaggtggaccgtaaggcgctgcccgcacccgacgtggacgtcagcgagcgacagtacgtcgcaccccgcaccccgacggaagagctgctgtgtggcttcttcagcagggtgctgggcgtggagcgggtgggcatccacgacggattcttcgagctggggggccactcgctcctcgcgacacagctcgtctcgcgggtgcgttcggccttccgggtggagctcgcgctgcgggagttgttcgaggcgcccacggtagcggagctggcgcgtcgcatcgatcaggcgaagcggtctggggccgagatgccgatgcttcggagcccggcggtgccacgcgcacgtgagctgcccttgtcgttcgcgcagcagcgactttggttcctggatcaactccagccaggaagtgcgttctacaacgtgtccgcggtggtgaagttgaccggcccgctggacccgatcgcactggagtggagcttcgaggaactggtgcgccgccatgagtcgctgcggacgaccttccgggccaaggatggaaccccggtgcaggtcatctcggccgagccgacgctcgccttcgctgtggtgtccctggaagcgctggatgacaccgagcgcgatgccgctgcgaagcgcttggctgaagaggaagcccagcggcccttcgacctgaagaaggggccgttgctgcgagccacgttgctacagttgcgagagcgggagcacgtgctggtgctggtgatgcaccacattgtgtcggacgaatggtccatgggcatcctcgtgcgcgaggtgtccgcgctctacgagccgctgtcccaggggcagcgctcctcgttgccggacctcccgcttcaatacggcgattacgctgtctggcagcacgagtggctggcagacgacgtgttggaggcgcagctcggatactggcgacagcagctcgctgggtcgccgagtgcgttggcgttgcccacggacaagcctcgcccggtgatgcagacgttccgcgggagcatgcaagaggcgctctggccctccgagctatgggccgcggtgaaggcgctcggacagagagagggcgcgacaccgttcatggtgctgctcgcggccttccagacggtgctgtcgcgctactcggaccaggacgacgtgagcgtgggctcgcccatcgcgggccgcacacgtgaagagacggaggggttgattggcttcttcgtcaacacgttggtgctgcggacgaaggtctcccctgtgtcgagcttccgcgagctgctcgctcaggtacgggaggtgacgctgggtgcgtatgcgcaccaggacgtgccgttcgagaagctggtggaggagcttcagcccgagcgtgacctgagtcgcagtccgctgttccaggtgacgctgacgctgcagaacacgcctttctccgaggtccaactgcgggagctgacgctgacgggcgtcgacgccgaggagaagacctcgaagttcgatttgtcgctgctcgcggaagaggtgccgcacgggctttccgtggcggtgaactacaacagcgacctgttcaaagccgcgacgatggaacggctgctggggcacctgcgggtgttcctggatgccgctgtgagcgctccagagacgcggctgctcgacctgccgttgatggggagtgaagagcgggagcgactggtgaaggaatggagcgggacggcgtcggagtacccgcgcgatgccagcctgagtgtcctcttcgagcagcaggtgcagcggacgccggacgcggtggcggtggagtacgaggaccagcgactgacgtacgcggagttgaatcgccgtgccaaccagcttgcacatcacttgagggggatgggcgttgggcccgaagtgagggtggggctgtgcgtggagcgctcgctggagttggtggtgagcctgctaggcatcctgaaggcgggaggcgtgtacgtgccgctggatgccagctacccgctggagcgactggcgtggatgaagcaagagtccggcgtcgcggtgctggtggcgcaggagaagctcgcat

SEQ ID NO: 1196 - DNA, 18324 bp, Myxococcus xanthus
ggggccccttctcgagcatcggcacgctgccggccaacctccgcgtggagctggacgctttggatgtgaggggccgccagttacaggacgcgctcaagggcgactcgcacaccctggccacgcgggccctggccctctaccgccagtgcaaggacgtggtgacgaagatgccgcccagcaccgggcgcacggagctgctgggcgtgctggagaagatgacgggcgacagcttctcactggcggaggtccacttcgggctggaggcgcagctcggctccgtggtggccaacgacgtggacgcccaggtgcgcgagctgcgagagcgcgccgccgccacgcaggacgcggtggcccgccggcagttggagctggccgcgtcctctctgggtgaagagctcaaccacctggacgtgctggcccgccgcaaggagcggctgctggcccagctccacgcgcaggtggcgctgctggagcgcgcccgggtctccttcatcggagtgcagggcaacgagctgggtgccaagggcgcgcaggccgctgacctggcgcgcaagctgaagcaactgggagagccctcctccagcggggggcccgacgacgtcgcctccgtggccgcgccgaaccccacgcgcgtcgccccctgagcgacgcgctacttcttcttccgggacgcccgagtagcgcgcttgcgccgcggtgggggcgggtggcgcaccggcggcgcgtgcagttgatccgcgatgcgctgttcaatggcctcgcgggtgctgcgggcctggaccagcgccgcctcgatttcctcacgcacgcgcgccgcctgctcctccgccgtggcccggtactctgacgccgtgcggcgcagagcgatgctgccccagtccggcccggcattccgttcaccagtgcgcactgccttgggagtcggtgtcctgcgcctgcggaccttggtcctgggtgtctgctgtccttcgtgctccgccatccgcgcctcccggaaagtcatcctggcctccaggaaagtgggctgctatcggacgcgaaggaagcccgtgcctgggccggcttctgggcaggcaggcaacacaccgcctgttcattcagcagggttgcttctcacctgctccaggaaaacgctatgggacgcccttcaagatgcggcaatttcaagggcccttggtactgacagcaccgccgtaagccccgtggccggcgggtacggcgcgcacacactcctgcttcgtctgcctccatgggaggcagcggcgccctgcgaggataccgtggcagtcagcgcacccttttcgttcctgaagaaccgcaagcacaacctggaccggatgacgctgggcgacctcatctactcgttcttcacctactacgcggtggtggcctacatcaccgtgggcatcatcagcctggtctttgccgtgaagtggttcgagaacccactgcgcatgctgctggcgatgctcgccgcgagcgtggcgttccccttcggctggtacctggtgcacaagcacatcctgcacagccgcttcctctacaaatcaccgctcaccgcggcgacgtggaagcgcatccacttcgaccaccaccaggacccgcacgacctgcgcgtgctcttcggcgcgctggccaacgtgctccccaccgtgggcggcgtgattgcccccattggctatctcattggcggcaaggcgggcgccgccgccgcgctgggctgggccatggtgattacgtgcttttatgagttctgccactgcatccagcacctgaactacacgcccaagtcccagttcctgaaggacatcaagcggctgcacctgtcgcaccacttccacaacgagcagggcaactacggcatcaccaactacttctgggaccgcctcttcgggaccttctacgagaagtcgggtgacaagcccaagagccccaccgtcttcaacctgggctacacggccgaggaggcccagcggtatccctgggtggaccggctctccggcggcacccgcggtgacggccacccgcgccgattctgggagaaccaggccgacgccaagacgccgccggagcccgcgacgcgacaggaaagctgacggccaggcacccgcctgaatccccaagccccctccctcacccagaggcagggggcttttgacggaccgcatctacgaagagcttcgttgacatctacgaatccgttcgtaatatggatccaggcaatcgagtcacggaaggaagcatcatgagtgagacgaagctgccgcgtcccacggatggagagctggccatcctgcgggtcctctgggcgcgtggcgacagcacggtgcgcgaggtgcacgaagccctcacccgcgacgagcccgagggcaccgggtacacgacggtgctaaagctgatgcaaatcatgacggagaaggggttggtggagcgtgacgagtcccagcgcgcgcacgtgtaccggccccgggccacggagcagcgcacccagcggcagttggtgacggacctggtggaccgcgccttcggtggctctccggcgcggctggcgatgcaggccttgtcgtcgaagaagacgcgtcccgaggaactggcggagctgcgccggctgctcgacaccctggaaggaggcgaggaatgagtcggctgctgatggagtccctggggtgggcgctgctgcactcgctctggcagggcacgctggtggcgctgacgctggcggtggcactcatcacggtggggcggcgcgcggcgcatgcgcgttacgcgctggcctgtggggcgctggtgctggcgctcgcgttgccggtggcctccgggtggaagcacttccacggcgcgcccgcgcgagtggcgatggacacctccgtgccgcgcgcgcagtccctgacctctgcgctgggaacgcggggcctggaggagacggtgacgcaggcggcgcggcccgcctggagagtggcgcccgtcgcggcgtcgcccgcatggattgacgcggacatggccgaggacggcgccgcgaacggcttcgagagcacgctgctgacgggcctcggctctttcctggtcatggccggcctgctactgcaacgcgcgctgtcccaggtggaagcacacctgcactggctggtgctggcgtgggtggcgggcgtgggcctgtgctcggggcggatggcggcggagtggatgaagctgcgccggctggcggaccgggccctgcccgcgcccgcggcgtggcaggagcggctggacgccctgtcgcgacgcctgggcctgcgccgcgcggtgcggctgctccagtcctccgacgtggacgtgcccgccgcggtgggctggctgtcgcccgtggtgctcctgcccgtgtccacccttgcgggccttcctgcccggcagttggagatggtgctggcccatgagctggcccacatccgccgtcatgacttcgcggtgaacctggcgcaggtgctggtggagacgctgctcttcttccacccggcggtccgctggatttcccacgtcatccgcgtcgaacgggagcactgctgcgacgacgtcgcggtggccgccagcggcaactccgtctcctacgcccgggcgctgacggcgctcgagacgctccgcgtgctgccgggagcgccaagccccgccatgtccgcgctgggcggctcgttgccggagcgcgtccggcggctcatcaccctgcccacgtcgcgctgcgcctcacgctgggcggcgggcgcctccgtgctcaccctggtcagcagcctggccgtggccgcgccgctgacgtcgctcctgctggggcagacggacgccgcgccgcagccaggcgacgagcccgtcctcatccagcctccgcccatcccggcgctctcgctcgccccgccggtgccgcccgcgcccacacccgtgccaccgccagcgcccccggcgcctcccgctcctccggccagtgtcgcggccgtggcggtccagtcagccccgggccccaccccgccacctgcgcctccggcgcggagcctgggttcgcgcgcccagcgtgagtcggaccagcagacgcgggtcggcgcggggcagcagctctccgtggcgcagctcatcgcgctcaagaacgcgggcatcaccccggagcgcgtgcagcaactgacggccatgggctacacgccgaccgtctccaacctcgtgaggatgagccacgccggcatcacccccgactacatccaggacatgaacacgcgcttcggccggaagctggaagcgaaggaactgacgcgcctgcggaacctgggcgtcacgcccgagtatgtccagtccctcaagtccgcgggcttcaacgtcgatgacccgaaggccctgtcccacgcgcgcgccgtgggcgtggacgaggacttcgtccgtggcatcaaggatgctgggtacgccggcatgtcgctggaggagctcgcccacctgcgcgccgtgggcgtgagccccgagtacatccgggagatgaacaagcacggcctgtcgaagctgaaggcccgggagctgatgcagcttcgcgccgtgggcgtggacccgggctggctcgccagcatccgcaaggcgggcgtgcagacgatggatacgaaggtgctccagcggctgcgcgccacgggcgtggacgcccacttcctgggtgagctccacgacgcaggcctgaaggacctctccgtcgacgaactggtgcggctgcgcaccggcggcgtggacgcggacttcatccggaagatgcgcggcaccggctcgaagtaagccgtccgtcccgcgccccatcacccaacacgtctcgattgccccaccccgctcggcgcacgtcccatccgacgcgcgccgcacgggaggggtctacccgaaggagcccaccatgcgtctcacgtcgtcacgcctgtccctcgtggccctgttgttgatggccacctccgccgtcgcggcctcttccaccttcgagcctcgcggcacctggtcggcctcgcccaagagcagcgacccatctaccctgaacctccagctccgccagggcccgcaccgcaacatgggcttcacggaacccctggcgtccttccagggactgtccaccacgggcggcgccaccaccttcaccctgccgcgcgaggccggtaccttccacttcgaaggccagttccaggacagccagggagcgggccacttccgcttcgatgccagcagcgacttcctcaagaagctggccacgctgggctactcggacatcacgcccgaggtgcagttccagttggcggcgaccaacgtcacgaccgcccgcatccaggggctggccgcgctgggctacaagcagctcagcacggaggaactcatccaggcgggcatcttcgacgtgacacccgagtacgtgcgcggcctgtccgacgcgggctaccccgggctgtcgttcaaggaactggtcgagagccgcatccaccgcgtcacgccccagcgcgtgaaggagttctccggcgtcggcttcgcgaagctgccctggaatcaactgacggccatgagcatccacggcgtcacgcccgacttcgtgaagcagatgcgcgagctgggcttccagggcacggacgcggatgacgtcatcgccttccgcatccaccgcgtcacgcccgacttcgtgaagcagatgcgcgagctgggcttcaaggacctcacccaggaccagattctggccttccgcatccacggcgtcacgcccgacttcgtgaagcagatgcgcgaggcgggctaccccaacgtcactccggacgagctggtgaccctgcgcatccacggcatcgaccgcatcttcattcgcgacatgtcggggacggcgccgaagaagaagtgacgccgggcgcggtcaacgtccgccggtgaacggccggccccgctaccgggatgcacggagcgccacccggccacatcttccccgcgggacggtggtggtggggagggtcggaatgtcgctgcttcgaaccgcttgtgccgggatgctcttcctggctgcgtgtgcatcaaccaacaagtccgcggcgcctgagccccgcgccacggcgccgcgagtcgagggggtggagtacggcttccacccccaggacccggtccgcgtcggctggggtgaccgggggatgatggccttcctggagctgctgcgaggcccccagggccagcgcatcgcctggcgccgcgtgggcccctgctgcggcaccggcgcgcccaccgagctggaggtcttcgaggtgacgtacgacgggctcgccgctccggtgagcctctacctggacccgaacaccgcgggcgccgtgcacgcgcccaacggcttcaacctccaggggctcgcctcccgctcgcaggtggagcaggaggagacgccccgggtcatcgagctgtagtccgcggctcactccagcgacggcgccgtgtcgcccggcaggaacacctcccgcgcgagcgacaccggcagcccgatttggaggagccggtcgtgaaagtccttcagcaccagcgtcttcccgcgcgactccaggtggcggcggtagtcgtcgcgcagcttgaaaatctgcatgcgccccacggcgtaatacaggtacgtggggtcgagcgtgccgcgctccacctcgcgcagtgcggggaagggctcgaagtacgcaatctccgcgtaccgcttcgctaccgcctccacgggctctccgtacacatgcagcgccagcgccgcataccagcgcgcgtgccgctggagcgcgcggcggagctgtcccagccgcacggccgggtcaccattgcccaggccctcatccaccatcatctgctcggagtagtgcgcccagccctccaccagtgacgcgggggtgaagaccttacgcacgtccgtgggaatccgcgcgccgtagagcaactgcacgaagtggccgggcatggcctcgtggacggtgatgcccagcaggcccgcgcggttgaagtacgtcaggtgctgggctttctgctcgggcgtccagccgggctccacgttggtgatgttgtagaaggcctcggtggccttcgtctcgaaggggccgggggtgtccatggacgcgaagcccagccgcgcatagggcggcgtctcccgcaccacgggcagccggtccgacggtagcgtgaggatgttccgctcgcgcacgaagcgctgcagctccaccaactgcgcccgcgccgacgccaccagctcctccgccttcgggtggtccttcaccagctccgccatcacctgctcgggcgtcttggtggcgtccaaccgggcggcctcgcgcgccacccaggccttgtagtcgcgaatggcgcgctcgttgatgtcgcgcagcgcgtccgcgtccagcgtgacgtgctcctccagcgccagcttcttctcgaagcgctcgcggcccaggcggaagtcgccgtccgccttgggcagcagctcacgctccagccacaccgcgaaggcctccatctgccgcgcggcctcctcacgcgcggcggagaaggcggcgcgctcgctcaacggcacctgggcatacccctgcgccgccagggcccggggcaggtccgtgcgcaggtacgccgcggtgccgcgcgcgtcgcgcagcgcgtactccgcccacagctttggcacgccgctcaggttgaactgcgccgcgtcgagcacgccagggatgcgcgccatccgggagcgcatggcgcgcatgcgctcggccacgggggcgaactcgcgtgacgacaggccgtccaatccgctggagatgatgcccacgtagaagcccgggtcgcgctcccaggggcgcacctcctccagctccagcaggtcggcgcgcatcgcgttctccagcacgcgcacgtccacggcagcgtctcccgacaggccaccgcgcgccaccacctgctccaggcgcgtcagccaaccgcgcagcgcctccgccttgcgcttcagcgcgcccgaagagacgtccggcaggtgggcgtcatgcatgtgatagccgagccgcgtggcccgggtgggatgcgccgccgcataccaatccaggtactcgcgcgcgaggacgacatagtcggcatccgcggcggagactgaagcggtgggcatggccgtggaagactccggcccagcccccgagcgcgaagcgcaagcggagacacaggccaacaggacgaatgcggagcgaatgcgcatggcgcgtcgagtctcgtaatgggacggcggttcgaaaagcgggaagcgcactctggatgcttcttcgtcgaacagcgctcgcccgggttgtcggctgaaggtccccggtctcgtacgccgaggcgcccgcggagggcgactgtcacgcaatgacagccctggaccgactcgcggacggcttgggtttcgtcacatcccggccagattgcgcgaccgcggcaccccaccgcagccagccaccgcaacaaggagtgagtatgcgtcttcgcgcacaaagccttcctttgctgttgtccgccgtttcaggcatcgccaccctcggatgcggcatcgaagcaccctacccggttcgcctggagcacggggaggtggaagccgccgccagccgtgaagacaccgcgcgcctgggtgcggcctccggctgggacctgtgcgacacgacggcccggctcgtgcgggacatcatcccgggcgcggggcactcccatccgcaggacctcacccacggcaacgaggtcctcctcttctccgccacggatggcgtggggggccgtgagccctggctgagttcgggcgtggctccgggtacgcatccgctactggacgtgtactcaggaggcccgggctcggacgcgggccccttcctccagtgcgggacgacgacgtacttcgcggcgaatgatggagtgcatggccgcgaactctggaagacggatggcagcaccgaaggcacggagctggtgaaggacatctcgccgggagggctgggctcggacccggagcacctgaccttctacgacggcgtgctgtacttcacggcgaatgatggtgtgcatggccgcgagctgtggcgcagcgacggcacggaggagggaaccttcctcttgcgtgacttcagcacggagggaaacctggtctccagccacttcgagctggtggcggggacgaacgccctctacatcaaggtgaacatcttctcaccgaccgaccgccagtcgagccgggtgcaactgtaccggaccgatggcgccagcttcgtgcggctggtggatgggtcggaagaaaacatgctgggcgacctgacgccggtgggggacaagctgttcttcacctggaacttcgatgcgccgcagacgcggctctacgtcaccaacggcacgtcgagctgggcgcgttacgtatacacgttcatcggcgcccccctggggatggtcgcttacaagaacaagctcttcctgagcgcggcgactggagccgggggggtggacttcgagctgtggcgcagcgacggaacgacatccggcacgatgcgggtgaaggacatctacccaggcagggtgccgtcgcagccgacgaacctcacggtggtgaaggaccggctcttcttcgtcgcggatgacggggtgcacggccgcgagctgtggagcagcgacgggacgagcgcggggacgcggctgcacgccgacatcgccgtgggcgctctgggctcggagcccgcggagctgacggccgtggaggagtacctcttcttcagcgcccacacggaggccggaggccgggaggcgtgggtgagcgacacccgcgagccgggggtgttcgaggtgcagggcatcgcgccggggtccatgcactcggacccgagcaacttcgttcgctcggggtgggacctctacttcgtcgccagcgacagcaccgactacggccgcgaactgcgcgcgctgcgcatccggccggcgggcatgtgtgacatgagcggcaacgacgggctctgagcggcaggcgccaggtcccttcttcaaatccaggcccgctccgagaaagccacggcactggacattgcccccggcggcccactacgtgcgccgggcatgagcatgaactgtccgcaccggtccgcctggacggagcgcacctccggctggcggcgatgggaccgggaaacgggcaggattgccggtggggcagtgctggcgctggcactgagctgctccagcaatctgcggcactctcaggagaccgagtcctacgggttcatgagcatcgactctggctatgtctgggccaggggtccgtggcccgaagtccaggcttcgagcgacccggacgaggtcatcgaccagctctgtccggccatcatgcgtctggacagggccaccgccagggacttcggacaggagtactgcggcgtcatctactcgcggggggatggcatctaccgcaccacgcatccctcaccgctgggagagcctcagttgcgcggtgagacgaagcagaagtcctgcttcccggtccgccgcgtcgtcgacccagaggcccgggtcacaccgattctcgcagacttccacagccacccctggttcccctcgccgctgtcccaacaggacaagatggcggccaaccagctctacttcttgaagatccagtttgattcggcctgccagatccagaagatcatcccctacctggacaggcccgatgcgcccggcgaggtctactcccggcgagggaaacgctgggtcctcattggaatcatcaagccgagcaacaaggccgcaggcatcgtgacccccgttggcgggctggactgagcaggagacttcatgacccggtggctgccgttcctcgtcctggcacttcccgcatgcgcgctcttccagcgcccgccacgccctgtccacgcgccaccggaagaagctgctcgtttcgaatttccccccacgggcattcccgaagaagggctgcgcagcattccaggagacatggcgcgagccatccagctcgccatggaggacttctatccctgggacaagaaggcgccgaccccgtctcaccccggcagggagtgcctgtaccggcgcgagtcgtacgacgtctacgcggccccctaccaggagggcgtcgtcctggtcggcatcgtcctgtcgccccaggcctgcggcgcccaggcggtccccaacgacatgggcgcgctctatgccgtcgacacgcgaggttggcgcatcctcgccgtgcaacactaaacgcctgcccgccctcggcgcagccggccccaggggcaaccgggacggcgttggcccccttcccttcctggcgccgggtgcccacatcggagaactgtcgagtggcagggggcaccaggagccggctggtgtccccttttttcgtgctcccagagcggccgtccgtccttcgaattgtacgcctccgtgcatttctccccgcctccagcgtcgttttgggcagaactgtcatgctgctgtcccgctgcgggctggcgcgtctgacgcgtgcggacgagcctgggctgggctaagcgtctgcctgcccgtcgggtaccagacaggccggcgcctgcggcccgctcgctggaagaggtctcaagcgacgtccgacaccgcggagaagaagaagcgccgctggccctatgtccttggaggagtcttcgcgctcctcgtcatcatcgtggccgaggcgctctggcgactggacgccatcctgctgaagacggctcgagaccaggcggccacctattcccagttcttgggacgtcccatcgaaatcggggacatctccaccaagctcttccccaccattggcgcccaggtggagaacgtcaccgtcggccccgccgaaggggaagacctgccgctggcccaactggccctgattgacgtccgcgtcgccgcgggcccgctcctgtcctccagcggcaaggacatccaggtgaagaacgccgaggtctccggcctcaccgtcaacctggtccgcttcgccgacggcaccaccaacgtgcagcgcctgctccagcggctggaagaacagcagcccaaggaagaggaggctcccgctgaagagtcccagcccatggacctctccggtgtccacgtggagcgcgcggccctcaccgacggcgccatccgcttcgtggaccgcggcgccggagaacaggcccgcgagctgggcgtgaaggacctggacatcgaggtgaaggacctccgcgtgggcaagccgctggtggtgaacctggccgccgccgtgctcgcggacacccagaacctccaggtgtccctccacgccgcgccgctgccggccacgctggtccccacgcccgagcgcgtgacgctgaaggcgcagaaaatcgacctcgccccgctgggccccttcctgccgccggacatcggcctgcgtgcgggcacgctggacgcggactggcaggcggacctgggcggcgccgttcccggcggccagggccccacgaagctggtgggcatcatcaaggccctgggcctgagcttcaccggctccgagggcggcaaggcgctggacgtcgtcatggacaccgacgtcgcgggcgacatcaacaccggtgacctggcgctcaacaagctgaaggtggacctgggccccgcgagcctcaccggcaagggcagcgtgaagggcctgctcacggacaagcccgcggtggagggcttcgagctgacgggccgcaacctggacccggccgtgctcgccgagtactacccgccgctgcgcaagcagctcaacgggatgattgccggtcccatcggcctggacgtgcgcggcagcggcacgcaggacgcccaggccatcgacgtcaacgtggacctgacgcccgtgcggctgcgcgttccggcccagctcaccaaggacgcgggcggcgcgatgaagctctccgcgcgggtctccggcgcggcggccacgggcggcgccctgcgcttcgacgcgaaggcggacctgggcggcatcgacctgcggcccggcctgctggtggacaaggccccgggccagcggatggacctgagcgccgcgggcacctacgcgcccggcaagggctccggcatgaaggtggacatccccaagctcaccgcgaacgtgctcgaggacacgatgacgggcagcgcgtccttcgcgctcgcgggtacggggaagaagcagacgacgacgttctccgcggacctcaagagccagaagctggacgcggacgcgctgatgatgagcgaggaggaagtccaggcgcgcggcggaccgccgccggaggagccgccgtcggatgacccgacgcgcttcaacggctaccggggcgacatccgcttcgcggtgggcacgctgcgctacatggagatgaacatgacccaggtgacgggcgtggtgaagatgaccgacgacctcatcaccgtggagaagttctccacgggcgtctacggcggacgcatcgtcgcggacggcaccacgatgcgcctgggcccgctgccggagcagcgccccttcgaggcgaaggtgaaggtggagggcgtcgcggtggagcaggcgctgacgcaattcacgccgcagaaggccgtgacgggcaagttcaacggcaacgtggacgtgaagggtgtgggctacacgcccgaccagctcaagcagacgctgctcggcggcatcaacggcgacctgctggatggcgaactgctgggcaaggacctggtggcctcggtgtccgagccgctcgccaaggcgctgcccatcgcggccaagggcctgaagaacgagcaagtgacgaagctgggcggtgacctgcccttcagcgttcaaatcaaggacggcgtggcccagctctccaagccgctgacgtgggcgcggccggaggcggagctgagcttcgacggcggcatccggctggatggctcgctggacctgacgggctccgtgtcgctgacgccgtccacggtgaagacgctgacgctgggcaaggtgacgccgccggccgccatccccgtgggcctgaagctgacaggccccgcgtggaagccggaggtcaccagcctggacgtgaagcctgcggtggcgcaaatcgcgaagctggcggcctcgtcgctggcgggcaacctgattggcggcgagcgcggccagcaggtccagagcatcatcgaaggcggcgaggacaagcttcgcgccgaagccgaagccaagcgcaaggagctggaggccaaggccgccgaggagaaggcgcgcctggaggccgaggccaagaagcgcgccgaggaagaagcgaagaagcgcctgcgcggcctcttcgggaagtagggcccgcggcccgcgctccctgaaacacgctgaaacagtcgggaaacaacgtgttcacctcgtcacccgaggcctgccctcggggacgagtgtggcatgcgccctgctagggcttcctgcccgtttcacgcgtcacaagggagcgcgcgacatgcagacgagcgaggacttcgaccgcggggattcggtgacgccgtccagccccgtggtggtgccggtacgcgaacaccatcgcgtgctcatcatcggaggtggcaccgccggaatcacggtggccgcccggctggcgcgcgccgggcagaagggcgtcgccgtactcgagccttcccagcaccactactaccaacccctgtggacgctggtgggcgccggggaggcgcgcgtcgaggacaccgtgcgcaacgagtcccgcctcatcccgcacggcgtgaagtgggtgcgcgacgccgccacggagatagacccggaggcgagggaggtcctcacccgcggtggcctccgcctgggctacgacttcctcgtcgtcgcccctggcatccagctcgactgggacaaggtcgcgggcctgcgcgaggcgctgaagacgccgcatgtcagcagcaactacgacgtccagctcgcgcccaagacgtggcgcctgctccagaacttccagggtggcaccgcgctcttcacccagccctccacgcccgtgaagtgcgccggggccccgcagaaaatcatgtacctggccgcggaccacttccgccgcaccggcgtgatggagcgcaccagcgtcgtcttcggctccggagccaagaccatcttcggcgtgaagcccttcgcttccgtgctggatggcgtggtgcaccgctacggcatcacgccccgcttccagcacaacctcatcgcagtggacggcgagcggcgcgaggccaccttcgaggccacgcgcgacgggcagacggagcgcatcaccctggcctacgacatgatgcacgtcaccccgccgcagagcgcgccggacttcatcaagcgcagcccgctgtcctggcgggagggtccgaacgccggctgggtgaaggcggacaagtacacgctccagcacccggaccatccgaacgtcttcgcgctcggtgatgcgtcggacctgcccaccagccgaacgggcgccgccatccgcaagcaggcgccggtgctggtggagaacctcctggcctacatgaaggacctgcccctgcccgcgcggtatgacggctacgcgtcctgccctctcaccaccggctacgggcgcctgctgctcgccgagttcgactacgacggcaagcccgcgcccaccatccccttcatcgacaccatgcaggagcggcgcgacatgtggctgctgaagaagtacggcctgccacgcctctactgggcattcatgatgcggggccttgcgtaagacgccgggagccgggctatgcaccggcgatgcccacctcccacctcgcgctccccgctctggatgccctcgcgggccccgtgctcctcgtggacgacgcgcggaaggtgaccgcgctcacgcccgcgctcgaagccctgctgggcggcacgctgcgcgctgggacaccgctggcgcaggtcctggggcgcgctgacggcacggagccgctggacgccgtcctgaagaacgggtgtgaggcctctgtccgcttgcgcgtgggtgggcgctcgaagcccgtgcgggtgcgcgccgtccccctggcgcgagggcctcgggcatccgggtgggccctgctcgtctcgcctgacgcggtggaagagacgaacggtcgcgcggagctgttccacggcctgtggacccaggcgcccgagttgcagcgcgtcttccgcatcgtcgagaaggtggcccgcaccgagtccagcgtgctcgttcgcggggagtcgggcaccggcaaggagcacatcgctcacgcgctgcatgcgctgtcggcacgggcgcgagggccgtttcgcgccatcaactgcgcggcgctgccgcccaacctgctggagagcgagctgttcggccatgtgcgcggcgccttcacgggcgcggtgcgcgacagcccaggacatttccggctcgcggacaagggctcgctgttcctggacgaggtggcggagatgcccctggacctccaggcgaagatgctgcgcgtgctggagacgcgcaccgtcatccccgtgggaggccgccagcccgtgcccgtggacgtgcgcatcatcgccgccacgcaccggccgcttcggcgcgaagtggagacggggcgcttccgcgcggacttgatgtaccgcctgcgcgtggtgccgctcttcctccccacgctgcgggagcgacgaggcgacatcctcccactggccctgcggttcctggaggaactgcaccagcgaggcgcccgccgcgtggagcgcttctctcctggcgcccgccgcttgctggaggagcacccctggcccggcaacgtgcgcgaactgcgcaacgtgatggagtacgcctacgtcattggcgaaggcccggtggttcgagaggcggacctgccaccggagttctccgagcagcggcaggccgctcccgcgaagctgccgcctccggatgcctcgctggagccggaacggatccgcgccgcgctcgcccaggcgggcggcaaccgctccgaggccgcgcgcctgctcggcgtcagccgcgtgacgctgtggcggcgcctgcgcgacctgggtgcgacggcggagcgctgagcgacgggcggacgtcggccacgaaacaccacgagcatggccctcaaacgacgtttcacgcctgtttcaggtgcgtttcacgcctgcgcgcttgaagcatgccgtcttgcccgcaaggtccgttcccgcggtgccggcaacccgtgtcccctcgacccgagtcccgccacctccatcaccccgcctgttggcacgtcactggcaatgacggcctcgcacccgattccgacggaggcgaacgatgctcttccgccagctcttcgacgcggacacctcgacgtatacgtacctcctggccgacgaggccacgggcgccgccgcgctcatcgacccggtgctggaacagacggagcgcgacctgaagctcctccgggagctgggcctcacgttgtccgtggtgctggagacgcacgtccacgccgaccacgtcaccggcgcgggtgtactccgcgagcggacaggcgccaccgtggtggcctccagccgcggcgcgccctgcgtggaccggacggtgaaccatggagacatcgtgcgcgtgggcggcctcgaagtccgtgtcctcgagacgcccggccacaccgacgacagcctgagcttcctctgtgagcgccgcctcttcaccggggacgcgctgctcatccgcggcaccggaaggacggacttccagaacggcgacccgggccaactctacgacgccatcacccgcgtcctcttcacccttcccgacgacacggcggtctaccccggccacgactacgccgggcacgccatgtccacggtgggcgaggagaagcagcacaacccccggctggctggacgcacgcgcgcggacttcatcgtcttgatgaacgcgctccagctcccacctccccggaagctggacgtggccgtccccgccaaccgggcctgcggacacacgccgccctcaccttccctccaggcctgaagtcacgcggagcccccatgcatcctctctgcgacaacgccgcgccccatcccgcgggctaccgcgacgtggaggtgggacagctcgcggcgttcctgccctccgagctcacgctggtcgacgtgcgtgaggccgccgagctcgacggtatctgggccacgtcgcgggcataaggcacgtccccctggccacggtaccgtaagttgtcaaagcatgaccgcgtgacacgcacgtggtgatgatctgccgctccggggcgcgctcgacgagggcgaccacaagcctggtcgccatggacttcacccgagtgatgaacctgcgaggcgggatgctcgcgtggaacaccgcgcggctgccg

SEQ ID NO: 1197 - DNA, 20232 bp, Myxococcus xanthus
  unsure (1)..(20232): unsure at all n locations
ctgctgtttgggcgtcgacaagcctccgcgctgtagtaccaacaattggtgccgtaagaagtttgtacgcagaagggcgcccccctccgcgcagcccgatagtccacctcatcagggttgatgacacagagcccgttgctacgctcggcggcatcttcacaggaactacggctgtggtaccagcaattgcggccgtagctcgtttggacacaaaacggtgctcccagcgctggaacggacaacaagaccgcgacacaaatcagaaatctcactaacgccccctcagtcacactgcgagactcattaaaccacacaacaaatccgaagcgccaccggggcaactccgacaccacggagggtcaaatcagacccaattcaatgacaccttgagcgcctccattgaaaatccgttcgcactaacataggcgaactcgtggagtgcgcacacccaggctgactgccagatctcacagaatgggaaaacgaaagaagggcaattgcatcttttgcttgtcgcgcccagcaacagagaaagagcatgtctttcccaggagttggtatccatctactacgccaccctcggtccagtacgtgacggcaccggtctgtgacgtctgcgcggacgagttcgagattgccgagcgaaaattcagcttccccgtcctcatgggaatggaccctagcaatcccgacgtggctagcgtcatggatggtctgcgccgttcgtggcagtttgataaggccccttcaatccgggagtccgtatatagggcagcaaaactaaaaagcatcgcgcgacaaattaagtatgtcgttcggccgcccaatacccccgctccatggcggctcgaagtgcccgtgcgcacgcccgcagggttgcttgtaaaggcgtcgccagcacttgagctcgaccacgaagtagctgttaagatttgcgagaagttcgttcgaggtcttcactacaatgaaacgaaagtgccccttccgatagacacaccgatcctgtttcagtggctcaagagactggccttcgacgtacgggcaagcattgaacaactcccgttgaacaacctccttgccccgggcttgcggtatcgcgtgcgtcgcgaggacaactgctcgttttgggtgttttatctttgggggcaagtggagttcgtagcatttgccggaacaccaacgcccgattcgaacaagggactgaccggaggaagtaccgagtaaaaagggtgcctctccgagccactcccagaatccgcacacatttacgtggggtcagcgcacttcgccgctgacgtaacccgagccgaagggcccacgtaacatgaacaacgcactgacgaagattgccaccgcgcaggctgcggctggcggacgctacccgcgcttcggtcgctacctgctcgaagtcgaggtcatccgcacgaaggagggcttcaagggcgactcggccatcgccgagctgaaggttcgcgagtccgagcccctcgcgggtggcgagactccgagccgaccgggcgagacggtcgactacgtcgagaacctgagcgaccagaagaaggggggcggcggacgcttcaagtccttcctgatgacgctcgtgggggccgacgaatacgagttcgccaacccggccgcgctgaagaagttcttcgacgagcggcaggcggggacgcacctcctgattcgctgcgaggtcttcccgaagcagctcccggtgaaggagggccacgccgggaaggtcatcagcggctatcgctggtcgcacgtcgagatgaacgacgagcagctcgcccaggccgagcacgcgcgcaaggcgagcaagctccccgcgctcaccgacgccctcgcctgaaaccgggcggcgactgacggcgcgcttccgtcggcggctggcccacgacacgggccgctttcccactcccaaaggcagccttcatgaatgtctggtccttcgacacggaaacgtggctgattcagcccggcttgctcgcgcctcctctcgtgtgcggcagcatcgcggcggcagctccaggcagtgaacgactgctggacaaggcccaagcccggcagttcttccgcgaggccatcgccgcgtctgacacgcgcctcgttggcgcaaacctcgcttacgacctgggcgtcatggcggcggatgacccgagccttgtggcgcccatcttcgcggcgctcgaagcaggccgactgcattgtgtccagattcgagaagccctcatcgacatcgcgaggggactctacggcgtggacccgtcgacgggccggaagctcgacgatgacgaaggcgcccgctacccgctcgcgcttctcgtgcagcgctaccttgggctcgacatcagcgaggacaaaaagaacccgaaggcatggcgcctgcgctacgcggaactcgacggcgttcctgtcgagcgctggccgacggaagccgctgcgtacccgaagcgagatgcccgctacacgctcgacgtcttcttccggcaggaagccgtagcacgggagacgcccaacggcggcaacctgcatgccgaagccgagcagatgcgcgccgccttcgcgctccacctcgcttccatctggggacttcgaacgaacggtgactcggtcgccgtgctgcgggagcgggtggaacgggagtggggagagaaccgggccaagttccaggcggcaggcatctaccgagccgacggcaccaaagactcgaagcgcctcgctgcgctcgtgactgccgcctatgacggacagccgcccattaccgcgcccagcgaccgattccccgacggccaggtcgcgaccgaccgtgacacgctgctcggttcgggcgacgcgctgctcgaagacttgggcaagagcgggcgcgtcgacaagtacaagtcgacttacctggacgtcgtcgaagcgggcacctcgctccccatcaatccgcgcttcaacgtgctcgttagcaccacgcgcgtttcgagcgactaccagcagctcccgcagaagggcggcatccgggaggtccacgaggcccgtcccggcttcgcctactgctcggtcgactacggagggcttgagcttcgcaccatggctcagcgggccatctgggaactcggctactcgaagatggccgaagcgctgaacagtgggctcgacgtccacacccttgccgcggccgaattcctcggggcgagctacgacgagctgcttccgaaggtgaaggcgaaagaccccctcgcggtcgccttccgtcagctcgcgaagattctcaacttcggcaagggcggcgggatgacgggcggctcgctcgtctacaacgcacgcgcgaaggaccgggtttccttctgcctgctggcgaagcgcgcagacgtctgcggcatcgagcgcatcgtcatcaccgtgcagcgcaagccgaagatggtctgccgggcctgcgtcgaagtggccaaggaactggacacgaagtggctcaacgcgtggcctgagcagcgcgagcttcagcagcgagcgaagtcgagcacctacgggggcgggttcgccgatgtgatgattccgggcgcgaacatcctgcgcggcgggtgcggctacacgcagattctcaacacgcccttccaggggctcggcgctgtcgggtgcaagctcgccatgtggcgcgtcagccgcgagatgtacgtcgaccgtcgctcgccgctctacggctcgcgactcgtcctcatggtgcatgacgagctgatcagcgagctgcccgccaatagcgcccagcggatgcacgacgcagccgagcgcaaggcgtacctgatgcgcgaggcgatgaaggagacgactcccgacctggcaccggcaatcgaagccgagcccgcgttgtcccgcatcatgtcgaaggacgtcgccaccgtgcgcgacagctccgggcggctgctcgtctgggagccaccaacaaagcgcgctgcctgaaccacggccgaaatccgcacccatttagggagcacacgcactccctaacaggtgcaacgcatggccaagacaaccgacgcgctcgaacagctcccgcccgccctctgcccgtatctcgacgcggacctcgacgacgcggtcgccttcgatgtcgccgacttccacgagctgagcttgctgcccacgctgggaggtgaagcgacctctcgtcatctcctggtggcggccccctgatgccgacgactcggaacctactggtggcgcttgaccccgggcttcgcgagtgcggcgtcgcggtcttcgacctggactcgggcgagctgctcgcggcgggcatgcctacgaatcccgagcggaaggcccgtgggctcgcgacatggtcgcgcatggcgggaggggtcgccgagttcgtctcgacgttcctggagcctctcagggccgctggcgtggctgtttccgtcaccgtcgcgtgcgagtgcccccaggtctacacggccgggaagagcaagggcgacccgaacgacctgattgaactcgcgggagtcgtcggccgggttgccggtgagcttcgcgcgacgagtgagcgcagcttcctgccgcgcgagtggaagggaacgctcgacggcgacgtcatggtcgagcgcatcaaagcgcgcctcggcgagcgaccgcacgaacacctacgggtgcagctcccgcgagcccaggacaagcaccacaacgtttgggatgccgtcggcatcggccttcacgtcgtcggccgactcgcgccccggaaagtcttcccgaggtagccatgccccagcaccctaccggtcccgggctcgatggccccgtcgtaacgattgaacgtgccgccgagctgcttctctgcaagaggactcgcgtgttcgaactccttgccgaagggcgcctgaagcgggcacccaagctcggcaagaaggcgacggtgcggctcgattcggtcctctcatgccttgacgtcgacaaagagagagagacagctcctcatcgaaagcggcaaacgccaacgcggcgaactcagtcgattgaagccgcttttcgcgaagtaatacggtctgtcgaggggtcttcttgatgaacgagttgaagagggagtcgaatcattgggggaacctcttccgtcaaatagaacttcttcgtcgtcttgacgctcgtgtgccccataacggccgagacctcttcgatggggagccctttgcccgtcggccgcacaagctctccgtacttgcgagcccacgtcgaaaagctatgccttaactggctcggatgaaggggaacgatcttcttccgctgctcctcgtctacacacgtcagcttaagtcgctccgcgatgcggcgaagagactggacgataccagagtcttccaggcccttcccgaatgcctgaagcctctccaccgcagcgaacgcttgagcatccagactgatcgtatgcgtcatgtccgccttgagctgccgaaaagtaatggtccccttgattccacaggggtcgctcacgtcctttagaatcgcatccccgcgcgccactcggtcaatctcggttccatgcatccccgtcttggcacgtagacacaacgtgtctctaaggcgttgactgtttgcttcagcataagcctgctctaccgcagccatgctgtaccccttttggcgaatgctcttttcagcctttgaagggggaaccttcagctcagccgtggggtcctcggcaagccgaagcatatccctctctcggagccaagccgtaaaagcctttaatgcgataatccggggggtccgtgcagttggccatttgtccaacattacgtgcaactcagtgagagacacgtctcgcagtggccttttctcaagtgccactccccaggcggtcaaatagggggcaaggatgtagcgacggtaacggtccgtcaggccctccgccttcacgttcctgagaaacgcctcgaaggtctcttcgtccagcgcaacgcccttcttttctgcttgggcgacggacgccgcagcctctgctgcaacctgcttcttggtcttgtaggcccccgggtcgcgctcgaaaagaaccagctcggcacgagcgtcgcgctcgctggcgacgtccagagtgatggcccgaacgataccgttgaccctccgctcgatgacccacacggaccgccctcgggtcagtcgaactcgaccaccatcccacctgccaatccacttcgcgccacctgtggacacacttcctccgatgttgttatcccgttgttagacggctgatttcatcaccatctgactcggaagtatgccccttcaagtacgaggaccaccccaacctcgcgggcccgctgggggcgctgctggcggacgaggcgcgaagcttcctcagccgagcacccgagctggtggtcgcgttgccgctgcacacgcggcgctatcacgcgcgcaagtacgaccaggcccagttgctggcgggcgcgctggcgaaggccacggggcgcaaggcccccgtgggattgctgacgcggcaccgcgagacacagcggcaggtggggctgagcgaggcagagcgggcaaacaacgtcgcgggggcgttcgccgcgtcttcccgtgtctcggggcagcgtgtgctgctggtggacgatgtgttcaccaccggagccaccgccagggcggcggcctcggccctgctcgaagcgggctccgtccaagtggagatgctgacgctggcgcgggccttcagcctggagtgagtggacagcgcccgaggactacttctgggcggcccggactcgctccagttcggcctggagctcggccacgcgacgctccgcgtcttccctgcgccggatttcatcttctcgcaggtgggccgcctcatccgcgcgctgttcgagccagttgatgcgctctcgcatccggacgatgagctcatcggactccatcaagagcgcgttgccagcccagaaccgcagccgctctcccaccaactccagctccaagcccagcacccgcgagacatagcggccctgcgtcggctccatccgcacgtagacgcccgcgccgggtgactccagcgtgtaggcctccagtcgctcccgggaccggtcgtagatgaagtactcgggaattccgagccgggcatagcgccgcacgttgaactcggcgtccttcttccggtcgcccccgacgtggacctccatcacccagtccaacccacggccctcatggctgacgagccacttctcccgcgggtgggcgcccacatcgaagacgaccagcaggtctggcgcgaagcgccgctcgtccgggtagtacaccggcagctccgagccgacgtaggccgtgcgccgctgatgaccgaaatagccccgaagaacatccaacgcccggaacttcgcccactggtgccggtccccttcgggcggcgccatctccgcatacgtcacttccgctggcagcgactccaccacccgcgcccgctccttcggattcatcctgtcccacgcatcctgcgagggcgcccgggggatggcagcccctccttcatcagtaggccgtcccatgatgccttcatcgtgtggcggcactccgtcgcggtcaatccgcccccatgtcctggcgtcagcaaatggcgaaccaacgaacgcctccgacgcgcgcggtccgaatcaccgcacggcctcgttcgcgttccggaacacggcatcccatgacgcggacgctcaacgcacacggtcccactctccgcctctccggaaagagccgcgttcatcagcgagtggccacactcaggggcttcggcccgagggccgactggagttagcgtcagcccatgcgctcgctcctcccacttgcactcgcggtcgccgtcctccgctgcgcccatgcgcccgaggcgccccccgccgctcccgtggccactgcccctgaatggcccgaaccccagccccccgcgctgcggctgcccgactcggtccgccccacgcgttacgcgctcgacctgaagctgctgcccgccgagcccaccttctccggcagcgtcagcatcgacgtggatgtgagcgagccggtgcgccaggtctggctgcacgggcaggacatggaagtctcgcaggcccgcatcgaagcgggaggccgcaccctggaggcccgtcctgtcaccgccagcgaagggcggctcgggctgctgctccccgaaacgctcgcgccgggcaaggcccgcatccacatcgccttcaccggcaaggtcgaccgcgagcgcagccagggcctctacgccgtggaggaaggcggcgagccctacctctacaccttcttcgagcccgtcgacgcgcgccgcgccttcccctgcttcgacgagccgggcttcaaggtgccctggacgctgcgcatcaccgccaaggaggaccacgtcgcgctcgccaaccaccccatcgtctcgcgcgagaagctgccggacgggctggcgcgcgtcacgttcgccgagagcaagccgatgcccagctacctcgtggcgttcgtggtgggccccttcgacgtggtggacgcgggcaccgcgggccgcaacgccgcgccgctgcgcttcatcgtgccgcgcggccggggcgcggagacggcctacgcggccagcgtcacgccgcgcatcgtcacgctgattgaagactacttcgacatgccgtacccgtacgagaagctcgatgtcgcggtggtgccgcgctactggggcaccatggagcacccgggcctcgtcgcgctcgggcagccgctgacgctcatccgtcccggcgaggagacgctcgcgcgccgcaagtggtacgtgaacatcgccaaccacgaactggggcactactggttcggcaacatcgtcacctgccagtggtgggacgacatctggctcaacgagtcgctcacctcgtggctggaccgcaagacggtggaccccttcgacacgagctggggcttcggactggagcagagcacccagtccacgctcttcgcgttggacacggacgcgctcgccgccaccccgccggtgcgcaagcccgccaacacgcatgacgaggtgctcggctcgttcgacaacggcaccacgtacgccaagggctcggccatcatcgacatgttcgaggcatggctcggtgaggagcgcatgcgcgacctgctgcgcggccacatcaagaagcatgaatggggcgtggccacgtcggaggacttcgccgccacgctgtcggccgccgcagggccggacgtcgcgcgtgccttccgcagcttcatcgaccagccaggcgcgccgcgcatcgccgccgaactgcaatgccagccgggagcccccgcgaagctgacgttcacgcaggagcgctacgtccccgcgggctccaccgccagcaaggaccagacgtggtccgtgccggtgtgtgtgcgcgcgggttccggcaagacgtccgagcgcacgtgcaccatgctcaccggggccacgggcgagttggcgttgcccggcaagagctgcccttcctggttcgtgctcaacgcgggcggcaccggctactaccgctccggctacacgcgcgagcagctcacccgcgtgctggccgcgcccacggaagcgttgacggtgcgcgagcggctgaccctgttggccgacatggaggccggggtgcgccggggagacctgcccctgagcgacgtcctgcgctacgtgcccaccacggccaagggcgaccaccgcctcatcatgcagcgcggcgcccggctgctgaccttcgtgcacgtggaccgactgtccaacgacgagagcgcgcgctaccggaactgggtggccgcgatgtacggccctcgggcccgcgcgctgggctgggagcccaagcccggtgacgacgacgcggtgaagtcgctgcgacccaacctcctggggctggcggcgctgcgcggcgaggatccggccttggtccgggatgagaaccccctggtgaaggngcggctggnggagnggaagtccgtccacccggaggccgttcccctcgcgctgatggtggcggctcgaaacggagacaaggccttcttcgacacgctggtcgcgcgcgcccgcgccacggaggaccggaccgaacgcagccgcgtcttcaccaccctgggctccttccgagacccggcgctcatgcgcgaggcgctcgcgctggtggccggcagcgagttcgacgtgcgcgacacccagtccatcctcacgggggccttctcgatgccgcagacgcgggcgctcgcctgggcgttctaccaggagcacttcgacgcgctcgccagccggatgcgctcggacgaagtcgccgggctcatcggactggtgggcatgctgtgcgacgagaagaccgccgccgaagcagaagcattcctcaccccccgagcggcgaagctggagaacgcgtctctcaccctcacccgcaccatggagtccatccgcctctgcgccgcgtccagcacgctgaacgcgcagagcgtcagggacttcctgaagggccagccgatccccgcgaagtcccgctgagcgcgcgacacgcctcccgtgcgcgtcatcgcgaaacgcatctgcgttccgtgatgacgcgcacggccgccgcggtgattgccccccgtggcatggggccacgccagccacgtccggcacacgggctgcactcagtccgccggacccatgcctcgaacgtacacagcacaagcgggcgactgcgtctccagcatttcccacgcgcacaacctgagtcctcagcgcgtctgggaagcgcccgagaacgagtcactgcgaagggagcggacgagcccccatgtgctcaagcccggcgacacggtgacgctcccggacaaggaaatccggcaggtcccctgcgcgacgggaaggacgcacacgttcaggctcaagggcatcccggaacgcttccgcctgcgactgcatgaggacggtgcgcctcggacgaaggtgccctaccggctcgtcatcggggacgtcacccacgaaggagagacgaacgagcagggcctcatcgagtgcgggattcctcccggtgcccgcgaggcgacgctggaggtcggcggcgaggagtacacgctgtccctgggaacgctccaacccgtgtccacggaggaggggctgcgagcgcgcctggtgaacctgggtttcctcgcggacgaggccagcgaagaggacgcgctctccgaggcggtcgcgaggttccaggccgagtacgggctgatgcccaacggtacggtggatgagcggacccgccacaagctgcgggaggctcacggtgcctgagaccacgccccctgctccagtgtccaagcgccgccgtctgggccgcgtcgcgcgcggcggtgaaatcaacacgctcaacatccggtttcccggccgctactacgcgttcgtcacggagcgggaaggcgcggacgacgacccgctctacctgcggctggagtgcgtcgaacgcgactggatggaccgtgtctggaacgaactggagaagcagttcgacccgggcgacttcctccgcttcttcaatgccgtcatcaacggccggcgcttcgaggacttctacgatgcgctgacgctggagcaactcaacctcttctacgtcgtctattactggttcctgcggcgagtcatcgacgacggcaatgattccgccccggtgtccgttttcgagttcgagctcgcgcccggggacccgctgcgtgatgacctctacgagacggactggttccacctggagctgcaggcggcgccgggcagcacccgcccggacgggctcttcgtgcgggcgggcaacgtgcgtcgcgcgggagtgcacacggtgcgaggcttcaccccggacacggactcgccgcccgcggagcgctggctgcggagcttcctgcgggtggaggatcgctcggatggagggctgacgcagggcgccctcaaggcgctccacttcccgctgcccgcgccgccaccaccgccgcctccgtctcgtccaggaggccctggcggctccggaggctctggcccgattccagagccgcccgtgaagaaccccttcgccattccttccgcgcccctccccatcccggtgtcggcccgggtcgccaccccggcgctggcccggtggatgcgcgccgcggcccgccagctcactcaacaggtgcgcgccttcaccgcggaggtcgcggacttcttcgatgactggatgccgcctcccggagggcccgtgctcgcattcgccggagcagccggccctgcgttgacttcacgagtggtgcccagggaacggtcgcggccaggcgccccaccgcctacggcccacgcctacgtaggtgatggcgcgcccaatccgatggatgcgtccgacccgaaccgcttgttcgcccccttcgtggggctcttcaacgtgggccagggcgcgtgctcggtgctgtacgacaaccaggggcgcgccatcgtctattacgacttcggcagcccggcgaacggccagcaggggaccttccccatcattccactggggcactgtgtgggcccctgcatgtgcaacggcccgctcatcatcctgtcccactgggacatggaccactgtgatttggggcgctactacccggagtccttccgctgccggtggctcgcgccgcagcagcacatgggcaccgtcgtgtgccgcgacacggtcgcgcgcgtcgtccacgacggtggcgagttctacatctgggcggcgtcggggcggcctggaaccgccgcgagtccgcgcggcacgccgagctcctggaaccgcccaggtggcagtcacatgcggtttccctggggcttcgtcgaacgcaactaccgtgaaggcgcgcagaacccgctcgccagtggctcggacccgcgcaacaactccgggctggcgctgtatgtctgcgtgcgcgacgcggccggtgcggctgctgtcgccgccggccccgtggccaccgacgccaacaacctggggggcaatgggcgaggtctggtcaccatcggcggaggcgcccctccgggctgggtggcggcagcgttcgcggggcccaaccttcctggcattggaggcggcctggccgcatttctcgcggcgatggggccggccggtggcaaccccaatcccgcggcgatcctcgcccggcgacagtcggccgcggccaccgcggcggtgggagctggtggtccaggcgccggtctcaccgcgagacagcggctggtcatcgcgacgctggccgtggcgcaccccgcgctcgctgccgccacggcggtggcgctgggccgggccgctgaagtcgccgcggacgccgtggtggtcgcgggcggaaacctgccccagatggcggcggcggcgggcgcggccgtcatcgtggcgagcggcgcgccgggcacggcggtcgccaccttcacggccatggggacagcggcggcgggcggcgcgccgctgatgcccgggagcgccggggccctggcgttggcccatgtgcaaggagccatcgtcggtgcacctgccgcctcccccgtcacgacggcggcgaatacggcggccggcgtcgtgccacagggcggcgaggcggtgcgggccgcggtggaggccgtggtacgcacccacgcccccgcgccgctccccggcctgtcgctggaaggcgcggtggcccgcgccgctggcgtcagcaacccggccgcggtctgcaaggccctcgcgcccccgctgccaccgacactccagggagaggcgcccttccacgccaacgagcggttcgtgctcctcacgggcgacgtcaactaccaatacatccccgcgcagcggcgccccttcgccgcacccggcggcggagctcccggaggcgcggtggcgctgccctacgcccccacgggccacccgcccgtcgtcgtgggcctcaccgcgacccaccacggctccaacaaggtgggggcgaacgacctgaatcccgacaggattccatgggctcccaacacgctgcccacccgtgcggccgcggtcgcgcacgcggcgtcagcgcttcccaatcccaacatccgccgggccgcgacggccgcggcggccgcggcggcgctcccactcccattgcccgcgaacctggcgaacctggccgccgcggcggaacgcgccgcctatgcggcctccgcgggggccttcaccccgctcgtggtggcccgtgcggcggccgcggcggtggtcctggagaacgccgtcccgaacacgccacaagcgcagttcgtccaactgggggccgtgtccgcgggcgccccgctccccgtgcccgtcctggtcggaggaacggcggcggcgtgggccacggtgacggccgcattgggcggtggcgctgcggcggcggtgccaggactgggtcccgtggtggcagtgccaggaggcccccaggtggtcagggcggccactgcggccgtcctcatggccagggatctccccaacgcccaccgcaccgcatcagcgcgcagagccgtggagcaggcgcacgtcagcgcgaggcccggagcgccacaacccgtcctgcaggccgtcgccgcggccgtggccgtgcggcggagcatcgcccaaggcggaaccatctccgtcccgaccgccaccgccatcgtccaggcctcccgcttgagcatcaccaccggcgccgggggcaccgtggcggccctcgccggagcggggattgccaacctccccgcggtgacccatccctatttcgccaccgccgccgccgccattcccaacccgccgctggcggcggttcaggccgcgctggggctcgcgcggagcgcgcccatcgacccggcgaatgcgcccttcgcggtggccaacgccttcgccccctcgcccgtccttcccgaaatcatcctggatgcgctggtgtctcgcggccagtcgctcccgaagtttccgctcgcgttggttgagattgccgccgccctcgcggccatcgggcccgcggcgtctctctccgaagtggccgcggttgtcgaggcggcgcgcgcggcgcaaaacggtcaggcggcgggcgcacctcccgccgccgggctcgcacatgcggcggcggaccgcatcggttattcctacggcgtcgccacccagacgggtggcgcggcggcggcccctcccttcgcgcaccgctatctctctcagggcgtgggacatcccgcccatctcgccatcgacaagtaccagcgccggggttgggcggtgcgccgcaacaccagcatgcacgcggaccagagcacacagccagaccacagccctcgcgggcaccacgccttggggtgggagctggccccgttctacgaaggaccgctgcgtccggcctccgccgtcacgggcaccctttcgcggacctgccatggctgcaaggaggtcgccgcggtccgagccgccgcagccgtgggagcgggaacagcgccagccacggccgtagccaccgccatcggagtggtccccgcagcggccgccgccacggcccccgcggcaggtcccgtcaacgccgcgcaactgggccggcacggcgttccagccacacgagcggcccgtcggagcctggagcccgccatcgcggcacgggccgccgtgcccttcgccagggcagcagtcacgggcgtcgccgcggcccatgccacgagcgcatgcatcctcgtgacccaagcggtcctcgcggcctggtggcccgccgccatggcgcgaggggacgtcgtcaggggcgggcctctctccccggcggccgcgatgctcgggggcgtcccgccatcggccgccgaggccgtcacggcggcccgtgccgcggtgctggccgccccactggtcctgcccccggtggacctcgccgcggtggtggccgcgctggcggtgagcctgggagagccgcctctcaccgctgtcgccgcgaccgtggcgcttcccttcctgggaggcacgggcgcggcggccctcagcgcggcccaggcggcggccgccggtgtcgggattgacaacttcgcggcggccatcgtcggaagcacccatgcctgcgcattgggcgcgaacctgccagcgcccgtcgccgccagggtggccgccatctccgccatggtcggaggggccccacttcccgcgaggctggatgcggtggccaacgccatctcggcgggacctccggtcgcggcgcaccacgccctcctcctgcgcacggcgggcatcacccttccggccatcgccgcggtcgtcgcggcggcagcgggcatggcccacgcgggcgtgactccgccagtcgcggcggacgcgagcacctgtcatgccgccgcggccgccaccgtgccgggcatcgcccaggccgccgtgaatgtctgcgccgctacgctcgcgggcggcgccatccaccccaacccagccgctgtcgcgggcctcgtggctgcctccacgccaacagccgccgccgccgtgacagccgcatctgccgtgctgacagccaccggggcggcccccccggcgctcggggacgccgccgtctgttacgcatcagcgacagccgccgtcaccgctgcgatgggaggcgcagccgccgccgctgaagccgcggccgccaccctcacgggcgtccccgtgcccgccgtcggcaacaccgcggtgacggccgccaccgtcgcgaattccagcgaggaggcagccgcggctgtggcggcggcagacgccctcgtcacggcggatgcattgacgctgccgaccgcggcccaatcggcggcctgttacgcggcggcagcggcggcagcgggtgttccggcgctcgcggcgaacgcggcggctgggaccattgccctggccggcgtcaccgccgccaccgatgccaacacggcactggtcgcgggcgccgccccgctcgcatgtgccaccgtcgccgcggccatggtcgtcacccagctcgccgtgggtggcgccgccaatcaccgcgcggtcgcggccgcggccagcgcatcagccatcggcgttcccgcggggccggtggaccaggccgcccagagcctcagcgtgggcatggcccatcccatctccgtggccatcgccgagtccgcgtcgatgcgggcatcgggcgcatcggaagaagcagccgcggccatggccaccgtccgggcgctcgagcctcggagcgcccccctggctgccacggcagcagccagtgcgggcgtacccgccgcggacgccgccgccacggccgccatccgtctcttcaatgtctgacccgtctgcgccctcgcgtgacacagttcccccatgttcgacgtcgcgcgctacctggagcgaatcggtgtcggggcggagcagtccctcacgaggctgcaccgggcccacttggaggccgtgcccttcgagaacctggacatccacctgaagcggcccattcggctcgacatgaacgccctcttcgagaaggtcgtcgtccagcggcgcggcggcttctgctacgagctcaacggcctcttcgcccggctgctgacggcgctgggtcaccgggtgacgctgctgtccgcgggcgtggccacggccccggatggcagcgcctacggccccgagttcgaccacctggccctccaggtggaggatgaacagggacgctggttggcggatgtcggcttcggtgagtgcttcaccgagcccctgcgcctggacacccacgacgtccaggtgcgctccggccgcgcgtaccgcctctcaccggagggtaacaacctcatcctctggagtgagaagccctccggatgggaggcggagtaccgcctctccctcgtgccccgccaactcgcggacttcgagggcatgtgccgctaccaccagacctccccggactccatcttcacccagcggcggctgtgcacccgggcgacgcctgagggacgcatcaccgccaaggagggcacactcgtcctgacccggagtggggtccggacagaacaacctctccccgttgaagacgccctgcggcgcgcgctcgtcgaacacttcggcgtcatcctcccgtccctggagtagtgcgtacctgtccccaccccatcctccatcgtacgatggccaggcaggggaagccccagaggggttcacctgttcatccgcgtcgacgcccctgcccggggctggcgccccttaccgcaagccgtccacccaggagaacggatgtcccgcttcacattgctggccgcagtcgtcgtgctcacctgcccgttgtgggcgcaggcgaagccggccgcggatgagaccgctcgcgtccatgcggccgaggcgatgaagcaggcctcctccccccgaagcgccgccagcctgctgcggatgcacgcgctggtggacgaggtggaggacctcacgcccctgctgagcacctacgcctacgtggcctcccgccgcacctcggacccgaatacccgcgccaccgcgcagatgctcctgctggacaccgagcgcgcccggggacgactggtgcgcgccaacgaggtgaagcagtggctgggctacgtgggcgactactacgtcaccggcggcttcgaaaacgaaggcaaggccggctgtgacaccgacttcggccccgaggccgccaacctggacctgtccgccacctaccccgcggccaagggcggcaacaccacctggcgcaagctgacggcgaacaccgcggatggctacatcgacctggccaccgccatccgccccaaccgcgaggccgtggcctacgccgtcacctggctggagtcctcccaggagtcgcgcgtgtcgctgggcgtgggcacgtccggcgcgttccggctgtgggtgaacgggcagctcgccgcgaaggaggaccgctacaacctgccgcgcccggaccagtcccgcgtgtccgtgaagctgcgcaagggcctcaaccgcgtgctcgtgaaggtgtgccaggagtccggcccgctgggtttctacctgcgccaggagtcgcccaccgtgcgcgcgacgctgccggcgaaggcgcccgccctggagaagctcaccgcgccgcagccccagccgctgcccaccctcacctccgccctgcgcgcgatggtggagaagaacccggatgacgccgcgttgcgcggcgactacgcccgggtgctgggcttcttccgcgcgtatgacgagcgcgagcacaccgccagcgccgaggccgcgcgcgccgcggaagccgcccccaaggacgctcggctccagttgctcgccgcccatgcgcagcgggatgacctgaacgagcgccgccgcttcctggaagccgccatcgccgccgaccccgccatgccggaggcgcgcgtggcgctggccgaccacgagctggaccgcggccaccccgagcgcgtgcagccgctggtggcgcccgtgctggagaagacgccggatgacgtcaacgcgcggctggtgctggcgcgcgcgcatgaagccctgggcgagcgccccaaggcccacgccctggtggaggagacgttccgcctgcagccccgcgtgcctcgcgcggtgcgcgccgcggcccaggtgtcccggcagctcgaccgtggccgcgaggccatggaccggatgcgcgtggtgctggcgctgcgcttcgacgacaccaccacgcgccacatgctcgccacgatgctggcggaggccgggcaggtggagtccgcccagcgcgagtacgcgcagttggtgaagctcaaccccttcgacaatggctcccgcgtgcggctggcggagctgaaggccagcaacggcgcagtggaggaagccgtcgccctcttcgccgaggcccgcgcgctgtccccggacgagccggaagtctatgagcgcgagggccgcgccctgctggccgcgggccgccgcgagccggcgctggcctcgttcgaacgctcgctggcgctgcgcccgcagaacccgggcctgaaggaggccctgcgcaccctcaagggcgagagcaccggcaccggcatgcagtacctggtggacgcccagccgctggccaaggagtcggaggcctacgtccacgaggacgccctctacctggtggacaacacctacgtgcgcgtccagcagagcggcctgtccagccgcctgcaccagacggtggtcaaggtcttcaactcgcgcggcgtggacgcgttccgcaccatccccgtcacctattcgccggaccgccaggaggtgcgcgtgctgcgcgcccgcgtcatcaaggcggatggctccgtggtggagagctacggtgagaacgagcgcaacatcaacgagccgtggacgggcatgtaatacg

SEQ ID NO: 1198 - DNA, 19862 bp, Myxococcus xanthus
ctctcagtccatgttctccacattctcccgcatcgtcccgttgcggacgaagtacgccatgccgatgcggtcctgcggacccacggccatggcgatggaggagatggggtcgaactgtccctcgctcgaatccaccacgaacttcgcgaagggcgaggtgtcgatcggaccgccgtcggggttaccgcccgcgtcagggggcgtcgggttgctgtccttgccacaccccagcgcgagcaccaggcccagagcccaggcatgccgtttcatgtgccactcctcgtgtgttgtcggccctgcacgtcgtggcggcatcctacgccagcgccgcgcggcggggagccaccgcgcatgtttcatgaagccagcgcgaagcgcctgcgtgcgctaggctcgcgcgccgtatgacacgtgcgcattccaatcgggggcgcctgtcccggcgctccctcatccagcggctgaccttcctgggcggaggcgtggtgttgctcggccccgcctgcaagcgctcctccgaatcccaagagaagacgccccccgcggacacaggtcccctggcggcgaagcaggacggccaggccccgcgcaccttctcctccttcgaatacgcggtggtggccgccgccaccgagcgcatcctcccgcgagacgaagacccgggcgccctcgatgcgaatgtccccgtctacatcgaccgcatcctccagacacctgagctggagcccgtgcgcgaggacttcctctctggcgtggcggccctggagcgccgcgcccagcgcatgcaccagaagggcttcgccgccctgacggccgagcagcaggacgaactgctcaccctcttcaaggacagcccgccccgcagcggcgaggcgcacttcttcgagctgctgacggtgatgacgctggagggcttcctcggggacccgtcctacggcggcaaccagggcaaggtgggctggcggctgatgggcttcgacaccgtgggcaccgtcgcctccgcgccgccggaaggctacgacgggcccaagtgcctacgtgagtgtggggtccaccgatgagcctgcccgaggtggacgtctgcatcatcggcagcggcgcgggcggcgcgcccatggcgctggagctgggccgcgcgggcttcaaggtggtggtgctggagaagggcccgcactaccagcccaaggacttcatccacgacgaaatcctgaacagccgccggaacttcttcatgccggtgccgtgggaggagccgcacctggtgcgccagggcgcgaagggccgctacgagaagacgagcgcggcgtggacggccaactgcgtgggcggcggcaccgtccacatgagcggcttcttctaccggctcaagccggtggacttccggctgcgctccacgctgggcgccgtgcccggcagcaccgtggcggactggcccatctcctacgaggagctggcgcccttctacgacaaggccgaggcggagctgggcgtgtccggcgagtccgtcccccaccccttcgccgagccgcgcagtggcccctacccgctgccgccgctggacgtgcatccggtggcgaaggaaatcgacaaggcgtgcggcgccatgggctggcattccctgcccaccgcgcgcggaatcatcagcaagccctaccggggccgcgcgccgtgctcatactgcgcgctgtgcggcagctacggctgcgagacgggcgcaaagagcggcaccaacgccagcctcatccccgccgccgtggccaccggcaacgtggacctgcgccccggctgcatggcgcgcacggtggaggtggacaagcagggccgcgcgcggggcgtcgtctacctcgacgcagacggcgtgacgcgcgagcagccggcgaaggtcatcgtcgtgtcctgcaccgccgtggagagcgcgcgcctgctgctcaactccacctccagccgcttcccgaaaggcctggccaacggcaacggactggtggggcgcaacctcaccttcagctcgttcggcgaatcccacgccaccttccgcctgtcgaagcagtccgccgcgcggccgtggctgaaggacccatctcccttcgtcaaccgcagcctccaggacttctacctgatgcccgacgcccagttcggcttccgcaagggcggcacgctgggcttcatgtgggcccaccccaatcccatccacgcggcagtggggctggcgggcaagggcgagaaggccctcttcggcaaggcgttgaaggacaagatgcgggagtaccgcgactcacgcatcctccagttcgaggtctacgccgagttcctccccaccgccggcacctacgtcagcgtggaggacagcgtgaaggaccgctacggcatccccgtggcggccatcaccgtggaccggcaccccatggacctggcggccacgcgcttcctggtggagcgcggagaggaggtcctcctgcgcctggacccggatgacgtccgccgcggcaccaccaccggggagacgtccatcctccagcacggcacctgccgcttcggcgacgacgcggcgacctccgtgctggaccgcgactgccgcgcccacgaggtgcccaacctctacgtggtggacggcagcttcatgcccaccggcggcagcgtgccgtccacgctcaccatcagcgccaacagcttccgcgtggcggaccacctggtgcgcaagctcaagggctgacgctagcgattgcgcagcggcgtcacgtccaccttgatgatgtagcgcgcctgcatgtcggactcgaactcgatgaggtggtcgcccacgccggtgagctccgcctcctcggtgaaggagccctgtcgctccatcacatccaacaccgcgcgcccttccgtggcccggcggatgcgcgcccggcagccctcttcatggaagagcatcacggtttcacttcccgccgcggtgacgtcctccaggaagagactcaccttcacggtggaggcttccttcaactggacgatgagctgctgccggccagggaagcggccttccgaataactttccgagccgagaatacagcccgccacgcggtcgcacacaggccaggccgcgccgcaggtgtccttcacacgcgcgccgatgaagtcctcgcgcgtgccgtcgcaggcaccccaaagcgacgcaaaaagcagcaccgctgctgcctgggccttgcggccaaacactgttacaaccggcgtcatcttcagaccctcatgcgaggcgtgtatgtccatgcgactgcgtacccgttggctccccatcatcttcttcgccctggctggctgtggggaggagacggagcttccccaggcgcccacactcttcatcgaccgcgcggcgctgacgttcaaccgcgagttcaaccacggcacctacgtcgggcagacggcctacaactcgctggccatccagaaccgcggcctggacccgctggacatcaccgccatcaccctgtcggcgccgagcgtcttcaccctccagcttcccgaaggcttcaccccaggcacgccgctgcggttggagacgtatgaccgcgcctacctgacggtggcgttcatgcccaccgatgacgtggaatacaacggcacgattaccatcgaatccaatgccgccaacgccgcccagcaggtcatcaccctcaacgggctgggcgtcgcgccctgaagtcctcgcggaccaccgcgtgacgggcgggagccagcgctcccgccctgacgccacccgcctcatggctggtaggtgaagttgcagcccccggcgtagttctggatgacgccgccatctccgtccggcgtcgtcccaccgtcggtgacgaccgggcacgacaccgtcgtcccgccgtccaccgggtagctctgcggatagtccccgtggccggtgcgcagcgtgtagttcacccgctcgtagtccagccgctccgacgccgtcacgtccacgcgcagggtgccgccgcggatgaagcgccgctccaggcagccgcaggcatagggcgccagggtgacgacggtggagttgggacggtcctccaactggtagagcgactgcaggctgctggtgcccgcgttggacggcgtgtgccaggcgcgcagcgcgtccgagcggtagcccaacgtcagcggcccccggttgcccgtgcgcaccggcgtgcaggtgccgacaccggcgtccgtcgcatcgccgtcacagaaggtgaggtccagcgccaggccgtgcggcgtgccaccgtcggccagcttcgccacctcccactggagcagccacgtccggtcctccggcggaggcaccgagggcaggtcgaacacgtacgagtccacgtcggaaggcacggcgtcgtagtccagcgggccacgcaccccgagcccgttgatgcggtccgtgccgctgcgcagccgcccgtggccgtgcgacagctggcccgtgacggagaactccgccgtgtcgggcggcgacgggaagcccgtggtggacgcgagcgtccgcgccaacggcgcctccgcgccattgacgtagcgagacagctcgtccgcgtcctccacatcccagctcacctccaggcggtagtccttgtcgtcgacccacgagccgttgtcctgcaccaggaagtagtacatcagcgcggcgtcatgcgccggaaccgggatgaccccccggaagttgctcagggcggtgaagcgcgagttgcccacggcctcctcgcgagacgagtgcagacacatgggcgcgggcaaatccgtgcgccggcagaagcgatccaccaggccccgggcgtcgggattctccgagaagtcgcgcgggcagacggcggcgtcggtggcgcagctctcccgcgactcgctcaggggacccccggtggcgatcagggtgaacacgtgcaccacgcgcgaggccgttaccggcatcgcggggaagcggccccccgtctccagcggcaccagccggtagcgcagcagcgtgggggtgctgaaggccggcagccgcaccgagtaccagtcccggtcggggatgtagcccaggcggccggtgaaggagacagacgagccggcgccgccgggcgtggcgctgacgaggttgcgcgtggtggcctcctgcgcgcggtcattgcccggcgcggtgcggtcctgcgcgtcctcctcctccagcacgcgcacctccacctcgtagggctgcgtgaggtcgccctgggccgtgtcccggtcattggtgccgcggtagcccttcaccaccagcgtccagtggccggggagctccgccttcttgattttgcgcgcggtggccagctcgccgccgcgcacctggggcagcaccacgccttcgtcctccttctccgtgaagcccgggcgccacagctcgtaggacaggcgccagttgggcacggcgtccaggtcgggcgcggtgacgtgcacgtaggcaatcttcccctccgccaggtcgaaggcatagtggtccacgtcattgtccgtggccagatagccggtggaggcgcccatcagcatctccccagactgcgtcagcaccagcggcgtggccgtctcgtgcgtgtcgttgggctcctgcgcgtccgggttctggtcgatgcgcaccgtcaaccggtacttgttgcgcgcgtcgaagttgggccgggacggcacgtctggcgcgtcctgcaccagcaccagcagcgtctggttctccagcccgtcgcgcagcggcaacacgatgtccaccggacggggcgcgccctgggcgtgcttgtcctctttcctcgccagcgagccctccttcccgtccggcagcggccccaggatggtgacggacagattcaccgcggtgctggacgccaggtacgtcccgttgacgttcagcagcgtgcgggcgttggtgccgggcggcaggacaatgcggtaccagtcctggtcaccagcgcgcggctcgctgtccagcgccaggaagcgctccagcggctcgcccggcttgagctcgcactcgggccgcgtcagcgcctcttcgcgcgaattgcacaggtcctccaccacgggagtccccgcgtctggtgtctcgcctcctccagacgaacaggcggcgaggacgagcaacgcgaacggcaacagacggacagaggtgggcatggcgtcggttctcaaggcgtcgggggcacgtcgtcggggcggccggggcagccgtcgacgagctgctcgggttccacgcggatgacgccatcggcgggcgacttgatgccgcccaccgggtagcgcacgtcattcacgcgaaaggtgcggacaagcgtccgggcggtggggtcgtctccgggcaccagggccacggacaacgcattgtcattgaagcccgccccgcgttgcaccacgcccgcgtcgtccgcggacgctatcgtgggggccagcaggacgttctccacgcggaagcggtagcactggcggcccaggttgtccggcgggccgtccgcctcgaaggcgtagcgatagccattcaccgacaggtccgcggtgtccaccaccagcggacgggtgtgcatccgcagctccacgcggttcgtcagcccgtcgttgtccgggtcctcgtccaggtcgttgctggcgccctgcgtgccgcccagccactccatgccgtccggcacgccgtcccggtcactgtccgccagcgtcgcgttggtgcccacgaactgctcgtcgcagtccagcaggccgtcgcagtccgagtccacgccgcgcagcgccggcggacacccgcggtccagcccgccgccgtccggcagggcctcctgcgtggggttgaagtccacgccgcggtcgcggaagtacacctccacgccgtcgctgaagccgtccccgtccgtgttcaccttgtgcgggtccgtgcccagtcccagctggtgcgcgtccgtcaggcggtctccgtccgagtccgcctcacccaccgggttgcccgtcggcgcggagaagttgaagtcccccatctccttctcgatgaaggcgcggcgcacctggccgaaggtgaagtccaggaagttgatgggctcgttgttgcggaagtcgcggaagttgccgccgcccagcgtcgccatctgctccaaccggtccgcgttctggttgatgatgagcagcgggcagcccccgtcaccagacaggtcgcacaccgaggaccccgcctgcgtggggttgaagacgtgcacggtgttgacgcgcacgtcctccaccaaatcccgcaactggcggatgcgcaccaccgcgtcaccccggagcagctcgtcatcctggtcgttggtgggcttgccgtccgacaggaagatgacggagtagcgcgcctgcgccagcgcctgcgcaccgcccgggtccagccggctgcgcgcgatgtccgtgttgatgagcgagtagatgtccgacagcggcttgacgaagtccgtcgagtcccggttcggcgaggtgtcggggttgcggaaggtgagcagctgctcagtcaggcgccgcagcatggcgtcatccatggaggacacctggacgaagccgtcctggggcgggttgcccggctgctgcgtgaggaaggccgtggtgctgcccgcgaagagcatcaccgccaggtgcacctggggtccctgggcaggttctggatgagctccaccagcgcggtggcgcgcgcgccgtccgggtcgctcacccgcatggactgcgaggcgtccatggcaaccaccagcttgatgggccgcaccacctcattgctgcccacggtgcagaagcggccttccaatgtcaccgcccggtccaccggcacttccgtgtcacggcgagggtcgtacagataggaatccgtacacgccatcaccatcgccacggccaccaggacgcccgccaggattcggacaacgcggctcacggattggcgctccccgagggcgggattccgacacagtcgttctggttgttccacgggttgctcaaggtgtcgggccggcggaagtcagcatcctcgaagaccagctcgggccccaccgggacccgcacgctgggcggcgcatactgcgcccaggcacaggcggtgcgccacacgccgtagtccgtgctcacgccactctccggcgcctcggcgaaccacaccttgaagaggttgtagccctgcttcacgcccgcgcggtccggcggcgtgacgagctgcaggttggacacggtgaagtcgtagcagaggctgccgtcggggcggacctccgcgatacgcgtctcgtactggtagccgaagcgctcatggaaggccttgtcgcggcgcgtggggtcactgcccgcacgcaactcctgggcgtccgggatgccgtcaccgtccgtatccaggcccgacacgctgttctccagcgggttgagcccccagcgcgcttccaggccgtccggcacgccgtctccgtcactgtccacgatgccggtgcgcgtgcgcaggtagtcctcggcgaactgggacaggccgtcaccgtccgtgtcgcggcagacgcagttgggcgtcagcggcgaggccgggttgcacccgcgcgcgtccaaatcattggcggcgcggaagccctggtcctcacggcggtactcgaagccgtcatccaggcagtcgccgtcgctgtccgcgacgaaggtgttggtcttcagcgtgaagctgttgtcgatggaatccggcaccccgtccccatcactgtccagcacgcggccggtgtcacccggcgcggagctgagcgactccaccatcaacgtcttcatcacgttgcgcgaggcgaacgacgagtagtccagcgcgcccaggcccaggttggagatttcgcccgtgtcgttgaactcctggtacacgccgttgccgatgtccgcgaagcgccgcagcagccacgcggcgatcttcttcgcggcctccgggtagcgcgccggctccacgcccgggtacacgccgtagatgtcctggcagatggggccacacgcccgcaccgcttcctggttgaagagcagcaccgtgtgcatgcgcaaatcgcccacgttgtactggtccttcaactccatcagccgccgcacgtagctgaacagctggtagttctggttgcggtccgtccccacctcgaacccgtcaatctggtccgtggtgttggtgaggttgcagaagtcacgcagcgagtccgcccacgtcaggtccgggttgtccgggtcggcgtagacgctgaggttgtcggtggccgagcagcgcggatacggcgtgccgtccgtgaggaagacgacgacgtagcgcgtgcgcggcagcagctccgggttggactgcgccaccgcgttgatgtcgctggaaatgaggctgtaggcgtaggacagggcgccctggtagtcggtgcccttgcccaactggctctgcaggccctcgatgtagctgtcgatgttgttgtccggccgggcgaagcggtcccccgtcgtggtgggcggccagacgttgcgcacgttcgtttcaaagggagcgacggacacctgcacgttgccgccctgcgcattcacttcccggaactgctgaaccagccgcttgagggcgcgcacgcgcgcgggctcggtgacgccctccgggatgatgtccagaatctcccggcgctggcagaagccgttgtcgagctgcgcgcccggcgggtcggagacgcacatgctgcccgactcgtcgatgaccaccaccaccttcaccgggaagccggaggggctgggcgggcgcgtgcacacccgcccctggagcgtcagccggtcatcgaggttggagagcgcatccaccctcgattcgagcatggcgtccgaacaggaccacaggcccgaagccaggaggcccgccgcgagcagcgaggtacgaacgaagcggcgcatgcggaagggacctcctggagggggacgacgaggttactgctggggacggcggcggcgcatcagcacgctgagcagcgcagcgcccagggcggtggcgctgaagccggcgggcaccgagctgcagttgttgcccttctccgattcatcccccacgagcaccgtgagggtggaggtggacacgcgctggtccgggaagacgcggtcggagaaggccaggcgcgcggtcagctggagctggtactcgcccttcttgtccgggacgaaggtgggcacgctgccgtcgacgtacatgtactgccagtcgcggctgagcgtcacggcgccctgcggacgctccaccaccgagatggaacccgagggacgcttcaccaccacccactcgtactccatggccgcgccgttgcggttggcgaacagcggcggacggatggtgatgccggccttgtccgtgcggaacaggccaccggcgctgacggtgaacggcgacttcgggtccaggcagtcgtcggggcgctcggggttcgtcaccaggcagtagcgcgtgtcgcacgcgtcgccaatgccgtcgcggtcgtcgtcgcgctggtcgcggttttcgacggcggggcagttgtcctgcgtgttgagcacgctgtcgccgtcgatgtcggggtcgcacgcgtcgcccacgccgtcaccgtccgtatcccgctggtcggggttgggcacacccgggcagttgtcgctgctgtcggagatgttgtcgttgtccgcatccacgcggcacaagtgagcctcttcgtctttgatgacctggtcggggttgtagacgcgggggcagttgtcgtcgccgtccagcacgccgtcaccgtcgtcgtccaggtcgcagacatcgcccaggccatcaccgtccaggtcctcctggccggggttgggcaccagcgggcagttgtcttccgcgttgtcgcggccgtcgttgtcctggtccgggtcgcagtcgtcgccgatgccgtcgccgtccgcgtcgcgctgctggaagttggagagcgtggcgcagttgtcgcaggcgttgcccacgtcgtcgccgtcgtcgtccgcctggtcgcggttggagacgaagggacagttgtcacggtcatccgcgcggccgtcgccgtccgcgtcgtccgtgtacgacagcgtgtcgccgtcgtccgtgtagttgacccacacgctgccgcccgcgccgcagccacagccaccgccgacttccagcggcatgccgcaccggtcgcccagacactccgggttgtcggggttgttgttggactgcgccagcgcccccgtggggccgaggacgaggaaagcccccagcgtgagggctgaagcgaaacgagcgcgtgtcatggtgactcctttcaacgccggacgcctagcaaggaacgatccgtaccagacacttgggggaagccctggaatgtcagtgagttgggcacgagcagggacgcgtcgaacaaaaggtgtggggggaactccccagtgagggcgaggggtggaccccacatccaaggagggcttcaggtccccgggatgaaggtatcgggatccagggggatgatgcccgccggcaggcggcccccctcttcgctgtattggatttcctggatgaggagcgagccgatgcccgcgccccgtggatcattgtcccggccagcctgaaggtagaggtacacctcgttggtgcccgccttgatgacttcgcccgggatgaaggggtgtggccgctcgcgggtggggacgacggtgacgttctccacgcgcacctggtagcagctgcggccgtccgcggtgggcgtggtctccaccaattcgtagccgtagccgcgctcgcggtggaagtcgaggtcggcgctgagcgggtctccgtgcgcctccacctccgacacgttggtgatgccgtcgcggtccgtatcgagcaggtcctcggggatgagcgggttcgtcatcaccagcgcctccaccaggtccggaagcgcgtccccatccgtgtcaccgatgcaggcgttggtgccaagcacgcgctcctcgcaggtgttgagccggtcgccgtcctcgtccagggacacgttgcagccgttgatgacgtccggctggagcgggtccaggcccatgcggacctcgacgccgtccatcaacccgtcctggtccgtgtcctggcgcagggggtcggtgcccatcaacgcctcatcctcgtcgggaaggccgtccccgtcgctatcgacgagcacctgcccggcgcgcaccaccacgttgcggttgtaggcgaagaagcgcttgagcttgagggtgttggtccgcgcggcgtactggatgttggtgagggtgcccgacagacccgccgcgtccgtctccagcggctcggtgccgccagcgttggcgatggcggccacgtgctggcgggtgatggggtctggcgtctcgccgcgcacgtagatgggctgcaccaccacttcgcccgcgctgaactgcgaggccagcgccttgatttcgccggtgacggcggtgagctcacactggctgcacgccgacgtgttgcccagcgcgctgcaacgcgagtcgagccccacgttgaaggccgggttggcgcaactggtgtcctggcttcgcaccacgacgacgatgacgtagcgcgtgcgggcgacctcgccgcggcaggacgtctgcatgtcgcccgacagcagcgtcttggccagccgcagggcggcgcggacgctcacggggccggactcctggtaggtggcgtagcgcggcagcgcggcctggaagtcggacgcatccgagaagcggcccagcaggcccgtcgccaccgtgtggtacgcgacgaggccgaactggacgaagggaccggagaagcggctggagagcgtggacagcgcctcgttggcgtaacccaccacctcgcgctcgacgccttcgccgccctggagcgcgaaaatcaccttcgtgggaaaggcctcgccgcccgcgagcggcacgcagacggtgccggcgaagctggcgcggtccttcccgccagggccacggccattgagcgcgtagaggcccgcgtcggaacacgacagcaagagcacgggaatgagccagacggaccgcgtgagggcgcgcatcagtccgattctacaccttaggccccggtgacaacgcaagcgctggtgacacgaagactgtaagcaccgcgcaagtgacacagcacggaccgacaattcggccccccgtggaacgggcgctgagccccccggaggcgccgtgactcccggtgtcctccgggcatggacagccaggtgacggcctacagcgtgagcaggaacgccagcaggtcatcgcgctcctcggacgtcagcgcgctggcgtggccgtgctggggccctgacgtctccagcagcgcgcgcagcgcgaagcgcgtctccaccacgagccggttgtccttcaccccatagcccgcggtggcgctcgtcagcaggggccacacgtcccacgcccccaccagggacggcgtcgccgcgccgggcaccaggtcctgttgctccaatctcagcggcagcgccaccggcgtgcccacctcgaggtaccggccccgcgtggccaggtcctggtccaacgtatagaggggcgccgggtgacacgtcgcacaggcgcccttgccctcgaacagcgcgcgccctcgcgccgggcgccccaccctcccgtccggcaacgccaccgtctccaacggtgcgccgtcctcgccgcgatgggggttgggcggcgtgacgatgagcgcgttgaagagggccagcgcctccacctccgacggcgacaggtccgggttgcggaagcggttgcgcgcgcccacgaagcgcaccgtgtccacgaggctgacatggctggcgggggtgaagtacggcggcgtgtcgcggctgcctcgcagcgtcgtggagcggtagatgcggttgggctgcgtcttctcgtagaagatgcctcccgtgtggccctcgatgtggcagccgtcacaggtgatgcccgtgcgtcccaggtccgcgtagtagaggacctgccccagccggcgtttggcctgcgcgcgagacgtctccaccggaagctgacgcaccaccagcgcattggccgcgttcgcatcgtgcacgtccaccaccgccacggtccgggtgaaccgattgagcacgtacagagtgcgcgcgtcgggtgacagcgccagcgcgctggggcccgaatggagctcctcgcccgccctgccccggaccccgaagtcctctggcggccggatgcgcggcgtaccgtcgggcggcgccaccgccacctcctggagcaccgcgcgccgggcgggcgcgtcccccgacaccagcgctcgcgcatccaacacccgcacgagccccagtcccacgtccgccgcgtagaggagtcccgcgccgtcgtccagcgccagcccctccgtgccgcccgcgccgaagccccggtgccgcacgtagccgccccgcgagggctccaccacggacacaccgctgttcgcgctcacctccatgcgctggggattgggccccacgttcggccccaggctcgacatgaagacgtgccccagccgctcgctcgccaccaggaagcgcggcgccttgccacccatcacctgctcgcggaagcgctcggtgttccctccgacgatggacacacccggccccggcgccaccgtggagacgagcgtcccgtcctcctgccgcagcagctccatctgccctgtctggagactgcccaccgccagcaggtccctccaccgcgccagcgcccgaggattggggtccaccggcgccgaccagcgcacacgcccgtccgccagcgacagcgcctgcacctggtcccgcacacgctcggccacgaaggccacgccggctcggccatccacggtcagcccctccgcccccagcggcgcgggcagcacccgaggcgcggcgtccagcgcgtccagcgcgaacaaccacagctccggctgataccggtgcgccacgcccagccagggccggccttccgaatccgtccaggccgccagcgcggagggaccgtctcccgtggccagccgcgacacgcgcccggtgtcgacctccagcgcgaacaccgtgtcggtgaagggcgaagtgatgaagagcgtgcgtccatccggcgcgggcaccatcgccgtcaggtcggtgaaggccgcgtcgttcaccaccgtgagccgcgccgagccctccgactcggcgccgtccgccccgacgagccgtgcctccaccaccgcttgcggcgcatcctctggcagcccgagccccgcgggcagccgcgcataggcgtgcgtggcatccaccaccgtcaacggcaggcgcagcgacagcggagggcccagcgacagcgacagccccggcaccagccgttccccctggatggagagcggctgggatgtctcattgctcgtgagccgaggccccacggatgacaacacagggcgcgccgcggcggataccggagcgggtgtggctgtttcacggagccgatgcaccaccacgcccgtggcgaccatcgacacggtcagcaccgccagcaccgcacgcctgcgattcctgctcatccgcgcccgtagcatccacgcgggagcatcccccatcccccgcggtgaggggatgaattcatgtctcggtgacccatccgcccggcgaactcggaacgcagcacggcacgccatctttccagcgtcccggcaacatcccgtctcaccgtggtggacgcgccccacatggggtggagtgccctctacacctgggcgcgcacggcgtcacatgcgtgccggagtgtgcgttgacagctcggtacacgcatcgcttaacctgttgatgatgcgacgcttcctcctctgcatggctgtcgcccagcttctcggcgtcggcacgctggtggctccggccgaagcctgggcccagagccgcggccgtacctcgcgccaggcgaagtccaaggccgccaagaaggcggcctccaagacgccgccgaagatcgagaccaagggctcgtccgtagtagaccccgtgacgggcgacgcggccacggcctcctccaacgcgctgccgcagcgaggcccggcgcgcatcgacttcgatgaccggctcatccagggacagacgaacaagtccggagccgtgtacctctatgaccgcaaggaactgaagacgcggtcgatgatccgcgagcgcgagagcttccgctccgaaacgctctccacggtgtacgacccctagggcagcaccgccccccagcccttgaatggagcgtcaccgttgagcggccagcccagcgtcttgcaagtcgtcatcctccgcgacggtctcctcgtgggcaccgaggtgttcgtcccgggcacctatgcgctcggctcggatccgtcctccgacctgcgcctggatgacccgtccgtggagccgcgacacgcgctgctctacttccagaacggccgcgcggcggtgcaggacgcgagctccagcacggggctcttcgtcaatggccaccgcgtctccgcctgtgaaatccggccggtggatgaggtcctctgtggccccttcatcctgaagacgcgcgtgttgtcgcagaagccgcaggaggccaagccgcagccgccgcccgaggtcgccgcgctgctcggcgcggcccaggcgcccacgccgttcgcggcgccaccgcaggtcgccgcgcccgcggccccgccgccctccgccgcgcccgcgcggcagctccgtccggccacggcggtcccgcccgtgtccaccgccaccatgcccgccgcgcgcgtgccacagcaggtggccgcggttcctcccgtccacgtggcgacgcaactggcctaccccacgcccgcgcagcccgtgcccgcggtggccgtggttccgcccgtgacgcagcaggcctccgtccacgccgctggcggccacgcgcacggactcccgcaggcgcagcccgccgtcatccccgtgcctggagcgcagcaggctcccgcgggcgtaccggcgagcaccgtcccctcggtccgccgccgggccgcgccggagccggcccccgcggccaactcgggcatgcagttcgcggacgagctgatggcggacctcgccctcgatccgctcccggagcccacggggccgctgctgcaggagcagcgcacgctggcgcggcccacgcatgcgccgcgcatcgcgcccggcaaaggcacggcgcagctctacctggagctgtactggggcgccatccgccgcgacgcgcgccgcttcgcgccggacaagaagaagccggtgcaggcctcgctggacctcgagggggccatgcccctgtggggcttcacgctgccggagggcgcgcccttcacgctggccgagccgctcaacaacgccttccgcctcttcgtgccgccgggcaccgacgtggagaagagcggcggtgacggccgcttcacccccgtcaccggcgcggccctggagtccgacggcagccgccgcttcctcacgctgcgcgagggcaccgccgcgcgcctgacgcagggacagatgtccctggtggcttacgccgcacccaagcccgcgcgcgtcttcgtcaacccgctcaagggcctgccctggctgacgctgacctgcctgggcctcttcgcctccgccatggccgcgttcctggtcatgaagccggaccagccggaggtggcggacttccagcacaagagccttccgcccgtggcgctgcgcctcatcgcgcccgagccgaagaagaaggaagaggtgaagaagaagctggaggccctccaggagaaggtgaagaagcccaccaaggagaaggtggcggagaaggccccacccaagccggtggagaaggcgccaccgcctccgaagcagcccgagaaagcggtggccgccgccacgccgccgcagaacaaggcgctcaaggcgctggccaagctgtccgccgcgggccccgccaccaacgatttgctcgccgccgtggacaagctcggcagtggccccggcagcaagaacgcgaagaactccaactacaagctgtccggcctcatcgggaaggcccccatcgccaacgcgggcctgggcaccttcgggctgggcggcggcggcaagggcggcggcgccacgctgggcgcggagctcttgcgcggcaagggcggcggcggcatcggcgcgctgggcgcgggcggcgtgggcaagggcaaggtgggcggcaccgtcacccgcgccacggcccgcagcatcgcctccacgcagggcacggtggaccgtgaagcggtggcgcgcgtcatcaacagcaacctgcacgaggtgcatggctgctatgagcgcgcgctgctcaaggacccgggtcttgcggggcaaggtggtgctggagtggaccatcggcgcgaacggccgcgtggtggccgccaagacgaagtcctccacgctgcgcaatgcctccgtcgagtcctgcatccttttccaagctgaagtcgtggacgttcccttcccccaagggtggcgtcgtcatcatcacctatccgttcctcttcaactcggtcggctactgacgtggcctcagtccgcgcgtccgttcccgccctcccccaggaagcccccaccgtgcgatacgccctgctcatcctcttgctgctgacgcccggactcgtccgcgcgcaggccgaggcgctggagaatcccggcgcagtgtccgccatccaggagcggcgattccggatgcaccacgagttgctgctcggcgtcggcgtgctgccggccaacgcctattacaagggcctggtgggcaccgtcggatacacgtaccacttcactgacaccttcgcgtggcaggtcgggcgcggcacgtacagctacaacctccagacgagcctgcgcacccagctcgagcgcgacttcaatacgtcccccaacgccgcggccttccaggaccaggtgcagtggatggtgggctcggacctcgtctggagcccgctctacgggaagatggccttcctcaatcagtcggtgctgcacatcgaggccttcctgctgggcggcggcacggtggtgaagctcgaccgcgacggcggcttccggcctgccgtcaacgtggggctcggcctgcgcctcttcacgggcaagacgctgtcgctgcgcctggacgtgacgaacaacaccgtcttcacgggcgccacgcgcgtcatccaggtgcccctcatccagctcggaaccgcgttcaacttcggcgccacggaatgacctcccgctcgctcatcgccgcgctcaccagcgccgcgctcctcgtgtctccagcgcccgccgacgcgcagtctccggccgccgcgcagcccacgtccaccgcccccgcggccgcgcccacccagggcacgcctccggcgggagcaaaggcccccggtgacgccaaggccgacgcgcccgacgccgccaggcccgccgcgaacgccccaacggcgggcgcggaagccccgccgtccgcgccgcagaaggtggacccgggcgtcttcgacaaggcgctcaaggactacttcgacggcaagccgcgcgacgccgccgggccgctccacgcatggctgcaggccgcgcccaagacggacgagaactacgcctggggccagtacttcctcgcgcgcagcctcatcgacctggggctgacgcacgcgggcgcctcgtacctggcccgcatcgcccgcgagcgctccaaccccaacgtgctgcctcgcgccctggacacgctcaaggcgctgacggaccggccgcacgacgaggtgatgattgacgagcaggtgttcggcgcgctggacctgggcttcctcccggaagacacgggcgcgtatgcgcactatcagcagggtctggtggacctgcgcgtgggcaacgagcgttgggccaacacccacttcgccaagctgtcggagacgagccccgaggccagccgcgcgaagttcgcgctgctcgtcacccgactggagcagg

SEQ ID NO: 1199 - DNA, 26533 bp, Myxococcus xanthus
agcgcaagctcaaggcgttgcagcgggagctcgatgcggtcgacatcccgtaccacctggtgatggagagcggcggctcacgctccatcgtcctcgagttcgtggacgaccagggcgcggacctgctggcgctgggcacccgggcgcgctccggtgtggcgttcgcgttgctcggcagcgtcgcgacggacctcatccgtgaggcgaagtgcgacgtgctcgtcgtccgcgaggccgagccccacgagtagcgtgaaggcccccgctcgtgcgggctcaggcctcgggggccttgccggcctgggtgtcggtggcgggtgatgcccctgcctcttccgtcgcagcgggctccacgccaccggagtcctgcgcctgcgatgcagcagcgttcgcgtcgctggctggcgcctgagcctgcgcggaagcaaccgtcgccgagagggccgcggccgtgagcgcgtctccagccacagccgtggactgggcttctcgctgctccagccgcgccccgccctgctccgccgcgcggaggaactcgtcgtactcggacttgcgctccgctgccttggcctgggttttcaccgactgctgtgccgcggcgtgccggcccatcatcaccgcacgcgcgctgagcacgacgcctccagcgaaggccgctaggctgaacacggagccgatgtccccggcccacagcccgtacacgccgctctggatgaaggccatcgcgttcaagaaggccgcgcccgtgagcgccgcaccgcccgccgtggtccacggacgcagctccatcacccgcgcggcgccgtagcacagcaccggcaacatcccgagcacccacaggttctccagcagcaccgccagcgccacccgcagcacgcccaccggcaccgcctggatgcgcacgctcagccgaagcgtcagcgccacactcagaatcgaccccgcgataagcgcgatgaaccccagtcccatgatgaactggaagcgacggacacggacgcgcagcggttcgaggacactcgtcttggagctcacgggcaggcagcctactccacttcagccctcatcctcttccgcgtccgtcgttccccccggcgtgcgggcaggcgggccgtcccggtagaagacctcctccagcaccagcccctgaggcggcgcggtgggcccggcgcgcttgcgctcctgggaggccagcacctccgccacccaggacgcgggccgccgtcccttccccacctccaccaatgtccccgccaggttgcgcaccatgtgcttcaggaacgcggtgccctccaccacgaaggacacggcgtcccccgacgtgccttccaccgccaggctccgtatctcccgcaccgcgtgcttggcctggcagtccgcggccctgaaggcagagaagtcatgccgccccaacaggtgcgcggccgcctgccgcatggcctccacatccaacggagcgaagacttcccagtgcgtcatccgccgcaggggcgagcgcgtgcgccggttgctcacgcgataccggtagcgcttgccccgggaccaccggcgtgggtcgaagtcctcggccacctccaccgcgtccaccacggccacgtcgggaggcagcaggccattgagccccatgacgtacgccttcatcggcaacacccggggcgagtcgaagcaagccacctgcccggaggcatggacgcccgcatccgtacgccccgccgacgccaccgacacacgcgcccccagcagccgctccagtcccgattccagcaccgactggatggagggcccgttgggctgcacctgccagcccacgtagcgcgttccttcgtattcgagcgtcagcttcagccggggcatgggtcagcggtacttgagccaggactcgagcagctcggccaccatgcggcccgcgggcacgttgttgcggcgggccaccgcctccagcgcttccgagacggcgggactcagcggcacggccagggtgcgcggctcggtgcggtcatcgtgggccgggggctccggctccggagcgggcatggccttcgcggtgtcgagcgcatccgccacatccgacagctccagggcctcctccgacgtgggcgcggccgcggcgcgcacggccaggcggcgctgctcggcggccagctcctcctcgaagagctgcttgatgaagttggacaggtgcagcgccgtgggcgtgaagtcgtacgcgtccaggaaggcgtccaggtccttctgcatctgcgcggccgtctggtagcgcttgtcccggtcgcgctccaacgcgcgcatcaggatggtctccaggcgctccggcaggtcctcgcggaagtacgacggcgcgtagatcttcccgtccgtgatgctgcgcatcaccgcggcctcggactcaccggtgaagagcttgaagccggtgagccactcgtagagcaccacgcccagggagaagacgtcgctgcggcagtcgagcggcttgcccagacactgctccgggctcatgtagctgagcttgcccttgatttcgccgttgcgcgtctgctccatctggttggcggccttggcgatgccgaaatccagaatcttcaccgagccatcgaaggcgacgacgatgttctccggtgacacgtcccggtggacgatgttgagcgggttgccgtacaggtcccccttggtgtgcgcgtggtgcaggcccgcgcagacgcacgaggcaatcttcaccgcgtacaccagtgggaagggaatccccagcgcctccgccttggggacgacgcggcgcatgtcccgcccggacacgtactccatggcgatgaagtagctgtcggcaatcttccccaggtcgtgaatctgcaccacgttggggtggttgagctgcgcggcgagccgggcctcgttgaggaacatcttcacgaaggccgtgtgcttggacagatgcgggcggatgcgcttgatgacgacgggagactcgcggccgtcctcctgctgctgatgcgcgaggaagatttcggccatgcctcccacggcgatgcggtcgatgaggcggtactttccaaagcggccggtgtcgcgctgcggggcggcgggaggcatggcccggcgagcctacctgtgccgagccgcggagtggcaacaaacttgggcgaagctcggcaggcctctattcctaacggacctgcacccggtgcaccttcagcgcgggctcctgtccgggcggcggtgggaaatccaacgcggacggcgccagcgagcccaacgacttcccctggcgtcccgcctgggacaccccttcgagcaccatggcctcgaagcggcgggcagccagtcccgcgtggttgcagcacgccaccagttggcctcccggactgacgacgcgcgcggcggcctcggccagccgggcatagtcgcgcgccgcggagaaccggccactgcgcgtcgtcgagaacgacggcgggtccgagatgacgatgtcgaaggactcgcccttcttcgccaggcgcttcagccaatcgaacacgtcaccggccacgtagtcatatcggtccaccgtctggccattgaggcgcgcgttctcctcgccccactccagcacgcgccggctcgcatccaggttgagcgcccgcttcgcgccgcccgccatggccacgacgccaaaggcacaggtgtacgagaagaggttgagcacggtgaggccccgcgcctgcgacagcagccacgcccgcgtgtcccgcatgtccaggtacagccccaccgacagcccctgcgccggacggatgaggaacgtcaggccgttttcgagcgcggtgaaggactccaccgcttcgccccgggcgggcgcctcgggtgcgagcgactccttcgccacgttggccaggacacgcgcctcccggggccggcgcttgaggtagaggcttcgaggcgcccaggcggccacggccgcgtcgagcagcgtctcctcctcgtccggcgtgaagtcccggtagaggctgatgacgtacacgtcaccaaacacatccgccgtcacatccggcacaccgtccgcttcggcgtttaccacgcgccaggccgtggtccgcgcgtctcccagcagcggcccgcgccggccgcgcgaggcgcgcagcgtctccacgagagaagaagccagtgtgcccatgccgccgctcaactgcccagacgcgcgcgcgtccagacacgctccagcgcctcggtcgccgcacgggaaagcgccacgtagtcgagccccagcaactgcccctcccgcacgcagacccggccgttcacgatggtccatcccaccggcgaatgcgccagttgcccgagcagatagggcgagtagcccgtctccggatccgcggtgggcacgacgtcgtagacgacgaggtccgcgatgctcccctcctccacgctcccggagggcaggccgaacagccgcgtgcacagctccgccgggccgttgacgagcaggtgcgccagcgcgccatccacgtccggcagccttccggaacgggagatgcgcagcacgcccaccagcgcggcgagcagttcgtcctggaggctgccatggcccccggtgccgagccccagcaggtggacccgcgacagcaccgcgtccatggggtccgcgccacgctccagcgcgcgcacgccccgggccgccagcgccacgaaggcaccgctctgctccagcagctccgcctccgcgctgtccagcacgcgcgcatagcccgcgatggcacgcggcccgagcagccccagcgcatccagccgcggaaccacgcgtttgccgtgctgcgagtaggtggaggagaggtcgtcctcgctctccgcgagatggaagacggtgggcgcgtccagcacccggctcagctccgcgatgcggcgcagcagcgcgtcgtcacaggtgaacgacgcatggaagccaagcgccccccggaccagcgggtggtcccgatgcgcgcgcgtgaagtccgcgttggcgtccagccacgcctgcgcctgcgcggcgccgtccaatccgtgggtggagtggctcgtcaccaaccgcaagcccaccgcctccgcggcgcgagcctgggcggcgagtcctccggccacgtcctggcaggacaggtgctccaccgccagggtgacgccgtgacgcagggcccgggccgccgcgtagcgggtgagggcctccacgtcctcgttcgtgagcagccgcgccacgtgccggagccggtccaggcgctcgcggggcgggagcatcaggaagtgtcccgtcggcggcagcaactggccgttgacgaggtgcgtgtgacagtccaccaggcctggcgccaccagccggccatgacaggcgacttcccagtccccgggcagcacgggcacctgggcgtccggagccatgcggcggatggtgttgccttccaccaccacggccatgccatggcggacgcgtccgtccgccctgaacacggcacagtttttcagaagcaggcggccttccatgaaagccctgttctaacacgggcacggcgcgacgcgagcggcgccgccgccagcgggcatgttagggtccgtacggtatgacgccgctgagccccgccgtgaactccccgtcccccgtgacggccccctccccgggcggggcgctggccttccggggcttgtggctcttctcaccgcgggcagatgccctcatcgtcgccctgcccctggccctggccctgtgcacggcggccgccaacgtctggctggccccgggcgccgcggaaggcgcacaccgcctttcagcctggacggcgcagaacctgctcggcaacgccacccacgtcatcctcacgttcctgctcttcgcggtgcaccgggacgtgctgacgtccgccccgggccaaccccggcaggtgctggcgggttcgctgggcatgctcgcggtgggcacggtgctcttcttcacgttctacgcggagcgcacggcgcacacgtatggcgtggcggtgattttcaacgtcttcggcacgcaccacaccctgtcccagcaccggggcatctggtcactccacgggctgcgcgcgggcaaggccggcctgcctggcgcgtcggcactggagcgcaagctgcaacagatgtacgtcccgctgctgctctcgctgctgctggtgcgcatcttcttcgtgccggaggcccccgggcccgatgcgccggcgtacctggacattggccagggcgcggtgctcccgcacggcacgctaggggtgctgctggcggtgtggctgggctatttcatgctgctgttccgcacggtactgcgcgcggaggccgtcagcggacccaaggtgctctacctcctggccatggcgacggcgaccgggctggtgctggtggcgcccacctggggctacgtcatgctgcccggcatgcacggcctggagtactacatgctcaccgcgcggatgctggagccgcgcgagggtgatacgccccggctgccgcggaagttcatcgtcccggcgatgattgcgtccatgctgcccctgttggcgctgggcgcggtgcacggcctgctccagcagggcgtggtgcgcggcgcgctgggcagcaacatgggcgtggcggagacgcatcccctgctgcgcgccatgacgtccctgggcttcgcggtggtgctggcgcactacttcgcggacgcgctcatctaccgcttccggattccctccatccgcgcggtgatgctgaagcggctgggcttcagctagccgcagggaacatcggcggccccctgtcgctccgcgttggccgcgaaggcatcccgtaggaacagcgacaggccagggcgcgccttgtcgatgttctccgtgaagcgcgtatccgccacgtacatctcccccaggccccggtgcatggcgggtgggcacgcgtagaaccacctgcccaggtattgccggtgcgcctcggccaggtccatggccgcggccgacgcggcgctggtgcccgccgcgagcaggtccgccaacgcctggaagaggacgtccccctcctccttgatgcgcttccagtcctccttcttgtagcgcgccgtcctccgggcggattccttgtaggcctccgtgttcccccagcgctgcttcgcctcctcctcgtacttcgaggggtcgaagtcgccaaaggcctcgaacatcgcttccttgtccacgtgcgtccccttctccagcgcgtccagcgccgcgtccacggcatgcaccagcgcgtccagacgggcggcccgctccgtcaggagctgccgctgcatccgcagcgcggtgcgcaggtcgaaggtggggtcgcccaggatgcggcggatgtcctccagcgggaagcccagctccttgaagaagagcacctgttggagcttctggaggtccgcctgtgaatagagccggtagccggcctcgctgcggtccgaaggacacaacaggcccagctcgtcatagtggtgcaacgcgcggatgctgattttcgccagccgggcgacctggctcaccgtcagggccatctccacctcttgatgaggaggtgtagggcctcacgtcgcgtgagggtcaagcccctgggcgggggtgctgccacttccggccgggcaccgggctgacgactcagccctcgacctcagccgcccgagaggagccacccgcacgaggcaggtatggctccccccggaaggacacggctcagtacgcgttgttctggccgaacgtcttgatggtcttcttctccagctggcgctgacgctcggtggcctcggagtcgacggaggcgttaccggccagcgcgtcggcggaggcgccgaacagcttgcggatgttgtcgccgaacagggtcaccacgccgatggcggcgatcgcgatgagggcgacgatgatgatgtactcggtcatgccctggccacgagccttgcggagctgctgcttcttcgagatcgccttcatggaactctccggggattgcagtggtggaaaaaacaccctgctgcttgggtgattcgcaccctagggcagatcccacttccacctccatcggtcatcgggaggatgcctggaattctcagtgattccaggcaattggcccgattgggatgatccaagcccccatttcaggggcccccgggggcggcaacgggcgtttgggccgtgccttcgcagctcgaacggggcagcgcctcgcagagcgagcgcagcgcccgggccagatgttcgtcgtccgggtgccgggacgcaacctcgcgccccagggccacggtgtcgtgcagggcacctacaggcgtccacatggtgcgcgaagcccaggtctgagccgtcaccagccggaggtaggccgtcaccagcgcgggcgcgcgtcctccccgtgccacctccggctccaggagcgaggcggccagcgtcaagtcctgctgggccagcgccgccttgcccagggccagggcggactccgggctgtcgggggccagccgccgccactgcgcggccgcgccgcgcaccatggggtcattgggcgcgtggtagcgctcgatgttccggtacagcccggcggcctgctccgcggtgggcgggtgctgctggacatagtcgtgcaggaagaggcggtccgccccttcgggcgcgcgccgctcgtccttcacgcgcacgtccagattcgacacgaagaaggcgatgggcgacgcgtactccagcaggttgtggtcgtccgtgttgatggggccctcaccggcgaactcgagctggccggcctcgctgtgcacctgcttggacagcagcgcgaacacgtcgttgatgcccacgcgggacaagtccttccgcacctccggatgccccatgcgctcggccaggcgcgccgcatcgaaggccaggggcttgcggctggccaccatcaccaggtcatgcggccccagccacgtggtggcgtgcgggaaggtgtctcgcagggtgcggaccaccagcttgatgaggtcctcgttgctctcgtaggtgtggatccactgcaccagcacgccgtcgtccgccaggtgccggtccacggtctggaagaagtcccgcgtgaagaggccggacacgccggacacccacgggttggacggcacgctcaccaccaggtcgtacttgcgcggcgacagcgccatgaacgtcttggcgtcgtccacgtgcacgtgggtgcgcgggtcatccaccgcgttgcggttgtccgccttgaacaggcgcgccgcgtcgatgacggcgggagcaatctccaccatgtccaggtgctccacggggtgcaccagcacgctgcccgcggtgatggcagcgccggcgcccaccagcagcaccgacttgggctcacgcgggtgcaacagggcgcccaggtgaccggccaccacctgcgtctccacgtcgctcccgttggacgcgtccaccttcccgttgagcttcatgaaacgcaggttgtccacgggaacgtccgccaccatcaccgtggcgaaggtgtcgtcctggtagaagatggggcggatgatggcctccgtgtccgccaccagcttcgcgtagctctccggcggcttctcgtgggagcggatggaggcgatgcccgacaaccgcaccgcccagccgctcatcccgcccagcaccaccagcgccagcaccgccgtggcggccaccggccacaaggcgcgcgcgtgctgtgcgggacggccgggagccgggtggaaggccagccccgcgccgagcaggttggccgccacgcccgcgatgaagttgccctccatgccccaccacggcatcagcaccagcacgcccagcgccgaacccgtaatcgtgcccaccgtgttccacaagtagacgccgcccaactggcgccccacctcggacaccttggccgtggccacgcgcgccgccgccgggaaggccgcgcccatgaagaaggtgggaaccagcagcaccaggcagcagaagccgaaggtcagcacctggaacagcggccaggtgtccagcgagcgcgtcatcatccactgcgccttgcggaataggtgcggcagccggacgtagagcggcagcgccacgcagatgctggccaccagcgcgacctggagccggccgaacaggcgcagcgagtccacctgtcccttgcgcgtcatcagccagaagctgcccaggccaatgcccatgatgaacgcggtgaggatgagcgtgaaggcgtaggtggacgcgcccaggacgatggacagcaggcggatccacgtcacctggtacagcatggacgtgaagccagacagcagcacgccgatgagcgccgccctcaccgcgatgcgcggataggacacctccgcgtcgcccgcttccgcggggggcgtctgtcccggcaccagcgcgggcgggaagcgccgggccagccccagcgaggccagcgccaccaggatgttgagccccgcggccagccccgccgaggaggacaggccgatggcgggcaccagcttcgtcccggcgatgaacacacccaccgccgcgcccagactgttgacggcgtagagccgcgccaactcgtagcgcacgcccgacaggctggaggcgaagtgccgcaccagcgccggcagcgtgccgcccatcagcagcgtgggaatcagcagcgacgcggaggagaccagcagccggggccccagtcgccagccatccggcacggacggggccacgttcagccatagcgcccccagcacatcgagcacataggggaagaccagcgcgtacaggcccacgcccagctccagcaggccgtaaagggccagggggttctttgcccggtcggctgtccgcccgaagacaaatgcgcccagcgcttgccctcccatgaacgtggcgagcaccacggcatgcgcctggccgctgttccccaggacattcccgaggtacttggaccagacgagttcgtaaacgagcgcagtgcccccggacaggaagaggaggcaggccacaaggttcttaggaaaacgcgccggagatgacatggggacagcgcggaaccttagtcggtatgtttcaggcccatcaaatgaacacccatctcctgcaagccgcgatgctcgcctggactccaagcctgcgggtgacacgcgccgaaggcgacctctccagcatcctgcgacgccccgccggggccctgttggagcagccgctccacgaggtcctcggcgtgtcgcccaagcgcgcccgtgagctggacgcccgcgcccgcgaggaccgccgcgcggtggagttcatctccgccaacctcggcggcgaggacgcgtcccccctccgcctgtccctgggactggacgacggcgaggccagcgccaccgtgctggacctcaacgccatgctggacggcgcccccccggtgcagatttcacggctgtcctcctcgctcagccacgagattcgcaaccccctctcctcggtgaagatggcggtgcagacgctggcccggaacaccggcctcaatgaccgggacaagcggcggctcaccatcgccaaccgggagattcgcaccatggagcgcatgctctggctcctctccgaatacggccgcgacaccaccccgaagctggacgcccatccgctgcgcggcgtggtgcaggaggccacggagatggtggcccccgagctggccgaacggcgcgtggaggtccgcgtggacgaggaacccgacctgccccgcgtccgggtggacccgacgcggctgcggcccgtgctggcccaggtgctgctcaacgtcgccatgggccaggcggagggcagcccgatggaggtggccctgcgccggggtggcccccaccaggtgatgatggtgctccacgaccccgccgccgccctgccccccgaggagaacggttcgctcttcgagcccttcggctcccggctggcccggggcgccggtctgtccctggccgccctgcgccgggtgatgacgggcgtggggggagacgtggccgcccggggcagcgccgagccgggcgtggtgctgacgctgacgttcgccacctgagagcgccatggagacccttctcatcgtcgacgacgacgtctcgctcctcgaaacgctgaagatgcatttcgaggagatcgagcaggacggccagccccgctaccaggtggccaccgccaccagcgccgcggcaggactgcgcgctgcccaggaggccatgcccagcgtggtcatcctcgacatgatgctcccggaccgcacgggtctggaaatcatcgaggagatgaagggcctgtgcggggacgcgcgcatcatcctggtcaccgcgtaccacgacatggagaccaccatccgggccatgaaggccggggctttcgactacatccacaagcccttcccggacccggccgccctggacctggtggtggagcgcgcgctggagtaccgccagctgtcgcgccgcgcggacgaggtccaccgggagaacgccgccgcccgcctgggcgacatcgtgggcaccagcccgctgatgcagcaactggtgaaggagattggaaaagtcaccggcagccacgccaccgtgctgattacgggcgagagcggcaccggcaaggagctcatcgcccgcgtcatccacaactactcctacgacgagccccggcccttcatcggcatcaactgttcggccatcgtcgacacgctgctggagagcgagctcttcggccacgagaagggcgccttcaccggcgccacggcgggcaagccgggcaagttcgagctggccgaggacggcacggtgttcctggacgagattggcgacatgtcgctgatgctccaggccaagctcctgcgcgtactgcaggagcgcgagttcgagcgcgtgggcggcgtcaaacgcatcaagctgcgcgcccgcgtcatcgccgccacccaccgcgcgctggtggaggaggtggaggccggccgcttccgcgaggacctctaccaacgcctcaaggtcatcaccctccagattcccccgctgcgcgagcggcgcgaggacatccccccgctggtgaagcacctgctcgagcgcatcaacgagaaggtccacaagcgcgtcacccgcgtgcccggcgaggtcatggagcgcctcacccgcctgccctggcgcggcaacgtgcgcgaactggagaacgtgctcacccgcgccgtggtgctggcccccggtgacgtcctgcgcggggacgatttgcccgccctggagtctcccctcccctcgccggagccgggccgggccacctccgcccaccacaccgccagcgccatgttcgccgcgccggccgaggacgacgccagcctgattcccactttggaagaggccgagcgccagctcatcgcccgtgcgatgaccgtcacgaaggggcacaagggtcgcacctgccagatccttggaatcagccgccccaccctggagcgcaagctccagaagtacggtcttgcacagagccagagccctcaagtgcacaccttccctgtgaaggatgcgttgtgagcactcttggacagtgtcgctgctccgacactcatgcccccggtttgaacgtttcgttcaaattgatcagactgtttgaacgttctgtttcaggttttggacacagaacgggctctggtgcgggcctgtagcgctaagtacccggcatttcaggaggtgttgtcccggcggcatttcaattcccgctggcacgaaccttggagaaggaaagtcccgttcgccgctgaagcagacggcccggcttccctacgcttccttcccaggagttatgccatgcacggtttcaaccgccccctcggccccatcggttccaacgtcgtggcgccgctgcagacgaccagctccgggatgatggtcaccgccaacaagctggtgcccggccaggaggccatcgacttcaagggctacttcaaggtcgagtccttcccgcacaactcgaccatctaccgccccggtgacaacaccgaccgcgtctacctgctgaagtccggccgcgtgcgcctgatgcgcatcggcaagaacagcacccgctccgtggtgtccatcctccgcccgggcgacctcttcggcgagctgttccgccccgagggcacgccgattgaagagatggccatcgccgccggtgaggccgaggtctggagcatcgagggccgcgacttccgcgcccagttggaggcccgtccggccctggcggtggacgtggtccgcgcctacgccgagcgcgtgcgtgccctgcgcaagcgcgtgctgggcctgacgttcaaggaggttccggcccgcctggcggacaccctgctcaccctggttgaagcgcacggcgagcgctgcccgcacggcggcgagacggacctgcgcggcatcacccagcaggacctcgcggacctcgtgggcgcctcccgctccttcgtgtccacgctcatcaacgagatgaagcgcgagggcgtgctcggcaacgtcggccgtatcctctgcgtgcgtgaccagaaggccctgcggaagatcgccggcaaggagaagtagtccgcgcgcccgcggcgaacgggaagcaggacaccagacgggcctgaccatgcgcatgccgcgtggccgggcccgtggtgtttccagcgaacggcgctccccgggtgtgcgtaggatggcgcgaatgtctggcgccattgattccatcctcgcgcttcaggagcgcctgaagcacgagacaaagctcccgctccggtccgtgtcgctcacgccggtggccgctcaggacctccacgtcttggagtcctcgctgggcgcgctgcttccccaggcctacgtcgacttcatctcccgccacggccttttctccgcggtggactggcagggacatgagcgcgcccggatgttgagccccaccgaggtgctggagacgctccagtggtccaaggagtacgtcgaggagggcgccttcggcgacaacgaggacgaactggaagccgccatcctcgagaagaagctccgcgagcggctcatccccttccagtacagcgcctactcgagcgtgagcgactactactacttcgacacggggatgcgtcgcgacaccgggctgctcatcttcccggcgcgccacgacgacttcgacctgtcgacgtggctgctggatggagcgcccgacgtctcgggctgcaccttcgacttcgacgaacacctgcgctgggtcctccgggagggcctggaggagaaggactgggggcgctgactcagacgcggcggcgcagctcttccacttcggcgcgaagcagccagtcatccgggaagtccgtggccgccgcggcaatctggctcagccgctcaggcttcacggagtgcgtctcccgcatcttccggacctcgcggtagagcgcggccagcgccgggtgcagcgccagggccttgcgtgtgcggggccttctcctcgccatccccttccgcgaaggcgctcagctcgccgtaccagcggtcccacgtcgccgggtccgaaggcccacccgccaccgagggcaggtgcgtgctgacgaagagcttcgccaccgcgggcagcgccagctcgcgccccgccaaccggccgcgcagcgccagcacctggccgccgtccgtggcgaagccctccagctccagcccactctccagcgacagcttgaagggcccgcgctccggcaaggtccccgcgccgaacgccaccagcgccggcccgctccacggcttgtcgtccagggcgcgcccgcctcgcgaggccatgatgggcccctccatgcagacaagcgcggtgcccagccccggcgccacctcgcgcggcgcggcgagcatctccagcacccggcccgtcacctcgcggccgtccgccagcaccaggtgattgacggtccgcgcgcgcagcgcctccgtcaggccgaagtcgccgccgcgcttccacgacagcgtggactcgaactccgccagcacctcgaacaggtgctcgaagtcccgcgccacgaagagctgcggctgcatgcgggtgatgtcgtagtccatgtccgcgcaggccacgctcagcggcagcttcttcaccgccggcgtcaggcagtgctgcgcctcgccgatactggacagcagccccgcgccgtagatgcgcggcgacgccacgctcccgatgaggccgtactcagccgtccaccagtagaggcggctcgcccgcgtgctctcgctgacgtagcggcggctcgcgctggcggcctccagccgggcctgcgcgtgcgccgcttcctcctcgctggcgtccgggtcctccttcaccaccgacaggttccggatggcctcgaagacggcctggtcctccacgctggcaatggccttgaagcccaccagcccgcaggccttgaggtactccgcgtagcggcggttggcgatgatgggcgcgtgcccggcgctctcatggacgatgtccggcgccggcgtgtactcgatgtgctcgtgggtgcggatgtccgcggcaatcgccaggacgcccatcgcctggagctccgtgaagacggcgggaggaatgaagccacgcacccccacacaggcccaccccagtcgagcgagcttctcgttcatctcatccaggctggggatgcactccgagccgatgcccgtggcctccaggccctccaggtagacggggtgcgccttgtccgccaggtggcccctcaaggagcccaggatattccgccagacggcctggtcccgcgacgtatacgccgcgtagtcctggctcaccacgtagcgacgcagatgagcaggcaggcgggcaatcgtccgttccgtgggagtcatcatcattcacctcaggcggaatcttctacttttcgaaagatatcctttctccaggcgaacggaaatccgtcagaaatcgacgtcttcgtcgttttaacgtcgaactagcctggcttgcggcgaagtccatccagaaccaaccgggcgccggggctgagcgctcccgaaggccacaaggccaccacctcgaccgcctggggctcctcttccaggaggggccacgcatggaggtccggtggaaacgggtgcatggggcgcaggtccggagtgatggcgcaggcgcggaacgcgcgcagcaactcgtagaggagaaggaagctctccgcgcgccccacttcatccaccgtcacgccgtgggcggcgaagcgggcgctgttggcgccgccgtaggggtcatcacgcagccagtccacgaagcgctgcccctccaggtccttcacgtgcagcgacttccgggacgcggcctgccgcgcgagcgcgttgtccggcccagcgagcacgacgaagggcatgcgcagcagtgactccgactccacgccttcatgggtaggcaggggcgtgaagtcgagcgccaggtcgagctgccgcgtctgtacctggcgcgtcagctcgtggggccctccgaagctgagcaccagcttgaggtccgcggcggcggcgtccctcgccacggcgcccaccagggacaaggacagcgtcgggttgaggcccagccgcaccacgggctcggcgctggccaggtcgcgcagccgcttcatgtccagttgatgcagcggcgtctgggtgcccgcgaagagccgctccccccgggcggtgagctgcaagcgacggccaggcccgcgctccaacaacggcgcaccatccgccagcgccagctccagcgagcgaacgtgctcgctcaccaccgagcgcgccacgcccaggtgctccgcggcggcctcgatgctgcccgcctccacggcggcggcgaaggactccaaccagacgaggtgccgaacgagcttgcgcggaggcatgagcagcatccttgcacgccgccatcagcgggatacgcccccggacttcattgatgcttgcgaaagtctggcatccggaatacctgcgccgtgcaatgtcacggatgtctgacgcggcgtcctccgcagccgccattttcctccagcgcttcgaagcagcccggccctacctgagcaccgcgctgacctggtgcgtgctccacgggctcgtcgcattgctgtacttcggcggcgcgctgcgcgtggccgtggagcggctggcgccgggactccgccccctcctgctcgcgggaagcttcgcccaggcgttgttcctggggctggtggcctttcttggaaccctcccgctggccgtcctgctcggccaccgctaccgcttcgcgctcccggtgctgacggcggtgggcggcgtgctgctcgggctggacgcgctggtgctcaactcactgggcttccacatcaacggcctggtgctggcggtggcgctccagccgcatgccctggcggagacggggctgtcttcgtcggaggtggcgctggtggccggagcgatggtggtcatcctcacgctcgacacggcggcgggcatctggttcctgcgccggggcttcggccctcgccgggtggcgcgcacggtggtgctgatgacggccctgtgcaccatcgagcggctggtcaccgcgtccctcatcttcgcccatggcggcgccgtgcagcacgccaccaccaccctgcccctccaggcaccgttgcggatgaacaccctcctctcgcgcatcacgggcaatgcgcccgcatccggcctgcgcctgggcgtgagccctgaggcgggcgtgcccgcggcgagcatcgaccccgcggcggtgcgcttcacccgccgtcccgacatcgtcgtcgtcctggtggagagcctgcgtgacgacttcttcaccgccgacgtcatgccgaacatgtggcgcagggcgcagagcggcacgcgcttcctgcatcaccacagcgcggccagctccacggactactcgctgttcagcatgttcttcgggctggaggcccagcgccgcaatgccgtggtgggcgcgggccgcacgcccctcctcttccccgcgctggcccacaatggctaccagcagttcttcttcgccgcgtcctccgttgactggatgggcctcaaggacaccgtcttccgcgacgtgacgggaggcctgcgcacggactacacgggccgcagccacctgcgggacgaagccatggtccgtgacgcgctggcggccgtggaggccacgcctcaggacaagccgctgttcctgttcgtgttcttcgccggcacgcacttcgactacgactacccaccgcgctccgaggtcttctcgcccgcctggaatggcaagggcggactctccacggcgcgcgtgcctcccgagcacctcaaggcccgcgcgtggaacgcggcctacgaagtggacaccaaggtcgaagagctgctggcgcgcatcgaaagcttgcgcggcgcgcgtccgatgacgctcgtcaccggcgaccatggcgaggagttccgcgagtacggccgcgtcggccatggcagcgacgtgacggcctcccagcttcacgtgcccatgctcgtgttcgacgaccagcttcccgtgggccaggtcgacgccgtcaccggacacatcgacgtggtgtccacgatcttcgacctgctgggagacacgcacagccccgcgatgctgggtgacggcattcccatgtcccggccggacccgcagcgatacctcctcaccaccgtgggttgggaggcgcgttacgcgctcatcggccaggagctgaaggtccatttcggcgcggggcggcctggcaccgtcatcaccgacctgcgcgaccgtcccctggccgatggcaaggagcgcctcgcggccgaggccccgcgcatcctccgccgactgagggggacgtcggagtcgacgcttcccgacgccgccacggccacggacgtgccctgacggtacctcgcggcgggccctggggcggtgctcacacgcgccgcttcagaaccggagcttcacgcccagggccagcgtgaagagttcgacgttcacggtggtgggattgcggatgaactgcaccagccggtagtcggtggcgacgagctcgaagtacccctccacgaatcgcaggttcagcgcctccaccgggcgccccgcgctggcgcccagcagcagcgcgggccggacggcggtgcggaaccagtagtagccccggtcgtaacggctgggcaggcccgcgaagtagtcgtcgcccaccgtgtagctgagcatcgcgcccaccatgagcgggcggacggtccactccgccgcatcgagcaggaagggccgccactgccccttcaacgtgaaggtgaagaagtcttcccccgccaacgcgggcggcgcccagcccaccagcagcgcggcctccacggtgtcgtcgagaaagctccagcccggccccgcggagagaaaaccgatggcgcccgcgaactgcatcgccgcatggtcgggcacgtaccagggtgacgcctcgtgcgccggctccggccgcgcctcccgcgccgccaacagcaacgccgccagcagcgaggctcggagactcccgtgcgcggccatcagaaggtggccctctgcacctgcaccgagctgccatcgacgtccacccagaggtagctccggcccttcatcgaatcggtggtgacgtaccggacatcgtgcgcatggacgtcgtggtactggtggacgtggccgtggaaggagatggcgacgccctgcttctgctggagcttcaccaagggcgcgacgagcgcatcgtcaaagtccccgttcccaggaggcacgtgggagaaggtgaaggtgttcagcaccgcgggctccggtgcgagcgccgtcttcagccactgcaggttcgggatgtcgcccgggaagccgtactcgcgggagttggagtcgaagaagacgaagcgcgtgcccgaatacgtgaaggagaaggactccggtccgaaggtgcgccggtagagcttctgccccatgcccagtgcgtcatggttgcccatgaccacgaagaacgggaccttcaaccgagacagcagttcgacgccccactcgtactcttgcgtgctgccgaactccgtcaggtcgcccatctgcaccacgaagtcgacgccgcgctgctccaagtcccgcatcgccgccgcggagtcatccaggaacaactgcatgtcgcccaccaccgcgaagcgaaaggcctgcttcggttccgctccgaacaaccgctcgagcgagcgcgcatgcaaatcccggtggggtccccggagttcataggggtggaactcgaaggcgccacagcccgcgcccaccagtagcaatgtcacccagacgcgcacgaacgcacgctaacgtcggcctcccgatgcttccatggaatgtgacgccggattcaggagcacgcggcgacaaggagcagccattctcacgcgccatatgaaccggactcaggcgacttccagcagccttctcgcctcgcgcattttggcggtgccgtgagcgcacctctgtcgacatgggagctgctgcattgggtggccacgaagcccacccggagcacgcgggaagacctcgacgcactgctcgcgcgagtggatttcacgcaggtcgcccgggacgccctggcgtcgggcacctcttcggagaagaccacggccctgcgagtgctccgggagctggcgtcacccgaagcccatgccctggctcggctcgcgcttcgcgacgaagcggctgacgtccgggccctggcggctcgggtgctggcgagcgcacaggacgctgcggactggcggagcctccaggaggcgctggatgataccgagccctccgtgcagcacgccgtcatggactcgctcgcgaggatgaatccggcggccgcgagcgacctcttcatcgagcgcttcgagcgtgccccggaggcggagaagctgaacgcgctcgccaccgcgcaacggctggggctccccgaatccggcgccctggctcggctcggcctggcttcggcctcttccaccctcaggaccgcggcggttgccctgctcgcgcgagaaggcgaggcgacagagggcctgctcatccaagtcctcacggatgccgccgaagacgtgcaactcgaagcccttcgcgcgctgtcccgtcgcgcacacgtgcccgccagcgtcttcgtcccgctgctttccgcgtcgtccccattacaagtccgcgaacaggcgcttcagtcgctcgtcctgcgtggcgacgccagtgcttgcgaacccgtttgccggctcctgaccgaccctgattcttcactccgcagaagcacgattctcgccaccgcacggctcggctgctccggtgcgacgcgcgccctgctggagatgctggcccggacacgcgacgaagatgaacgggcggacctcatcaccgcgctcggacaactcggtggacccgaggcatgggaggcgcttcgccaggcgctgtcggatgaatccctccgcgtcaggcgcgccgccatctccgcctggacctcggacgccgcaccgccagacgcaaccccggtgctgctggagcgcctgcgaggcgcccccgacacagaaacgcggaaggccgttgtcctggccctcatgaacagccgcccggaggtggcccaccgcgccctgcggcttgcgctcgaggactccgcgcccgaggtccggcggatggccgtgcgagacctgggcctagaggccagcccagaggcccttcaaaccctgcgcgaccatcaagccaccgaacgtgacccggacgttctgcggcacctggacgcggcgctcgaacgacagcaggcccctgacgacacgcccgtctcagtggcctcacccgccgaacgtctcttcttcgacccggcgcgaacgggacagagcgtggcggagtggctcgcggtccccgaacgctaccccgcgaccgagcgcttctacttctacgaaggcggacacctggagcgactgggcaccgacggccgggtccacgcctttcagtacaccgctctcggagaccaactccgcatccaacccgagggcgcccccggccgaagcacggcattcaccgtgacgcccgagccgccagcctccaacggcatgccacgccgcttccgcctggagctggcccgggacgtcctctccagcacggacacgccacgaacgctgcacttcatcgagcccgtgccagccgacccggagccggtcgacagccactgattcgccggcccgctacgcagcggcggacgaggcgccttcccagtcctcgacctcgtagaggaacttcgaatcccccatcagcttccggttggccgacgtgctctgcacgaagacgacgtacttctccaggctggcgggccgaatgcggaccgtctccccgggcggaagcccgagcatctcccgggcgcggtctccgctgaagaggtcacccgtcttccggtccatgagcaccacttccttccggccctggatggtctccgtcttggtgaactcgtagaagccccggcccgtcttgaagcgcaggccgttctcctgcacgaagtccttgatgggctgggtccggtccacgtccagcacctggaagcggcccggtggaaccgcgcgcaggtccgcctcgccgtagagcggcggcgccgtgcgctggagcatggtgctgaacatcacgttgaggccgcggctcatccggccctcgcgcaccacttcctgctcaaacgattgaagctgtacatccgaggactgcttgtagcagacggccagcagcaggtcggtgacgtgggcgaactggtccaggctcaggtggaagccgcccgacttctccgccagctccttgtagaaggccgtcgcgtggcggcgcgccagggcttgcacgccatacacgggaatgcccatcttccccagcgcggccacctccttgcgccagtccagcttgtgtggattctgcgcgggcccgtggggaacgtcgtcgccaatcaagaccagcgcccgcgtgtaaccaaccgtccaggacaggctttgcgcctggcgaagtacgaactcgtagcattcgggcgcgtcccccccgcccgtgtgctccacgcggtccacgaagcggacgacggcgccctcgtcgtccgtcaggtccagcatcttggtgacatacgtggagcccgcgtcgcagtagtccccgtgggcgatgattccaatgcggatgcccggaatctccttcatcagccgggacacggtgccccgcagcttcttccgtacctgtgcaagacacggatacatgctgccggtggtgtcaaagctgaagacgatttcgacgcggttatcaatgactgacgtgctcattccggtgcccccctcgtgaccgccgatgaggacaaatctacgcgccgggtctgacatgaatcaggccaggaaacggggtgctggccgggcctccgtcgacccggcgtcacgcatttgcacctgccgcttgccctgaacgccgcgtgaccgcagcatgcgtgcccatcgtgtccgccaccgccgagcccccatccccgcatcgcacgtacaccgagcgccgagccgccgcgcaggcggaactgaccgcgctggaccgcgtgagcgcccgctacgccaacttgcgaacactcgccttcctggccgcggccggcgtcgcgggcttcgtgctggcggggcgtctgcccaaggtgtggtggtgggccagcgccgccgcgctggtgctctacggcgtgctcgccgtcctccaccaccaggtcttccgccgcgaggcccgggcgaagctgtacgtgacgctcaacgaacgcggattggcgcggctggggcccggctggcacgacttcaccgagcgcggtgaacgcttcctctcccccggtcacctgtacaccccggacctggatgtcttcggacagggaagcctcttccaactcctcaacgagacggccacgcgcgctggagaagaacggttggcggcgtggctctccgcccccgcgtccgcccaggaggtcgaagccagacagggcgccgcgcgcgaactggcgcccaacctggacttccgccaggacctctgcgtggacgcgcgggacgcctcgcgcgagaaggcggacccggcgctgttcatccagtgggcggagtcgggtccacagctgaatgccatccgctgggcccgaccggtggcggtggtgctgcccctggtgacgctggccgtctacgtcctgggcaagttcgaggtactgccggagtcggctttctgggtgggcttggccgcgcaactgggcgtggccgtcatcacccgccgcccgctgaaggtcatggacgaaggcgtggaggtgggtgagcgcggcttcgtgcgctacgcccccatcttcgagcgcgtggaggcccagcgcttcgagcacccgcgactgaagacgctccagtccggcctccagcagcccggccagccgcccgtgtccgagcacttcaagcgcttcagccggctgttctccttcatcgagttcaagcgccaccagttccacccgctgattcactggctcacgctctgggacatccacgcgcacttcgcgctggagcgctggcgcgaggcccacggtaagcagctgcgccagtggttcgaggccctggccgaactggaagccctgtcttgcgtcgcgggcctcgcccatgaccggccggacttcacctggcccgtcttggcggccaatggcccctgtgtggaggcgacagcgctgggccacccgctgctggacgctccggtgcccaacgacgtgtccctgcccggtccccggcacgcgctgctcatcaccggctccaacatgagcggcaagacgacgctgatgcgcgcggttggagccaacgtggtgctggcgttggcgggcgcgccggtgagcgcgaagcacttccgcctgacaccgctccagacgctcaccagcatgcgggtgaaggactcgctggagcgcggcgtctcctacttctacgcggaggtacagcgcatcaaggcggtgctggacgcggcgcaggccgcgcgcgggcaggtgctgttcctcctggacgaaatcctcctggggacgaacacccgcgagcggcagattgcctcgcgcgaggtgctgcgcctgctgctgggcaccggcgccattggcgcggtgacgacgcacgacttgtccctggcggtgctcgcggacgagccgggcgcccatgtcgtcaacgtccacttccgggaccacctggaggccgggaagatgatgttcgactacaagctgcgccagggcgtggtggacaccaccaacgccctgcgcgtgctgcgcctggccggcgtaccggtggacgacccggacgaagccacggcggcgcgctgagcccgaaacgcaggcccgaaacgacacgggccccggggtttcccccgaggcccgcgcttgaatcagtgacttgcgtcgaagcggtgactacttgggcgcctcgatgagggcggcgaagcccatgccgccgccgatgcacatggagacgacgccgtagcggccgttgcggcgcttcagctcgcgcaggatggtggccaccatgcgcgcgccagagacgcccagcgggtgacccagggcgatggcgccgccgttggggttcaccttgtcggcggggatgcccagctcgcgcacgcagtacagcgcctgcgccccgaaggcctcgttcagctcgaagacgtcgatg

SEQ ID NO: 1200 - DNA, 24986 bp, Myxococcus xanthus
ctctacgacggcagccccgcgtggagcatcaccggccactaccgcatcaacggctccgcgccggccagcttcgatgtggcgggcgcgcccgtcaccggcaatggaccgacgctggacttgcaggagcagggcctgttggagctttggttcctcgtgtccagcccgggctgcgagcactacgactccaactacggcggcaacttccagttcaacgtcctggaggccagcgccacgcccatggcgacgctcgtgttccagcagggctgggtggagcacgtggtgggcacgccgcgccagggccagcccttcatcgtggactacgacatcgcgcgcctgcccgagtgccggctgctctacaacggcgcgcctacctgggacgtgggtgtgcgctggcgcttcaacaacggggtgatgggcgagaagagcgtcaccaccaccagcggctatacgcgcactggcacgcccgtcaccatcatcccgcccgtcggggccacctccgtgcagatctggttcgagaactgggaccgcggaacctgccgccgctgggactccgactacggggccaactacacgttcaccctgcagccgtagaccgccaggcggcatcacccacgttccggcccgaataccctcgcactgtgagacgcgcccggaccggaacatgggtgctaccctttgcgcatgagtttcttccaggacccgccgaggctgggcaatcagtacgacgacgatgcgctgctccagagctacctggcacgcaccctccccgaggacctgcggcgcgcgctgacggatgagttccgcgagttgggagagctgggcggggattacttctaccgcttccagctccgcgaccggctgaacgagccggagctgacccagtgggatgcgtggggccagcgcgtcgaccacatcgaggtgtcgccgctgtggaaggaagccgagtccctggccgcgcggcgcggactggtggccacggcctacgagcagaagaacgccgagctcagccgcgtccaccagttcatcctcaactacctcgtgcaggcgtcgctggacgtgtactcgtgcccgctggcgatgacggacggcgcggcgcgctcgttgctcacgctgggcaatacggcgctcatcgaccgcgccctgccccacctgacgtcccgggacccggccacggcgtggacgtccggtcagtggatgacggagcgcaccggcggctcggacgtgggcctcacgcagacggtggcccggcagaccccggagggctggcggctgtctggaacgaagtggttcacctccgcgacgacggcgcagatggcgctcacgctggcgcgtccggaaggcaacggccccggcggcaagggcctggccctgttctacgtggagacacgggacgcggccggaagactcaatggcatccagatcaaccggctcaaagacaaactcggaacgcgcaaggtgcccacggcggagctgaccttggatggcgcgctggccattcccgtggcggggctgacggatggcatccggaacatggcgtggatgctgaatgtgacacgcacctggaacgcggtgggctccgcatgggccatgcgccgggcgctggccctggcccgggactacgcccagcggcgggtgcagttcggcgcgaagctggcggacaagccgctgcacatggacaccctggcggggctggaggcggagtttcaagcggggttcctgctggccttccgcgccgtggagctgctgggccgcatggaggcgaaggcggccaccgagcaggagctgctcctgcagcggctggtgacgcccctggcgaagctgaccaccggccggcaggtggtgcacgtcacctccgaagtcacggaggccttcggcggcgcgggctacgtggaagacacgggcattccgcggatccaggccgacgcccaggtgctgtccatctgggaaggcaccacgaacgtcctctccctggacaccctgcgcgccctggcgaaggaaggcgcgttggaggcgttcttccacgaggtggagggccgtctgggccagacccgggacgcgggcctgcggccctgtgtcgacgcggcccagggcgcgctggagcacgcgcgggcctgggtggccggtgccatggaggaccccgccaccctggaggctggcgcccggcgcttctcgctgacgctgggacggacgctggagctggccttgctctgcgcccatgcgcagtggtgcctggaccatggccacggcccccggagcaaggcggcggcacggcgattcgcctcgcacggcgtggacctcatccaaccggccgcgagcctggaggatgtccggctcctggcctgaggtgccacgtctggcagcggcccgaaacaacacgacgcaccaagacaccctcaatcatttacacgcaattcctatcccaggggccgccctgcccctccctccggggcgggcacccttgaaggcatacggacgtcggttcgcagacggcgtccctcccctcaatccgagcccgcacatcacctgcccactcccaaacccggcgcctgtgtaacacatcacgcttcaacgggagacctgatcggccaaagacatactcgcgaagagatagaaaaatcagctgcgaaacgcatccaccatctcgaatcatgctcgacatgcacacgatgcaatggcgaagcttggacgagatgatggtggggctcagaccaccagagaactgctgcctcgagcagctctcgcgggactccgtcgttcaggtcacggcgcttctggggaaatggtacccggatatccgggtcggcacggagagccggcacctggagcccgctttctatgatcagtgtgtctgtatccagggcgagtctccggatcgcccggtgtatgcgattctgggaagggatcgggacacccaggaagtcatcgggctgctgacgctggagaagaacgctcgcggcctgcagttgtctgccgcgatgggggccgttgaaccctctcagcgaggcctgggcctgggccagttcggcatctccctgctggagcaggtgggccgcaacatcggcgccgaggtcgtcctctattactccaccctgaagatggccagggcgcagcgcaacgccgagcaccgcggcttcaagctggtgggactggtgcccgcgttcgatgtggacgccatcgcgcccaacacggtgaagcgcgtctacgaggccatctacgcgaaggtgctcgtcggtccggagaagatccacctccccgactggaatgccctcatccccaccacgcgcgcgctgtacacgcatctctttggccagcacccggccgccgccatcctggagaacaggaacggcgtctccattcctgcctcggcgccggtgcccatctccgcgcccgaggcccaccatggttgaggtccgcgccttcgaaggcggcgccaaggaagcgtcccagttcatcaacagcgtctggcagcgcacctacggcgcgaagatgggactgacaatctgggacgagcgtttcttcgactggctgctcttcagcaatcccctggcggaccgggactatctgctgggagcgtattcaaagggcaagctggtgggggcattcctggcggagcctgcgaaaatccagcttggccagcggcaggtggatggcacctacgggagctgggtcagcgtggcgccggagagccggggccagggaattggcatcaagctgtcggacaccatgcaggcacgccaccgcgagcgtggcgccgcgctcaccttgagctgcgtggccgacggcaccctgggccagggcttctggagccggcggagccacacgcgctacctcaacaacctgggcatgtggctgcacatcttcaacacggagaaggcggtccgttggtcgctgagcgccgccgagcgcgcgttcctcaccttcacgcgtccgctccaccgccgggacttcctggcggcgcgcaccgacaacattcgggcctaccaaccccgggacctgccgcagtgcatggccctggtccagaagatgatgcggccggtgaacctgggctacgcctacacctcggagcgcctggcccaccagctccagttccgtgacatcccgcacaccttcgtcctggagcgagatggcgtcatccaaggcatggtcaactactacaccctccagatgacggcccgaggcctcctgacgacgggactggtggacctgctcgccttccaggacgggctgcccttctcggagcaacggcggctgctgtgggtggccatgcaggacatggtggcccagggggccgactgcgccgcgatgctgcgcagcccgtgtacgcccacgcacctgatgctgcgctccgggtggttgccattccccggaggctcccgggtgacgtgcctgctcaccacccccgacgtggagctgcccgcctcgccccgggtgttcatgcacctgcgctgacgcagcgcgcgaagctgaagccctgtggttcagcgcagccaggagaaggcgcgctcgagcggggccacaccctcatcgaggtagcagcggccgtgcgcgaggagcacccgacgaggctgccatgccatcatctgctggtagcaggcgcgcgcctgcgcggtccggccccaggtcgtcacccgcacctcgcgtggcgtctgccccggccacatcgtcccgccgagcgtcagcagccatctcaggcgaggccggagacgctcgggctccaacgccatgaccagatccgcgagaatcaaggtcgaggactcaccgtggaagaacaccacctcttccacgaagcgactgccccgaaagatgagctggcccaactccgtggaccaggccgagggcgcggcgtcgtcgaggtcggcatcgaatgggacgtccatctgctgggagcgcgcccgctcgcgaacgcccggagacgcccaggccgtcgcgcgcggatagcgtgccttccaggccgggatgcccgcgtagtggaaccggttcggagagacgagatgttccaccgtgccgagtgcgtcgacctgttcgaacaactcgggcgtgggtgccgtgggcgaccagagccacaagcctcccgtacccaggcgaacgatgaccatgcgcgtcgggaacggcagggagacggggcccacgcgcatcctcgccaccggcccgtccacccaccagacgccgtccgcgaccggcttgagggtggaaagcggcacatagggacgcaccccatcgttccattcgaggtcggcggtcatcacccaggcagcgtaccccgctgaccatgcaatgacgccactcgactggacttcacgttcgtcaccttgccggagcgctccaggacgccttctcccaccaggaagagcgcgccatggatgtccttgcggcaccgctcgtacacgtccggaggcaccaccaggttcgcgatgcccgtttcgtcctccagggagatgaagcagagccccttggccgtgggtggacgctggcggcagatgagcatgcctcccaccgccaccctccgcccgtgggccaccttcttcagtccctccgccgtcaccgcgccttgctgcttcagcaccgggcgcagcagctccagtgggtgcttctccagcgagagtcccaccgtgtcgtagtccgcgcagacccgctccagcacatccatggacggcagctccaccgccgttccgtccatggccatgccgaagaacaggtcatccgagtccagcggccccagcgcctggagttcccacaacgcctgacgccgggagccacacagcgacgacagggcgcccgccaaggccaaccgcgtcagctcgtgcctgggcgcccgcgaccaccgcgccaggtcgcccacgtcacggaagccctcgcgcttcgccgtcgccacgcgccgccccgcggactcgcccaggcccttcaccatccgaagccccagccgcaatgcagccccgccctcctccagcgtgcagtcccagctcgagtgccgcacgtccaccggccgcaccaccacgccatgcccatgcgcgtccgccaccaacgtgtgcggcgcatagaagcccatgggctgcgagttcaacagcgccgccgtgaaggccgccgggtagtggcacttcagccagctggacgcatacgcaatcaacgcgaagctcgctgaatgactctccgggaagccgtagtgcgcgaagccccggaagttgtcgaaccactcctcggcttgtttgcgtgtgtacccccgcgacacgcagccctccacgaagcgcccccggtattgcagcagcatggattcggcgcgcttgtggctcagcacccgccgcagtccgtccgcctcgcccgcggtgaagcccgccgccaccatggccagcttcatcgcctgttcctggaagagcggcacccccagcgtcttgccgagaatctccttcaccgcctcgctcgggtactccacctgctcctggccgttccgccggcgcaggaagggatgcaccatgttgccgacgatgggccccgggcggatgagcgcgatctccaccaccaggtcgtagaacgtcctcggccgaagcctgggcagcatgttcatctgtgcccggctctcaatctggaacacgcccaccgtgtccgcctcgcacagcatgtcgtagaccttcgggtcctcggccggcaccgtcgccagggacagctcccgcccgtggtgctcgcgaatcagcgcgaagcacttcgacagcgccgtcagcatgcccagcgccagcagatccaccttcagcagccccaccgcgttgatgtcgtccttctcccactggatgacggtgcggcccggcatcgccgcgttctccaccggcaccagctccgtcagcggctcgcgtgtcatcacgaagccgcccacgtggatggacaggtgccggggaaagccctccagctccatggccagcgccagcgtcttctggacccggccgtcctccgcggacaggcccgcctcgcgcagcacgtccggcgtcacgtcgaagccgttcgacgcggacaccttcgacagccggtccacctggtccaacgacaggcccagcgccttgcccgtctcacgcagcgccagccggccccggtagcagatgacctcgcacaccatgcccgcgtgccgacgcccgtgcttctcgtagacgtactggaggacctcctcgcggcgctcgtgctcgaagtccacgtcgatgtctggcggttccttgcgctccatgctcaggaagcgctcgaacaacaggcccatccgcaccgggtcgatggcggtgatctgcagcgcgtagcagaccgccgagttcgccgcgctcccccgcccctggcagagaatcccccgggccctggcgaagcggacgatgtcccacagcgccaggaagtagccggcgaagtccaacgcggcgatgagcttcagctcgtgctcaatctgcttcaccaccgccggaggcaccccttccggatagcggaaccgcagtccttcgtatgtcagcacgcgcaggtgcgcgtccgcggtgcgcccttcgggcaagccctcttccgggaagcggtagtgcaagtcatccaatgaggcgtggcagcgcgaggccagctccgccgcgcgcgccagggcctccggccggtccgcgaacaggcgcgccatgtcccgtggggacttcagcgtccgctccgcgttgggcaacagccgcgtccccgcccggtccaccgacgtcccgtggcgaatggacaccagcacgtcctgcagggcctgccgccggcggtggtgcgtgtgcacgtcgttgtgcgcgaccaacggcacgccgagctccagcgccagccgctccgcccgggcctcgcgctccgcgtctcccgcggacagggtccggcagatgccgacgtggaagcgctccgggaaggcctccgccagcgagacgacctgctcgaagggcgcgggcgcgggaaggagcgcgagcagccccgcggaccggtccgccaccgcgcgccacggcagcccggcctcgcccttggggtgggtcatccggctctgggacaccagggcgcacaggttcgagtaccccgtcccatccgccgcgtacaccaccaccggtgggccgtcctccagcgtcagctcggcgcccaggatgagccgcaccccgtgctccttcgcggccaggtgcgccttcaccacgccgtacaggccatccgcgtccgtcagcgcgagcgcacccagcccgagcctcgcggccgtggccaccagctcttccggatgcgaggccccgcgaaggaacgagaagttggagcggcagaccagctcggcgtagtccacgcccggatctagataccgaacaggcgttcaggcgctagattggatcttcgcggtgcgggcaagcaacttcatgggttgacgcggatgagggcgatccatgcggggtggcgactgctgcttgccggacagagcgcgcggccccctccttcagggcaccccaccaggcctggcaaactcatcaggcgccgcctccgtcttgtgacgagcttcgtgaatgtcgcatccgcgcagcaagtcctgcacacccgcgaggccgggcaaacctcagggagttaagcgacctgcgctccacccaaaagcctgagctgtgatgtttgaagctcgcgccgccgccgtttgacaggatgccgatccgactgccaaacatgtcttcatggacctcactcccaccgcgtggcagctctggctgatcgcggcgctcctcctgggagcgctggagctccagctcaccagcttcatggtcctctggctcgccgtgggggcgctggcctcctcgatcggggcggcgttgggcctgagcctcaacggccagctctacctgttcaccgccgtctccgtcgccctgttcgcggcctcccgcaccctcttcaaaagcgttttcatgcgcgacgcagcgcatttgaagacaggtatcgaggccatgcttggccaggaggcggtggtggtggagtccctgggcgatccgctcgggggcacggtgcgcatcaatggcgagctgtggacggcgcgctccctgtcgggcccggtgcccgagggcgaactcgtcacggtggagcaggtggaaggtctcaaactctgggtgcgccgaccgacggcgtcgttgccggttccctcgggggacccgaggaaggagtaggcgggatggaaatcgtgacgattttcggcatcttcgcggtcatcctggtgggcatcgccgccaccggcatccgcatcgttccgcaggccaaggtcatggtcgtggagcggctgggcaagttctacaagaccgccagcagcggcctcaattacctcatccccttcgtggatgccccccgcgccatcgagatgcgcacgggcaaccgcttcatgcgcagcaacctcgtggacctgcgcgaacaggtcatgggcttcgacaccgtccaggtcatcacccacgacaacgtcaacatggaggtcggctcggtcatctactaccagatcgtcgagcccgcgaaggcgctctaccaggtggagaacctcgcgctcgccatcgagcagctcacgatgacgaacctgcgcaacatcatgggcgggctgacgctggaccagacgctcaccagccgcgagacggtcaacaccaagctgcgcatcgtgctggacgaggccaccgagaagtggggcgtcaaggtgacgcgcgtggagctgcgcgaaatcgagccgccccaggccatcaaggccgccatggccaagcagatgaccgccgagcgtgagcgccgcgccgaggtcaccaaggccgagggcgacaaggccgccgccatcctccaggccgagggcgagaagatctcccgcatcctccgcgccgaggccgaacgcgacgcggagattgcccgcgccgaaggccacaagcgcgccaccatgctgcaggcggaaggcaaggccgaggccacccggctcgtcttcgaggccatccacaacggccgcgccactcccgaggtgctcgcgctgcgctacatggagaccctccaggagctgggcaagggcgacaacaagattttcgtcccctacgaggccaccgccacgttgggcgccgtcgccaccctcaaggaggtcttcgcccagactggggatgccgcaaagcccgccccggcgccggcccgctccgccgcgagcctgagcggccaggccattgcccggaacacggtggtccccgagcacgccaccctccccggcggcacgcccgccgtggcccctcggcgtccgcggcccgccctggacacgcaggacgactgagcccaggcgtaggcagcccccgcgggaggaagacgcctcccgcgggacactgagcagggctcgcgttcgcgcatccaggacgacggtccattgcgccaccaggggccgagcaaacggcgtgccctcctgtacaccgcagcacgcgcagtcacttcaagggaaccttccctgtgtccgagtgtcagagcctctgaacacactcaccggagaggagcacgcagaacatcttcttcacaggaggctggaggatgtaccccacgttgctggcgggaatacttctcatgggagccttgatacggtacgcatgccgaccaggggcgggttacgtgccgctgaagctatgcctaggactttgcaccttgatagcctgaactcttgtttttggcacggacatcctataacttgtgcaggcctatagcgggccgctgcgggaccagggtcctcgcgtgctatacatcggcacctacgaggcgctgcacaacgtggcgctcgccttgctgcttgccatgctgggccccctgctggcgtccatcggggcgtggggggtctccccccggatggggagcttcgcggcgcccgcggcaggttgatgtgtgactgtcggacgcactgccagaggagtgccccctgcctccatgaaggcgggggttgcattccggcacgcgtctggacatagattgcagccatccccaggagggattgacgccccctcccaacgagaggtcagacgcacccttgaggacgcttcgctgaattcccaggtccgttgatgttcccgcgctgagccgccttcgggctggcttgcgccctggattcaggagtttcctctatgtcttccgtgcgcgcgcaccgcgtttcgttcgccttttccgacgccgttcctgtcctctctgaagtcgacttccacctgtcccctggctggacggggctcgtgggtgccaatggcgccggcaagtccaccctgctccggctgttggcgggagagctgacgcccaccgagggacaccttcagttcgagccctccacccccaccctccgcctctgccggcaggaggtggaggcgctgacgcccgacatctccgccttcgcggagtcgtgggactccgtcgcgcggcgactgcacggccaactgggcctggacgtcaccgcgctggagcgctggcccacgctgtccccgggcgagcgcaagcggtggcaggtgggcgccgccctggccgcggagccccatttgctgctcttggatgagcccaccaaccacctggatgcggaggcccgcacatggctcatctccgcgctgcgccgcttccggggcctgggcatcgtggtgtcacacgaccgcgacctgctggagtccctcaccacctccacgctgcgcgtccaccacggcagcgcgcggctgtggcccggcgcatacaccgccgcgcgggcgcactgggaagccgagcgtgaggctgaaatcgccacccaccagcaagcccgcgccgaacaacgccgtgcggcgcatctgctggaccaggcccggcgcgaacaacagtccgcggatgccgcgcggcacacccgcaagcgactgaagaacaaacacgacaacgacgcccgctccatgggcgccaaggtcgttgccggctgggcggaggctggggccggacggcgcgtgggcatcgcacggcgcgagttggagcgcgtcagtgaggccgtgggcgagttcaccgcggacaagacggtgggccgctccgtcttcctggactacgtgcgcgcgccgaacccgtggctcttcacgctggacgtgcccggcctccgcgccggtgacgtggagctgctgggccccgtgaatctctccgtgagccgtgaggcccgcgtgcgcgtcgaagggcccaacggcgccggcaagagcaccctggtgcgcgcactgctggagaacgcgcgcattccgctggagcgcgtgctctacctgccccaggacgtcagcgcggacgaggcccgggccacgctggacgcggtgcgcgcactgccgcccgaggaacgcggacgcgtgctgtcactcgtcgcggcgctcggcgtggacccggagcggctgctcgcctccgagcagccctcccccggcgaggtgcgcaagctcctcatcgcccggggactggggcaacacgcctgggccctggtgctggacgagcccaccaaccacctggacctgccgtccatcgaacggctggaggcggcgctgcgggagtaccccggcgcgctgatgctcgtcacgcatgacacgtccttcgcccaggcctgcacctccgaggtgtggcgcgtggagcatggccaggtgacggtgacgtccgggtagccggcacggaggccccacctcgaggcacgttgaagacgcccagccacgtctcgtcgttctgcctcaggtgcccgactgttcgtggaaccacgccaccagtcgtgtcagcccctcctccacggagacgcgcggccggaatcccgtctctcgctccagcgcggaagggtccgcccaggtcgcgtccatctccccaggctgcgcgggcgtggacttcacccgcgcccgggcgcccaggatccgctccaggacagagaggaaggcccgcaccgaaacaggctcgccccggcccacgttgaggacgcgatggcgaggtgcccctgggagcggccggtccagcacgcgcaccacggcctccgccacgtcctccacgtaggtgaagtcgcgctgcatccggccttcgccgtgcagtgacagctcggtgccgtcacggatggcctggagaaagcgcaggggggccatgtctggtcgtccccaggggccgtacaccgtgaagaagcgcaggccactggtggggagcccgtgcagatggctgtacgcgtgcgccagcagttcatcggcgcgcttcgtggccgcgtagacgctgagcgggtggtccgccgcggcgccttcctggaacggcggcaccgagcccgcgccgtacacggagctggaggacgcgtagaccaggtgccgcacccgggccgcgctggcctgctccagcacctggaggaaccccgacacgttggcgtccacgtatgcctgcgcggtgcccgccggcgcccgcacgcccacacgcgcggccaggtgcaccacggcctcggggcgcatctcctcgaagagcgctcgcagcgaggggctgtcggtaacgtccacgggacggaaggtgaagcccgtcgcccccggcagcgtgccgagccgcgtcagccgggcctgcttcaacgccacgtccccggacgggtccaggttgtccacgccgatgacggcatcgccgcgcgccaacagccgcgcactgacgtggtgggcaatgaagcccgcagctcccgtgacgagtacccgcatccacctccacgctcccacgccagcccccaacacgccacggcggaagacgtggacgcggcgcttcccgtcccagccacttgcacgtagggtggaggccctcatggtgtccgtgaatcagctccgccccttcgccggtgcctcgctggacgcgttccgggccgcgtccggccctgtggccctcatccagcagcccgtggaactcgtcggccagcacagccggggcctggcggcacgcaccgttggcatggcacaccgcgcgtacatggacgagcggctgctcgccatgctccgcgacttcgacaacctggaggtccacttcctccagccctccgtggacggcgaggagctgacggtcggccgcaccgaggcgtgcgacctggtggtgcccgacccgtccgtctcccagcatcacgccacgatgcgctggagcgccgcccgcggcggcttctccgtgcgtgacgccgagtccatgaacggcaccttcatcaacggtgcccccctgggctaccgcgcccaggtgctgctccacgacggggacaccctggccttcggcgacgcccagttcctctaccttcgcgccgaaaccgtctacgaacacctgcgcctggccagcccgaagaaggcccgctgagccagcccgagcccgaggctcacggaatggcctggatggcctccaccaccgccttgcgcaggtaggagcggaagtccgtctgcgcctggtacatgccaatcgtggagacggtgcgcgtggggttgctccatcgcagcttgccgttgggtcccaccacccccgtctccagcagcacctccgcgcggcccatcagctgggcggacgtcacgtccacccagttcagcaccaccaccactccggcctcggcctcgttgtcctggatcatcgccaccacctcgtgaatggtgggtgacggtgcctgggagatgcgtgtccccaccacctcgaagccccgctcactcagcgtggcctgggcctggctgacgagcaccgaacggggattgccttcccccatcatgtcctgccggtacgtgtaggtcggcagcgagtccactcgggagcccaccaccaccaccaccttgcgcagggcccccggcgggcggacctgacgcggagcgcacgaagcgagcaggaggcaaagcaggacggccgcgggacggaggacgcgcatgacgggaaacctgggagacgggtacgaggccactatgctgggccactgggcctcagtcgaacagtccctggaggtagaaacgtccatcccgtccgtcgcggaacacccaggcggggcccagcccctcgaagtggacccggtagtagtcccgttgaaagggcgtctccgaccaccactccccgcccagccgctccggcccggtgagcgccgtcacccggtgccgccggccctccatgcgcgcggccagcaagcgtccggactccgccacttccgcctccagacacgccggctccgccagcaaccgggagggccgctcccgtgaagccgccgacaccgaggcgcgccgggcgcctggctccagcaactccgccgacaggccccggcgcgcctccggaggccggaaggcccgtattccatgggccgcctcgggccggtggaccgcctccaggcccgccgcgaagagcgacgcctcccccaacgtggacgccagccgcgacaacacgacttccagcgccgcgtcgccctccggcgcgtcccccagcgcgagctgctgtcctccgtcctcggagtgctcgtccacccgggcggacacctccgccaccgggttctccagccgcagctcctccagccggtgccgcgccagttcgtgcagcagcttcgcccgcgccgtgggccgcgccagcgtcagcgtcacctgccgttgccccgaggggtccagcttcagcgtgaaggtgagccgcaccgccgcccggcaccgcccggacaaccgtgcccccagccggtccgtcaacgttttgagcgcgaagcgcagcggctcgaaggactcggccgggaagtccagcaccacgcgctcctccaacacctcttccagcgccgcggggacgaagggcgtgtcgtcctctccgcggcaccgcgcatgaacccgtgcgccagccgcgccgccccgggccgccacggcccccacgggcagcgccgccacctcgcccagcgtggtgaggcccagcgcggagaacgccgccccctcgcggccttccaacgcggacagcggcaacggcgccagggcccgagcactgtcccccggagccaccacctccacccggcgcgcgccatgccgagccaccgcgcgcgaggtgaaggcctccgaggccaccaccacgtgcgcccggtaacccagctcggcgcacagcgacagcatccgcgtgcccaggccttcctcgccgtcgcacaggtgcgcggcccccgcgtccagccacaatccatccggggcgcagagctggaagcccggggccagtggcagcagcgcctcgcccagcgccgtcagcgcgcgcagctcgtcctccgggcggtagtcgaagtgccgcagccccggctccagcgcggtggccgccgtcagcgtcatccccgggcgcacccctgccttcagcgccgaggtggaggcgaaggccacgcggcgctggccacgcaccgcctccaccagcgcaaagggacggcccgcaagttccggggactccaccacccggcgctgaaccgggaagcgggtgaggtgcagataggccctgcgcatgtcgtgcctcagtgcgccggcagggccgcgtccagtccctgccgcatgggcggcatgggcgcgtcacggccgggacgctggcccaggatgcccagcccgttgcgcagcgccccggactgatctcgcaggaagtccggcgtgccgtcctccgtgtcctcggccacgtccagcaaccggccgcctccctccagccccagcgccgggtacagcgcgctccacggcagctccgcccgcgcgcccgtgccgccctgccggctgcgcaccacctccaccgaccagccgtccccgtcccgggcctccgtccgcagccggaccacgccgtccgccggggactctggagaagtcagcagcaggagcagcccaccgccgcgcgccgccgcgtccgccagcttgcgcgcctccgccagggccacccggcacgctcgcccgccgggattcatgccgcgcgtcaggtccagcaccacgcaggcgaaggccccgctccgggccagctgcaccgccgcccagatgcgttgctcagaagcctggggccgaacgatgagcagccgctccaggtccacgcccagggccgcggccgagggcgagtagagctcccgggggccgtccacccaggcgcacagccgcgcctcctggtgcgccgcggccaccgcgtgcagcgccaggctggtgcgccctgaggccgcctcgccacacagctccaccacctgccccagtggcaggccccccgtcggcagcagggcgtccaccgccgacaggcccgtgcggagcaccgccaggtagcgccggggcgctgcctgcaactggcggatccgctcccgaagctgctccacgaccgagcccgtcccctgccccgctcccactcgctgctccgccgcgctcatctcgcctcctcgccaggcccctccggaccggacgaccggcggggcggtcgtccactatcctcggaggtctgacatgcgccttcatgggacgcatggcggtgggtgcgtggatcagacccgctggtgcgggttcacccgggcatcagccggcgcagaggaccttcacttccaccttcttgtcgtccgcgcggcgcaggcagctcgactggaagaacaggcgggccgggtacgcttccgtggaggcctcgtagcgcaggtcgcccgcggccaccgagcaccgctccacctcgtcattggcgcgcgtcagctccacctggaccagccgggggtcgggcaggttcaccacctcgatgctctgcgccaccgtggccagctccgcgatgcgcagcagggtgtcgcggtagttgtcccggcagatggaatcgaggttgtcgagcccctggtcgaacgcctccgccatggcgcgctgccggtggccgggaccgtaggaggtcgggcaatcgacgttgcgcacgaagacaccgtcgggtgtcgcgtcgcggatcagctccgcccgcttgtcggacagcgccaccggaccaatcgtggcccagagcacctgacgcgaggcccccgttgaatcccgaagctgctggaacgtggcgaagtactcctccaccggcgtcagcagatgggactgctcactgcagttgtcaatggacgtgtcgtcggacacccacaccggcggagggcgctggatggtgctgcagtcttcctcgtcggtgaccaccgccaccagcaggcgcgcgccgtcgcgcaggaagccggcgttgccgttctccgcccccggcgtcgacaccagcggctccgtcacggccagccggaccgcttcgaagggcgtctcctgcccgctgccatccgtcccctggatcaccagccggcggaacttctccagcacgtacggatccgtcccgtcgatgaagcgctcgtcggtggggttgcccgccgcatccggcacgcgctgcaaccggccagactccttggcgtactctcggagtgtcgtctgcccctggaacatggccagccggtacacggacgtggtgatcacgcccacccggaagtcctgcgagacgccgctgccctccttcagcgcctccaggaaggcgggcagctccgtggcgatggcgttctgctcctcttccatggatccggagttgtcgatgacgaagaggatgtccgtcttctgcggcgcgatgacgggcgactcgctctcgcatttgccgggcaggttggagcccggttcgtcgacgggcgaccggcacgacgtccacaagagagacggcagcaggagcaggtgggcgaagggtcggagcttcatggggggcctctcgaagagctgcgcaccccggcggggcgccgcgtcagatgctaggggggcgatcatgccccaccctacgtccggacgcgagacttccgaggaaccctggagaggtgacggggggcggaaaaacgcacactgcgtttgccatgtccgttttggttgttacgttggttcatccgccgcagaaaacctggaaatgttcactggttgtcgaagagaaaaggctgaatttcatgtccgatgagaagaagaagggctccgctgcgagcgctatgcccaccgcgatggcccctccggggctcatcaacaaggaagacatcccgcaggtgcttcccatcctccccctgcgcaacagtgtcttcttcccgggcggggtgcttccgctggccgtcggccgccagaagaccatcgccctgatcaaggacgccgtgcgtgacgaccaggtcatcggtgtcgtcacccagcgccgcgccgaagaagaagatccgggtgccgccgacctctacaccatggggacggtcgcccgcatcgtgaagctcctgaagatgggcgaggacaactactcgctcgtggtgcaggggctcgcccgcttccgcgtggtggagctggtccaggaagcgccctacctcaaggcccgcgtggacgccgtggaggacaagacctcttcggagaacgtggaagtcgaggcgctgggcatcaacctcaagaagctggcgcgcgaggtcatcgagctgatgcccgagctgcccgccgccgccaccgagctggtggagagcatcacccaccccggccacctggcggacctgatcgccgccaacgtggacgtgcccatcgaggagaagcaggccgtcctggagacggtggacctcaaggcccggatgaagctcgtgctggagctgctcaaccggaagcgggagatcctcaagctctccaacaagatcgactccgccgtgaagggcgagatgtcgaagacccagcgcgagtactacctgcgccagcagctcaaggccatcaaggaagagctgggggagatgggcgaggaggaagaggagctcgacgagctgcaggagcgcctgaagaaggccggcctgccgcccgacgtggagaaggtcgccaacaaggagctcaaccgcctgaagaccattccggcggcctccagcgagtacaccgtcgcgcgcacctacctggattggatcgccgacctgccgtgggcgaagatctccgaggacaacctcgacatcgagaacgcgcgccagcagctggacaaggatcacttcggcatcaagaaggtgaagaagcgcatcctggagtacctggccgtccgcaagctgaagaacgacatgcgtggccccatcctgtgcctcgtcggtccgccgggcgtcggcaagacgtcgctgggccagagcgtggccaaggccacgggccgcaagttcgtgcgcctgtcgctgggcggcgtgcgtgacgaggcggagatccgcggccaccgccggacctatgtcggcgccctccccggccgcttcatccagagcatgaagaaggccggcacgaagaacccggtcatgatgctggacgaaattgacaagctcggcgccgacttccgtggcgacccgagcgcggcgctcctcgaggtgctggatccggagcagaacaacacgttcagcgaccactacctcgacgtgcccttcgatttgtccaaggtgatgttcgtcgccacggcgaaccagctcgaccccatccccggtccgctgcgtgaccgcatggagatcatcgagctgacgggctacaccttcgaggagaagcagagcatcgcccgcatccacctggtgcccaagcagctcaaggagcacgggctgagcccggaccacatcgacatcaccgacgaggcgctgctcacgctgaccaccgcgtacacgcgcgaggccggtgtgcgcaacctggagcgccgcatcgcggacatctgccgcgcggtggcggtggaggtggccggcgggaagacggagaagcagaccatcaacgccgaccgggtgaaggagatcctcgggcccgagatgttctactccgaggtcgccgagcgcaccgaggttccgggtgtggccacgggcctggcctggacggcggcgggtggcgacctgctcttcatcgaggcgacgaagatggcgggcaagggcggcatgacgctcaccggccagttgggcgacgtgatgaaggagagcgccacggcggcgctgagctacctgcgcagcaaggccgagcagctcggcatcagcccgaacttcctggagaagacggacctgcacctgcacttcccggcgggctccattccgaaggacgggccttccgcgggcgtcaccatcctgacggcgctcaccagcctcctgacgggcatccgcgtgcgtcacgacacggcgatgacgggcgaggccacgctgcgtggcctggtgctgccggtgggtggcatcaaggagaaggtgctggcggcgcaccgagcgggcatcaagcgggtcatcctgcccgagcggtgccgcaaggacctgatcgacgtgccggaccaggcgcgcaacgagctggagttcatcttcgtcacccacatggacgacgtcctgaaggcggcgctggagacgcctcccgtcggcgtggcgggaaccccgggcggtgagccgggcaaggaggctccgctgccgaagccggccgagtccgcccctgaggtccgcgcctagcgcacggccttccagccaataggaagtgacacgggcaggttcccttcttccgggaacctgcccgttgtctttgcggggcaggtggcgctcagagcgagaacaggaagtgtcgcggctccgggacgcgcttcacccgcaggatgtgactgtgctccacaggcagccgggggatggcctctggacggggaacgtagaggatgccggggtcatcctctcgggtgaagacgtactgcccgcgcgagcccttacgcgtgcagcccacatcgaggatgaggtgccgctcgatgtccgccgcatccgtggtgttccagttgaagcgggtgagctcctccaccgtgaggccatacatctccgccacgctctccagcgtctctccgtcgatgacccggtgctgggtgacacgtgcgaggaaacgcggcccgctggcccccctcgcccgctgacctctcttcgcgggcttttgctgggaccaggggcctcccgtccgcaccagcgccaacgtgttgtccagggtggccccttcgaggtcggacaggacgtgggcgccccccttcggaacgcctttcaggtcgatgcggccctctgaatccgtccgggcctgatgctcggaccggtcgtcgagttggatgcgcaactggatgccggcaatgggcacatcggtggtgtcgtccaccacctgaagccgtagccagaccggctcctccaccggaacaggcacacccccaggctggggaacggagaatgacggcgaaacggcggcttcgcgcgggggagcctgcgccagccgaaggacacccgagtccagaaggagcgcggcctgccgcacgacttcgtccaccggcagcggtgcgcgcatcccgctgcggtgtccatggatgtagaccagtgattggagcgtccgctggttggatgaatcctgcgcgaactggcgcaatctccgctccagcgcccagccccgcgcaggagtcacgagcgtgtacccgttgggcagcccctcatggagcgcgaggacaatgtactcgcgcaacccgtctttcagacaaggatggagaaacatgctgtcacctgaaggagacgtctctatttgcggaacttctggccttcacgaaggtgccgctccaccggaaccaagatgtctgccttggtgatgaagcccttgccaccgcggtccaaccccttgttgggttcgtagcccctcgaccccttggcgtaacagacgaaggacgcgtccttgccgagcgcttctggacagaggatgcacgcgtagacatcacccagattgtctagaggcagcttcgaccgcgccttccacatgcggaagtacttggcgacgtagtcgagctgttcgacagcgctcatccgcaccagtgcggacagcttgatgtcgagcgcatcttttccttcgttgatggccgtgaactgaatgagaccgaaagcctgatgcccagcccggttcggtgtatctgcccggaaggcattgcctgtctcaaaggccatgcacgccatcaaatcatcggcattcatctccagttgctcggcgatgatcagcaccttcctccggaatgcctccgtcacattcgggtggctgccgtagatgagcgttccttcgatgcggcgcggtgttccctccaggtccaggtggatggcaggaagcgcgctcgagtggttggcattcgcccgctccaccaggcgcgcttcaatccgaaactggcccttgcgccgcatccgctcgacgagcgccggctcccggagacgcgccaccacccgtccacgagcgtcgcattgccccgccgcccccttcgcgacctcataccggaagggcacggcaccgaagacaacgggctccgcgacgtcagcgaagaactcatacaggcggaactcgatgacatccccctcctttccattgggaacgtggagggcctgacagcggacttccaggatggacgtatcatccgtgagctggacgaactcggcgcgaagtccctggagttggggaacgcctgggtactccacgaagaaggccggtggcgctgccaccaattcgtcccagagccgtgcatccggttttgagactcgcccctggatgaagaccttctggcggattcgaggatcgtcgaatcgaacgagcgcctcgtagtaacgaggattcccatcaaggggccgcgcatccaaccgaagcacctcggcctcccgagagaccgttggctccacgggacgctggtcgtcgcagagcgaaaagacaggcgaggcctcacgccagtagtcgagatccccgatgaccttcacggtgatgagcaggtggttgtcgcgagcccccagccagacgtccccgaagcgaggcatgcgcgaaggccggaccgccaattccttggaggccagtgccgtcaccaactcctggcgcacccggtcctgcttctgtcgcgagggagccctggccgacgctggggcctccagccacaggtcctcgtcctcgaacgcgaggaattgtgtctcatcgaagtccagcaccgagcggatgggcacgtattcatcggaccccgtcaacgagcgcggaatccgcaacaaggcgaagctcttccggcgcagccagtcctcagcgtcgaggaattgccgtaggaacaggcccctctcgttggcgttcaccaacaccggccgcgagacggggtccatcagggtgaaggacagggcctctcctcgcgtctgagcctcgtaccgccaatgggtcagctccaaggggagctcgaaatccggatccagatgctccaccgtcgcggtgaccgcgtggtgcttgaattccaacccggtcaggttcggcttcgggcacacgcatgcccttggctgatcccacaccacgtagggccgcgtctccccctcgatgtctcggagcacttcgagccgcaggtcgaaggcgtactcgccctgaatgggctcacgccatggcagtcggagaccgtccccactccaggcgcagccaactctccagtccttcgcgcccaagtcggaagcgccccattccagcgcggcatagcgctgcgcctctggagccatcctcggcgccacgccacgcttcggctccacggagtggtagatggagagccgaagcgtcgcgccggtgaaacgtgcatccatgtccggcttcaagcggaaccgccggccaaacaggacagggacgctcaggtcgagccccctgagccccaaggggatgtcgaactcaaagggcttttcgaggcagcattcctgcgcgaaggggaagtcaggaatgacggtcatctccgcgtggccccggccgaagaagctcgcctcgtagatgtccgcctcgaactccaaggtgcatgacctgccattgacacgcagtgggacgttgaccagcgtgtactcccgcgctggcatcccacgcgcgtgcgtcttgatcagaacgctgcagaccgtgtcagccggcaggttcttgtgcgttccctccaggatgaaggcaatcctgtcctgagcggcccggtggctcttcagggagagcttgagctccgtgggggccaccgcgacgagatagaagacgccctcggctcccggttcacgccgaagctcgaagcgctcgccgccagcatgtgactgtgaagcaacggctgtgtccgccatcacccttcccccttcatgggcacggctcccc

SEQ ID NO: 1201 - DNA, 21511 bp, Myxococcus xanthus
cgggaagtgcgtacagcctggtgagagccatggcgatggctgaaggattcagcgcccttcccgcccggcagcccggctgcgacaagggcacgcaaacgcgcgcactcccgcctcccccaacggccggcggggacggttcggccgccgcttccggcagggccccgccccagccgcctcagggagagaggcgggccagcgcggccaggagcaccgcgggctccatttcggagacggccagcgcggcccgctcgcccccaccaggcagcacgcagatacgctcgcccacgggcccttgcgtgcaccgaggcccgtcaccagcgaagcgggccgcctcctgcgccgccgccgagcccggcaggggaaggaagagcgtcatcgccttgccctcctcgtgccggtacagcaacgaggcggagagctttccatgcaaccggcagcgacgggcacccagcagcgtcgcgcctggcaccaccggcacatccaccggatagcccacctcccgctccacccacgccttcacctcggccgggtccgaggactcgaactcacagggggcgatccgggagaaggccttgaggtgatgccgctcgaggtccatcgccagcgcctcgttcatgccactgggccatgacgtccagaggacccccaccgacgcgagcaccgcggccaggcccgccgccagcctccgcctgggaaaggacggccgggggcgcgtcaccagccgcgtgacacgctcctccagttcgggcggcacttgctgctccgcggagccctccgctctcagcgcctgccgcagcgacgcatagcgggcagcctcccgggcacagcctgcgcatcgggacaggtggtgcgccaccgcctgctgttcatgcgcctggacctcaccgtcgaaccacgcggagagacgctcctgccactgggggctacaggcttccatggaccttctccttctcgaggaagtcgagcatcgccagccgcgccctcgccagccgcgagcgcacggtgcccaccgggcagccctgcacctgagcaatctcctcgtagctcagctcctcgacttcccgcagccacaacgtgtcgcgccactccggcgccagggagtcgagcgccgcctgcatccccgcactcaaggtgcgggcgtgcagctccgcctccaggtccgcggatggctccggaggaagcgcccggcccagcccgccctccagcacctccaggtgaggccgcagaccccggcgggagttgaggaacacggtgcgctgtacggcgagcagccaggccttgaggcgctcggtctctctcagcgcaccgcgctgctccagggcgcgcgtcagcgtctcctgcaccaggtcatctgcttccgcggcgctgcccgtcagccgacgccccacccgcctcaagacgggcaggtgctccagggcacgttcgatgaaggcgcgggcgctcacgggcatgaggacacggtggggcgggtgaaaggttcccggaaaaggacgagggcgctcgagaaggaggagcgccctcgccttccgcgtggcggacgcggggttactgagcgggcgtggcgcccacgtgcggagcccctggacgcggtgcgcctacgccgctccgcgcctgcagcacctgcgcgaggtagaagcccgcgaacatggcgggcacgaagacgagcaacgggaaggccccggtcgccagcgaggtgagcgcgggaccggggcagtagccggccagcccccagcccacgccgaagagggccgagcccacgaggagcttcgcgtccggcttgctggcggcgaacgcagggaacctggtggcgaacaggggctgcgcgcgccggtggatgaggggccgcagcgccgcgtgaacggcgatggcgccgcccatcacgaatgcgagccggtagtcccagtcgcctgcgatgtcgaggaagccgaggacgttggccgggtccgtcatgcctgcgaggcccaagccaatggcgaagatgaggccgctgaggaacgcactgagggaggaacgcatgggggctttctctagaggacgtggcggaccaggaagacggtgaggacaccggtggccatgaaggtgagcgtggcggagatggagcggaccgagccccggctgatgccgcagacgccgtgtccgctggtgcagccgttgcccagccgcgagccgaaccccaccagcagtccggcccccaccagcagccagaggccgcccgcgccaggagtcgagggcgccgggaaggaaccggggcgcaaccaggcgagcagcagccctccggcgagcagcccggcgaagaagagcacgcgccaggcgacgtcaccgcgcacgggggccagcagcgagcccaccacgccgctgatgccggcgacccggccgttggccaggagcaacagggaggcgctcagcccgatgagggccccgcccaggagaggaaggaggatggaggaagtcatgtcgcgtgagagccaggctccaaagaaaggattcagcagggcctgagaatggattcagcagggcctgaatccttcttccacgccccggcctctcatggacaggaggcttcgacatgattttccggcagcttttcgattccgagtcctcgacgtacacgtacctcatcggcgacgaggccacgcgccaggccgtcctcatcgaccccgtgctggagcaggtcgaccgcgacctgcaaatggtggccgagctggacctcaccctcacccacgtcttcgacacccacgtccacgccgaccacatcaccgcatcgggcgcgctgcgggagcgcacgcaggccacggtggtggggagcgtgaacggcgccagttgcgccaacgtccaggtccgccacggggacgaggtgcgcgtcgggcagctcgtcttccaggtgctcgccaccccggggcacacggacgacagcatcagctacctgctcggcgaccgcgtcttcaccggggatgcgctgctcgtgcgcggcaacggccgcaccgacttccagaacgggaacgcgagccagctctacgacagcctcacgcgcgtcctcttcaccctccccgatgagacgctcgtctaccccggccacgactacaagggccgcacggtgacgagcatcgccgaggagaagcggcacaaccctcgcgtggccggcaagagccgggaggagttcatccacatcatggagaacctcaacctgcccaggcccaagctgattgacgccgccgtcccggccaaccgcgcctgtgggcacacggcgccctcaccccagggggcctgagtcccctggccacttcgcaggagtcccgaccatgacactccgcccctatcaggacatcacgccctcgcagctcgacacgctcggccccgaggtgcggcgcatcgatgtgcgcgagccggacgagtacaccggccccctgggccacctgcccggagccgagctcatccccctggccacacttgaggccgccgccagcgcgtggccgcgcgaggcgccgctgctgctcatctgccgctcgggcgggcgctccgcgcaggcggcgcggttgctcgcccacggcggcttcaaacacctcttcaacctggcgggcgggatgctcgccgtgcgcgagccgctcgcgccgcggccccaaggttgagcgcgcgtcgcgacaggacgaacaccatgccccttctcggcttctccctcgcggcgctcatgggcctgtcgctcggcctgctcggcggcggtggctccatcatcaccgtccccatcctcgtgtacgtcatgggcttcggggccaaggagtccatcgccatgggactggccgtggtgggcatcaccagcctcttcggcgcggcgagccactggcgcaggggcaacgtccagtggaaggcggccctcgtcttcggggcggtggccatggcgggcacctacgccggggcgcgcctgtccgcgctcatctccgggacgacgcaactgctgctcttcgccacggtgatgctcgtctccgccgtcttcatgttccgcaatggccggaaggactccgtgcaggcgcccgagcccaagaaggcgtccttccccctcatggccctggccgccctcggggtggggggcctcaccggtctggtcggcgtgggcggcggcttcctcatcgtcccggcgctggtgctgctggtgggcctgcccatgaagcaggcggtgggcaccagcctgctcgtcatcgccctcaactccctcgtgggcttcgccggctacctcggccacgtcgaggtgccctgggtctcccttggcatcttcacggccatcgccgtggtgggcatcctgctgggcacctgggcgtcccacttcgtctcccaggcgacgctcaaggcagccttctccggcttcctcgtcgtgatgggcgtcttcatcttcttcaagaaccgggaagcgttggggctggggggcggcgccgccacgacgcagaatgcccactgacgtcacgcagaactccaggaggagcaccatggccgagcagccccccgacgcagccgctcaatgggacgcacgcttcagtcacccggcgtatgtctatggcacccagcccaacgacttcctcgtggagatggcctcgcgcctccctcccggcgggcgcgtgctgagcctcggtgagggtgagggccgcaacgccgtctacctcgcctccctgggccacgccgtcaccgccgtggacgcgtcgagcgtgggactccagaaggccaagcagttggcagacgagcgcggcgtcaacatcgagacgcgcgtcagcgacctggcgcacttcaccttcgcgccggaggcgtgggacgcggccatcgtcatcttctgtcacctgccccccgcactgcggcggcgggtgcatggcgcgctggtgaagagcctccgccccggtggcctggtcctcctcgaagcgtacacgcccgctcagctgggcttccgcacgggcggcccgcctgtagaggagctcctctacacggcggaagccctgcgcgaggacttcgcggggctggagttgcccgtgctccgtgagctgacgcgcgaggtccgcgaggggaccctgcacaccggaagggccgccgtggtgcagctcgtcggtcgcaaggcgacgtgagcctgaacctgcacgggtggaggacccctgttccggcgccgtgtccgccctcgccaccgacctgctgaaatcaaacctggataccgaagcatgatgccgccaaggagctttcctccctgcccctccccgaccaaccacccatgatgcgggacttgacctccgggagtgggtcaggtgtgcgaggcaaggcccgggcgatgctgcgcattctcttgagggacattgagcatgcgcagggatgcgccggcggtttcctacgggtttggcgtccagcagaggaatggttcctcaatgaaatttgaaacgtagccattggcgtcaagcacgcggaatcggatgtacttggtgtagtatcgtccgcctgtaaaaaagccatacctgcacggctcactgaaagtagtggaaccattgcgccagtagaagttacctgggtctggattggcatcgagattatgtgccatttgccactgatagatgtacggcgttacgccgccgcttgcacttccagagcactcaattcttgtgaatgattcattctggaaacagctcccagtcactgtcggaggcggtatgtcaaaggcgactaccgtgtcgcccgtatcgacttcccttccttcggcggaaagaggctccccgcaggcactgagcaaggccaccgccgaagcagtcactgcgacgatcggaaggtacttcctgatggtgcgaaccgacatgggcgctcctgtggcaaggccgaaaaggcagtcgaaatttaactgactttcgtgaaattcagcctaagcaggtgggaagtgttctgaactgctcagatgctgcgagcgtccgtggggctgccatccccgttggctcggtccgcaactgggtagccgttcagcggggcaagtcccgaatcttgtgtagctatttcggagggggatcaagcagcgcggcaatggtttcgtgagcgctgtcgtgtggccctccgggtcggggccacacgcgacaccagaggcaagccatagactttgaagatcggaatcgtcgtcggctcggccatcagcccgaccgtcaatgaaggtcgggagcctcggtcacgcgctcgaacgacacgcccagattcccgacccgttcgagttcgttcttgatgtcctccgagacaatgaaggcgatcttgaactttttcagccgaaagacgtgcgcgccctcagtcttcgagggatcgattcgcagtccgtagatccagttgtactcgcctgggtaatcaggggacggttcgtcctcgtcatagtgatgcacctcccggcaccgtgcctcgtctatggcgtcaaccaccctgattgcattgacgacgaagtaccgttcgggctctccctctatcgacaccggaaacagttggacgtcatcgggagccagtgttctgaagacgttcgcgagtgcttcgctgacgataggcgtgcgctcaacccctccaaacacaaactcgcgcttcgtacccggatgtgaaatctgagaattgatggagccagggtctgtaaggacgcacccatctgtgaacatccaaggctcgtcgaactcttcgccggatgtccgcgtgggtgtctcaacaagccatcgaggcacgtccgccaagcctacccaatagaagttccgttccaccttaccctcctactttacgatgaagctgcgcaattctgagcccggagtaagcaactcgtctgcaatcttcgcgagctccttcagcaaactggcccggcagctctccgtcgttctgcaacgcacaacagaacgttcaaggcgagtcatcacctgattgtgataaaattcgggatgaggcccctcgtgcccattgagccgcaccttgtttgcagcgtcctcaagagtcatccctgccttcttgaaaatcctctcgcactctggcgtccaaggaccgccagtcgctgcggaaatcgtgttcctgctcgtgcagatgtggtgaacgggcccttcagtgtcgcccgggaagcgcccgtccgagtacatcgccagggccgcagcggctccgggtgatagggcgacgttcaacacaccggcagcgggaagtgcgatggacgtgacgccgccattcatggccgcaccgagctgaaatcccgcctcggcctgcgctcgaatcgcggcctgagggaagcccgggagcttcggcccctgggccgccatcgcgttcgttcctccaagcgccgccatgacgacgagcaccaggacgcgcgtgccgttcgtgccgagcacccgcccgaacctatgcccgatgtcttgtagctcgatgacgctcatcgccgtccccgcatcatcccacaaccggacgaatccgcgcccaatctcccagacgggcaccacgcccaggtaggccaccatcgccgccgtcagcgccaccgcgatgaccttggtgacgggctcgggcaacgccagcgtgaggagcagcgtcagcgcggccgacgtcaccagggccttgagcgccgctgggttcagcaccttgccgacctcggcctcgacgctctcccatacggtatcgagcgcgaaggacagcgccatgagcgtccggtcctttcgcgagaacgtcagccccgtcccacccaccagggtcaagcagtcgtccgcgtcggggcagatgcgcgcgtacaaagattcaggtgaactccccgaccccgaatccgcgaggcccttcgaggacgcgatcagggccctggagcgcacccatcctcgctcatccgccgcttcagccgctcggaacgcaacgtccatgcgcatgtcgaggatgagccgcgtgaggacagacttgaattcgccctcgctcacttcgactgggtcaacatctaccgactcgtggacgactcgctgaccatttccagcatcgatattgacgatgcgagtggtcgcacaccccgctgaaagaagcagcaaagacaccactgcaacccatctcatagcatcccccgaagacacccctgggaatcaggatgcgctgcagcctgactccggggtctgacagctccagcagagttcgcgcgcagccatactactacatgcatcccaaataaatttccataccctccaggttgcactgcccttcagacaccaccgagcaagagtggattgccccaccacgctcctggtaggttgttcgcgctatgagacctacccaattcacaaggtccatcctgactttcgcagcgctagcgacgttgagtgcgcaggccgccgatcactatcggcggtccatcctgctctccgagcatccggagaacgggacccactccgtctacgtgaaggggcaagtcatcacgacgttgcgcttcgagcagcccgtcaacccgagcaagacgaaggtgctcggctgggaaggtcgactcgaaccactcacggtggtccacaacaaggtcatcctggagcccatccgggatctccaccgcgatgacggccttccgttggtcgtgaccttgacggatggaacggaggtcccgttccttgtgaggccaccttggccgaagaaagacaacgactgggcaccaatcctcgaccagcagatcgacgtgttcaagaaccgggagagccacgcgtcgatgcacgccgcgctggttgatgcactcgcgaagaacgacgccctgatggaagagaacgaacgctaccgcaaagaggagacctccgaggaccacgccctggctgccctgctcgcgtcgggggcggttgcgcagaccccgttcacaatctttgaccacgtttctggcaaagatgcggatgccgaagttgatgccacgatcttcaagggcaaaggcaaagcggctgtgatcttcaaggtcaagaaccttgccaccgagaaatcctggagcgtcaagagggtgcgccttgtgactgtgaatggcggtcatgaccgagcggtcgctgttcgtgcgacggttcgcgaagtcatgcccggcgggtctggtgtgctggccgttgtcgctgacggtgccgctttcgtggacgacggcgtattgaccagcctttggctggagctctaccaacacgatggactgcggcaggcattcgtccagctagatcccaccctcattgcgagataagagcggggggcatggcctccgacaagttcgcgctcttgggctgcgtcgtcctgctcgtcacgtccactggatgccctggctccgcgacgggtggtgtcgccgtccgtcccgatggcagcccagggccccaagcgtgccccgagaaggctcgtgaggcgatgaactacctccgcatgttcgtgggggaagccgcgtgggtacaactcgatgcgaaccaaacacgagcgcgtcccatcactctttacgatgggaacatcgagtccgtgctcgaggagaacatcggactgatggaggcacccgcacggctttacggccgagtctggactggcgggccgcaagtcgtcatccggtactacgcggcccagccggtgaagggtggcgacccagtgcccatctgcgccgtggctcgcctcgggttcgggcagctccgaaagcacccggagtccaagccagggacagccatcctcgattcgccccgcgcaggggtctacatcgtggacgagttccggtgaggaagcagggccgctgaaaatgtcgcggcccccagcctggttggagcaacgcctgagcgtcgatcgcggcggaaaagaaaaagggctggttgcctgaagcaaccagcccttctctcttcttggagccgacacccaggattgaactggggacctactgattacgaatcagttgctctgccgctgagctatgtcggcgcgacaggtgcgcggggagtaccatggcggctcatgcccggcaagcagaaatgaaggcgagtactcaccctccccgccacctcgcccgttttccgcccgcccgcatcgttggttttccaaccatcccaacgattgaccaccctgacacggatgacacaccgcgtctgtcgtaggtgacacatcgcgttgacataagtgcccgttatcgctccagattcttgggagaggacgggtgcttggcgcggttgaagtctcggagcgcctatgtacataagggccccgctacccccacgtgcctcgcccacgagcggcgacgcgacaaggagcatctcccgtcatggccagcgaagagaatttcatgcgtgccccggcccctacgcccaagcgcaccgtctacaccgaggcgatggagatcttccatcgtgcagcggacctcatcgcgctggacaagcgcgtccgcctcgagctggaggagccggactacgagcacatcttctacgtcacggcgaagctgaaggaccgcctcgtcccgctctccgaggagaaggcgcgcaccttctccaaccttcccgagacgcaggtgcgcaacaaggaaggcctggagctgctggccaacggcaacatcatcctcaacggccgcgccctgctgggctcggacgtggacatccgccagggccacctgcgcctgcccgacggcaaggtgtaccagttggtccccggtgagtcgcagcgcttcaaggcctaccgcgtgcagcacaaccaggcgcgcggcccctacaagggcggcctgcgctaccaccgcgaggtgtccctggacctcttcaaggccctggccgcggagatgacctggaagacggccatcgccgaggttccgttcggcggcggcaagggcggcatccagatcgacccgcgcgagtacggccgcgaggagatcgaggccatcaccctgcgcttcatgtaccggctcaagagcatgattggcccggacatcgacatcccggcgccggacgtgggcaccaaccccggcatcatggccctgctctaccgccagtactcggacggtgagcgcgagcgccacaacctgcgcggcatcgtcaccggcaaggacgtgcgcatcggcggctccgagggccgccacaaggccaccggccagggcgtcgccttctgcatcgaggactactacgccgaccgcggcgagtccgtgaagggcaagacgttcatcatccagggcttcggcaacgtgggcagccacgccgccaacatcctgtcgcagatgggcgcccgcctgcttgcggtgaacgacgccgacggcaccatcttcaatggtgacggcatcgacgtgaccgcgctctccgcctacgtgcaggaccccaagaacctcaagcgcagcgtgctcggcttcccgggcgcccagcgcatcgagaagaaggacctctgggacgtccaggcggacatcctggtccccgcggccctgggcggcgaaatcaccgccgacgtggccgagcgcctgcgcgtcaagctggtggccgagggcgccaacggccccaccaccccggaggccgaccgcatcctggagaagcgcggcatcgagctcatcccggacatcatcgccaacgccggtggtgtgacggtgagctactacgagtggatccagaacaagcgcatggagcgctggagcgaggccgaggtcgaccagcggctcgagcgcgccatgaagcgcaactaccgcatcatccgcgacatctcgcgcaaccagccgcgcaagacggagatgcacgacagccgccagtactgcatcggtgagacggtggacacccgctgcgccgccatgattctggcgctcaagcgcatcgaggcccactacctcctcgagggcttctcgcagtagtcgaagccacgggcacccgcccaccgctggaaacacgaagggcacggtcctccatctggaaggccgtgccctttcgttttcaccgggtccggaggttggcttgggcggcccccgctgctgttccgggaagcgccaggccgcgaagcccctcacgggccccgggcggacgtcagtgcatcacccgctcgcggtcgaccagcaagaggggcgcgtcgtcctgcgtctcataggccacgatgcgcagccccacgccgcggctgctgccctcgcgcccgtccttgcgcccgaaggccagggccacctggtagcggacctcgcacaggcacgtcatctccgtcccgtcctcgcccgcgaacgtcaccttcagcttctcgcccaggcccacctggtcccggacctccacgaacatgccccgcgcgctgatgttgcgacccaccccccgaagcatcccatcctgggtggtgaggtagacggtgaagaccttgtcgaaacggaggtgggaacggcgctcgtgaggacgctcaaacatgggggtagctcccggaacaggtggtgacaggcgcaacctacacggtagccacatgtaggcaagttcttcacccacatccaccctcacacacccatgtaacgagtgccggatgctttccgaaatggcacgattccgggctgaacccctgttccccggagacctcgcccgtgaatcgcatcctcctcgccgccgccctcttcctcgcgcccgcgcttgccctggcggacgcggaccctcgcttcgccaagctgcgtgacgaagccgagccgctgggcgggctggggaccttcttggataagttcgtgggcgcgtgcgacggccccttcgtggactcgcagtgcaaggccaacgcggaggcgttccggaagaagtaccagggcaagcggctgtacatgatcgtcaccgaggacgacgccagcatgctcaccccggggccctattcgctgggaacgggcgagtacagcatcaacatcaccccgttcttccccggcggcagctcggcgctcacccacggggcgcccaagaagacggacggcaacggcaaccccatcctcccctacctcaccgtcaccggtgacatgccggcggggtggaacctgcagatgttcaaccgcctcttctccacgcgctcggtgcgggcgcagattgtcttcaccccgcagagcgtgtggaccctgcccaagaagggcggcgggaagagccacggcgtgacggcgcgcatcgaagccatcttcatcacggagggtcgcagcggccaggccatgggcctgtggctccacggcaaggacgccaagaagcgctaaccgggcgtcacctcaccgggcgatggcgatgtactggagcgcctcgccccgcttcacccgcaggaggatgctgaccccggcgctccccttccccagcgccgcgcgcaccccagccacgtccttcacccggcggcggttcacttccgtcacgacgtctcccgcccgcaggccggccgagtccgccgggctgcgcggcgtgacacccgacaccagcacgccggaccaggccgtctcccccaggggcgcggccacctccggtgtgaggtcacggatcaccagccccatctcctcctcgctggccgtccgctggatgagcccctcggtggcctcctgcgcggggcgcgccaccagccgcaccgtcacttcctgcgtctcagtgccccgcgtcagcgacaggcgcgcctcggtgcccggcgccagcagcgccaccttgcgcaacaactgcaggtaggagccgatgggccgcccgttcaccgccaccagccggtctcccgggcggatgcccacggccgcggccgggctgcccttgtagacgtccttcaccagcggggcctggcgctcaccgcccccattgctcccgtcgtcattgatgacgacgcccagccacccacgcgccagcttgccgttctcccggaggttgggcagcagctccttcaccaggttgctggggaccgcgaaaccaatgccctgcccctgactgatgatggcggtgttcacccccaccacctcccccttcatgttgaagagcggcccaccggagttgccggggttgatgagcgcgtccgtctggatgaagtcgtcgaactggcccacgcccaggacgcgctccttggcggagatcatcccgtgggacacggagtggtccaggccaaaggggttgcctatggccaccacccagtcgcccaccgccatccggtccgagtcccccaggtagacggcgggcagcttacccaggtccacgccactgagccgcagcagcgccacgtccgtggaggcgtcacggcccaccacggaagcggcgaactcgcggccatccgccagacgcacggcaatctgctgcgcgctggccaccacgtggttgttggtgacgacgagcccgtcgggcgtcagcacgaagccggagccggtggacttcttcatcccctccaggccaccggcccggggccccacggtggtgatgttgacgacgctcgcctccaccgcgcggatcagcggcgccagcgaggacgggggcacgaagtgggggatgcccgggtctccctcggcgcgctcgcgccacaggcccaggctgcccgtctgcccctcgacaccggcggcctgcgcggcgaaccacgcagcatgctcccgggcccgcgcggaaagccacgcgtcgagaggaccctcggcggccgccgcgaccggggcgagcgccagcaccaaacacagggagaagaatcgggagaacacggagcggcagtctacacggcggaccagggtcgagcggactcaacagcctggcccggcgcccccttcccgtgagtgacgggggcgccctggacggcggcgtcaggcctggacgggggcgacgtacttcgccaccttcacccgggccggacggatgacgcggtccttcagccggtagcccgcacgcagctcggcgacgatgcggtggtcgtcgtccggcgtggcggtcacttccatgtcgacggcatcggccgtgttcgggtcgaaggtctgcccgacgacctgaaggcgctcgatgcccgtggactgcgccttgcgcaagagctcgtcacgaatcatccggacgccctcggccagcggcgaggtgtcctgggcgctgacggacaggcaccggtccaactcgtcgatggcctccagcagcgtgacagccacgttgccgcgctccacgtccagcatgcgctcacgctcccgcgtcacgcgctgcttgaactcctcgcggtccttctccgcggcctgcaccgcgcggacggcgatgtcgaacttcttgcgaagcgtctccagctccgcgaccatccgctcccgctccgcgtcctgaccggcagccgcgtgctcctccggagcctgctgctgggaggaagcctcctcggcggcggaaacaggtccctcgccattggccgaggggggctgctggggggcttcgggggctgcgtcggtgcgggtgttaccggccatgtctaacctgaggcgatggtggatgcgcagtctcgcgcgataaggtaggcagtcactgctgcccggaacctaaccgcgagacggcccctgtcaacgcgggagcgagctagtgctcctgcggcgcggcgggagcctcggccatgaagccgtggtccacctgccctgtcacctcgtcgatgatttccacctgggcggcccgcagcgagtaatagaggagccaccgctccgccgccgtcagggttcccgccggcaaggcctcctcaatctcctgaaccgtgagccggccctccttgagccccttcgcgaagagggccttgcgggcgatgtagctcttaccgatcctgttctccacggcgacgcctcctttcctccaaagataatttcgcccaccggtcaccgcaggacgtcgcggtggcggtgggtttcgggacggcaggagggcaggcgcccagccaaccgaagtctcaggagtcgagcgcgtccgagtgctgcgtgggcggcgtctggtcgtcaccgcccccgacgtccaccgggtgcgcggagatgacctgacgcgcctccgggtgcagcaggccacgctgcgccaacaccttgggacccagaatcgtcaccatggtgtcctcctccaccacctccacggccagaagccgggccgccaacgcctgggccctgtccttgtgggtggtcagcacctgacgggccctgtcgagcgcttcactgacgagcttgcgcacctcctcgtcaatcatccgcgccgtctgctcggagtagctgcgcgtctccggcacgcccgccgagcggaggaagcccgggccatggtccgcgctcagggccaccggccccagcgtgctcatgccgtagtcccgcaccatcatccgggccatttccgtggcctggcggatgtcgttggacgcgccggtggagatttccccgatgaagatctcctccgcggcccggccgcccatcatccccgccatcttgtcgcgcagctcgtccagcgacatgagatagcggtcctccagcggcagcgacatggtgtagcccagcgccgccaggccgcgcgggatgatggacaccttcgtcacccgctccgcgtgaggcagcatccaccccaccaccgcgtggcccgcctcgtggtgcgcgacaatctccttctcacgctcgttcatccggcggttcttcttctccagaccggcgacgacacgctcgatggcttcctcgaagtccgcccgcatcaccgcgtcgcggttgcgccgcgcggccaggagcgcggcctcgttcaccacgttggccaggtccgcgcccgcgaagcccggggtgcgcgaggcaatggccttgaggtccacgtccggtcccaacttcacgcccttggcgtgaatctccagcacccgctcgcggccccgcttgtccggccggtccaccagcacctgccggtcgaagcggcccggacgcatcagcgcgctgtccaggatctccggacggttggtggccgccaggatgatgagacccgcgcggctgtcgaagccgtccatctccgcgagcagttggttgagcgtctgctcacgctcgtcatgcccaccggccacgcccgagttgcggctcttgccaatggcatccagctcgtcgatgaagatgatgcacggcgccttcgacgtggcctgggcgaacaagtcgcggactcgcgcggcgcccacgccgacgaacatctccacgaactcggagcccgacagactgaagaaggggacgcccgcttcacccgccacggctcgcgccagcagcgtcttgcccgtacccggagggcccaccagcagcacccccttggggatgcgcccgcccaggcggcggaacttctcgggcgtcttgaggaactcgacgatttcacgcagctcgtcgaccgcctcgtccacgccagccacgtccttgaagcccacgccggtatcggcctcggcctgcaccttggcgcgcgtcttcccgaagctcatgacgctctgcgggccctggcccatgccgccggccacccggcgcatcatgaagctccagaagaggaagaagaggcccaggggcaacagccatatccacagcgcctcgcccagccctgactgcggcacggcctcgaactggatgcccttctgctccagcaacggcaccagcccctcgtcaccggcgacgcggtaggccatccacggcagggcgctcggctcgccgcgcagcgtgcgctccccgtccgctggaggaggaggcggctgcgccgtgtccttgaggaagcccttcacccactcgttcgaaatctggacccggctgaagttcccagcttccaccccgtcacggaactggctgtagctcacgcgccgcacgcccgcgtcctggaagacgttgcggaacagcaggaagcccaggacgagtaacaggatgtagcccaacggagagccgaacttgaaccccttccccgttggcgttggcttgtctgtcttctttccgcgtgggcccatcccaggcggcaaatcctgtggcttcatcgtcggcacgctcgaccctccccctcccccgcccacgcggacacagtgaccgcgaggcgtcttccctggcgggccaaagatgttcaccgttgccataccgtcaacccgccaggcgggcttcacgctatgtgcgggcccttgcgccgaatcagcgacacccgatgagccacaagggttggccagtgaactccgtgcccaacaaatagccgttgccgtcttgcacgaaggtgatggcttctgcctgggcttggctcccgctcggaacctcgacgagctctccttgcaacaggtcctccagccgcgcggcgccggggcggcgcagctcgtacgcgcgcgagtaggtgcgcagcagcagccgctcaccggagggatgcagggaggccgcggtggtggcccggtccatcccgagcggcgccgtcagcgtccccagcttccgggcctggatgggggtctccgcgctcaggccatccagcgcgaagacatctcccagggagtccagcgtcttggtgatgacggccaaccggccagagcgggcgtcgatgatgaccgactccgcgtcgcggggcccgcccgggtacatgaaggacagtacgtccaccggcaccgtggcatcctcgagcgcctccggttctggcagccggtagagccgcacctgctcccggcgcgcgaagttgtcaccgatgtccgcaagatagacgcagcggcgcgacgcccccgaggcgcagggccccacggtgacgtcctcgatgtcgcgaggggtggccccggtgagcgtcagccgggcgaggatgccgcccttcgcgtccatcgcgaacagctcgaagccgttgccggagtcgttgtgcgcccagaaggcccccgggtggcgctggctggcggccaggccggagagctcgggcagcacgtcgggcacggtgccgaaccgctgaggctcgccgtagagcgtgcaccccggcacgccctgggcagggacctggttcgtcgcctcgggtggaggcggcgcgggcggcggcttggagcgggagcacgcgcccagcactccggccagcaccgccaggaggagacggcgcggcacgtcagttgtccaggtcgagcagcttcgccagcgtcttggcatccgcgtccgggaagcggtacgcggacatctcctccagcgtcacccagcggtggtcatgcacgcgcaggtgttggacttcctccgtcggccgcgagagccggcagtggaagacgcggaagtcgatgtcgtagttggggtactcgtggtgggtgtgcatggcctgacccagcacgtccacctccacgcccatctcttcctggatttcccgggcaagggcctcggcgtcctcttcaccctcctccacgcgcccgccggggaactcccacagcaagggcagtgacgcggtgggggggcgttgggtgatgaggtagcgcccctgctcattctggagcatcgcaccgacgacacggacctgacggcgggccattcgcttctcctctttctggcgggacaccggggggaggggcgaactaacacaccccccgcccggcgccaatgccgcaaccccagtcgcccagcctgcgcacgtccggacaacctgaccaccctccccctgggccgcacagtcgccgcggacgcccggggggcttgccccggccgaccgccccccgggcaatgttcgggtccgtgcgccagcgcaccggcatgtggtgaattggatgacgggaacgcgagaaggcgtcatgctcggcccatgacgacgagtcgtagggaaagggccgaggtgctcggagcggcactgaaggccgcccgccagcaggcggggctcggcatggaggaggtcgccgagcaactggaaatccccgtggaagtgctcgctcgggtggaacgaggggtgatggtgccgaccattcccaccctgacgcgcctgtgtgtgattctgaagctggacccggatgtgctgcccgagctgccggagatgagtgactgacgtccgggcgtggccggcctagctcccggccccgagctcccacgcccatgcgttgccccacctgccatcgccgcgtggccgagcgctgtcctcgccacggcccggtcgaagcgcgtgccccaggctccgtgccggagcctccggatgtggtgggctatgtcctgggagcgcccttggggcgcggtgggtttggacgggtgttcgccgcgcggcgtgaggtggatgggcaggacgtcgcgctgaaggtgttggagccgctcgcgggcgaacggctggggcgggaattggaggccctgcgccgcatcggtccccccgccgtgccgcggctgctgggcgaggccacgacccgcgccggtgagcgggtggtcatcatggagcgcatcgagggcccgacgctggctcggcggttggcgacgctgccgggcgccggggccctgccctgggccgatgcggccctgctgacacgagccctggcggaggcgctggcccaggtccatgcggcgggcgtggtgcaccgggacctgaagccggaaaacgtcgtgctgtccgaagggcggctcgtcctgctggacttcgggctcgcgcggctgacggcccaggatgatggggaggggctctcgccagggctcacccgcacgggtcagcggctggggacccatgagtacatgtcacccgagcagtgccgggacgcgcgatacatcgacgcgcgcgcggacctgtatgggcttggggtcatgttctttgagttgctgtgtggtcggcctccctttgtcggagaggcggcagcggtgctccaggcgcatgtctcgcggcggcctccggcgatacggacgctcgcgccttggccggtgcccccggcggtggagacattggttcagcggctgctggccaaggtgcccgaggaccggggagacagtgcacggtcgctggcggaggagttgcgcgagcttcagggcgctggcgacgcgctgggcacccatgcggtgtccggggccctggcggagaacccgcgccacgccacgggggcgtcatggacagacacgggcccttcaaccgcccccaccccaggctccagccgagccacgcgcgaggtggccgtcctgggtgtgaagtcctcactggatgcaccggccttgcaggcctccctcaccggaagcggcgtcatcctcgcgcgcgtggagccgggcctttgcctcttcgcgttcccccacgaagcggcggtggaagccgggctgcgcgcggcgctccgggccgcggaggtgctgaaagccgccctccccccaaacgcaacgctcgcacttcattgcgcaccgctgcgcattcgtgagcgtgcaggtcgcttgacggtgggtggcgcggcggtggagcggcccgagcggtggtggccatcgcttgaatccgtctccacccctgagacggtcgcactgacggccagcgcccgcgcccacctgggcgacctgccatacagcacgccgcatggggacgcgctgacatctcctgacgtcctcctgggccgggacacggaacggcagtggctgcgcgaagccctgtcgcgcgtgcaggcacacggcgcgcccgtgctgcgcaccctgctggcggaagagggccagggcaagacacgcctgctcacgacgtggcggaccgaactggagggcacgcccggcgtctccgtgcgcttcgtcgaggcgctcccggatgaaggcagcgcgagcgaaagcggcctgcgaagtctcatc

SEQ ID NO: 1202 - DNA, 24602 bp, Myxococcus xanthus
ggctcgaggatgacgggcatccggtcatggatgggcgccatcagcgcgttgggcccgatggtgatgagggtgcaggtgttgagcacctcgcccgtgtcgggcgcggtccactcttcccacagccccgcgagcgtcaggagctgcccgtccttgcggtggaagtagtacggcgtcttcggcttcgtggactgcttccactcgtaccagccatccaccacgacgaggcaacggcgccgcttgagcgcggagcggaagctgggcttctccgccactgtctcgccccgtgcgttgatgagcttgttgccaatggcggggtccttcgcccacgacgggacgagcccccagcggaaggcatccagcatccgcgcgccatcgttggtcaccacgggcatcaactgcgtgggacagagattgaagcgcgggcgttccaccgcggtacggatgcccgcgaggcccagcccggtgacaatctgctcaggagaagttcggacggtgacacggccacacatgggcaggaagtatcgccctggctggccgaatgcccaagaagacgccttgccagtgcagccaaacaggcggggggccgctgcggtagcatggacagtatgagcgacggccccaagaagagcccgaaggtgtttggcgttccggtgaagatcgacccgtacacgtcggtccggcccgagcaccccaccggcgagttcggcatgccgagcgcgaagaagaaggatgacaagcccttcgaccccttcgccgtcgtcatcgagtcaccaaaaggcggcggctgagcgacggaatccggagcgtgccgcctgtctgctggactacaacgggcgggccatgaaccggactgctctgctttctctctgtgtcgccgcctcgctcgtcgcctgcaccgagcgaacctcgagccccgccgccggagtcgactccggtatcgccgccgcgcctgtcgcgcctgccacaccgggcaagggacagacaccctcccccgctccgaacacagagccccagggggcgggcagcccggatgctgcggtgccgggctcggcaacggccgaagcggccaacgccgattcgggcgtcggcgagtacacgggagcgccggccgcggagaagggcacctgctcagcggcgagcttgtctccgcgcgcagcaccggcttccccggcgctgccagcgcccgtggagtcgatgcgtcagcgcatcatcgccgcggcggtggcctgtgattacacggcgctcaataccctggccgacgagaacggcaaggccgtgcggttcaccttcggcgacggcaccgacgcgggagagtactggcgtgcagcggagaagctgggcaacccggagctggcccgcatcgtcaaggtcctgaacctgccctacgcgaagcaggacaatctctacttctggccggccgtccacgtcaccggcgcgacatccgacaaggattggggcgcgctcaagggcgtctacccggacgaggaaatcgcggggatgaaggaccagggcagctacctcggcctgcgcgtgggcatcacccccgaaggtgactggcaaattgcagtcgcgggggactgaggcacgccacgcgaatcacgtcggcagcttgatgcctgacagccgttggaacagctccacggcgaagccgtccgtcatgccggagatgtagtccgtcacacacagcagccgctggtatttcgacagacgggccaccgcctcggtgatggcttcgtcccgggacgcgggctcttccgccatgtcccggacgtgttccggacgctggaagaggtccagtggcagcaattgccgcagtttcttctcctcgcggttcggcgtgtcggtgacgaccgccatcgcgaacatgtccagcaatccgcccagcgtcttgaagcccgcgctctcaatctggagcacgcgctcgctctcatagccgtagcgccgcgtgaggttgcggatggccttcagcggcttcgccacgtcgtcccgcgcggaggccaatggcgtctcccacttcccgtcctccatcgcctccacgttctccaggaacaccttcacggaggcctggatgagctcgccaatggcccgcgctcgcgcctgcgcaagccgcgtctccggatgcgacggtggcggacgcaccggccccttcaccagcttgggcaacaccgcgtccagcaactcacacgcatccttgatgggaatcagccccagcttcgccgagtcctccaggtcgatgaccgcgtagcagatgtcatccgccgcctcgacgaggaacgccagcgggtgccgggagaacacgccagcctcccgctccaccaggcccacagcgcggtacgcctccagcgccagggcctcgtcgtcctggaagtaaccgaacttcttctcagacacgcgccccttgtcccgctcacgcccgcccggcagcaccgacgcacgcgggtacttgctcatcgcccccaatgtcgccgccgtgtagcgcaggccgccccgccgctcgcgcgactgaagccggttgaggattcggaagccctgcgcgttgccctcgaaggcctccaggtcctgccactgctccaccgtctcgaaggggctcttccgcccatccacctcggcaccgggccgcgccagccgctgtgacacccaatgctggatggccgcctcgccggagtggccgaagggcggattgccaatgtcatgcgccaggcacgccgccgcgacgatggtgcccaggtgcgagggattcaccatgacgtcgcgcgcccgcagtccccgtcccgccagattccccagcgagcgcccgacacaggaagcctcgatgctgtgcgtcagccgcgtgcgcgtgtagtcgctcgtggacagcggaaacacctgcgtcttgtcgtgcaggcaacggaactccgcggagaagacgatgcggtcatagtcccggtcgtagtcggtccgctcgtcctggagcagcgcgtccatgtcactcaggacgggcgccggctcctccaccggcttcttctccgagcccacccggtaacctgaaagaagccgccgccaacgctccgttcgactgctgctgctcacgcctgcctcgctgtgcgaagggacccggggtgacatgctgcccccctcacgcaccgaggcaagttttaccagccgggcggacgggcccccgtcacccctcccaagagacaccgcgccgctggacgaaggcgcggcccccgggcagccttccgcccggcgaacaccgcccatccaacggaggcgtcctcacgtatgaagctcaaggccctgtgcatcaccgtgtcgctactcacccttcccggcgtggccttcgcgcagggcgggttcggcgccctcaccaaggccgcgggcgatgccggcaagtccgccgtggagaagcgcgtcaacaccaagctgatggacgagggccggcagaaccagtgcagcttcaagacaggcaccgcccagctcgatgccggctgcgaagccaagctcaagaagctgaccaacgcgctcgtcgacgccaagaagcagctcgtcgccgctggcgtaaagtcctacaagttcgaggtctccggccacaccgactccaccggtgacgcggccaagaacaagaagctcagcgagcagcgcgcggagaccatcgtcaaggagctcatcgcgcgcggcatcccccggggcgaaatcatcgccgtgggctacggctccgagaagccgctggtgaagcccgacgacaccgccgccaagaaggcgaagaaccgccgctacgagctccaggtccgcctgtagcctcagctcgtgcgggcgcccgaggacatgggccccgcgggcacggccacctcgtcccgcggcgccgtccgggccgcgggaatgaaggtcatcgcgcgctcggccagcgccgtaatcgtgagcgacggattgacgcccggattggcggagatggcggagccgtccaccacatacaacccctcatggccaaacacgcggtgccgcgagtcgatgacgcccgtctccgccgagtcccccatgcagcagccgcccaggatgtgcgccgtcgtcggaatgcccagcagggtctcgctgacgatggtcatcggatagccatccagcttgtccgccacgcgccgggccaggtcgaacgcctccggcatgttggcgctcggcgccgggccctcctggagcgccgtgctcagccccagcctccgcgagcgcgtcatgcgcaggtgcccttccagggtgcgcatgtagagcagaatcatcgtccgccgagcgaagtccgggacgaaccacgccttgaggaagcgcagcggatgccggaccagcaggcccaccagccgcacgaagcgctggagcatcgtggccccggacacctgcggcgccatcaacaaccggaagaagcccgagcccgccgagtagcgcaccggctccaggtgggactgggcatcggtatgcaagatggaaccgatggcgatgccccgtgacaaatcctgccccttgcggccgttcaccacccccacgagcgcctcggagttggtgcgcacgccgtctcccagccggtccgacaggcgcggcagtccgtccgggctcgccttcaacttgagcagcaggtccagggtgcccagcacgccccccgcgaagacgacgtgcttcgcggtgaaccgcaccttcttccggaagaagcgccgcgccccttgaagcgcttcgacttcgtagcccccgtctggcagcggtcgcacccaggtgacttcggtgtccgcgtgcagcgcgaggccgcgccgctccgccaggtggaggtagttcttgtcgagcgtgttcttggcatcgaagcgacaccccagcatgcacccgccacacgcggtacagcccgtccggtccggtccctcaccattgaagtatgggtccttcacggtgacgcccggctcgccgaagtacacggccaccgtggtgggctggaagtcggtgcggcccaggtccgtgcccacgtcctggagcacctggtctggcacggtgcgcagtggattcggcgtggcgcccagcatcctccgcgcggtggtgtagtgcggcgccagctcctccttccacgcggcgaggtggccccacgtggaggcctggaagaagtcgtcccgggggatggggagcgtgttggcgtatacgagcgagccaccgcccacgcccacgcccgacagaacggtgacgtggcggaagaacgacatctcgaacaggccccgccaccccagcgtgggcatccagagccagcgcttcagcgcccagttcgtcttcgggaagtccggggcgcgaaagcgccgccccttctccagcaccatgacgcggtagcccttctcggtcagccggagcgcgctgacgctgcccccgaaccccgagccgatgatgagccagtcgcagtccatggccatcctgcctcccgacgggcaccacgccacacaggtcacgcaccagcgcatgacggcggcgccactctacgacaaagggatgcatcagcccggcgcggagattcaggcggtgcggggaacgaagcgcctgcccgcccagcccgacttcaccctgagcacgtcttctttttcacactccgaccaagccacagaaagcctttatttctcgaaaagcggaggctcctccccgcagcacgtcccccgtgctgcgacgcaacgccgtctccctggaggagcaatgcggatgaagacctggatgccggtctcgctgttgctgctgaatgccccgctggcccttgccgagccgctcaaggccaagccaacggacaagactgtctggattgcgattgggacggatgccatcacgcccatgcaggagaccttcgcggccgaaggctgtaacgtgcccaccgccctcaagcagcagaagcacgcgggcgtgttccaactgaaggagtcccagctgtcgcggctggcgctgatgatgcacgagaagttcgaccgatgcgcgggcttcatcacctacgagacgcaggaggaagcactggcgtccctggcgcccgtagcccccaatgcggcccagaaggccgtcagctacaccctcaccaacgccgcgaccgtgaacaccctggtgggtgagctctctgccgcgaacatccgcaccaccatcgccgacctgtccgccttccccacgcgcagccagagctcgcaagggggcgtggacgccgcggccatgctcctggcgaagtggcagggctacgtcactggcgcgggacgcacggacgtcaccgtggcgtactacccgcacacgggctggcggcagccctccgtcatcctcaccatccccggcaccgatttgtctggcgaggtcgtcgtggtgggcggccacctggactccatcagctccaccagcgccgcgcctggcgccgatgacgacgcgtccggcatcgcgacgttcaccgaagtcatccgcgccgccatggctcgcaactacaggccccagcggacggtgaagttcatggcctacgccgcggaggagacgggcctgcgcggctcgcgggagatcgccctttcgcacaagaacaacaacatcaacgtcgtgggggtgatgcagctcgacatgacgaactacaagcaccccaacgccacatcggatgtgggcatcgtcaccgacaacacgaacgccacccagaaccagttcatccgcgacctgataacgacgtacgtcggcgtgccgttcaccaatacgacctgcggctacgggtgctcggaccacgcctcctggcacagccagggctacgcggcctccatccccttcgaggggactgtcgtccagaagaaccccaacatccacacccccagggacaccctggcgaactccgacagcagcgccgcgcacgcgctcaagttctccaagattgccgccgcctatgtcgccgagctggccaagggcaccgcgcagtaggccctgaagcccaggggccccggcgcgagacatgcaccggggtccccctgcatcaccagttttgtcgggattacaactttgccggcatctggactagcctgcgtgcaatgggcttgattcagaatccgccgctgagccacgcatcccttcgtcgcgtcctggcactggctcgtcccgagtggaggctgctcttgctcggcacgtgcttcctcttcatcgggagcgcgggaggcctgctcttcccacaggccatccgggtcatcctcgacgaagccctgactaccgccacgctcgacatggtgaacgacaccaccctgtggatgctgggggtgtgtttcatccagtcggtggccatcgggctgcgcttcgccttcttcaacatcgcgggtgagcgcattgtcagcgacctgcgggagcggctgtatcgcagcttgctggagcaggagatcgcgttcttcgaccagcaccgcactggcggcctcaccagccggctgtccactgacaccgccctcatccagggcgccgtcagtacgcacatcgccatcatgctccgcaacgcaaccacgttgattggagggctggcgctgctgctctacacctcgccccggttgacgctcgtcatgctggcggtcgtcccccccgtgacgctgggggcgctgttctatggccgcaaggcacggcagctcgcgcgagacgcccaggccgcggtggccgaagccaatgaagtcgccgccgagtccctctatggcattcagaccgtccaggccttcgtcgccgaagacgcggagcgccggagctatggccgtgccattggcaaggccctggcgctggcgcgcacgcgaatcgtctcctcgggcttcttcatgggaggaacgggcttcaccggcctggcgtcgaccctgctcgtcttctggtacggcacgcacatggtcgtttcgggcgacatcacggtgggtggactgacctccttcctgatgtacacgctgatggtcgtcatggccgtcggtgccctgagcgagctgtgggcggagttcatgaaggccggaggcgccaccgagcgcgtcttcgagctcatcgaccgtacgcccgccatctccgtcagcggcggcgagcggcccgcgaacatggaaggcaacctgcgcttccgcgacgtcaacttcagctaccccacgcgccgggacgtgcccgtcctccaaggcctggacatggacgtcgcgcccggtgaagtcgtggcgctggtgggacactcgggcgcgggcaagtcgactgtcgcctcgatgttgatgcgcttctacgatccggaccgaggggccatcctcgtcgatgagacagacctgcgaacgctcgacgtccgctggctccgtcagaacatcggcatcgtgtcgcaggagcccacgctcttctcgggcagcatcgccgacaacatccgctacggacgcaccgacgccaccgatgcggaagtggaagccgcggcccgcgtcgccaatgcccacgacttcgtgagccggtttccagaaggctaccgcacgcgcgtcggcgagcggggcatccagctctcgggcgggcagaagcagcgcgtcgccattgcccgcgcggtcctcaaggatccgcggctgctcatcctggacgaggccaccagcgcgctggactccgaaagcgagcacctggtcaaggaggcgctggaccggctcatggtgggacgcaccaccctcatcatcgcccaccgcctgtccaccgtggcgggcgtcgaccgcatcttcgtgctggaccagggccgcgtcgtccagcacggaaaccacgaggcgctcatcacccaggacggcctctacaagcgcctcgtggaacggcagttcatcgccgcctgagccctcactcctcgcgcatggccatgctgggcgggacgcgcgcggcgcgccaggcgggcacgtagcccgccaccagcgccacgaagagcagcacgcaagccgtcccgaggaagacgagcgggtccgcggggctgacctcgaagagcaacttcgacaggccccgcgccaggaccaacgccagcacggagccgatgatgacccccagcccggcgagccgcagcgcctggctcaatatcaaccagaagatgctcccctcccgcgcgcccagcgccatgcgcacgccaatctccgtccgccgctgggtgacggagtaggccatgatgccgtagacgcccccggcggccagcagcagcgccacgcacgcgaagaaccccagcagcgcggccagcaggtgcctggagccgaacgactccgcgatgagctcctccaaaggccgcggcgacggcggtggttgctcggggtccaacgacgccatgccctctcgcaaggacagcgccagcgacgacgccgccgcccccgtccctcccacggtcaccatcatcaccatcgcgtcacgtggggcctgcgccagcggcaggtagaactccggcacggatgaacgcacctgcccgcgccacagcgtccggacgtcccccaccacgccaatgacctcccacggctcggtgccgcccgtgaagaagcgcttgcccagcggcgactctccgggccagaagcgccgcgccagggccgagttgatcatcgcgacccggggcgagtcctccacgtccaacgcgttgaaatcgcgcccctcgtgcaaggggatgcccatggtccggaaatagcccggggagatgacgcgctgactggcctcgggcaactgcccgggcagcggcttcggctgcccatccggatagatgttcgagctctgactgcgacggctgatgggcggcaggctcgccgccgagacggcctgggctcccggaatggaggacaaccgctcctgcagcgcatggaagaagcgaacccgctcggcgtccgtcggatacctggtctccggcagcgtgacgtcgaagtagaacacgcgttcggcggcgaagccgggtgaggtcccctggagctggtagaggcttcgaagcatcaggctcgcgccgacgaccagcatcaaggccagcgccacctccgccgttaccagggccgagcggatgctctttcgccccgccgtggcgcccgccccctcccgcatcgcctccagcgggttctgccgcgacatctggaacgcgggcgccaggccaaacagcaccccggtgatggcggacagcccgacacagaacagcagcgcccctccatccacctggatggattgccaccctggcaggcgctccgccaacccgggcggcagcatggtggcaatcatgtgcgtgccccacagcgcgcccaggattcccaatcctcctcccaggagcgacagcaagacgctctcggtcagggcctggaccatcagacgcgtcgggctcgcccccagcgccccgcgaatggccagctcccgccgccgggccgccgcgcgcgccagcagcaggctcgcgacgttcgcgcacccgatgagcaacacgaagcccaccgcgcccgccagggtgatgagcagcggcctcaagggccccaggtaggcctcgcgcacggacgtcagccgcacggtgcgctccgaatccgtgtcggggtaccgctccgccagttgccctgcgaggacccgcagggcgtcctccgccatcgacacggagaagccaggcttgaggcggcccaccacccgcaccttccggtccccgcgcgcatccagctccgcctgcgtcggcgcgagcggcacccaggcttcggcgccaggcgggaagtcgaagctcttcggcatcacgcccacgaccgtgtagggctcaccatccagcgtgacggactcacccagcacggagggcgcgccaccaaaccggcgccgccacaacgcgtccgacagcaccaccaccgcctcgccacccacgcggtcttcttccgcggagaacgccctgcccagcgagggcctcgcctccagcgcggggaacagcgcggcgcccacccgaaacgcctggagccgctccggctgcagcgcgccgcccatgttcaagctccgcggaacaatccccgccacgtgctcgaagccccccgcctgcgcggtccagtcctccagcgtcgccagggatgtctcgctccgctcgacacccgccttgggaagcgagtcccacaccatcaccagacgctcctcatgcgggaaacgcatgggttgcagccagatggagttgaccacgctgaatatcgccgtgctcgcgccaatccccagcgccagcgtcatcatcgcgaccagggtgaacgtcggactcttgagcaacaacctggcgccaaaccggatgtcctgacgaattgtatccatgtccctctcacgcaagagcatgccatgcggcgtgcaccgcggcgacgcgcatcaccacgaaggcccaggcccggcgcccgagaacacccaagtccgcgaattttcaaagctggcagacatttcatcaaaaacatgtctaagcctggacatccgctcggggttcgccgtactcttcgagatccgagctgaatgcatcaactggcgtcaggctcggcacgttcggcgacaagttcgtgccgcgcgtgtggtttgattcacctcccctggagttcctcatggttgagagcaacatcgttttgaagcccgaggtggtgacgttcaagcagctggatcccgcgaaggtggacgcgctccgcggccagctgagcatgatcctgggtcgtggcgagttccccacgatgtccgctcgcgcgggcgccgtcgtcgtcaaggagccgcaggatcacaccagccacacgtctgacggctggttctagcaggtctctgctccccggcgcccagcgatgggcaccggggagcaggttgtcttgacgcaaggattgcccccttcccgccgcaggagcatcactcgctccaagccccggtggtgttccacctggatgggattggagaccggctcctcgcccttcccaacccgcgagccctgagtcagccgtacccgggtcgatcgcgccgaatctcacgcgtagcatttatttcactgaaaacacgtctacgcctggacattcgttcgaggtacgccgtacccttggggatccgagctgcgagcatccattggcgtcagactcggcacgttcggcgacaagttcgtgccgcgcgtgtgttttgattcacctccccaggagttcctcatggttgagagcaacatcgttctgaagcccgaggtggtgacgttcaagcagctggatcccgcgaaggtggacgcgctccgcggccagctgagcatgattctgggtcgtggcgacttcgcccagatctccgcgcgcgcggtcggccccgtcaaggaccaggagccgcaggatcacaccagccacacgtctgacggctggttctagcaggtctctgctccccggcgcccatccctgggtaccggggagcaggttgtcgtgacgcaaggattgccccctccatgcagcagaaacttcgttctgcccaagcccccgtcgtatttcacctgaatgggattggggaccggctcctcgcccttcccgccctgcgagccctgagtcagctgtacccgggtcgaatcagactggtgggtgcgccaggtgattcaagcctgttcttctatcaagagctcgggctcatgaagattcacgaggtccgcgcgaccacgcagggcacggagcgcagcatcgacgccgagatgctccggcaggcggtgggggcctgcgacttgtttgtctgtttcaacacctggcacgcgacgggggtctccgagctgctcgaggggttcccggcggccaccgaaacagtgggcctgtatcgccgttacaagcagtgggtccggagtgaagaactccagcattccgcggaccggctcttctcgctggcccagcaggtggatccctccctgaggctggaggacttcgcccaggcccccgtgctgacggccgaggccaccgagggcgggaggcactttcgtgacagcgtccccgatggggccaaggtgctcgcgctccatacggagaccggcgcccggaaacagtggcccgtcgcccgctaccgcgccgtgctggatgccttcctgacagcccaccccgaatggctcgtgctcaacgtggactacagcgccacggagctggcgcccatggtccatgaaggccgcgtgctgtccgtcccaggcgccccactcgatgtcgccatggcgctgctcggcgcctgtgatggcttcctcggcatcgactcctgcatgctgcacgcggcggatttcttccggctcccttcggtgggcctgttcggaacgacctctccccagcaatggggcttccgtttcacgccggccttccgcgagcccaccgggaacgggagcatggacgacatcaccgaggaagaagtcctcggcgcgctcacggacctcgccgccgggcggctgcgccccgcctgagcagcggcgagggcgccagccccggctggcctcagccgctctgcacgctcagcatcggcggcatggcctgcgaggaaggctctgtcggcagaccgttggccatctccaccagggcggcgtccattccaggcatcatccgcaacagggggatggggtcctccacgagcttgcgcaggacccactccacgaccgccaacgtctgcaggcattcctcggacgcatgggggcgcggcgtcgcgtccccggtccgggcatagtcgagcaccggcagcacgccgcagtagggattgaaggcgcactcgcggcactgcgggtcacgatcccgcagcgacaggttcatggaccggaacgtggccttgttgcggatgagcgcgtcataggtcgtccccttcacgttgcccaagccgaactcggagcgcatcgaacgggcttcgtccgacggcaggatttcgccgtcatggtcataggtgatggccgaaccgaagtccccgaccgggttgcgccagtccacgaagcccgtatccgtcgactggagaatcttggccaggacgacccggaccacgcgctcggagtagttctcgttctcctggcggttcttctcgtagatgtaatcgagcgcgtccaggtagtagtggaggaagtcctggatgtcgaagggcagcttctccttgcgggcgttgcccagggccttgagcttgaggatggcgaggtccttgaagccctccgcatgatagaagtcgatggtgcgcttcagctccttggcgttggaggcccccaccacgcacaggggcgacgcgctgagcacgccggggaatcggtcgcggaagtggctcagccgctccatgaccttgcggaagctgcccgccccgctccgagtgactcggaatgagtcgtgaatgtcctcgggaccgttcaacgaatacgacacgttgatgcggttctccttgcagtacgcgatgtgctcgtcggtggcgaccatgaggttgctcaccacggagaagcggagccgcttgcccacggcttcgttctgcctgcgggcctcctcgacgaagtacttcatgccctcgaagttcaagaagggctcgccgccctggaactcgaaacccaggaagggggccggagaaccgagcgcgaagcggatgatggcatccgcgacgtcgggctgcatgtcgaagcgcttggagtccgcggagatgttctccgggttcatgtggcagtaggtgcagttgaggttgcaccgcttggacagcacgacgatatggagccccggccccgcgtaggtccggtcatgccagcgcttgaggtcctccagcacgcgcgacgagttctgcgcggtgatgaggtggctggtctgctcgagccgctcgaacagggcctcatccatggagatttcatcgagctgggcattctccgcgccggacagcagttgcatggcgcccgtccgggacagccgcacgaagtggtccgggcccacctgcttcgcggggaagaagttgggcagccactcgtcgcgataacgcaaccctgggaccctcatgcggcacctccggcgtgctgggtatagcgggccgcgagcactgccgcctcgcgccagcccatgtatgtctcggcgtcattcaccacgggaccgctggcggccactcgcgagaagtgctgcttcatccaggtgtcgaaggcctggtccatgtccgcatccgcgacacgctcgatgagcggatgctgctcactcagggcctgggccatctgcgcgaggagcacgcgcccttcgggcgtgggacgctcgaagtccaggagggtccggaaggagagcaggttgcagcggtgtgacttgagcagttggaagcgccactcccgctgcttgaactcgggcctgtccagcgccagcagccggagccggttcaccgccaggaaggagtgcaggcccagatgcacgcctcggagggggcgagggtcggtgcggtaggcggagacgaactcgggacgtgagtcgtcccaccgtccgaatgcgcgcgagtcgagcagcagatacatgcgctcgtgttgcagctcgtggaccaggtcctccgcatgctccaggccgttggccacgcgcgtgaggaagacaggcgtgccagccccatacgaggacgagcaacgcacgctccggttctccgggccccccatgtcgacgagcgcggggagcaacacgcgggcccagtcgagcacttcgggccacagcttccccaggatgtggaaggcctcctccgtgctttgcagcaggggcatgggccgccaggtgcccgtgctcccatcgtccgggatgcccgcctggtcgcgccggccggtgatgccgagcatctcgctgtcgtccagcaccggaacgttccaggtctcggaccagggcaatggctggatgctcacgggcgcatcgcccatgagcggcagcgggatgcgcagcccggggccggagtgcccctcgacggagagcaggcactccgcgccagagaagtgccaaacgacgcgcccctcgccggggccgcgcacgtcgagccgctcaccccgaggcaggcagtagagcgtccgcggcgtcacgaagaaggcttcgccgtgggtgacctctccccgcagccgctggacgatgagcagagaagcaaggttgcccatcaggcattgaatcaagccaggcccgacggcggcgggccccagcaagcggccgagcagcaccgtcgtgctccagtgctccaggaactcacgcgccagcgccggcgcgcgctcgacgagctcgaacgcctcggagaggagggactgaagctccgtggcacatccccccaacttcccgagccgctccggctgttggacccagcccatgagcagatcgagctgccccatctgctgcgcacgcaacagctcacgcgccgaggcttccgtctcgggggacaacggcgtcgggaacgtgaaggcatcttggaattgcatcagtgactccagtcgagcaccaacggcgactcgtgcgacagatgggacaggaacgtgaagatggccgaccggacgtcgtcgtgaggcagggagagggccgcgctcacgtcgccgaccatctcggcgaccgtgcgtccatcacattggtccagcaggagcgcctcgagcgtcgacagcggctgatagcggatgcccgccgggctcgcgtaacacaggacctcggacgtctccggcgacagcgggcgcgcgtccagcagccgcgccaggtctcgtgtgactcgcaggtggtagggacccaacaccgggcggcgctggaggaggctgtcacgcaggaccgactgatggctcgcgcgaagcgcctcggtgcgctcgtcacggcgggccaactccttcatccggcgtgacatgcactgaatgtggaacaggccccggtccatccacaggcaggccgccaggtcctcccgctgcggctcctcgagcgccggctcagacaggagcgcggcctcgacagcggcgaagtagccagcatccatgtccgtgggctccgagaccttcgacgggaggagcgagaccagcctcgccgcgagctcgaaggccttgccctccacgaggcagcggagcgtccggggcgccaggaccgccgcgggggtcttgttgacggacacctggcaccgctccagcaagtagcgcaggtcgcgggtggatgcgcgcaccacttcccggatggcttcgaatggctccagccaacgcacgaggtcgttgttgtctccccagccccaacgctgaatgggtttgctcgggtgatatcccgtgaagaaggtcgtcagcagggcctggggacgccgctgcccccgcgccggttcgaaacgacggccgggctgcagcagcgcgcagcgctccaggacgtgctcgccatagacgagccgatacggaggcttccagggcacgagcgccgagtcatgagcgcgagtcaccgcggcggccatccaatgcgctctgtcgaccgggtagcgctccaggcggtcttcccgcggccgccccgccatggacagcgtgcccccacaggtcgcgatacgcgctggcttcagccaatcgcagaacgcgagcgctcccacggagtccatctgattccagaagccctgccactggaccgaggcccccgtgggaacgaaggcgacatcaacccggccccggaaggcctccagcgcttcgcgcgtccggggtgaatccgtcacatccaccgcgtccagcgccagcacatccggcgtctccaccagcagggcacattgctcctcgccctctcccgaacactgcgcgggcaggatgtggatgcgcaggtcctgggccagctcgacgacgtccccctccaggaagggatggagattgcgaaagcccagcgccgtgagaatcgcgcgagcgctcgactcaggcgccgcgccaggcttcggcctgtcgaggaagtagagggcgacgtcttcgcgaagccccaacaggctgggtggatggagatggtcgtcgtgcgcgtgggagaagaagaccgcgtccaccgacgacaggtcatcgaagaaccacgcgggacatgcaggctgccgaaactccagctcccgcagcaccagcaccgggtcgatgagaaccctcagaggaccgcgctgaatgacaaaagaggtgtggcccaggtgctcgatgaaagtctgcacagcctgcccattatgaatattcagaattcaacgtatcaattcacatccccgagcgtcaatccaggccacggggaatgacgactcagcgcggccggagcagctcggacgtgcggtgtgtggccagataggccttggcctcaatcaccggggcccccgtcaaacccagcttgacgtgcgcgagccgcttatcgaagacactctctcgcgtggccgagccagcgggcagattgacctgcgtgcgtcccggccacgccagcagcgcgtcacgccgtgagggtgcgcagagcccccgcgtcacgagttcgtcgagcaggcgttgccaccggggctcctcggcgggctgcgcacgtccctggaacgagcactcgagccccagcgtcggcagcaactgcggcgccaggtccaggttgagcatgaagcgattgacgccgagcgggaggacccacgcgagggtgtcccgcagttgctggaagtctcctggccacgccacggcttccaggtacgccaccacgcgctcgggaggcacgttcttgagcgtgaagcgcaggttcttgctgcgccgcgacatcatcacgcaggccgcatagaggtgtgcaccgggaggcagcgcctcgatgcagacatccattccccgctgaagctcaggcgtgagcggcgcctcatccccacgcaagagcggaagccccgcgtgcagcgtcgcgcggtaggtatccgacttctgctggtggagcgcttcgttgacggcgacaggctggtcccgtgtgcagaggaacacgatgggcagcggaggcgaggcgacgggcgcgtccaggtcgaactccagccagaacgcgtcgacttcccggtcgagcagcccgcccggctcagcccacgctcgtgcgaagtcgcgaatgcgccgccactcgggagcggcgaacaagggcgctgggagttctgagtgcggatgcctgccagcaagcagcgcctgcccgtcgtgtttgatccccaggatgaagtccacccgaggcgtcccctccagcagccggacctcgaagcccccatctccctccagcgccgcgggcagccattcacccagcgcgagcaggcgggctcgcgactcgggagaaaacagcgcgggcggataatcattgtcgaaggccgccaacgtctccttccaggtgcccgaccgaggcgggagcgcccccgggaggaagttgtcggtccgctccgccgcgatgcgcgcgattcggacgtaccggacgagcgcttcgatacacagcgccgccgatgcctcgagcgagccgtagacgacgtccccggcctcgtacagcggcgccacgggccagagcccctcctcgctctgcccgctcagcagcagggacgccatggaatccaacgtccgctcgaagaggttgacgtccgtcggacgccccaggttcatcagggcgctcatcgcgagggcgacattcaccgcgccgcgcacctcccccttctcccagagcgaaatgagttctgcccgaagggggaccgcgagctgccagtggtcacccacgtgacgaacccagcgcgtcagcagatagcccagcaggaaaggcgaaaccgcgggctcaccgcgtgcgcagcccagaagcccctgggttcgaaccttctcggaaacaagcgcggcgcggcccggtagcgaccgcccttcgtgcgccgccaggagcaggaggtccgcggtcgtggcgacgtctgcttcagggggaacaccctcgatggccgccgcccctgactcggacgatgtctgcgctgcgtcgcgcgacaggagcgcagcgagcgccggaggtgggtccagcggcatgttccattgcctcaacgccaccagcgcgcgggccgactcccccgcttccgaccgttccgaatccggggagaaacgccagaagccggtcgacgcgcgactggagagcagccgccgcacgcaggacgccccatgcgcattcgcagccccctcgctctcggccagcgcgaggagaaccagcgttgccgccgccggcgagtccaccgaatgaacgcccgctcccgtggaagccagcatctccgcgacgggaaactgctccagtgcggcaaccgccgcgccaatcgcgccatccagcatttctgccgtgggccggatcggctctcctggactctgaacagacacgggcttcctccgagcaacgctggcgaatggacgcaaagcgtgcccgagcgcgaagctcagggtcaatcacctctccatgtaaattgctgaaatcaatttagacccccactccttgtaaaattggcgaactgatactctcgcggcgctccatcctccacccggcagcgagggcccgaagccccggcgcgaaacacgtaccggggcccctggcgggacgacgtgtccgccagcgtgaagccgatgcgggtgttacgcgcgggggcttccggctgctgttgcacgaatggtccgaggagtcgctccacgggttcctggtggcgtgcaagcacggccgcatgcctcagccggcgaagctggtgtcccccgcgtgctacgtccagctccccgccgttacggggatgcgcggacaggcgccgaggagcgcttcatgcggaccagatggcttccacgcgggagcgcaccttgcgccgcgcctccgcgaagccgggctgcgcgcgcaggggcgtcagcgccgggcagcggtccatccactccaggtcgatgagcgccaggttcgccgcctgctggagataacgcagcgcctcggcgggcgcgccccggatgcacatcaactccgccgcgagctgacacaccatcgacgcgaagcgcgagctcacctgctgccgggtgagcatgtcgtccagggtcgccatcgcggcctccaccgacacctcgcccagggccgccgagcagtaggtggccacgtaggaggccatgtggctcgggtcttcgttcaacgcgtcccggcactggcggacgtcgtccatgtcgcccctccaggccgcgacccgcatgcggaggatgaggaccggcatgcccagcaggggctgactgttcaggcgcgccatgcaccactggtaggtcgcatcatcgccacgcagcgcactgcaacgcgccacctcgaccaggcagatggtcatgcccggctccagtgagtaggccagcttcaagcgcggcagtccttcgtccgcgcgccccgcctcacattggaggttgccgaggagttggagcgcgggagcgaacgtgggggccgtgtcgagcgccgtgcgcaaggccaccaccgcgtcccgccaccggccttcgcgggtggccaggatggcctgggccagcttcgtctccacgagttccggcgccacctggcgggcccgttccaggctggtccgcgccagggcatcccagtcgacctcgtccgccagggtgctgatgaagcccgcccgaagcgtcgccaccgcatgctgcgccgccgcgtgcgggaagccaggcaccgaggcgtgaagctgttcgagcggcgtgatgacctcgtccttcaattcgcccgtcatcgagtgcgcgagcatccgggagagcgcctgccggtagagggcaagggcctccgctggcacggtggagcggtaggccaggatggtcaactcgccgcgcagggcttccgccagacgctgccccagccggtcctggagctggaatgggtcgtcatccgcatcgtcgaaacggccgctccatagctgcgtgcccgacgcgccctccaccacccggagcgtcacgcgcaccgtcttgcccgcggcctggagcgtcccatccaccagcaactccactcccagctcgcgcgccgcgacgcgagggtcccgctcctgccggaaacgctccgtggccccgctgctctgcacccggaggccccgcgtcctcgacagcacgtcgatgagcgcctccgtcacgccgtcgcccagaaatgcctggtctgaagcgcccaggaagcgcagcggcagcaccgccagcgactgctcatcagggcgcaacggcgtgcgagctaccagcccgcccgaggacatcgaggcatggccgaaaccgctgggctgtggcgtggacgcgccatgggtagcagccgaaacctgggaagcgccgctggaccttggcgtggacgtgccgtgagttcccaccacggaggacacgctatcgccacccagcgcgtgtcctcgcgtcccgaggtgcacgccatgggcatgtttgggctcgatggcctcgccgacagaaccaagccactgcctcagcgcatccgccacacaggccgcgtcccgcggccggccggagggctcacgcgacaagcacgcgagcaccaactccgccagcgcatccggcaccgccgccagcaaacgtggatcaggcggcggctgcctcagacgggccacagccacggccatgggcgaatcaccggcgaacggaggcgctccggtgagcaactggtagagcaccaggcccgtggcgtagaggtcggcgcgggcatccacctcgccactctccaactgctcgggcgccatgtacatgggcgtgcccaccagtccctgcgtgcgcgaagccccctcgcccgccaatgcccgggcaatgccgaagtcggtgagcaccacgcggccacgggcctccaccaggacgttggccggcttcaagtcccggtgcacgacacccgcggcatgcgccgccgccaggccttcacagagcgccaggaccagccgcgccgcccgcgcgggaggcaccgtgtgctcgcggtccatcaacgtttgaagactctctccctccacgtactccatggtcaggtagaggcggcccgagtgctcgcccaggtcgaaggtccgcgccacgtgccgatgggtgatgcgccgggccagacggacctcgcggcggaagcgctccagccactccggcgcgggcgaagcgcccaactccagcaacttcaacgccaccacgtcgcccaccagcgtgtcccgcgcccggtacaccgcgcccattccaccgcgcccggccaaatcctcgaggacatagcgcccggcgaacagcgcgccttccgtcacgtcggtgatggcgggacgcgggtgcggcgatagcaacgtcgcatcggtcccctcgggtggcgcactccggtttttctcctcggacacagcgcggaatctaccctgccggaagtcggggcgcccggcattcaggatgggcccaggatttctggaatatcgagaccggcctcagcgagacaccgggggcgtctccggcggcttcggcttgaagagcgcgcacgcgcggaccggctgcggcgggtacttctgaggcagcagcgggcagaggatgaaggtcgtggtcctcgactggacgtagcgaggtggcgcggcgcagcggtggcaaaggctgtcgggaaacggcagcgattcgggcgggggcgtcgtcatggccttcggtcctggagcatcgcacgaatcccaccacgtgcctggtgctcgtggagagcggccatgccagcgatgacatggccgctcgcgaataccgcttcagtcgcgcagttcgagccacacgggagcgtggtccgagggctgcttgcccttgcgctcctcgcggtccacgtccacgaccgtcagtcgttcggccacgggcgccgtcacgtagaggtggtcgatgcgcaggcccaggttcttcgggaagccgagcatgcggtaatcccaccaggtgaacttctgaacgccagggtgcagcctgcggaaggcatccgaaagcccgaaggcgcccaggcgctggagggcatcccgctccttcagcgtgaagagcgtctggccttcccacaacttcgggtcataggtgtcgatgtcctcgggcgccacgttccagtccccgcccagcaccaggggctcgtcgggcttgtcccgtgtgtccaggtagcgccgcagccggccgtaccactccagcttgtactggtactgcggcgagtccaccgactggccattgggcgcgtacgcgctcaccacgcggatgccgcccacggtcgccgcgatgaggcgcgcatgcgaatcatccacgccgtcggacaggcccttcacgacgtccttcggctcctccttcgcgaggatggcgacgccgttgtacgtcttctgcccgtggacggcggcgtggtagcccaactcccgcacggcctccatggggaagtcgtcgtccacgcacttgagctcctgcaggcagaggacatccggctgggccttcttcaaccaggcgagcagccgttcctgacgggcccgcaccgagttcacgttccaggtggcgatcttcatcgcgcggaccgtcgcatgccgcccgcgccccccgccatgcttttccccggccctgtggccacagggccacacagccccctccgtccctctgggagcatgcgtggcacgccagtcgcaatgacgccgggtgggaggccggcacacggccccccggagtccccgtcccgggagctccgccagcagtcgaggccgccgccatgcgccgcaaccacacgaagcccacgtcccactccagcttccgcccgccggcctccgtgcggcgcgcgctggtgctggcaagcctcgtggtgctcggactggccctggcgtgggcggatgcgccgctgcccagggcactgcgcgcgtggctggccgcggaggagcctttagag

SEQ ID NO: 1203 - DNA, 23738 bp, Myxococcus xanthus
ttgccgcatacgccgggaatactccgaacgtgctaagcgcaactgatctgtgtctgttgacaatgtagttgtgccgacttgttctgtagttccgagcgcagagcgagagcgcgtagaatgcgaccgacaaaacgaggaatctgggggcgtatgcaaatatcgtcagaggcattgagccttgtacgagggccgcaggagtgtttacgctggcgaaccatgcgatcgctgcgataattgttgctgtggccgtgacgccaatgagccacttggctgcagagtctttgtgctcaactgcttcgttggcgaagtgctctgactgccgggcaatgaccgtatctatggagagcttcttgaggtcgtcggcaagttgttcacattcgactcgcgtcttcttgacggctaccagttcgttttcgagttttgactgggtgctctcgatgttgggggatctttgcatttcgagggcgattatcggggcggcgactctgtagagggtgttgtactggttgcttatttcttggctgtatgactctggcggggtggtgttggttggtgtccttctgctgctgggggttgttagggtggtgattgcgctgtgagtgcgacttcttagctccttgctggtttttgagggcgtgttgctgatgtctatcgaggcgatgagcttgaggagggagatgaggttcgttagatctgttgtggggttgtgatcgggatctggtgtgccgtcttgtgtgatggtattttgaattttctccatgttgaggttggagatttttgactcaaggtgttcgcgatagtcgttgttggggctggcttggttggttggcatgcgaggagcgtatcgcatgctgattttggatagcgaatggggggcgatgaatcgcgccgcgacgccctcgttctccaagagttgcgctgtgtgctagtgaatgggccaacccatggttcccgtgctgttgtgcctcgggtggctgctctcctggctggtggctttcgccagagactcctcgagctgtttggccttccgctccattgagatgcagggccgacgatgaggatggggcacccgagactggtgcgcttcggaggcgattgaatcctcagaggcgacgcgtcagcgagtcctggatgctgctgcatgggccggccgccggttagatgtgcgactcggcgtggagggggcacttccagtggaggctgtgccggaggtgtcggtgcgctcgtggttcgccaagcgcgcgcccgccaagcggggggccatccgttctccctcggaagaatcctgagagataccgtacccggcagtacgtcagtctttccggagccggaactccaaccgggaaagcaacttgggcagtgaccccgacaggaatcgaacctgtggcctgcggtttaggaaaccgccgctctatccaactgagctacggggtcgtgctctcaagtcactgcgctttctggaggaagtccgccagaaaggtccagccatgctcccccaagccggggcgcgtgcacaacgacgtgccttatagcaggcggcccggcgcgcgcaacgcgccagcatcaccgtttccagccttccgctccctaggggccctgccgggcgccctcagcgtgacgcgggaacgtcccggaaccggaccatgcgaccccgctttccgtcccagacgttgagtcgcagacaggccagcacgtccctggggtgcagggtggtggtgcgcgggttctgcagttcggggatggcggccatggcctccggcagccggtagaaggggatgcgcgggttgaggtggtggacgtggtggtagccgatgttgccggtgaaccacgccatgacggggccgcaggccaggtagctcgacgcctccagggccgcgctcgcgtgcgtccagtccgggtcctcgcgcagcgcgacgtccgggaagttgtgctgggagaagaagaggtacgcccccagcgcgtagccgagggacagcggcagcaccatcgccgtgaggtacacgcccaggcccccgaagtggaacaccgccgcgctgatggtcacgtggaggagcacggcgaagcccgcgctccagtagcgcagcgggtgcttcacgaaaggcacgatgcacagcccacccaggaacgcgagcgggtacgcgaagatcatcacaagcggatgccgctccaccacgtaggccagccgctccagcgccgtggcctctcgccactgctgcgccgtccacgtggtgaacgtccctgacgcggaggcagccagccgcgccgtgttcgcatggtggtggttgtgcgactcggtccagacgcgcggcggcgtgagcagcagcaccgcgtgggtgtggaacagggctttggcgatccgcgagcccgacagcagtgaaccgtgcaagtagtcgtggaccaggatgaaggagcggatcagcgccagcgcttgcaccacgctgcccacgatgcgcaggggccaccaggagggaagggcggcgagcgcgatggcgcccagcagggccgcgaaggtggtgcctacttcccaccagctccgccgcgtgtcctgcgcagcgaagggccgcgtgcgggcgatgaggttccgctcggcgtctcgggagagtgaggtgaaggcgctgctgcgggtcgcggagtccattcggaagtccagggctggcacggcggcggctgccgccgattcgagtccctggaaccatgcccacccactgtcatgcgaccgtcatgggcagtgctattggcagacaccactcacggatgctgcgatgcgttggatgtcgcgctgccccgtctggcccatggggcccgacggggcacggctcctcgttacgagcgatgcttgttggcccggaactcgctggcccactgctcgacgatggatgccacctgctcgcgctcggagcgctgcgcggtcggaatcaccgaagcctgggccaactgcagaatcggcgcgctgtcgccactgggcgtcgggaccacggggctggcgcccttcttgcggacccagacgcgaggcccctcgctgggacgcacgggctccggggtgacggcggtctccggtgcctccgaagactcgcggcgcttccggcccaggatgacgtccggaatgctgttcggcgcggcgtcttccgtccacgcgtggtgcaggcggccggacgccaccatgaggcgccgcttctggtagtgggccgcgcagtagcccaggctgcgcaccggccgcttacagccgatgacggcgcaggctcgggcttccggggcgacttcttcctcggtggcgtcgtcgggccccgtatccagggtcgcgagcgacgacgccagggcgtccagggccgcgttcggcagctcacgccgcggctggcgccggaggccgctgggggacaggctctccgcgatgcgcagaagcgtgtccgtcagcggcgacagttgcccggcgagttcctcggccagcacggtgcggaacgcgcgttccagcggcggcaaggatgacgcgggaacgcgagtgattcgcgtggattgatgagagggggcggaacgaaggctacggggtcttggcatgtcgatgagtgcctgtggtcgctgccggttgcttcaggggaccgtggagcggacggccgttgcgttagcacacctgtggccgaccgcccaggacagcctgtcaaagggctcgtgagtggatgtttcgcggcgataacccaagcggtgcgtccccatgtcaacacggcccgcgtccattcaatcccgagccgcgcccgcccccccaaaaaaaggtatgtcggagtcctacctgtcgagtcatcggcatgacttccagggaacacgcttcttcctcggctgaagcaggctgctgcggcaggatgcgcgtgtcgtgcaacttcactgagaggaattgcccgtgcgaaacatctcgactgtcgcggtgtcggtggttgcgcacctactgcccctgacgtgacgtctcagcgctccacgctggaggcacccggcgtagatgcgctttccgactggcggcatcgcgattcggccgcgcgagcgttcgcggcctcgtagccgcgacccacggcttcgagcagcgccgccgcgcgagcgtagtgtccggcggcctgtcccttgggcagcaactgttcgtccgcgtgcgcggcggcgagcaggaagggcagggcgcggtcctcctgccccgcttccatccagtggtgggccaggatgatggcgggcgcgccatcccgttcgaagacgcgtgcaagccggccgtgcaggaagcgggcggcggagtcggacacgctgggcgtgggaccgcttcccagcaccagtgtcgtgggtgaagcgctccgctacgaggatctgcgcggactccagctcggacagcgccgcgtgcagctccgccacgctgacctggagcgcctcgggcgccaatgcggctcggaagtggaggtccgctcgcgccgccaactgcgccgtgagccgggccaggggtgtgaggcgctccagacggcgttggatgagcggccccactcgccccggaggtgggagccggcgcggccagtcccggtggagagcgtccgtttcgatgaggtgcttcagcgtctccacgatgtacagcgggttgccccccgtgtagcgcgtcagcgcctcggcgtgaggttctgcgcccggaagctccaggcccgcgagcagttgccggacctcttcgagcgcgagcggccccacctcgatgacacgcgcgagccccgtgtccacgagtttgcgcacgttggcttcggagtagggcgggagctctcccttgcggaagcagtcgatgaaggcgggcgcgcgggccggcgcttcgtacttccgctccatcatccgggccagcgagtacatgaacagcttcgcgctggcctggtcccagtattggacgtcgtcgacgacgatgacctggtcaccctcgtgcagcagggccatcgcctccgcgtgggcctcgtagaagcgcagctcgtcggcctcggaggcgagcggtggcagggcggtcccattgcccagctctggcacgatgcgcgacagctccgtccggacccagtccggcatcacgatgccgggccgccgggccaggtgggctcggaccgcgcgtgtctgggaggcatagggcacctcctggtcacccgggcgtgcttcgagccggaaccacgtccccacggacgcggcgaactcctcggcgagccgtgtctttccgctgcccgcgtctcccgccacgaagagcaactgccccgcctccaggccttcctggagctggcgcagggcgtgctgcctgcccgcgaggacgggcgggcgcatcacgctcatgggcagcggtgctcgggtgggctggggggaggcggtccacgccgcatccttttcgatggtgcgcaccagggtgagcgtctccggcatgggagcgacgcccaggtcgtgtgacagcgtgctgcgcagccgctcgaaggccgcgagcgccgcgccccggtcaccccggaggtagtgcaggcggatgaggtggcggccggcctgttcggactccggctcctgctgcacccaggcctgggccagggccagcgcggtgggccagtcccgcgcgtccatgcggcgttggacttcggcctcccgggcgttgcgcacccatccctccacggcggcacgggctccatccagccaccgcgacagctcgtcgcagtcgtcgaagctcactcccgtcaacaggccgacgccggtgccctgcagcagcgcttggaggacatcgggggacaggggctttcccgcggcgcatttcagcctcgcgaggtccagcgtgacgtctggtgacaggcccagtcgttgggagtccccgtccaccaggtccgtgccgccgcagctcagccggagccggcgcagcagttggcgcatgttgttgcgcacggcggcgggcggtgagtccggccacagcaggtgggacacggcggccttcgacgcggggccctccatgcccaggtaggccaggagggtggcggctcggcggtccatcctcacgcgctgcccgtcgggaccttccaggtgggcatggcccaggacccgagcgctccagccccgcatcttcacctgcgccactccgtcatgcgactccgcttccggccagttcgaccccatatcgaacatacggaacggtgccggaaacgggtcttcggataaatggttttatttgaattaacagcgagggcccaagccgtctcggggcttggaacgcgggagtctggccggtacaacgcgcccctgggcccgcgggcatgtcgtcctggccccggctgtcatgatcgcgaacctccacaacgccgacatcccccagcccgtgctggacgtcatcgcgcggctgcgcgacctgggccacgccgtctacctggtggggggctgcgtccgggacatggtgcgcctggtccaccccaaggacttcgacgtagcgaccagcgcgctgccgcaagaagtccagggcgccttccgcaaggtcatccccacgggcatccagcacggcaccgtcaccgtcctccagaatggcacgcacgtggaggtgacgacgttccgctcggagggggattacctcgacggccgccggcccagctcggtggccttcgagcgcgacatcgtcaaggacctgtcccggcgcgacttcaccatcaacgcgatggcctacaacccgctggaccgcgagctggtggacccgttcggcggacaatcggacctccggtcgcagctcatccgctgcgtgggctccgcgcaggagcgcttctccgaggacggcctgcgccccttgcgcgccgtgcgcttcgccgcggtgctcggcttcgcgctcgattccgccacccgcgccgccattcccgccacgctcggcgtcttccgcaaggtcgcgctggagcgggtgcgtgaggaactggtgaagctgctcctgtcaccccgggcggagagcggtctgctgttgctcgcggacaccgggcttctggacgtgttccttccggagctggcgcgcgcggaagcctcggccgccgcgtccgtccgggccgcggtgcaggcctcgccgctggaggtggaggtccgtgtcgcggtgctgctggccgatttggtggaccgagcccaggcgcgcgacatcggcctgcggctgaagttccccaacaaggtggcggacctggtggcgctgctcgtcgaacacgcgaaggcggagactcgtgtgggggagccggacgccgcgcttcgccggctcctggctcgcctggggccgccgcagcttccgctgtgggcagcggtcgttcgcgcccgggtcggagtccgccagccggacgcgctcccagcggtggaggcgctcattgcccgcgtggaggcgctcgccgccgcgaagccgccgttgacggcgaaggacctgtcgctgacaggaggcgacatcatggccgccctgggcgtggggccttctcccatcgtgggcgaggccacccgcttcctcgtcgagtccgtcctggatgatccgagcctgaacacggccgacgccctgcggcagcggttgcaggcgtggcaggcgcaggttgctcgctgagccggcgggctgcacggagtgacggggagcgggaaagggcgcccttcgcgtcctccccgcgtgcgcccggacgcgcgggcgtgtaggaaggagcaccatgcgagtcgtcgttgcgatgagcggcggggtggattcctcggccgcggctgccctgctcaaggagcagggccacgaggtcatcggtatcaccctgcgcgtctggtcctacgagggcaaggcgacgtgtgggagttgctgcagcccggatgacatcgatgacgcgcgggccgtggcccagacgctggggattcccttctacgtggccaacgcggaggagatcttccaggaccgggtcatcaaccccttcgtccagtcatacctgggcgggcgcacgcccatcccctgcgtcgcctgcaaccgggacgtgaagttcaacttcctcctcaagcgcgcccgagcgctcggcgcccggctggccacgggccactacgcccgcgtggaggaggtggacggccgcttcgtcctgcgtcgcgccgtcgatgccgccaaggaccagagctactttctcttcacgctcggccaggacgagctgcgcgatatcctcttccccgtgggcggcatgacaaaggcggaggtccgcgccgtcgcggagcggcacggcctggtcaccagccagaagccggagagcatggagatctgcttcgtgccggacggcgactacgcgggcttcgtggagaaggtcgccgggccgcagccggccggggacatcgtggacaccgagggcaacgtgctcggcacccaccagggcatccaccgctacaccgtgggccagcgcaaggggctcaacctggggggcggcgagattcgctatgtccaccggctggagccggagacgcagcgcgtggtggtgggccccgccgagggcaccggccgcgacaacttcggtctgctccaaccccactgggtggacgggccgcctccggccagtcagccggtggaggtccgcatccggcaccgccactcgggcgcgcaggggcgggtgcatgtctcgccgcacgggctcgtctccgtgaagctggacgcgcccgcgcgcgccgtcacccccgggcaggccgcggtggtctacgatcaggaccgcgtgctcggcggcggttggattgtctgacccgcgttgcctcggagggtgcagcacatggcgcagcgcctcgtgggatgtctgatcgcggtcgtcaccgtcttcgcggccgctggctgcaaggagcgctcggacaaacccgtcgcggggctgctcgccgccggtgcgccggtgctgcgcgcggaaggcaagcagtggcggcccatcgccgtcggctcgcagttgctggggcatgacgagctgaaggccaccggccccgcggtgctggagttcttcggtggtggcctgcgcttcctggagaagggcgacacgctggaggtgggcgaagcggacgaggcgaagctccatggcgtcaacctgccgtcccgccacattgtcgagggcaagctccaggaggcgccgcgcccgctgcgcatcatcgccgcgcgctacacccaggtgcaggtgacgcccgcgagtgcccagcaggaagacccgtacagctccaacggctacttcgtcgccttcttcacgcccaacgggctgtcgcccaacaagacctctgacgaaccgtcgcgggatggccctcgcaagccgttgccgcctccgccacaccgcccccgcgtgccccacatccacgcaggcaacctgggcgagggcggtctggtggccaccgtggaggatggcttcatcgtggcggagacggacgacctggccaccgccgtgctgctggaagggggcgatgtgccgctgggccgcacggtacgactgatggtgcccgccggcacggaggtggtcctgcgcacgcagcagggacgcaagattgaagtcgaagggcccgcggacgtccggttgcggtgaggggacggggagggtggtttgtcctttgggggcccgcttcggtagagtcctcggtcgcccagcgggaggtgtgcatgacgcgcagtgagctcatcgagcgcatcgtggagcgtgccacgcatgttccacggcgtgaggtggaagccatcgtccacgccgtcttcgaggaaatgtcccaggccctgatcgccggacggcgaatcgagctgcggggcttcggcgtcttctgcgtccgcacgcgccgggctcgcacgggccgtaaccccaagacgggccagcgcgtgtcggtgcccgcgcggcgcacgttgtccttcgccgccggaaaggacctgcgcgagcggctcaatgccccacccgccatggcggcttcccccgttccggacaccccacccggggaggcgctgtcgccgctgccgctcgccgcgggggcttcgttctccgtgcccgtcacgggttgacggtgaggcttggagtcgttccgcgaatttgaccggctcaggggtggggcgtactttgccctccatgccgtcgctacaggccgcaacacggatttcgtgtggccgttgcgaccgcgcccgaggactttcaagccatgcgtgatgctcaccggatgaaggagaagttcgacgtctctctggacaaccggcagatcgtcagcctgctcatcgccggcattgtcgtgatgggcgcggtcttcgtgctgggggtcgtcgtcggcaagaagctcgcgggcaacgcggatgccgtggccgcgccggacctgctctccgcgttggatgccaacgcgcaggcgctccagaatgtgcagcaggagcagccgctcaccttcccggacgaactgacccgcaaggccgctgccgagccggtggccccgccgcagcccaagcccgttgtcgccaaggctccgccgccgacggagaagcccgccgccgcgaagccgcccgagccgaagccggccgccgcgcagcgcgccgcgctggcgcccacgccggacccggacacgggggagctgccgccggaggagcccaaggccgagccggagcgcgtcgtggtcgccgaggcccccaccgctccgactcccgcgaaggccgtgccggtgtcgggcaaggtggaggcgtccgccgtccccacgcgcaccaccaccacggagggtggcggcctgaaggaggccattgcccgcgccacccagcagccggcgcagcccgcctcgccgcccgcgcaggccgtgaagggtggggccttcacgctccagctctcggcgttccaggacaagcaggaggccgaccgcttcgccgctcggttgcgtgatcggggctatgccccctatatcctgacggccgaagtggccggtaagggcacgtggtaccgcgtccgcatgggaagcttcgcctcccgggatgcggccacccggtatctgtcagacttcaagcgtgagacttcgctcgacgcattcgtggccggcacgaactagagcgggacgaggaagacgggaagcgccatgacgacgacgaagcgggtggagaagccctggggatacgaactcatctgggctcacaccgaacgctacgtgggcaagctgttgcacgtgaagcagggccacaagctcagcctgcagttccacaaccgcaaggatgagaccatccacgtgcagagcggcaagctgctcttcgtcgtcgacgagggccaggggctcatcgagaaggagatgaaccccggtgagagctaccacatcaagccgctcaccaagcaccgcatggtggcgctgaccgactgtgacatcctcgaggtcagcaccccggagctggacgacgtggtccggctcgaggacgcctacgggcgcaccggcaccagcaacccgtagccgttgtccaccgcggcggcccgcctattcgcgggccgcgttgttcgggttgcgggtccacttgtccaccgtgccgtccccgtccaggtcctcgccgatgcgatccacctggccaccttcccagtactcccagtagtcgatgcggcccgtcccgcgcgtgtcgcgctccttgcgcaccagcttgccgccttcgtagtacgtgaagctgtccgggcggccatcaccgttggtgtcgcgctcgcggcgcgtgttgacgcccttctcatggaagtaggtggcgtccacgcgtccgtcgaagtccaggtccagtgactcacgcgccttgtcgccgttggcgtcgaagtagcgcgtcaggtccacgcggccgtcccagttcaggtccagctcctggcgcaccttccgcccgtccaccgtgtaggtccacacgtccgggcggccgtcgccgttggcgtcctgctgcgtgacttcctcgttggccccgcgttccgggcggatggcctccccggcctgccggcccctcgcggtgcccgcgccatcctgctccgccgacttgctactggcgcagcctgccagggcccccgaggtcatgaggcctaggaaaatcaactgcttgtagcgtggcatcgagaactcccagggtctgggggccgcttggcgacgtcattcgcacgagatgctttcgcgcgacacgtcatttcatatattttcacatatcgccatggcccgaaagaaagtcagcaccaccatctacatcaccccggagcagaacgagctcctcaaggcgctgaaccagaagacgaaggtgcccgtggccgagtacatccgccagggcatcgacctggtcctggagaagtacaaggcgcagttgccggggcagtcgacgttcgacgagctgtgagagagaggcgtgacgtgaagagcatgcgtgggaagcgggtagcggtcctgggcggcgccggcttcgtcgggtcgcacctgtgtgagcgtcttctggatgacggcgcggcggcggtcatcgccgtggacaacctcatcactggcaacgaagagaacctgcgcacgctgaacgggcggccgggcttctccttcgtcaaggcggacatcaccgagcgcatcccggtggaagggccgctggactacgtcttcaacatggcctcgccggcctcgcccatcgactacgcgcagctcccgctggagacgctgcgtgtgggctccattggcacggagaacgggctgaagctggcggaggcgaacaaggcggtgttcctgatggcctccacgtcggaggtatacggggatccgctggtgcatccgcagcgcgaggactactggggcaacgtgaatcccattggcccccggtccgtctacgacgaggccaagcgctattcggaggccatcaccgcggcctacgggcgcaccaagggcgtgcaggtccgcatcgtccgcatcttcaacacctacggtccgcgcatgcgcctcaatgacggccgcgtggtgccggccttcgtgggccaggcgctcaagggcgaggacttcaccgtcttcggggacggcagccagacgcgctcgttctgttacgtgaaggacttggtggacgggctggtccggctgatgctgtcggatgagtcgaacccggtgaacatcggcaacccccgggagatgaccatccgtcagttcgcggaggccgtgcgcgcggcggcgggtgggggtgggagcatcatcgagaagccgctgcccaaggatgatccgaagcagcgtcagccggacatcacccgggctcggacgctgctgggctgggagccgaaggttccgctggaagagggtcttcgggagaccattgcgtggttccgagaggttgccggcacgaagcccccggcatagtttgccggcgcgaagatcctgcatggcctgcaggcgggaggttgcgtgaaggtcctggtgacaggtggcgcgggcttcattggctcgcatgtgtgcgatgagttcctgcgcggtggtcacgacgtcatcgcgttggatgacctgtccggcggcaagcgggagaacctggacccgcgtgtgcgcctggcggtccacgacatccgcagccgcgaggcgtcggagctcatcaagtccgagaagcccgacgtgctctgccacctggcggcgcagatggacgtgcgccgcagcgtggacgacccgagcttcgacgcggacgtgaacatccgcggcatgctcaacctgctggaggccgcccgcgtctccggggtgaagaaggtcatcttcagctccaccggcggcgccatctacggcgagcaggacgtgttccccgcgccggagagtcaccccacgcggcccatttctccgtacggtgtctccaaggcgtccggtgagctgtacctgggctactaccgggcgcagtacggcctgccctacgtggccctccgctacgccaacgtctacggcccgcggcagaacccgcacggtgaggcgggtgtggtggccatcttcagccagcggctgatcgccggtcagggctgcaccatcttcggcgagggcaagcagacccgcgacttcgtctttggtccggacgtggcgcgcgccaaccggctcgccttcgagaacgactacgtgggcgccatcaacatcggcacgggcgtggagacggacatcaaccgcctctacgcgctgctggccgaggcggcgggctccagcgtctccgtcgcccacgcgcccggcaagccgggggagcagatgcgctcctgcgtggacaacgcgctggccaggaaggtgcttggctgggagccgagcgtcgacgtgcgcgagggcctgcgccgcacgcttgagtacttccgtcagaaggccggcgcgcccgctcgcgcgcacggctgagcggcgtccagcgcccccgctggcggtcgaggcgggggagggcggtaccccttcccacggacgtacccgggccggccctgagggccggggaccgggcgtgccgggaggggctcagggcctgtcccaggggagttcgcccgggatgggcgctgatgaattgggaacaaacaagctctcccggtgggttgctcatcgggcgtacgcgtgcgcgtagattttcgcgcgattccctgttacgcacgcccgcttcttccgacgagcgccctgaacatgccggctgaaaacgcgcatatccgcaacttctgcatcatcgcccatatcgaccatggaaagtcgacgctggcggatcgtctcctcgacaagacggggactctgaccaagcgcgaggcgcaagcccagttcctcgacaacatggccatcgagcgcgaacggggcatcaccatcaaggcccagtccgtgcggatgaactacaccgcgaaggacggcaagcagtacgtcctcaacctcatcgacacgccgggacacgtcgacttcgcctacgaggtcagccgcagcctggccgcgtgcgaaggcgcgctcctggtcgtggatgcgacgcagggcgtggaggcccagacgctgtccaacgtctacatggcgttggaccacaacctggaaatcatcccggtcatcaacaagatcgacctgccgagcgcggacgtggatcgcacgcgcgcggagattgaagacgtcatcggcatcgatgcgtccgtcgccgtgccgtgctccgccaaggagggcatcggcatccaggacatcctggagtccgtcgtgcagaacgtgccgcctccgagcggctccgcggacgcgccgctcaaggcgctgatcttcgactcctggtacgacaactaccggggcgtggtgacgctggtgcgcgtgctggaaggcacgctcaagctgaagcagaagatcaagctgttcagcaacaacaaggtcttcgaggtccaggagctgggcgtgttcagcccgttctcccgcccggtgccgcagctcatcgcgggcgaggtgggcgtgctcgtggccaacgtgaaggagctgcaggacgccaaggtcggtgacaccgtcaccgaagagtcgcgtcccacggccgagccgttcccgggcttccaggaagtgaagcccatggtgttctccggcatcttcccggtggactccgcggactacgagaacctgcgcgacgcgttggcgaagctggtgctcaacgactcggcgttcacctatgagccggagtcgtccaccgcgctgggcttcggcttccgctgcggctacctgggcctgctgcacatggagatcgttcaggagcgcctggagcgcgagtacaacctgaacctcatcaccaccgcgcccagcgtggtgtaccgcatcaccaccagcaagggtgaaacgctgctggtggacaacccggccaagctgccgccggttcagcacatcgagaagttcgaggagcccatcctcacctgccacatccacgtccccaacgaccacctgggcgccatcctcaagctgtgccaggagcgccgcggtgtgcagaaggacatgaagtacctgggcagcagcggccagcgcgtgcaggtcacctacgagatgccgctggcggaggtcgtgttcgacttcttcgacaagctcaagagcgtctcgcgcggctacgccagcctcgactacgagctggcgggctacatcgagtccgacctggcccggctggacatcctcatcaacggggacccggtggacgccctcagcgtcatcgtgcaccgcgagcgcgcctacctgcgcggccgcgaggtgtgccagaagctgaaggaggtcatcccgaagcagatgtacgaggtcgccatccaggcggcgattggcgcgaagatcatctcgcgtgagaccatctccgccatccggaagaacgtgctcgccaagtgctacggtggtgacatcagccgcaagcgcaagctcctggagaagcaaaaggagggcaagaagcgcatgaagcaggtcggaacggtggagattccgcaggaagccttcctcgcggtcctcaagtcggagcagtagcccatgaacgcggccatgccttccgccacccctcccgcgaagctctccgaggcgatggcggcccgccgcacgccggagatgcttcgcgcccgcaatgtgctggtgtggcgcgagcgcctcaccagcctctgggctccgttgatcatcctggcgctgctgtacgtgccgtacacggtgatcatcgagtactcgcgcgcgtccgccgtgtgggcccagccggtgatgaaggggctggggctgctgctggtcctctacttcgtggccctgctggtgtggcgcaacgtctcccccaagaagaaggcgctgcgcggcgtgcgccatgatgcgaacgagctgctggaggagaacgagcgcatcctccgcaagcccggcgtgagcgcgaaggtggcggggccggtgctggaccgcatcgccgagcaggcgctgcgcgtggagcaggcctccgccgcgggtgacgcggagcaactgcgcaccgaggtgaagggcctggaggcgttgaccgcgcagcatctgggcgcgttccgcaagcagtccgccatggacttcctgggcgggttcggcaaggcgctgctggtggcgctggtgttccgcaccttcatcgtggagccgtaccgaatcccctccggctccatgctccccacgctggagattggcgaccaggtcttcgtcaacaagttcatctacggcgtgcgcgtcccgttcctcaacttcgtgccgttcgtcatcgtccggccgccggagcgtggagacgtcatcgtcttcaacaacccggtgaacgagtcggtggactacatcaagcgcgtggtcggcgtgccgggcgacgtggtggaattcatcaacggcgtcgtccacatcaacggccagccgcagaagcgcgagctcgtctccaacgagttcaccgtccacaacatcaccgacgacgggcgctggtacgaccagcaggagaccctctacgaggagaacctgtccggcgtggcgcacgccgcgttgcagacgctgccgcgcatgccgcgccgggaaggcccctacgaggttcctccgggccacgtcttcgccgtgggtgacaaccgggacaacagcgcggacagccgccacggcctgggagtcacggggtacggcaaggcggagtacgtcccctacggccacatcaagggcaaggccatggtggtgtggctgtcgctgggctatcacgggctgctgcacggcctgttcggtggcaccggcctccgcgtggatcggttcttcgaaccggtccgttgaggcgttcgctgaaagcaggcaggccgccgcgccgcgcacgacgcttgacgtgccgcacgccccggggtacgcggcgcccccggccatgagacacctgcttggaatcgaaggctggcgccgggacgagctggagtcactgctcgaccgggcgaaggcacacctccccggcggtcccgacaccacccacctgcttcgcggcaaggtggtggcgaatctcttcttcgaggactccacccggacccgaacgtcgttccacatggcagcgaagggtctgggggccagtgtgctcaactggactcacaccggctcctcggtgtccaagggtgagacgctgctggacaccgcccgcaacatcgaagcgacggggccggtggccatcgtcatgcgtcatcgctcgtctggagcgccgcacctggtggcgaagcacgtgaagtgcgccgtcatcaacgcgggtgatggcacgcacgagcacccctcccaggcgctgctggacgccttcacgctgcgccagcgctggggctcgctggacgggcgcacggtgctcatcgtgggcgacgtgctgcacagccgcgtggcccgctccaacctgcactgcctcaaggcgctgggcgcccaggtggtgatgtgtggcccgcccacgctgcttccgccggggctggagtcgctgggcgcggaggtgacgcacaacctggatgctgcgctccctcgcgcggacgcggtgatgtgcctgcgcgtccaactggagcggcaggagcaggcgttcctgccgtccacgcgtgaatatgcacggctgttcggcctcaacgcggcccgcgaagagcggatgaaggcgggcgcggtgagtgatgcatccgggccccatcaaccggggcgtggagctggcgccggcggtggcggatggcgcccgcagcgtcatcctcgagcaggtgtccaacggcgtcgccgtgcggcgggccatcctggaggtgtgtacggcatgagctccacggtgctcttcaggcgggggcgtgtcatcgaccctcgcaacggggtggacggcgtccgcgacgtgctggtccgcgacggcaaggtggtggaggtgtcggtgaccctgctgccagtgccctccagcgccgaggtggtggatgccaccggcaagtgggtgctgccgggcttcatcgacctgcacgtccacctgcgcgagccgggcgaggagggcaaggagacggtcctcaccggctgccgcgccgccgtggcgggtggtttcaccgccgtggtggccatgcccaacaccaaggtggtcaacgacaacgccatggtgacggagctggtgctgaaccgcgcccgcgccgcgggcctgtgtcatgtctatcccgccggggccatcaccaagggcctcaagggcgaggagctggcggagatgggcgagctggtgtccgccggctgcgtggccatcaccgatgacggccgcccggtgatgaacgcgtcgctgatgcggcgcacgctccaatacgccacccagttcgacgtgcccgtcatggtccacgaggaggacctgacgctgtccgcgggcggggccatgcatgaaggcaccacgtccacgcggctgggcctgcgcggcatccccgcttccgcggaggtggccatggtggcgcgagacctggtgctgctggaggagacgaagggccggctgcacgtggcgcacgtgtcctgcgagggcagcgtgcggctcatccgcgaggccaagcgcagcggtctgcgcgtcacctgcgaggtggcgccacaccacttcatcctggatgaccgcgcggtgggggactatgacacccacgcgaagatggccccgccgctgcgcgcggacaccgatgtgcaggccctgcgcgaggcgctggtggacgggacggtggacgccatcgccacggaccatgcgccgcacggggtgttggacaagcaggtggagttcgagaagggcatcaacggcatcgtggggctggagacggccctggggctgacgctggagctggtgcatgcgggcgtgctcaccgcgaaccgcgcggtggagctgctgacgcacgggcccgcgaaggcgttcggcctgccgggcggtcacctggcgcctggggcgccagcgcacgtcacggtggtggatccgcacgcggagtgcacggtggacgcccaccagttccattcccgcagccggaatacaccgttccatggccggaagcagaagggtcgcgttatccagacgtgggtcgcgggccacaaggtgttcgacaagggccaggtcggccagagcaaggagtcgcggtgatgacgaagcgggcagtgctcgccctggcggatggcaccacgttcgaaggccgtgcgtttggcgcggtgggcgaaacggtgggtgaagtggtgttcaacacgaccatgtacggttaccaggaggtcctcacggacccctcgtacgtgggccagattgtcaccatgtcgtacccggagattggcaacgtcggcgccaacccggaggacgaggagggctcccgggtgcacgcggtgggcatggtggtgcgcgccctcagcgagcagccgtccaactggcgcgcgaaggagtcgctggacgcgtacctgaagcgcaacggcgtcgccggcatcgagggcatcgacacccgccgcctggtgcgccacctgcgcacgcatggcgcgcagatgggcgtcatctccagcgagggcctgtcccccctggccctggtggagcgtgcccgctccgcgcgcggcatggagggcctggacctggccacgggcgtgtccacgaaggaggcctacaccttcacccagccctcgccggacgtcttcaccggcttgggagaggtgcgggtgccggccgagccccgcttcgacgtggtggcctatgactacggtctgaagaagtcgatgctgcacttcctggtggatgtgggctgccgcgtgacggtggtgccggccaacacctcggcggaagaggtgctggcgcgcaagccgaacggcgtcttcctggccaacggccctggagatccggcggcggtgaagggcgcggaccgcaccgtggcggcgctgctgggcaaggtgccggtgttcggcatctgcctggggcatcaaatcatggcgctggccctgggcggccggacgtacaagatgaagtttggccaccggggcggaaaccagccggtgaaggacctcacgacgggcaaggtggaaatcaccgcgcagaaccacggcttcgccgtggatgacgccagcctcaagggcctggccgtcgtaacgcacatcaacctcaacgacggcacggtggagggcctggccgtcccggacgcgcgggccttcagcgtgcagtaccaccccgaggcctcgcccggcccccatgacgcgcgctatctcttcgacaggttcgcgaagctgatggcggggtaggatggcgccaccgaatatgacctcgtcgctgtcaccgctctcctatcagccgtatctggatctgctcatcgcctttggcagtgccgagccgcgcaaggaggatttgctccaggccaaggcggagtacttccgtctgacgggcgaggtcttcgaggacgacaagctcttcgaactgcggatggcgtccttcctggacttctacctctatgaccgcgtctcgccgctgacgaacaagacgccggccacggagttctacgagcagcgcctggccggttccgcgcccgaggaggccaacgccttccggagcttcacggagacggtccatggcctcttcgaggtccgcaagctgggcaagggcgaggtccgtcttcgcgagctgtactcgggcaaggacttcgacgtgacggagcgccgccacgtcgcgggcctggagacgggggacatcatcgaggcgcgcctcattcccttcggtgggcacctgctgttctcctccgcgttctgctaccacccccgcatggccgtgaaggccatcaaggcggaggtgaagcgccgaaagaagaaggagccggaccgcacgcccaacgagctggtgtgggagtgcgcccgccgttcgctcaacatggagcgctaccggcagctcgccgtcgagaagatctacgacttcgagcagaaggtcctctgagcccgctggccacggagccccggtgacggcaagtcccggggcctccacgggcccgctcagatgcggtggatgctcatcaggttggtgttgcccgggacgttgagcgggacaccggccaccaccacgacgggcgtgccgggcgcgcagagcttctccttccggcacagctgacgcacctgggtgagcatggcgtccgtggtggacacgcgcgccacctgcatgcccgtcacgccccagtagagcgccatgcgattcacggccgtctcgctcggcgtgagggcgatgatgcgcgcgtggggccggaactcggagatgaggcgcgcggtgtggccgctctccgtgtaggcgacgatggtgccaatgcccagttgcgtcgccgccgccacggccgccgcggccacgccggtgcccaggtcctcggagcgctcgaagggggagtggtgctggtgcttcaccacgccgcgctccgtctcctccacgatgcacgccatggtggacgccgcttcgacggggtacttgcccgcggccgtctcgcccgacagcatgacggcgtccgcgccgtcgaggatggcgttggccacgtcggacacctcggcgcgggtggggcgcgcattggccaccatgctctccagcatctccgtggcgacgatgacgagcccgcccatgcggttcaccgcgctcaccatgtgcttctggatggccggcaggcgctccaggggcatctccacgcccaggtcgccacgcgccaccatgatgccgtccgccacggcggcaatctcttccacgcgctccaccgcctggggcttttcaatcttcgcgatgaggggcgtcttcagcttcgccacgtgcgcgcgcgccttcttgatgtcctcgggcgtgcggacgaaggacagcgccacgtagtccacgcccacctcctgcccaaaggccaggtccaccgcgtccttgcgcgtaatcgtgggcaccgacatgggcgagccgggcaggttgaggcccttgtgattcttgagcacgccgcccacctccacgcggcactgcacgtcctgcccgtggacgcgcagcacccgcagccgcacgcgcccgtcgtccaggaggatttcgtggcccttggccacgtccttcaccagcgacttgatgggggtggggatgacgccgtcctggcccaggacgttgcgcgtcgtcaccgtgacggactggccctgcttcaccagcagttgccccccgtcgaagcggcccaggcggatcttcggcccctggatgtcctggaggatggccaccggcgtgcccaggcgcttcgcgaccttgcggatggtttccactcggcggcggtgctcctcgtgcgtgccgtgcgagaagttcaaccgcgccatgttcatgcccgcgcggatgagcccttcgatgacctcgggcgtgtccgaagcggggcccagggtgcagatgattttcgccttgcgcatattgccgcgcatcctaggcggcggggtgcccggcttgacagccttgcgcccgcgagactaactcttcgacccacgcgggcccggcttcgggccgcgcggagcctttgcgctctcgatggcagagagagaaagcccggcatccctgggaggggggccgggctttcttgcaagtgcctctcagcaggccctagagctcgatttccttgcccgtgcccagcggcgtcttgggcatcgagtggcccggcggcaggccctccatgtccatgtcgatgggcggctcgctcggggcgcccggggcagggaagccgggcgcgtccagcggcccgctgccgcccacgccggggccttcctgctggaggccctcgatctcctcgcgggtgatgccggccagcgtcagtaccttgcgggtgacgcggatgcggtcatgcctggtcacatgcatggggatggagtgtgtaatccatgtggtaaccctcctcttttatggcgcgcagtttaagggtgcggttccagaacagtccgcgttcgggcgggggaccaggaatgaatgtgttcatgggcgcccagcttggtcaccaggtcgtccaggaggtcctgtttag

SEQ ID NO: 1204 - DNA, 23091 bp, Myxococcus xanthus
  unsure (1)..(23091): unsure at all n locations
ggcacgtgcgcgcgagctccagcaccgacagcgcgctccggatgttggccgaggtcgcctgcgccagcggcaggtcgaactccacgctggcggcgcagtgcacgacgtgcgtgacgtgctggcgcacggcgtcggcgtcggcgggagacaggtcgcaagcgggctgctcgaggtcgccgctcaccaccgcgacgcgctccgtccagcccggctggaggcgcgagaagcactcggcctgcgccaccttcgcgaagcgctccgccgccgaatgcacgcggccctggcggtccttcgactcgcgcaccagcaccgtgacgcgctcgacgccctgcgcgagcagcgcctccagcaccaccttgccgacaaaccccgtgacgccggtgagaaatacgtggcgggacatcagtgcgcctcctcatccggggtcagggccaccgggccgttgattccgcagttcgacgcgccgaagacgttgtcggggtcgatggcggccttgaccttgcggttgagggccagtgcggcctccgagtacacctcgggcaggaagtcgcggcgaatcttcccgacgccgtggtgatgcgacagcgagccgccagcggccaggatctcctcgcgcgccgcatgctcgagcgccgcgtaggcgcccaccgggtcgctgacgccgcgcgcgtagaagcccagatagaaatagatggccacgcccgtctggtagacttgcgtgaagcggccggtgaagaagaccttgcccggaaggcccagcgcggcgtgctccttctccacgcggcgctgcacgcgctcgtagaggtccatggcacggctccacggcacgctcgtctcgaagctctcggcgatggcccagtgctcgaaggtgaggtcccggatgtacgcgatgccgaaggtcaactggtagccgcgttcaccgttggcgccaccgcccttcatgccgccgtgctccgaggcgatgcggtacaccgtcttctcctggaaggcgacctcctcgcgcgagccctcgaacacgagggtggccacggcgagcttgtacgggtcgaagcccttgagcttcgtcaccacggccttctcgacctcgctcttcaccttcgcggccagcccgtgcttggctggcttgagcgcctggccgaagtggaactgggtgttgtccatcacccgcacgctggccggcaccgctcccgactgctggagcgcgtagaggaacgagaggcccgtttcgaggtcggggaagatgaccgagccgtagcgctgcacttcgggaagggggaacagcttcaccaccgccgtggtgacgatgccgaagttgccctcgctgccgaacatgtactggcgcgggttgacgcccacactctcccggggggcctggcgcgggcgctccacgatgccctggggcgtgacgacctgcatgtcgagcaccaggtcctcgatgttgccgtagcggttcttcttcatgccgctggcgttcgtggcaatccacccgccgagcgtggagaactcgaggctgtccggctcatggcccatggtgaagccgaacttcgcgagctcctccatcaggtgacggcccgtggcacccgcctcgatgcaggccatgcggttgacggggtccacccacagaatccggttcatctgccgcatgtcgacggcgatgaccaggcgctcctcggagagcgggatgcgcagcgcctccgtcacattggtgccgccgccgaaggggatgacacaggcgccgtgctgggtggcgacctccaccagtcgcaccacctcatcgtggccgcgcgggaagacgacgaggtcgggcacccggtccagctttccgtagcggatggcccagatttcaccgccggtgtggccatggccacggcgcaggcgctgcttggggtcgtcggtgagctgctcttccttcaggaactcgcgcagcgccgctacaagcttgtcgttcttcttcgccgcgggaatctcgggcgggtagtgcggctcgttgcgattgtcgtaccccagcggcgaggccagcttgccggcgaaccactgcatcaagtctggcagcgcgacattgctgatgttgtagcgggtgcccgtgagaacggtgctcccgtcgggcttcaccacgaaacgcgtgtcggcgaagccccagccttcgagtgattcttcgtccttcgacgcggcaggcgtcggcggcgtgaagcgcgtgtctccggaggaaggcgtgggtgacgtgctgccgaagcgctcgctcacctcattcagcgccacattcccaagacggcgcagcaaacctgattgtttagccatggtcactcgcagtcgtacacagggccctcttctccgtcaacgcgcgcgggttacgcaggtgcgcactgcgttacgcgatttcggaaccgccggtctcgtaagtgggttgtttccgagacccgaagtctcgtaaaggcgagtcatgcggacgggacgacccagggatgaaaaagtgcgcctggccattctcacggcggcgcaggaactggtgctggagaagggctatgcggcggtgacgaccgccgacgtggcggagcgcgcgggggctgggaagcagaccatctaccgttggtggccgggcaagggggcgctggtgctcgacgcgttctccgaatgggtgagtcaggcgccccgcatgaaccggcgcaagccttccctgtcctcgacgctggtggagttctgccggggggccgcggaggcggcgcccgtgctgcgagcgctgatggcggaggcacaattcgacgaggacctccaccggcggctcatcgcccaactggtgcgcccgcggggtgacgagctccgggcgtgcctcgccgatcgccggcccgccgaccgggagctcgtggtcaacgtgctctccggcctggtatggcagcgcctcatgctcaatgagccactggacgcacgtttcgtgcgcttcgcgctgcgggtggttcagcgcatctgaggcgggcggctctgttgggggccaaccggggaggcgtggaacgcggtggcggctcgcggtcctcctgtgctagctagcccggagccacttgacgctccgatggcggccgcgacatctcgttgcgaccgtagggtgtcctcgagtggctctgtcaggcgtgtgcctctcgagcattcaccacgttgttgctggaggctcacatgtcctcgtccgaacttcccgttctcaagttcgtcctcacgaactacaagaatttcaacgcgcgcgcgacgcgcgatgcgctcctgtcctactgggagcatgtgtcgaacggtggccggatgttctggagcgtcgcgggcgcgatgtcgtcggcgcagctcggcatcacgctcgcaccggccatccgggcggggctgattcacggtctgtcggtgacgggcgccaacatcgaggagtcgctcttccggctcgtcgcgcatacggggtacaaggacttcccggagtaccgctacttcaccaagcaggacgacacgcgaatcctcgagcagcggatgcgccgggtcaccgatacgagcatccccgaggacgaggcgttccgcgcggtggagaagattgccgttccgatgtggaagggcgcgaccgagaagggcgagcgccgcttctggcacgagtacttctacgcgttcatccaggcgctcgacccctccgtgtatgagggtgacccggaggcctgctggctgctcgaggcggcgcggctccgtctgcccatcgtcgtccctggctatgaggactcgacgttcggcaacatcttcgcgtcttacgtgaaggcgggcgacttcaacgcgagcatcgtcaagtctggcattgagtacatggccgacttctacgaccgctacgaggagatgtccgagggccggggtgtcggcttcttccagattggcggcggtatcgccggtgacttccccatctgcgtcgttccttcgatcaagtacgacctgcagaagccggtgaagccctgggcctacttctgccagatcagcgactcgacgacgtcctacggttcgtactcgggcgcgacgcccaatgagaagatcacctgggacaagctgaccgagacgacgccgatgttcgtcatcgagtcggatgccaccattgtcgcgccgctgattctcagcgccctgctcgagtgcaagagcaacccggaagcggcgaacgcgctcatcgcgaagcaccagggctagccgtcgcagcaggcggggcggctcgcgccgctccgcacgtgggaatggcgtgacgctgccacgacgcacgggatgccgtgcgtcgcggtcccccagtcagccgggctccacggatggccaggtgagccgtaccctcgtcccgtgtggctccacggcgctgaaggccacgtcgcagttgaaccggcgcgccagccgctccacgagggacaggccgataccgaagcccgagtgtccgggttcgacctggccgaagcccacgcctgtgtcggagatgctccagccctctggcgcgatgtggatgacgatgcgcccctggtgcgtataggcgagcgcgttcttgatgaggttgcccagcatcactcgcgccacggaccccggaagtggcgcgaggacctcctctttcgcctcgatgacaagcgccacgtcgccgtgagggcggtgtttgccgtacagcgcgaccatttcgcgggagatgctcaccagtccgcacgattcgtcggagcggcctgaccgggccagccagaggatgccctctgtcagcaggcccatgtggtgaatggcctgccgcagacggccgaaggtctccgtgtccgcgggtgggtccaactccagtatctccaccgcgccttgcgccacggcgaggggcgtacgcagttcatggctcgcgtcccggttgaaggcgcgctcccgctccagcagttcctggattcgggcatcccggacacgcagggcttcggccagggcccgcacctcggtgaccccgacgtccacttccggcgccagagtatccgactggacgcgtgccacgagctgttccagcggacggctgagcctcctcgcgacgacaagggagagcccggcggcgcccagcagggccagcagggcacttgccagcagcagtccggacgtctggcgcaggtggcgggtggtgctcgtcagcgccgtcgtgtccaagaccacgtagcgcgtcgtgccagccgacgcgtccggtcgcaccgcgacatggaagtgcccacggccttgagcaaagacctcgtattcgccgcgaggtgtgtccagggggagcgcgtctccgagccaggacggaaggccttcgtggccgacataggccgtcattccaagtgggatggcccccgtgtcatccctgcgtccgtccgccgcggtggcgacgagccgagcgaagatggcgtcttcgaggtcgtagctgaagagcgtgaagaacgtccccatcaggacgagcgcgagcgccgcggacatgcccatggcgcccaggaggagacctcggaccgacctagtcctcgcgcgcatccaggcggtatcccttgttgcggagggtggtgatgcagtcgctcatccccagctcggagagtgctccgcgcagggcatagacgtgggtgcgcaaggcactggactccggcgcatcgtccccccagaggtggtgggccagcgtggctggcgatacgggctcgggcgcggcctccatcaggagcctcaggaggagcgtctcggtcttgttgaggtggacggtgcgcacgcctcgccgtgcctggcccgtgtctggctccagcgtcagtggccccaccgtcagccgccgtccgctcggaggcacggggcgccgcgccagggcttcgagccgcagccgcagctccctcaaggagaacggcttgacgaggtagtcatccgcgcccgcgcggaagccttcttccttgtcatcgagggtgtcccgcgcggtcagcatgaggatgggcaccagccggggagcgagctgccggtagcgttgacacagctcgatgccactcattcccggcagcatcaggtccaggacgatgacgtcgtattcctggcccagcgagagcgtgaggccctggggcccggtggcggcgaagtcgagctggaagtccttccccagaaacctctcgatgttggcctggaggtccaggttgtcttcgacgacgagcactcgcatgggtgggcaggttatcagccgccacgtcaaccggaggtcaaccgggtgttgacgcgtggctgacgcggagggcggcaaggtgaccgggcttcttacctctgggagaaccgcgatgacccgcttgctgtcgttgtgcctgctgcttctatccgcttctgtggcgcgtgccgccgccctggaaacgtcgttggacgttcgcggcgcggatggagaacgcatccccatgcgggtgctggagccggagggagccgccgcgaatccacccatcgcagtcctcctgcacggccttacgcgccgcaaggaggactggctgtcgaacgaggggccaacccacggcggtgtgctgaaggacgaactgctgcggtccggctaccgcgtctatctcctcgatgcacgccggcacggagagcgggcgacacccgaggccaggccaggagcgctcgccaagcgggcccatcaaggggacccctcggggtacgtggcgatgattgccgacaccgtccgcgatgcccacgcgctgctgaccaccgtgctcgcgaaaggccagccgcctcgggtgctcgtcgccgggtacagcatgggcgcgcaggtgggaatcctgctggcggcgcgtgagccgcgcatgacccacctggtcacgatggttcctcccaacatcgacccgtcgatggaggagggtgccccctcgcgtcacatggcgagcgttcaccaagactggctgctgctgacggcgaacaaggatgacttcgcgcctgtcgcggacagccgcgccctgttcgatgccgcttcgtcccgtcgcaagacacacaagaccttcgacagcgggcatgtcctccctcgggagtacctggaggaggtgcgccgctggctccatgcggaccgccgagcgcctggccgcaaggatccatgaggagcccttaccgtggaccgcccagggtccggaggaagaacaggcccacatcgtcccggtagtagcggctggcggcaccccgaggggagtgcggctggccgggcatgatgagcaattcgaagcgcttgcccgcgcggatgagcgcgtccgccatccgcatcgtcacggagagcgtggcattcacgtcgctcgtgccgtgcatcagcttcaggtggcccctcagcctgtctgcaatcgcgaggttgtcgcccgccgcgtacccctggggattgacgcttgggaggttgagatagggctcgttgatgatggcctcttcctccagcgctccgggggctccggcgtagcccgccttgaagaagtccggcgccgtcagcatgccgcgcagcgtgaaatagccgccccacgaaccgccgtggatgccgacccgctccaggtccatccaggggcgcgtggacgcggcctgcttcagccccgcgacgtagtcgggaatctccgtctggcccacgcggccgtagttcgcgtcctggaaggacttgctccgtccggggccaccccgggggtccagcaacaccacgatgaagcccagttgcgccaggccgctggcggtcagcgaatccgaagtccccaggaagctccaggggacaacggtggtgaacggacccgcgtagatggaggcgagcacggggtagcgcttcgaggcgtcgaagtcgcgtggcttgtagagcacgccgtgcaggggcgtgacgccatcggccgccttgacgagcagcgcctccggccgcgtgtcgccgagcgactcgaactcactcgcgtccgacgtggtgagccgcacgcgcttgccaccctccacggacaccagctccctcaaccggggctgtgtccgcgaggaccatgtgtccacgtagtactggccggagggggacggcgtgatgcggtgcatccccgaggcagaggacagccgcttcaacgcgcctcccttcaggcttccccggtagaagaggtgctcgtatggcgcgccgctgtcggcggaggccagcacgtagagggcatctcccgtgggggcgactcccaccacttcgtgcacgggaaaggcgcctcgcgtgagctgcctcacgcgcttccccgagcggtcatacgcatacacgtggcgccagccatcacgctcggacatccagaggtagccgcgccctcctggcagcgccgtcacctgcttcgcccagccgcccaccgcgaagtccaggccggtgacgaaggtctccgggcgctcctcgcgcaggacgtgccgacgctggcccgacgcgggttccacgacgctcaggtccagccgcttggcgtcacgcgagaggtggagacacagcgcctcggtgccctcgggattccagccggcgaaccagtcatatgtctcgccctcgacgggcggaacgcgcgtcacgcggcccgtcgccacttccacgacatggagctccgcgcgcggcagtggcgtcccggacttcgtgtacggcaccgtcgtcaccttctccagcgcggaggagtagtccacgacgggcacctggtgaacggcgcggaggtcgtcccgccacaccaccaggaagcggccatccggtgaccagggacgctccggaatccgccagtcgaggttcgcttcccccgtgcgctcgaccacggtggcgccttccgcgttcagcaccgcgaagccgccctggcgttgcacggcgagcgcgccgcctttcggcgcgaggaagtgctggggcgacagcgtcagcgcggcccggtcctccggcgacagcaaggtgacatggccacctgacaggcccaggccaaaggtcttcccctccaggcggaacacgatgccccgctcatccggagcgagcgcgacgtcgaagaagcggggcgcggtgatgggcttgcccagcagcgtcgagagctgctgcctcagttgctcaccggaaaggagtggcttcagctccccggtcttcgcgtgcgccagcacccacgtcccgccgtccttgccctcacgggaccagaagaccaaccggtcgccctcacgcagccacctggggggaaccaggctgtcccgcaggagttccgcccggcggacgaaccggtccgccaggtccagcttcgcctggacctgcgcatccggcgtggttccggagggggcgaggggggggggagcgtcatccagcgccaggccgggggctcccgtcagcgccgtgagcatcaggccgaggggaacgaaggggaatcgcatgcgccgatggtaggaagcggcatccttcacgaccaatatatcttttgatgcgcattgagatggatatcgtctcgatatggaattccgtcagctccagctcttcgtcgccgtggcggaggagttgcacttcggacgcgccgccgcgcgcatcggcatggcccagccgcccttcagccagcagattcgccggctggagtccgagctgggagtcgagctgctcacgcgcacgagccgccgggtagccctgaccgccgccgggagccgcttgctggaggatgcgcgcgcgttgctggctcggcgcgcggatgtcatccattcggtgcagcaggcggcgagtggagagacaggcacgctgcgtgtcggcttcgccgcgtcgtctgccttcggcgtgctgccggacatcgtgctgcgcttccgcacgcggttcccgaaggtgaagctggagttggacgacagcgagacgctggatgtcggcgccgcgctcgtctcgggggagctggacatcgccatcatccgggcgcccttccgtcacgaagggctcaccgtcgagcgactgctccaggagcgcttcgtgctcgccctgccagctcgacacccgcgagcccgtcaacaggtcgtcgcgctgtcctcactggcgaacgagccgttcgtgctctttccgcgtcactccgcgccgggcctgcatgacctggtgacgagcatgtgcctgggcgcgggtttctctccgaacatcctccaggaagccagctcgtggccgtccgtcgttggcatggtggaagcgggcctggggctgaccatcgctcccgcgtcctcccaggcgctgtgtcccaaaggggtggtgtttcgccccctgagcggcgctcccggacacgcggagctggtggtggccttccctggaacgcggcccgcgcccgcggcgcagcacttccgcgtcctcgcgcatgaagccgtctcccgctctggcaggcgtgcttctgactgagcggcactcgcgccacgaggcgcacgtcatgcgcggagggaacgccctacatccgttcgccaggcaatcgactggcctgcttcacccaggcggcgaactgggcctcgtcgagcggctcgtcctcgcggatatcgaggtagcgcgtgtcccggctcttggacgcaccgggtgggatggggcgcagcgaggtgccgcggaagaaggccaccttgatgtacttcgtgaagcagtggacgctgaggaaccatccctggccctcgacgccgtacatcggcgagttccatttgaccgccttgctcacacccgggacggtgcgctcgatgagctcgtcgaggcggtgcccgacgtcgcgtttccagcccggcatggccttgatgtaggcccggatgggggcgtcgccgtagcccttcgcaatctgcggattgccgccagagaggaggaccggctcggcggccgcagcggggctcttgcgtctggccgcggtggccttgggcgctgccgccgatttcttcgccgtggccttcttggacttgggggctgctgacttggcgactgccttgctcggtctggccgccttcgacgtgctcggcctggcggtggccttcttcgcgaccttggatgacttgacagccatggtgttcgctccagacgggcggtgattgggaccgccgagggcggggtgtctcaacgtcttatcgaggaggagttgagcgacccgcgccgcggaggtcaaccttcacttcgagcgcttcgtgggcttctttccgctcgacgtattgagcgcgacggccgcgcggatgagcgccttgaatgccttcgcgtccagcgcctcaccttcgtgaatgtcgatggcgcgcctgttgttcccgtcgaggctcgagttgaagagtccggagggctcttccaacactctggccctcgccgcaagtgcgggtgagatgggcgttcatggggacgccagggtgtggccgaggttgcggtccaccacggtgaagccggcggactgatagagggcgagggaggccgggttgtccgcgaaggcgtacacgatggcctgcttggcgcccagcgtgtgcatgcgccggagcccttcgtgtaggagcgcgcgcaccagcccgcgtcgcctgttctctggggcgcacgccactggttcgaattcgcccaccgcgttcgcctcgtcgagccaacccagcgcgcaggccgcgaggcttccgtcgggcgcctcggcgacgaggtccaacgcaggctggtaacccggtgcctccatgagccgcgcgtacacctctgttgtcacccgctcggagccgaagccgcgccggtgtacgagggctcgcgcggccacctcctcagggccccgcaccgcgcgcacccggtagcccgcgggcaacgaagacggcggagacggcaccgcgggtagcggctgtgcgaggtgcaggtagcatccgcccgtggtgcgccgccagccccgccgctgcagcgctgcgagcagcgggccgttgctctccagcgcccatacggtggtcggctgcgtggtgcgctcgtggcgtgcgcgaacccagggacgcacatcctccgcgaaggcgtcagcgtgcacgagcgggtggacgaacaggtccacatcgccgttgttgtaggcccacgcaaagccagcgagctgccccggcgcgcgttcccacagggcgatgtcctcccgcggccgtacctgtgcattgcgcagcaggcgccaggtcaggtctcccatcgcgcactccacgtggggaccgcgctccgcccaggcttgcgccacgagacgagccatggtgttgaggtcggccacatcgcgataggggcggaggcagaacatctctactcaataacccagacagtgcgtgattcgcactcgtggatgggttgattcaatggtgcgcattgcctttgacgcacctgtgacgcagcgaccggactttggacagacactcgtacctgtacgcccaggccccgcggggggctcctcctgttcggaagcggaggcggtgcgggtcctccaggcgctcctcgcgggtggggttcgcatccagggcgggagggacacgacatgcatctggatttcctgcgggagcatgcggaccggagccccgccatcgcgaaggtcctggcgcaggcgggcctcccgtgacggagccgctcccgccgtcctggggggcgggagcggtgggacggtgcgctactccagcttctcgccgcgagacaacgatgagccgtgagtcaggcggagcgctgctcttctgaagcgacctcgccaacttcaaggcgcgttcgcagccagcgtgccagcgactctgcctgctcctggcgggggaagccggcgatggcttcctggcgcaccccgccgtcggcggtggagagctcgagcgtgagatgatagcggctcacctgcccccccttctgtgtgggagcctggggttcgacgcggagcgaccgcacgtcgcgccaccgtacgtcgagcccgtgtttccgtccggagaaggggggcagggagaggctccgctcctggggatggagacgcaggtcgtagtacccggccttcacccgtgtgtgcgaccaccgcccgacgagcacaccgctgacgatgacgaccccccaggcccccacggccacgggcagcggtgcatggaggcccacagtgagtcctgcgagcgcgacgcacgccagggaggcgcccaccagaaccagggacaccaaggtggccgtccacggcccctcgagcgtcacgcactcactgccgtcctcccggaagaaggtggacaagagcggcggttccggcttccaggcccccaccaccagggtacccagccagagcatcaccaggttgaagggcatcaggagcatgagcgtgaacagctgcgacccgtccatgcccgtctgcaacaccgcctccgagggctggccgggccggtagtacacggggagggtggccccaagggggtagcgtgccaccaactcctccgcgaatccgcggtcccccgagcgccacatggaggggcgggccttgctgccttcatactgctgcccgtcgacggagtaggtgtaggccaccttcaggccgtaggtggtggccttgttcgagcgcaccgcatccacctcgctccgggtgatggtgccctgcacggagggccagctctccgtctgcatttggaggaccatgttggagacggtgaagtagtccgcggccagcgtgatggacgtccacagcgccacgaacgcgagcaagacggcggaagagaccacgcgaaaacgcatggcctcagcttactgggacaccctggattgaaagaaacgggcccgggtcaccttcaagggcgttcttgagggctccgcgactggttacttcaacaccttgaagggcgccgcggagggcgtcatcgggtccctcacggcgggccgggccaatccggccgctctcatctttggaagcgccatgggcgtgctgggtagcaccgaggccgctctacagccgatgaatgacatcgccaaccaattgacccccaccgctgccactgatagtacgtcgtgatgttgagaatgagtatcaatatcgacaccgtcctcgcgccttcgagccctgcctgtacaccgtgaacatgcccacacttcgtcgctggcggggtgcccccgcgccatcctctctggtccccacgctcgcactcctctccgtgctgtcgatgggcgtcgcgcgagcccaggatgcgagcgagaccccggcgccggcgacgtccgcatcaccctctggcgcgacgccgcacccgcaggcgccggagggtgagggcgggcctgcgccatccggtggggtcatccctccggtgctgctggccgagccagaggctgtctatccgtccgaggcactcgccgcggggcttgaaggcgcggtgaagctcctcctgacgcttgatgcggagggccgggtcacgcgcgcggaggtggtcgagggacttgggcacggactcgatgaggcggccgtgagcgcgctcgagaacgcgcgcttctccccggcgatgcaggacggcaaccccgtctcctgccagttcgagttcatccaccacttcgtcctcgcccgtcatcccgaggtagctccgtcaggcgccgaggatgtcgcccaagtcgctcccgacacgcccgcggaagaggcgaccgcgcagccttccgaggagccagagcctcccgctcctcctggcttcacctcggtcgtccgcgccaggtcgaccgaagcccgcgccctggtgcgcggctcggaggccgtggacgtcgtcgaattggagaaggcccatgagcgcgccgaggacctcgcggaggtgctgacgcgtgcctctgccgtgcaggtccagcggacgggcgggatggggagccggacccagctctcgctcggggggctctctggcgaccaggtgcgagtcctcctcgacggcgtccccatcgagtactcgccctatgtctacggactgggaagtgttccggtctcgctcatccggcaactcgaggtcttcaacggcgtcgtcccggtgcgcctcgcgacggacgcgctgggcggtgccatccacctgcgctccgacctcgcgaagcccgaaaccggcgcgtcccctgtcgctccagggcgggtccttcggcagctaccgagggactggcaggctgacgtggcgggcccatgagcacgtcttcgtgcgggcagcgggattccacgaccgcgcgcagaacgactacgtcgtcactgtccccgtggatgacccggcgacagggcgcgtctctccgcgcgccctgcgccgcaaccacgacgcctatcggggcaccggaggcgatatcgaggtggggttcgaggcactaccgggtatcgaccggctcgtgctcaatggctacctcggtcgctacgacaaggaggtcccgcacgatcagttcatgatccagccctatggcgcggtcacctccgcgcaggagagttggggcctcgggcttcgctacgaggtgtcgccccatgagcggctgaaggtgctcgccatcgccgggtacaaccagcgtgtgggcgagcttctcgacgcctccgactgtctatacgactggtacggcgcctgccgtgcgacgcgggcgagggccggggagactggctcgacgccgctggagaacacccagacgcgccagacgttgttcggccgcgtgcggctcctcgggacgctgctcgacccggaggacctcgaggtttcgctcggcgtcgatgacagtgaccgaagcggcgagaacgcctacctcacccgtctgcagcaggaggaccctctccgggtgccgctcgcgctcacgtccgccttcggaggtctctcccatcgtcagcttctctgggacggcaggttcgagaacaccgtgttcgtgaagggctacttgcagcgcttcgcctcgggaacgaggcaggaggccgcggagcgccggtgggccggtggtttcggtgacaccttgcgcttcagtctgacgcgggggctgctcctcaaggcgtcctatgagcggaccacgcggatgccgcgggtggacgagctctttggtgatgggggcctgctcgtggagaactcggcgctcgtccccgagtcgagtcacaacgccaacctgggcgtggagctcctccccatcgtcacgtccgttggccgtttcggcgccaacgcggtcgcgggcgtccgagacgtcgagaacctcatccagctcttccccggcgacgccacgcaggcctacgagaacgtggaccacgcccgctccttctcggcgcacgcaggcgtggactgggactcacccggcgactgggtggggctcaccggcaccgtcacctggcttgacttccgcaacctcgcgcgggaaggccagttcgcccgctttcacggggaccgcatgcccaacattccctggctccaggcctcggcgaccgcgcggttccagaagcgtcagctcttgagcgcccaggacgctcttggcttggagtggacgacccgcttcgtcgagtcgttctaccgctcttgggagagcgcagggcggggtggtgacaaggcgcgggtgcccacccaggtgctgcacttcgccgcgctcacctaccgctcccggttcgaggggcgcgccttctccttctccttcaacctccagaatctcaccgacgctcccgccttcgacatcgtcggtgtccagaagccgggccgcgcgttctccgcgcgcgccacggttgagctctgagcgcccgctgaggcgcttcgagtctcctcgcaggaacccttcgctaaaaggaagcccgatgaagctgaaagcctcactcctcaccctcgccgtgttcgccacggcctgctcggattcggacggcccccaggtggaccccgacgctggaaccgccgggcccctctacgccgccatcacccaggtcgccatcgctggtggaaacacccagagctacctggtgacgttggacgacatcgagaaggcgcagaccgtcgggattggcgacgcaatcgagcttcccgcggacgcgtacatcgccgccggccttccgggcaccggcaagttcatcgtcagcagctcgaggctgccgacggtgaccccctacaccctcaacgcggatggctcgctcaaggccggcgatccgctttcgttcaccagccagggtgtcgccgcgaccggtggctatcagtcccagcactacttcgtcagcgagacgaaggcctattacttcgaccacgtgaactacaagctggtcatctggaatccccaggacctcgccatcatcacgtcgaaggacctgacgtcccagctcaaggatggcgacttctcgttccgctattcgcagagcctggccatcaccgctggcaacgacgtcatcatcgccggtggctggcacgccgcggacgtgaagacggttccggcgaagacggcgctggtcatcgtggacacgcagaccgacgaggtgaccgtcaaggtcgacaatcgctgcggctgggcgcgcgacggcgtcaagcacacggatgggaagatttattacgccaccgagtccctgggcagcggagcgcacttcgtgtctcccgggaccaccggcgcgccctgcatggtccgcttcgatcccgcgacgggcgagttcgatgcgtggtccaccacgctcgattccttcatcaacccggggacggagggtgacatcgccgccatgctcctgcctggagctcccggcaagggctacctgcgggtgatgaacaaggccgccgcgcagtccgcctgggacgccgcggtgaccgccgagcggacgttcaacgggcagagcgccgccgtgggcgcctggtggagcctgtgggaggtcaccctcggcgacgcgccgaccgcgacgcccgtcgtccgggatgacctcgtgcccaccaacggtcgcaccatcccgcagaatcctggtgagctcctggtgctgccggagttcatcaatgacaacgcccagacgcgcttccgcctcatgagccccgagacgggcctcggggacgcgaagacggtcgtcgagggccaggtgcgcggcctcctccggattcgctagccaccggcctgccgttcggagccccgccgtgcatgggcgggggctccggttcatccgtcatcaccaggtctcccgccatgagtctcttcatccctctcgtactggcgcgctcccttgggcagcgcttgctgaacccgctgctcgccgcacgcttccacgtgctcctcgcggcgggtctgctgaccgccagttgcgcctcggggccggtgtcccgcgccgcgccggtggctcgggtggacggggctccggtgacgctccaggacaccttccagttcgatctcgactcgacccacaccggacggacccaccggttgtacgtggcggtccccgagggccccgcgcccgccgccggccatccggtcatctacctgctggatggcggtgcgcactttccctccctggagcgcctcacacgcgccctccccaggctcgcgcggggcttcggcgtcgcggcggccacaccggtcatcgtcgggctgacctacccgggtgaccaggcccacaacgaccaggcacgcggtgaggactacacgccgcccgccccgaatctctcgaacacgggggatgggttctcgaagaagcagggtggggcggatcgcttcctggacttcctgaagaaggagctcgagcccgcgcttgcttcgagattgccgatcgacggctcgcgcaccgcgctgatgggccactcctatggcggcctcctggtgctgcatgcgttcttcacgaggcccacgtccttcgacaccttcatcgcggggagcccgtccatctggtggaacgatcgctacgtgctcaccgagaagaaggccttcctggagcggttcgcgcggaccccggtgaagacgcgtgtgctgctcacggtaggagggctggagcagaagccgcgccagagtgaggggacgcggggcatgttcgccgccgagcggcggatggtcgacaatgcccgtgcgctcgccgtggaactcgaggcgatgggcggcggcgatttcgcggtccagtacctggagtttcccggcgacgaccactacagcgcatggctccccatgctgagccgtgggctgctcttcttctccgccccctcgctgcttccgggcgccgactgagcccgcgcgggccccgccctcctcgtcgggcttggcgttgggctcggtaggaccgcagcccgcctcaggccgtgctccgaagcctgttccgctcccaagacagagcgagctcggtcagccatgagtcgccattcgccgtgcctacgcgcaggtgcgtctcgcgcaaggggacggatggggtgcgctccttcgcatggacgtgggcgaagagtcgggcccaggaagctcctccgagaggaaggcgcgcaccgtggccgcgaacaactcgggctgctcctcgaagggaaagtgcccgctgcccgccagctccaccagccgcgcgtggggaagcgcttctaccacgcgcgcggtggccgagcggggctggaggtcctgggcgccatggatgacgagcgtgcgcgcgcgcacccggcgcagccagtcgctccagtcgtgatgccggcccaggctcaggtagagccccagcgagagaaagcctccggcggcaccggagccgggaagcttcgcgtcgggatgctcgcgccgcatggcctggacgtacagcggtccgaaggcggcgaagtgctcggcgagccgggcctcgtcgtccttcaggcgggcagggaagtcgaaggtgtgcttcatccacgccgccagctcgcgctggcctgcctcgtcaagccgggcccgcacctgggtgaagaggtcgccgtcgccagcgggcatcgtcaccaacggcgcgggtgccaccagcacgagggcctccacccgctcgggccactccgcggcgtacagcgcggccaccagggctccgaaggagtgtcccaccagcgtgaggcgctccttgccgagcaggcgccggatgcgctcaaggtccgcgagctgcgcggcgagtcccagtcgagcctccaccgtctgcagggtctgccacgtgccgccgggtggagcgtgggtaaagggacgtgaagaggcgccgcagcctcgctggtcaaagaagtgccagcgcagggagtcgcctgtcatggccgccgcgcgccagggcttggccggggggaggccggggccgccatgcacgacgacgacgtcccgcccgtcgcccacggcgacatgatggaggcgcacgtccggcgacacctgccaggacggggcgtccgctcgttgtccaggaggaacctccagcgtttcgccccgcgcggccagtaatttctccacggtgcccggccggaagagtgctcgccccatccaccaccaggtgcccgcagccgctcccacgagcaggatgagtgttccaaggactaccgccatgaccttcctccgagacgcgtcttcgggtgacatgcgcggagggtggcggtctccccttgggggagagtcaagcggaggaggcgcgcgctggcattgaaagcggcgctcgcaaccggacggtgcggcgtgctcctggcggcgggcgcggacgctggccggcatgaccgactgcagatgccatcacccaccgcgatgcggagggcgggttcatcccatgcggctacgcgctgtcaggcacgtaggacagcgaccgcttcgacttcgaagagcatcccgtccagcgccagccgagggacgggaatcagcgtacaggtcggcttcatgccgccgttccaggccgcgtccaactcggggccgatgatccggagtttctcctccgtgtggtccaccacgagcatcgtgagcttggcgacatcaccgacgccggctcccacggattccagggccgtgcggatgttctggaacgcctgtcgcacctggagacggaagtcgggctggagggccccggtctcattctctccaccttgccccgccaggtagatgagccgggtgcccggcgccacctgcgccacgtgcgagaagccgtagggcgccgggtcgaacagtcccttgggattcgtcaggaccagcggcgacgtcttcgaggggtctgcggtctgtcccatgattcacctgtatggattctggaggctgcgtatccaggttcggacccggatatgcgagcgagcaaccgtcgctcttggagcatggcgcatgtgtggccagctatttcgcgcggcgcgagttccggccgcccaagagccagagcgtggagagcaggcccagcaccgtcagtcctccgccggcctgggtgcagcccttcttggtgtcgaccggctcggggagcgggtcctcgtccacgatacctccgtccacgatacctccgtccatctcggtccccccatccgagcatccgctcatctggctcattcccgcgttcgcgacccgtgccgcgcagctcaactcgaagtccacgctcacggggggaagcgtgatgttcgcgtgctccagcgtcgccttgagcgtggcccggtgtcgtccgggcgggaggctttcgatggtcggccgctggtaggaatcagcgcagcctacgtagtcacagaatgtatacaggaagagcagctgccggttgtattcatagcgacgcggctcggggctctcctcaccagtggaggtcagcccgctgtgcttcgcatacgaccagggctcgccgtccacctccaccgtccaatgcacccacggaaggaacggcaccagctccggtgacggcgtaaagcgcagcgtggtgaagttcccttccacctgcctgtcgccgcagctcgaatctccgtacacgttgaagatgccctggctcggcgtgtcggccgtcagggtgccagtggtcgtgggtagagggagtgcggggccggcggtgaaggttacggactcggtctgggttggctggaactgacagacaccctttgcctcgatgcggtacgtggtgcctggcaccagcggtgcgtccgggaccaggacctgcgtctgatgcgcgcccggcgtgacggtcgcgggcacctgcgttccatccggcaacagcagccgaacggtggacgaatccacgctctccagcagcggcggcaccgtcaccagtccggggatgttcgagggcaccgcaccgccgtcctcggggaggggaaagcgcacccccaccatgcagttgggggcggcacaggcgtgcgccgacgtgggaatgagcgctcccattccaaggaggaacatccccaccgtgctccatttccacgtgttttcgtgcatgcctcattagacaccggaatctggggattgggatatcacccagatgtggtttcggatgtgcggggccagcgagaagcatgcgttagcaaacgcgtcattccatgcatcgtcttgcagatggggcccgaagaatggtggggcctcaatgtcgaacatgtgcgcgatagatgtcgccgggctcaatcagccgtccgaatgtaggcccaaggcattccgaatcgccgctgcctggcgcggtcggcggcacgggtttccctcggggtacgcttcaggggcccgtgggtaccgagcatctcgaggagcgcgtcgcatgaacccaggagtctccatcgtcgccgatgacacccggagctggggattggagacccctggccctgggctgctgctgagcgtgccctccacgggccgctgggcgcggcggccctcggtgcatctggatgccgctccggactaccggatccggttgcgcggcgggggccagacgctgctatggacccgcatcgattcctactgggaccgcgcggtcttcgttcggggaacggccaccgctccccaagtcctgccgccgctgtccgcacccgaggtccgggccgtggaggcctcacccggctccgaggcgtggtgggaggcctggagttggcgggttgcgcgagcgctcgtggatgcacccctgccagtgctccacgctggccactggtgtctgcgccccgtgcgcgccatcgcggcggagaaggcggagcggcacccagtctcccccatggagtggggctttggtcagcctccgctgccaccgcactcgctggccgccatgacgcggttcctgttcgcgtggaaggaggactggtgggagtcgctgccggaacagcggccgggcgccgtgctcgggctgcgcgcgctctctgcgtccgaggatgggcgtgtgaagagctggcgaaagcgcgcgcgggacgggacattgccgnccgtgctgctgctcttcgtggacatcctggcaaatngggtgggctgatggcatg

SEQ ID NO: 1205 - DNA, 18469 bp, Myxococcus xanthus
gtgtaggtgaacgcccccaccagcgtggtgggggcgccgtccgcgttctggacctcgatgtcgacggtgcccgcggcgtgggccggggtggttgcggtcagcgtcgtcggagagacgatggtgacctgggtcgcggggcggccgcccatcaggacccgcgcgccctccgcgaagtccgtccccgtcaccgtcacggccgtccctccggccgttgtcccccggggtggttcgacgcgggtgatggcaggcgccgcgatgtaggtgaaggccccgacgagcgtgctcgcggcctctcccccattctggacgacgatgtcgacggcgcccgcggcgtgcgccggtgtcctcgcggtgagggagtctgggggatggatggtggggaccacgttcgtgcccccgatcgacaccgtggctccggcggcgatgcgcgcgccccggatggtgacgtcggtacccccaacggagggacctcgggccggttggatgctcgtgacctcggcgccaatgaaggtgagcccctggggcagcgtgccggcgacgccgtcaccgttggtgaccaccacgttggcggcccccacggcgtgcgctggcgtttgcgcgaccaactccgtactggagcggaaaacgacgtgcggtgagggcgtaccgccgaaggagaccgtcgccgccgcgtcgaagaacttgccacggaggacgatgtcctcgccgcctcctggccgcgcgctgttcggcgtcgcgcctgtcaccaggggcgtgcagtatctgaaagcggcccgcgtccccgcggcgcggccgtggttccagaagtcggcggcggcaacgccactccccgcggcgtgggctggcgtccgcgcccggagttcggtcgcggacgccacgacgacgttggtcgcgaggacgccgccgaactccacctccatctgggcgtggaatcccttgccggtgatgacaacgtcagtccccccggacgaaggcccctccgctggcgtgatgctgctcacgacacagcgatagtggaagccgacgaaagtggccggtgccccatggacgttccggacctggacgaccgcagtgcctgggagcgcccgggcgggcacgatgaccgtgatttgggtggcggagacgaacaccatgttcgttccgggagtccccccgaaggtgacggtcgagcccgccgtgaacagggttccggtaatcgttacccgttcacctccatcaactgtgacgttgttgggagtgatgcctgtcacggtcggcatgcgggatgtctcctcgtctgcgggcgattgttcataggccgggccgcggaggcgccccatgggctgcctccgcgctgctcagtcaacgtggggcgcactcaggccaggtactcagcgcggagccgtgtcctcgtggcgtcgtcgagctcacaggtcaccggcaagtcatggtcgcgctggaagtcgcggagcgctcgtcgcgtccacgggcccatgacgccatcctcttcgccacagctatagcccaggtggcacagccgcgcctgggcgccagcgagggtgtccagcggtgcgagtctggcgacttggaacgcgtaggcttctcgcttggagccggagccgaaggtgaccttcagggtatggaccgacgccgatgcgggctcgacgaggaatccttcgctgttcgtcgctccagcgcgctcctcggtcctgacgtcgctctccagcgaaaccacgtagggcagcttcacgcgaggctggccctccgcgtcgagaaaccggacgcgaagcgtctccgtgaaccccttcccacggaggaggtaggcgttgccagcgtcgacgccctccgtcccacggcggggcgcgggaatcacgacggagtccccgggattgaggatgttcttgtccccacggagttccttcagcgccgcgttctcctccgcgttccagagtgtctccggcagatgtccgtgccggtaggcaagggtcgagatgcactcgccggcttgcacgacgtgggtgatggcttccctcgtgtcaggcccactcggggcctgccatgcggcattcgtgtcgcagcggtcccgctcggggggaagcttctcggacgactccagctcccaggcttcgtggtcgagctcacgcgggtggagctggtacttccccatcgcgaggccgcggaagcgcgcgagtccatcagcgtccgtcttcgcgatgagcacctcggactcgctcttctcgagcacgagggtgacgttctccaacggggcgtcgtcggagccgatgacgcggacttctatcgtgtgggctccgcgcaggggacacggaacggtgaggttgccgggggccacgttcgccgggctctggctcgcgacctgctcggcggcggcgagtctcgcgtgcttgtcatcctccgcctcgggcgccgcgggctcaggcggtggccggcgacccgagccggcgaagtacaacgccgcggggtcttgaacgggaggggcatctgattcccagaaaggctcgctcatgcggcaccgcccagcgcagctcgcgccttgcggttgttcgattcagtcttgaggtcacgcaggcaccggcgcgacacccggctcagccgctccgagggcaatgcaatctccgcgtcatgcaggtactcgccaacccaggggcgcgatggttcctggtcgaagtgccagccgaacgatgcgcagaggttcaggaagcggatggtgtcttgcgtgctcgtgaggccgtagccgcgtgcccgggtcaggctctcttcgatgtggatgcgcagttcaccatcgccgaggccatcgacttccctcgggaagtgtgaccgcaggtgggtgaccatctcgctggtgaactgcgtctctctcgcgctccccagcgccgtcagttgttcgcccctgacaatcatttccccagcgtatcggaacgaatgagaaaattcacgtcgagtatgagttctattgcggcccgagctcccgagtgccttcctgctttggcgcagcgcgatggcgctgtcttcgcgcctacaggacgtagcccctggctcccacgagaattgactggctcagcagggagtggaactcggtccgggggcctccgtggtgaatgacgcccagcgcgaagagcgctacgcggctccagacattccactccgcataggcggaggcctgtccgctgccatccaccaggttgagtgaatagcggagctgccaggtcggcccggtgtcggtggggttgttctgcacctgcatgaacaggtagtgccgccccagcagcggcagtccgttgttgagcgccgctcccagcgtctggcccgcgagcgcggcatccggagaggggagggtcaggaccgaggatgcacgggtggcgatgtcgaagtaccgcgcgccatccgcccaccggtagccttcattgttgctcaggtactccaggtagacggtgtggccggagtccagcgtgtagccaccgccagcgagggcggagtagatgagccggtggtcccgggcatggcgcggcaggaaggcgcctcccacggcgttcgggagccgctcggggtagagcgcggaggtcccctgccgcaggccaccttccgcgtagaggagcagcgcctcgccgacggtcgtctgtccgaatgcaccaaagtgcgggcgttcgtgggcccagcgcttggaggcgttcagtcccacgacggaggcctcggccgtgtagtccaccttcagcaacgacagggccttgaacccgtcctccttctcccattgccagtctccgcgcccgtcgccgaactggtgcagcagcgacagggacagggcctgcgtgggggaccaggtggcctgggccacgtccacaccccgtagctcgcgcatggggttgttccggccgttctcgaagtagatgggattgctgggcgaacggaagttggagggcccccacatgagcacgtccctccccagggacaccgcgagcgactgcaccgggtagagcgtcaccaatccctggttcacccaggcgtcgagccgcgtctccggtcccgtctctccgaagcgccgccactcgaagcgggcccggggcttcaggctcacctcgaaggtgtccgtggcgagcttcaaatcaagccggccctccacctccgtctgccctgctggaagacgggcgatgcggttgccaggattgagcaggctgttctcacggagccctcgctcactgtccagcgccagcacctggaggccggcggagccctgctccagcagctcctggaacgcctgggccttcgcgttcgtacccagccctcccgtcaacaggcccacgaacaacggtaggcctgctggcgagaagacagcgattcgcttggagcgcatgcggctcagttcccaagccggttgacgtcgaacgtcccgcgcgccagctccgtcacctgcacgtcggcgtactccagcgtcgtcctggcgggcgtgagcgcgtcctggatggtcatcttgctcacgaaggggaacgtcttgccttcgtgggtgagctggttgccgtactcgaaggtggcggacttcagcagcttgccggagagggagaagaactccgccttgacgccgacctgccgctccttggagacccagtaggtgatgcggtcataggtgcagaacgtgttgatggccttcaactccagcacgtagctggcctcgccgttgacgtcctcttcgcgcagcagcttgccctggtagtcgacggcgtagttcgtcgatgcgatgtcgccttgagacgcctgaccggagagcttctgcctcggtgagatggggatgggcttgcggaggccgggacggctcatccacatgttccggtccacctggagcagcttggagcccttgaagcgcacgggctctcgtgtctccgcgaggctggcggtggcattggccttcagggtgagcagccgctcgggctccttgtccacgccgctttcgggagtgatgcggaccgtccagcggatgccaggaagcccgccaccccgcgagcggtccgaggccttgagaatctccgccgcgtctggctccgccgcccgcgccgtgccggtgtgcaagagcagcagccccaggatgagcgccaggatgtgtttcatggtgatgtctctctttccgtcagacatggcccagcgagtcggtgatgcacttgcgcgcggcggtacgcgccgggaagaaggccgcggcgatgcccagcagcgagagcatgacgaacgtcctcgccatccggggcacgtcgaggtcgaccatgaggctgaccacgttggaggagttgggcggggtgtaggtgatgcccgcgctgttgacggccagccgcaccagcaacgtgaagagcaaccctccggcgcatcccagcaccacgagcatgaaggcctcggtggtgaagagccgcaggatgcccgagcggcgaagacccatggagcgcagcgttccaatctcccgcgtccgctccaccaccgtcatgctcatggagttcacgatgctcatgaccaccacgatgaagacgttgctgaagatgaaggcgaaaatcatgtcgaacaggcgcttcacctgtgagtagaagctcgacagttccagccacgtcttgagctccacgtcgaagcccgcttgcttgagctgcgcggtgagctccgtccgcgcctgctcggtgaaggccttgtcatccagcagcacgatgagccgctcggcgccgtcgaagtcatacagggacttcgccaggtcgaagggcaggtacaggaacttgtcgttggtgccgacgttgcccgtgttgaagtcgtccacgatgtccacgtctagcgcattggcctgacctgtcaccgtgctcaccagcagcgcggccgaatcgccgggcttcaggttgagaatcctgcccaggtcctccgccgtcgccaccccgatggggttgtccgccttcaagtcacctgacagcttgcgctggaagtcaccctggagcttcttgacgtcctcggggaccatgccctcgcccacgaagacggtggacgcggtgccgttggacaccattccgctgagggacatgcgcggcgtcaccaaccgcgtgtgagggtacttccggaggatgggcatcacccggtccagctcctccttggagaacatgtattgcgcaggatggaggcggccttcggtgcgcaggccttgcttcatcaccgtcaggtgccccagcagctccccatggatggcctgcttggccagcccgctgtacacatacttgatgtatcccgcgaagaggctgatggaggcgaagccgaagcccacggagaggagggtgacgaggctgcgccggtgattcttcaggatgttgcggaagccaatggagaagtagttcatcgcacagcctcgtccgcctggagcaagccgtccttgagcaggagtttccggtcgaccaggtccatgagccgcgggtcatgggtggtgaagatgaaggtgacgcgcttggagcggttgagctcacgcatgagcttgaccaccatgtagctgttctccgagtccaggttggccgtgggctcatccgccacgacgatggacggcgacgtgacgagcgcgcgggcaatcgccacgcgctggcgctgaccgccactcatcttgtccgggcgcgcgctggcttgattctccaggcccacgtctttgagggcctgactggcgcgctcgcgtacctcggcggcgcccacgccttgaatctgcagcggcaccatgacgttctccagggcgctgagcacggggatgaggttgaagctctggaagacgaagccgaccttgcggctgcgcaagtcggagagcgcgttgtccgtcagcttcgcgatgggcgtgccttccagcgacacctcacccgaggtgggcgcgtccaccagccccaggatgttcatcaggctggacttgccgctgcccgaggggccccagatggcgacgaactctccccggtggatgcgcagggagacgcctttcaaggcttcgacccgtgtttctcccaggacgtagtcgcgccggatgtcattcagggacaggagcacgtcctcgttcgccgtgctcgccgccgtcccttccaagttggccatgtctgtgttcctcgatgctagagcgcccggaccaacgccgcgccggcgttgcccccgaacgaataggagtgcgccagggccgtccggacgggccggtgtggccgcggctggcgtaccagattgagctcgaactccggctgctcgatgccggcctggacaggcaacccgcctccccgaaccgcgccgacacaggcgagcaggttgaacatgtcgctggcggactcggcctcgcccatgagccccttcacgctgctgaggggaacggtgctcgccgcggcgcccatcaccgtcttcagcgcggccacttccgcccggtccaacgattgcgtggagttgctggccgcggcgatgtagtccacggcctcgggcgaggcttccgcgtcgcgaagcgcctgactcatcgcggaggccagtccccggccctctgggtggtggatgccgaaggcgtgcccgtcgtgcgccacgcccaggcccgcgatttccgccagcggggtggcgcctcttgcccgcgcggaggcgagcgtctccaacaccaccaccgccgccccctctcccatgatgtagccatctcgccgggtgtcgaagggacggctcacgttggcatcacttagcacgccaatgtcatccatgtcgaagtgcgtggccgtggtgaacaggtcgaacgtccccgcgatgagagcgtccgcccgcccactgcgcagcgcctgcgcagccagcgcgagcacctggaagccgcaggcgttccccgcgctgatggcgtaattggtgccgcgccagccccagcggatgctcagcgcgctggccaccgcgttcgtcacggtctcctggaacagcagcggttggacgaagcgcggctcgctggtgatgatgcgatgccagatgtcctggctgacctccgccatggcccggtaggtgcccaggaacacgcccacccgctccgggttccaggtggagggcccatgccccgccatctggagcgcctcctccgtggcgagcatcgtgtactgcgtccctcgaggcgcacgccgcaggttgttggagcccgtcagcgcggacaggctccctcgaggaacgcgcgccccgtgtttgcaaccgcatccggacacatcgaagtcgtcgatggggcggatggcgctgcgtccctcggcgagcgcgtccagcaagggcgggacgcccgccccgtagggggacaccgcgcccatgccggtgatgaccactcgcatctcgtctgtcattcgcgtaccgccagccatgcgtttccccttgtgttccatcagccctcccagcggcggaagaccatcgcggcgttgttgccgccaaagccaaacgcgttggagagcaccgcttccagcttcgtgggtcggctgtgatggggcacgtagtccaggtcgcactcggggtctggcgtatccaggtgcagcgtgggcggcaggaagccgtcgttcagcgccaccaccgccgcagccgcctccatggcgccgctggacccgaggctgtggccgaccatcgccttgatggagctgacggggactcgggtctgctcgccaaagacatgcttgatggcgcgtgtctcgatgacgtcattggccggcgtgcccgtgccgtgcgctttgatgtagccaatctgctcgggtttcatgcccgcgctcgccagcgccgcctgcatggcccgcgcggggccgcgtcccgtctcgtcgggccgggtcatgtggtaggcgtccgtggagcctccgtagcccgcgagctccgccaggatgttcgctccgcggcgcttcgcgtgcgcctcgctctccagcacccacagcgaggcggactcgcccagtagcgtcccatcgcggtccttgctgaagggccgcagcttgtcgctcgccagggagcgcaggacgccgaagccggcctggggcatctcactgaggggatcgactccgcccgcgaacatcacctccgaccgcccggagcgaatcacatccatcgccacgcccagggcatgaaggcccgcgctgcacgcggtggacatgaccaggctgagtccccccaactggtactggctggcgacgtggtcactcatggcgcagatgaagctgtcgagcaccagggctcgccagggctccttcgggcctgcgcgcccgcgccggtaggggtagtgcagcgcggcgtagccttccttcctggcgggcattcctcccaggttggttccgagcaccacgccaatgcgcgagcggtcctcgacatccaggtccatcccggacgccgccagtccctgcgccgccgccacgcgaatcatctgggcgccgcgactgaggtagggcagctcatcggggctgaagtgcgcggagaagtcgatgttcttcagctcgccagcggactgacagcggtgcttgctggcgtcgaaatgggtgacgggcgcgatgccatctctccccgagcgaagcccttcggagaactccgccaggttgttgccaatgggcgtgagaacgccaatgccggtaacgacgactttgttgctcatcctgttcctctcaacccgtgttgcgcgattccttgaaaagacagatgtccgcgagcggcgcgctacagcaccagcccgccattcacgcgcagcacgtcgccgaccacgtaggcgctctcaggagacgccaggaagagcgtggcgttggcgacgtcctccacggttcccagccggcggatgggggtggcctggatgaagccctcgcgcaccccgggacggttcatcagccccgcgaccatctccgtctccacgaagccaggcgccacgcagttcacccggatgccatgtggccccagctctcccgccagcgcctgcgtcagcccaatcaaggcccctttggtggcggcgtagggcacctgtcccgcgcgtccccggattccggcggaggaggacatgttgatgatggcgccacggccttgctgcatcatggtcgggatgaccgcctgacagcaggcgagcgcaccgtagagattgacgtccaccgtctcccgccacgctgcggcctggagcatcatcaagtgcccatcccggctgatgccggcgttgttcaccagcacatcgatgcggccgaagtgggagagcgccgcctctcggagctgtcctggtacgtcggggctggcgaccgagccggggaccagcacgcagcggcgcccctgtgcctcgacctcggcggcggcctgacgcgcggcctccgcgttgctcccgtagttgaggacgatgtccgcgccctcagcggcgaacgcgagggctatggccttaccaatgccacgcgagccgcccgtgatgatgaccgtctgctgttggaaccgctgacgtgttgtctgggactcactcaccacagacctccggtggcggacaggcgctgacccgtcgtgaggttcgccgcgctcgaaccgaggaagagcacggcctcggcaacctcctccgcgctcccgagccgccccaggggacccaactcgccatcgagccgctcgcgctgcgctggggtgaggtgtgcggtctcctcctcaaggagttggaccgccagcgtgttcacggagatgccttgccgggccacctcgttcgccagcgcgcgtgtcatcgcggtgatgccttcggcggccacgcggctcgcacctccggaagcggcatccagcaggttgacgatgcgccccgagcgcttgcgcatcatcgggcggatgacctccttgcagaaccacgccgtcccactcaactggcggtcgagcacggccttccactgttcggcggacaggtcgctgagtcgacctgtcgcgcggctcaatgacgcgttgatgagcaggtcgatgcggcccaattccgtggcgacgcggcggaccaccgcgcccaccgcctgtgcgtcagaagactcgcaggccagggccagctccgcgctcagctccctggcgagtgccgttgcctctgcctcgtgctccggcaggaacacgagggccagacgcgcgcccgctttcccatggcgccgtgcaatggcattggcgatgggctgtcccgctccggtgactagcaccacctgctggtggagaaaaccgtccaggaacggtgtgtttgtttcagggtgactcatgtgacttcgaacctctctgggaaagcaccatgacgccgctggcagccgggacagcgtcggcccaggccttgacctcgacgcgcaccgtggtccgccatcgcttgagaatgttggcttccatccgcaggacgctgccggccgggatgggtgtgtgaaatgtcattgtctcgatgccgccgaggtaccagacagacggtgtgacttcgtcgggctcgcgcaggagcatgatggcgacctgtcccagggcatccaccagcaggcaggagggcagggcggggggcgcgtctccgaaacgctcgaacatcatctcgttgccggagacctgcttgaacgtcctgccaaagcccggtgagagcgtctccaccgtgtcgaccagcagcatggggaaccggtgcggtgtcccgccgtagatgcgggccatggggtgctcagtcatgagcacccccgcgcagcaccacggccagggcgctgccctcaccccccagggcggtgaccagcgcgcatcccttgtcgagggcccgcgtggccagcacgacggccagcatgcccgccgtgctgaacgtctctccaagcacgtccttgggacagctcacgggcaccttcgccgcgtgcgccccgagggcttcgtgcagcccacgctgctcccacccgtcgaagtctcctcggccgctcgcacaggagaagacggcgctcagttgctcgggctcgattcgggccaggtgcatcgcgtcccgcaccgcgcgggccagcgtgtgcgcctggttcgtgagcgagcctccccggtgcccggtgcccaggacttccgcgtggcggtgtgcgccgcgcgtcagggcgtgcgtgtgctcctccaggaccagggcgcacgccgcttcactcacccgcattccctcaggcagggcgatgccagccaggagcatggggctcagggtgtccgcgcccaccaccaccatccgctccgcctgcccttcctcgatttgctggcagccgaagcgaagcgcctccagtcccgcggcgtggcccgagcacagggtcgcggtgggaccgcgaaggtcgtgcaccatggagatgtagcccgtcgccgcgttggtgacggtgttctggaacaccaccgggtttccgtagcggccgccccgctccaggatggcttccaggtactccgcgttcgtgggcaggcagccgtagctggagccgaacgcgatgcctgtctggaggggattgccgggcccggcatcctcgatggccagcgtggtcgcggtgagcgcgatgcgcccgagccggtccatgtgccgcaactgggcggactgcttcgcgaacgccgcgtcgggaatgcgctccgccagggaggacggtgggcccgcatcgccttgggagaagcgctcccaaagggccgtaggtcccgtggcctggggacacaccgcgccgagcccgctgatgacgatgcgccggctcatcgtgccgccctccctgtctcaggaaagcgccgggtaacgagagcgacgttcgccccgccgaacgcggacttggtgctcatcagcgtgtcgatgcgttgggcgcggccctcgccacgcaccacgtcgacgtcgcacttcgggtccagttcctcgcagttgagggtcggcgggaggaagtcacgagccatgcccagcacggagccgatgagctccagcgcgccggaggcccccagcgtgtggccgaagtagggcttgagggagttgaccggcagcgccgcggctcgcgcaccgaaaacacctcgcagggcctggcactccgcggggtcattggccggcgtcccggttccgtggaggttgacgaagtcgatctgctccgtcgtcagtcccgcctgtcgcaaggcgagcgtcatcgcctgttggagcccccggccctcggggtgcgggctggtggggtgatgggcatcgcccgccgttccccagccgcacagctccgcatggattcgagcgccccgctggcgggcgtggttcagctcctcgagcacgaggatgcccgcgccctcgccgagtaccatcccattgcgccgatggtcgaaggggcggcacaccgtgggcgtcatggcgcgcaggacggagaagccactgaagctgagcagggtcagtgcatccgctcctcccgccagcatcacggaggcccgtccctgacggatttcgtccagtgctcggcccatggcgaggctgctggacacgcaggccatggtgacggtggacaggatgccgcccaggccgaaccggtccgcgacgttccgcgcgatggaggagaagggaacctccccgaagtgtctccggcgagcgtcctcatcacctccggagcgaatgacctgttcgagggacaaggcgggcccacggctcgtgcccagcatgacccccgccacctcccgccagttcccctgggcttcgagcccactgtcgcggagggcctgctccgcggcgtgaagtgccagctttgacacgcggtccaaaccgttgtcgggcgtctcgcccggcaggtccaccacgcccgcggagtacgtccggccttcgatgtcgaacggggcagcccgccggatgccgctgcggcggttcaacagggcctgggcgagcttgtcggcggacagcgcattggcggccgtcacgccaaggcccgtgatgacgacgcgatgggggctcatgagagcttctccagtggctcggacggcgccgtgtccaccagacagtcgtggcccgggatgatgtggcggtattcgcggaggagcttgcggcgggtgtggctgtagagctcggtgtcctgcgcgagctggagctcccgctcggcgttctccaccaaggtcttccgtgtgaagagcgcatcccccgcgatgaggatttttcgcggcgtgctctcatcgtccgtgcgggcgcggtgcgcgacgacggagatatgaccatgggtatggcctggcgtgggcagcacctcgacctcctccgtcagccagtggctgccgtcgacagggacgaagcgcgagtcacgttcgagcacgcggttgtagaacccgatgttcccgagtcacctcgcgcacgatggaccggacatagaactccttcaccgtctggtaatgctcgcgcagcagctccgaggtcgcggctttccctggggtgtggtcctggtgatacgcctcgatgaagtgcgcgttttcgacgaagtccttggcgcccacgacgtattgcgcgttgcggaacagcaagtgattgccgcagtggtcgtagtggaggtgcgtggcgacgaccacatccacgtcatccggtgtcaggccgcgttccttgagtgccagcaccaggcgtcccgcgtcgtcgcacagaccgctgtccaccaggatgtttcgctgttgggattgcacgagggtgacagtggagcgcagccgtggaaagccgctcccctggagcaacacattcaagaacatggtgatgtgtttccttggggctaggcgcccagcatcaattcgccgtcggcgaccagctcttcacccacccgtgcttcgaccttcacatggtggatggtgccaaggctcttgaggtgagtggcccggacacggagctggtctcccggaacgacagggcggcggaagcgcatccggtggatgttggccatcacgcccggccgcgctggcttctgtgtcgccggctccacgggcgcgaggtccgggcggctcctcgtgcggagcatgacgcccgccacctgggccatggattcgacgatcagcacgccgggcatgatggggtgctcgggaaagtgcccctggaagaagggctcgttcgccgtgacgcacttgattccttcggcgaacacgccgggttccaagctgtcaatccggtcaaccatgagcatcggatagcgatgcggcaggagtcggaggagctcctggatgccgagccccgcgggcgttgctgcctgctggctaggcacaggcggccttcttcccgccttccgcgatgagccggttgaccagcgccgcgagcgtgtcgatggagtggaactccttggcgacgctgtcatccgcgatgacgacgccccacttctcctcgatgccgaccacgatttccaacgcctcgacgctgtcgagtcccaggcctcccgcctcaccttcctgcgagtcaccgccgaacagcggcgccccgtccggaatgctcgcggggtcgatgtccagccgcaggcggtcgacgatcatggccttgaggccgctcttcacttccgtgttgtcgaggtgcatccgcttctcctgatgttgagaaaccaacgtatcggagccctctgacatcgccggacaggttggaaacatgggctgacgtgtttggtttctcgggagtcaggattggctcggcggctgcgtggggggcccgctgagtcctctgcttcgcggttcaaacgcaagacgtcgtgctagtcacgccttccgacatgaccccgttcaccgagccgtcccgtctcttcgcgccggcttgttcgctggcgctgctgttcctgctcaccgcttgtggtgaggatgcgccgatctggaacctcaccctgcgcgcccgtcatggcgaagcatggaaggagttcacggagtcccccggcttgcatttcatcactgaagaaggtgtctggagacgggccacaacttcggagctccagacgccatgaccgcaccgctgactcgccgccatctgttgcgcgccctgggagcgacgggcgcggggcttgtttgtgctccagggttcctgggacgggcgctcgccgcgagtcctgtgtcagccgctcgccgcacgctggtgacagtcttcctgcgcggaggcgtggacgggctctcgctggtgccgcccatcgaggatgcggcgtaccaccgggcgcgcccttcgctggcactgcgggcaagcgggccggatgccgcgctgaagctgtcagggccgttcggtttgcatccgaggctcgatgcgctgatgccgctgtggcacgacggccggctggcggtgctgcatggcgtgggattgccggagccggtccgctcccacttcgacgcgcaggacttcgtggagtctggaacgccagggcgcaagtcgacgccggatggctggctcaaccgcgcgctggacgaagaggcgggcgccgcgctgcgcgccgtggcgttgcagcccacgctgccccgagcgttgttcggagacgcgggggcggtggccatggggcggctggaggagttccggttgcgaggcggacgccggggggaggaagccacccggggcttcagtgcgctctatgcgggcgccgtggacgaggcgctgcggacgacagggcagggcgcattcgaggcgatgtccctgctggacgaggaccggctggcgaagctgccttctcacgcggcggtggcgtatccgaaggggccgctcgggcagcggctgcgggacatcgcgcggctcatccatggagaagtggggctggaggtggcggcaacggagtcgggcggctgggacacacatgccgctcagggctccgcgacgggcgcgttcgccaaccgctgccaggagttggggagcgcactgtctgccttcgccgcggacctgggacctcggctggagcaggtgacggtggtggtgttgacggagttcggccgcaccgtgcgggagaacggcagtcgcggaacggaccacggtgtgggcagcgcgatgctggtgctgggcggcggcgtgaagggcggcaaggtgtacggacgcttcgattcgctggagccggaccacttgcaggacgggcgcgatgtgcctgcatggacggacatccgcgcgccgttggcggaagtcctgctcgcctgtcggccgggtgtggagttggcgagggtgttccctggcttcacgccgcctccgtcactgggcctgttcggataggcgctgcgctcagcttctcggtggggcagacagaggagcggcatttctccgccgctcccccgaacggtccacgtccgtattcacgtcgagtcgccacggtccttccgcgtcagctcacgtccctctgctcagcggcagcaggcaatgcgcccgcagttcgtatagagacaggtgagttcgttgggcgtgggcgtggcggggcaggtggcctcggcatcgccgccggtgatgaacgccagcgtcgcatcctccagctccatgacggacgcgggcctgcccggaagcgcggcgcgctccgcgtcggagaggctgtcgtagtagtcggcgttacgccaggcgcggaggatgtggttcttgtcgctgtggctcatggtgctgctcctcttgggttgttgggggactgccaacggaccgccaaccctcgcggtgccggagttcgtcgggaacgaagccgcttcacgagacgggaggggccacggagagcaggtccgccacccgctccggcgccgcgagccgcaacaggccgtgggcgatgcccgcgagccccaccatcaaccctggcgtctcgatgctgtcgggcaggccatgtagatagccgtgcgactcgatgccctggaggatgccgcccgcgagctgataggtgcgccgcagcagcgtgtcatcgtgcagtgcgcgcgcggcctccagcaggaagagcacgttgcccaggtcgccatgacacaggccatggttgtagccgaggcctcccgcgagcgttgcgcggaccgccgcggcgatttcctcacgcacctggtggtcatcgagcaccggcagcccggagatgcgcgccaacccgatgccgggtgcgccattgcaccagccacacatgaaggcgggtccatcaccgccgtgtaccccggcgtcggcgcggaggtcgggccagtcgccggcctcgggcgagaaccggccacgttcatacgccagcgcctccagggccgtggtgtggaagcgggactctcccgtggcggaggccagctgcagcagcgccagcgcgatgcccgcccctccatgtgccagtccgcacagcgcctgtccgccggtcgcgggtgagagccagcccatgccatgggattggggtgtggctgtctggagcagcttctccccacagactcgcgcgagccgtgacgctcgctcggaaggatgccgccccacgagcgtcagcaggccgagcagggcgcccgcgcagccactgcccaggtccaggtgctcgtcctgctccacgcggggagccatggcgtccacgaaggactcggcggtctcgaacagcgcgcgctccccccacagggctcccaggtgggtcagggcgtagaggatgccgccccagccattgaggatgcccacgccacggacctgcattggcgcggcctccaggcgccaggtcaggtggcgcaatgc

SEQ ID NO: 1206 - DNA, 18686 bp, Myxococcus xanthus
gacacggacggacgggcagcagcccccgccccggcgattgaggccatttcccgcgccgtggcccgggcggcccgaaaaggcgcggggctgctgttcgcgcgctgagcccgacgtcaggtcaggctgcgcgccagcgcccccagcgtggacatggccgcctcgatgcgcggcgtccacgggtggccacagttcagccgaaagcagtggcgataggaatccatccgcgcggagaagatgggccccggggcgatgctgatgcccgcctccagggccttcgcactcaacgccagcgagtccacctgccgcggcagctccacccagagcagcgcgccgcccgagggccgcgtcacgcgcgtgccttcggggaagaactccgccacggcctcggccatgcgctccacctgcgcggcgagccggcggcgcaaggagcgcaggtgcctgtcatagcctccattctgaaggaagcgcgcaatcgcatactggggcaccgtggcggtcgtcacggacgtggagaacttgagcaactccacccgctcccggaagcggcccggcgccacgtagcccacgcggaagcccggcgcgagcgtcttcgagaacgagctgcacagcagcacgttgccgcgcgtgtcgaatgccttgcatgagcgcggacgctcggcgccgaagtgcaggtcgccgtagatgtcgtcctcgatgagcggcacgtcgtgagcatccagcaggttcaccaggcgctggcgccgcacgtcgggcatgcagctccccaccgggttgctgaagctgggcaccgccagcaccgcggcgatgcgccgccgcgtcagcgccgcctccagcgcctccatctgcatgccgttgcgcgggcagcagggaatctccagcgcgcgcaggcccagcgcttcgatggactgcagcgttccgtagtacgcgggggactcgatggcgatggtgtctcccgggcgggccaccgcgagcaggcacaggtggatggcctcggacgcgccgaaggtggtgatgaagtcgtccgcggccagcgagcagccccagtccatggagcggcgcgcgagctgctggcgcagctccggacacccgggcagcgcgtcgtactggatgctccggtcgcgcgattcgcggctgagcgcgttcagctcgcggtacagcctgcggacgggcagcagctccggcgcgggcgaggcggcgcccagcttgaccatgcgggcatcccccatggaccggtagacgctcgcgacgagcccgctgacggtgacagcggtggcgctggacgcgggccgggacacctggggctccgccagccggggccgctcacggcggcgcacgtagtggccggactgggggcgcgtctcgatgagccccagggactccaggtgcaggtaggcctggaggaccgtggagatgctcacccgctcgcgcaggctgagctgccgcacggacggcagtctgtctccaggctgcaaggtgcccgcggagatggcatccgcgagccgctcggccacctgctcgtagagctttgctttgtgtgccaccgcgcccatggctcctcccaaggtgagccgcatccaccacggccggtatcggagacgagaacaggcccattgcccagatacagctcccgtcgacggcgaccggcacagtttagtggaacagaactgtactggtcacaatctcgccggactgaatctgttccgcaaccgcccgggggcgcatgttggcgccctggaggacgcggtgatgtgggactggatgaggacggtggtgagcgggctgcggttcgaagcagcgccagcgcggaacgtgggcttggtgcacctggcccagggcgccttgtggagcgagcgcccccggagcggccatcccctaacgctgacgtgtcgcgaaggcatgctgtggctcacctgcgagggcgatgcgaaagactacgtgctgcaccccggcgacacgctgcgcatggagcgctccgggcacgtggtggtgcaggcgctgaagccctcgcgcttctgcctgatgcagcgcactccggtccatacgccgtgcacgcctccggcgaggaagcatgaggcgcctgtccgatagtcggtgccatgccccgccttgctatcgtccgcgccatgcccagcctccctgactgtcgccgcctcgcctcgctcctcacgctcgtgtcttcgctcctcaccgcgcaggccgcggaggtctccccggcggaacgggtggagacctcgccgggcctgtcaccggatgccgtgcgacgcgccttcgacagtcaacgccagacgctcacgtcctgcatgcgcctggtctccatccagcgcggaaaggacaaggcccctcattcgtttgagttcgttccctggaaggccggacccgacacggatgatcgcattcgggtgcgattcaccctggcgccagacggcaaggtccagaaagaagaaaggaatacggatgcatggggcgtgcggtcgctgttcctcgacacaggctgcgtggaagagcgggtgaagacctggtccttcccaacctttccagggaaccatgacgagcgggtgcaggtggaactgtgggcgcggttccggaccacggaggcggaacggacggcggcagccacccggttgcgtgaattctacggcgacttctgcaaggccctttccgcattgaaagtcacccagcagcctcaggcaggcgtggagtggcgcgccaccatcaaacgattcctcgccgagcacggcgcgcgcgtcgacccacgcatcggcactgccatgcaggcggtcggagacatcgcgggccacgacgtgccaggcgccatctcgatttatgagctcagcatggaagagtcgctcgccacgaccattccctgcccgaagctccgcgcctgggtgaaggaggggtgagccccaggccggcccctcctcgccggctcactcagagcacttcgcgcaggttgccctccacgatgcgcgtcaactgcgtcacgcgtttgtggagccagaacccgaagggctggatgcgctcgggcttcgtcatcctgggcagcttctggatgctctcatcgaagccgaccacggcgtgttcgcgcgtcggggtcttcgtgcgcaggtcaaaggcgaaggacctgccggtgtgccagccgccgtggaacacggagaggcgctccaaatccgcgtttccagtcgctgcgacgaggccgtcgaggtcatagacgtcgtcggcgatctccaggcagcaccagcccccgcccgaaacgtttccgcacgggaacgtgggcaggccattgtcgaccacgttgtccacaatccaggtgatggagccgtacacacgcaggcagtaatcccagctcgactctgtcttcctgggcttgagcgccttcacgccattccaacgtccgatgcgtcgcagagggagatgaggtgggcgccgttcagggtgcctcgacggaccacggccttctctccgcgcacctccacgtcgacgaagagctgggacagcaacttgaagagcgtgaagcgctccttcacgggagcggacaccttcagcgtcttgggctccggcttgtagagggtccccgcgctccagactcgcagctcgcctcccgccgagtagagccagacctcatccttcacatcgagctggggctccgagtaccagatggcgtcgccgccgttgagcttctgtaggcgcttccagtcggacatgcgcccccctctcgcatgaggctgacgaggggtcaacggaagcaccggctcaacggcccaagccacgcgcgcagtcggccaggacgtcctccgctgccggattcacaaccccagcgcgctcatggggatgcggtacatgtcccccgtgccgcggccaatgccctggacggcgctgtcatcccgtggcgcatcgaaacgtgcccccacatcgcccgtgaaagggcgggtgctgctgaagtagagccactttccgtcgggggagacgctgtggttgtagtcgctcgcgggcgtgttgatgccctcgcagagccggcgtgcaggcgtccatgcgccatccacctttcggctgaggaacaagtcgtatccgcccaggccatcttcccgccgcagtgcactgaagatgaggtagctctcatcaggagcaatccacggctcgagctcatggaccgacgagttgatgccgggccccaggttctctggcggctggtaggcgccgtcgacccagcgggagacccagaggtcgctgccacccagtgtgccgtctcgctcacccccgaagtagagattgccattggcggccacggccggtgaccactcgtcgcggtgcttgtcgttgacgggggccggaaggcgtcgcgcgtcctcccatgctccgtcggcgtccagcgacgcggcccagatgtcatacgagcttcgggggccttgctccccaagctcgggacggttggagatgaagtacaccgtgcgcccgtcgggcgagaagtgtgggtccgcgttgctccactcggtggcgaagcgcgggagcaccggacgggaccagtgcccttcttcggtcaactgcgtttcgtagagcgtatattgttggaaacggtcatctgcccttccaaagagcacgcgtcgctgatctggagagaaggccatgaagaagtcccaggccccggtggtgaagagccccgcgccgtagagttcgggcgtgcaggtgcccccgtgattctccagtgccgtcgcgggccgtccaccgtgtgcgccacaacccagctcccagagcgtcatcatcaagagcacgcctcgcatcgacgacatccccgccatgtacggctcctcctggacattgcttcagcaccacggcggtcgggatagcatcggcccatgaggcgaaactttgggaatgttgcggtgcttcccgagcgggcccccggctatcacgcgctcagcgcgggcgaggccttcgacatcagtgactgtgtctgtcgagcaggcacccgcagccccatcttcggcggcgagcacgcacaggtctgcatcagtgtcgtgctgtccggtgtgttccatgtccggagccccgagggggccgcggtggtgggaccgggcgcgctgctgctcgggaaccggtcggcgccctatgagttccggcacgtcgatgatggaggagaccgctcgctcgtcatcgagtgctccgacgcgctgctggacgatgccctccgctcgctggggcgttccaatcggggaacgcgccccttcgcgcgcgtctgcgcaccggcgtcgctcacgtcggtgaacgccgtcctcctggcgcgacaagcactcgagagtggccaggtggaggacctgcgagaagcggcactggcggtggtggacgcgggggtgacgctgggaagcaacccgacggagacacgggtggaggtctcggaccttcaggcgcgcagagtggcccgggtcctgcggtatctcgaatcaaagttcatggaggactgctcgctggacacgctcgcggatatcgcggggctcacgagctttcacttcctgcgcatgttccgagcagtgacaggacagacgccccgccagctcgtcatcgctacgcgactgggcatggcggcctcggcgctgcgcggcagccgtgcgcgaatcaccgatgtcgccctggatgccggcttcggtgacctgtcccacttcacgacgagcttcacgcgagcgttcggtctctcacctcgcgcctaccgcgctcgcgcgcgccaacacgcctgaccgcggtggcaggcgcggctcgcgtttccgccatcgaacgccagagtcactgcctcagggcatcgccaaggcgggataccgcacgatgcgggaactcgaagcgccagatggtggtgccgttcgccgcgaactccccttcgagccggcggagcgcgcgccagaatgaaagaacgatgtctcgcgccggggcttccatcctgaagcgttccgcttcggtgtcctgcatgcgcgtccggtccggcaagcgcacgagccgcagggccgcctgaaggccaggaccaggctccaggcgcagttcgtctacttccggttccccattcaactgcgtcgtgcccgggagcccgttctcgtagaagccgagaagcgattccgccaggtgccgaagcgagtcgaacggcacatcggagaaggtcgaggagacgtgccgtccctgcacctcgaacgagagctccagccacccctggcctctacatgagaacgcgactttcaatccttgccccatcacgggtgagcctaccggagctgaacagccgctacgaattggcgcggctcgcgttcaccgtgggggaaccccttgcgaagtgaaacgcgccgccgacctcactcgcttggatagcagccgtgggacggacctgtgcttccgccgatcccacctgaatccccgccctcccattcacccgagccggaacgcattctcgaagccgactacgactttccgaggacctctcatggctcacgaccaccaccatcccgcccaccacatcgttccaggatttggcgcggaccgcgccgcgcactacgacgcccaggcgtccgtcgcgctcgcgggcacccacgccctgtatgaactcggcgtcagcacgctgacggcccagctcgacggccaggacgcggcctcgctgctcttcgtgggagtgggcacgggtgcggagttgatgccctacacccgcttcgacgtccccggctggcggttcacgggcgtggacccctccgacgccatgctcggcgtcgcgcaaaagcgcctggaggcggagggcctcctctcgcgcacgcacctgcaccacggagagctccacacgctcccgtccggccccccctttgatggcgcgcagatgatgggcgtcctccaccacgtggagggtgaagcagcccgcctcgatttgctccgggaagtcgcccgtcggctcaagcccggagcccctctcgtcgtgggctgccgcatcggcatggaccccgagctgttgaacgtggagctccggcgatggcgggcctatggcaccccacgagaggaactggagcgccggcgcgagcgcttcatgacgctacggcccatcgagtccgatgccgccctgttcgcgatgctcgccaatgcaggactggtcgcgccgaagccgatcttcgtatcgcttcagttcaaggtgttcctggcgcgatacgcgccctgagagcgaccgccgcccccggagcgcgcagccggaggagtccggccgcgcgcgtccatggactcacgccacggaggaggagttcttacgagtgagccccggcgctcacccgctgcagctctgctgccccgtcatgggcctgttcgtcgtcgtggcgcaggagcagaggccaccccggcacttgaacgaggcgctctcctcacacaggtcactcacccgcttccagcggaggatggtcccccgcgagtcgtcctggtcctgggtgaagagttcgtcgccccggaccgcgaaggcatggacctcggtgacgaggttgtccagcggcccctcactgtagtcgtcgcacgaggaagcccgggtcagctccagcttcccgttgctcaccttccaggtgcccaggtagttgttccagcttccccccaggaggatgacggagctgccacggaggaccatcgccgcgtcgtagccattgccctgctcgacgcggtaggtgccctcccggagggtgccccccgtcagcggcggtgcgttcgtcacctcgttggggtccgcgctccacgtcgtgcaccaccccaccgcggagcactggagcgcgttgccgcctcctccaccgccgcctcctccctcaccgtctttgtcgtcttccttggagtcaccacacgacacagcgaggagtgagagcgacagcaccaacgcacgcgtcaggttcttcatcggaacttcccggaaaaaggttcatggggatttgccccccacaaagagacatcccgggtgccatcgttgcgtcgaaatcggacggctagcgcggacagcggtccttttcggcgcgagcctcggcgacttcaccggggtaggccttgcgccagggctcccactccagccacgccctgcgcgcctcctgacacgcctcgtcggacgccccggactgacgcaaggcttgggcgagccgccgccgcgccaggggaacccgcgcggacgccacctgttcgctcgcgagcgccgccagcgccgtcctcaagggcgccaccgcctccgctggcgcgcgcctcgccagatggatgtcgcccatcagcaccagcgccttgatgcgctccggcgccaccggcccccagtcccgctccagcctcgcgagcgcccgctccgcgtggccccgagcctcctcgacgcgccccaggaacagcagggcatccgcgagccagcgcagcccctccccctccagctcgccgcgcgccaccaacgactcctggagcgcgacgccgcgcgcgtggaaaccccgggcctccttcgcgcgccccagcaatcgcaacagccgccccacctcgtgcaggtccagcgcgacctccggatgcgtggcgccgtacacgcgctcacggtgggccaggctgcgccgggcctgctccagctcagcctcgcgcgcgcccagctcacccagcacccccgtccggttcgacgtcatgcccatgagcaccgcgtccgcgccttccggcggcacgctcttgcgagcgaccgcgaggctctgctccgccgcgcgcagcgcctccggcccccgcccccactcgaaatagatgacggccaggttggacaacgtgcgcgccaccacgaggtgttcctcgcccaggctgcggcggaggttggccagcgcccgctgcacgacggcctccgcgcgggccagctcccccgcgtgggccagcgtgccgcccaggttcaccagggcccgggcggtgtcgcggtggtcggggccatgcaagtcctcctgaagccgcagcgcctcttcctgccagcgcttcgcttccaggagccggccctgatgacgggccagcaagcccagacgtccgttgagctccgcgcgggcagcggcatgggagacgcccttcgccgtgacacggtccagcgcctcgcgcagcagcggctccgcctcggagaaacgtccctcctgttcgaacaactcggcgcggacatagttcaacagcgcgtcgaactcggggtcgcgcagcggctcagccaccgcctgagcgcggttcagataggcccaggcctcctgggtccgttccaagtcatggccactcaaccacgcctgggcatagagcacccgggccagcacggcatgatggcgccccgcctccgcggcgaggccggcctggaccagcgaggctcgcgcatcctcgaacgcactggcgtcttcctggagcgtggcgcacagcaggtgggcctccgcctccagcgggcggtagcgcgtgcgcacggcccgctcccgtgccgccagcgccaccttcaacgcctccggcgtatggcccgcgaacagccccgcgttcgcccgggccaactccgcccggaccgccgtcacctccaacagcacggccgggtcctccggaggcgccacggcctccagcaacgtcctcgcgtccgagcagcgccgcaggctcgccagcgagccccccagcccgaagccgcgcgccacggtgcgcgcatccgcgccctggagcgccgccaccacgcgggtcacctcttccagccgctcgtcgaggcaggccatgcgcaggcccaggacctgctctggctgctcgccccagacccgcgtggcctcgcaggcctcctggtgcgcgcgcgtccagtccagcttccagcgctccagcgccgccgccaccgcggagaaggacgcttccgcgtccagggcgcccgtggccaggaaggcccgccgggtggcctcccgcgtctccgcatcccagacgcccgcgaagtgccgctcactgccctgacacagcgcttgaggcgcctgcctggagagcagcccgaacacagccagccccgtcaggaccgcgcccagcatcaccagggccaccgtgcgccagcgcgccccggggtcccgggacaaccgcgcacgcagcacctccatggaggagaaccgctccgcggggtcggcggagagcccgcgccggacgacggcccgcagccacgcggggacaccggcgcgttccggacgcacggccttccgcgccacctgctccagcaaggcctcacgcgtctttccctcgaagggacgctggccgttgagcgcctcgtagagcgcgacacagaatgagaactggtccgaacgggcatcaccgtgctcgccgcggagttgctcgggcgccccataggccagcgtgcccagcaaggtccccgtgacggtgagggatgccggagacaccgtgccgggagccgccgttccaggcaccagggtcgcgttggccaggccaaagtcggtgatgcggacgaggccccccttcgtcagcaagacattgtccggcttgaagtcccggtggacgatgcccagcgcgtgcgacgcggcgagtccatccgctgcctgccggaagcgctcgagcacctcccggagcgggcgcggttgctccgtcagccagcgccgcagcgtgccgccctccaggaactccatcaccaggaagagctgtccctgatactcgcccacgtcatgaaggctggcgatgtgcgggtgggacagcttcgccatggtgcgggcctcgcgctccaggcgttgccgcgccagggccagcgagtcctcatggaaacgctccggcttgagcagcttcagcgccaccttgcggtccagctcggggtcatacgcgacatgaacccggcccatgccgccctcgcctagcagccccagcaccacgtagcgccccacccgcgtgcccggggcgagcggccccacccccgcgaaggaggtccgcgcctcattcgagctcagcgcggcgagcacgctccggcactcggcgcagccggcgacgtgggcacgcacctgttgcgcacgctcggaggagagctggccttccaggtggcgcgcgaggtcgttctcgtccgggcagctcattccttcgccgccaggagtccggacaggctcacgtcgaggcggccatgaacggcccgcatcatgctgtccagttcctcctgggagagcgacagccgctccgtcagcccctcgtgcgtgcgcgtctccagcagcgccttcaccccggacagccgccgggacagggtggacttgtgcacgccgtagagttcccccatgcgagccagcgacagatgctcgacgaagtggagacgcagcaactcccggtcctcgtcatccagggaggccaccgcctggacgaaggcggcgcgcacgtgcgagcgggcctcctcgcgaaccagccccagctccagcccgccttgcgcggggtccgcggccagcatctccgcgtccacccgtgcctcctgcccctgggcctttcgcatccggagcgcgaggcgcaccgcggagatgttgacccagtgcaacaacgaacccacgcccgcatagccaaggagccggggcggcgagtcgggccgaggcatcagcagatttccccggagcgcctgaagcacttcatccacgaacgtgggcgaggaatgaaaccgtgcgagcgagccatgcagcttgcgcaggacctgcgcttcgaagaggtccgccgcccccggcgtcccttgagcgcaggcgagcgcgagggcgaggtcccttgcgtgcaaacgttccagcgcgacgacggggtcctccgcctcggagagccgttcgcccaggtgccgcgcgaacaccaggggctcgggcgccgcgcactgaagggaggccgcctcacgcagggccagggcgagcgcccgcggcgcctccggcgcggagcgcaagcggcccgcggcggcggtgtccatcgaacgaagaaccgtctcgagaatctcctcgggaagagcgctgtccgtacgcatgagatggtgagttcccgtggcgatgaggccacatcccctccccggaatctctagcacgaatgcccgagcggactcccggtcctctgagcggcgcacccctgcgcggggccgctctctcccgacgggctacacccccgacagcgaccgccgggggagccggagcgcacggccggaggagtccggccgcgcgcgtccacgggctcacgccacggtgaggatttccgcgccctgctcggtgacgagcagggtgtgctcgaactgggcgctgcgggtgccgtcggcggtgacggcggtccactcgtcatcccaagtgcggtgaccccagccgcccaggttgatcatcggctcgacggtgaaaatcatgccgggctgcatgacggtgtcggcctcggcctcgtagtagtgcggcacctggagcgaggtgtggaacgtctcgccgatgccgtggccgcagtaggcgcgcaccacgctcatgccgtgctgggtggcatgcgtctcaatcgcgcggccgatgtcgctgatgggccggcccggcttcaccgcggcgatgccctgctccaggcactcgcgcgtcacgcgcaccagccgctggctctcctcatccacgttgcccacgaagtacgtcgccgagcagtcaccgtgcacaccatccaggtagatggtgacgtccaggttgacgatatcgccgtcctccagcgcccggctgtccgggatgccgtggcagatgacctcgttgacggacgtgcagagcgacttcgggtagcggtggtagttgagcgtgctggggtacccgccccgcttgatgtacgcctcgtgggtaatcgcatccagctcgtccgtggtgatgcccggacgcacgtgggaggccacctcttgcagcacctcggcggcggccttgcacgccttgcgcatgcgggcgatgacgtccggcgtcttgatgtcggagcccgcgtccttgcgcgacgggcggcccgtcagcgcgtagtccggacgggggatgtggagcggcacctcgcggcgcgggctgatgacgcccgggcggatgcccttgcgaagcacctccgggcccttcttgcgcgcctcggcggcatccgcgccgcggtggcacttcttgtacttggtgccactgccacaccagcaggtgtcgttggggcccggaagcacggcgggcggggaacggggaacagcggtagtcatgactcacctccagcgcggagctgctcgggcttacgggcgcgcatccagcgcaccacctggggacgaagccaaagccggggccgccccgtgcccaggtccaggacgggccggggcatgtcgggatagcggcgcaggtaggtgctgacgctgttggcgtggcgcaggcgcagcaacccggccaccgcctgagcgtcaatcaggtcttcggtcttcaccatgggacacatttcgggcgtgtctatacccctagacatgcacccatgcacggcttctttcccagacgggacggcggcactgctcgccaggcgacgccgcccgcccggacagggagcgggccttcagcgcgccagggcggcacacgtcaggcaatgccgggcctctggaacagcgcgcagccggtgccggccaatggccccgccgcagcgcgcgcaccggccgaactcaccatgagcgatgcgcgtcagcgcctcctcgatgtcccgcagctcctgcgcctccgcctgggtgaaggacaggccccccacccccaacgaggcccgagcgcgcagccgatggctgcgctgccgcaatgcttcctgggcctcccgagccagcagctccatgttcgtctcccactgcggccaccccggccactccggacccacggcccagcaggagattatgctttcaggaagcgtgccttgcggtgcgcggcgctacagccctgaaaacgcgcaaggcttgcgcaccccggccagggccctgcatcggttgcggcgcaccggcgtcattccgctcgtgcccgggatgcggcgtgttcccgggcacgcttctccaccgcgcggaacgtgtcctccacggcgtccttctgccccatgcgcgccaggaagccaggaatggagccggccgggtccacggtgaagcggtacacggcatgggactttccttcgcctcgaggctccacgcgccagcttccctcgttgagccggatgcgaacggtgccgcgccgctggggaatggcgtccggcgtcgcctgccagcgctgcgcgaacacacccgagccgtcctccgccagcctggactccaacaccacgctgcagatgtagtcgcgcgaggacaccaccggcaggtccagcttcgtgtacgtgagctgcccctcgtccggcaggtccttcaggatgcgagactccttcacatacggcatccagtgccggtaggcgtccacgtcccgcagcaccgactggacatccgcggcgctcgcggccagctcgccctccgcccacacgtccttggcctcggagcccgggcgcgcgcggaccttcaccacgtaaggcttctccgccaccgtcttccacgcctcttccgcgcgggctgctccggcggtgagccccagcacacaggcggacaggaccgcaccactccacgacatcttcatgcaagcatccttcgcggctcgggccggatgtgacgacacgtcagcatccgacacccaggcgcggcggcgcattcacgaatgcgcaacgggcccacgcaagcaccgtccccgagccaccttccgaaggtggcccggggcggcccccccacgccgcgccctacggcacgcggacggcccgcccgccgaacgccgggctggccatgacatccattgccagacggtccgcataggggcggcccagccggccgtaggcctcggcttcctgctcggtgaggaccacgcgcaccgtgaactgggcgatgccccccaccaccacgtcaaggaagagcgccccctccgccgagcgcaccagccggtacatgagggggctctggatgaggacctgctcctcgctcacggaatctccgtcaccaccgcgtgggagacgggcgcgtcgatgaccatcagctccggcacgccgccagaggtgtagccaccgaacttgaagcagtccgtgtcctcctcgctggtgcacttccagacgcccgggtcgctgtccacgggcaggcgcacgcacacgccggtggccgccaggtccagcgtcatcatccgcagcgggccttcgaagttcttcgccggcaggcccagcgcctggccaatcaccgccgggtcatgcgcgccgttcaccatcgacttctcgacggcggcctggatggtctccgacggcgcggcgaacagatagcaaacgctgtcattgcagcggccaaagttctgcgcgttcggcttcaccacgaagttctggtacgcggcgtccgtcatcagccacgacaccttcttgccagggaagttcttcgccaggtgctgctccacgctccacgggctggcgcgctcatcggcctcgcgggagatttgcgcctgctgcgcatcacaagcctgcggctgcgtcggggtgggggtgacgctgccgccacccgtgtgcttgcagccggacagcaggaagacaccgaggagcaggctccgaatcgtccacgtcatgggcagttctccaaatagggaaggagtgaaagaggtggcggaacctacctcctgtcggcccatggatagttgtcatttctggattttataatctccccggcctgcccccctccgagcggttatagggtgaggcatgagccagaacctctacgacattcccctcaagtccatcgatggtgccccgcagtcgctcggccagttcaagggcaaggtcctgctggtggtcaacgtggcctccaagtgcggactgacgccgcagtacgaaggcctggagaagctctacgagcgcaagcgcgccgagggcttcgaggtgctgggcttcccggccaacaacttcctgggccaggagccgggcagcgagtcggaaatcaaggcgttctgcacgctgacctacgacgtgaagttcccgctgttctccaagatttcggtggtgggcgcggacaagcacccgctctaccacgcgctgacgggcgccatcccggacgccgtgggcgaaggccccatgcgcagccggctccagggctacggcatcaccgccaaccccgtgccggaagtgcagtggaacttcgagaagttcctcgtcgggcgtgacggccgcgtcgccgcgcgtttcgcgccggacgtcgccgcggatgatgcgcgtctgctgtccgccatcgacgcggagctcgcgaagcaggcttgacccggccggggtgccgctggacttctgccgtccagcggacgggccctgacgaaagcagtgacttttcgcgcgctccggggcaagccaggggtgccatgagcacgttcattcctggtcccccgcccgagcgcggactgttctgcaaccgcaccctcaacctgcgcgccatcaaggcggtgggttacgacatggattacacgctcatccactaccatgtggaggcgtgggagcgccgcgcctacgagcacatccgcgaccggctcgtcgagcagggctggccggtggcggacttgtcgttcgaccccgagctgtcgatgcgcggcctcatcatcgacacggagaagggcaacctcctcaaggccaaccgcttcggcttcgtgaagaaggcgctgcacggcacgcaggccatgagcttcgaggcccagcgcgacgaatacgcgcgcaccatcatcgacctgcatgagcagcgctgggtgttcctcaacacgctcttctcgctgtcggaggcgtgcatctacgcacagctcgtggaccggctggacgccggccagctcccgggccccatgggctattcggacctctacgagcacgtgcggaagaacctggacgccacgcacatgcaggggcggctgaaggcggaaatcatcgccgacccggagcgctacgtcatcgacgacccggagacgccgctggcgctgctggaccagcgcaacgccggcaagaagctgctgctcatcaccaacagcgagtgggcctacaccgagcccatgatgcacttcgccttcgaccggcacctgccggaaggcatgacgtggcggcagctcttcgacgtggtgattgtctccgcgcgcaagccggagttcttcaccacgcgctcgtcgctcttcgaggtggtggagtccagcggcgaggcgctgctgcgtccgcacacgggccccttcaagccgggcacgccgtacttcggcggcagcgcggtggagctggagcgccacctgggcatgagcggtgaccagattctctacgtgggcgaccacatgttcggcgacgtgcacgtgacgaagaatgtgctgcgctggcgcacggcgctcatcctgcgcgagctggaggacgaggtgcgctccatcgcctcgttccgcgccacggagacccggctggccgagcgcatggtggtgaaggagcggctggaggcggagagctgccagattcgcctggagctccagcggcggcgcttccagtacggcccgcgcacggacacgccgtcggagacggagctggtggcgcggctggccacgctgcgcacggagctggaggcgctggacgcggagctggggcccctggcacgcgcggccaccgagctgtccaaccccatttggggcctgctgacgcgcgcgggcaatgacaagagccacctggcccggcaggtggaacggtacgcggacatctacacgtcgcgcgtgtccaacttcctgttcgccacgcccttcgtctacctgcgcagcccgcgcggcagcctcccgcatgacccaagcctgcccggcggcacgcccgtcttcggcgccagcgaggccggcggcggcatgtccggcacggacggcggggagtaaccgccccccttgggactcggcggcatggggcctccctgtgccgccggcgtcctaccaatcggggtggatgtgtagatcctcggattcattgaactttcgctcagtatccctccgaggagcgggcaggcaggcatccccctccacagggcatgtcagaccgccccggtatgagtgctcttgtgagccactcgaccacgaacagctcttcgacgcgcgtcctcgagcagcgcaacctgcttgggggcatggacctgctaccggtgctgggcggcaagggccgcaagcgcgctcggcgcttccacgtcgcctcggagcgacgggtggggttcgccgcggcgctggcgctggtggtggagcatggcaagcagaaggcgaaggagacgggcgtcacgtccctgagccgctgcccgcgctgcggccacatgggccccacggcgcaggacttcggctaccgcaccatgcgcggcgagcgccggccccagtcctggtgccgcggctgccgtggcctgcacctggagcccacggagacggcgcggaccagcaacaccgccccgcgcggcgcggacggctggctgttcccgcccgagagcaccaccagcacccgcccgccccggcgtggcaaagggtcgtcgactcagtcccgctgagacacggccagccccgacatgtcacgtcggggctgaccggaacccgggatgaccgtcgcgactacgaacgcgccttctccgaaccgacgagggccttcgcgtggtgtgcgaagtggtccgcgaggaacgtggcgatgaagtagtagctgtggtcgtaccccgcgtgccgccgcagcgtctttagagcacg

SEQ ID NO: 1207 - DNA, 23417 bp, Myxococcus xanthus
  unsure (1)..(23417): unsure at all n locations
ccctggacggccccacgccgtacaccttctacaagtggcagctctccccgcgcaccgtgcgcccggtgggcgaggtggccgcgtccaactggcaccgcttcggcgatgaggaggcggacgagctgctgacgcgcttcgagcgcacggacgccgaggacgcgcagcgcgcgctgatggcggcggtgcagcggcgctactccgagctggcgccgtccatccccctcttccccaacccgtcctggggcgagtccaactcgcggcgcttcaccggctttcccaccgagcagaacccctacgcgcgcctgtcccctcatgccgagcccgacagcctgctggtgctgacgtcgctcgcccccagggagccctgagcgccatggcctacgtcctgcggaggttgggcttctacctgctggcggcctgggcgtcgctgacgctcaacttcatcatcccccggctggcacccggtgacccggcgtccgccatgttcgcgcgcttcgagggccgcgtgcagcccgaggccatggtggcgctgcgtgccgccttcggcttcacggaggcgccctggtacgtgcagtacgccacgtacctgaagcacctgctgcgcggcgacctgggcctgtcctacgcgtactacccggcgcgcgtgtccgaggtgattggcaccggcctgctgtggacgctggggctggccgggtgcgcggtcatcatcagcttcacggtgggctccttgctgggcgtgctggccgcgtggaaccgcggcgggtggctggacgcgacggtgacgccggcgctcgccttcctgggggccttcccctacttctggctggccatgctggccctgtacctcttcgggttcgggctcggctggttcccgctgcggcacgcgtactcgcacgacctggagccggcgctgtccttcaccttcgcggcggacgtggcgcgtcacgccttcctgcccgcggcctccatcgtcgtggccacgctgggtggatggatgctgagcatgcgcaacaccatggtggccacgctgggcacggacacgctccggctggcgcacgcgaagggactcccgccccggcaggtgatgctgcgctacgccgcgcgcaacgcgctgctgcccaacgtcacgggcttcggcatggcgctgggcttcgtgctgagcggctcgctgctgacggagattgtcttctcgtacccgggcaccggctacctgctcatcctggccgtgcgcaatcaggactaccccctgatgcaggggctcttcctgaccatcaccttcgccgtgctcgccgcgaacttcgccgtggacctgctgtgtctgtggttggacccgaggacccgcgcccatgcgtgaccttcttcgacggctgctgcgccaacgcaaggcggcggtgggcgggagcatcctgctgggcttcatcgtgctcgcgctcatcgggccctggctggtgatggaccccacggagctggtgggccgtccccaccagccgccctcctccgcgcactggttcggcaccacgggccagggccaggacgtgctggcgcagacggtggtgggcgcgcgagagacgctggccatcggcttcgcggtgggcgctctcgtcacgctcatgggcgcgctcatcggcgtgacgtccgggtacctgggccgccgcgtggatgacgtgctgacgctcactaccaacgtcttcctcgtcatccccggcctgccgctggccatcgtcctgggcgcctacctgccctccggccccttccgcatggtggtggtgctgtcgctggccggctgggcctggaacgcgcgtgtcttccgcgccgaggccatggccctgcgcaaccgggacttcgtctccgccgcgttcgtcgcgggggagagccgctcgcgcatcgtcgtccgggagctgctgcccaacatggcgtcgctgctgggctcgtcgttcattggcaacacgctgtacgcggtaggcgcgcaggtgggcctggagttcctcggcctgggcgacgtgggcgcggtgacgtggggcaccaacctctactgggccggcaacgacgcggcgctgctgacgcgctcctggtgggtcttcgtgcccacgggcttgtgcatcgcgctggtcggcttctcgctgacgctgctcagctccgccatcgacgaggtgaccaacccggcgctgaaggcgccgccagtggcgaccacggcggtccgctcggcgcggtcctcttcggcggacgcggcgccgccgcccggcgccctgctgagcatccgagacgtgtgcatcgagtacgccacggagcgtgggcccgcgcgggtggtggactcggtgtccttcgacatcgcgcccggtgaggtgtttggacttgcgggtgagtccggtagcggcaagtcgacgctgggatacgcgctgctgcgcctgctgcctccggccgccagcatcacgcagggccgcatcatcctggatggcacggacgtcacggcgctggatgaaaccgcgctgcgcgcataccgctggagccaggtgtccatggtcttccagagcgcgatgagcgcgctcaacccggtgctcacgctgggggaccagttccacgacaccctcgccgcccatgggcggaccacccgcgccgcggcccatgcccgagcacgggagctgctggccatggtggggctggcaccgcagtgggtggacgcgtggccgcaccaactctccggtggaatgcggcagcgcgtgggcatcgccctggcgctggccctggagccgaggctggtagtgatggacgagcccaccacggcgctggacgtcgtggtgcagaaggagctgcttcagcgcgtgctggagttgaagcagcggctgggcttcgcggtgctcttcatcacccatgacctgccactgctgctcgcgctgtcggaccgcgtcggcgtcctccagggcggcaagctggtggaggtggacaccgccgagcgcctgcgcacggaggcgcgtcacccgtacacgcgcctgctgctgtcctccttcccgcacctgagcgcggcggacgcgcaagtgccggcggacgtgacgctggcgagctcggagcgcgcgccgccccaggccgccgcgcagggaggtggccgatgagcgccccgctgctggaggccacggagctgctgcgcacggtgcccgtgggcggcttcctctcccgttcgcgccgcaccttgctcaaccgcgtgtccttcaccctggagcgcggctaaatcgtcgcgctggtgggcgagtccggcaccggaaagtccaccctggcccgggtgctggcgcggctgtacacgccggatgccggcagcctaagaatgggcggcgagcacgtgctcaccctggagcgcggcggcgcatcgctcgcgtaccggggccgcgtgcagatggtcttccaagatcccttcgcctcactcaaccccgtccacaccgtggcccatcacctggagcgcccgctgctgcgccatggccgggccacacgcgccggactcgaggaccgcgtccacgccctgctggagtccgtgggcctgacgcccgcggagcaactggcacagcgctacccccatgagctgtccggcggccagcggcaacgcgtggcggtggcgcgcgcgctggccgtggagccagacgtcatcatcgcggacgagcccacatccatgctggatgtgtccacgcgccggggcgtgctccaactgctgcgcggcctgacgcgcgagcgcggcatcggcatcctcttcatcacccacgacctggccagcgcgcgccacatggccgaccgcgtcctggtgctgtacgcgggcagcgtcgtggagtccggcaggacggcggacgtgctcgccgcgccccggcacccgtacacccggctgctcctgtccgccgttccggacggcgcggacttcctcaacaccccgctgccggtgcggcccgccacgggccccatgccggtgttcggctgccccttcgcgccccgctgtccccatgcggacgcgcgctgccacgacaccctccccccagctcacgtccacggcgcggcccacacggtccgctgccatctcgaatcctcgaaaggagcctccgacaatgcggcagttccccaatgacttcctgtggggtgtggccacctccgccttccagattgagggcgccaccagcgccgatgggcgcggtgagtccatctgggaccgcttcgccgccacccctggcaaaatcagcgacgggtcggacggcaaggtcgcgtgcgaccactaccaccgctggcgcgaagacgtggcgctgatgcgctggctgggcgtgaagtcctaccgcttctccgtggcctggccccgcgtgctccccaccgggcgcggcgccgtgaatgccgcgggcctcgacttctactcgcggctggtggacgggctgctggacgcgggcatcgagcccttcgtcacgctctaccattgggatttgccccaggcgctccaggacctgggcggctggccttcccgcgacaccgcgagcgccttcgtcgagtacgccgacgtgatgagccgcaagctgggcgaccgcgtgaagcggtggattacccacaacgagccctggtgcatcagcgtgctcggctacggcaacggcgaacacgcccccggtcacaagaactggggcgaggtgctggccaccgcgcaccacacgctgctgtcccacggccaggcggtgcccgtcatccgcgccaacgtgaagaacgcggaggtgggcatcaccctcaacctgtcgcccgcggagcccgcgtctcccagccccgaggacgcggaggcatgccgccgccatgacggcagcttcaaccgctggttcctggacccactctacggccgcggctacccgaaggacgtggtggaggactacgtgaaggacgggcgcctcgcctcgtccgcgctgcccttcgtgcgcgacggggacatggccgccatcgccgtccccaccgacttcctgggcatcaactactactcgcgcgccatcatgcgcagcgaccgcatccccgaatcccagaacgcgccgcgcaccgtgcaccccgagcccgagcgcacggacatggactgggaggtgtacgcccccgccctcacccggatgctcgtgcacctgcacaccgactaccagcccggccccctctacatcacggagaacggctgcgcctacgccaccggccccagcgaggacggcaaggtgcatgacgacaagcgcgtggcgtacctgcgctcgcacctggaggcgtcactggaggccatccgccagggcgtgccgctcgcgggctacttcgcctggtcgctgatggacaacttcgagtgggccttcggctaccagaagcgcttcggcatggtctacgtggactacgactcgcagcgccgcatcccgaaggacagcgctcatctctacaaggccctggtggagaagaacgggctggatgtggagctcgccgcgtgaacgccatcgtcctcgtcaccagcctcgcgctcacgctgggtcaggtgccgccgcccagcgggccccagacgcccccgccttcgtcggacgcgccggtggtgcgggtgtcccccgtcaccgtcaacgcggcggcgcaggccgtccgcgtgtaccgggacgagcgcggcttcaagctccaggtcaacggccgggacttccccatcctcggcatgaactggggctacacgcccattggcgagaactaccggtactcgctgtggacggagaaggaggacttcatccgcgcggtgctgcaccgcgagatgacgctgctgcgcgacatgagcgtcaacgccatccggcaattcgacgacatcccgccgcagtgggtgacgtacatccacaagaactacggcatctacaccgtggtgaacccgctcatgggccgctacggcacgaacgtggatggcgtcatggtgccgaacacggactactccaacccgaaccaccgccgcgcgctgctcaatgatttggcgcagaaggtagagaagtaccgggacgtgcccggcgtgctgatgtggatgctgggcaacgagaacaactacggcctgcactggaccagcttcgaaatcgaggcacttcctggccaggaggacaccgcccgcgcggagcacctctattcgctgatgggcgaggcggtgcggaccatcaagcagcgcgacacgctgcaccccgtctccatcgccaacggtgacttgcagtacatcgacctcatcgcgcggctgatgcccgagttggacatcctgggctccaacgtctaccgcggcccctccgcccgtgacttgttcgacgaagtgctgcgcaagctgaacaagcccgtcatgttcaccgagttcggcgcggacgcctacgacgccaaggccggccgcgaggaccacgtggcgcaggccgaatatctgcgcaagcagtgggaggagatctactcccaggcctacggacagggccgcgcgcagaacgccctgggcggcttcgtgttccagtgggtggacggctggtggaagtacaaccaggaggccaacctctccatccacgacaccaccgcgtcctggcccaacggcggctacgaatccgacttcgtgcccggccagaacaatatgaatgaggagtggttcggcatctgcgcgctgggccccgaggacgaggccggcatcgcgcgcatccaaccgcgcaccgcgtactacgtcctccaagcggccttccgcatggacccgtacgcccccaccaccaatcccgacaccatccgcgagcacttcgcgtccatccgccccacggaactgtcgcgcggttacgagtcgtccatcgcgctggcccgggcggatgacctcagcgcggtgcgcgtctccaacctgcgcctgatgatggacagctcactctcgcgcgggagcatcgccacggtgcggcccaaccaggtggccgcggaccacacggagtccgtcttcttcgacctggcgctccagccgacctcgggcgtgtacgggcgcgcctcattcaacgtcgtgggcaacgtggcgcagaaccgcctcaacaacatcttctatgagaaccgcggcacgccccccgcgcctgccacggccaacggcggcgtgggccaggcccccgtgcccggcgtgggcaacccggcggggcagcagccgctgggcctggaccggctcgcgctgtaccaggccgagttcaagctggaccgcgcggacttccagttggagggcttctaccgcaccgcccactaccactggggcgaggaaggcgacttcttcggcctctaccgtgaggcgaactacggccccgccctggacatctacaagggcaacgcccccttcggcgtcgtcttcaccgggaagaacaacctggagggcctcaaggtggcggtgggcccggagctctactggggcgccaacccgtccatcgtcgccaagtaccgccggaacgtggggccggtgacgctgacgctgatgcaccaggaggacatcgcccggggctccacccagctcaccgcctccgtcatccgcgagcgcgtggcgcgcaggtccacgctgtcactgggatggacgaaggggcccatggcactggaggtgggcggcatcctcgcggccccgcagcgcgtgggggaggagttcatctggtctcgccccacggacggccccagctacctcgacagcggctacgaggtgatgcgggacgaaatccggatgctcgacaccctgggtgcgaaggcacgcctcacgtatgacctgggcgcggtgcgaacgttcctccagggctcctaccgcggcctggtggcggacggcggtccggagcagggcatcctgctgacgggctggagcctgcgcgagagcggccgtggcaaccacttcggtggacaggccggcgcggtggtgcaggtcggcagcgcgttccaggtgtcgcccaacctgctgtaccagaagcccctcatcgggcccaacccacgcatcgaggacgcgttcgacccggagtcggggcggtacttcgccggcgtgcgtccgcgcaacgtgctggtggatgccttcaccgtcctggacaaccgcgagacgctgggcgccgagctgctcctcaccttcgaccccacgcccggcacctggttctggcagtgggaccgcgacatgcgcgaggacgcgcccttcgccgcgggtctggacctggtgtaccggcggcaaccgacgtctcgtgacgcgggcatcgccatcctcgcggatggcagcatggtggccttcggcaacgcgccgtccgctcgggacgaatgggaggccacgctgcgattggtgaccaacccggtgcagcggctgaaaatcttcggcgccgccttcgccggcagcaaccagtcctccggcgaggacgaccggcaggtgcggcgcttcggcgtggatgcctccgtgctgtgggacacgctgatgctgaccacgcagctccacttcaacaactggggcccgtatgactaccaccgcgtcttcaacctcacctatcccatccagctcggtggggacctgtcctacggcctcaagcgcccggtgatggggacggtgacgacgcgcttcggcgtgcgcggattggtgcgcatgctggaccagtactcggaagggctcagtcagacggcgctcgaccagggactcgaaggccgcgaattcgaggtgggcgcgtatgccatcctgtctctctaacggaggacgtatgaagacgtggcttctgctggcctgcgccggagtcgtcaccggctgctacgaccccgccagcttcgtgtatggcgaatccctggacggactcacgctccagttccacagcccggacgtcggcatctacccggaccagtccgttctggacgatccgaacaatccgttccgaagcagcacgcccggcgcggagacgaagtgggacatcgaatcccgcgccggaaacgtggccgcgttctattcgtgggccacgttgctggcccgcgagccgggcggcgaggcccagttctacgtgggtaacaacctgctcgccatctaccagaacggtgaggcgcgtcaggaggacctgccgcaagtgcggctccaggccatccgcgcgtatcaaacgatgctcgattccttcccggacgcggtgacgtacgacgccacgggcacctacgcctatgacctggcgacgcccgcgtacaagggcatcgtggagatggaaggcgcggtgcagggcggttgggtgttgatgagcacggctggcggcggagaccgggcggtgcggccatgagacgcgcgggcttcgcggtgctcatgctcctggcgggctgccgtcccgacccgggcgtgccggactacacggaccagggctacaaccggcccgacgcgggcggggaacccaacgacgaggtgctcccgggcccctacccctatgtggagggtcagcggcgcctgggcgtgggtttctacgaagggggccgctcccaggacatcccggtggacaacaccaccgtgcacatctacctctacgagggcacgctctccctggagccctccaccacgcgcatcgagggccgccagtccgacctggtggtgcacgcgggcaagacgtggctgggcttcggcgtgcactggaacaccccgcgcaacctggatggctggacgacgttgcacgtgagcctcaactcggccgacccgggcttcgccaacgtgtccattggcatgaatgacgaccagagcgtccagttgcccgcgtcacagtacggttacacgaatgatgggcagtggcaccacctggccattccgctggcggacttcgtcgcgggcgggttgcagctcaacgcagtgcaggcgccgttcgtcttcatcgctggcgcgggcccagccgcggacacgctcctgctcgacaacgtgtatttcaccgcggactgagccagtccctccgtggagcccggcccgctgtgggggctgtcactggtgacggggtgcgccaccatgggcggcgcgccctactgctctggcagccaaaaccaacgcccattggagcgtagcgcgcccgctagaaactccgagaaagagcgcgcgatttggcggcagtaggccggatccggaaacgcttcgttgtagccgtcgcgaatggggtagcggccgtccaactggtggctcacatcgagcaggatgtagttgctgtcccgcacgtcgcagagggcataccaagacgagggaccggccttgtccgtgtccttcttcctcatggtcacccgtgcgcgacgaatctccgcgagcggaaagaaggagaaggcggggtcaacagtcccaaagaggtctgcgccatcgcaatgcaggtagaaggcgcggaggtctgggtctaggcgccatccaacgctttgctcgaaggccgcgatttgagcgggcgtagcagggggccgcgcgtggtgaacgcgggacacctcttcgagcaaggcaggcatttgcatcgggctactctccgtaggggtaatccacgcccacctgggtccaaggagggtcgttggcgtagcactcgttatagaggtcgaagagttccgtgtgcaggtccttggggaacgggatgatgttgtcccagtcggtggggttgccgccgtgccaaaggtcccgaacgtgatgcccttcgtagagtcggccgttgggctccgtgggccatgcgccaaagcggtttgcccacgcttcccggaaccctgggcgggcgttgctccagcggctacgggctgctgcggtctggtcagggctaagcttgccgtagttgcagcaacagtgggtcattccaaagcggcttccggccctcatcacggtgccctggaagtccattttcacgtccgcgagccacatgcagccctggagagcgtggccgctccctgagcacttgtttgcgcagtagtccatgagctggcggctgcactgccacggcccgtagtagatgacggttcggaactggccgcccccaggcacgttgacaggtggcccgacccacttccggacagcgttggccgtgcgcgggagtggagtttcagcacacgccgcgaagaggagtgccaccagggttgcgtggcagcacacccgagtagtgttggatttcagtcttggcattgtgcgctgcgaaagcacgatgcaacctgagttgtctattcctctgaatgggtagtccgtgggggtgaagttgccccggttccgcagagcgttccgcgctttcgccctcaagcggcaacgcgcgcttcttgtcgtgcacgttggccgcagagagcaacactgccagcgggctgaccttcttccctctgtccctggggttcttgcccgtttcggcccccctttttcgcccggacactgttcgagtcaaacgcggcgtggctccggtcgatgcgccccttcatgcccagttcgtccagatgggcatccgtttgctcggctgtacgtcccggatgaactgccggtgcggtcatgaaacgagttcttagcggcgcctccgctgctggggacgagcgggcttcgccttcgtctccggaggcagctcgtccaaccacgcccgcaccgcctcggcctggagcgcccggcccgaggccgtgaagcgctcacgcgccttcgccgcctcggtccgcgcctccacaccctgcccttccttccacagcgcccgcgcgagcgcgaagcccgactcccccagcgagtcctcctgcgcgcccgtgaaggcaaccgccttgcgcagcggcgccagcgcctcgcgcgtgcgccccagtcccagcagggcctgccccacgccgtcgtaggagtactggaggtcctcgtcgtcgggccccagttgggcgtgcttcaccgccagcgccgcctcatagactttcagcgcctcttcgtggcggctcagcgcgagcaggctcatgccctcctcgtcgagcgcctccgccagcttcaggtgactgtcgcccagcagctcgcggtgcagcgccacggaggcctgggcatgcgccaaggcccgcgcgaactctcgctgctcgcgcagcgccatggacaggccctggtggcgccgagccacgtccaggtgccgaggccccaccgccgcctccgtctggcgcagcgcatcctccatcacccgcacggcctccgggaaggcccccacctccagcagcacccgccccagtgagaacgtcacccgcgcgcgcttcggatggcccggcaccagcgcgtccgtcagcacggtgttggcttcctccagcaacgcccgggcgtcgtccgtctgaccgcgcatcaacgcgaggttggcctcgttcaccagcaggtcgccccgcagcaccgcgtccccgcccaaccgctggagggtcgccttgcccagacgtgcccattgagaggcgtgctcgaagcgctcgcgctccccttccacgtagagcaacttgttgagaatggagacctccagccggtccgcccggcccgacgtggcgtcatagacggcctgctccagcagccccgcgcccctatccttctcccccagcacggcctggagccatccctggtggaagcgcagctccgccgtcagcggcgcgtaccgcgcggccaacacccgcgactccaccgcgttcgccgccgccagcgcctggggatagcggctggtgtccaccagcgccttcacctccgacagcgcgccttccaatgactccagctccgcgcgcattgccgggtccgcgggccggggctgctggctcgccagggactccacgtccgcgcagtcctcgggtgaaggcagcgcatacgccgcgtccagcgccttctccacgcccgccttgtccacctgggacagggcgcccaccagcgcacgcaaatccttgtgccgccgctccagacacaccacgcgctgggtgaacagcgcctccggctgcacctcgcgcaggcgcgtggcctcgcacgcgtcggtgtgctgctgcgcccaactgctggcataggcatccaacacctgccccacccggcccgccatgtcccccgccagggggctgcccgtggccgcgaaggccgaggacagtcgctgcttcgcctcggccccccaggtgtccgccagcagcccctccgcgcccgcgcagacgctggactgaaaccacagcccgcctcccaccgcccccaccagcgccaccgtggccgcggccatgcctcccgccttgcgggcccgtgcgcgctgctgctcttgcgacagcgcctccagcagcgcccccatggaggcgaagcgcgcctccggctccagtgacaacccccgcatcaccgcgcgccgcacccaggcggggacgcgggcgtcgctgggcggctcgtggatgggcgagggctcccgcccggctcgctccagcggcgccgtcaccttcgcgggtgcggaccgcagcgccttcgcggcccgagagagctcgtcggggtcgaagggacgctggttgtagagcgcccggtacagcgccgcgcagaagctgaactggtccgagcgcgggtccagggactcgccgcggaactgttcaggggacatgaacggcggcgtgcccaggacgacgcccgtttcggtgagcgggtcatgcagcgtgcgcgacgtctccgaggcgtcgcgcacgcgcgccagcgtgggctgttcgtccagaggcaggttgtccacgggacgcgccaggccgaagtcggtgacatagacgcgcccgtcacgccccaccagcacgttggcgggcttgaagtcgcggtgcaccagccccgccgcgtgcgcggcctccaacccgcgtcccgcttgcaggtacttctccagcacctcgcgccaggaacggagcttctcgcgccgccagtccgccagcgtgccacccgccacccactccatggtgaagaagacctgcgtgtcccaggtgcccacctcgtagatgggaatgacattgggatgggagacacgcgccatggcctgcgcctcgcgcagcagccgggcccgcccgccctcctcgtccgcggagcgggcctccacgctcaacaacttgagcgccaccttgcggtccaggtccgggtcataggccgcgaacaccgcgcccatgccgccctgccccagcagcttcaacggaatgaagcgccccacccgctggcccagcgggctccgcgaacgccaatccccagacgcgtcgcgcgcggagggagactccgccgcatgcggcgcgctgcgcggcaccgccccctgcacatccgctgacacgacctgcgtggacagctctggcgaatcatcagcacccgagccccggtcatcggtgttggccattgcgcaagtgtaccgggaagcgagcgacaccctgcgcccatgaaggactcgcgcgcaacaacacacacatgccgccgataatgcgaacaggcgaaggaagtccgggagggtccgccgtgaccaggattgtcaccaccgtgttcaactcagcgccccaggccctgtccaagcccatccagccggtcgtgttgaaggacgccaggacgcccatggagacgtcgctcgccaggccggtgagcagcccggccccggcgacgccccgtccggagcgggacactttccaggacacgaagcccgcggccaaaggcgtgccgcggctgtcggtgccggacgccacggggaccagcgagcttcccttcctgcgagacctggccccagagaatgaagcggcgcaggcgcaggccgacaagggctgggcgcccaccgcgtcggtcatcgctcagaactcggacacgggctgcggcgaggcgacgctggccttcctgagccgggcgagccgcagcgtgacgaagggcacgctgtgcgagaagcaggagcgagagacggtccgcgagcgcgcgtcgcaggtcagcggcgcccggtccgtccacgccccggtggacgtcaacctggatgatggcgccacgcccacggagatggcgaccgcgttggggggcatgggcatcgaagtcacggacggcttcgccgacttcgacgcggcggcgacgagcaagatgatgaaggctggtcagttcggcctggcgctcgtggatgccaatgccatcctcaatggcgcgctcgctgcccgagcagcggcgcggcgggccgggccagctccactgggtcaccatcgacggcgtcaacagcaacgggacggccgacacgtcggacgacttgttccgcgtgaaggaccccgtcaatggcgagtactgggtgtccgccagggacttggagagcgccgtccaggccggcaaggagcaccacggcagcggcggcatcttcgcgctggagaaccgcacgggcgtgggcggacagaaggagcgtgacgccctggcccacctcaaccgcgagcgcacggcgtccttcgcggacaggaacggcgtgggcagtaagcgcctcagcctgggcgagtcgagctgaggcgcgcgcccggaacctgtctcagtaggtgtaatagacaggcggcgtggtgctggtgaagaagtcgtaatacgtggccacgtagttggggcggttgcccacctcacccggcagcgggccccccttcgtcccgtagacgaccagcgtcgcgccgccgtccgtctggtccagcgcgcaggagctcacatggttcgtcccgtacatgacgacgatgtcatgcgagcggaccatgtcgagcgtcgccgggtcgatgtggttcacctgacagcgattcatcgagctgccactgggcgtgggcttgtacgagaaggccgtggccacgccgtagctgttggccaggagcgcgaggtacggggtgttgtaggaccttcccagcgtcacgctgcccgcgccatgggcgcacgtgccggacgccgcgcgtgtcacgacgatgtccaggcttggaggcatggagccgggcaccggcacggaggagatggtgtacgtacagccctgcgtggtgccggtcaccagcgcggcctcctgctgcgccagcgcctcctgctcgggggcctcttcaggggcgccacaagcggccagggacacggcggcacaacaccagacggcggacttgaagactcgcatgtcgggactccagtacggagaggatggggactcatccccacctctccaaaagctgacagagtccttgtccagcattcaactggagcaaactgcaacacagttacattgcaatttggcggcgctattccttctcgatgtcccggtcccagagctggacgcgggtgtcttcgtccgtcaggcgctgggtgagctcggcggcgatggcgacggagcggtgcttgccaccggtgcagcccagggccacggtgaggtacgccttcccctccttctggtagcgagggaagaggaagcggcagaggtccacgaccttctcgaggaactgctgcgtctcctcacgctccagcacgtaggccgccaccttcggcaccttgcccgtgagccccttcatctccggaacgaagtacggattgggcaggaagcgcacgtccaggacgaggtccgcctggggcggcacgccgtagcggtagccgaacgacatgatggacaggctggggcccgcggcgggctccgggctgaagcgcgcctgcaccatgcgcttcaagtcatgcacgttcagcgtggacgagtcgatgacctggtcggccagctcgcgcaagtcacgcagcgcctggcgctccgccttgatgccctcggcgacggtgccgttgggcgccagcgggtggcggcggcgcgtctcgctgaagcggcggatgaggctgtcgtcgctggcgtccaggaagagcacttccacctggtgcccggcgcggcggacctcggcgaggatgcgaggcgcgtccttgaggaagacgccttcgcggacgtccaccaccagcgccatgcgctcgaagtggccgccgcccgccagctccgtgagcttgggcaagagcaacaccggcaggttgtcgatacagaagaagcccgaatcctccaacgcgcggatggcggtggacttaccggacccggacatgccggtgatgatgacgatctgtttcgcgggggcggtcactcgacctcttctcccagggtacggcgcatcgccccttcggcgatggcccggttgagtcgctcggcgaactctctcgccgagtggtggccctgtagctttagcaactgattacgcgcggcgacctcgatgatggtcgccatgttgcggcccggacgaacgggcaccaccgacagggggatgtccacccccacaatctgcagatgcctgtcctccacgcccagccgatcatactcctggtgggggtcccactcctggagctcgatgaccagctcgattttcttctgttcgcggatggcggccacgccgaacaggtccttgatgttgatgatgcccaggccgcgaatctccatgtggtgcttgatgaccgggttgccagcgccgtagacggcccccttgcggcgggtgacgtccacgatgtcgtccgcgaccaggcggtgggcccgcatcaccaggtccagggcaatctcgctcttgccgatgccgctcttgcccagcagcaagatgcccacgccgaacacgtccatcaacaccccgtgcaggctgctggactcggtgagggcctcttccaggaaggtctgcacccgcatgatgaagtcactggagagcaacggcgtcttcatcagcgccagccccgcgccttcacacgcggagacgagggcctggggaatgtccaggtccttggtcaccaccacgcacgccagctcctcctcgccgaagagctgcgccagcgactcgcgctgccgcgcttccggcagcgtggccaggtacgaaatctccgtgttgccgaacacctggacgcggtgcggatgcaggtgctcggtgaagcccgcaagcgccagccccggcttctggatgcgcgaggacacgacaatgcgcgacagcccgccgccgccggcgacgagactgagccgcatgtcgtagtcgcggtcctcgaggagttgggagatgcggatggatttcatcgtcagggcgtggatatcaccggtggggccctttgagggggactgccttccttgggccctcaacgagaggggcccaggtaggagacccggggcccgaccgccccaccgggaggcaaaatgcgggttccggcaggcaacggaaggccacggaagccattccgcggggctccggccgctggtaagccggaaaacatgtccgactgtctcttctgcaagattcgcgacgggctcatccccgccaaggtggtctaccgcgacgacgtgtgcgtggccttcgaggacatcaatccccaggcccccacccacgtgctcttcatcccccacaagcacatccccaccgtgaacgacatcacgacggaggaccgcgagttggtgggccacctcttcatcgcggccgccaaggtggcccaggagcgcgggcacgcggacccgagcgacggctaccgggtggtgatgaacacccatgcgcacgccggccagacggtcttccacatccacctgcacctgctggccgggcgcccgctgggctggccgccgggttagttccgcccccctctgcccgaggcaggtgttagcctcgggcattgcgatgcccttctcatcggaatcgtctcccgggaaccggcgagcctacacactgctgtcactgctgctcgcgggcgtggcgggcctggtgaataccacgggcttcgtggcgctgggcctgcacacgtcgcacatgtccggaagcatggccacgctgggagagtccctggcctcgggcaacgtggccctggcctggctggccgcgcagctcctgctgtccttcgtggtgggcgccgtgtccgcgtcggtgctgctggaggcctcacgccagcgcccccggggccgccactcctccgcgctgctgctggaggcgctcacgctgggcggcatcggcgcctggctgtcgtaccaccccagtacacacgagccgacgctcatgtggggcctggcctatgccatggggctccagaacgcgctcgtcacccgcgtctctggcgccgtggtgcgcaccacgcacatcaccggcatcctcaccgacatcggcatccaggtggtgcggctgggttcctggctgcgcgagggaacgcggggccagggcttgctgggcctgcgacgccgtctctgggcgctgcccaccgctgttgaattcgagcggacccggctgcacctggggctcggctccgccttcctgggcgggtgcacgctggggccgatgctcttcgcccggctcggcgcggccaccctggcgattccctgcggggtgctggtgatgctggtggcgctcgacctgagcgccgtcgcaacctccggcccccaggcgatgccgcgcgcctgagtcactccgtcccgggctgggcggacgcggggccaggcgggccggaggacgcctccacgtccttgacgctcgccgagggcctgccgcggcggagcacgtgcagcacgctgctcttctcgtccgtccacgtgaagtcggggtcctcccgcaggcccagccggcgcacgcgcgcggaggcccgggtgaaggtgggtccccaggagaactcgcggtccgggctcagcaccatccagttgctgcgcagcgcgtccccttgcgtctcgttgaccaccagcgccgcatgcagccccagggcccgcgcgtgagccagcgtcagcggcactaggtccaggtggacgttgctgatgtgcagcgccagcacgccatggggcgccaggtgcgcgcggtagagcgccaccgcctcctgggtgagcaggtgcaccggcaccgcgtcggaagagaaggtgtccagcgcgagtacgtcgaagccctgcgcgccgcccgtctccagctcccgctccagggagatgcgcgcgtccccctccaccagctccaccttcgccggcgtgtctcccaggaaggagaagtagccgccctcgccctgcgccagcgcgatgaccgcggggtcgatttcgtagaagcgcccggtgtcctccgcctcgagcaacgcggcgctggtgcccacccccagccccagcacgcccacgcgaagccccgcgggcagccccacggcttcgcgcagccggcgatgctcggcgatggccagtcccaggcccgcctctggcgtgtaatacgtcgtgggcacgcccctgcgctcgggcgtcacgtactggagcccgtgggtgatggcgccatgcagcagcgtgaagcggtggtcctccggtgagcccacgccctgctccatcacccgcaccacgccgaagaagttgcgcgaggcgaagcgcgcgcggccctgctcgcgggccatggtgtacgtcaggtgtccggccaccaggagcagcatggcgccgcgcaggacgcgctgcagccgctgcgtccgcgtcgcttcgcccgcctctttcgcaatgcccaccaacgcgacgacgcagcacgcgcccagcgacaaggggtactcccagtaggcgctgaagacggcgggggccagcacgctgatgagcagcccgcccagcacaccgcccgcggacacccacaggtagaaggcgctgaggtggcgcggcggtgggcgcagccggtacagctcgccgtggcacaccatgctgcccgcgaagagggccacggagtacgcggccagctggagcgcgagcgacgactgcggcccctgcgtctgcgcgtgcgccacgcccgcgcccgaggcgatgagcagcaccgcgtagacggtccgcgagtagaaggactcgcgggagaaggcgaggatgaaggtcagcaggtagacggccaggggcagcacccagaggaaggggccggccgccacgtcctgtgagagctggttcgtcgttgccagcagcagcaccgacgcgcaggtgctcaggcccagccacgtcatcgtggcgcgcacggtggggcgtgccacctccgcgccggcctctcccccggcgccttccgtcagcggcgtggccgtcacgggcgcggccgtggcgacgggcgccgtgtccggctgcttcatcacgtccagcgcgcacaccgcgcaggccacggcgaagaagacgaagcccacgccccagccccacgcctgggcgccgcgtcccacccacggctccaccaggaagggatagccgagcagcgccagcagcgagcccgcgttggacagcgcatagagcggatagggcgagcggcccggccgcgcgcgggcgaaccacgactggagcaacggaccggtggtgctcagcacgaagaaaggcaggccgatggtgaccgccagcatcgccagcagccggggcacggccagcgcggtgccctccggacgccattcaggcccgggtgccaccggcgagcccgccagcaacgcacgtgcgcccagcagcagcaccgccaccgctagcagtcccaggtggacgcgggcttgcgtgcgaggtgccagccgcgaggcgagtccgtgcgcgtacgcgtagccccccagcagcaccgcctggaagaacaacatgcacgccgtccacacgccgggcgttccgccgtaccacggcagcgaatagcgccccaccaggggttgcacgccgaacaggaggaacgcactggcgaagatggcgatggcgtagcgggacatgttggcggtccaggctttcccgcccggcacgtccggtcaactgtccggcgtccggggggcgaagaaggttcagcgcgagggtgctcggggcgcgaagagccgggcgccggacggagccagcgcggtttccatgggcagcccgtagagcgtttccagggagccacgctccagcacctcgttcgccggcccctgcgcgagcacctggccatcccggaggagcagcacgtgggtggcgaaggcggcggcgaggttcacgtcatgcagcaccgccaccgcgcccagccccgcgtccacgcgcgcgcgcacgcggtcgagcgagcccacctggtgggccacgtccaggaaggcggtgggctcatccagcagcaacaactcgggctgctgcaccagtcctcgcgccagcatcaacatccggcgctcgcctccagagagggcctccgcgggccgctcggacaggtgcgcaatgccgagctccgtcatcacctcccgcgcgagcgccacgtcggccgcggacggcagaccccagaggcccaggtgcggactgcggcccatcaacaccagttccaggccgctgaagccctccgtggattcgatggtctgcggcacccaagccaccttgcgggcgagcgctcggggctcccaggcggcgcgctcgcggcccagcaggcggacttctccgcgcgtccagggccccaggcccagcaccgcgcgcagcagcgtgctcttgcccgtgccgttggggccgagcaccgcccacagctcaccgggccggacctcgcacgccacaccatgcaagatgggacgaggaccgtagcccgcgaccagcgcccgggtgacaagcaggggctccacgggactagtacagctccttctgcttctgcagcaggaagcgcttcatcgcccggaccttgcgcagcgcttccgggttttcgccgctacccgcggcctccacctcgctcttcacctcggcgtaccgcgtgcaccagaggccgagcaccacgcacgaatgctccgagttgagctggttgaagagcgcgttcgtctcgcgccactccctctccagcacggtgagctgacgggagcgcgcggagcgaatcttgcggaccggcgccgcgcgcttctcgggagcctcggtggtcttctgctgcgcgtccagcggcgcgaggaaggagtcgtcgagcgagcctctgccttccgtggcaccggatggcggcacgacgtcgggcgcgggggttcccggagcctgcgccgcgtccccctccggaggcgggccgttctcgttggcagccttgcccgccagcgcctcgtcgggagcggagggacgcaggggctgcgcgggcggcggcccttcgggttgctccggcatgaactggctcagcacctgggcgcggagctccgggggggccaggaagaaggctccgaccacggcgaggatgaagaacagcaacaccagcacgagcaccagtgggcccttgcggcgacgctcggggcgttcgggcatcgtcgtgcggcgggtgtcctccttcgcgatgcgctcagccgagcgcgtctccgggcggacgggcatcgtcgtgcgccgcgtctcctcgttgggcgtgagggagacgcggacatcgtcgtcgctttcgtcctcttcttcgtccgtcacgacgggggcgggcgcggtgggacgcacggcggagacggaacctgtcctgcgcgcggtgctggccggtgccatccccggcgaagatggccgggcccgccgaggcctgggccgggagacgccggaccgctcctcgtcctcggagccatccacatctttgaagaggcctgcgtccagcaccacgcgcggatgcgtgtcgtcatggcgggtgacgcgagggtccgtgtcggcgttatgtgcgacgncgggctgggtgtcgtcgtggcgttc

SEQ ID NO: 1208 - DNA, 22301 bp, Myxococcus xanthus
atcaccgcacagaacacacagggtgtcactcgcgtggacgtgatggcccccgaagctgtcgccgcgcaaatcgacgccgtggcctccgacatcggcgcgggcgcggtgaagacgggcatgctcgtcaacccggccatcatcaccacggtggcccaacgcttgcgcgcgctgggcctgggtccgctggtggtggaccccgtcatggtgtcccgcgccggcgcgcgcctcatcgacgacgcggcggtcggcgcgctcaaggagctgctgctgcccctggccacggtggccacgcccaaccggcacgaggcggagctgctcgccggcatgaagttggagacgctggaggacatgcgggaggccgcgcgccgcatccaccggctcggccccaaggcggtgctggtgaagggcggcggcatgacgggtgcgctgcgcggcaccgacgtctggttcgacggcgagcgcctggagacgctgcacctgcgcgcggtggacacgcgcaacacccacggcacgggttgcacgctgtcggcggccatcgccgcgcacctggcgctgggacagccgccgctggaggccacgcggcgcgcgaaggactacgtcaccgccgcgctggagcaccccctgcccctgggcaagggcccgggccccttcagccacttcttcccgctggaggggtagcccgggcccgccaccgggcgactacttcgcggccttcttcggcgcggcctgcgcggcaggcacggggaagccgcgcttgcgcatcagggcctggatgcccgcctcacggccccggaaggcgcggtacgcgtcggccgggtccagcgtgttgcccacggagaagacgtgcttgcgcaggagcgcggccacgtccttgtcgtaggcgcccttgccttcggtgaagcgctcgtaggcgtccgccgtcagcgtgtccgaccacaggtagctgtagtagcccgccgagtatccgtcacccgcgaagacgtggccgaactgcggcgtgcggtgccgcatgacgatttccttcggcatgcccagcgcgttgagcgtgtcgcgctcgaaggcgtccgcgtcaatgggcgtagcccccgccaggtgcagcttcatgtccaccagcgcgctggacaggtactccaccgtcccgaagccctggttgaaggtggcggccttctcgatgcggtccaccagcgcctggggaatgggcttccccgtctggtagtgcagcgcgtaggtgttcagcacctcgggcgtggacagccagtgctccagcaattgcgaggggaactccacgtagtcgcgcgccaccgcggtgccggccagcgacgggtacgtcacgttggagctgaggccgtgcagcgcgtggccgaactcgtggaacagcgtggaggcatcctcccagctgatgaggacgggctcaccggggctggcccttcacgaagttggagttgttggagacgatggtggtgacttcaccccggaaccgctcctggctgcggtacgcgttcatccacgcgccggagcgcttgcccttgcgcgcgtacgggtcgaagtaccacaagcccacgtgacgcccgctggcctggtccttcacctcccagacgcgcacgtcggggtggaacacgggcacgtcgttcacctgcgtgaaggagaagccgaacagctcgccggccacccagaacatgccctcgcgcagcttctccaactggaggtagggcttcacctcgttctggtccaggtcgtacttcgccttgcggaccttctccgcgtagtagcggtagtcccagggttcaatcttgagcttcgcgccctccttgttggccacgcgctgcatgtccgcgacctcttcgtgaacgcgggccaccgcgggcttccagacggcctccatcagctccatggcgcgctcgggcgtgcgggccatggcgttctccagccgccagtgcgcgtgcgtcttgtagcccagcagcgtggcgcgctcggcgcgcagcttcaggacttcggcgatgatgacgttgttgtcgcgcgcgtcgccgttgtcacctcggttgacgtagttgcgccagaccttctcgcgcaggtcgcgccgcgacgagtacgtcaggaacggctccatggaggagcgcgtgttggtgatgagccacttgcccttctgaccgcgcgactcggccgcggcggcggcgcccgcgcgcacggagtccggcaggcccgccaggtccgcctcggactccaggacgacggtgtagccctcttcgtccgcgagcacgttctggctgaaggacgtgtagagcgacgccagccgctggttgatggccgccagcttctgcttggccgccgcgtccagcttcgcgccggagcggacgaagcgcgtgtagtgcagccaggtgagccgctgctgctcgggcgtcagcttcgccttgtcgggcgactggtacaccgcctcgatgcggcggaagagcgcctcgttctggaagatttcgtcgtcgaaggcggccagcttcggcgccatctcccgctccagcgcctggaactccggcccgctcatggacgagctccagatgccgtagagcgtctccacttcgccctgcgtcttgccggcggactccagcgcgacgatggtgttctcgaacgtgggcgccgaggtgtcgttcgcgatggccgccagttcgccgcgcgtccgctccatcgcggcctcgagcgctggcttgaagagctccaccttcacctggtcgaacggcggaacgccgccatgggcgcccgtccacttcgcgatcagcgggttggtctgctccggagcagccggcgcggcgggggcggtcgtctggggcgcggtggccaagttctgggactcctgcgaggtcgtcgcacagccggtggacacgagtacggccatgcccgcgccagcgaagaagagcttacgcatgtagaggatgtctcccgacgaaaggggggctacctgaagagggacgcagcctagcggcatcgcgtcgcgaaccgggggacggaatcgcgggcacaccaacatgcctgcctgcccatctgttcccggccaacaccatggtcacgggaaagacgcggtgtgttacacccattgcccccacagcattcaccctccaggaatgaccgtgacgagcacgctgaaggaccgcatcgagaacaccgagttgctggcgaaggtcgtccccgtcgaagaggcggtgaagcacgtcgtccacggcaacaccgtggccatcagcggcttcaccaagtcgggtgagccgaagacgttcctgccggcgcttgcctggcacttctcccagacggcaccggacgcccgcatcaccctgctgtccggcgcgtccctgtccgaggatgtggagggccccatggcgcccttcatcgccaagcgcggtccgtacatgtcctcgcctgcctcgcggcgccgcatccatgccggagagatggacttcacggacgtccacctgtccgccttcgcgcgcaacctgatgtatggcttctacggcgacatcgacgtggccgtcgtcgaggtgtcgcgcatccggaagaacggcagcgtcgtcctcacgtcgtcggtgggaatcagcgcggaggcgctggcccgcgcgaagaagatcgtcctcgaggtcaacacctccgggccggactacacgggcttccacgacatcgtcctgcccgccgtccatccgcacgtgggctggccgctgccgctggtgaacgtgagggaccgcatcggcaacccctacgtggagctcgacctgagcaaggtggtggcggtggtggagtcccgcacgcccgaccacccggtgcccttcaaggcggcggatgacaccgccaagcgcatcgccgagcacgtcatcgacttcctgatgcgctgccgtgagcagtaccagtggggcaagcgcctgccgcccatccagtccggcgtgggcaacgtggccaacgccatcatcagccagctctacgaccctcccttccagaaaatccgcttctggaccgaggtcttccaggacgggatgttgcgctacgtggaggacgacgcaaagttcgaatacgcgtccgccaccgcggtgtccttctcctctgagggccgccagcgcttcctcgacatgttcgagcggagcaaggaccggctggtgctgcggcccatgtggctgtccaacagccccgaaatcatctctcgcctcttcgtcatcgcgatgaacacccccatcgaggtggacatctacgggcacgtcaactccacgcacatcgacggttcgcgcatcgtcaacggcctgggcggctcgggtgacttcttccgcaacgcgtacctgagcatcgtccacacgccgtccacgcgaaagctgcgggatggccgcaccgtgagctgtgtcatgccgtacgtgcggcacatcgaccacaccgagcacgacatcaagtgcgtcgtcaccgagcagggctacgcgctcaacatggacatccgctcgcccaagcggcgcgcccaggacatcatcgaccgctgcgcgcacccctacttccggccgctgctgcacgcgtacctggacatggcgggccctggcgacgagccgcgcgccaccgacatgaaggtgctccagggctggtgggcggactacgacgcggcgacgcgtgccttcccccagaacggctgagaccccggcggtggagcgcaacggccgcgaagcctgtcccccggagctggccgcccaactccgggaggtggaccgcctgcgacgcagcgggcgttacgcatccgccctcacgctcgcgcgagcgctggcggaggcgcatccccggcaggcccgcgtgctgctggaagtggcgcagacgctggccatctggggcggcgtccccggggaagcgctggagtggtacgagcgcgtgctggcgctggcccccggccacctcaccagccgactgcaccgcgccttgtgcctgtcacgcctgagccgccatgaagaggcggtcgcggacttcgacgcgcttgtcgcctcgggctaccgcaaggcactggtgctgcacatgaagcgcgccgaggcgctggaggcgctgggccgggatgaagcagcggagcgggactggacgctcgcgattgaggaggccctgggcaacccgtggctgctccagcagcgcgccgccgcgcgggcccgcctgggccggctggacgacgcggcgcaggacctcaccgaggcgctagcgtcccagacgggcgacgaggtggacccggagctgctgcacgcgcgcggtgtgttgcgtgagcggcaaggtgacgtggacggtgcgcgcgcggacttcgaggcgggactctccgcctttcgtgaaggcgacccacccgccctgctggacgcgcttcgtgaaggaaccatgcgcaaaccatgacgggcccttcgcggccacggcatgcgacaagaatggccatgcacacggcggctccggccgcgggtgctgattccgggcctgatgctcccggaggggcgggggtgctcgcgagtgggccgagcgccgatgcaatgcctgacaccacgtgagagcgccgacttggggcggtgcttgggaaccacgttggtggaggggagcgtcgtgcgggcgcggaccacgccgagcgcagcggtgggccagagggaatcgcatgccgggccgaaaggaagcggctcgtacctgcggttccctctggtgtcggggtgatgccccagtcaggccgcgacttcggcttcgggctcccgccgcaccttcgccagcgccgccacgacgacctccggcccggcgccctgcttgtgggcattctcactcaggtgcctgcgccacgcgcgcgcccccgggagcccctggaagagccccagcatgtgtcgggtgatggcgcccagcggcgcgccgcgcagcatggccttctcgatgtacggcagcatggcctcgacgacttcgtgccgctgcggcaccggcgtggtggcgccgaagaaacggcggtcggcctcggccagcaggtacgggttctcatacggggcgcggcccatcatcaccccgtccacatggcgcaactgctccgcggcggcgtccagcgtcttgatgccgccgttgatgctgatgtccaggtgcgggaactccaccttgagccggtgcaccaggtcgtagcgcagcggcgggacgtcgcggttctccttggggctcagcccctggagccatgccttgcgcgcgtgcacgatgaagcgggtgcagcccgcggcggacaccttccggatgaagccctccagcgtgggccactcctccaactcgtcgatggcgatgcgcgacttcaccgtcaccgggatgctcaccgcctctcgcatcgcccccaccagccgagccaccaggtccggctccgccatcaggcacgcgccgaagcggcccgactggacgcggtcgctcgggcaacccacgttgaggttgatttcgtcgtagccccactgctcgccgatgcgggcggactcggcgagcgccgccggctccgaaccgccaagctgaagcgccaccgggtgctccgcggcgtcgtagcccagcagccgctcccggtcgccatgcaggattgcgcccgtggtgaccatctccgtgtaaagcagcgtgtggcggctgagctggcgatggaagtaccggcagttgcggtccgtccagtccatcatcggcgcgacagacagcggcatgggatgagtcggcatcatgcgagaacccggggcagcaaccggagcgtcccgttcggcgggccgctcccctgccgcctgcatgtagccgggttttccgcccctgcccacccctttgccgcccctcttccctggccaccgggcaggcgcccacggcgaaccacttcactccgggcaaatccacccagccagcgagcccttcccgcatggttgtctggccgccctgacggtccgtggatagtcatgcccgcatgaaagcctacgaactgaagcagacagggagcgccgacgcatgggtgcaggtggagcggccggagcccacgccgggccacggccaggcgctggtccggatccgcgcggtgtccctcaactaccgggacctctacatcgccctgggccgctatcccggaccgcgccctgcctccctcatccccgtgtcggacggcgcgggagaagtcgtggccgtgggccccggcgtctcacgcgtgacgccgggtgaccgcgtggcccccaccttcttccagacctggacggatggcccagcctcgccggagaagacgcggaacgccctgggtggcagcgtgaatggcgtgctcgcggagtacgtcgtcgtggacgcggaggggctcgtcctcctccctgaccacctgtccttcgaggaaggcgccaccctcccgtgcgccgccgtcaccgcctggaacgccctggtcgccgaaggccggctccagccgggccagacggtgctggcgcagggcaccggcggcgtgtccatcttcgcgctccagttggccaaggcgctgggggcgcgcgtcctcatcacctccagccaggacgcgaagctgaagcacgcccggacgttgggtgcggatggcaccatcaactacaagacgcacccggactgggaggagcaggtgctggcgctcaccggcggccagggcgtggaccacgtcctggaggtggccggcgaggagacattcccccactccgtccgggccacgaagcccgggggccacatctccctcatcggcatgctcagcggcggcttcgccaagccggaccccgccctggtggagcccaagaagctcgacgtccagcggacttacgtgggcagccgcgccatgttcgaggacatgaaccggctcctcatccagcaccgcctcgagcccgtcatcgaccggagcttcccctttgagcaggcgcgcgaggccctgcgttacatggagtccggcgcccacttcgggaagattgtcatcgccgtctgagcggccggggcgcgagcaaggtggccagccctggctcccaccctctgccaccggcgggcgcgccctagcgagggagaaagccacaggcaagcagaaaggaaggctggagattctctccacttagggtagtcacgggcgcgccaagggtgcgtgacagacatgtcaaccgccctcaagaacggcgtcgcctgccctcaggcgacttggagggacggatgctcgagaagctgatgccgaagtcggacgagttcttcgacgacttcgatgcgcaatgtgccgtcaccgtcgaaggcgcgaagatgctctacgagttgctcagtgactaccgcgacgtcggcccgcgggtccaagcgctcaaggacgcggagcaccgtggggacgaagtcacccacaccgccttcaaccgtctgcacaagcagttcatcaccccattcgaccggggacagattcacaccctgctctcccgcatcgacgacgtgttggatttgaccaacgccgccgccgcccgcctgcactactacgaaatcccggccagcctgccggacgccacggagctggcacgcctgctggtgctgtccacgcagaaggtgcaggaagtggtggccgcgctgcggctcatcaagaagccggagcagattctcgccgggtgcaaggaaatcaagcgcctggagacgcaggcggatgaagccctgcgctcgggtgtcggccggctcttcaagagcggcgcagacacgctgctcatcatcaagtggaaggagatttacgacttcattgagaccgccaccgacaagtgccagtcggtggcgaacgtcatcgaaggcgtggtgctggagcacagctaaatgctactcgccgccgtcatcctcattgtcgcggtcgcactcatcttcgatttcatcaatggattccacgacgcggcgaactccatcgccaccgtggtctccacccgagtgctgtcccccaacctcgccgtggcctgggccgcgttcttcaacttcgtggcggcctttggcgggaacgtccacgtggccaacaccatgggcaagggcatcatcaacttcgagatgctccgggctcagggccccagcgcggtgctcgccgtcatcttctccgccctcatgggcgccatcgtctggaacctgttgacgtggtggtggggcctgccctcctcgtcgtcgcacgcgctggccggaggcatgattggcgccacgctgccggtgcttggcttcgcgggcctggtgggctcgggcatcgcgaagatcgccgccttcatcgtgctgtcgccgctcattggcatgacgctgggcatcggtctgatggtgttgagcacgtgggcggtgcaccgccagacaccgctgaaggtggactcgtggttccgccggctgcagctcgtgtcgtccgccatcttctcctacagccacggcaccaatgacgcgcagaaggtgatgggcatcatcgcggtggtgctcttcggcaccatctggcaggaccggccgttccacatcgactggtggatgatcatctcctgccacgcggccatcgccctggggaccttcttcggcgggtggcgcatcgtccgcaccatgggccacagcctcaccaagctggcgcccatcggcggcttcgccgcggagacgggcggcggcgtcaccatcatcgcgctggcccaactgggcatccccgtgtccaccacgcacaccatcaccggcgccatcgtcggcgtgggcgccacccggggctggcgcgcggtgaagtggggcgtctccgtccgcatcatctgggcctgggtggtcaccatcccggccgcggcgctgaccgcggtggtcttctacggactcacccaggtggtcatgcgcctggcaagctgagcgctggggagggctcgcattgacctccgcgagcccttccccgtcatgcatggacctgccgggtcccctgcttgacttgccgcggcaagttcggccagccttcccttcatgaacggcgtcaacggccagcacgtgcagcgcgagggaacgacgttcctcgcccgcgcgtgtgtcctgacgaccgtgctgaccaccaccaccacgaccacgacgactccccgccgggcgcgggtggtctagcgacggaaccaccttggtttccagctcggccccgcgctctccggcgcggggcttttttgttttcacatgccgcaggagccccgacatgcagccctcctcgcagtcgacaccgacaaacccgccgtcccgcctcgccgccttccacgcggaggtgcgctcatgagggtgatgaaattcggggggacgagcgtgggcaacgccgagcggatgcgcggcgtggcggacctggccgcggcggcgcgcaagcagacgcgggtgatgatggtcgcctcggccgtgtccggcatcaccaacctcctgttggaagcggcccgcgcggcccaggaaggtcagccggtggagtcgctccacggccgcttcgaggacgtccaccgcggcatcatccgcgagctggcgccggagctgggggaggcgcggcagcgctcgctggaagagggactttccacgctggcctcggagctgcgcgggctgctgcagggcgtggggctgctgcgggaatgttcgccctccgtgctcgcgcacctgtccggactgggcgagcgcgccgcgtgcctgattctgggcgcgctgatgcacgcacgcggactggagccgcacgcagtggagccacgggacgtcatcctctgcgcgggggacccgctccaggccacgccgctccaggaggagacccgggcgcgcttcacgccgctgcgcgaggccggcggtcccgggttgatgctgatgccgggcttcttcggcggtgacacccggggcaagacgatgtgcctgggccggggtggctcggattattcggcggcgctggcggcggcggcgctggacgcggagctgctggagatctggacggacgtggacggcatcttcagcgccgacccgcggctggtgccagaagccttcccgctgcccgaggtgagcttcgaggaagccatggagctggcctacttcggcgccaaggtgctccaccccaagacgattgcgcccgcgcgcgagcgcggcatccccgtgcgcgtctgcaacagcttccgccccgaccacccgggcacccgcgtgaccgacgacgccgcgccgcccgagcacccggtgcgcggcctctccttccttcccggcatcgccctggtgaacctgggcggcgcggggctcaagggcgttccgggcaccgccgcccgcgtcttcgagtccatggccctcgccaacatctccgtggtgctcatcacccagggctccagcgaatgctccatcagcttctgcgtccagcaggcggacgcggagcgcgccgtgcaggccctggaagtcgcgttcgagatggagcgcgcggcgggcaaggtggacaccatcgagcagcagcgcgggctcgccgtgctcagcatcgtcggtgatggcatgcgccaccgcgtgggcgtggcgggcaccttcttcagcgcgctggcggacgtgggttgcagcatcgccgccatcgcgcagggctccagcgagcgcagcatctccgcggtcatcgcggagacggacggtccccgcgccctggcccatgtccacggtcggtgcttcggcaccacggaagtcgtggagctgctgctggccggcgtgggcagcgtgggcggcgagctgctcaagcaggtccaccagcaggcgcccaagctgcgcgcccacggcgtggacctgcgcgtctgcgtcatcgccaacagcaagcgcgtcgcgacggcgagcgagggaattcccctggaggactggaagcagcggctggcggccagcagcgacggcgcgcccctggacgccttccgcgactgggcccgcgcgaagcggccgggccggcccgtcttcgtggactgcaccagcagcgaggacatcgcgctcgcctacccgtcgctgatggaggcggggctccacgtcgtcaccgccaacaagaaggccaacgccggccagtggagccactaccgcaagctgcgcgagacggcctcccgtcaccaacgccgcttcctctacgagacgaacgtgggcgcggcgctgcccgtcatcgacacgctgaagaacatgcttcgcacgggagaccgggtgctgcgcgtggaaggcattctctccggctcgctgtcattcatcctgggcctgacggaggaaggcgtccccttgtcgcaggcggtgggcaccgccatggagaagcgcttcaccgaacccgacccgcgcgacgacctccacggcaccgacgtggcgcgcaaggtgctcatcctcgcccgcgagctgggccgccaggtggagttggagcaggtgacgctggactccctgctgccgtcggacttcgacgccaccgggccgctggatgacttcctcgcccggctcccccaggtggacgccgccttccagcgccgcgtggagacactccgcgcggagggcaaggtgctacgctacgtgggcagcgtcacggaggacggttgctttgtcgggctcgtgccggtgcccctgacgcacccgctggcggcggtgaagggcggagagaacgcgctcagcttcacctcggagcgctacagccccacaccgctggtgattcgcggctatggcgcgggcgccgcggtgacagcggctggcgtgctggcggacgtgctccgcctggtcgacgggccactcccctgagttgacgcccggtccgacaggtccgcggccgatgtacgtttgaagttggctgcggacttgtcgacaatgccccgcctgccctcgaatgcgcgagaggcaagggggagagaacggaatggacgtgactcgcaagccgacccgagacctcacctgcaaggtgctggcgctcgcattcaccctggcgctgacaactgcgtgtcccggtgatgacgacgatgatgatgggggcaacggtcccccgggcgaccccgtcaccctgagcggcacggtgacgtacgacttcgtcccagccgtctactctccctccacgcggcgggggaccctggagttcaaccaggcccagaagcgacccgtgcgcaacgcagtcgtccaggtgcgacaggggacgcgggtgctcgtcgatggaacgacgaaccaagagggccgctacacgctgacgtacaggccgtctggcagcggcgcgctaacggtcgtcgcgctcgccaagacgacccagcccgaaatccagattgaggacaacaccgacaacaacgccatctgggcgttgggtggcgacatcaccacgacggtgacgaccaaggacttgcacgcgacccacggctgggcgggcaccagctacacggccagccggcgcatcgcggcgcccttcgccatcctcgacagcatgtacaccgcgtcgcgggccttcatggacgtgcgcccggtcaacttcccgctgctgaaggtgaactggagcccgaacaacgtgccccagtctggcagcaagccgcagggccgcatcggcacgtcgcacttctccttctcggagaacgaaatctacgtgctcggccgggacggcgtggacaccgacgagttcgacgcccacgtcatcgtcccagagtgggggcactacttagaggcccacctgtcgcgttcgtacagcccgggcggacggcactccagcggagacatcctagacccgcgcctagcctttggcgagggctatgcaaatgcgctcgccagcatcctactgcgggagcccatcaacgacgacacgatgtggaacggctcgacgctggccgccttaggcttcaacgcggagagagagccgcccagcacagacgacccggaaaagggcgccttctcagagatgagcgtcttccgggctgctctatgacttgagcgactccggcaccaacgagtcgtacaacagggtgtcgtacgacctgggcatcctctacgacgtgctcgtcggcccgcagaagtcgacgcccgcgctgaccaccatcggctcgttcatcaacggcctcaacgcccagcccggcgtcagcaccgcggacgtgtaccaactgctggcccactacaacatcgggtccatctcctcggacttcggagatggggacacccggctgcgcgccatctacaccgacgtgccgggcatcccgtacaccaccgaagtgccgctggtgggcgggctcgactacaacaagcgcaagcagaaccagtactacgtcttcaccggcacgggccggaacatgacgctcagcgcgtcccatgcgtcgcaggacgtgggcatcgaagtcttcggccagggccggagcctggcggagtccgacatcagctacaccggtacggagacggtcagcatcccgacccaggcggacgcgcggtacgtcgtcgtcgtgtacggcttcaaggagacgaccggtaactacagtcccttccccaccctctccatcaccagccagtgattccggagcgcacatgaacctcaaggcaatcgcagccctgtccagtctcctcgcgctcacggcgcaggtcgcctgcacctccccgtcgaagtcgaaccccacgcccagcgacagctcggacaccacgaaggccggcgcgccagtgaaggtggacgcgaagctgggtgaggaccaggcccgcgtctccctgcgcttcgacgcgccggcgaccgacgtcaaggtcagcctctccggcgtggacggactggaagtgaagagctccgccacccccgtgtcgggtggcagcttcaccccggacgccgtgtccgagttcgacgtgagcttcacgccgggtgaagggcagtctcacctcgtcgtcaccgtcacgggtgatttccgcggcgcgcacctgtcgcgggtgttcagcttcgcggtgggcacgcccacggcggcgcagcagaagaccgagggcacgacggtgacgggcgacgacgggcagcccatcaaggtcatgccctcgtccgacgccgagtagtccggcgggcacagccggggcccggagaaccgggccccgccgaagcagaccccctgaaaaaacacagcggggagcgcgccccccgacgcactccccgccgcgtgagccactcagacgagagctccagaaaaaaacattgggagcacgccccctcgacgtgctcccaatgactgcgcggcccgactccggcgcgccctccccctctggaagcaacagcccccccgggcttgcttcctccccatccccacttcgaaattcaaaacgcacggcgccgaaaaccttgaagcacccctgcgttttttttccgggccgcctggagcgatgctccgcccacacggccacacacacgctgcgtatgggccttcgcgagtggctcccaggatgacgaccgaccttcccgccccgaagccctcgacccacggcctcacagggacgctgttccacctctgggtcttcctcggctccttcctgctcttccaggtggagctcatcctcgcgcggctgctgctgccctcctacggaagcagcgcggccatctggacgacgtgcctggtgttctaccaggcggtgctgctgctcggttacttctactcgagccgggtcgcggtggccgcgcaccagggccgctaccgctgggcccacctgggcttcgtgctgctcgcggtggtcgtcttcccgttccggctgcacctcttcgagctgcaccccgtggcggccatcctgctcacgctgacgctgtcactggggctgccgttcctcgccctgtcgacgacgagcgtcgtcgcccaggggtggttcacccgaacggagcatccctcccggggtgacccgttcttcctctacggaacgtccaacgcgggcgcgctcacggcgctgctcaccttccccttcctggtggagccggcgctcgacatccaggagcaactggccgtctggtacgtgggctacggcgcgttcgtcgtcttcgcgctgctctgcatccagcgcgttcgcccggcgcttgccggtggaagcacgacgtccgagccagcggcccggaccgagccggtgccccgcgcgccgcgcgcctcacgcatcacctggctgctgctgtccgcgagcgccaatgcgctgctgctcgcggtcaccaacgtcctcacgctggatgcctccatcccgctgctgtggatcctcccgctctcgctgtacctgctcacgctcatcgtctgcttctcgaagcggccccccacgcccacggggttgaaccggctcgcgctgggaagcctcgccgtcgcggcgggcgcggcgctcttctcgctggcacgcgcgcagacgtcgctcccgtccctggtgctgcacagcgcggtgctttgggtgggctgcctgctgatgcatggcaacctcgtgtggtgccgcccctcggacccgcgcctgctgggctcgttctatctgcacgtctcgctgggcggcctggtgggcaccttgctgctggccctgctcgttcccctgacgctgggctcgctggcgctcccgtacctggaccacggcatcaccggcctgctcctgctgggaggactggcggcgcgggacatgatgcgccggggccaggggctgcccgtcccgaagctggcgccctacgtatcgagcggagccgccctgttcgtcgtcgcggtcctggtgctctccgggtggatgctcgcgcgcgggcgcatcgaaggctcgcgcaccttctacggcctctacacggtcaaggacgcggagggcctgcggctgttccagcacggcagcaccgtccacggcgtggagaacctccacccggacgagcgaggcgagcccctctcctactaccaccggggctccgcggtgggccgggtgctggcctcggaacggattccgcgtgagcgcgtggccgtcgtggggctcggcatcggcagcctcgccgcgtatggccgcactggcgagcattgggacttctacgagttggacccggaggtggagcggctcgcgcgccagcacttcagcatgctcggctccagccaggcggagctccgcgtcctcgcgggggatgcgcgccttcgcatggaggaagccaaggacggcgggtacgacgtcatcgtcctcgatgcgttctccagcgacttcgtccccacgcacctgctgacccgggaggcgctgagcctctatctccggaagctcgcgccggaggggctcctgctgttccatgtctccagccggcttttcgacctggtccccgtgctcacccgcttgagcacggagctgcgggtccaggggctcgtgaaccggacggagcgcctcaccgccgaggagctggcgtcgggccgctcccccagcgtctggttcgccatgagcgccaacagcgacgtcgtggcccgcctcacccaggagctgcccttccagccggtggacacgccgcccgagctgaaggacaggcgcgtctggtccgacagctacgtcaacctgctgcacgcgctcgcgcactgacccacggcctcgtggcgcttccgaccaagccccggaagcgccctgtggccgcgacggctacgcggtcttctcccgggccgtgagcacctcggacgagggctcgccggattcggcgatgcgccgggtgaggcggcgacggacgacgtcgacgtgctcccggaagaagtagaggttctccgcgtaggccaggggcatggggatgcggttcacctcgcgctcggcctcgtcgagccgccgcagcatctcctccagcatctcccggcccgggccctcctcgagctggagctcgatttccttcagccgcgcgtaccagcggaagatgcgcgagcgcacgcgccactggtacagcgccggcgccacccggcccaggggcaccaggacggcgatgaagggcaccagcatcacccagagccggtccaccaagttggcggcccagaacggcagatagcggtgcaggagcggaacgccggactcgtagtagcggcgcgcctcgctgctgaacggaaagcccgcctcgagcgccgccgggaattcgcccgtgcggtccaggatgccggccttgccgtggacctcgctggccgcgcgcatcaagaggtaggccagcgccgggtggagcgcatcggtggcgaccaggttcgcggtgggcgccaacatcaccacgtcatggcctggcacgtccgcggccaggtcgagcacgccccgcggcagcacgtgccgggacagataggggtagcggcgcacgtaggcctcgccccgcgagaagctgaggagatggatgtccggcacccgcgcgagccgctggacgggcggcgactccgctggggacacgatgaagacagcatcgaccttgccctgcttgagctgctcgatggcctcgtcgcgccccaggttcaagagttccgtgggcgcggcgcccacgccgttggcctccagcaacttcatggacagggcgcgcgtgccactctcctcggggcccacgacgatgcgcttgccctgcagggcattcaggtcgtcgatagtgggccctcggtagaagacccacaacggcacataggagaggcttcccagggacacgacgtgcggcgccttggtggcgtcggacgtcccgctctgaacgaaggccacgtccacgcccgagcgctcgtcctccagcagtttgatgctggtgagcgagccgtccgtgggacgaatctccaccgtgacgccgtgcttcgcgagaatctcctgatacttgcgcgcgaagtaccggaagccgccctcgtccccagccgcggcgatgacgaccttcttcggcggcgcgggcttgacgaagtagaacgtgacggcgaacgcgatgctgacgatgacgagcgcggggcccagcgtcatccagaggtcccaccgcaacgtgcgacgcaggcgggccttgagcgagtccttcttcatgatgggcgcggagtatagacacggcgcgcgccagccacggggcccggccgccggtggggcggccgggcagtcagaaggcggtcactccacccgcctcccgagggacggacgtctcagtcccgccggcgcttggagcgtgacgcctcccagcccatcaaggtcctgccgcgctcgtggcgccggtggtcgcgctcggcggacgcactgcgctgacggacctgataggcctgctcacgccgcagccgctcgtagctggcgagccgcgcctcgggcagggcccccgacgacacggccgcgcgcaccgcgcacccgggctcgcgctggtgctggcagtccgtgaagcggcagccggcggccagctcgaggatgtcggtgaacgtctggccgatgccgtcatcctcgccccacagccccagctcgcgcatgccgggtccgtcgatgagcagtccgccgcccgggagcacgaacagctcgcggtgcgtggtggtgtgacggcccttgtcgtcctcggcgcggaccgcctgggtgaccagccgcgcctcgcccaggagccggttgaccagcgtggacttgccaacaccggaggaaccgagcagcgcccccgtcttcccggccggaagctgcgcgcgaagggcctcgatgccctcccccgtccaggaactcagcgcgagcacgggtacgcctggagccagctcctccacctcggccacgagcgagtccgcgtccgggcgcaggtccgccttggtgagcaccaccacgggcgcggcgccgctggtccacgccagcgccaatgcccgttcgatgcggcggggattgaagttgccgtccagtcccgcgacgaggaccacgacgtccaggttggcggcgatgagctgcccgtcgcgctcactgcccgcctcgcgccgggcgagcacgctggcgcgaggcagcaccgcgtggagcagcgcctcgccgtccccatcggggagttggagcgccacccagtcgccgatggtgggcagggactcgacgccgggggcttgatggagaagccggcccgcggtgcgcgccaacagggtgcgcgtgtccgtctggaccgtgagcagccctcgatgctggcgcacgacgcggccagggacgagggacagtggggactgcgagacgagcgtagagaatgcgtgttcgaaggctggaccccagccgagggtttcaagcgacatggttggaaggactccggacagagcggtgccaatggcgcacctggttcttcagggctccccgaggagcgcacggccgcgctgtgtcagaccttcgcggccggctaggcggcctgcgccctcgaggcgaacaggacttccaccgcgtcgagcacaaggggcgagttcacgatgcctccaaaggacttcaaggggcggtgcccaccaccgcccggcacggcatgtctatcccggcgcgtggcggcggggaatggccacgtgtgcagaaccgccgccagcgcccggccgtccaggtagcgcagcgcgccgagcacatgccgcaccgggcgagcgcccgccttgcgggtgggttccggtggaaacggacgcaccccattgttaggggcagatgtcctccaaggagcagccgtgttccgattcgaaaacgaccgggcgctcatcgaatccttccgccccagagaccgccgagtcatcgagatgcccccgggcatcaccttcccactcttcgtgcgggactacctcgcctggacggagacgtccggcgcgcgcgtgtacctcatcttctccgcaccgggcagccgcaagcccattggcatcatcttccgccgggacgccctgggcggcgagcccgtcactcgcatgtgcgagtggtgccacagctacggctcggctcacgaggtgtgcctgctcaccacagcggtggacaacaagcgtcgtgtgggggtgaacctctgcgccgaccttcggtgcagggagaagatggaggacgcggcggaccgctccggtcgacacccgcttgaatttctcggaaagctcaatgaacgaatgtttcgtttcgcgcatgaggcgttgggcatcgaagcgcagcccgccgcctgatgccgccgggcaatcgggcttgacggtggcggcatccttcgctctttagcgaagtgatgccccctgtccgcctcgtcgttctcgcctcgctgctggccgcggggctcgccgccgccgcccccgtcgtgcaagtgccggagggtggccgccccgtggaagtgctggcccagggggtcgtctgcggaccggtccgcaacggctggagcctgggcccggatggtcgctccgtgcatccgcccgccaggccggacgacaacgcgcgcacgcaggacctcaaggtcgccgacaccccggcgcagtgcgcgaccagtgagcgaatcgtcacggtgattgccaccgggccgctgccgcgcatcgacttctcggggacttccttctatccggacgaaggccgcctggagctgcgcggcgtggggctgttgaacgtgggcgtcgcgtggtcgggcaagccgcgcggcgagccggagcgccccgccatggaggggcaggacgtctgtctgtccccctccaagccccggggcctcgcggactgcgcggtgcccgtgccgcagggcctgcccacggacacgtcgctgtactggattccgccctacggccgcgtcgggccagacgtgaagacctacgacgccctcgggaacctggtggaccccgaatcgctccgcatccgccccggccgcaccatcctcaccgagcccctggtgctctccaacggaatcgacgtgtcgaaggggccgggcagcgtccccgtcagccactccgaggcgattgccaccgccgactgcggcatcgcccgctgcgaaccagccgaaggcttcatctccgtgcgcaacgtcccgggcgtggatgccacggtgacgctgcgcgcgcgactggtgccgcgcgtctacttctcgcgcgccgatgtgctcgaccaggtcatcaccaccacgctgtccgtgctggcgtgtcccctcacggcggtggagggctcggtgctgcgcggcgcggagaactccgcgctcgtggtccggttggatcccgtctgcgcccatgacccgcgcaccctggtgtggaccgtcaacggcctgcgcgttcgcgtggagcgcgtggtgaagctggcggagggcacctatgtactgctgcgcacgggcggcacgtccgatcagcaggtgaccatcaccgcgctgacgtcgcggcaggatggaacggtggtggcctcggagacggcgaagacgctgcccctgcccgtgccccgggccagcttggagctgcccgggcttggctccatcgatttcatcccgacgaaccggcccgcccaggtgagcatggcgtccaacgccggcctgggacgcttcgtgctggagcccttgcctggcgcatacagagtcacgacgcgggagtccgtcaccctcatccagggcgaggcggcgccgggcgcctgtcgtggcg

SEQ ID NO: 1209 - DNA, 21330 bp, Myxococcus xanthus
  unsure (1)..(21330): unsure at all n locations
ccacgcacaccacgaaggtgaggaagctggagaaggggtccatcacgccaaagccgagcatcacctcctggggtggctcgaacatcgtcgtcagcgccatggcgccggccgccaccgccgtcaccacggtgagcaccgcctggtacgcgcgcgacgccgtcgtggagaggaacacctccgacaacagcaggatggaggcgcccaccaccatgatgatggcgggcagcagcgggaggaagtctgccaggctgagattgggcaggttcatgtcggaagctcaggcggctactgccgcggcgagggaacggccggggcggcggccaacggaacgggcgcggacggcgcggcgacgacctgacgggatggcagggacatcacctctacccgaagtcggtcctcctgcaactcggcccccggcgtgcccacgcgggcgcgggccaggaagcggtccgtggaaggcgccagccggtccaggaagggctgcggctgcagacccatcacagcgaccaggacgatgaaggggagcaccgtgaggccctcgcgcaggttcatgtccgtcaggtgctggttctcccggtgggtgattccaccgaagaacaccttctgcaccatccacagcatgtacgcggcgcccaggatgacgcccagcgtggcgaaggcgccgaacaccgccgtcaggtgcgggttgcccgcggcctcgcccaggtcgctcttgaaggtgcccagcaggaccaggaactcaccgatgaagccgttggtgcccggcaccgcgatggaggagaaggtgatgatgacgaaggccgcggtgaacaccggcatcaccttcgcgatgcccgccgtagtccgcccatcaggcgcgagtggcgccgctcgtacaggtagccgaacaggaggaacagcgcgcccgtggacacaccgtggttgagcatctggtacgcgctgcccgtggcgccctcggccgtaatcgccaggatgcccagcatgcagtagcccaggtggctgaccgacgagtacgcgatgagcttcttgatgtcccgctgcgccaggcacatcagcgcgccgtacacgatgccgatgacggccagcgtggcaaggaagggccgcgcctgctgcgtggccaccgggaagaagggaatcgcgtagcgccagaagccgaaggtccccatcttcagggtgacgccggccagaatcatggagccggccactggcgcctgcacgtgcgcgtccggcaaccaggtgtgcagcggccacatggggaccttgacggcgaacgcgatggcgaacgccgcgaacagccacgggccccaggtgtgcagcgtggcggccagcccggtgagtgagtcacacgcgcccgcgggccccgcggtgcatgcgctgagctgacggttggcgtccagcaggccgttgtagatgctcgcgtagtcgaacgagcgggcacccaccggcgagctgatgaagtacacggcgatgatggccaccagcatcagcagcgagccggccagcgtgtagaggaagaacttcaccgccgccatctggcggtcctcggngccccacacacccaccaggaggtacatggggatgagcatggcctcgaagaagatgtagaagagcagcacgtccagcgacaccagcgcgcccagcatcgttgtctggagcaccagcagcgccaggtggaattccttgatgcggaacttgatgtacgtggtggacgccagcaccaccaggggccccaggaagacggtgagcagcagcaggctcacggccaggccgtccacgccaatgtggtagctggtgccgaacaggtcgaaccaacgcgcccggtactcgagctggaactccggcccgcccggcacgtacgccatgtaggcccagaccccgaacgccaggtccagcaccatggcgatgaacgtgacggtgcgaatctggccgctctcgccggcaggcagcagcgccaccagcgccgcgaacaccagcggcaggaagacgacgaggttgagcaggtggttgtcgaagaagctcattgcatcacctggatgagggcgtaggccatcccgcccaacagggcgatggccatcacagcggcgtaggcctgggcatcgcccgactgcacgtagcggagcgcactgcccacgcgcgccgtcacccacgccgtgccgcggaccgccacggtgtcgatgacgagcgcgtccaccacgcggaagaggaggaagctcatgaacttcacgggacggatgacaatcagctcatagagctcgtccacgtagaacttgttgagcgcgagggggcgcaccgcgcggatgaaggcgggatccggcagacccacgcgcgaagggaagtagcgcaggtagaggaaggccgccgcgccgccacccgccagggccacggcccaggccttgaggtagtccggcaccaactgcgggcggctggtgtccagcgccaccagcgtgctggcgtcggtgatgcgcttggtcgcgctgaacaccgggctcaggaagttgtcgagcaccggctgcgccgtcatgttgaggaagtcgatgccgaacgcgtaacgtgcggcgaccacgctcaggaccgccagcaccaccagcggcagggtcatctgccaggcgctctcatgggcgtgggccacccgggcctccttcgagcggggaccctcgaaggtgagcaggtacacgcgcgtcatgtagaacgcggtggacgccgcgatgagcaggcccaggtagtagacgaggctggacacccactccaggccctgcaggtggttgtggtgcacgccgtgcaggatggcgtccttcgagaagaagccggacagcgggatgatgccggtgatggccagggtggcgaccaggaaggtggcccaggtccagggcatctccttgcgcaggcctcccagcttcttgatgtccgtctcgtcgccgttgccgtgcatcacgctgccggcgccgaggaagaggcaggccttgaagaaggcgtgcgtcatcaggtggaacaccgccgcccagaagatgcccatgcccacgcccatgaacatgatgcccagctgggacaccgtggagtaggcgagcaccttcttgatgtcgtcctgcgcgaaggcgatgagcgctgccagcagcgaggtgagcgcgccgatgatggcgatggtcgccatggcggtggggctcagcaccagcagcgcggacatgcggctgaacaggtagacgccggcggtcaccatcgtcgcggcgtggatgagggcggagaccggcgtcgggccggccatggcgtccggcagccagacgtagaggggcaactgcgcgctcttgcccgcggcgcccaggaggaacagcagcatggccaccgtcatcacgccgccgaaggtgtagccctccagcgggcccgcctcgatgggggtgctcaggtcgaccttgtccgcggagccgtccaccaggccctcggccatcttctccaggcccttgaacgtcaccgggcccttcttctccagcgcggccgtgtagtgctgcgcggtggtgccggcgttgttgtagtccgccgcgttcgactgctgggtgaaggcggagaccagcagcaccagcaggaaggtgccgacgaggaacgcgaagtcaccgatgcggttggtgacgaaggccttgcgcccagcccaggccttggccgggtcgtcgtaccagaagccgatgagcaggtagctggccatgccgacgccctcccagcccacgaagagcaggatcaggttgtcggccagcaccagcgtcagcatcgccgcgacgaacaggttcaggtacgcgaagaaccgccagtacgcggcgtcgtgctccatgtagctggtggagtacaggtggatgaggaagccgacgccggtgatgatgagcagcaggatgccggacagatggtccaccatcagtccgaagttcacccggaagtcgcccaccgagaaccaggtgccgtagtcgtacgcgagcgcgtagcgcacgaagtcccgctcgatgccgaacgggttggggaagatggccgccagccgacccgtctcggggttgtggtggctggtggcccagaaggccaacaggctcaggacgaaggagccggccaccgccgcgcaggcgacgagctggacgttggcccggcccatcatcttgccgaacacaccgcagatgaacgcgcccagcaggggcagcgcgatgatgagccagagcgagggcgccaggatgtctggcgccacgggtgccgcccggaagaattcgacgagagtcatgacattggctcctgggggggcatcagtgcttcatcgtccggaggtcttccagcaggatgctgccccggcttcggaagacggcgatgacgatggccagaccgatggcggcttccgccgccgccaccgcgatgacgaagaaggcggacacgtggccgaggttgtcaccgcgcatgcgcgcgaaggccacgaacgtgaggttggccgcgttgagcatcagctccacgctcatgaagacgaccagcgcgttgcggcgaacgagcacgccgaacatgcccatgcagaacagggcggcggcaagcaggagataataggtgatgggaaccatgggccgattcggggcctcgcgagcggctgcctgcgccgccatctagcacagaaaagttgtccgggatgggcgatcagatccgcgacttggccacgacgactgcgcccaccatggccaccagcagcagcaagctcacagcttcaaaggggaacagccactgggtgaagatgacctgacccatggtggcgatggtgccgaaggaggcctgggctcccgtgctcagcgtggccggctcggcgggcagcttcaggaggatgatggccaggaccgcgaacaggcccaccgtcgccgcgccgcccgcgacgcgggccaccgtgggcttgccgcgcgtgggcgactctcccaggttgagcagcatgatgacgaacaggaagagcaccatgatggcgcccgcgtacacgagcacctgcatgacggccaccgtgtgcgcccacagcagcacgtagatgccggccatgaagaagaacgtggacaccagcgccatggccgaattgatggggctgcgcgcgaagatgaccgttccagccgacagcaacgtcaggagcgcgaacgccccgaagaggatgagctcgatgttcaagaccagtctccgaacgaaccccagggcttgtcgccgaacgggcagcggtgctcacggatgtgagcctcgaactcgtcccggaaccgcatgaggaacgagtgcgtgggcagcgccgccgcgtcgccgagcgcgcagatggtgttacccaggccgatgggcgggtagggggcgatcgacgacgcgacgttggacagcatgtcgatgtcgcccggctcgccgcggccctcttcgatcttgcgcaagaggcgcgtctgccagggcgtgccttcacggcacggcgtgcactgaccgcacgactcttccgcgtagaagcgggccacgcgccacaggctgcgcaccatgcaggtggtgtcgtccatgacgatgacgccgccggagcccgccatggtctgcttcaccttgagggcctcgaactccatggccacgtccagctcgtccgcgcccagcaccggcgccgaggagccgcccggaatcacggccttcaccttccggcccgcgggcatgccccggccgtacttgtcgtcgaagatgagctcggagagggtcgtgaacatcgacacttcgtacacgcccggccggttcaccgtgccggagaggcagacgagccgcgtgccgcccgacttgtcggtgcccagcttcgcgtaggcctccgcgccctgctggaagatggcgggcacgctggccagcgtctccacgttgttcaccaccgtggggcagccgaagaggcccaccaccgcggggaagggcggcttaagacggggccagcccttcttgccttccaggctctccagcagcgccgtctcctcgccgcagatgtaggcgcccgcgccgcggaccaggtagcagttcagctcgtagtccttgcccaggaccttcttgccgaagatgcccgccttgtaggcctcgtcgatggccgcctgcgtgcgctccgccgggaacttgaactcgccgcgcaggtacacgtagcaggtgtgcacgcccagcgcgtaggacgcgatggcgatgccctccagcatcatgtgcgggtcgtcttcgaggatgtagcggtccttgaaggtgcccggctcggactcgtcgccgttgaccgccaggtacttgggcttggggctgtccttggggacgaagctccacttgaggcccgtggggaagccggcgccaccgcgaccgcggaggttcgacttcttcacctcgtcgatgatggcggcgggctccatctggagcgccttcttcagcgcctcgtagcccccccgcttgcggtagctgtccagggtccaggactgaggcttaccccaggccgccgagatgatcggttcgatcgtctttgccgtagaggccatgtcgatgacgtcctaagcctaagaagggtgggggttcagctcaacttggcgaggatggcatccagcttcgcctgggtcaggctttcgtggtgatcctcgttgatctgcaggcagggcgcagtaccgcacgaggccaggcactcggtctctcgcaaggtgaacttctcattggcttcacctgccttgaggcccagcttctcctccaggtaggcgagcatcttctccgcgccccacagcgagcaggacaggttcgtgcagacgtcgatgacgtacttgcccggcttcttgaggtggtacatcacgtagaagctggccacttccatggcccgctcgggagtgacctccagatgcttcgccaccagccgcaacccttccgggggcagccatcccttgatttcctggagcagacgcagcgctgggagcatgcccgcgcttttccgatccggggggtagtgggagatgatctccgcgattcccgcgtcgaacttcttctgctcttcagaggtgaacaggggctccgccatggcgggccggtacgtattgccccaatggctacgttgtcaacataaaccctcgaagctacactgggttgccatcagcaaattgccgagcgatttcaagcccttgttatgaacccgggtccagaggacaagcgccagcacccccgcgtcccggccgtgctgagagtggactacacggacgggcgccaggcccgcgacgtgacggagaacctgtcccacgagggcctgttcgtccagacggaccagtccttcgtcatgggggacgaggtccggctcgcactttctttcccgggactgctggatccggtagaagtcagcggaaccgtggcctggatgcggccagcgggccccgatcagcctgcgggcgtcggcgttcgcgtggagcgcgagcaggaccggcggaaactgggtgacatcttgagtgcggcaggagcagacagccatgcgtcccacgcagagcacgagggctatcgtgtgctcatcgtcgaggacaacccgcacatcatcgagatgtacagctacgtgctgaagaagctggccagcggcgagctgcacggaaaggtccccctggaggtccacttcgcgccggacgggcaccacgcgctgctgatgctgcgcgaggaccgcttcaatctggtgatgacggacctctacatgccggtgatggacggcttcgccctggtggagcggatgcgcgaggaagacgcgctgcgcaccatccccatcatcgccatctccgccggcggcaaggaggcgcaggaccgcgccatgcagctgggcgtggacatctacctgcgcaagccggtgcgtttcgtggaagtcctggagacggtgaagcagctcttgcgcatcaagtaggggcgcgttttaccgccagtcatccgttgagccatggcgtggggacggcatagagtcgcttccccatgcagaagcccgccctcaatcgcgacaccgtcagtggcgaggcgctgttcatcctccggaacctgagggagaacggccgtcttggacgctcgaacaagctggcagacgtgaaggccgcactcgagccatccgtgtcgctcgagttcgacaactacttcttcttcctgcgcaagttccactacatcgccatggaccgcgaggcccagctcaagctcaccgaccagggcgagcaggtggcgggtggggagctgaacgagcgcttctccctggaggtcggtgagttcttcgccgatcagctggtcgccgccgcggacgcgcccctggagggggccggtgggcacgagtcgctgatggttcccccgcctccgccggagctgctgctggacgaggccgaggtcgacggcgcgccgcatgtgccctccggcccgcccgcgccgccgcccatgccgccggtgcgcagctcgcgctcggccatgcccgcgctggacctgggcatgccgtccgcggccatccccatgccgccgccgtcagccgagccccgccgcgaggccaccgtcatcgtccaggggcccttcaccgcgtcgaacacccccgcaccgtcccccacccctcccgcgcctgccgccgcccccatgtctcctccccccgcttccaccgccgccgcagcagcgcccgccgctcccgctccgaagggtgccgagctggacctgcgctaccagaagttcgaccccatcggcaccgggccgctgggcaccgtcttcaaggggcgcgtcaccgcgctgggcctggacatctgcctcaaggagctgaaggacatctttggctacttctccttcctgcagcgcggcgaggtgctcaagcgcctgaagaaggagctgtgcgcccaggcgcaggtgcgccacccgggtgtggtccaggtggtggaccagaacgtggacgccgcccggccgtacttcgtgctggagctgatgcagggcagcctgcgtgagcggctggacgcgggcggtggcaacggcgtaccggtgcccttcgcgctgcgcgccttcctgcagatggcctatggtctgcgggccgcacacgccgggggcctcacgcaccacaacatcaagcctgagaacgtgctcttcgacgtgtacggcaacgctaagctggccgacttccgcctgggccgggtggtggaggtggacgccaccaagggcatgccccaggtcttcgtgggcacgggcggcatggcctacatggcgccggagctgatgaaccggggcggcaaggagccgggcgcctccgcggacgtgtacgcgctgggcatcctgctctacgagatgctcaccgggcagattccgggccgccgctcgccgctgccctccgaggtcaacccggaggcccccagcggcctcgatcagctattcgacaaggccacccaggacaagcgcgagcagcgctacccggacgtggacgccatgttggaggacttctacaaggcgttcccggacaaggagttcctcgccaagggcgacctcgtcatctcctcggacacgccgaaggagtgacggacgagcggccgggccccggcgcactcggggctcgccgcgcacgttgggggctgccacactccgtggcgccatgactccgcccctgtccgaaagcgtgctcatcaccgtcaccgggaaggaccatcccggaatcgtctcgcgcctcaccggcctgctggcggaagctggcgccgagctgctcgacgtggagcaggtggtggtgcaggggcgcctcacgctctgcctgttggtgcgtctgcccccggcgagcggcaccctggagacgctgttgtccgccctgaagacgctgggcgtggcgatgcccttccaggtggtggaggcgcccgccacgcccgccgcgtccgcgcaccacgtcgtcaccgccgtgggccgcgccctgggcgcgagggagcttcatgcgctgacgcaggtgctcgcggggcacggtgccaacgtggagcgaatcacgcgcctcagcgagccgcacctgggctcggtggacatccacatcagcctgccgccgggccagccgcccgacgcgctcaagcacgcgctgctggagctgtccatgcagtcgggcgggttcgacgtggcgctgcagcgcgagagcctgttccggcgcggcaagcggatggtcgtcatggacatggactccacgctcatccgcatcgaggtcatcgacgagctggcgcgcgcgcatggcgtgggcgagcaggtgtcgcgcatcaccgagcgcgccatgcacggcgagatggactacgacgaatcgctgcgtcagcgcgtggcgttgctgcagggcctggacgcgtccgtggtccaccagctcgcggcgaacctgccgctgacggagggcgcggagacgctggtgcgcgtgctcaagcggctgggctaccgcaccgccgtcatcagcggcggcttctccgtggcggccgaggcgctgaaggcgcggctgggcatcgacttcgcgtactccaacgagttggagattcaggacgggaagctcaccggccgcaccgtgggccgcatcgtcaacgcgcagcgcaaggcggagctgttggagtcgctggcgcaggcggaaggcatcctgctggaccaggtggtcgccgtgggagacggtgccaacgacttgctgatgctggagcgtgccgggctgggcatcgccttccgggcgaagcccaagctgcgcgccgcggccgacacgtccatcgccgcgggcggcctggacagcatcctctacctgctggggctcaccggccgcgagcttctggaagcgggctcgggcgccggctgagggcgcgccctacagccgcatccgcgccgccagttcgcgctgctggagctggttcttctccagcagcagctcgagcagcgcgcgcagaatcttggagctcttctcctggttctgctgcaccgtctgcagccgcttgaggtcctcgtccgtccactcgttggcgggcgcgccacccgccagaatctcgtcaaggatgtccgcggcgctggcgccagcgcctggggcgggggcgcgctccggcgcgcggggcggaggcgccgcggcgggagcgggcggggtgatgtcggcgatgcgcttcaccaccgtgttgccgctcatgtcgacgaccttgaactcgtcctcgtcctccggcgcgtccgagctgctcgggcgcttgttgccgccgaagcgcgtgctgacgacgggctcctggccacggtagtggcggaggatggcgtgttcgatttcacgctcgcccgccaccataacgaccacgcgggcgcggctcttcgccgccacctggtccagggtgacgaggtccgtggggtccgccatggccagcaccagcgtcttgccgttgtccttgagcgacaccgggaagacggccttctgttcggcgaggctcacgtcgacgcgtgagagcgcgcccgcgtcgcgcgtgacgttgcccaactggatgcgctgcattcccaggccctggcagatggcctcggtgatgacgtcgtcggtggccagacccaggtccgcgatgatgcgcgacagacgtccgccccactggtcatgggtggccagtgcactgcgcagctgcaagtcgtcgatgacgcgtgccttgacgaggatgtcgccaatgcgattccgggaaggagaggccatggctcggcattctaccgtctagatgcgcggacgctgagtccgtgatgaggagacccagccatgcagcccttcgcggaatccgccgcccagctgtgcccctactgcggtgaggaagtggaggtcgccgtggaccccattggtgtggcctcggagacgtacatcgaggactgcccggtgtgctgccgtccctggacggtgcaggtgtcccgcgacgaggagagcttcgccgtgcaccttggccgcgacgacgactgaggcggcctggggggcaggcgggcgggcgtgaaacgtggcgccggcgaaggcgccggggcgttgcttgacacgttccgaagcatggttctcttgagtcttgtgaggcggcgctggagctccggtggggggcaccgcggcgaccgcgaaccagaacaacccaggctcattcatgccgtgcgtccgcgaggacgtcacgaacaggagacgaccatgcagactcgcaatccgttcaactcccgccgtcgtggtgaacccgctgatgcgcgatgtcgacgcgctcttccgcgagctgacgcagcccatgtggcgccaggccccgcgtgagcgcacgccggccgcggacatcaccgaatccgagagcggcctcaccctccatctggacatgcccgggctggaagcgaaggccatccaggtgacggtggagaaggacatcctcaccgtgcagtccgagcgcaaggccgagccgcgtgcggagggcgtcaacgtgcgccgccaggaacgcgccttcgggacgttcgcccgctccttcgcgctgcctgacacggtggacgcaagccgggtggaggctcgctacgagcagggtgtgctgacgctgaccctgcctcggcgcgaggagtccaagccccgcgtcatcgaagtcaaggtccagggctgaagccgcgagcgcacaccgcgggccagggaggtcacctgcctcccactgaaatccctgcccagggcttccgcgagcaaggcggaagccctgcctgttctaccgcttggcgctgagcgccagcggaacgcggaacagttccagcacctgctgcacgtccagcggcttcgccatgcacgccagcgcgccggcctgcttggactgctccacgacctcgggcgtatgcgcggacgtcatggtgatgagccgcacgccctccatctgcttgcgcgcgcggatgcggcggcagacttccagaccgtcgatgtccggcatgttgaggtcgatgatcatgccgtgcggcttctgctcggacacgagcagcagcgcctccacgccgctcgtcgtcgtctgcagctccacctgggccgcgaacggcttgaacgcgcgcttgatggcgtccagcaccggacgctcgtcatccaccgcgagcaggcgcaccgtgccgctgccgagctcctcgggaaccggcatctggtgggtgatgaggaacgtgcgcaggtccgccgaccgcacgcggcggtggccacccggcgtcctgaacgccatcaggatgccccggtcaatccacttgctcaccgtggacggatccacctgaagcaaacgactgatgtcgtgcgtcgtgtagagctggtccgtcatggccgtactcccctcttgctgcatgattccgctgcccatggaactattcacctaccttgaacacgggttttcttcaacctcactgagtaccgcgcctatcagtccctctcatcagacccactgcgtcgtcccagcggccactggccttgagacacagctccacgagttcgcgagcggcccctcggccgccaggactctgggtaacgaagtgtgcctcgcggcgcacttcggggaccgcatccgcaggacaagcggaaagagccaccattgaaagtggacccaggtcgttgtggtcgtcacccatgtacgcgcaggcgtccaagggcacgtccaactgggtgaccaactctttgagagcggccgacttgtcacggcggccttggaacacggccgcgaggcccagctcccgcccgcgcttctccacgatgccggaggtgcgggcggtgaggatggcggcgggcaacccggacagccgggccatgacgagcgcatggccgtccttgacgtcgaagcgcttcatcagctcgccgtcctggccgtagtagaggccgccgtcggtgagaaccccgtccacgtcgaagacgagcagccgcacgcgcgcagcacgggacatcagctcttccgttgccagtctggaaggggcgtccgtcaccatggcttgctcgactcccttgtttgccgacacatcaacccggctcgtggcccaacacccggcggatgctcagcacgtttcgtaccacgtcttcaaacatctgtggattcagcgaacagggaccgtcacacagggcacgatccggatcttcgtggacttccgtgaacaacgcgtcaatcccggcggccgcggcggagcgggccagcagtgacacgaagcggcgttcgcccgccgtctcaccgttgccggcgctggggagctgaacggagtgggtggcgtcgaagcacacggcgaggccggcgtcgcgcatctgcgcgaagccgcgcatgtccaccaccaggttgttgtagccgaaggttgaaccgcgctcggtgacgagcacgttggggttgcccgcttcgaaggccttgcgcgccgagtggacgatgtccttgggcgccacgaactgccccttcttcaggttcacgcccttgcccgtacgcgccacggcttccaccaggtccgtctgccggcacaggaaggccggtatctggatgatatccacaacttccgaggctggcccgacgtgactcgtctcatggacgtccgtgaggacgggaacgcccacttcatcccggattctcttcaggattctcaggccttccttgagacccgggcctctgaaggacttgccgctggtgcggttggccttgtcgtaggagcacttgaaggcgtacggcacgccgagccggccggtgatttccttcagcatccaggcatggcgcagggccatgtcctcggattcgatgctgtcggggccggcgatgacgaacagcttctgaccttggccgaccttgaagccacacagctcgatggggttgggggcgctcattcggtcaccttgccggccgccgcgttcgcgtcccgctgggcgagcgccgcgcggatgaagccggagaagagggggtggggtgcgaagggcttgctcttgaattcagggtggaactggcagccgatgaagtaggggtggtcggccagctcaatcatctccaccaggttgagctcggggttggagccggagatgaccagccccgcctcctgcagcttgctacggtacgcgttgttcacttcgtagcggtggcggtggcgctcctggatggtgtcctgcccatagagctggtgggcgagcgagccgggcttcagcgcacaggcgtagctgcccaggcgcatggtgccgcccttgtcctgcaccttcacctggctctccatgagcgtcaccaccgggtgcggcgtgtgctcgttgaactccaagctgttggcggaggacaggcccagcacgccgcggctgaactccaccacggccatctgcaggcccaggcagatgccgaagaacggcaccttcttctcacgcgcgtagcgcacggcggcgatcttgccctcggtgccgcgcacgccgaagccgccgggcaccaggatggcgtccacgccggccagcagcttctccgcgccctgctcttcgacctcctggctgtcgacgaagtgcaggttcaccttcacgtcgttggcgatgccgccgtgcagcagcgcctcgttgaggctcttgtagctctccgtgaggttgacgtacttgccgacaatcgcgatgcggacctggccgcgcgcgggctcgtacaccttgcggatgatgttctcccagcgctccaggtggggcgcccggctccagatgttgaggacctccgcgagccgctcatccaggccctggcggtgcagctccagcggcagctcgtaggtgctgcgcacatccggcgacgtgaagacgctgcgcgtgtccacgttgcagaacatggcgatcttgtccttcagctcgcggggcacctcgcggtcggtgcggcacacgaggaagtcgggctggatgcctatctcccgcagcttcatcaccgagtgctgcgtgggcttggtcttcacctcgccagccgcgccgatgtacggcagcagcgtgaggtggacgtagacgacgttctcgttgcccacgtcgtagcgcatctgccggatggcctcgaggaagggcagcgactcgatgtcgcccacggtgccgcccacctccacgatgaccacgtccgcgtcctgcgccgcctggcggatgctggacttgatttcgtcggtgacgtgcggaatcacctggaccgtcttgcccaggtattcgccccgccgctccttcatgatgaccgcgtggtagatgcggccggacgtgaagttgttgagccggctcatccgcgcgttggtgaaccgctcgtagtggccgaggtccatgtccgtctcaccgccgtcctcggtgacgaacacctcgccgtgctggaacgggctcatcgtgcccgggtccacgttgatgtaggggtccagcttgatgagggtgacggccagcccacggttctccagcagggcgccaatcgaagcggaggcgagacccttgccgagggagctgaccactccgcccgtcacgaagatgaacttggttttcttggagcgcatgtcccgttctgcctactgaggcagggatgcgtcaattattctgtttccgatggacggccgcccgctcgggccggcggggacggcgtcagttgccgtcccaagcacccggccgggcgaccgcgaactcctgggcgttcggctgcccgacgcggaacttgcgcaaatcgcagttccggcagctccagccctcccagccccgtttcaccaccaggtgcaggcaggcgtcgtagttggggcagaagaggttgcgctgcgcgtccacggactcctcgtcccggagggcggtgggcagcgggctggggcatggagtgatggacacggcggaaactcccggatgaaacgtgttgggtcggcctctcccccccggcgcgctccgaacaggaggggcggtctggcattcccgagccgtagcgaaaaggcccgtccccctcacggggaacgggcccggaactgccagcatccgccaccgcctcggtgccttttcaggccagcgaagcggaggtggacgccttggagttgctgtcgttcaaggcatcacctcctttcggagcccctgacttaatcgggagccagggtgcgcgccactgtcgcgaggtgcgtggcgggcgccgtgtgggcaccaggcgttcaagctgcgacaaactgccgctccaccaggcgccggtacaggccctcctggctcatgagggaggcgtgggtgccgctctggatgacgacgccgccgtcgagcaccagcacccggtccgcgttggccacggtggacaggcggtgggcgatgatgagcgtggtgcggcccttcatcaggcgctccagcgcgtccttcaccaggtgctcgctctccgcgtccagggcgctggtggcctcgtccaggatgagcaggcgagggtccttcagcaccgcccgggcgatggccacgcgctgcttctggccaccggagagctgcacgccgcgctcgcccacctgggtgccgtagccttccgggaagcgctcgatgtacgcgtgggcgttggcggcgcgggcggcctcctccacctgggcgtcggtggcgccgggccggccgtagcggatgttgtccgcgatggagcaggagaagagctggggctcctgcgccaccatgccgatgttgcggcgcagccactccggctccagggcggtgagcggatggccgtccagcagcacctcgccgttctgcgggtcgtagaagcgcgacagcagggaggccagcgtggacttgcccgcgccggaggggcccaccaccgccaccacctcgcccggccgcagctccaggtccaggccctggagcaccggcacgtcgggacggctggggtaggcgaagtgcacgccgcggaactgcacgtgcccgcgcaggtcggtcagctgctcgccgccagcgccgatggcgggcttgcggtccagcagttcgaagacgcgctcggcggcgccactggcgcgcatgaagtccgcccacagctccgcgatgccgctgaacgagaaggccaccagcatggtgtagatgaggaacgaggtgagctcgcccacggagaggccgccttccaccaccagccggcctccgtaccagagcaccgcggcgatggagccataccccgcgatggaggccacgcccatgaagacggaggtctggagcgcgcgcttcttcgccagcgtgaaggagcgctccacggcgacgctgtagcgctccacctcgtgccgctccgcggcgaaggagcgcacggtgcggatgccggacaggtcttcctcggccacctcgccgctggcggcgagcgcgtcctgggcctgacgggaaatcacccggacccggcgcccgtagaacacgccgccaatggccacgggcgggatgacggccagcatcaccagcgtgagctggacggacgtgtagagcagcaggcccacgccgcccagggccgtgacgacgtagcgcagcatcatggacacgttggccgtgacggtggtctgcaggacggtggtgtccgaggagagccggctggtgagctcgcccgtgcggcgcgaatcgaagaagcccacctcctgggacagcagggcgcggaagaggtccttgcgcagccgcgacaccacgcgttcgccggcgttggtgaagaggtagatgcgcagcgccatggcgatgccctgcaccgtgaacacggcgagcatcagcatcgcgagccggtccaccacataccggtcgcgcgcggtgagggcctggtccaccaggtcgccaatggcgcggggataggccagcgtggctccgctgctgatgaggaggaagagggtgcccgcggccaggggcagcagttcggggcgcgccagcttcagcagtcgccggacggtgacgccaggggaggcactgcttttcgaatcgttcgcgggggaagacaccggcggagactaacgcgagcttccaacctgcgcaccggacgcctgcgtgtgcgttgaagcggtattaatcctctcgaagcaagtcatacgccgaatcagggggagtgccatggagcagcgtccattcggaagcacacgggtgtccgtgcccgtcctgggccaggggacctggcagatggaggaggatgaccgggcaggcgccatccgcgcccttcgcgccgggttggacctgggaatgacgcacgtggacaccgctgaactgtacggctacggcaaggtggaggagtccatcgtctccgaggccatcgcgggccggcgcggcgacgtcttcctggtgtcgaaggtgatgccgtccaacgcttcctacgcgggcacgctcgccgcctgtgagcggagcctgaagcggctgcgcacggaccacctcgactgctacctgctgcactggccgggttcgcacccgctggaggagacggtgcgcgccttcgagaagctggtggtggatggaaagattcgcgcctggggcgtgagcaacttcggggtggaggacctggaggaggcgctcgcgctcgcggggcccgggcgcatcgcctgcaaccaggtgctctaccacctggaggagcgcgccattgagcacgccgtcctgccctggtgcgaagcccacggggtggcggtggtgggctacagccccttcggcaacggccgttttccccggcccgacagccggggtgggaaggtgctgggcggcatcgcccgcgcgcacggcgtcacgccgtaccaggtggcgctccggttcctggtgcgcgggccgtcgctgttcgccatccccaaggcgagccgggaagcccacgcacgcgacaacgccgccgccgcgtcgctgacgctgaccgccgacgagctggcccacctcgacgcggccttcccgctggggcccgagccggcgtcgctgcccgtcatctgatgccggcggcgaaggccttgcggaaggcggacacggtgggctcacccgggcccaccgtcaccgtgcccgtctcgccctccacggcggcgcgggtgtcgcggcccttgaggaagcgcacggtggtgatgcggcgcagcacctcgcggccctgctcctgggccagggcgcgcaaggcgtggctggcgacattcacggcggactccagcgcgcggcggcccggctcgtcgtccaggcccacccagtccacctcgaagcgcaggggcttgccgcccagggacgcctcgcccggccagaactgctcggtgagggcgtggggcagcttctccagcagcgtcaccacgtcctgccgcgtggggttgggccgtacgagctgcgtcagctccagcagcttctccgcgttgcccaccgccaccgccaccaccgtggacaggtccacgtaggccaccgactccgagcggcgcagcccctccttgcccagggccatcagcaccgattcgcggggcacgtagtccaccacctcgcccgtcatcgaatgaccgtgcgaaaggtggagcgtgacggtgatggtgggcacttcttcgcccgagcgcgcccgcgtggcgagcgttcccaactgctccagcacccgctccaccttgcgcgacaacagccgctgaacgccctccatgtcctcgtcctcctgctgctgcttgcgggtctcttgcgcgcgctgcggtttcggaggcgcgggtggtttcggggcggcttcggcccggggggcttccgcgggagcatgctcccgagcctcggcggcatggggcgcgcccgctggctcggcggcggggaccgtggttcccgctccgggcagggcggatgtggctggcgcggcagcgggcgccgcgtcaggcgccggggactccgcgtccgccttcgccgcgccaccgccaaacacgttcttgaggaagcccatggtcagcccccccgcgcgcgcatgagggcctccaccttctccacgtcaccggggaggtcgacggccaccgtgtgcgaggtgaccttcgcgcagcggatggggatgccgtgctccagcgcgcggagctgctccagcttctccgcgtcctccagcggcgtgggcgccagcttcgccagcgacagcagcacctcgcgccggtagccgtagaggccgatgtggccccagcgctggacgggcgtgcccggctcgcggacgtggggtaccaggctgcggctgaagtagagcgcgtcgccgttgagcgcgagcaccgccttcaccacgtgcgggctggcggcttcgtccgcttcgagcgggcggaccagggtgcccatccgcacggacgcgtcctggaagaggcccgccagccgctggagcgtggcggggtccaccaggggctcgtctccctggacgttcacccagatgtcgatgtctggacggccgagcgccacctcggcgacccggtccgtccccgtggcgcaggcggggctggtcatcaccgccttgccgccaaagccctccactgcggcgcgaatgcggtcgtcatcggtggcaacccacacctcgtcgaaggcctgggcctcctgacagcggcgccagacgtgctcaatcattgttcggccggcgatgattgcca

SEQ ID NO: 1210 - DNA, 26289 bp, Myxococcus xanthus
aggcccgcgttggactgcgccgctgagtcagtgcggatccgtccggatggtgtggccacctgtggcgatggcgccgtgccgaccggagctcaggcgctggccctggggcgtccgttggatttgaactcggcgaccgaggaggagcttgccctgctcccaggcgtcgggcgcgcactggcgcggagcctcgtggaggctcgcgaggagcagggcggtttcaagagctgggatgacgtggatgccgtccgtggtgtgggttccgccaagttgcagaccctccgggcggccacggcgcttggcgcgcctcccgacgccgggcccgtgtggtaagcacgtcgagtgcagatctcgtgccctcagtgctcgatgcagtacgtcctcgactcccgcttgctgccgccggggggcgcctccgttcagtgcacgcgctgtggtcacgtgttcatggccacgccgcatggtgcgccgccgccctcgcgctcgactccggcggtgacgggcggggcggggcccgcgcgctcgagcatgaagtccacgcagctcttcgcggggactcccgctggcgccacggcaggttcgtccgtgacgacgacgcagtcgtacggtgcggtgacgtcgaaggggcagggcgccgacaacgcgacgcaggcgttcggggcggtgtctcccgtagcgcccgttggaacgacacaggccttcggagcagctccggcagcgagcaacccgacgcagacgttcggcgcggcgccgcccgtggcacccgtggggaccacccagactttcggggcagctcccgcggcgagcaacgcaacgcagaccttcggcgcggtgcctcccgttgggtccacgcagacgttcggggcagctccgacgactgggcggagaactgacaacgcgacacaggcgttcggggcggtgcgcccggtagcccccgcgccgcagacgcaggcgttcgggacgatgcctttcaggggaccggcggccgatgctggcgcctcgtcgcagggcggagctcccggagccgggacacagatgttcggcgcggttcctccggtggcacctgtcattccccccgtgggaaggacgcagacctacggcacggtttccggacagcaacacggggcgccagggagtgccggacctggctccgtggcagcaggcaacgcgacccagacctttggtgcgtacgcgcctcctcaggctggcgctttcatgatgccagacctgggttccgtacccacgccgcctcccgtgagcccgattcacgttggcggggcgcaggttgcatcccagggctccgcctcggcggacggcgcccccgttggattcgccgcgcctcccgcgagcgattccgtggccccattggggcgcagccagacgttcagcgccgtgcagccgtctgcctccgaggcacctgtggggtcgaagcggatcgtcggctccgtgccgcccgttcccgcgcccgcgagcctgtccggcgaggcccccacgtcgtcactggatgccgctgagccctccgtgggcgtccgagcgacgagcccctttggcctgtcaccgctgtccggcgccgacagtggcatccagctcccgccagaatcggagcccaccgcgacaccgggcgccggggcaggggggctgagttccctcaatgactccagtgcctcggagttgggccctctggccggagccgcaacacgccgagccccactggagctccctccggacctgattgcgtcgacccgtctgtcgatggacggagcgcgggcgttcgagcgcggcggctcccagcgaatccgtccccgggtggtgctggccagcctggtcggactcatcgtggtggcctcgctgggctacgtcgcgctgaagaatcgcggggtggagatccccgcccatgtggtggaggcgacggaccgtgtatcggtgctgctccgtcgggatgactccaccaaccgtcatcaggccatcgaacggctgcgaaccatcgccgccgagaatcctggctacgtcgacgtccaggccgagctggcggtagcgctcacgctgagtctgtcggatgcccaggcggatgccgagcgtctgcgtctccggggcgctgccatcgcccgggggttggaggccgcggcgaagatgcgcgtccttgccgatcaggtggctcgccgcacctcactccagcaggagcaggacgccaacgcgcgcgaaatggcgtccctgcgtgacaccgtcgacacgcttcgcaaggaactggacgtgcaactggcccagttgagcaaggcgccggagtccgagccgcccagtgccgcgacggctcggctcaaggctcgcgccctccatgcctccgtcctggcggcaccggactccctggccctggccgagcgtctgcgcaacgtggagagcgcaccgtacccgtggagcacgctcgctcgggccgagtacgcgctgatcgccgggtcgccgccggagtcgctcgaggcggtggccagggatttggaggcgctgcgccaggccgacagcacgctgctgcgcgcctacctgctcggcgctcgcgtggcgctgaagctgaaggacacggccgccgcccgttcactcctggacgacgccgtggcgctgaacccggaccaccaggcggcggctcggctgatcgcgcagattgacgcggacgccgcctcgccctgaaacgacgaccgcttccgccgtctcgagggctgaagaaagtccagtccctcacccggtgcagagtcctccgtggcgccactgcgtgtgaattcaagcgcgtggaggaggcacgcctcttgctgaacccggacccgtttcgaggactgggtgctgggaggcagggctgatgtcggaggtcttcttctggtgtgccgtgctgctgctcgcacacacttactttctctaccccttgagcctttttttgctcgaaggggccgcgcaggtgctcaagaacgcccgcgatggacggcgcgcggaaacagtcaatccaggctccggcgggcagcgggcgttgccctcggtgagtctggtggtggcggcctacaacgaggcttcgtgcatccagcagaagctggagaacagcctcgcgctggcgtacccggcggagcggttcgaggtgctcatcggttcggatggttcgtcggacgggacggatgaaatcgtccgcgcttgctccgacgcgcgcgtgcggctgtcaccggcgcctcgggcgggcaagacgacggtgctcaaccgctgcatccccatggcgcagggggacatcgtcgttctttccgacgccaacacgatgatcgaacccgaggccatcgagcggctggtgcgccacttcgaggacccggaggtgggggccgtctgcggcaagctgcggctctacaaccccacgaagcaggactacgaggagagcgcgtactggagctacgagtcgctcatcaagatgtacgaggggcggcgcggcgctgtggtgggcgccaacggtggcctctatgccatccggcgctcgctgttcaccctgctgccgccgtccaccatcgtggacgacttcgtgattccgctgcgcatcctggatcagggctacaaggtcgtctacgaagagcacgccgtggcgcacgaggagaccacggaggattacggcaaggagttcggccgccgggcgcgcatcgccgcgggcaacttccagagcatccgcatggtgcccgggctgttgttgccgaccgcgggcttcccggccttcgccttctggtcgcacaagctgctgcgctggtgcgcgcccgcgctgatggggatggcgctggtggcaaacctgttcctgctggaccggctcttctaccagttcaccctgttcagccaggtgctgttctacgcgctcgcgtacctggggaagacgggggtgctgaagcggggcacggcgaagaaggccgcgtcggtggcgtactacttcgtgaccatgaacctggccatcgtcgtggggttctggcgcttcctgcgcaactcgcagcgcgccgcgtgggaccggacggcgcgcgcgtagtcggaatccaggagcccgttaccggagtgccacggggacgggcttctgggccttggggctcttgggcagcacgctgccgtagcccccgaagagctgcccggtgaggacgggctcgcggttggggcccgggtgccggagcatgtcgttgagcacctcgcccgtcttcggatccctccgaaggtgcgggcgttccaggttcatgcggtagcgcacgacgcctcggcgcacgcggtggatgacggtgaccgtcccgctggcgctgacgttctccacgatgcccacgtgggtgaggccgtcattgcggcgcccgtcgcggttctggtcatacgtctcgttgaagaagacgaggtcgcctggggtcggccgctcttcctggtacacgcggcctcgcgagcgggcgaagcggtacatggcggtgacgccgttgtcgccgggctgcaccgttccccggaaggtgacgccggcctgggcatagacgccttcgatgaggccggtgcagtcggacgggtacttgcggccgttgagtgcgacttgcgtcttgcccaccagcgagcgcgccgtggtcaccaccttggcgcgggcatcactggccacgggggtggggcgcgtggcccgggccggcgtcgcgcgggacttgccacccgacgccttggccgggcgggcggccaccgtgtcgggacgtgccgcgggcgcctcgcggttcgcggtggccacctgcttggaaagggactcgcgcgggaaggcgggcggggaggccgagcggtagcgaagactgtaggagtccagccatggctccagcggcgcgcccgtggtggcgcagccggtcgccagcgtggcgaggattcccatcagcgtgactgtcctcatggtgcgacctccctgtagcgtcctgggggcacatggtccgcccgggaagctgtgtcgtcaaaaaacctacccaggcaaccgtccgtccgcgcttgggtttccgggtgggcgcgggtgcggtattgctccagggacatggcctcctttcgccgagccctcgccgtcctgttgctggccactggctgcatcccctcgccgtatgaccgcgcggcgaagaaggacaccatcgacggctatcgcgccttccttcgtgagtaccccacgcacgcggacaccgacgcggccgaggcgcggctggaggaactggagttcgaggaagcgaagcgactgcacacggtgattgcctacaagcgcttcctggaggcgtaccccgacgcggcccaggcgcgcacggcgaagacgctgctagagggcctgcgcttcaacggggcgaaggagacggataccgtcgccggctggcgccagttcctccaggagcacccggacggcgtccagcgcgacgaggcgaagcgcctgctggcggaggcggaagcacgtgagctggccaccacggaggatccgcgcaagctggcggagtacctgcgcgcgtcgccggatgatccccgccgccaggacgtggaggcccgcctggatgctcaagccttcgcgcaggccaaggcctccggcgcgacgaagctcttcgcgtacctcaaggagcacccggccggcgcgcaccgcgaggaggcgcgcgtcctgctgctgcaactggaggtggaaggcctgctcgtctccggcctggtggacgaggccgaggcccgggtgaaggcccatcccctgggcccgaagctcaccggcttcccggagcggctggctcacgcccgcgccgagcgcgccgccctggcccggccggagccactggcccaagccgcccacgtggggcactacctgcgcggggcggaggacctgagccgcgcgctggtggcgcccgacgcgctggaccgctggcaggccgcggaggagctggggcagcacgtgtcggtgcgcgtgttggatccgctgctggagagcctgcgcgcggcgcgcaacccgctgatccgtcagcatgccctggagtccctgcgcacggtgctggcggcgctgcccaagcccgtggcggagtacgaggtggcctcgcgcctggatgccctgcgcgagcgcgccaccagcgcggagatgtacctcacggtggcggtgctgctggacctgtccggccagttggcccaggcgtccacggagtaccagcgcgccgccgagtcaggcgtgccggatccggtcatcctgcggcgctgggtgcagattcgcgaggagcggcgccagcacttctccgcggcggtggcggcgcggcagctcgcgctgtggtccctggaggtggcgcaggaggagccggtgacgcccgaagggcgtgttcccctggcgtcggcgcggcagctctgcgcggcggccgtcaacgcgaacttcgccgtggcggccattgcccgcgcccggtccgcgagcaccgagttccccgaggacctggcggagttcgagcgcaaggcggcggacgccaagcggctggcggacgcgcggctggcggacgcggagctgctgctgcgtgagcagacgcccggcgtgaagacgtgcgcggaccgcggtgtgcgtgaccgcctggagaacgccgtgaaggagcgcaccgccgcgctggactcggtggcgacgaagctgccgcaggtggggcggctgctcctggaggtggcccgggagcgggatccgtcgccccaggtccgcgcggccgcgtccgcccggctgaccgcgctcaagccggttccctgatccgggtgtcccggtgcgccgggccggttagagtctgcgtccccatggcctcccgcaccgatacgctccaggctccggccgtgacgccctcgctgcggatcgactatgccgcgctcctcaacgaggagcagttgcgcgcggtggaggcgggggaggggcccgtgctggtgattgccggcgcgggctccggcaagacacgcacgctgaccttccgggtggcgcgcatgctggagcgaggtgttccgcccgcgggcatcctcctgctcaccttcaccaacaaggcggcccgggagatgacgcgccgagtggaggagctggccggcgccttcgtggacgtgcggcgcatcctcggcggcaccttccaccatgccgcgcacgtgctgctgcgccagtacgcgggcgtgctgggcttctccacgaacttcaccgtgctggaccgcgaggacgcgcgggacctgatggtgacgtgcatcgccgagcgccggctcaagagcgacaagcgcttcccccggccagacctggtgttggacctggtttccctggcggccaacctccagcaacccgtgtcacacgtgctgatggaccgccggccgcagatgttgccgctggcgcccgaggtgctcgccgccgccgcgcgcttccagcagcgcaaggcgcagatgcacctgatggacttcgatgacctgctggtgcacctcaagcgcctgctgacgcatcacccggacgtgaaggcgcagctcaccgagcgcttccgctgcgtgctcgtggacgagtaccaggacaccaaccggctccagggcgacctggtggatttgttcgccggagagcgcaaggacctcacggtggtgggggacgactgccagtccatctacagcttccggggcgcggacttcaccaacatcatcggcttccccgaacgctacccgggctgctccgtccatgcgctgacgcgcaactaccgctccacgccggaaatcctgcggctggccaacacctccatcgcgctcaacacgaaccagttccccaaggtgttgacggcggcacggtccccgggcgtcaagccgctcatcgttcccgcccgggacgccggggagcaggccgcctacgtggcccagcgcatcggtgagctccgcgaccagggcctgtccctggaggccatggccgtgctgtatcgggcccacaatcactcgctggagctccaactggagttgacccggcgcggcatccctttccgggtgcgctccggcgtccgcttcttcgagcagtcccacatcaaggacgtgctggcccacctccggttggtgaacaacccgggggatgagctggccttcaagcgcgtcatccggcgcgtcccaggcgtgggaccggcgacggccgagcacctctggaccgctctgcgcgcatcgccggaggggacacccctggcggaggggctggcccatgcggacgtccgcgcgcacctgccacgcaaggcgcagaagggattccaggccttcagtgacctgatggggcggctgacccagccggaggcgtccccctcaccagggcgcctcatcgaggacgtcctcgccgggggctacgcggacttcctccgggcggagttctccgaggaggagcaccgggaggacgacgtccgccaactggcggagttcgccggccgcttcgaggacgtggcgcgcttcctgtcggagatcgccctggtgtcggagttcccggcggggcaggcattgaggcagcaggggccggaggcgtgcctgacgctgtccaccgtccatcaggccaaggggcttgagtggcgggccgtcttcgtcctgtggctggccgacgggcggtttccgctgtcattggccacgcgcctgcccgagtaggaggaagaggagcggcggctgttctacgtggccctgacccgggcgcgggacaccctggcgctggtgtacccccagtcggtgctgccccgggacggggagcggatcctcctgcgaccgtcccggttcctccaggaactgcccggcggggaggacgcaccgttcgaccggtgcatcctgtccaccctggaggcggagcccgaggcgtccgtggggcaggatggtccccctccgggtggatcggacccggtggactgacaccgtcgcccagaaacgcgcactcctgtgcgcgacgtgatagacagtggaatcaggggcggcgtcttttggcacgagccccctcacttcatggcggacagacctcgcatcatcgggattgacctcggtaccaccaacacgctggtggcgtccgtccgcaaccgtatcccgaagatcgtccccaccgatcgcggcaatctcacgctgccctccgtcgtggcgctgtcggcgcgcggcgacctgttggtgggtggggtggccaaggaccagatggtcaccaacccgaagaacacgctctggggaaccaagcggctcatcgggcggaagtacaactccaagacggtggaggatctccggggctacttcccctacgacatcgtcgagggcgccaacggggacgccgcggtgatgatgggcggcaagctgtactcgctgccccacgtgtccagcttcgtgctgggccaggtgaagaccatcgcggagcagttcctgggcggccccatcgagggggcggtcatctccgtcccggcctactacaacgacaaccagcgcaacgcggtgaaggaggccggccggctggcgggcttcgacgtgaagcgcatcgtcaacgagcccaccgccgcggcgctggcctacggcttcaaccggggcctggatcagaaggtcctcgtctacgatctgggcggcggcaccttcgacgtgtccgtgctgcacctggccggcaatgtcttcgaagtcctggccaccggcggcgacaccttcctgggtggggcggacttcgacaaccgcatcatggagtacgcgctggagcgcttccgggaggagaccaaggtcgacctcaacacggagaaccccatcgcgctccagcgcatcaagaacgcggcggaggcggcgaagatcgacctcacgctgatccccaacgtcgtcatcgacctgccctacatcgacgagcgcaagggcaagccgatggacatgcgcatccccctgacgcgcgagttcctcaacagcctcaccggcgacctggtggaccgcaccttcgagatctgcgaccgggtgctggcggagaagggcatctcccgcgcggagatcgacgagatcatcttggtgggcggccagagccgcatgccgctggtgcagcagaagatccaggcgcacttcggcaaggcgccgcgcaagggcgtccacccggacgagtgcgtggccctgggcgcggcgctgctgggcgactcgctgggcagcatcgacgcggtgacgctgctggacgcgctgtccatgcccatcggctacgcgatgcccaacgggcgcgtgaagcgcatcatcgagaagaactcgctgattcccatggtgaagagcttccgtctgcctcctcccaaggagccgggctcgcccttcatcgagctggacatctaccagggggacagtgacctgctggtggacaacgaatatctgggcacggttcgcgtgccctcggccgccgccggccggaagatcgacttccgcctcaccgaggagtgtctgctccaggtgacggtggaggaagcgagcggcatgcgcaaggtggacctcgccacccgcgacacgccggagcagctcaagcgggcgctccaggaggtcgcgtcgcgtcactcacagcaggtgcccagctccagcaacagcgggagcgacgaccgggggctcttctccagtatcaagagcatcttccggaggggctaggagtccagatggcgaagttcccgtcgaaggagtgggtggacgaagcggtccgcctcaccaatgaggatcccgagtgcgccatggccggcaagggctggaagggcgacttcggggcggtggtggaagccgagcccggcaagctggcgaaggctttcgtggtgcacgtcgtccccggtgactgccgcatcgagaaggcgcgcgtcctggcggatccagacgacctggacgagctggagccggtgtacctggcccgcgcgccctacagcgtctggaagcagctcctcaaagggacgctggacccggtggaggcggtgctcaagcgccgcatctccatgaagggcgacctgcagccgctgatcgaacgcatgaagtacaagggcatcgccgaccgcgtcttcgcgcagctgcagacgcagttcatcgacgagccctgagcgagagaccccatgggaatcaaggacgacctgaagaagcaggccctcaatgtgtcgggcaaggccatggagaagctcatggccgacgaccgtcgcgcgatggccattgccaacgccattgggaaagcccagcgcggcaagcaggcgctcgaccgggggcaggaggagctgatgaaggcgctgaacttcgcgccccgcagcgagttcaaggccctgggcaagcagctgtccggcctcaagcgccggctgcgcgagctcgatgagaagctcggcgcgctgtagtcgaaaatgcgttgacacctgagcgggcgaatggcatctacacccgcgttcgccgctggcaacaccggcggcgggcagcagaaagcagaagggcgtatagctcagcggtagagcactgccttcacacggcaggggtcgcaggttcaaaccctgctgcgcccactcaagaaaggccgtgagtccgaatcgggactcacggcctttctgctttgcgggctccgcattcaccgtcgcgccagacgcaagaaagcccaccccgcatgctgcgcggagtgggcttggaatcgcggcgtgaggccgcggtgcggctcagaccttgggcgcgtcggcgtcgctggtgggcgcgtgccgggacttgattagcgacgcgacgatgctcgcgcccagcaggccggcgatgaccgacagggacacctcgggcggcatcttcacgaagtcgatgatcgccatcttcgtaccgacgaagacgagcaccgcggagaggcccaccttcaggtagctgaacttctccaccgcgccggccagcatgaagaacatggagcgcaggccgaggatggcgaagatgttggacgtgaagacgatgaaggggtccgtcgtcacggcgaagatggcggggatggagtcgagcgcgaagaggatgtccgacgcctccaccagcaggagcgccatcagcagcggcgtggccagcttgcggccgttctccacggtgaagaagtggtgcccgtcgaagttgggcgtcgaggggatggtccgccgggcaagacgcatcagcgcgccttcctccgggttgtcctccttgttgcgctggaggaagagcttcacgcccgtgatgatgaggaagccgccgaagacgtagatgagccagtggaagcgggccagcatcgccacgcccgcgaaaatcatgatggctcgcagcgccagcgcgctgaggatgccccagaagaggactcggtgctggtacagcgcggggattcgcagcgccgagaagatgacgacgaagacgaagatgttgtcgacggagagcgacttctcgatgaggtagccggtgatgaactggaggccgggctcaggcccgaacttccaccagacacccgcgccgaagacgagcgccaggctgacccacaacgcgctccagcccagggcctccttgaacttcaccacgtgggctttgcggtggaagacgccgagatcgagcgccagcatcgcgatgacgaaggcgataaagccggcccacaggcccgggctgccgacgcttgggaaggtttccatatgggggcgtcagataggagtcatccgagccttccacaaataggaattccagctgcactccatctgaaaaaccgaaggacccgggcaaaatgcgtccgtgctccctctgtggcctggtgggcatacgggcagtcaaaaacatcccagatgtttgggaagtggttttgaaggcgacgggtttggaaccgtcccggttggaaaaatcaaacacggggctatgagaccagccaggcgtcaccgtccctgaggcagctaccccacccgacggaaggacgcgtcgagccaactccaggcgataggcgcctggggactcgtcaccctcatgcctcaagcagtaaggacgctattttgactcggaatcgttttctgtcctcgacgtgtggtgcgctcttcgctctggccgccatcacgggctgcgggaatgaagctggtaacgaggattccaacgcgccagggcggaccgagacccctggccagtctccgcaggtgcctgctccctctccgtccgagcagacgcccggtggccagactcccggcaccccggagcctggggattctgacacttcgccggatgagcctgtcgccaccacgccgcccgacgagccctcgacccatcccgagaacccgtcgaccgagcccgagcagcctgtcgcgtcgggcgcggacaagttcggcgtgacgatgatccacccgtccgccgccggcggtgagcagtggttcctggccgacgacgcgatgtccgacagccgcttcgacccgcaggacgacctcacgcgcaactcggacggctcctggaatctcaagagcgacaaggtgcgcatgaacgtcttcacgtccaccggctacaagccgaaagagatcgccacgtatgaccgtgacgtgctcgccagccgtggctacatgcagtcgccaaacgactggaagaacatcgagatgacgggcttcgtgaagctcaactccgcgtccgatgagtccgacaacttcgacatgtatgcgcgtggcgggaagcacaacgacgaccacgagggctgtgagggcagcagctacaagggcgcgctgcacttcaatggccaggctcgtttccagaaggaggcgtggcacgtctcctacgagcaggcgccgtacaagaaggtgacggagccgctgacgggccgctgggtgggcttcaagacggtgatgcggaacacgcaggtcaacggcaaggaggccgtgcacctggagatgtacctcaacgagaacgccgacaaggtctcctgggagaaggtctacgacttcgtggacgccggtgattggggtggtgacgccgagcactgcggcggcgcggatggcgcgattccgctcacgtggggcggccccatcgccacgttccgttgggacagcaccgacgacgtggacttcaagtggctgtccgtgcgcgaaatcgcgccggagcagtgagccgctgattcctggcgcgtccgctgaacggggcgcgcctgaacacggaagtccgcggtcacacgagggcgtgggggacccgacgaggtcctccgcgcccttcgtgcgtccatggacgggaaggtccacctcccgggcgggtggcgagtgcggcttcggcctccccaccttgcgggcgtcgacgcgccagccagccgccggcagccctgttttgccggggctcggcgctcaggccggcccactggctgtcagagaggaagacttcccatgcacattactttcctgggccacgccgggttcgtcgtggagacggcgggggccattgtcgtcatggacccgtggctgtcgtcccgcggggcattcgactcggcgtggatgcagctgccgtgcaaccaccacctggcgccgcgcgtgcgggagaagctggagacgcccggcaaggcgcgctacctctacgtcagtcacgagcacaaggaccacttcgacccggagttcctggccaccctccgccagagggacttcacggtgctggtgccgcgcttccaccgctccgaactgcaggacgtgttcgccaggtatggctgcaagcaggtcatcgcctgcgaggacggccacgaggtccccatcaagggcggctacgtgaagctgttcgtgtcggagcaggggaccaaccgtgactccgcggtgatggtgcgcggtgacgggcagtgcttcctcaacatcaacgactgcaagctccatgaccggatggggcgcatcgtcgcggaggaggggcccatcgacgtgttctccgcgcagttctccggggccatctggcaccccacctgctacgagtacccggcggagacctatgcggccatctcgctgaagaagcgggagagcaagttcgaggcggtggcgcgcacgctcgaggtgattcagccgcgggcgtacatcgcggcggccgggcccgcggccttcctggacccggcgcagttccacctcaatttcgagaaggtgaacatcttcccgaacgcgacgcagctcttcgcttttctgcggcagcgtctgccccaggggaagacgcgctacctggagccgatgcccggggacgtgctggacgcgaagtcgctggagttcgtctcgcaggtggccgagcgcgtgacgccggagaacatgaaggcgtacttgcacgcctacgcgaagcggcaggagtctgtgttccgcgagcggcggcgaaacctgctcgtcgcggaggtggcggagattcacgagcggctgcgcgtggaactccagcgcaagctggacctcctcgacctgcacgagcgcgtgggcatgccgctctacgtggagctgacggagcttccggaccggctcttgcgcgtggacttcaagtcgcgccgtgtccacgtggtggcggacatccaggaagaggttcgctacacgctgaagacgagcgcggccgacgtggggcgcgtgttggaccgcaagctcacgtgggaggacttcctgctgtcgttccgcctgcgcctgagtcgcaacccggacgtgtacgagccggtgctgcacggcttcctgggtgtggagatcgaggacatgcgcgagttctgcgacggcatccgctccaccgagtcccagcgggagcgaacggtggtggaggccggtggacggcgcttctccatccagcgcttctgcccccaccagggcgccgacctgtccgagggctgggtagagtaggggcgctacctggtgtgcccgcgccaccgttggcagttcgacctggacgccgggggcgtgtgcacgcagaacacgtccacgctctgcgcggagctgctgcccgagcgtgagcaggagaagccccagacgccggcgacggacccgcagcctcagttgtagtgccgtgttccctgggcgccgcgcggttgccgtggcgctcagggggcgacgcaagcgcggagggcccgcacttcagggcggcggcgtggagagctgaagactcagccgaacgttgtccgagcgcaggcccaccggggcatccggcgcgagcgcctcttcgggcacctcgcccgtccacgcgagcgtgtcgtccgcccagacgcggaggaccttgccgtcgaactgggcccgcagcgtgtgaggttcccctgtcgagggcgcttcgagccggacgtgctgctcggggtgcaggagggtgtagccccggtttccgcactcgcggctggtgtgctgccccgggttgcgcttgaaattgacgacgatgcccggcttgggtgccagccgccacatcgcgtacagcacgttgcaggcatccaccgcgaagagcttgaggcccacctgctggcgctgctcccccgaagccagggccacctggcgctcagtggggcctagaagggtgaagcgcagcgccacgtcgctcgtcgtgctttcaggaacgatggcgcgcatgcgcggcccgtcgacgaggagctgctcgccgggtccgggctccaggcttccttcagtaaccttcagtcgggacaatgggacgcgcgtcagcatgggccagcctttcttccggggagcccctgggcgtcgcggctcaccccgttcgttcggagcgagccgtggcgccacatcgccattccagccctcattcgctggactggagtcggcgcccagcagcgaggccaggacgccgcagcccacgagcagccggcgcggtgtcacggcgaccgggcccccaggaaggactgaagcgattccacatgggcacgcaaataggcctgctccgcgcgcaggcgggtgagttccatcatcaggtagccgcggaatcggcgaatctcccgcgtctggagcgcgtccatggactgcagctgcgcttccaggtccgacaccagggtgctcacctcacgcaaccggccctcctcggtgcggtggacggtgcgcagctcggcgaccagctcgttgacccgctggggcacgcccgacacatcatcgagcgtcgcgcgacggcggccctccctcgcccgtgcgttggccgagcccagccacagatggcccagattgtaggacagcgtgagctgcccgaagaggggcaggtcctggtcgacgtcgatgagcttgtcgtacccaccgcgcacgctgacgcgccaggcgcgcgagctgcgcagcgcaccgtgatacgcctcgagctggtcatccgcggctcgcagctcgttcagcacactttccagccgctgaccttcttgaacccgaggccgtgccgccagccgctcgcgagcaatctgggtgttgctcgagagctgacgcagcccatccagccggacctgcaccgcgttcagctcctccagcgtcaccaggccttgcttcatgtcgttgcgaagcgacgtgagcagcgcctcggcgtggggcagcgcctcctccagaacgcgagctcgagcctccagcgcggcctgttcgcccaggccgctcccctggcggatggcggactccagcaccaccatcgcccgttgacggcggcagtccgcctccgcacgcttgtggatggctcgaccgcggtagatgcccacgaggtcgtacatcaaccccgccgtcacacgcggggtgggctcacccaacggcgtggtaccggcgccactgctggcttcgcccgcgttgaccacgccgaaggccccgaacagctcgggcgccagttcgagcgcggcctccgcgctgcccacgccgcggacgaagtcgcagtaaccggcggcccggtcctcgcgggacggtgacgtgagttctcccgcgggaggaggcgccggctgggccagcgccaggcgcgcggcaagtgacagcaatgcgccacaagtgacggtcatccgcatggtcgagtgtctccggctccgaggccgtctccagtcaaagggtggtgggattcacagcagcagcggcggccggcccaggtggagcaggtcttcccgggcggaaggcgcgtccgtcagttggacctccaccatgacgccgcggagcatgtactggcggatggggtgcttgagggacacctcgccctcgagcacgcgcccgatgacgcccacctcatggcaccagaggaccttggccgcgcacgagtacagcggcgtgccctgctcggcgttcgggatgttctcgtacgggacgaatgcgacggtgaggtccctctcgatagccttgaggtacggggacgcacgcagcgacgcaatcagcgtgtcgtagcgcagggccacctcgtccagggcggccaggtccgtctggaggctcttcagcgtcgcctccgcgcgggcctgctccaggacggagtgcgtgtactcgcgctccagcagcagcacgtcggacgtcatgccctggggcgtctcgttcttgcccatcccggattgcaccgccgagaggccggcaatctcccgctggagcgaatccagccgcgtctccaggtccgccgaggactgcgccagtgccaggttgctctgcgccagctgcgccaggtggtggttgatggtgagcttctcctcctgctccatcatgcgcgcgtcgtacagcgcgtcggtgcgcgtgcgcgccagtccggcgaaggcacggttggactggagaatctccgcccgggcgctgctgtactcccggcgcagcaacgccagccgccgtgccacccggtccctggcgtcgcgctcgccgcgcagggcgacgaggaagcgctgctggaacgcgcgctccgcggcgacggtgcgctcggcgtcggagatgcggttctccaccgaacgccggtccgacaacacgtggtcgcgcgcggacgtctgcgcggccacctgcgtattgagcgtgagaatctgcgggtccgtaggcgagatgaccgtgggggtcacccagctgcggctcaccaggaagaagccctggacggacaggaaggacaccagcccgagcatgatgagcgcgagcagcagggaaccgatgaacttgtaggccgatacggcgatgctgttgacgcgattggcgacgcgttggttcatggcgtagtgccctcaccagcatgggtgggaggaaagcggcccccggagtcgaccggggacgtctcgggagcggtgttggcgctgccccgtgtctcccagctccccgagtccagcgtcagcagcgccagcggtgtgaagagcgcgtacgtcaccggcatcagcagggccatgggcaggaagctggcgccgtggacgcgtcggtccgcgggaaggtgccgtgtttcgatgcgatagatgacccccagcaatccgatgaccaggaagtggaaggcgaggatgtcccagaactcgccggtcaggacgttgtgcacgatgaccagcgggtaggagaggagcagcgcgagctgcgacacgtagtggaccgccacgaccgggtggagccgccaggcgtgtgacaggccgcccagcaggtccaccaggttggagcggcgccaccggagctgctgggagaagtacccggccagcgtcgacggcgcggcggtgaagcaaaaggcgtccagcgtgtagaccgtctcgtagtcgtgcttgacgatctgccgcgtgaggaaccggtcctcgccgtacttgatggggatgcccgcgatggcgcgcgcctcgaggatgggctccagctccagcagcacgtggcggcggtacgcggtgaggcagcccgacaggcacatcacctggcggaagctgcgctccaggtccttgagccactcctgggcgaagtggaacttgatttcaatcatccgcgtcatccagttctgatgacggttcgtcacgtaggttcggccgcccaccgcggcgatgcgcgggctgacgaagcggcgcaccagttggcggacggcggccttgtcgacgatgacgtccgagtccaccgacacgatgatttccgcgtccgtggcggccttcaccgcgcggttgatgcccttgcgcttgcccatgttctccgggttgcgcatgacgatgacgttgggatttccctccgccgccttcagcgcccaggcgtagctgtcatccttggagcagtcatccaccaccacgatttgcagcaggtggctgggatagtcctgctccaggagactgcgaacgccgtggtagatgccttcgccttcgttgaacagcgggatgacgatggcgactcgcggcaggtaggtgtcgtcgactctgtcgaacttccgccccttcaggcgccgtagcaatggcccgaggacatagcggttcatcagaaccaccatgaaaagtaactgaattggaaagagctccatccgtccccgccccccatcacgccacgagcagcccttgtcgctgcccctgcaaccgtcacgaccctcaagatgggcgagcgaaaggttggcggggacgacggcgtgtgccaactgcctcggggtcagagatagtggccatcagtggccatgccacgcagaagcacgcaggagcgaacaggtggcggtggtagaaagggggcatgccgacagacttccagcccctcgcgctgcgtccggatgaggtccatgtatggattgtcgagcccgagcgcatcgacgaccggcgcctcctggatgcctactgggcgctgctggacgcgaaggagcgcgacaagcagcagcgcttccgcttcgagcggcaccagcgccagtacctggtgagccatgcgctggtgcggctgacgctgtcgcgctacgcgccggtggcgccggaggcctgggccttcgacaccaacacgtacggccggccggtggtgcggggggagtggggcccgaagctgcgcttcaacctgtcccataccgacggcatggcgctggtggcggtgggctgggacgcggagctgggcgcggacgtggaggacgcgcagcggaagggggagacggtggagatcgccgaccactacttcgccgcctcggaagtggcggcgctgaaggccctgccggcggagcggcaccgggagcgcttcttcgagtactggacgctgaaggagtcctacatcaaggcgcgcggcgcggggctgtcactgccgctggaccagttcgccttccacctggagccgggacaggcgccgcgcatctccttcgacccgcggatgcaagacgtgccggaggcgtggcagttcgttcagctgcgcccgtcggagcggcaccaggcggcagtggcggtgaaccggccccgtgggcagccgctgtcggtgcgttggcagttcacggtgccgctggccggggacacgccgccccggttccaggcggcgtagacggcgggctcagggcgcgcggcccatccaccggttcaggtcctcgctgatgtgcgcgaggagggcgtcccgctgcgacttgatgaagaagtggccgccggggaagaggcggacgcggacgtcctcgctccgcgtctcgtcgcgccagcgctccaggttcgcggtggggacgtgcttgtcctcgggcgagccgacgacggagatggggacctccagcttcgcgggctgggggccgtcctccgtgaaggcgatgccgaagtcggcgcgcagcatgggcagcaccagctccagcagctcgcggtgctggaagatctcctcgggcgtgccgtcatagcgccgcagttgcgcgatgaactccggttcgggcagatggtggatgggctcgcgggtgttgacggacggcggcccggcggcccccaggaacaggcccacggggcgcgggccattgcgagcctggaggcgcctggcgagctccagggagatgcgagcgcccatgctgtagccgaagaaggcgaagggccggtccagcagcggcgcgatggcgggcagcagcgcgtccaccagggcaggcaggctgccaatgggcttctcggacaggcggcgttcgcgcccgggaagctggacggggcacagctccacacccgccggcaggccctggctccactggttgtagatggccacgctgccaccggcgtacggcagacagaacagccgcagcccgtgggtccgtcaacggcttccgggtggggaaccagcggtcgggggcatgagggctcgagttggacgcgctttgcatgacgtgaaggctctgtcgcatggccacggaaaacgggtcaagtcccggaggccgcgtggcgtgttagcgtttcggggacgcgcaggggcgtcgttctggagtcacaatggggcgttccgcgggcttcatactctggctgacaggtctgtcaggtgcgggcaagagcaccttgtcccgtgcactgcgtgcgcacctggcctcgtcgatgcccgtggaggtgctggacggggatgaggtgcgcacctggctgtcccgcgggctgggcttcacccgcgaggaccgcgaggagaacgtgcgccgcatcggtcatgtggcccggctgctggcgaagcacggggtgggcgtcatcgccgcggccatttcgccctatgcgagctcgcgcgccgaggtgcgccggctggccgaggaagcgggcatccccttcgtggaaatctatgtccaggcgcctctggacgtgctcatcgcccgggacgtgaaggggctctacaagaaggcgctggccggcgagctggcgcacttcaccggcgtgtcggacccctatgaggcgcctgacgcgcccgacgtcaccgtccactcggatgtggacaccgtggaggcgggcctgtggcgcgtcttggagacgctgcgaaagcggggcctgctcgacgccgccgcggcggcgtgaagcgcgtccccgaggtggcggaacgtccgcgcacctcgggggaacggaggcgcggactcaagcgaggatgcgctccatcttcacgtaggggcgctcggcctggatgcccttcgtgcggcagtgctccaggaacttgttcgactcgacaatctgcggggccttgtcgtcgtagacgaggatcatcacgtggcgcagccacggctcctggcccatggcgtagacgtagacctccttgggcgacaggtagttggtgatttcgatggcgcgggcgctgtcggagccgttgagccggcgggcctggtccatcttccggggcaggggattgcacagcagcgggccgtacatccagctcatcgggccgccttcgcactccatgccgaggaacagcacgtcgatggtgccgacgatgtcgcgcaggtgctggtacatgcgcggctcgatggcgttggagtccgcggccatcagcatggacttgccgcccaggcgcaccaggtgcgctgtcttggcctggatggccaggtcgctgtgctcgcccaagaagggcaggccggtgatggagccgcccggcacgggaatctcctggaggtcgtcaatctccaccacgttcttgaagccgttgtggtggagcatcagccgcagcgacgggtccgcaagcgagttgccgttgttgcgcgggacgatgatgcagcccacccggtgccgcagctggatgagcgtctccatcatcaggtggtcggcgtggccgtgcgtgaggaccacgtagtcgatgcgctcgggcaggtcggagtgggtgaagcgggggaggtccgtggggaactcgtagctgatgacggggtcggtgaggatgctgacgtccttcgtctccagcagcacgcaggcgtggccgaagtagcgcacgcgcacgccctcaccggtgtagcgctccgtgcggcggggctcgacgtcggtgaagagcgcggcgaaggcgtccgcggcggaggcgggcacgccgagcatctccgcgacctgtccgggggagcccggcgtgtggcgcatgcggaagagggcgtccaggccttcgtgcttgtaggggacgcgcagccacaggggcgtgtcctcctccaggcggggcgtgctgaagatgtagggccgccagtcgccgtccacctgcatgagcgtcacgctctgcgaggactccttgtggaaggggctgcggtacaggagcggctcgatgtaccgcgcgctggcgcggttgctcaggtcgtacgtgagctccacgtagccgcggaggatgtcgggcaccttggcgtagaggccctccagggagccgccgttgttgggcgccatgagctgctccagctcggccaccgccttggtgtacgcgagcatgttggcctgctccttctgcgtccgctccaggagctccttcacgcgcgaggccttcgccgccgggtggttgatgaacgggccgcccatcagcatcgggttcttcagggccgccacgtgcacgtccgggttcgccacgaaggactgcatcagcttctggtgcaggttcgtcacgaacagcggggccgtcgccggagacagcaggtaccaccacgcgtaccattgattgtagagcggctcgatggcgacgttcggcttgaggtacatggggcggtccagcatggcggtctcctccgagcgaggtccggaaaacgtcgggtaattggcaaacgtggagcccgtagatacacggattcgaagggtgatgcacggggccaacacggcgcatcttttgcgctagctcaaccgtgcgagcattcgggcgtatccctttcatcgtgcaacccgagcgaggagcgtcccatgaaggcagcttggaatgttgtgctgtccctggtggtgggagtggccgtgggctgtggcgttggcgccatggattcggagggcgcgcaggatgaggcgctcgccacgtcggaagcctcgctcgcgatctgtggagacggtgtctgcgaaatcggcgaacggctgagttgtcccctggattgcccacgtggcgagttctgtggaaacggcgcgtgctgccctggggagacggcccggacctgtcccgaggattgcacgcagggtgacccagggcgttactgttaccggacgcattgagtccctgacgggtcctccacggacgtgcgagcaacgggtttccgttgcccgcgcgccgttccgccgtgtcaggtcgtgcggggcgttttcgctacatcgcgaagcagccgtagaccttctcgtagtaggaggtcttcgtgccgttgaggaccgtctccggcgtgctgcagccgcagaggagctcaccgaccttggtgaccttcgcgggctccgcgtagtacgtgatgacgtagtcccggccggtgatgtcacgacaggggatcgcctgggcctccgtttcgagcccggcggcggcctcctcttcgatgccgccacagcccgtcatcagccctactgccagcagtcccaccatgatgcccgtacgcatgaattctccttttgtgagaaggtgatgcgttctcaggatagccagagaacgcgtcaatggcacctgggggctgcggactgtcgggatgcgaacgggcccattcggtctgtcggcgaggcgcccgcgcgggaagagcgccgctccgtggcggatgcccttcattgtgaggtcctcgggctatgtctggatggtgttcatgacattgatgggcgatgggagattgaagagcactgtctccggcacgtgattgctgtctgggttcagcgccaggtagcgggcaatgtctcgggcctgccgcatttggattgcgtcgccgacggcgcggatgtcctggaagagttttccaccaccgcgcgcagcttgctgtcattgaacaggtatgagtcctggaggacgtcgagcgcggatgttcatgtcgcgcaagtccggatagttcctcgtctgcgaaggcatgcaggcgatgacgtcggcgggactccatttgctggatggttttcccgcgggcggggcgtacatgcgcgtggaggcgttgggggcgaacgccgcatggttgtacgcctcctcatttacgaccgtgtgctggacggagaactgccacacgaacatggtcatgagctccgtcaactgcggcctcgtcttcacgctcgtggggaagcgctgcgcgcgcgacgccgtcgaggtagttgaatgcgggaatgagcttgtcgaagaagcgttggagttgcccccggcgtgtctctccgcctcacaggaagctgcgcagtaatctctcgaactcactgtctcgctcgcgttgacaggttccggggcccgtgattgctcggcgcctgtgacagatggttgagggggctggcttcggccagtagtcctcctgggctggcggatgtcactgtcaaaatgcgccaaccgcctccctgcctgatgggcagcaattcggcgattgtcaaccatgcattgcgattgcactgggagatgggttgcgtcacggtggaagcccttatcaacccgggcgcagagagtgactgaggtgctcaggcaaaatctggggtggttactttggagaaatgcgctgtaacagttccacggcagttgcctgtgggagcggttccacttgctctacagagtacccactccgcttgcgagaaaagatcgcgctcgcagcctg

SEQ ID NO: 1211 - DNA, 24791 bp, Myxococcus xanthus
ggccctggagcgcctggccgcgcgtgacgccggcacgctgccttcagggactcccctacgccccacggacgaggaagtcgccgcacacgcggaggaagtgcgtcagcaggcccgggtggagaaggctcgcctggagtccttctttgatttctgctgcttcgactccagcttcgtcgagctgcgccgccgcacccgccacgacttggaggtaacgggcaacgcgtactgggaggtgctgcgcgacggcaagggcgacatcgcccgcttcgtctacgtcccctcctacaccgtgcgcctcctccctttggacaaggaggccgtcgaggtgcgcgagcgcgtgcgcatctccgccgtcagcttcgacaccgtcacaacccgtcggcgcctgcgccgctacatccaggtgcagggcaacgagcgggtgtacttcaagtccttcggggactcgcgcgtcatctcccgcctcaccggccgcgcattccaggacgtcgccgccctcaaggccgcggactcctcggacggccccgccacggaactcatccacttcgccatccactcgccgcgctccccctacggcattcctcgctgggtgggcactctgctgtccgtcctcggctcccggcagatggaggaggtcaactacctctacttcaacaacaagtccgtccctcccctggcgctgctcgtctccggaggaaggctctccgacgcttcggtgccgcgcatcgagcgcttcatcgaggagaacatcaagggcaaggccaacttccacaagattctcatcctcgaggccgacggcaccggcaccggcgacggaggccgcgcgaagattgagctgcgccccctgacggacgcccagcagcaggacgccctcttccaggcctatgacgcgcgcaacatcgacaaggtgggcagcgccttccgcctgccgccactgctgcgcggcgacggtcgggacttcaaccgctcggtggcggaggcgcagctgcggttcgccgaggaccaggtgttccagcccgagcgcgacgagttcgacttcttgctgaatcggaaggtgctcgccgacatgggcgtgcgcttctggcgcttccgcagccagacgacggccaccagagacccggagcgcatgacggagatggtggagcgtctggtgcgcgtgggtgtgctgacacccgaggagggccgccagttggccggcgacatcttccaccgggagttccggaagattggggacgactgggtccgacgccccctcacactcactttggcgggcatccaaaccggagtcgaagatttgaagccccggaaggacaaggactcgctgctgagcgaggccaagcgactcgtgggcctgcgtgaagagcttcgggccgaggaggagcgcctggcccaagggcgcctggcgctggcccgcaggtacatggacaccgagcacgtccccgtcccccgcgaggagttcgacacctggttctcggcgagggagtcatgacgcccgagcagctccagcgcgcgtgggtgctccaggcccaggccgatgccgagcgaggtgtcctagagtgccgcatgtgccgaaggcgcggtcccctggaggagacgacgacgctgtggcgcaacggcctccttgtcttcgcgctgtgtgacaggtgcgcggccagccacgacgtcgtcttctcccccactcaggcaggagtcgaagtgcgcgccaggcgccgcagtcccgtggatctggcgacgcaggaggtgccccgtgtgcacggcccccgctgacagcctcctcctcatgcacgaggcgcgggcggtggcggatgccctgctgggggacgtcctgcggctgccggtggccaaggccctggacgttggcaccgccgcgggcatggaccgcgctgtagccctgcttgccgcgcgcctccgtcgcgccgtcgggcgcgcggacgtggacgccatgcgagaggcagtggctgtcctcgacgtggactggaggacgacgacagcagcccaacgcaggcgcctcgtcgcccaggccctggaggcggccggccggcagacagccgtcattcccgcccgcatccaggcgcccctcggcgacgcggccgaggaggtggtggcgtccacccgcagccacgcccggcgcgagcagggcctcgccctcgccgcccgcttcaacgccgtcgacaggcgcgtggcccagcacatcgtccgcacccagggaaacttcgtccgggacgagtacgggcgccggctggacgccttcggcgaggaggtccggcgtctcgtggccgagggactggaggccggcctcggaagaagcgacatcgccgagtccttggagagggccgcgcgcggcgccctcatcgagcgggcccccttctactgggaggtggtggcaagccacttcatcggccaggggcgctccttcgcccaggtgagcagctacgccgaggccggcatccgccgctaccgcattgaagccgtcctcgacgaggccaccacccaggtgtgccgattcctccatgggcggacattcgcagtggccgatgccctccagcgcttcgagcgcgtcgagtcgctcgagcggccggaggacgtgaagcaggagctgccctgggtgagggagcgcctcgacgcggacaccgggcgtgccctcctctacgtcaaccgaggtggccaggaaacgcgcctggccgaggtgctccgctccgccgccagcacacgcgacgacgtcggcgagttccgcgcgctcgcttcggacaggcagctcgcggacgcgggcgtgggcttccctccattccacggcctctgccgcacgacgacgctcgccgtcacttagtgatgtccccgatttcgcgccgcaggcctttgtctctttcggagacgaaacgccatgcaggccacctggacaccgacccccacctcacctccgacgccggagggaaacaagacgacgcaggagtcgacctccatggccaaggccgaggcgacgcccgtcgtctggccccgcgacctcaatctccccacctccggggagctgacgtggggcttcgacccggagggcctctgcgatgggtgacaccctcgccaaggccctcgctcgggcccgccacgtcctgaagtccctccagggcgagccggtggagaaaaccatctggggcagccccgcaggcaagaagcgcctggcgaagcgcctggtggccatgctgcccgcgcacaagacgtatgtggagcccttcgccggcagcgccgccgtcctcttcgagaaggctgcctcggacgtcgaagccatcaacgacgccgacaccgcaatcgccgacgcctaccggctcatccagaagctgacgcccgcgggcatggccaagctgaagaagctgccgtgggtgggcgacgagaagacgttcaagagcctcttcgacgcgaagccgaagggcgacgtggagcgcctgcaccgattcctctacctgacgcacttctcctacgggaagctgcgcggtcgcagcttcagccccaacggcatgggcgtcgaggcgaagacgctcgctcgcattgagcagttcgctccgcgcctcaagcgcgtgaaggtgtacagcggcgactacgagaaggtggtccgcaagtacgacgggaaggacaccgtcttcttcctggaccctccctaccccggctacaacgtcgacgtcggcgagggcgacttcgacgaggagcgcttctatggcgtcctcaagtcactgaagggccgctggctcatgacgtatggcatccgggggaagttgcctgggatgctgaagggctccggattcctcgtgaagcgcatccggacgcctcgcaccatcgccgccatgcgcggcgtgggcggctcctccgtgctgacgcagctgctcgtctccaactaccagcccgccgcgaaggcactggagggcggcagcgacttcgccgtggacgactggcagccggaggagtcgcccgacaccgcctccttcctcgcgacgatgccgctcctcaagggcgtcgagcctgacgacgagaggtacgtcctgggcatcgtcctggagccggagacggtggacgcgcagggcgacgtctactccgccgcggagattcgccaggccgcgcaccgcttcatggcggaattcggcggcctgggcctcatgcaccagatgcgcgtcaacgggcacgtgaaggtgctggagagctacctggcccccgtcgacttcaacctgggcgaagtgccggtgcgcaagggcacctggcttctcgccgtgcgcgtcctctccgacgagctctggggccgggtgaaggacggccagctgacgggcttcagcattggcggcaccgctcgccgcctccccgaggcctcgccgaccaccgagccgcccccttccgacacacctgccgctgactcccagccggaggccgcatgacgagcacaacccaaggccccgcgtccgtccaccgcctcgtcgacatggtggtggaggaggtgtccctcgtggacagggccgccaacaagcaccgcttcctcctcgtgaagagagacgacatgcacgacgctccccaggactccgcgcaggccgaggacacctccaaggccgaggacgcgctcctcgccgctgcccagaaggcccttgaagcagtgacggccctcgtcgaggcattggcttccacggacggcatcgacggcgtgcgcgtggttgaggtggcccagcacctgcgcgcgctggccgacgcgttggaggacgaggacgaagacgaagaggacgtcgaggcgcgagagaagactgccagctccgagccccctcccgcccagccggctccgcccgcgcccacgccaggcgccgacgcctcgggccttcaggagagcctcaccaagctcaccgacgccgttcgcgcgctggagggctccgtgaaggagcagcaccagcgcctgggccgcgtcgagaagcagttcggcctgcccaacagcagcgcccccgcggagcgcccgcccaagcccaccgtcgaggacgttggctggccgctcgacctcaacaaaccgctcaaccgggagagcgtcgacaaggccctctccttccacgacgtctgacgtcccacccgccgccaggaagcctcaacgcccaaggaatccccatgagtcgtctcgacaacagcaccctcttggccaaggcggacctggccctcgccgacctcacggccggcggcggcatcctccagcccgcccaggcccagaagttcatgcgcctcctcatcaagcaaagcgtcttgctgcagcagtgcaccgtcgtccccatggcggcgcccaagcagcagttcagcaaactgaagttcggcagccgcatcctccgccccggccaggaggccaccgccgtccccgccgcccagcgcgtgaagccggacctctcccaggtggagctggacgccaagctcttcaagggcgaggtgcgcctctccgacgaggtgctggaggactccatcgagcgcggcgagctgcgccagacgctcatggagatgatggcggacgccatcagccgcgacatggaggaaatcctcgtcaacggggacacggcctccgccgaccctttcctcgccacgatggatggcgtgctcaagcaggccaccagcaacgtcgtggacgcggccggcgcccccatctccaaggacgtccttggagacttgctcaagtcgctgccctcggagcacctgcgcgacaagagcagcatggggttcctcttaccagcgtcgacgcggacctggactaccgcagcacgctggcggagagggccacggctgtcggcgacaagttcctcgagggcgacgcgcctgtcctctactcgggcgtcccgctgcggccgattcctctctggccggagaacctcggcgcgacgaatgaccgcacggccatcctcctgtgcaaccccaagaatatccacgtcggcatctggcggcagattcggctcgagtcggcgcgcgacatctccgagggcacgctgaaggtggtggccacgctgcgcttcgacgcgaagttcgcggaggagccgggcacggccaaggccatcaacgtgcagctgtgaggccctccatggacaacacctatctcgtccgactcaaggcatacgacgcgcgccggggccacgtgctgcggcgctacacgtatgccggcatcaagtttcaagaggagcgcggctggtaccgggtggagaagccggtggcggactacctgcgcaccgtgcaccaactgcccggtgacacctactcgccgctcgccttcgacgtgtcctcggaggccgaggcgaaggccctcgacgcggccgaggccgacgaggcccgcgtgaagcgcagcgccagcgacgagctgaagctgagtgcggcgcggcctgtcggcacactgacgacggaggacttgccgaaggccagcgaggagaaggactcgcgccgcggcaagcgggagaaggactgacgtgtacgccacggtggccgacatgcgcgccgagggcgtcacaccggccatggcgggcgacacccgcctggccgtcctcctcgatgaggccacgcgcaccatcgacaaagtgacggggtggtacttcgagccgcgctcggcgacgttgcacctcgacgggcgcggcaccccgtccctctggctgccggtgccacccattcgcctctaccgcctggcgctgtacggggcggacgtgtccttctccaaggagcacctggtggtggtgggtgctccggtgggccctggcttcgacgggccccgcctcaccttccggcatggccgtgtcttcccgcgcggcgagggtaacgtcacggtgggcgcgcgctggggctacaccgaggcggacggaacgcccgaggggcgcacgccggccgccgtccgccgcgcctgcatgctccttgtcctgcgcagcctctcgccgctggcggacgaagcctccctggaggagcgcacgcgctggcgcgtggtggaggagaggacgcgcgagcagagctaccgcctcgacactgtccgccccgcggtgcggcctctcaccggagagccggaggtggacaccctcctcgccccctacgtgaagccctccttgcccggagcggcctgatgaggggcaggctcatcttccccttcctcgcggagctgcaccgtttggacaccgccgccatggcgggccccggcccgggcccccatgccagcgggtacgacgcggacttccacgagccggtgctggtggacgcggacgacgacggcctggccgaagccttccgacgcgaatttccgccggtgcgtgtcccctgccaggtggagccggatgcctttgagtctttgcgcatgactccttccggcaacagcccccggacgagcttcgaactcgtcttccacttccgcgacttggagcgccttggcctcgtcgacgcggccacgggcgacgccctcatccgccccagcgacaggctgggggccctctacgacgtcgcgggcgccctcgtgcaggccgtgaggacgccccccgggctgtacgtcacggaggcgcgccccacgggcttcggactccaccgccggaggcccagccgaaacctccttctcgtcaccttcaacgacaggccccaggcccgaggactcgcatgaaagcactcctactcaccccacttctcgctgctgccctcctcacccgctgccgcgcgccggacgggtgcgcgccggtgtccacccggtgcgctggcaacgtcgcgcaaatctgcaacggcgacggcaactggcagcctctggccgactgcgacgctgtcagcgagcacagcggcgccgccttcacctgcgcctacgtcaatgaggagggcgtcgccggtcacacctgcctgcccaccaccgtggacgccggcaccgtggacgccggcaccgaggaaggcggtgtcctgtgaagggctacctccagtcccttcccggcgtaggcggcctcttccagcgcgacatccagcccgcggaggtgtgggccttctggaagtacatgcaggagcgcctgcgcaccaagacggccaacaaggccgactccctcgaaatgcaactggcggccgaggcgctgcagcgcatgggcatcctcgacaggcagcgcttcctggagaagtacgccaccaccgtgggccgcaccctctacgtgcccttcgaggtgggcgtgccgaaggggggctgggacttgtgggcccaggtggtggtgtgcgtccacgagcaccagcacgtcgtccagcatgacgaggagggccccagctacgagctggcctacctcaccagctccgccgcgcgcgcccgctacgaggccgaggcctacacctgcaacctggagctgcactactggcgctacggcaccctgcccgccgtgcggcccatggccgagggactcaagcactacggctgccagccggaggacgtggaagtcgccgcgcacaccctggcgctcacctcggtgtccgtccgccacggcgcggtggtgagtgaggccacccacgtggccctcgagtggctcaactcgcacgtcccccacctgcgggcgaagaagggctgaggcccccatggccgtctcacgcaccggagactgggcccgggcccgccaactgctagaggcgggctcgtcacgccttgagggggcgatgcaggcggccctgcgtcaggaggcgcacgccctgcgcaaggaggtggtgcagggcctcacgcagcaggcgcctggtggcgagccccttcgcccgccttcgcccctcacgctggcggcgcgccagctcgcgggcttcagcgggacgaaggccctcctcgtctccggcgcgctgcgcaactccatctccgtcgtcgtggaaggcgacgaggccttcatcggcgtgtcccgcacggcgaaaggccccgacggtgaggcactcgtcgacgtggcgcagctccaggagtacggggggccgcccgtcgtcattccgatgacgccgaagatgcggcgcttcctcttcgcgctgctgcgccaggccggcctggccggccagtcgcgcaatggcggcggcgggcgcggcgtcattgtgacgcagacgcccgcgcggcccttcctgcggccggccttcgcgcggtttcgccagggcgccagccgccgcttcctcgcgcgcgtcgcgaaggagctgggcctcggagggccggggtaatggccatccccactctcacctccgtgacgccctcctcggggcccaccagcggcggagacattctccggctcgccggcacgggcttcgccgcgcgggtggccgtgagcctgggcggactgcgtgcggaggtgctctccgtgcgccagcagtcgggcacctcgcatgtcgacgtccggacgccgccacacgcggtggccctcgtcgacgtggagctgctcaacctctccgcggacgggcgtcccattccaggagaggccgctctccttccgggcgcgtaccgctacctgcgcccgcgcgtcgcgaaggaagcggacctcacccgcctcgtgcgcaccctgctgcgcgagttgaagcggcaggtggtggccaacgtcagcgccagcgtctccgtcgactacgacgatacggtggcagacggcctcaacgtcatcgccatggcctcgctgccctccgtggtgctgtcaggccccacgctgcgcgagagtcgtcgctactccaccaacgtcttgcacgaggacgtcgtgcagggcccctccggctcggagctggtgcgcaggcgccccacgtacacggtggatttggccttcaccctcacggtggcctccgagcgcaccgccgagctcttcaacctcatggccgccgtggccaccttcctcaaccgcaatcgttggctgtccatggcccgggacgccgaggacgcctcgcgcggcaccgtgcgctgggagatggatgcggacggcgaggtacgcacgcagctcggcagccgcgacgacgtgcgcgccttcacctgggggcttctcgtgcgcggcttcgacgtggacgagggcctgcccctcgacatcggcaaggccgtcgccggcactcacctcgaaacggactctctctccggaggcacctcatgagcgtcaccctcaccaatgccctgggcaggctcgtcaccttcctcctgccccatgagtcgtactgcgtggcgcgcggcgcgtgtgcctgcggcgtgcagcctggccgtggcggccggcgcctgccctcctccctcaccctggccacgggcgtgtcgcgggaggacgtccacgaggccgcgctctctgtgcccgctgtggcggctgccattcgccggggcgagctcgcgctgaagcggcaagccccctccaccccgccgtcctctccatccctcctccccgcgtcggaagcgtccgcgcgcgtgtcccggaagaagcgaggtgcctcgtgagtcgtgcgctgctgtcgtcgaaaatcgtggttgaggaggaggagccgcgcgtccgcggcattccctccgcgcccacctccgtggcgggtgccgtgggcctggcggagcgcggccccatcggccaggccgtgctgtgcacttccttcgaggagtaccaggccaccttcggaggcttcaccccggactcggacctcgccctcgccgccatgggcttcttcgagcagggcggcagccacctctgggcggtgcgcaccgtccactacgaggacgtctccaaccccgagtcgcacacggccacgcgtgcggcggcggccctcaccacgggcggcgggcccacgcccgctgtcgtgcgtggcaccctgcggccccccttcaccctggccgacggccagcgcctggaggtgtccgtcaacggcgccgaagcggtggacgtcatcttctccggcgcagcggcttccgtctctgcggggcgccctgggccctatgccctcaccgccggccaggcgctccgcgtgcgcgtcgacgccgggcgggacgtcttcatcccattcctcgaggagtccttcggcgacatcgcccaggccaccgcccaggaggtcgccgccgtcctcaacgccggactcgttgggggtcgcgccctcgttgaggacggtgtgctgagaatcgccagcgacacccaaggcgccgccagccgcctggaggtggacgacgaggtggctggcgacgtcttcggcttccccggcggcccgcaggtgggcagcggcaacgtccagagtctgcgcgccgtcgagttggcggaggtgcgtgctctcgtcgaggcagcggtggcgggcgtccgcgtggcaccctcttctcttgggacgctgcaggtgcgcacccagtccacgggccctggcgcgtccttgcgtgtacagggagacgcgggccccggcctcggactggacgcgctgctgcacacgggcgacgcatccggtgccatcgacgtcctccatctggaggccaaggatgcgggcgcttacgccaaccgcatcgaggtggaggtgcgccccgcgacggctggcgcgcccgacacctttgacgtcctcgtccttgaggacggcgcctaccgcgagtccttccccaacctctcctcggccgaggacgacgcgcgctacgccgagcgcgtcctcaatgacgagcgcaccgggagcagctacgtccgggccttcatggtgcaacccggcgccctccctgacgagcagacggtggcactcacaggcggcaccgacggcctcgtcggcctcaacgacacggacttcatcggctcggaggccggcgggagcggtcttttacgcgctcgacgaagtgcaggacctcacgcttctcctggtccccggccgggccacgccagccgtgcacaacgccatggtgcgctactgcgaggtggcgagaaacggattggtgttcgccattctcgactcgcccgcgggctacagggcggcggacatggtttcctacgtctcgcaggaggcggctctcgaaggcctctctgagcacgcggccctctactggccccgcgtgaaggtgctcaaccccgcccgcggcgtcttcggcaacgtggagcagctcgtcgtcccgccctctggaatcatcgccggcgtcttcgcgcgcaacgacgccgcgcgccccggcggtgtgtatgaggctcccgcgggcatcgaagccgggcgcatgttcggtgtcctcggcttcgagtccaaggagtgcctcgacgagaagaagcgggacatcgtctacccccgccgcatcaacccgctcaccacggggcccggcctgccgcgcttcattgacggcagccgcacgctgaaggcgggcggcaacttcccctacgtcgccgagcgccggggcgtgtccttcatcgagcgcagtctcaagtcgggcctgcaattcgcccggcaccgcaacaacacggaagggctgcgcgcccaggtgcggcgctccatcgccaccttcctcctcgcgcagatgaagaacggggccttccgcagccaggagcccgccaaggcctacttcgtcgacgtctcggacgccctcaacccgccgtccgtcgtcttcgccggaaagctggtggcgcgcatcgggctcgccaccaacaaaccggccgaattcatcgtcctgcgcatcgcccaggacacccgcgccctcgaagccgagctggcttcggcgggcctgtgaggagcaccccatggccatcatcggacagccgcgcagcttccataagcgtttcaagttcctctgtgaggctgacggcctcgggcactcaggttttcaaaaatgctccgagctgtccgtcgaggtcgccaacgtccaatacttcgagggcggcagcctcatccccaacaagtcgccggggcgcctcaccttctccgacgtcaccctggagagaggcgccacgcaggaccaccagctcttcgactggttccaggacgtcgtccacaccaccagcggcctgggcctgccagacagcctctacaagcgcaacctcgacatcgtccagcaagacagagacggcaccacgctgcgtcggtggagcctctcccgcgcctggccggtgaagttcgtcgcgggcgagtgggacaacgagtccgatgaaaatgtcatcgaaagcgtcaccctcacctacgattccttcgagctggccaagtaggactcagccagcgacgtagcacccgtgggccttgcacgcgggtgggcggttcccattcagaggcagcgccacatccgcccgcgaattcaacaagcctcagcgggcacggagacgatatccacaactgtcaacgtgcgccgtgtttcgtcccactcgcagatgatgtccagcggccctggggccaaccgaagccgagtggcggtggtgcctcctgacgagcgctgcacgcgtccttccctcgcaaggagggcgacggcctcctgcacgacaacgaatgtgccttgcggcatgcgccccacctgcccccatgcctgagggctgaacaccactcggcatgagagtttcgaggtatggggcatggcggttgcacttcattagccacgaggcggaccatcggctcaactttccaccgttattgagctactgaaggtgtcctctgtgtggccaagccaacacgcgcaggcaccaccgtcgtcaaatgaaacgcgcttgaggatgtccccgatttgtcgcccgaggcctttgtccttcccggaggaaggacatggcggacatcatctcatgcccctcggggctgacgggccgcattcgcggcatgcgagtgcgggaggagcgcgtcctcgcggataggaagctggcgaagagcggcggccaggtggatgagctgctctccgcgtgctgggaggagatgcaggaggcaggcccctacgccttcgccgacggaaaggtggattggggccaagtgcttcagggggaccgcttctacgcgctcctccaggtgcgcgtcctcacttacggccccgagtacgccttcgccgtcccctgtcagagtgcagcctgccgagcccgcatcgactgggagctggacctgacgcagttgccggtgcgcgtcctctcggacgccagccgcgcctccttcgtcgccggcaaccgcttcgagacgacgctgccggacgccggcacgcgcgtgcgcttcaagctgctgacgggtgaggacgagcggcgcctgcctcagctccagcgcgcggcccccgagaagctgctgtcctccgtcctcgcctaccggatactggacgtcgacggagtggatgcgcgcgacaagcgccgcttcctcgaggacctctcgctgcgcgacgccgacttcctcgtcgacgagtttgacgccgtcgactgcggcgtggacaccaccctcgaagtcgagtgcgcccagtgcttcatgcgacaggaggtggagctccctttcgaccggggcttcttccttccggggactcagcggacggcgaggcgtcgggagcgcaccacctcttcccgcgagtgacgctagagacgtggcgcgagggcctcttccaactgtgctggcaccagcacggaggcagcggcctcgcagctcccctcggtgacgcgctggagctgcccacctcggacagggactggctcctggagcgcatgggccagcagcgcgcccaggaggccaaggcgctggagaaggccgcgaagcggaggtagcgcatgctcaacaacctcggcctgggcttcgtcttcacggcgcgggacttggcctctggcacctttcagggcgtggagcgcaacttcatgagcctcgacaggcgcgtggggttgggcacggcgcgcattgagggcgccttcgagcggctcggcgtcgccatggccctcttctcggcgggcgccgtcacccttggcgcgtcgctgtccctggccaacaccgccggtcaattcgagcaggccgtggcgggcgtgggtgccgtctctggcgcctcggccgaggtcctcgggcagctccgtgacgcggccatcaaggcaagcctcgccacgcaattcacccccaccgagtccgtgctgggccttcgcgaactcacccaggccggcttcaccgccgctgagtccatggatttgctgctgccggtgctggacctggcgggtggctcgttgggagagctgacgccccagggcgcagcgggcctcgcgtcgcaagcgatgaaggccttcggcatctccaccgacaaggccgccatctccgtcgaccagatgctccaagccgtcaacgtcttcgccctcagcgcgaatgagctgcccctcgccctcggcaccgccgcgcgtggtgcacaggccctcaatcaatccctgcccgagacactcatcgcattggggttggtgaagaatgtcgtccccggcgtggagagagcatccaccgccgtggccgtggccatggagcgcatggcggacccgcaagtgcaagagcacctgcgcggcctgggcgttgccgtcaccgactccaaaggcaacttcctctccttcctcggcatcctcgacgagctggcaccggccctcgaacgcatgacggcggcgcagcgctccgccttcctgctgaaggccttcggccgcgaggcgctcggcggcgtgaatgccatcctcacgcagttcaccaacggaatccgcaaggacaccggagagattgtccgcggcgcagatgccctcaagcacctgcgcgatgagttcgagaacgcgggcggcacggccacgaagttccgtgagcagatgctggacacgtttcagggccagaagacgctgctcgccggcaacctggagacgctcgccatcgtcctcggagagcccttcggccaggtgctgaaacccttcgtcaccctcgtcgccagcgcggtgcagcaggtgctgggtgtcttccagtccctgcccggtccggtgaagcgagccttcgcagccttcgcgctcggagctggcggactgcttactctcgtcggcgctgtcatctccgcgaaggtgggcctggcgctgctggtggtgggcctcaaggtgctgggcctcacgctgggcagcctcctggccacggtgctgccagcggtagccgctgtcgtcctgctgggcgtcgccgtagccggcctcgcctacgccttccgtcacaacctcggggggctgggagacttcgtccggcgtgtgcaggagcaggtgacgctcgccttccgcggcctcgtccagctcttcgaggacggaggcttctccggcgcggtgcgggaggagctgggccgggccgagaattccgggctgaaggacttcctcatcaacctctacctgtgggcacaccgcgtccacagcttcttctccggcctggccgacggcttctcctccggactcgaagccgcgcgccccaccctcgacgccttccaggcgacgctagggcgggtgggcgaagcgctgggcttcctctccgagagggacgacgcggccaccgccgccgcgaagttcgccgctttcggcgacgcgggggccacggtgggccgcgccctcgcccgcgtcttcgacttcgtcgtcaggggcctgacggccgccgcggaagtggtggagggcctggcggggcagtggggctacatgaaggccggcgtcgacgtcctcctgggcagcctggcgcacctgggccgcgtcctcgccggggccctctcgggcctcttgggcaccaactccgccttgcagcagggcagcagtgggtgggcgctcatgggacaagccattgggtttgccatcggcaacatcaccaccgtcgtgggcgtgctggtgtccgccgtctccctcgcagtgtccgtggtgggaggcatcctcaacgcggccctggcggccttctccggcatcgtcgacgtcttctggggcgtggtgttgacgctcagtggcatcctcaccggcgactgggccgaggcgtggacggggatgaagctcgtcgtcttcggcgtggtggacgccatctccggcgtcctcctggaattggtgggcgccatcctcggcgtcgtggacgccgtggcgagcctcttcggcacggacaccggcctccagcaggccctgcggtcagctcggctgggcctccatcgggacttgtccgtcgccttcggcctcgaggacgccaccggcagcgccgccacacctgtgactgccgtctccgcggcctcgcccacctcgccggtggactggccactggagtcctcgtccatgccggcggtggcggccctccaggcctcgctgccccagtccgaggtgctctcctcgcagcctgcctcgactcctgccgcgcccgtcctcgtcagcttgcaggtggacggcgaggtgctggcccaggccacggcgcgcgccgagagggacgccgcctcccgcagcttctcccccatgccggcgtactgaaaggcgggattccacgtgtccatcgctgccggcctcgcccgtcctcctcgctgcgtgctggtgaatgtcctcaccggcgaggccatggagtgcctcttcaaccccacgcagttggtggagaagctccaggtgaattggaaccgcctcgcggtgcccggcctctctcaccaggtgctccagtttcagggcacctccaatcggcagctcgcgggcgtggagttctacctcgacgccttcttcgccacgcagcaggccgacgcctccaacatcatggcgttccgcggcttcctgcgcgcgctcaccgtgcccccggcgggcaccgagggtgtgctggcaacggcaccaccgcgcgtcctcgtcctctggcctggcctcctcaccgtggagtgcgtcgtcgccagcgtggagttccattaccgccagctcgccgtcgacggacgcgtcctcgtctacaccgccaccgtcaccttcgaggaggtgctcgacacccgcgtcacctccgagcaactgcgccaggaggtgccgtagtggcccctcacgccggcagccgctactccttctccctcggcctccgggacgaggccggccacctcttcctcagcgagagagtcccctacggcttccagccgcacgcggacacgcgcatccacctcgttgcccagggcgactctctctgggggctggccggccgctacttcgcgcccctcccgcgcgcctgcggcttctggtgggcgattgcggactaccaaccggagcccatcatcgacgcgacgctggagctggaggctgggcggcgcctcttcatcccctcgctgcgcgtcctcaccgacgtcatcctcagcgagcagcggcggagggccagcgaatgacgcggcccctcgacaggagcgcgcctggcgtgcgcctcacgctgctggcacacgagaaggcccgcggcggcgagcccctctctcttgagggccgagtcctcggcctcaccttcgaggactccgcgacgaaggccgacaagctgtccctccagttggacaacttcgacttgtccctcttcgaccgagctgagctcgtgggcggcgcggtgctggaggtgtcctggggctacccggggctcatggcgccgcctcggcgggtggtggtgaagaggctgaagggctttcaggtgctgaccatcgagggccaggcgctcagcgtcctcatgcaccgcgaagcgaagacgcgcacctggaagggcaagacgcgcgcccaggtggtgcgtgaggtggccgccgagtacggctatgaggaggactccatccacgtcgaggacaccggagagtccttcgacaccatccaccaggccggggagacggacgcgaggctcctccggcgcctggccgcgcgggaggagttcgagttccacgtcgacgataggggcctcaccttcggcccgcgcaaccaggccgccgcgcccacccaggtgctgtggtggtacgccgacgcgggccgcggcgacatcctctccgtcaacgtcgagtcggagctgggccgtcgagtgggccaggtgggcgtccgtggccgggacgccatggccaaggcaaccatcgaagtccaggcgagcagtgccaccgtggagcgcaccaccctcgcggactttctcgaggtggtggagaagcgcacgggcaccacgtcgctgcagctccgcaacagcaccaccaacgtccagcccacctcggcatcgacacctgcccaagcccagcgcgagtccgaggcccgcttccgacgcgcggaagccggcacggtgaagctgtccctccaggtggtgggcaatcccagcttgcgcgcgaagtccgtcgtggaggtgcgcggcatctccagcttcctgtccggccggtactacgtcaccgaggcgaagcacgtcctctcctcctccggctacaccacggacttgaagctgtcgcgcgacggcaccggccgccggcagcaagccagccccgagaagcagggccagccccagggcggacagcccaacaccagtgcgcccgagacgactggggcgctgaaggaagtggaggcattcgagagggacaccggcacccggtacatcgagtaccgccgtgacgggcagcccatcggtgtcgaggaccccgaagccggaatgagtctccccaggtagcgagcccaccatgagcagcttcgacgacgacctcctcgcccacgacacgcgcctgctcggcatgtacgtgggctacgtcacccagcgcgaggacgaggcgcagctcggccgcgtccgcgtgtgcatccccggtgtcctcgagcccgagtccgcctgggcctggcctctgggcacctccggcggtggcgccaaggacacgggcttcttcgccgtccccgaggtgggcgcagaggtcgctgtcttcttcaaccagggcgacgtcgacgccccctactacctcagcgcgcactgggggcggcccggcggtcagagcgaggtgcccgaagaagcccaggtgtctccgcccgacaaccgcgtcctcgccacgcccaccttccgcgtcgagttggacgagtccgcaggccaccgcaagctgaagctcaccaaccggaagacgggcgactgcctcaccttcgacgcagaggagaacaccgtcaccctggaggccaccaccgccctcaccctgcgcgcggtgggagctatctctctggaagcggcccaagtcaccatcgctggccgcgtagtgcgccccatcgccgagccgatttgaggaagcccatggcgctgcccatctgcatccacatccccccgctgccccaggcgcccaccctcaccctccctggcggcgccaccctgcagcaccaccaactcctgcaggccgtccagccggcgctcgcgccgctcacgcccctcttcgacatcatcggcgcggtgctggccctcgtcgaagtcgtgaaggcgatacctgacgcgctggggcctccgccggacccgacagccatcgccgcggctctgcccaaattggccgagaaggtgtccaagctgctccgcctcgtcccccagctctcggtgccgtacacggtggtgggcgtcatcgacatcgtcctcggcgagctgggccatgcccgtggccagctcctccacctgcaactgcgcctatcgagcgtcgcgcaggcccggcaacgcgccgcccagcttcgagacgcgggcctgctcgcggtggccggttgcgcggaggccaacgtcgcccaggaggccgccaacgtcggcaaggccctggccgccctctcccagctcatggccctcctcaacgtcttccttgggctggtgggtgggccccaggtgccggacttctccagtcttgaggggagcccgttggaagaagccattgctcccctcgatgccatcgtccgcacgctgcagcaggtgcgcgcggccatccccattccgtgaggaggacgtcgtgagtcgagccccccagaatctcctcattcccttccggcgcgacaggaagcgcgacttcgccgcgggcgccggggccgagctgctcgcctcgaaggtgcggcaggtgctgctgacggaaggtgccacgccccactccaccggcgagctgccctggcgcaccagcttcggcgcgggcctctcgcgccttcgccaccagcgcaacgacacggtgctggcggagctggcgcgcgtgtacgtccgtgacgctctcgcgcgctggctgcctggcgtccagttcgtgcaggtccgcgtcgagcagcacgcagccgtgctgacgcttcgtgtgcgcgtgcgcgacggtgacgcgacggcagccctggacgtccccattcctgggtgaatggcactccaatcccacgcattcgagtggacttctgagcgcaccagagcgctgtatggctcagctcaaccggagcgcctcacccatgattcgacaaacaaaacacatcgacagcagcaattccaaaccgcactggtgggaggtagggggcaaaatctgtttctatgacgcgcgcggagaagtcgcgcagctacacattcaacagctccaagaagaggccgtgaggattgtccggcaacacccctccggcattcgcctcatgcctctggcgcgcggagtccacaacctgcaccccgaggcccccttcgccagcattcctcctgccctccactcgatgggtcgcaccaccttcacgaatgccgtcagcaggcccgagcgcggactctacgtccccacccgaaagagtgtccctccagtgactatccccgctgaccaggaagaggagttcctcctgcctctcgccgcgttcctcgagggagacgtggaggagctcaccgccgcagtccccttgggcagccaaggcctcggcgacccatgggggttgccggacatcgtcggcgtgtaccggcgatgtgcgggggactccttctcgtggactcccgaaatcctcgcagtcgaagtcaggggcacgacggaggacctcctctcggcctatgggcaggcggcggcccaccagctcttcgccacgaagacgtaccttgccctgccacacactctttccctccgcgacaggcgggagctggtggcgcgctgccagttgcacggcctcggcctcattctcttcgggcccgggccacgcgacgagtacaccgtcctcatccctgcgcgcagatgccccccggcgccagacgaagcactacgcttcagcgagcggctgcgcgcacatgacgaggagaagttccgcaccctgttcgggtaggacgaggcgtcaggctgcagagccccggccctgcgcatgcagcgcaaggccgggccgaagcgctgtcgctgtccccatgtccccgaaaagaagtgggcccaaggcctttgtctcccggtggaggccttcgccgacgtgccacttcttcccgcgtccaccgactacacccaccgcgacttcgacgccctgcgcgcgcgccttgtagggctggtgaagagcgtcttcccagactggacggacttcgacgtcgccagcttcggcaacctgctcctggagatgtacgccttcgtcggcgacgttctcggcttctatcaggacaacctcgcccgcgagtcgcgcctctccaccgccacccagcgccgcaacgtcatcgccctggcgcgtatgctgggctaccggcttcacggtgcccaggcggccacggccgaggtggagctgcgcctggcccagcctcctgccgcccacgtcaccttccccgccggcaccgtcgtccgcacccaggaggtgacggaggccgtccgcttccagcttctctcttccgtcaccattccggccggcgccaacccaccgcgcgtcgtcgcggtggtggagcactcgaagacgcacacgcagctcttcgacgcccgcggcctcgccgacttcgaggcgcacctggacttcgctccctacctcgacggctccgcccgcgtgtccaccgcccagggtgccttcaccgaggtggacaccttcctcaactcccgcgcctccgacgcccacttcctcatttcggtggaccagggggacaaggccaccgtccgcttcggaaacggagtcaacggcctgccgcccgctggcaccgtggcggtggtgtacaagacgggcggcggctcggcaggcaacgtggacgcggagcgcctcgtcgtcgtggaggggagctttcgggacgcccatggccacgcggtgcaggtagccgtccacaaccccgcctcagcctcgggtggcgcggacaggcagacggtggcctccgcgaagctgctcgcccccgagagtctccgggccctgacgcgcaccgtctcccgcgaggacttcgaaatcaacgcccggcgccttccaggcgtggcgcgcgccctcatgctgacgtccaacgaggacgccaccatcggggagaatgccggcatcctctacgtggtgccccagggcggtggagtccccacgcccgcgctcaaggcccaggtgctgcgccaggtaacggaagtctacccctgcaccctcaccttccaggtgagcgtccaggagccggtgtaccggcgcgtggacgtctccacccgcctcttcctgcgccagggcgcttcggctcaggacgtcgcctcgcgcatccgccaggcgctcgccgcccacttccgcatcagcgagccggacggcacgcccaacccccgcatcgacttcggcttcaacctcaaggacgcccagggcttccccgccggagaggtggcctggtcggacgtgttcaacgtcatccgcgacgtgcccggagtgcggaagctgggtgacgcgcgcatggacctgacactcaacggcctgcccgcggatgtgaagctgacggtgcgggagctgccggtgctgggcagcgtcaccctacaggacggcgacaccggaggactcctctgacatggccctcctcaaccccagcttcgaggacgcgggcgctcggcccggcgaggctgctcactggacgctgacagcggtgacgcgcattgaggtcctggcgggcttcggtgtgccggaggaggcctgcgaggacttcgagcgctggtatgtgtggcacgccgccctctccgacgtccccgttgccctcgcctttttctccggccagcgcgacggcttcgaggccttctcccggggctgggacaacgacggcttcctcttcgagctgccgcccgcgcagctcgtcccgcaccgcttcgaggggaacgtcgccgagacgtggggtcatgggcccttcctcgcggactgggcggacgcaacttccgtggagggcctcttcagcgactcgccgcgcgaggacttcgagcagcgctggcacaccaacgaggcctacgcctggcgctgggaggacgtggcaacgcgcgcggccctcttcaacaccacgcagcccagcgaggacttcgacaccgggtggccagtggccgccacgcagtgaggacaccatggcactcgcagactggacatacctcaatggcggaatggacatcgccaccgtggacaggggcgtgacggcgggcattgcccgtcccctgggcggcggcaacttcctcttcgccttcaactccctcaccgccgcgcagggtgccgttgccctcttcgccaacctgccggacttcgcccccatggccaagggaggcagcatccgcggctgcctccagcgcgggcccggtggaggccccaccggcttctcccccttcctgtacctctgcggccagggcacctccgtcaacgactccgcctacctcctgggcctctccgacgacgagccgcaccgagtggtgctgcgcaagggcgcggtggccacgggacttcccgacgcggacggccccggtgtcctcctcaagtcctccgccagcttcacccagggcacctggctgcacctgcgcctggacgtcatcgtcaatgccaacggcgacgtcgtcctcaaggccttccacaacgacttggccatccacccgctgggcacgcctcccgaatggcagccagtaccaggcatggccgacttcatcgacgacgcccgcggcatcaactgcgacagtcagcccc

SEQ ID NO: 1212 - DNA, 26012 bp, Myxococcus xanthus
ccgtacggctcgtaggagtacatcgagctcaggctgccggcaccatcaacgagcgccactgtcgttcccatgacctccgacaagaagtcataggaaccgctggaggacgtctggctataaacttcgtccagcccaaatcccgtcaacaagtcacgcgttcccgccagggacttaacctgaatgaaattgtccccactatagagatagtcctccacgacgccgaacaacatcgtgcgtgaacgccttcccgtgggctcatactcgaacgtcgccaacgctccgggaccctcgacgatctgaaccaactgattgcgcgcatcccagctataggttctcgcgccatccgacacaagattgccattggcgtcgtaggctcgaggctgaccattccagactgtcaactggctggccgcatcgtagacagcgccagaggccgtcagcggcaatcccgtgcgtgcaagggtgccaccgactgagacgcgattcccgtctccatcgtaggtgtagtgcaggtctcccaccacagacatcccctgccgatactcaattgcggagagtcgcccagcagtgtcgtaggcgtaatgctgggataccccgttaggcagagaaatggactgccgacgacccaccgtatcatgggcaaaagccactgtacgccccccctgcgcgatggcggtcaaccggccggcgttgtcgtgggtataaattacctgagagtgcccagtggcattcatggtcgccagttggcccacggcgtcataagtatagtccacagtcccattcggcgacacctcctggacgagccggtccaggccatcatgtgcctgggtgataatggctcccaagctgtcctccattcggacaaggcgcccccccaggtcgtactcgacggcgatgctgtttgcatacaccgtcggcgcagacaccgtggcgccaaaacccaccaggaccgtctcgccagcggagttatagctccacccactcacctgccccttacgatctttgaatgcctgcaggcgacctgcggtgtcatatgtgaacgtctcgatgcgccccaacgggtccatccgctcggagagcaggcccaggttgttgtaggcataaagggtcgcctggccgcgggcatccgtcgaggacacaaccctcccagatctgtcgtaggcgaactcgacgacgtgaccgctggcattgatgtacttgagcagccgatcgctgccatcgtactcgtaccggtcgacatgccctgcggggctgcgccgggtgacaacgcgccctagggcatcgtgggaaaactccgtggtcaggtccccgccattcgtcaccgcgatgatgtccgcgccttcataggtgaaggtgaggggagcgtccgtaccgacacgcaccgtgatcagacgccccaaggaatcatgtgtgtactctagggtccgccccgttgggtcctcgatgcgcctcaggttgccccgagcgtcgtactggtactcggtgatatggccaagtgcgtcctggacgggtcgagagctgattggtcgcgctatatgcgtactgcgttgacaccgcctgcggcgtgcccgcgagactggtcacccgggtgatgttgccccaggcgtcatgttcgaattcggttcgcctccccagtgagtcaatgacggctttccgcctcccattggacagatcaagctcgaagctcgtcgtgcgctcctcgggcgcgccaagtggatatgtgtcatagatgatgtaccccgaatagaacgacacgcgccgcgtttgccccgagcggtccttcacgtcagtgcggttgatctgctccccctcacggacattgcaggcgccgttaggcacgcagtcagcgatcatctccactagataagtgaactcgtaggtgctgccatcagccagcgtctgtctggagacgcgacccttcgccccgtactcattgtggacgacgagtcgatcctccgcgtccaccaccgtctcaatgtagttggaatcgttgtacgtgtatttgcgaaccgcccctactgcgtctgtgacctgagtcagccgcccctgcgtgtcgtaggtataggtgacgattcttccggcattgtcccgagcctgggtggccaaaccgttatagaggcccgagccaatggtgaactccacccagcggccagacggcccggtgacacgagtaattgggcctgagtacccactctggcgagtgatggtcagggcatttccgttgcgatcctcgatccgctccagacgatgagcgtggttgaacgtccagcggcgaccatcccggaaccacaggtcccagccaaggatgtcggcattataaacgatgcgcgagccggaccacggacctgggtaggtcgtctcgaagatggcgctctgcgaagttgttccgggagacacccgttcatagcggatgcgcgttccgtctggattgactaactcatactcagtgaaggccgccgttgctcgccagaggtactgctcgtagttaccggccatgcccaccccaaattgcctgcgggtcaagtccagtgagcgataggtacgctccacttgaatgggaaggatgtccgcgatgaacaagtccaactcgcggttgaggaattggccggaggcgagctggacggggtcgccacctgtcggacttccaggccccccggcggagccccccccacagtccccgccgccgccttcgccgccctctccgttggcacagcattcggtgttgcaaccaccgcccacgggaggcggaggaacgtcggggttgctgaatccagccccgacgaagccatagagggcaacgccatcgtccggaatcacctggcgcccatccgcgctgacactgcccaggccataggcataccagccactactattcgcgtcgtagttccagaagttagccttcgctccgggaagttcgccccggtagttggcgtagtaaagcttcgcgccgctgaagccgggcgatagcccttcgaagcgtgcgtcgcttggctggagcgtaaagtagagcggcatctccagattaggcaggggaaaaggtgcttggttgatgggcagcggggtaatgttgatctcggtcaacaagttgcccgcgcggtcacgcactactgttcccggcggcagccgcaactcaagccccgggatagcgggtgtcgtcaccgcgacctcctccgtcgtgggacttgggatggcgaccgtaccctggggatccaaccggggcatccacacggtgtgtcccagtgggttggtgactccttcccgaatttcgatatgcatgaagaaaaggccataacgggtcgaaccgtgattggccgtctggccattgacctccagggtctgccctcccggattaagcccttccaagaggaagcgcccctgggaatctgtaacagtagcaataccgcgcactacgatgcgtacgcccgcaagtggcttgccattgaggcgcagcacgcgcccggacagagcagtgacacccgaagccgccgtgagcggctccaccggaggcacctggggctctcttgaacgccagtcgcccatgaaattctccggtcccggcaaccacgtttccccattatcaaagaaaggtcgctcgggagcgcgccactcgtagcgtccgtccgggcgccgcatctcagatgggcgcaccagggacaccggctgcgctgtcgccctggcgcggccgggccgtggccgaggaaggcgaacgtccggccgtccctcgcccaatgccaagctcgcggtcgtgaagcccaccgaggtgaggggcagaacctgccctgcttgggtcttcaacccctcgacagcagcgcgtatatatagtggccggcagcagcgactgcgagggacggaagaacatcaaccgcccttgctccgccagggtatgggcaccaggcacctcacccacaggtcgcatcagcgtgacggccgtttcaccatcctgggacatgggctggctcaagcgcactgccagcaaggtgtccacccgtactgctgacgtaccgtctacgggaagcgagcccgccatcctcgctgaggagttcgaattcggcagcctgtcacgttcggcggcatccactcggacgaactcgccccggaccggatcgaacagttccgcagtgggcaccgcgcccgacgcgtcaccgccccagagcaacacgcggccatccggcagcagcaccgcagtgtggcccgcgcgggccacctgcatgcgggaggagagccgcgtcacctggagggtccttgaatctaggagttccgcggtatcgctagcccgtgaatccactgtctccccaccggtgaagagcacgcggccatccgtcaacaccgtagccgagtggcgcgcacgcgcctccgtccggagctccatcgcgctcgtgaaggtccgagtgtctgcggaaaaccattcggcggtgccgagtagccgtccggccgcatcgcgtccccccaccaccaagaccctgccatcgggaaccaccgtcgcagtcggatgcgagcgcgcgaacaccaggccattttccagcggctcggggacaccggtctccggcaggagctccgcgtcacgtgtcggctgttcgccccctagaaacaaccagcgcccgtccggcaagcgcgttgcaccgcgatccactcgcactggaggcctaaccacggtcagcggttgcatgaggtcatcgggcaccgcagcgaacgggacttcttccgcgcagccggtaatcacgcccagcagggcgaggcaggcgaccgcgagtacacgtctgatttgaggcatggtctttccaggttgaatcagggaggacatgaaggtcacttccggacatccgcttgggctggtgccgagggagcgcccgcggtctttattcccaaggagagttggccgatgctggcttggtacgggtccacggtgatgccgtacgtacccgtcgtggggggcgtgaagttcaccgtgtagccagtggcggagcccgtggtttggctcgtcaactgcgcgccatcaggcctcaggatgcgcaccaacgtgttgctgccgaagctgttgcctgtgattagcagcgtcaggttggaattcgcgttggcagagaaggtgtagaagccatcctggcccacccgcgcagtgctgaaggtgtgagcggggccatccaccgtgaggacgtctcccagcgacgtcgacagcaacaggcccaccgtcgccgtcaccgtccctgatggattcaccgtcaggctgtatgtgcccgtcatcggcaacaccggcacgtcgcagttccctggcacgtagaagttgctgcaatcaaccaacagggtgccatctggcttgagcagcttaatgacagcgctccctccggcaggcgtagtgctgacactcgtcacccccagccctagtcgcgcccccatcgtgccgctgaaagtgtaacggccgttctgccctgcattcaggaccactgtcgtctccaccccatcgacggtgcccgcgcttccgctggcctcctcaaccaattggagcgtcatctggccgatgctggcttggtacgggtccacggtgatgccgtacgtgcccgtcgttgggggcgtgaagtccaccgtgtagccagtggcggagcccgtggtttggctcgtcaactgcgtgccatcaggcctcaggatgcgcaccaacgtgttgctgccgaagttgttgcctgtgattagcagcgtcaggttggaattcgcgttggcagagaaggtgtagaagccatcctggcccacccgcgcagtgctgaaggtgtgagcggggccatccaccgtgaggacgtctcccagcgacgtcgacagcaacaggcccaccgtcgccgtcaccgtccctgatggattcaccgtcaggctgtatgtgcccgtcatcggcaacaccggcacgtcgcagttccctggcacgtagaagttgctgcaatcaaccaatagggtgccatccggcttgagcagcctgatgacagcgccccctccggcaggcgtagtgctgacactcgtcacccccagccccaggcgcgcccccatcatgccgctgaattcatagatgccattctggcctacctgtcccgtgaaggttgccgataccccgtccttctccagcatgccgcgcacagcacgcaccaatgcgaaagacgcattaaaccccgttgtcgtgccgctgagtcgcaccacgagcgtgtagacggtgtccctggtagccatcggaatgtcgaagaccccgcctgctgccgcaaggctaaagttgcccacctgcccgcccatttgatcatggaccaccagcgtcgcttggttcgctccccccaggaccaccgatgtcaccacgagacttacctgctccccctgccgcacggagaagctcaacaccgccttacgcgttgagtccgccagggacacagcactcgacgccccgccgacttcagcttggagtctggtgtctgtcatcgcaggaaccgcccccacggggagcactaggaagtcctcggagctcgtcgctcgccctgaaggagtggagacccgaatcgcgcccgtcgcgcccaattgagagaccttcacctccagctgtgatgcggaggaggtcagcaccgaggcctggatgtctccgaggaagactcgattgaaaagacggtcggggtcgaagttactccctgtaatggtcaccactgagtccaccgggcctcccactggagagaaacctgtgatgacggggccaagtacgggactcgtaacaataaagtcctcatggctcgggaccgtcgccccatccacggtcacactcactggccccgttgttgcgttcgccggaatcgtcaccaccagtcgctgcggactcgccgcagacacgatggcatccacgccattgaaacgaaccgtgttgccaaccagtgccgggctgaagcccacccccgtcaatatcacatccgccccgggagggcccgcgttgggagtaaaatcgaagagccccagctccgcttcggataggcgcttaatttccaagaggtttccccctgggtcataaacatactgagcgctggcgcccgccccgtcatagacgcctaccagacgccgactttcgtcatagacatactgaattggaggccctgcgtcccccagagcactggaccgggtctccgttcctggctgagatgcaggtggaccgccacacgcggacaacacaaggacacaccagagagcgcgaacgcagctctcccagaaagttcgcttcaagaacgactcctagcttggaatgggctggatggacgaaagtgttaccggccaatccctgtcgaagcagcggggctggtcagcgaatggagaaaagccacaatgtcggagcgctcggaaggggtcatgtctcctacctgaagcccctcaggcaggcgataatacagctctcgttcaacggcttgaatcagcgtgggaacactgccgtcacgcatgtacggcgccgttacggctacgttgcggagggacggcgtacgaaaccgccccaggtcagaagccctcagggtcaccacgtatcgccccagcgccgccacttctgcgcgcgcagagacagccgcccgccgcgcgccagggtccagcagcgccagttctcgagccgcgcccgcctgcttagctatgagggccgcggaaatctcaccggcatggtacgacccatccgtgaaggctccgccctcgggcgggtggcagcgcgcgcagcccgcccggcctgtgaagagcgcgaaccctcttcgctgttccggacgaagtgcctgcgcgtccccactaagaaactgctcaaacggcgagggaggaggaacctgctggcgcacataggccgcgagcaccctagataccgtttcccgcgtcgccccccttccaggaaagagtcgctcgaattccgctgaatatcgagcctggacagatgaaatgacagcttcctctccttccatcccatgctcttcggcggtcgtaagcggatcgaacatcaacgtctctaatgaggcccttcgcccatcccagaaaaactcacgggccgaggccaggccccacaggctgggtacgttcctagtaccggtgcggtcgaacacaccccgtgagacaggcttgccgtctgtaaaggcggcatcaggtggatggcaagtcgcgcaagccaccttgccatctgcgctcaaggacgtgtcgatgaagagagcagcccccagggaggcccaggccttttcgtctggcggagatggctgcggctcggcgccgctgtccaaagacggaacgagcagtccccataccgataccaaacagacgaggcgcctggaagacagacacaaagcctgccacgattttcttttcacattcgcgccatccctgtcccatctccccaaagtccactcaagcactccaaaacgaaagaaaggcaaatccatccccaatatcccccaaaggttcggatgagaaattcgcaggaccgaccattcgctacccaagcgagaacagggccgacggttttctcgtgccatcaataggcgttaacggacccgttcgaggccctactgccatgagagctacggaagcggtcgattgcgtgggagccacctaggtacagtcagcatctccccaattgaggatgagagtgacctgtcaccttcgctccagagcagagtttgaaacccggtgccagacgaaatacatctctccacgagaagtccatctgactgactgaggagcaacagtcgtggtgtccgacttctgcagcgcctcatcgtcgaagcactcggattagaaccctggcacctgcaatgccttaccgcatgccaccttactttggtcacttccacgctgccttctggcaactcgtgcccaccgttcgacaatctcacggcatcaaaaactgttcctgccgcccccccgcttcttccacctcatatacatggtccccgcctgtcccattacggtcagcacgcaggcgtcacttctcattcactggcaagcacggtcaagtagccgacagactgcttcgcaagttgttgcgttgagcaattaatggaccagcgcctcattggcgaggtctgggcagacccagcgggctcctaccagcagcatgacttcggttcacaggagctcggttgtcgtgtgtacgccgcacgcggccgtccacgttgcgggatttaccgtctgtggaactggatgggccactctgcacgatttcgctcgcggtgcgtgtcaggcccctccggaaacagcagctcgcccttcccgccagcccccctcccaagccaccgaccgggtcagtcccgggttcccggggtcgtccggcacctcatgcaacctccaagaactcctgcgaagccgcctcttgtggcatatacccacaccatgccttccgccctgaccgcctccgagatccgcgaggcgttcctcaaattcttcgaggagcgcggccaccgccgtgtggcgtcctcctccctggtgcccgccaacgacccgacgctgatgttcaccaacgcgggcatggtgcagttcaaggacgtcttcaccggccgtgagacgcgcgactaccgccgcgccaccacgtcgcagaagtgcgtgcgcgccggcggcaagcacaacgacctcgacaacgtcggcttcaccgcccggcaccacacattcttcgagatgctcgggaacttctccttcggcgactacttcaaggccgacgccatcgcgtacggctgggagttcgtcacccggacgctcggcctgtccaccgaccggctcgccgtcaccgtgttcaacggcgagggcggcaccccctgggacgaagaggcctacgagctgtggaagaagcagggcgtccccgccgagcgcctctacaagctcggcctcaaggacaacttctgggccatgggcgacaccggcccctgcggcccctgctccgaaatccactaccaccagggcgacgacatcccctgtgtcgaagaggccgagggcaagaagtgtcagggcgtcgcatgtgactgcgaccggtggctcgaaatctggaacctcgtgttcatgcagttcgagcgcaaggagaaggacgggcccctcatccccctgccgaagccgtccatcgacaccggcgcgggcctggagcgcatcgcctccgtcgtccagggcaagcggtccaactatgagacggacctcttccagaacatcctcgccaccgtcagcgaactgtgcggcaagccctactcgcaggagtctggcgcgtcccagcgcgtggtcgcggaccacagccgcgcggcggcgttcctcatctcggacggcgtccagccctccaacgagggccgcggctacgtcctgcgccgcatcatgcgccgcgccatccggcacggcacccagcagttgggcctggaggacgtcttcttcttcaaggtcgtcgaccgcgtcatcgagctgatgggcgacgcctaccccgagctccgggagagccgcaccttcgtcctggaggtctgtcggcacgaggagacgagcttccgccagacgctcagccgcggcctcaagctcatcgaggaggagctgtccgagctgcagaaggccggcggcaagcagctctccggcgacgtcgtcttcctactccacggcacctacggcttcccatgggaccttacgcagatcatcgcccgggagcgcggcctcgacgtggacctggtccgcttcgaggagcgcctcaaggaagaggcggacaagaacaagttcgcgggctctggcgacaaggccacgggcgaggtctacctgaagctggcggagcggctcgggacgacggagttcctcggctatgagggcgagggacacgaaggcgaaggcagcatccgggccatcgtcaaggacggcgccgaagtcacgcaggccacgcaaggcgacacggtggagctggtcctggaccgcacgcccttctacggcgagtccggtggccagatgggcgacaccggccgcatcgtcggccacggcggcaaggcggtggccaaggtcaccgacgcgcagcgccccgtgccgggcctcgtggtccactcggtggaagtctccgagggcaccttcaaggtcggcgacatggtccaggccggcgtggactcggagcgccgcaagtccatccgtgcgaaccactccgcgacgcacctgctccacaaggcgctcaagctcgtgctcggtgagcacgtgaagcaggcgggttccgtcgtagcgccggactacctgcgcttcgacttcgcgcacttctcgcccgccacgtccgcgcagcttgagcaggtcgaggacctggtcaacggctggattcgcgacaacgcgggggccgagacgcgcgtcatgagcctggaggacgcgaagaagtccggcgccgtcgccatgttcggcgagaagtacggcgagacggttcgcgtcgtcaccgtacaccccgagtccaccgagctgtgcggcggcacccacgtgcgccgcagcggtgacatcggcctgttcaagattgccagcgagagcggcgtcgcgtccggcgtgcgccgcatcgtcgcgctgacgggcatcggcgcgctccagcacgtccgcgagcaggaacacgagctgcgcaaggtagccgagctgctcaagtcgaacccgaaggaagtctccaagcgcgtcgaagcgacccagaagcgcgtgaaggaactggagcgcaaggtcgaggaagtggccgtcaaggcgcagacggccagcagcaaggacctgctggagcaggctcgcgatgtgaatggcatgaaggtcctggccacccaggtggacgcagcggatgacaacgtcctgcgcggcatggcggaccagctccgtgaccgcatccgctcgggcgtggtcgccatcggcggcgagaaggacggccgggccatcatcctggtcgcggccaccaaggacgtcgtggccaagggcatcaacgccggcgcgctggtgcgcgagatggccaaggaagtcggcggcaagggcggcggcaaggccgagatggcccaggctggtggccctgatgcctcgaagctccccgcggcgctggagaagctgtacgagttggtgaagggcgtgggcaccgcgtgatgaaccaccgggcctccgcttccgtggcgctcctggcggccaccctcgtcctgggtggctgcaaggaggagtccgtgcctgactacacgggtacgggtgacgaccggacgcttcagaagctccgccaggaagtggaccgggtgaaccagggcggccgtccctcccagggccccgaggccacgcgcggagacccgaacgcgaacctcgcgggcctggccgcgggcatcaacgtccccaccgagcgcgcatgggagcttcccgcccccaacgacgccgtgcacttggagaccctgtccgtgaagctcaccggactggacgcgtcgcactcggtgaagggctcggggaaggtgagcctgacctccgaggacctgttcttccgcgttcaactcatgacgcagaacgtgggcggcgcgtcgctcaccctggacctggacggggcgaagctcttcggggctgaaggccagtcgtacaccgtggcccgggatgcccaggtcgtcgggggcacccgcccccttcggcgcacctgggctccggatgagcgcaccgacgtggtcctcctgttcgagcttcctccggaggcccttcgggacgacgggctacacctgttgcttcagggctccgggggggatgtgcggattcccttgaaatgagcgggacagcgtccaagctcctcccgcttcgcatccgcctcccgtacacgacggaggaggagtttatcgacaagtacggctcgaacgtggcgcgcggtggcgtgttcgttgccacgcgcgccatgaagcccgaaggtaccgggctggcgttcgagttcgtccttgccgatgggacacgcctgcttcgcggcgaaggcgtcgtcgtgaaggcccaggtggacgcggtgggcgggcgtaccggcatgacggtgcgcttcgtgaagctggacgctgcgagcaaggcgctcatcgaccgggtggtgtcgaaacgtaccggaagcgcggagccacaagctcccgcccaggtcacgctcccgcctccggcccctgcacccgcgccacctccgggactcgttcgccgcacacccggcgcgaaggcttcgaatgcggtgcgtgcctcgactcccccccgcgagccctcgcgggaggatgcgcgcgtcgaaggcacgccgacgggagttcctgacgcggtagctgccaacggagccgatctcgcgagcacggtggcggtgccggaactcacgcccagttccgagactgctacggcggatgatgacgcacgcgcggaagcgccggactccggcacggctgctccgtcctccgagtccgagcaagtgccggatgagcctgcgtccagcacggacgcgcatgcggtgtccggtgaggcggacacgggctcacttgatgcctctgacgcgttcggcgggagtgctttcactgattcaggggctccgagcacacaagatgcggacgcacgtccgggacctgtcgctccgcgctttgaagctgattcgagtgacgggctcgacttcgccatcaccgcgagcctcgcggcgtccgaggatgaaggtagcaatgcgaatgccgtagccgagcgacacggcctcggtgagcccgccaaagcggcactcgtcccggtgaattcgtcaaccgacgccggcactgcgccgtcagcgaccgcgactccggacgtgacggcgaaagcctccgacgcactggcctcgagcgagccagtggagccgcctcaaacgctgcttcgtgtcccgcccgagttggagacaggcgacgatgcgcatgcagcagccgagccccccacctccgcgcccgcgcgccctgtatccctgcctggtcctggtggacgcgcgccctctgaactcgacgaagccgtcggtgacgaagcttccgccccagcaacggatgcagatgcagcggcgccccacggagcatctgtcactcaggcgaacaccccaatcgtcgcggaagctggcacgcctgcaacggcggaaccctccgcgacgacgccagttacgggtactgctcccgccaacgaagcagccacggaaccctccgcgacatctgcgacgacgagctccgagcccaccgccaagggcagcgatacatccacgattcgagcaaccgccgaggcatcgaccacaagcgtcgagcccgacaccgacgagggcaacgaaacagccccgacatcctccgggacggcggcgcccgcgagcgaaacgcgcgatgccaaagcaggcgacgcatcaccgactgaaacgccaactgccacttcgatcacaagcgtcgagcccaccaccgaggcaggtcacgtagcatccccggaggcgtccgcgacggccgcgcctcctcgtgcacagtccgacgccgaagcaggcgacgcatccaccactcagccccccgccgcgacgtcaccactgagcgatgcgcccgtcgccgaggcaagcaacgaggcagctaccgagccccaagcagcagcgccgaccaccgaacaaagtggcccgagtgtcgcgtccgaatctacgacgacgacccacacggatgacccgtccggcagtgctcccggcgaggcagcatccgcacaggcgatggccgcgctcccgagcgcacctggcgtcgacaagacggcgcacgccgctccaggcgcgaactccgctgagcgttcgcagggcgcctccacatcaggtgacacaccgccccaggcggcagccagtgcagcccccgcggccgagtcgagtccgccaccagagccaacactcgcgactgccgagccgcatgagcgcaccaccgctaccgaaagcgtgcgccccggcgtggcctcggatgaagcttctctgttcaacacggaagcagccccagcccgcaccgaatccgagcccacgccccccgtccctcaggacgcggacgtgccacgcaaccgccgccgtgccctgctcgaagtcccccttccccagccggcctcgacgcccgcgctccctgaggtcgtgctgggcatcgacctgggcacctcacatgcgcgcgtcgccgtcgtccaggacgggacacccaagctcattcccctccccggcaccaccaccacggaccttcccgcgctcatcgcggtgaacggaaccggcgacctcgtcgtcggcgccacggctcagacggaaggccaacgtgccccccgccgtgccatctccggtctcaagcggctgctgggtctgaagccgcgttctccgcaacttcgctggctcgccccgttgctccccttccccgtcaccacggacacgaatggggactccgccgtggaggtccgaggccgcgtcatctcacccattctcttcacggccatgctgcttcgcgagctgaagcatgccgccgcgacgcacctgggccgcaaggcaacccgcgccgtcatctgtgcccccacgcacttcaccgaccgccagtgcgcggcccttcgcgaagccgccacgctcgcggggctcgatgcccagcgcatcctcatcgcccccgcggcggcagcgctcgcgtatgcacatggccgagggctcgcgcgaaagcgggtgctcgtcgtggacctgggcggtggcggtctccaggtctgcgtggtgcaagtcacaggcgatgacctcgaggtcattaccaccggaggcgacgccaccctcggcggtatggacttcgatgcgcgcatcgccgaggccatcgccagcgacctctcggaacagggcgtgcccaagccggaccatcccttcgactgggcccccctgcgcaccgccgccgagtccacgaaggtggccctctccagccaggagcaggtggacgtcaccctcccctcgggaaccgtgccccccatcaaccgggagcgagtcgaagccctcaccgccgacctcgcccagcgcgtcaccaccgtggtccgcgacgtgctcgaatccaatgcgctctccccccaggggctggacgcggtgctgctcgtcggcgggcagagcgccgcgccgctggtccgccgccggctcgaagagagcctgggcgtgagcgtgcgcgacgacgtggacactcgaggcagcgtggccctgggcgccgcgctgctcggacaggggcttctgctggccgcggccggcaagcccgcggccactgtctccgaggtgctgtcctcgccgctcgccgtcgccgagcgcggtggcaccttgcgccgcgtcctcgaacggaacacccgcctgcccgccaccaagacgctggtgcttcccgccgtgccgggtccactcgagctggccctcttccagggggcagtcacgcaggcgtccgacgccgagtacctcggccggctcaccctcaacgtggagcgcgcgggtgaggtggaacttcacctcgccctctcagtcgatggagccctgtcgctcgaaaccaccctgcctggcatgaagcggcacgcggtgtctctggccacggagcacttggacgacgcgaccttcgacgcgctcatcgcccgctcgccgctggccgctgagccggagcgacgcccgggtggcgtgctgtccggactgaagaagctcttcggccgccgctgagcccctcctcgctcgtccgcgcacaagtcacggcgcccttcgccccgtgggccgatgcgcccgcggccatccaggccaccgtgcgtccctgtggctctctctgtagccgtggcgacagatggccagctttccggtgactgattttccggggaggaatgcgatgcgacgttcgattgtgggtggagccgccgcggcggcgctgggcatggcgggacctgccttcgccatcgaggcacagcaggtgggcgagcggctgcgcgtcaaggagcggccgctggtgggcgtcgacgtccgactgggtctcggcaacttcaccggagacctcggcagcaacaccaaggtgggcccgctgctgggcatcaacgccagcgcctatccctggcagtacggaggcgtcgaggtcggctacgaaggccagcgcttccccatcgacgactcgcgcctgcgcaacaacggcgatggcgaaggcgtctggcgccacaacgccaccctgctcgccaaggcgggaccgctcatcgacgaaaagtggcgccccttcgtcggcgcgggcgtcggcctgagctacctcaacccctctgacggcgcggaccgcttctacaacaatgactggcagacggagctcccgctggccgcgggcctggactaccgcttcggcaacctggtggccggcgcgcgcgccacgtatcggttcgtcggcggggagggcctcctccgaaaccccatcaccaacgccgacgagaaaggcagtctcctcaacggcaatgtgatgattggcgggcagttctagcccgcccccatgtcacaggctgaagccgtccagcagcgcctcggggcggggattcttctcccacgcctcgagcaccgccaccgcgggcgaacgccccgacgcggccaccgcgtccagcgcgtccagcaggggcgcatcctgcgcatccagccgcatcaagccccggcgggagatggccagcatctccgccgccaggcggtgcagctcctgcgaacccagccggccgcccagcccctcgcgccgcgccgtatcatggaaggccaggtgctcggcgtaggtcagcttcggcaacaggcgctcggcctcctccagcgcggtggcgtcgtacaggatgccgcgccagagggcggcgagcgctcccgtcatcgcggggttcacgcagtccgcgccgcgcacctcgatcaccgtcttcagccgcacctcggggaagagcgtggacaggtggtccgtccagtcgttcaggtcgggcggcttgccctcgaagccctccttcatcaactgccggaaggtcagcttcgggtacaggtactcgttgttgcgccgcaggaagagcagcggcgcgtccagcgcccactccacataggcgcgatacgagaacgagccgtcgaagaacgcgggcaggtaaccacatcgcgtggggtccacctcgtcccaaacgcggttgcggaaagacaggtaacccgacggcttgccctccacgatggggctgttggcgtacagcgcattcatcagcggggcaagccgcgccaccaccaccgtcttgcggacacagtccgactggtccgcccagtccagggacacctggccggtggacgtcatcaacatcatgttcagcgccagccggccgcgctccggcaacgtgcggcgcatgatgaggtagcgcgtcttcggcatccacggcatctgcgccgtcgtaccgaaagggcggtagcccaggaagacgagccgcaagcccagctccttcgcggcggaggacacctccgacaggtgcgtcaggttctccgcatgcgcctcgcgcgcggtgacgaaggggcttccggacagctccacctggccgccgggctccagggagatggtggcgccaccgcgctgcagcgcgatgacgggcgactccggcgtctcccgaaacggcgtgtagcccgccgaggccacccggttcagcagcgcgccgacgccccgctcgccttcataggtcggcggctccgcggcgcccaccgggtagaggaacttctcgtgctcgagccccagacggtgcgcaccgctgggcttctcggcggctcggaatccagccaacagcatgtcgacggaggagatgggctctgaggccgcgcgcttgaggtcgagtgacatgggcgcgccctatataacctagacttttggacccgcccggatttgcgcactggcctttatgagcccacactgcaccctccccaccatctccccccagccccgcctgtccgatttcttccagggaatggggctcctcggccgggccttctccctcatcctgcgcgaccgtcggctgttcctgctgtccgcgctctgtgccgccgtcaccgccgccgcgctcgtggggctcgcttggctgctgtggcgctacgcccccggtgccctggaatccgtctggacccgcccggagagctggtacggccaggccgcctggaccgcggtgctggtgttgtccggcctggtgctctgggtcgtgggcgccaacgtgctgccgcccctattgctggccccgctccaggatccactgtctgagctgaccgaagaggcctgtggcggcggcccaggcgcctccttcaccgtggcgggtttcgtccgggggctcgtcaccggcatcgcccatacgctcgcgcggctgttcttcctcctcgcgggcctggcggtgctcctgcccctccacttgataccgggggtgggcagcgtgctgtggacggtcctcgccagcctgtacaccatgacgtggatggcgggtgagtacctggccgcccccatgacgcgtcacctgtatcccttcgccgaggtgcgccggatgctgcgcgagcgccgggcgctctgcctgggcctgggcgcgggcatctacgtgctgctctgggtccccatcctcaacgccttcttcctcccggtggccatcgtcgccggcaccctgctctatggcgggctgcgcgaggcccggctgctggcgccccctcctggggagtccactaccgctgcgttgaaataaacgcccgagccgggtgtccaacccggggaaccgggaacgcaatgcccgccagggacgttctgctccaccagcagagaggcgatgccttgaagcaccaggagcccgtgattaggcttgcccggccgcttacagtgttcgcctactcggtataaacggtcgaaatctcaaggcttctcgccacacccggggtgccggacagcgcgccccagcttggatgaaccaaatgccgcgtttcctccgccgaatcacagccgttgccgtgctcctcggcgcctgggccctggtgggcagcaaccgggctcccttgccgctgaccatgggtgcagccgaggccgggcaaggctcgtgggacggcagtcttcctaccgtcaaaggcgagaaggcaccgcacgacctcaacagcctgcgcgtcctgacgaaggtcatcctctacgtgaaggagaactacgtcgaccccaagcgggtgaagccgaaggagatgatgatcgcctcgctggagtacgtcgagaagagcgttcccgacgtgctcgtggacggcaacgcggagacgggcaagctcaacgtcaacgtgaacggcaagcagcgcgagttcgacatcgcccacgtggactcgctgtggaagatgtccttcgcgctcaaggacgtcttcgacttcctgtcgaagaacatgcggcccatcgaggacacgcgcgacgtggagtacgcggccgtcaacggcatgctgtccacgttggatccgcactcggtgctgctgcgcccggagctgtaccgggagatgaagctgtccaccaagggtgagttcggcggcctgggcttcgtcatccagatgcgcgagggcaacctcaccgtggtcaaggtgatcccgaagacgcccgcgcaccgctccggcatccagaaggacgaccgcatcaagaagattggcgaggagtccaccgtcaacatggacctcaacgaggccgtgtcgaagctgcgcggcccggtggacagccgcatcaccatcaccgtggagcgcgacggctgggacaagccccgcatcatgacgctctcgcgcgccatgatttccatcgagagcgtgcagcacaagatgctctccaacaacgtgggctacatccgcctgaagaacttccagggcaacaccacccgcgacctcgaggcggcgctgacgcagctgcgcaagcaggcggacgcgaagggcggcttcaagggcctggtgctcgacatgcgcggcaacccgggcggcctcttggagcaggccatccaggtgtccgacacgttcctgtccagcggcaccatcgtcgcgacggtgggcctgtccgacaagctgcgcgaggagaagcgcgcgcgcgccacggacggagaggacagctaccccatcgccgtgctggtgaacgctggcagcgcctccgcgtccgaaatcgtcgccggcgcgctgaagaacctcgaccgcgcgaccatcatcggccgtcagacgttcggcaagggcagcgtgcaggtgctgtacgacttcccggatgacagcgcgctgaagctgaccatcgccaagtacctgaccccgggcgacgtctccatccaggaggtcggtatcgtcccggacatccagctggtccccacccgcgccaccgatgagcgcgtggacgtgttcgcgccgcgccgctccatgggcgaggccgacctggaccagcacttcggcaacccggactccagcaccgtcgccaagaagcgcgaggacgtgctcaaccgcgagaagccgctggagagcctcaagtacctgaaggtggacgagaagcaggcccaggccaccgccaagaaggaagagggcaaggccccgccgaagacggccgccaacgccaaaaagcacggggacaaggacccgctgctggacgtggacgtggccggcatgggtgaggacctggacgaccagctcgacgccgaggcccaggaggagatcaaggaggacttcgaggtccaattcgcccgcgacttcgtgctgcgcgctccggccaccacgcgcaaggagcagctcaagcagggcaaggcgttcatcgaccagaagcgcgccgaggaggagtcccgcatcaacgccgccatcgccgcgctgggcgtggactggagcgcggggcccacgccgaagaacgtgcagatggccgtgtcgctgacgccgggcccggacgcgaagattctcgcgggcgaggtgatggagatggcgctgaccgcggagaaccgtggcaccgagccgctcaagcgcgtgcgcgcctggacggagagcgacaacgccttcctggaccgccgcgagttcctcttcggtgcgttggcgccgggtgagaagaagacgtggaaggtgaaggtgcgcctgcccaaggacctcaccagccgccgcgacgacgtgacggtgcgcttcttcgatgaccacggcgccctgcctgagacgcgggtggccgagctcaacttcgtggagctgccccgccccgccttcgccttcaactggcaggtcatcgacgactgcgccacctgcaacggcgacggcacggtgcagcgcggagagactgtatctgtgctgctcgacgtgacgaacgcgggcaccggcacggcgctcgactcgttcacgcagatcaagaatggcggcgacgccaacatcttcatcgaaaagggccgcttcaaactgggcgagctgaagcccggtgagacgaagacggcgcgcttccagttggaggtgaagaagggcttcaagggcaacaccttcccgctgaagctggccatcatcgacgagccgctcgaggagttcgtgatggagaagctggagctgcccgtcaccgacgccgcgatcgccacgatggagccgaagaagggcctcatccgcgtgggcgacaaggtggacctgtatggcgcccccgcgcagggtgcgcgcgcggtggcgaagctgagcgggacgacggtgctgcccgccgaggcggtcaccaagggctactaccgcgtggagctggagaaggaccgcttcgccttcgtgcgcagccaggacgcgaaggagctgaagacgggcaaggccaccaccccgaaggccacgctggtcaccaaccaccgcccgcccgacatccgcctggacgtggatccggccgctggcggcatggtcgccaacggggacaagttcacgctctccggcgtggtgacggacccccacgggttgctggacgtctacgtgctggtgaacgaccagaaggtctacttcaagggcgtggaccccaagggcgccgagccgaacacgctgaagttctccacggagttcgcgctgaaggagggcaacaacaacgtgctggtggtggcacgcgaggacaacgacttcgccagccgccgcacgctggtcatccgccgccgcccggccgaggtcgcccagaaaatggcctcgcctgccggtagccccgccaacaagccgcagtaggcgccccgcgcccacctggcgcgccgcctccttccgggcggcctttccagcgggactccttgagaggagaccgcgggaggggccgcccgttttgttgacgctcctcgcgagcaggcgttaccgtccggcgcggtgggcgccttaccggccggtcgcgcgccctggaaggcggtgactctaatgcagacgttcagtcggtgggtggctctcgcggcctgggcgtcaggcgcgtccgttgtcgcggcgcccaatgacctgcagatcgcgcggttcggcaaccccacgggtgacaacccagtggcgtccgccgacgcggatttccaggccttcgcccgcatcatgggcgcggccatcacctccgtgaacttgatgcccccggagacgacgggccactcggcctgggccatcaacgcggagctctccgtggtgtcgctgcccggcagcgtgaacatccccacgcagaacgagcagccctccacggtgctcatcccctccttccacgcgcgcaagggcctgcccttctcgctggagctgggtgggcgcgtcggctgggtggagaagagcagccaggtggtggccaccggcgagctgaagtgggctgccaacgagggcttcacctacctgcccgacttcggcgtgcgcggacacgtgacgaagctgttcggcgcccgggacctgggcctcaccgtcatgggcctggacttcggcgtgggcaagcagttcccgctgggcggcatggtgacgctgacgccctacggcggcctggacctgggcttcgtcggcgcgacgtccagccgcatcgacttcaacccggaccgcagcttcgatgacacgacgggggacgattcgcgcgcggcgctgacggataccgccgcgtaccggaaggtttccttcggcagcaacatcaaccagcgcatctacggcggcgtccgcttcattggcggcgtgctccagttgggcgcggagctgtcgctgacgcgcacgggcagcgtctcctacgaggagaacggcagcaccgtggaacggggcctgccggccgtcttcgccttcaacacgacgctcggcctggacttctgagcgctacgcggcggggtgcagggcctgacggaccgcccccggccggttggtgatgaggtagctgacccccatccgctccaggacatgggcgcgctgggggtcgtccaccgtccacgccgccacgctcatcccggccgcgcgccacgcggccacccgttccggggtgcaggcctcgtggaaggggtggaccgagtgtgacgacacgagcgggctcaccccgtaggcctgcagggcccaggacttgtccgggtcgatgagcagcccccggcgcagctccggcgccgccgccgccaggcggaagagacacagcgggttgaagctggagatgacgacccggcccgccagtccgcgccggcgcaccagccgcgccacctgctccgccaggcctccgtcgtcggcgcgctcgcacttgagctcgatgttgaccaggaactgcggtggcagggcctccagcacctcttccagcagcgggattcgggcgggggcgaagcccagcggcgagccgacgtccgcccgctggagcttccaccacggggtgaggcgaacctcccacggcagccgcgcgaggcgctccaggcgctcgtcgtggcagacgacgacctcgcccgagccacagagcatcgcgtccagttccacaccgtccgcgccttggcggaccgcctcggcgaaggcttccagggtgttctcgggggcatcggcgctggcgccacggtgggcaagcaggagcatgccctccagtctgcgcgggtggccgccgccgtgcatcagaagtccaaccgggcgtgcggcggtggacgcatggcttgcctccccccgccctttgctgcactgtgctccatcatgctgggcctcggcctcggagaaatcatcgtcctcggcttcatcctgctggtggtcttctcggccgcccgcatgggtcagctcggcaatgccgtgggcaagttcgtgtactcgttccgcaaggcgtcgcgcggcgaggacctggtggatgcgaagccgctgcctccgggccgccgcagcaccacggacgccgagttcacggagcccgagcagccgcgccgccgctaggcccctccccgccccaggatgcgaagcccgtcagtcgtgcccgcgacgcccggggatgagtgacgcggccgcaggccctgttccattcccttcggcgagcagccgggtggcctgcgcgcgcagggcgggatggagggcggcgttcgagacgagttccctcaagtccgccgtgttgagcagcgggacgattttcgcgcccgtctccggcggcaggtaggggttgaagacgagcgcgcgccggatggcgtggcgcacggaccagcgcggtgacttccagatttcgatgagcggctcgggccgagccgggcggcgcgcggcgatgcggaccaccaactcctcggtgagccgggggttgatgagcacgttgcgcaggacagtgggattgctgacggtggccaggcgggacagggtgtccgggtccctcgtgaggcgggcctgctgcttcaggtgcccgagcgactgcgagaaggcgttggcgtccgcgcgggcggcggcgtccgggtccatctccagcttcgcggggccctgggcgaacaggtccgccacggtgtcgagcgactggacgtgcgcgagccgccgcagcgacgccacatgggggatgtgctcggcctcctgctccagcgcggccatgaagtccgacaacgcgcaggaggcgggcccccaccccgcgcgcgagagggcgatgaggtggcccaccagctcgttggagtcgagtggatctctccaggcgagctcacgcgcggcggccttgcgacggacctccgacccaccgctcaaggcatggatgaagcgcgcgacggtcccggcatccttctgcgtgggcatggtggctcactccctccggggg

SEQ ID NO: 1213 - DNA, 20250 bp, Myxococcus xanthus
tggacatgagggttctcgcatgggcgctcgcagagcgggctggacggacgctcccaggataaggcccctggcttcgtcaacatcgacaccggggacttccgcctgggggcgggttcgcccgccctcaacgcggggctgtcgctggggttggcctggtgcgggccaggcccggaccagggcgctttcgagtcggactgcccctgagccgtcagggcgtgtagagtgggggccccttctgccctggaccccactctccacgtgccgtcctcgctggaattcgtatcaggcatctccctggtgccctcggactcacccgcgcgggagctgctggccgcggccgccgctcgtgcgggtctacgggtggtggacggtctcgaagaggcctccctggcgctggtggacctcaccgcgccgggagggctcgccgcggggcagtccctggtggacgccgccctcgccgcccacctcacgttggtggtgctggtggcaccgggcgaaagccacttcgccgaggcgcagtccctcgaaccggcggacgtcctcaccgcgccggtggccatgcacgagctggcctggcggctccagtgcgccgccgagcgccacgtggagcgcgaggaacaggcgcgcagccaggaggacctagcgctcctgctggaactgacggcggactacgcggagacgtcggacgtggaggcgctgctgcacggcgtcacccggcggctggcggagaagctggacatcgcgcgcgccacgctggtgatgctggggcgcagcgcggatgagggcatcatcgtcgccgccagcgacgaccccacgctcaaggacctgcgcatcgacctgtcgcgctaccccgagattcgcgaggtgatgcgaacgggcaagccggtggtgatgcaggaggcctccacccacccgctgctgggggacgtggagcggcgcgcggtggccgcccggggcatccacgccatcgccgcgctgccgctgcccatccgcgggcaggtgcgcggcgtgctgctgctgcgcgcggcggggcggcggcgcaccttcacgccgcgggaaatcgacttcctcaccaccgtggcgcacgccaccgcggtggccctgcgcaacgcgtccgtgctccagtccgtgcgcgggcagacggaggcggagaagacggcccgcctggccgcggaggagcaggcggcctcgttcaagccgtaccagctcttcttcgcgcacgtcagtgaaggcgtggccatcctcgacgacaaggcctgcgtgctgtcgctgaatccgtccggcgcggccatgctggacgtggatgctccggacgcgcggggccgccacctgcaccaggtgactcagccggtggatgagaacgtgctgatggagctggtgaccaccgccgcgcgcggcgaggcccgctccggcgcggacgtgcaggtgtgcacccgcacgggtcgccgcctgacgctgtccatgtccgcggcgccgctgcgcgacgaggaggcggccaccatcctctccttccgcgacgtcacggacgcgcgaaggctggaggacgagctgctccagacgaaggacttcctggagcggctcatcgactcgtcggtggacgccatcatcgcgaccgacttgaaggggcgcatcatcctcttcaacaagggcgcggaggcgctgtgcggttacaccgcgcaggaggccctgggcggcggcctcaccgtgcaccagctctatccgcctggcgtggcgaagcgggtgatggccatgattcgggcgcccgagcacggcggcaagggccggctgtccctcatccgggaggagctggtgcaccgctccggtgagcgggtgccggtgaacatgacggcctccatcgtctacgaagggggccgtgaggtgttcagcgtgggcatcttcacggacatgcgcgcgcgcatgcagttggagcgcaagctgtccgacgtggagacgcggctggaggagagcgagaagagcgcggtcatcgtcgcgctcgctggcaccgccgcgcacgagctgaaccagccgctcacctcggtgatgggctacgccgagctgctgaagcggaagctgaaggaagacgacttcgcctggaagccggtggacatcatctaccgcgaggcggagcgcatggcggaaatcgtccggaagattggaaagattacccgctacgagacgaagtcctacatgggggcgcaacagattctcgacctggacaaggccacctcccatgaagactgagacccgagccgtgcgcatcgccggcggccctgcccccgagttcttccaggccctgttcgaggcgctcgacgcccccgcggccatgtgtgacccggccctgcgcctggtcgccgtcaacgacgccttccgccgcttctgcgccgaccagcacgtgtccgtggaggaggtggcgcgcaccctgtccggcgccagcgtgccggcggatggcgccagctgcgacgtggagctcttgcccgacctgcccggcgtggtgctgacgctgtcccgccggggcgacgtggtggccgtccgcgcgcgcaacgagccggagctgtcacgcaaccggctggtggtggcggagcgggcccttctggagcaggcgcgcactgaaggcgtgctgttggacctgggccgcagcgtggccgaggccggcggcgaggaggaactggtcgccgcggtggctcgcggcgtgaaggagctgttccccgggcgttcgttctgcatccgcatcaccgactcgcggacgggcggtctcacgtcgctctacgcggaggggcggctgaaggaaggcgcgcacgagccgctggtgctgatggagcgcgcggtggagaagacgagcctggaccgcgcgtccctgcccgtggaccgcgtggcggtgctgggcgaagtcccgctgctgttccaggacagcacccatggcgtgagcgcgccgctggttgccagcgggcaactctttggcgccatcaacatggagtacccggcggacttcgtctccgacgtgccgcatgacgagcgcgtgctgctccagctcgccaaccaggtggcggtggcggtgaagaacgcgaagctcatcgatgagctgacgttcgtccgcaagtacctggaggacctgctggagaaggccaacgccctcatcctggtggcgaaccgggacaagcaggtcgtcgtcttcaaccaggcgctgagcgcgctcaccggcttcggcaaggaagaggtgctgggccgggacttcttctggctcatcccggagagcgagcacctgcggctcaaccagctcatcgccgcggcgattcgcggcgagccggtgaacagcttcgagacgcggctgctgacgagcagcggcgcggaggtgcgcgtctccttcgcgacctcctccaagctctcccagcacggggaggtggagggcgtcatcgccatcgggcaggacatcacggtggtgaaggagctggagaagcgcatcatccacgcggagaagctggcctccatcggtcagctcgccgccagcgtggtgcacgaaatcaacaacccgatgacggcggtggccacgtacgcggacgcgctgctccagcgctcgcggatgacgccgggggccaacccggcggaccaggagaagctgcgcaaaatcctggagagcagccaccgcatcctccgcttcacgcgagatttggtcagctacgcgcgcccggcgcaggaccggccggagcgggtgcaactcaacgccatcgtggacatggcggtgggcttctgcgagcacgtggtggcccaggctcgcgtcaccatccagcgcgagtacatcgaactgccacccctgtccgccgtgcgcgccaacctggtgcaggtgttcgtcaacctcatcaccaacgcgtgccacgcgatgccgccgggaggctccgtcatcctggccacgggccgtgacgggcaggacgcggtggtgaaggtgcgcgacacgggcacgggcatcgagcccaagcacctgcagcgcatcttcgagcccttcttcaccaccaagccggaagggcggggcaccggcttggggctctccatctgccagggcatcgtggagaaccacggtggccggctgacggtggagagcaccatgggcgagggcaccaccttcatcgtgcgcctgccgctccagcagggctgagcccgcgctcagtcccgcatgtagtggcaggtgtagccgcccgggttcttcaccaggtagtcctggtggtagtcctcggcgggggtgaatgcgcccgcggacacaatctgcgtgacgacgggccggggccacttcctggaggcatccacccgcgccttcacttcctcggcgacgcgcttctgggcgtcggacaggtagaagatggcggagcgatactgcgtgcccacgtcattgccctgacggttgagcgtcgtcgggtcgtgcatgcggaagaaccactgctccagcagcgtctcgtacgtcagccgggtggggtcgaacacgacgcgcacggcttcggcgtgccccgtcttgtccgagctcacgtcgtgatacgtgggattgcggaaggcgctggagccgcccgtgtagcccacctccgtctggacgacgccgggaatcttgcgcagcaggtcctccattccccagaagcacccgcccgccagcagcgccgtctccgtgaagggcgaggtgtcctggcgcttcgtggcggcggccggagcggggcggccgaagagtggaagccaggccccataaccctccttcgccaggtcattcaccgcgacgaagcgcagggccgcggagttgatgcagtagcgcgtcttcgcgggcgcgggcccgtccccgaagaggtggcccaggtgtgagcccgcggccttcgagcgcacctccacgcgctccatgccctgcgtgctgtcccgcttctcgacgatgcgagcgctgtccaccgggcgagtgaagctgggccagccggtgccggagtcgaacttgtcgcgcgaggagaagaggggctcgccgctcaccacgtcgacgtagaggccctcttcgtggtggttccacaggggattgcggaaggcgggctccgtggctcccttctgcgtcacctcgtaggccagcggggacaaggtgcgccgcaagtcggcgtccgagggcttctcgtagcggcgggtgtcctggatggtggggcctggcgcggcgggcgcggccccgcgggcctcggtgcacgcggacagcacggcgagcgcggcaagggccaggggcatgagccgacgggccagggacgaggaggtggaggcggtgggcatggacgcggtctccggaagttcccgcgagcgcgggtgcttctgtgtgtacgcgcgaggcccccaggtggtttccgaggcggtggcaccgggcctccgcccgccgggcatgcaggcgggcgccccgcgcagatgccccgtgccacacgaaccgcctcgagccgattcctcccggccccggtgcatcgtcacgactcgccgctggccttgtcctcgtcgtccagctcgcgggtgaactcctcgttcgtgagcaggcccttgcgcgccatgatgcgcatcagcgcccagaacttccgctccagctcctcgacgcgatccgggtcttctcgcgcttgtccgaagaggtagtccaggtcgtccagcacgccgcccgcgttcgccacgggggccttgggcttcgcggcgccgccctgtccgcgcttctgcttgctctgctcctcgcgggcgcgaatcagctccgccagggacgtgcgctgcgtcgcctcgccgggcggcagctcctcgccgatgatgacctcctcgtcgtcatcctcttcggacggcggcgccgtggggcgtgtcaccggcggcgcggccttcaccggcttcgcggcgggcctcgcgggcgcggggcggctggcggagggcgaggccaccggcaccttgtggtagtagcggaggatggcgccacgcacggtggacagcggcgccacgcgcgggctgaccttgaggccggtggtgaactcaatctcctccaccgccgtcacgttgagcggatcactcatcgccaccacgagctgtttgcgcccgcccgtgctttccagtgcgacggggaacaagtcgtgctgttcgcagaagcgcgcgcgcagcatgtgcaccgcggcccactccggcgtggtggccgcgaggtccactcgcggcagccccagggcctggctcagcgcgtccgcgagcgtggcctccgtgatggcaccctgcgcgatgagggtggcccccagccgttgtcctgatttccggtgagctgcgagccccgcctcgagctgggcgacgctgatcgcccgctgctccaacaggagctcgccaatgcgcttcctcgccatgaatccggccttaacacgcgcgacgaaacccaggaagcaagcgcggtgtcacatccggaggcacttgggaatacccccgaaaatgcccgcgctgctgcttggaggacggcctgacaagagggggctcagcgcaaaattcctgtgagatttcagcacttaacggcactgcccctaccttgacaccccacacgcccattcctaaagtcggcacaccgttttcaacatccattcctgccgcccaaccgggtggaccgtccgctcggggggacgtcaggtctggaaggtccgctagagcgggccaagctgcctgtggaggcaacactcgatggacctggcgtctgtgacgaacctgaccgtgctggcgaatgtcggcggccctcagcggggcttcttcgaagaaatcgccatgcgctgggaggccggccagtggggtatgtaccccatcgccgcctgcctcatcgtggcactcgccatcatggtcgagcgaagcatcatccttttcggcaaggcctccatcaacaaggaggccttcctgcgtggcctgaagaagcacatctacgcgggtgacctggacaaggccatcaactacgtggctggccagaagtccacgccgctgacgaacgtcatcaaggccggtctgatgaacgttccgaagggcaacgacgaggtccaggccgcgctcgacgaggccagcctccgcgagacgccgaagatcgaggcccgcaccggttacctcgccatgctcggcaacgcggcgatgctcgccggtctgctcggaacggtgtccggtctcatcgcctgcttcgaggccgtggccaacgtgaacccggccgacaaggcggcgattctcgccatcggtatttctgaagccatgaactgcaccggcttcggtctgctcacggccatcccggcgctgatctccttctccgtgctgacgggccgcacgcagagcctcatcaacgacatcaacgagaccagcgtctccgtcctcaacctcatcgtggccaacaaggacaagttcaagaacctgaacgtccccacggcggctcgcgacgaggagtaggaagtccttcgggaacccggagtccgggcgcgctgtcctgtccccacggatgtggggacgcgcggcgcgctcccatcagtctcaccgacgctcactgagcgcggccgaaggagaagaacgccatggccggcggaatggacacaggtggaggcaaaggcggcaagaagtcgctcgacacctccatcaacctcacggcattcatcgacctgatggcggtgaccatcagcttcctcatcctgacggcggtctggacccagattggccggctccaggtttcgcaggcgggtggcccctccacggaggaggagcagcagcaggaagagcagaccaagacggtccagctcaacctgctcatcacgcccacggagctgcggctgaccgcggaccagagcgctttcgatccgattcccctcactaaggatgcgaagggcaagacggacctgaccaagctggtggcgcgcttcaaggaactgaaggcgcagctgccggaccagtccgccatcaccctgcaacctgaagacaaggtccgctacgaggacctggtccgcatcattgacgagtgcatcggcgctgggttgccccaggtgtcggtgtccgcggcgatgggctagccgcccaaggagctcacgacacgtcatggccattcaggttccaggcaagcgatacggcaagcggctccagcactccaaggtgttcgggcacggcgggaccgcgaagaagagcggttactccgacctcctcatcaccccgctggtcgacatgttcatcatcatcgtgctcttcctcatcgcgaacttctccgcgacgggtgaggtgctgatgatgaccaaggacatcgagcttcccgaggcggtcaacgtcaaggaagtggagatgcacccggtggtgatggtctccggtgagcagatcagcgtctccggcaccatcattggccgcgtggaggacttcaccaaggacgagtacctcaacattccgtcgctggaggagaagctccgcgacatgaagaagcagtacgaggacctccactccatggcgcaggacacggccaacaccttcaagggcgacatcaacatccaggcccacaaggacgtggagtactccatcatcaagcgggtgatgttcagctgcgccacggcgggctacaacaacatcaacttcgcggtgattacggcgggtgatgctgaggcggtgaaggccgccagcgccaaggccaccccgtagcttccaggtgattgggccttggggccccgcgacgccctggtcctcgtggccagggcgttttcgtttgtgaagaaggacgcgtcttcatgctgcttcgtgccgtcatcttcgacctcgatggaaccctggtggactcgctgggggacatcgccgatgcgacgaaccatgcgctggcccaccacggtctgcccacccatccggagtccgcgtacctgcgcttcgtgggcagcggtgtccgggagttgattcgccgggcggtgccttcagggcaggacgcgctcatcgagccggtgctggcctcctacaaggcctactacgacgaccacctcttcgaccgcaccgcgcactacccgggcatcccggagatgctgaccgcgctggccgcgcagggcacgaagctggcggtgctcagcaacaagtcagacgacttcgtgaagcgcctggtcgcgcgcctgctgccacaagcctccttcgccgccgtgtacggcgagcggccggagctgccgcgcaagccggacccgacggcggcgctggcgttggcctcggagctgggcgtaccacccgcggcctgcggcttcgtgggggacacgtccatcgacatggacacggcgcgcgcggcggggatgtacggcgtgggcgtggcctggggcttccgcgaggtggacgagctgaaggcccacggcgcgcgcgcggtggccgccaccgcggcggagttgctggcggcgctgcgggatgccaggccttgaacaggaggaagacccgcgcgggcgcactccagtcccgcttcgctgttgagtagagggcggcgaccctgagcggtgtgttgctccggcgacccatgtccccgggcggccgccattcgaaaaacggctgcgtacagtgcggagcccatgcgagctccgatgtgccgccgcccttccgccgcgagacgcgccgtggtcctggccacggcgtgggtactcggttgtgggcgctcgccttccttcggggagcgcgagcccttcatcccccgggacagcgcggaggtcctggcgcgcgtgccggctgtcggtgtggatgcgcgcgcccgcgagcgtgccgcgcttcgcaaggccctggccgggcacgccggacagttggacatggcgctgcgcctggcgcggttggaagtcgaggcaagccgcgtgttgggagagcctcgctacctggggcgcgcacaggcggtgctgcgtccgtggtgggagctggccacgccgccgcttggtgtgcggctggtacgcgccaccttccaccacgcgcggcgcgactttccggcggccttggaggacctggacgcggtggtgaaggaggaccccggcaacgtcgacgcgtggttgctgcgcgcggaggtgttggggattcgaggcgagcatgccgaggcggcccacagctgcgcgaggctcaccgcgttgacttcttcgttgacggtcgcggtgtgcgaggcccgggtacgaagcctcgcgggccattcgcgcaaggcgcacgcgctcctgtcggaggcgctgcggcgcagcgagcgcagtcaggagtcacgcacgcgtgcactggccacgctggcggaggccgccgcgctggcgggggatgccggtctggcggagcgttacttcctccgggcaatctcgctggattcgaaggactacgccgcacgcgcggcctacgcggacctgctgctggacgcgggccgcgcgcgggaggcggccgtcgtggtgatggaccacacgcaggacgaccggttgctcctgcgccacgcgttggcggagaacgcgctccggtcgtctcgcgcgcccgaagtcgcccacgccttgtcccgcaggttcgaggagagccgcctgcggggggacagtctcctcgcgcgcgaggaggcccgcttcgcgctccaggtggagaaggcgccggagaaggcactccggctggcgcaggccgtgtgggcgtcacagcgtgagccatgggacgtgcggctgttgattgaagccgcgctggccgcgggcagaccggaggcggcccggcccgcgctggacttccttcaagcttcgggctgcgaggacccggggctcgtcttcctggccgagcgcgtgcggagtctgctgccatgagccgcgttgccctgctgtcgctcctgctggtctccctgtccgcccaggcgcaaaagccgagcgacagctacctgcgactgaccgaggcggacggccaaggcgtctccggccggtgggacgtgtcgctccaggacctggacgacgtcctcgggttggacgcgggcggagacggcgccatcacctggggcgaggtgctggcgcgcgaggccgacatccggagctatgtgctcggccggctggtgctcgggtcggaaggtgcaccctgtgcgctcgtttcccagggcgggctgcacatcaggcagcactcggacggggcctatgcggtggtggacttcgacgcgcgctgcaccggctccgccgcgcggttggacgtggactacacgctgctgttcgaccacgacccgcttcaccggggcatcgtgcgcgtgggcgcgcgcgagccgctcatcttctccgtgtcccagcacttcgcgcgggtgcacctgcgggacgagtctccctggcgcaccgcggagcgcatgacggtggagggggcgttgcacgtcgtgactcggcccgaccacctgctctttctcttcgcgctgctgctgccctcggtcctgcgccgtgacgtggacgggcggtgggtggccgtctcgggtttcggcacggcgttgtgggacgtggtgaaggtggtgtccgccttcacggtggcgcacgcgctgacgttggtcgccgccacgctgggctgggcatccctgccgccgcgcttcgtgtcgatcgccttcgcgctgggcatcctggtggcggcgctcgacaacgttcgcccgttggggtgggggactcgctggacggtggccttcgtgctggggctgctgcacggcttcggcttcgcgtcggtgctggcggggatggggctgtccgcgggaagcctcgcgctggcgctgctgggcttcaacctgggcgtggagctgggacaggtggccttcgtggccgcgttgctgcccctggctttcgtcttgcgcaaggcgccgctctaccgccgcgcggtcgtcgtgggcggctcggtggccatcgcgctgctggcgtgtctctggttggcggagcgcgccctgggcctgggcgtgtcggttacctgacacgcgggagcgccgtgtgctccgcccgcgtgtcagcggtggggccgcatggccgcgtcagacgactgtgactctgtacttgtccttgtcctccgcccggttgtgggcggtgacagcggcgacgatgtggcacacccagcccaggcacccacccgtgccaatccagaagcctggggtgatgatgagccagaacaggccccgaagcaggtccccgttgtagatctgtcccacgccagggatgagaaaagacagcagggctgcgattgcgggacgcgacatggttcgggtgacctccgtgtcttcccctacgggcgagttccgaagccattgcacttcgcctatcggttcctggacggttgccttccagtcaaccggggggcaggtgcaataccggcggtgccccggctagcatgcccttcatggatacccgccgggtcggcgggcgggtgtcggggggatgggtcatcttcgggctgctccaagccagtgtacgtggagtccgaggccggcatctgctggagatgctggggctggtcgtcgtgtacctcctcgcgggggccctggggctgcaggtggccatcgtgggcaacatcagcccggcctggcctccggcgggggtgtccctggcggcgctgctcgtgctgggggtgtcacgctggcccggcgtcttcgtgggcgcgtcggtcatttcggtcctgggggatgtgcccgttgtggcctcgctcggcgtgggcgtgggcagcacgctggcggccgtgctcggcgtgggccttctgcggtggttgggtttcgacaaggggctggagcggatccgcgatgtcgtcgcgctgtgcgcgggagcgggcgcgctgtgcctgggcgtgagcgcatgggcgggcgtggcgagcctcgtgctgggtgggcggcttccctcaacgtccctggccgcgggcctgcgggtgtggtgggtgggggacttgatgggggtgctcgtggtggcgccgccgttgatgctgttcaagcggtggtcctggccgcggcgaggcggcgaggcggtggtgctcgcggggctcaccaccgtgctgggcggcgccatcttcttcgtgccggacctgccgcacagcgcggcgcacgcggccgccttcctcctcttccccatgtccgcctgggccgcgcttcgcttcggtcctcggggcgcggcggcggccacgctgtgcatcgccgccgcttccatcgtgggcaccgcgcgggggcaggggcccttcgccacggatgacctgacgcaggacttgttggtgttgcagctcttcatcgccgccaacgccgtcactgggctgctgctgcggcggcgcagcactgagcgtcagcgcgccatcggccagctccaactgctgggcacctccgtgcgcagcgtgcacgaaggcgtcctcatcgcgcaggtccgcgcgggaggcgcgctgcgcaccgtgttcgcgaaccaggcgctgtgctcgctcctgggataccggctggaggaactggtgggccaggacccgtgctcgctctatggcgcgcaggagccggagttccgtcagcgcacgcggcagtcactgttcgcgggcgagccggtgttcgcggaggtgaagctggcgcacaagcagggcgacctcgtgtggagcgaggtgctgctgtccccggtgcgggccacgggcgaggacatcacccatttcgtggccacccaccgcgacatttccgcgaccaaggagctccaggcccgcctggtggcggccgaacgtgtggcggcggtggggacgctcgcggccggtgtggggcacgaaatcaacaacccgctggcctacctggtgctgaacctggaggccgccgagcgcggattgagccagggcggcatgtcgggcatgcgcgacgcgatggccaacatgcggggtgcgttggaaggcgccgagcgcatccgcctcatcgtccgggacctccaggtgttcagccgccaggggaaccaggacccggggctggtggacctcaacgcgctggtgccgcccgcggtgcgcatcatcagccacgcgctgcgccaccgcgcgcggttggtggaggagttcggtccggtgccgcgcgtgtcggggagcgaggcgcgcctgggacaggtgctgctcaacctgttggtgaatgcgatgcaggccatcccggagggcaacccatccatgaacgaggtgcgcgtgcgcaccagcacggatgcctccggccgggcccgcgtggacgtggtggacagcggcgcggggattcccgcgcacgtgctgccgcgcatcttcgaggccttctacaccaccaagtccagcggcgagggcacggggctggggctcgccatctgccagcagattgtccgcgcgcacgggggcgagctggaggtccgcagcgagccgggccggggctccgtcttcagtgtgctgttgccgcccgcgcgcgtgcaggcatccacgccgccgcggccgttgccccgcgccagtctgcctcagccctccgcggcccggcggggccgggtgctggtggtggatgatgagccgcgcctcgcgcagtccatgcggctgctgctggagccgttccacgacgtcgtcaccaccacgcggggcagcgaggcgctggcgctggtggacgcgggccaccgcttcgacgtcatcctgtgtgacttgcagatgccggagacggacggcgccgccgtctaccagcatctatgcgcccacgcgccggaccaggccgcgcgggtggtgttcatctccggcggtgcctatacgccggagtcccgcgcgttcatcgacaccgtgcccacccgcgtcttggagaagcccgttcggccggacctgctcatgaccacggtggccgcggccctgacggcagtggacgcgatggggccggagccgcgcgtggatgaggcgtcgcccgtggcggccgttggcggcgtgcggcactgaggcctgcgcgcgctccgggccgcgtgctcacgtggtggcctccacccgcgatagcgcgtcccggatggcggcgcacagcgcggcccgctccgtgaagagcgcggtgacgtgcccggcgtccacccagcgcagctcgcttcggggccagtgcgcgtgcagcgcgagcgtttcatcaccgggcacgaacccgtcacgtcggcaggccaccaggacggccgcttcgggctgcctcggaggcgggaagcgcgcgaggttcgccaggtcgaaaatccgtcccagccgactccgggcctgctccgcgtcgcgccgggggccatccagcaatgcaaaggcaatggaccaggacagcagcccctgcgtgaagacggggacgggagacgctccagccgcgagcgccgccacggcgagcggctccgggacgacggccgccgtcagcgccgccatgtagccgcccatgctgtagcccgccacgcccaggcgcgcatggccctcactccgcagccacgcgagcagcgcgcgggcctcgtcgaccatgcccaggttcatcaagacgtggtcgctgacggtgcgcagcgcgccgcccttctgccccacgggacggcgcaggccgtaataggggttctccagcaggaacaggtcgatgccttcccgcgcgagcggcgcgtacatgcgctctcgcagggagaagccctcctcacgggacgcagcgagcacgacgcaggcgccgcgtgagggcccttgccccgcgctcagccaccggacatgggccgtgcgcgctgccgcgtcgagccgggccagcggagacggaaaggtgccatcccggacctggagaccgcgttggagccggggcgcgctccactcgggcgcgatgggcggaggccgttgctggaacggcgcggccgccgcgacctcttcgaggaactgctcatcaccccagccctgggagaagagccgggcgcggcgggacaggcccgcgaagaggacgtccaccggatgggttcgcagcacccgcgccatcctatgcccccgcccttgacgccgcgacctgtttaatcaaatgattaaatcaatggattcattcaaggggttcttccagtcgctgccccgggtgggagcctggttccgccagggggacgtccagcccgaggaaatccaggtgttctggcggcacatgcagcggtgcttccccacggacgcggtgtgcagtcacacgagccccgcgcggctcttcccgcgcgctggcgtggccccggggcattgtctccacctgcctttcgaggtgggcgtgccccgggccgggtgggacttgtggcgtcaggtggtcgcgtgcacgcacgcggtccagcacgtgctccagttcgaagaggacggcctggaggtgtccctcgcttcttccgccgcgcgtgcccggagtgaggccgaagcgctgcggtgcgacttggagctgcacttctggcgccacggcaccacgccgccgctttggagtctggcctggcggctgcgcgcgcagggctgtcacgcggaggacatcgcgggggcggtgcatgtcctcgctttgtccgccgcatccatccggcagggggccgtggagaacgaggcctcgcacgtggctctccagtggttggaagcgcacgtgccccatttgcggtgggaccgggcgtatcattcccgggcgcgttaggaatgcggctggggggagccgggcttatcactgcaaggtgccccccatgaccgctcaagaacgcatcgagcgtgccgccagcgcgctgaaggtcttccccctcccgtcggcggtgctgttcccgcacaccgtcattccgctgcacatcttcgagccgcgctaccgggccctcgtccgggacgcactcgcgggcgaccgcgtcctggcgctgtcccagctcgagcccggttgggaaggcaactatgggggccggccgcccatgctgcccatgatgtgcgcgggcgtcatcgtctgggacgaacaggtggaggaggggcgctacaacatcctcctccagggcgtgagccgcatccgcatgacgtccgagctgacgacggaaaaggcctaccgggaggtgctcgcggaggtgctgccggacgtgccctacgagggccccgaggaggagcagttgcggcaggccgtcttcgagctggccggccgcgtcccgccgtccttcgcggagaacctgctgccggtggccgcgcgggcccagggcggcatgctcgcggacgtggtggcctccgccgtcatcccggagccggagcggcggcaggaactgctggcggagctggacgtgcgcaagcgcctggaaggcgtgctggaggacgtgggggcgctcatcggcaggctccagcccctgcggcccaccggccccttgaactgagcgggttgcgcttgccttgtccggcgggccgcgcattgctgcgcgccggacgcgtcatcgaaagggacgggagcaaccatgcggctcgtgaagctcgggcttgccagtgtgaacaccaccgtggggtccttcacccggaacacggacaaggcgctggcgttggcggggaagatggcggcggagggcgtcacgctgggcgtcttccaggagcagctcatcgcgggctacccggccgaggacatggtgcagtggcagggcttcatggaccgccagtggccggagctggagcggttcgcgcgtgagacggcgcccttgcccaccgtcttcgtggtgggcgtgggcgtggcccatcagggcctgcgcctcaactgcgcggcggtggtggccggtggccgcatcctgggcctggtccccaaggagaagctgcccacctacagcgtcttctacgaggcgcgcaccttcggccgcggtcagccgggcatggcggaggtccaccggggcgtgccgctgggggactacctgttccacttcgacttcggcgtggtggccccggaggtgtgcgaggacatctggagcgcggacggccccatgcggcggcgcacgtactccggcgcggagctggtggtgaacctgtccgcgtcgcccttccggctgggcttcgtggagacgcggcgcgagctcatcgccacccgcgcggcggaccaccagtgcaccattgcctacagcaacgcggtgggcagcaacgacggcctcatcttcgacggcggcggcttcctcaaccagaacggccgccacgtcatggagacgccgcgcttccaggaaggctacacggcggcggtggtggacctggaccgcaccctgcgcctgcgcgccgaggccaccacctggcgcgtggaccgcgagtcatggctggcgcaaggcggccaggcggtgccggtgctggactgcacacaggtggtgcatacgaagcgcgacgcgctgacgttcccggtgcctccccaccgcagcttcttcctgccgtctccggacacgcgccgcaccgcgcgggatgcgctgtgcgaggacatcctcgacgcgctctccctgggcgtgggcgactacttcgagaagacgcgcgccttcaaggtgctgggcatcgcgctgtcggggggacgggactcgctgctgacgctgctcatcgcgcaccgctacgcgaagcgcgcgcggccggagaaccccggttcgctcatccaggcgttctacatgcccagccgttactccagcgacgccacgcgcgacgcggcggagacgattgcgcgcgagctgggcgtggccttccaggtggtgtccatcgacgaggccttcgagcgcgagcgcgccgtcgcgaagacgatgctgggtggcaaggacgtcacgccgattaccgagcagaacatccaggcccgcctgcgcgcccagcgcatgtggaactggagcaactcctgcggcggactcttcctgcagacgggcaacatgagcgagaagtccgtgggctacaccaccatcgggggtgacctcatgggcgcgctggccgtcatcgccaacgtcccgaagacggtggtgatgtacctgcttgactacctccaggacaccacgggctacgagggcatccgcaaggtgctcgccaagcccgcggggccggagctggcgcatgaccaggtgggcgaagaggagttgatgcccttccccatcctcgacgcctgcttctacctgtacggcagtgagaagctgacgcccgccgaaatcctccaggcgctcaccgccatgttcccggaggtgccgtcatcccgcctgagcggctacgtggagaagttcgtccgcctcttccagcagtctatctacaagtgggtgcagtcaccgctgtcgctccacatcggcaacctggacctggaccgggagcgcgcgttgcaactgcccgtcgtcaccggcacggagtggatgcggcaggggtagcacgctgccatccgctgcccgcatcgcgcaggtgtgggcagtcctccacgcccggtggcctgctccccgggcaattacccccaggtgtgagtgccgcctccgcgccttgccggacgtcgcgcgggaaacaaccttcatgtctgccactcgacgacggaggcatggatgaaagcgaagattctggcgggcgccgttgcggcgctcatgtacggaggcgttgctgttgccgatgacggcgactgcccgccaccgcaggccagcaccagccagagccagcagggcacgatggtggcccaggcacagcaggaagacccgggcggtgatgacctgctgcaggaggacgacaccatcatcctggagacggagcccgttcccggcgtctccggtcagcagtcgcaggacagcatgggcatgggcggcagtggccaggagggcatggacgacgcggccctcggcggcagcggccagcagccctcgaacgcgcagggcgaggtctacatgaacgtgcccgtccgctgcgagccggtgggccagcagggcatgggcggaagcggccgggagtccatgacgccgcctcccgccgcgccccagggcacgcatgacagcgagcagctcgtggtgccgccggcgccgccgttgggcacgggcggcagcgggcagccttcctcggagcctgtctacccggagccggagtccgcgtacccgcccccgaagggcggcacgggcggtagcggcatcgccacgacgccgcctccctccaacttccagccgtcggccgagcgcgccgagccgatgaaggtggagaagcacgaggacaagaacaaaatcaaaggcctctcggtgatgctgggcggtggtgtggagggctacaccggcgcgctggctccgcagctcagccccggtgccaccgcgggcgttcgcgcgtccatcaagccgtccaaggtgctgggcctcgagctgggctacacgggcgcgctgaacaacatccgccgcggggagacgggcgcgagcgggccggacctcgtgcgtaacggtggtcaggccgtcctgacgctgggcatcacccccacggcgtggcagccgtacctgctggggg

SEQ ID NO: 1214 - DNA, 22807 bp, Myxococcus xanthus
gtcacgcccgcggcctggaggaacagcaccagctgtccccagcccatgcgcgccgtctgcgtgggcgccagcacctcgcgggactgcgcgtccgtccagtcgaccatgcgctgctgctcggcgttgtcgatgccccagcgctggaagatggcgcgcagctcgcccgagcgagcgatgttccccagcgccgtgtccagcgcctcccgcaggtcctcctcaccgggccgcacggcgatggcgtagtagccttcccccacgtcgcccaccacccggagccctggacgtggctgcccgtagcgttgcgcgatgatgtcgtccatcaacacggcgcgcacccgcccctgctccaggtcgatgtagggctcctccacgccttcgtaaggaaccgcctccacgccgctgcgctggagcaggtcccacgccagggaattggccagcgtccccacccgctggcccttcagcgcatccagcccggtgatggccgcatcgtcccgccgcgccagcaagcgcaggtggaagacgtagtagggccgcgtgaagaggatgcgcccggagcgcgacggcgtgacttcgaggccgttgagcgccacgtcgaacgagccgcgctccaacgaggggaccaggctggaccagtcgttctggacgaaccgggcccgaacccccagctcacgcgccagggcctccgccagttccacctcgaagcctcgcatgcccccgggtgcgtccgggtcctccatggcgtagggctctccaccctgggcatccgcgccccaacgcagctcccccgtgcggcgcacccgcgccagtcccgagtcctgttccgcgccacacgagctcagcagcgccagcagcaccagcacgcagggcaggaggaatgaaggcctgattgcctgggacagtgacgggctccttctggcgcgtgtgaggcccccgccatatgccaggagccgccccaccgccagtcgctcctgacagcgccgccccacactggtaggccggtgaccctgagcggcattccgccggctccaggacctggagatttcgatgccgtggtgggtctatgcactgctctccgcgggcttcgcggcgctgacggcggtgctggcgaagatgggcgtggaaggcattccttccacgctcgccaccgccatccgcactgtcgtgattctggtgttcgcctggagcatctccctggcgcgcggggagcatcacgccctgcctgccatcagccgcaagacgctcctcttcctggtgctctccggcgtggcgacgggcctttcgtggctggcctacttccgcgcgctccagctcgggcccgcctcccgcgtggcgcccctggacaagctcagcttgccgctcaccctcgtggtggagttcctcatcctccacgaacccctcacctggcgcatgggtgtgggcgtaacgctcatggccgtgggtgcattgctgacgttgaaatgaaccccgggcgcaatgggatgaagcaatcccacccaccctgtcgcaggtgcgagcatgacccggcattcattttccagactctgggattttccgtaggtgcccggtctagagtgcgcgcccgaggagcgacgttgtcatggatgcgttcaaggttctggtggtcgacgatgagcagcccatcgcacgcgcgctgcagcgtctgttgaagcgagagggattcgaggtccagattgccttcaatggcaacgaggcgctggagcggctggaagggttcagcccggacatcgtcctgacggatttccggatgccaggaatgacgggcagcgagctgctccagcgcctcaaacgcagccatccgctggccctgcgcctcatcatttccggctatgcggacttcaagtccgtggtggcatccgtgaacgagggcgaaatctgccggttcatcagcaagccctgggacgacgcggagctggtgacgtacctcaagggcctgctgcggcaccgcgagacgatggcgtgcctctacgcccccttccggcaagcgccggacggcgtgaacgcggaggtgggcatgtcggccgcgtccatggtgctcaaggtccaggtggctgacccgtccttcccggcggaccaggccgttgcgctcatcgagcgcttcgcgggcctgctggccgacgaccgcctcaaggtggtgggcggattgctcgagcgctacggcgggcgcctgtccttcatggcggacgtcggtggcccccagcggctccggctggaggtgccgatgcccaccctggaaaccgtcaacgccctccgccctggcgcgagcgacgcctgacggaaacacactccaccccacacccaggcacaccctcggccgataacgcactgcgccgtccgatttcaccgaagggaatttccccggcccgttctcaccgtgcgcagggagcagcccaccggtggaacgacacgagagcaggacaactgagagccccgccgcgccgggcgatgggtaccgccgtcaattcgacgcgttcgcgcgagcacggcgtccggcgttggttcgaatcgcccggcgattgtgctcgggtggagccatcgacccggaggacctggtgcaggagacgctggagcgcgcctaccgccacttcgacaagctgatggcggagaacgcgggggcggtgagcgtctggttgagcaccacgatgagcaaccgcttcctggaccactgccggcggcggcgcaccgaggtcatgggtgcgcccatgctgcgcctggtgcaggacctggacgccgaaggcgaaacggcgccccaggagcggtgggagcgcgtgtctcgcgacgagttccagcgggccatcgaccagttgcgcccgccgcacctgcgggacgcctaccggctgcacgtcgcggggttgcggtatcgggccattgcccagcaactccgctcgacggaagggacggtgggccggtggctcacggaagcgcggcaggcgctgcgcgagctgctgggcggcaaggacgcctcgcacgaaggcatggctgaatcatgagcagcgtctgcgacaacctggaacgtttcgtcgacggggagatgctccccgcggacgcggagaacttccgccaccacctggcccgctgcgcggcgtgcgagtcgcggatgaaggagctggtcgccctggagctgctcgcggacgacgcgctgaacagcccggggacggagcgcctcggcgcgacttcgccctggcggaacaagtcctggctcatggtggtgccgctcgcgctcgccgcgggcctggccgcgctcgtgctggtcccccggacgcagcccaccgactccgcccccgagctctggctggcggaagcggccacccggcccctggaagtccgcctcacccatcccggcgcggacggacaccggccctaccaggtgatgcgcagcggcgcgggcgcccggccccaggcactggcgctgcgcgagctggcccggctggaggaagcggcggaccaccggggcatcgcctcggccttcctgctgcgcggtgacatggcccaggcctccgcgttcctcgacaagctgcccgcctccgccgacctggacacggaccgcgcggccctggcgctccaacaggatgaaccggagaaggcgctcgtcctgctggagcgcgcgctgaagcggaagcctcgccatgcccaggcgctctggaaccaggcgctggcgctccagcggctcggcctgtcactgcgcgccgcggagtccttcgaacaggtggcgcggctcggagagcgcggttggagcgacgaagccgcccagcgcgcccaggcgctgcgaaacgcggcggagcaggagcggcaggactggaagggcatgcgtcaggactgccaacgcatggtggacgggggggcgccgctctccaccgcgcaggcggaggccctgccgggcatggcgcgcgtgtgcctctacaacgccctgcgtgcggcggcctcgcccgagcgcgtggagtccctgcatcccctggcggtggtgctggaccgcaaggaggacggcacgcacctggaagatgccctgcgccgcaccgcgcggcgggatttctccgcgcgcgtgcccctggccagtgagtacgcgcgcctcacccggggcgagctgaagggccccgccctggagtccttcctgtcgcggctgcgcgaggcccggcaggaggacctgctgctgggcgcgctcgcctatgcggacccgcgccagttcccagacgagtaccgggcgctcgcgttggacacgaaggacccgtggttcgcgctgctggccgaggagcggcaggcccggacggacgcactggcggatgccccgcagcgcgcgcgggagcggctccaggccgcggtgaagacgtgcacggcctccgggaagcaactgtaccggtgcatgttgatgcagcgggagctgggactggtgatggcgcggctgcatcgccccgtcgatgcacgcgcccgcttcgtgggcgcactgcgcgccgcgcgcgacagccgggagtggggttctcagcggaacctgctccaggacctgggacaggtggcccggacgcagggagacctggtgctggcccgggcctatgtggaggagctgctgctccagacgcccgagggctgcgcggactccgaggtggcgctcaccagcctggcgctcgcgcaccaccgcgcgctggatgtcgcgggcgcccgggagctgctcgaccgggccatccagtgcagtcagaagccctccatggcgcggctggccctgctggccgacctggcccgcacgcccttccgcaagccggaggacgcgcggttgctggagcagggcctgggggcgctgcgcgattcgggcgcgcaggacgcgggggacctcgcgctgctgcgccacatcgagggccgcttctacctggagcaggacgcgcacaaggggcaggcgctgttgcggcaggcgctggccgacgcctccaggttgccagcggcgaacgtgagcgcgcgcaaggcccgcgtctacagctacacgtcactcatcctcgacgcgggccgaacgggcgagctggcgcaggggctggccctcttcgccgaggagcacgccatgcccgcgccggagcgctgcgtgctgggcgtcacggtggacgacgagcggaccttcgtcgtggcccgggacgcggagggacgcctcctgggccaccacgacacgggaaggacggcgccgttggagggcgtcgaaggcctggtgcccggcgcggtgatgaaggcccttcgcgcctgccccagcgtggacatcctcgcgcggccgccagtgcaggggcgcgcggggctgctgccgtccgacatcgcctggtcctaccgggtgggcggcctgcccgatacgccgccgtcccaagcgaaggcccagcggctcatcgtgacagacgtgctggcgcccgcgtcgctgcacctgcccacgctgcgcgcgtggaacccggccagcgacgcgggcgaaggactcaccctgctccgcggcgccgaggccacgccgccgcgcgtcctcgccgccatgcgggatgccaccgaggtgcaggtccacgcgcacggcatcatcgacccgtccgtggcggatgcctccgtcctcgtgctttcaccggaggccacgggtggccgcttcgcgctcaccacgggcgacctgaagggacagcggctgcgaggccggccggtggtgctgctcgcggcctgctacgcgggccataccagcgcgtacctgcatgagaacttcggactgccgctggccttcatcgaatccggagcgcgggccgtcctcgccgccacgcaggagattcccgacgacgaagcgcacgccttcttcgagcccgtcctcgcccggattcgcgatggcgtccccgcggccgtggccctgcgtgacgaacgtcaggcatggttgcgacgcaacgccagcgcctgggtccagcaggtactcctcttcgagtaatcccctccccttccatcgagtgagttcatccccatgaagaagtacctcctccccctcgcgtgtctgttcctggcctcggcctgccggcacttgggcaacacgccggactggcccccctcggaggacattcccccgggcacctatgtcctcatcaccctgcaagacgcccacagtccccaacggcgttccacctacgtggtggacccgcgcacgggcaccgtggtggagcgacgggatggcaagcgtgcatacgcggtcgcggacccccagtcgctcgacaccgagtccacgggcgaggccgcgcaggccgccctcgcgcccaccagccgcgtcaccgtcgccatgtccgtcaattgccgtgacaccctgacgttgccggatggctgcgtggacctggccatcgaccccaagcatgagacgtccggggacccgaaccccatcaaggatgagaagcagcgcatcgccatcacggagcgctacgtgaagcaactggccgtgaacgtcctgcagacggcgcgccgcactggtgtccaggtgcatgtgcccgcgctcaagcgcccggcgaagtaacggcccgcgtgggcctaccgcgcgtccgcccccgaggctccctcgggggatggagccgccggcacgagcccgctcagcgtctccacgtaggtggcggccacgcggaggaagcgcgcgcccttcacaccggtgaggtactgccgcttcatcgcgcgcgtcgcgcccacatagaacatggcgcggcggatgcgctcgttctcccgggtcgagcgctcgcgggcaccggccatccactgctccgcggtgtccagcgcatccaggcccgcgaagaagacgatggggcattcgtgccccttgcaggagaacaccgtggtggcgcgcacgtggtccacgccgctgacgcggaagtccgtcacgttgcgcccacccttgcctccgtaggcctccgcgggcacgcccgcgcgctggagcgcctccgtgtactgggagggcatgacgggggccaccacgaggatgtcactggggtggacgccctcctcgcggatgaggcgggccacctcgcgagccacctgccgcgcctcactggcgctggatgcgaagccgcgcacctggggcagcacgccgccgcgctcggtggactgcacgcggaagaggccctccagcgtctcctccggaagccagacgagcccctcgcgcgccagctcgcccaccttcatgtattcgcgcatgccgggctcggccgcggcgtgctggcgcatcgggtccagcaccacgttgaaggcgacgtcgaggatgtcccgggtggcgcggaacgtctccttgaggacgcgggtgcggccgcggaacgacagcccctcgggcagctgctccttgagcgcgtcgatgggcacctggccgtagacgttctgcgagtcgtccatgaagagctggaagcagcgcacctctcgtccgtccggcaacgtgtccggacgcaccagcgcatggagcatggccagcgccttggcgtccatgtcctgggcctcgtccacgaagacgccgtcgaacgattcgggggcatggcggcgcagcgcccccacgtgccgcaccgtcacccgtgcgcgcagctcacgcactcgcaggcggcccgcgcgctgggccaacgcctccaccaacaacttgtccaccagcggggccagcgcccggttgaagaaggacaccagcacctgcgcctcggagtgctccagcaggtagcgcgccacccagtgcgccaacacgtacgtcttgccgctgcccgccacgccgcgcaccaggtggtgcccgtcgtcgaagcggcgctcgaagagggacacctgctcgtgtgtgaagaggggcttgccgggccgcgcgcccgagatttccgcgcccaggtccaccggcaccggcgggggtggcggcggcggcgcgcgctgcggcatgggcaatggctccaggcgcaacggctcaccggggtgcacgcgaaggcgcggcagcagcgacaagaagcgctggggaatggtggcggcgcgcgcctcgtcgcgggaggccagcaccagcaggtagtccttcgcgcggctggcggccacgttgagcatgggcaccagcgtgtgaggcggaaagggcctgcctccagcgacggtgtccaccagcaccacgtcgtactgggtgccctgctggcgatggatggtggacgcgctgaagacgtccccgcgcaggcccgcggcattgcccagccggcgaagcagcgcggcctgcgcgcggtagggcgtgacacacaagacgctgaggccagagcgcaccgcctcgcgcgccagggacacggcgaggttggcggacagctcgcgctggtagccggagcccgtctccccgcggccgtgcgtgaggcgctttgaatctcgcgtgaggccgtccagcaccacccagcccgcgcgcaccgaagggaacgcggccaccggagcgggccgctccgcgcgctgcttgacgacgtcgccgtcctccagcgcgccgccgtagcagaagtggctcaccaccttcgcgatgtccgggtgcatgcggtgctgggtgcgcagcaacaacacatccgcgcgcgccgcgtccttcaccgcgtcttccaggtgcgacagcccgctgccgcgaagccacttctgcgtgcccttgcccgcgccctccgcggcgcggctcaccgggccaatctgcttcgggtcaccggccagcgtcacccgctccgccagcggccccatcaacgcggtggccgcgcgggtcaccatgccggcctcgtccaccaccagccgcgcgaagtgccgctttccctccagctccgacaccagccgcaacgcgcggtgcacggtgaccaccaccagcgggcagtcccccttctccacttccttgagcgtggggtccttcaccttgccgcgcaatccgcgcagctccgcctggagcttggccagctcatgggcggggccgcctcgcacccgctggaggatgagctcccgctcccgctcctcgatgctggcgcgcagcttgccgcccttggtgtcctccagcatgacggtgggcagcttcaccaacgcctcgctcgcgccggtgccgccacggaagatgctgcgcgccaggggccgcagcggaatgggctcgcgctccagcagcgcgctgacgcggaggaccagttcgtccgcggcgcggttggtgggcgccaccgcgaggatgcgctcccccgggaaggctcgcagcgcccgcgcgatgaggtccgccacggccgtcgtcttgcccgtaccgggaggtccccagatgcagccccagggctggcgccacagcctatcggccggaatcagggcctcatcctgaggtgtcagcgtgacggcaggcgcctccccacaggcgcggcgcagggactcggagagggcatcctgccgctcttcgtaagcagaggccactgcgcacagggcctcggcgaagtcatagggccggtagcaccagcggtccgcggacagcgcgcggcggtccacgtcatccccgtggctgggcgcggcgaacacacgccccgattcgaagtccaggtggacgacgtctccgccgaagacgcactcctcccccaggaagccgagcaccgaacctcccgaccagtccgggtccgccgccggacgcgggatgagcgacagcacccctggcccctggaggctgacctcgcgcacgtcctgtagcaactgcgcgcggtactggctgcgctcggacaggagcgcctcccgcaggtcctcgggcagatacgcgggcggagcccagagctcacggcgcttcccggtggccaccgcggcgcgcatcgcctcgcgctccgcggggctgacgtcctctggcgcggagacatcgcgcgacggaacgtcctctccgccttcccgtcctcgcgccatccgcgagacgagcagcaacggattcggcgcccgggccacgtccgccttcgcgtcggtgggctcgggggcgtggggcggctccacacgcaccgcgttctcggtgcgccgcagcgccacgtcctcctcacgtggaggctcgggtgcctggaacgtgttgcgccagcgcggcactgcccccacccgctggggcggagcggcttcgggcggcggcgcatcgtcgtattcgacatgcagctcacgcgtggacgcaggcgcctgcgagcccccgtctccgggctccgccgcctcgcccgcacgtcccgcctccggcccccgcatcatcggacgcgcggcctccacaccccgccgcgcaccggccctgggccaccggtgccacgcggggccgttacatccggcagggctggagaagacgctgcggctgccatggcgaacactcgcaaaacctacacttcatgacctgcccacccgaacaggtcgccacatgtaagaggccggccaaggtaggggaggcttggatcgccgtcaatgcgccacacccagggtgcatgcgcggtgggtaggaaggcaggccgccccggtgtacaccctctccagccgggcttgcttccacgtcctcccgatgttctgggtggaagccccctgcccctcaccgacatggcccattcgacgcgctacgcccatcccttcctgcccaccacccgcgccgacatgcaggcgcgcggctgggagcagtgcgacatcatcatcgtgacgggggacgcgtacgtggaccacccggccttcgggccggtgctcatcgcgcgcttcctggaggggcgcggcttcaaggtgggcctcctcccccagccggactggcactcggccgagcccttcaaggcgctggggccgccgcgcctgttcttcggcgtggccgcgggcaacctggactcgatgctcaaccggctgacggcccagaagaagaaccgctcggaagaccagtacagccccggcgggcagacgaactgccggccggaccgggccaccatcgtctacgcgcagcgctgccgtgaggcctaccccgacgtccccatcatcctgggtggcatcgaggccagcctccgccgcatcgcccacttcgactactggagcgagaaggtgcgccgctccatcctcttcgacgccaaggcggacctgctcgtcttcggcatgggcgagcgccccatcatggaagtggcggaccgcatgcgccagggtgagcgcatccaggacatccgcgacgtgcgcggcaccgcgtacaccatcaacgacgaggagatgcgcgccctggaggcggacccggccagacgcgccgcggaccgcaagacggtggtgctgccgtcctacgagcaggtcatcgaggacaagcacgccttcgcggtgatgagccgcgacttccagatggagaccaacccgggcaacgcgcgtccgctggcgcagcgccacggcaaccgcgccatctacatgaactcgcccgcgctcccgctggaggacggcgtgggcaccgcgggcgccgaaggcaagtccgtggccatggacgagctttatgacctgcccttcaaccgcgtgccgcacccgatgtaccgggagcgcatccccgcctacgagacggtgaagcactccatcgtcctcatgcgcgggtgcttcggcggctgcaccttctgctccatcaccgagcacgagggccgcgtcatccagagccgctccgcggagagcgtgctgcgcgaggtccgcgccctgcgccgcatgggcgacttccggggcaccatcaccgacctgggtggccccaccgccaacatgtacaagctcaagtgcaagagcgaggacatcgagaagcggtgccgcaagctgtcctgcgtccacccgggcgtgtgtgagaacctccagacggaccacggccccctcatcagcctcatgcaggacgtgcgcaaggaggacggcgtcaagcacgtcttcatcgccagcggcgtgcggtacgacctggcggagcgctcgccggagtacgtgaaggagctggccgcgcaccacgtgggtgggcagttgtccgtggcgccggagcacgtctccccgcgcgtgctggagaagatgaagaagcccggcatcgagagcttcgagcgcttccagcagatgttcgcgtgcgccagcgaagaggccggcaaggagcagtacgacatcccctacttcatcagcggccacccgggctccacgctggaggacatggtggagctggcgctgtggctgaagcagaacggcaagcggccccggcaggtgcaggacttcatccccacccccatggccatggccaccgccatgtacttcacgggcctggacccgctgaagatggagcccgtctacacggcccagggcctgcgcgagaagcggctccagaaggcgctgctgctctactggaacccggagcagtggccactggcgcgcgaggcgctgaagctggccggccgcgaggacctcatcggtcgcgggccccacgcgctcgtcccgccggagtcccccggggaggccgcgcgccggcagcgtaccgagcgcgacaccggcgctggtgcttccgcgccgcgtcacgaggccgcgccccggctcggaccgcatggaaccgcacgtccccgggcgcgccgtcccggtgggcctcgcgcccgctgagccccctgggacatgggggcccgaacgcgcggtttgaataaaccgccgcgattttcgtcgggcctcccaccatgctcagcctcctttccgcgttgtggctcgccacggctcccgtgacgacctcggaacagcccgtggtccgccccccgcctccgcagtgtgtgttctcccagggacgctcggtgtgcggctaccagtgcaagacgaccggaacacaaacagcctgtgcccggacgccctacggcatctgtgaggtcctggtgggaggcgtgcactgttgggacccgcccctggtcgccatccagcacccgcccaccacgagcgcgaagccagagtgcaaggagagccggggccaggtggcctgcggctacaactgccgtcagttcaacggcgaggtggcctgcaaccggacgccctacggcgtctgctccacgaacttcaacaagctgacctgttgggacccgccggacgccgtcatccaccagtacggcgcggagacgcccgcgccccgctgcctcaacgcctccgaggacatggcctgcggctatgactgcaaggccacgcgcaccgaggtgcagtgcgccaacacgccggacggcgtgtgccggctcgacaaccagcgcttcacctgcttcgacccgccgtcgttgctgcactgcgaccacagcgcgcccccgccgccccggcactgagaccacacgtccagcgcgtgtgactcggcacgcgcgtcatgcccgcgaaggggaggcccaagcccccctttgcggtgctacacggctccggatagggtgcgccgcctttcgcgacatcgcgacacacccaggagcacgaagacgatggccaggacgacccaggagcagacccaggagcgccacgcgtttctgctcgagctcttccgccagcagccggacatcagcagcaaggaggcgctggagtccttcaaggataagtttggcggcaccatcaacatgaagacgttcaaccagctccgcgagcaggccgaggacgaagccgcgtcggccgcagccgccgcgcccgcccccgccccggaagtggagcccgagcccgagcccgagcccgagcccgaggagaccgaggcgacggtggacgacgccgcctcccgcctgaaggccgccgcggcccccgaggccatcaacggcgcggccggcgcccccgccaagaaggccaaggcgaagggcaacggcccgaagaacatcttcgtggacgcgcccaaggagcacctcaccttcctggagggcatcatccagcagttccaggaggccggcgccgccaacatccgcatcgaccacgccacggaccggtggatggtcgtcgtggtggactcgaagtagcaggaccgtcccgggccaggcggagtgcccgcctggctgggagacgcgccgtcagcgctcggcggacggcgccagcatctccagaggaagcagcgcggaacgggacaggcggctcacctccagcgccgggcccgctccactcacgcgcgccccctggaatcccgtggcgtcagcggcgccctcttcccacgccacgaaccaggccgtcccgtcccacaccaccacgggcgcgcgtgacgtcgccccggcgggcaacacgacgggcacatcgagcaactgtccatccaagctcacccgagcggccagcatgcccggcgtgccggagagattctcactccagaccgccagatagccatcggtgccccgcgcggcggcgaccggaggcttgtggccccacgggcgcgtgaggcgcagcgccggcctgtccttcaccacatcatcgtgcgtcacacgggtcgccaggatttcgtgcgggccgaattcatccgtgcctgtcgtcgtgcccgcgtaggtgacgaggaacttgtggtctccggccgccacggcgggcgcgatctcctgctggaagtcccccgtggagatggtgaagcccgacttcgagcccaggatgcttccgttgtcccccacccggacaccgcgcacgcggtggataccctgccgggtggcatcccagacgacgagcgacttgttgccactgggcgccacccgaggcgccgtctgctcgtccgcgcccgtggcgattccgaaggccgcgggcccgtccaacgcgaggttctttcggaaacgggcgccgtagatatcagcggtgtcgttcttgtcgtcctgccacacgacgaagaagtggttgcccgtccacgtcacgtcggggacggtttgagcaccctcacggacgacgagcgggacaccgccagccccatccagccggatgccgtctttcgtcacccggttcccgaagatgtccggcgtgaggactccaccgcgctggtcgctccagacgaccaggaactgttttccatcaaaggccacggccggcttgatggccatgttggaggcggagacggagagctgcgtgcgctcggacacgtctccgtcagacgtcacacggatggcgttgatgatgctctccacatcgccgatgaaggggaaggcgagcagacacagcttgtgtgcgcaggcgatgcctggaggccctcccacctcatcggagccgaagacgacgaaccggcggcgcacatccccgtcgcgctccacatgggcggcaaccagaccggaagcgctgacccaggtgaccaggaagaactttccgtcccaggccactcgaggctgcccgccatcaaacccgctgcccgcgttgatgggaaagccccccgggtccagcaccttccccttgggtgtcacccgcgcgccgaagacgcccccctcgcgttcgtcctgccagacgaccaggaactgttttccatcaaaggccacgccttctcccggacgtcccgtgggcggacgcttcccgatgctccctcccatctcggacaggccggcgcggccgtccaacgcctgccagacctcctccggcacgccttcgggcgcgtcgtccaagggcacaccgcaggcgcccaacagcactcccagcaacacgccaccccaccgcgccatccgcacgggcttccacttcccctgacgcatacgttgctcccctctggttcgacaggcggcaacgtcaggcgcgcgaggtgacgcaacaatccgcccggtggggagggaaacgcatccgtcacggcgccctatccatcccatcgggtccctcccgggacgtccctcgctcctgcggttgtcaccggcccaccacctcaccaacccgggagtggtccacgaggcctgccttgtggatgaatggcgcgcgtgatgcgcacgctcctcatcgcctccgtcctgctggtcgccaccgcctgctcgcgcgccagcaccacgcgtcctgattccgccgtggagcagcctggcgtccaggcgccgcttcccaacgagtggtcctctcctctgcaccgagagcatccgctcacgggccgcatctgggacgtgaaggcggcccgcttcgtggacgcggacaccatgcgccgctcgctcgcccaggcccgcttcgtggtgctgggagagcggcatgaccagcccgaccaccaccagctccaggcgtggctcgtccaggccctgaccgagggaggccggaagcccgcgctcgccttcgagatgctcgacgtggggcaacaggcggcggtggacgcgtcactggcccaggccccgcgggacgcggaggcgctcgcgctcgcggtcaactgggcgggcagtggctggccagactgggccctgtatcggccagtgttcgcggccgggctcgaggcggggcttcccatcgtcgccgccaacctgccgcgctcgcaggtgcgcgacctggtgatgcgaggtccggaggcccttgctcccgagctgcgccagcgactgtccttggacacgccgctgcctgagccggtggagcaggcgatgcgcctggagcaggacgaggtgcactgcggtcatctacccaaggagatgctcggccccatggtgcaggcccagcgtgcacgggacgcgcacctggcggaccggctgtcgaacgcggacaccggccagggtggcgtgctcatcaccggcaacggccatgcacggacggaccggggcgttcccgcgcagctcgcggcgcgtgtgcccggcaaggacgtgcgctccgtggggctgctggaagtcgccccggcgctgcgcgcgcctgcggactacgcggcctctttcggcacgcaatcccttcccttcgactacgtctggttcacgccggcgatgcccatggaggacccgtgcgcggcgctcctcaagcgccccaagaagtagcgtccggggcgcgtggcgtgacatgaccaacacgtctgggattcgccggacatcgcgggcggcaacctgttgctccaggtgcgcttccaaggacgaccgcgctcacccaccacgcagcaccgtgagcgcgcgctggaagtcctcgggcaatggcgcctcgacgcggacgggctgccccgtagcagggctcggaagctccaaggtgaaggcatgcagcgcctgccggcccaacgcccgcgccgcggcatgcgcgcgtgcctccggcggaccgtagagtgaatccgccagcacggggaaccccgcctcggagagctgcacgcgaacctggtgcgtgcggcccgtgtccaggtcgacctccagcaacgcggcatccgcgaagcgctcgcgaacctcgaaggagagcgccgcgcgacgcgcggagggcacgcgggtggtgaagcgccgagggtccgccgggtctcgagcatagggcccctccaaacggccctgggcgggcggctgtcccaacaccagcgtccagtagcgcttgtccacacgcttctcctggaaggagcgcagaagcgcggcggcggccgtatccgtgcgtgcgaaggccaggcagccactcgtctcccggtccaggcggtgcaccacccctggctgggccaggccctccacatcgaagggcggccgctgcgcggcgagcaaccccaccacggaggccgcgcgcccttccggctccaccacgatgcccggaggcttgttcacgatgaccagggccgaatcgtcatgaagcacaggcagcaccggcccttcagaagcggccaccgacgcagcgcgaggctcgggcctttcgagctcaatctcctcgccgccccacagcttccgcgtgggctggcacctcttgccccggatgcgaaccgctcccgaatcaatcagggcacgggcccgctccaggttgatgcctgggacctgcttcgacaggaagcggtcgagccgctcaccggcggcctcacgaggaacctggaccttctgctgtgccatgcgcttcccgtccctcaacgcggggggcgagtcaacggccttgggcgccgtccccgccacgccacacgggagcatggcttgcggacgacgaggacggcccggaagatggcgaagaatcgacccggcccggccccgtgaatccgacctgccccacatgtcatacgccccaccctggtgccgaggcaggtccgcgacgcacctgcgccgcctgcggtgcggacctcacgcccggcgcgcaggcgcgaagcacaccgccggagccggacctcacgggtgaatccctggcgggcttccagctgaactcccgcctgggcaccgacgccacgggctcactgtacgcagcggaaggccatgtgggtccatgcgtggtgaaggtgatgtcttcctcggtgacagcggatgcggaggcgcgagcacgcttccaccgggaagcggagacactgcgaagcctccgccacccaggtattgtccgcgtcctcgcggtgggcgaggagcgcggccactgctggtacgccctggagcccgtgattgcgcccgccctggaggcgagactggaccgggcgaacgcactgcccttccaagaggtggagcaactggcgctgcggctgctcgatgcgctcggcgccgcgcacgacacagggcttgtccacggggacgtgcggccccagaacatcctgctcgcgaaggacggcgcgatgctgacgaacttcggcctgtcgctcgtgcctcccggtgcccatggctaccaggcccccgagcaacgacaatggggccgcgccgtcccgcagtcggacctgcatgcgctggggcgcgtcctgcacgaggcgctcacgggaggcatgccggagacgcagccactcccccagggcgtgccccggcacctgcgccggttgctgaaaagcctgctctcggaagccatccaggaccgccccgacagcgccatctccgcgcggcgactgctgacccagcgtgcgccgctgggccctttggccgtgggcatcgcagcgctgctggcgatgctgatgttcctgctgctgcgtgcggcgtgagcgcctcccgctcagaggccctggagctggacaccggacatgcggtgcttgggcttgcggcggatgaagcggttcgcatcgccgcgccggtagcaggtgatgaggcgctcctcgtcattgagaaggacaatccacccacgcgcctgccgcgccacatccaggctccgccaggcccaaggcagctcccgctccagcaccgtgacgtgcgtcatgcccgccgcccgggtccggatgccaaactccaggatgaagtcgagcacatcgtcacgaagctgccgaagcgagctgcgctcgacgaagtgacgcgtggcggaaaacccaggggaaacgggcggacggcaaacgggcatggcgtggacctcctgttgccaggaggtcattacacatgccgttccaacgcctcattcccaagattccgcgcacttggtcggctccggcacggcggacaaatgacattccgtcaattcccgtgcaggcgtgtgacagcaaggcgcggacgccccgacgccggccctccctggccgctccggacacatggtgtagaaggcccgccatgcgttccgtgccgaagccgccccccggtgaattgctccaggatgccacccgcgcctacgtgcgcggatatcgcacggcgtccctctgcgccggcatcacccagggaggcgtgcatcacgtcgaagcgctgcggagcaaaggcgcgccgcccgctgaaagcgccctcttcgcgctgggcgagctgaccccggtcttcacgggggccctcctcgcgttgctcgtggaccagggcaaggcacggctcgacatgcccctgtccgaggtgattccccggtcgctgctcgcggatgccacggcgggccgcatcaccctggagcaactggcgacacacacctcgggaatgccccacctgcctcccaacctggagcaggacacccagacgatggaggaccctttcggccattacgacgcgagacacttcggagaattcctccagacctatcagccggaatggccgccgccgcgccgctatgcgccctccatcctgggcatgggcgtgctgggccacgccctctcccggcgcgcggggctcaactacggacacgcgttgagggacctgctcttcaagcccctgggcatggccgacaccacgctgcgcgtgtccgaggaacaggagccgcgcctgacgcccggccacacggcgcgaggcaaacccatcccccaatggacgttccccgccctgccgggagctggcgccgcctactccaccgctcccgacctgctccgcttcctcgatgcgaacctcggacggggcgacgcgggcatcgtgcgtgccctgcaactgacccatgtgccgcgcgcggaggcgaaccccgggaagatggggctcgggtggagcgtgacgcaggtgcgcggtcagccagtggtgtggcgctcctccgtcatccggggctacaccagcttcatgggcttcgccgccggagcggacgcgggcgtggtgctgctggcgaaccatggctggtccttcttctccgcgctccgtgggcgcatccccctgcaagccccagggctcgagctgctttcccgcctcctcccgacggaggcataggttcggcgcccgatgccggggtgagtccgccacacgcgattgtctttccctcgccggacgcggcgaaactgaacgcggtgctggacttcgtgggcgcccggagaacgagcgcccgccctcagacaacgaaagcctgactccaggagaggagcagttgcgcgtgctcagggcgcgcggcgcaggggcagcaaggcccggagacgtgcgtcccgcagaaaaagacccgcccaggcgaaaacgcccacgaggatgggggcgatgaacggctcggacagacgcacgtgcgtcgaggtggcgccgccgaggtagcccgtaacgaggatggcgcccaagacggctgtccgcggcaccgcgtagagcaccatgcagatgagctcggtgattccaatggccagcaacaccgagccagggtagccagacttctcgattccctgaatggcttcgggtgactgacccagcttcatcgacgcgctgaaggccagtgtggcgacgacgagcccggtgaagatgcgtcccagccagagcatccatcccttggcggcaggggcggactgcgtggaggccggggagacggcggaggaagtgctcgacatgagagagacgccctaggtggaagtgggacctggaagcctcgccgatctaacgatcccacacacttctccacaagggacgaggcgcagcgaacaagcccattcggggaaggatgcgctgttgacggagaggttggccgcgcgctccaatggccatcatggggggtcgttccatgacgttgctgaacgaattgcgccagcgcattgactcacgctttccgctcaccgcctatgcggacccagcgccacgcgcattccaacccgccgccctgctggcgttcgccacccgggtgacggatgcctatgcggccgacgcccggcaccttgatgagggatgcagcggctcctggcgagccctgctggcccacgccttcgacgtctacgaagccgtccggccctgcctgtccatccgctattcgacgcgcaccgtctactcaggcccggaggacatcgccgcggacctggagcggggacagctcgaaatcaacaccgagcactgcgagcatcccttgtggacgccggaggagaactgcgtcttccgcatcgtccatgacgtgattccccatgccatgtacgcgcggcccttctcgctggagggagaagtgctcgccttccatgaccacatccgccgggcccccgcagaggcgaagctggcgctgttcacggaaatcttcggctatgccgccatccgttactccaccggcgtgtatcccgaaacgcagaagtgcattgtcttcccggagctgctcgcggactacgaagcgggcttcctctcgcccgcgagcagtccccccacgcagcccggggcgtaagagccctttgaacgtcagcgccaggtcgtcttcttgcgcgcggtccgcgccgccgccgtgatgcgctcgcgcagccccggctccgctcaacgcactgcactgtgaatccttgacgcaacacagcaaggggatgcgacaactgacctcgcccggtttactgataatgcgggaggcgccttgattctggtctgtgattggcctacgcgttgactcgcgggtcaatccgcagtggacccgtcccccgaacaggagcccctcctcatgcgaaacgctgtccggacactggttctggctgtcgcggcacttggcttgtggtcgcaacccgcgctcgcgaatacccaaacgcagacccgctatcccatcgtgctggcgcacggcatggcgggcttcgactcgctgtttggcgtctacgactacttctacggcatcggctccgacctgcgctcgggcggggcgacggtgtacgtgacgagcgttccgcagttcaacaccacggagcagcgtggcgaggcgctgctggcgcaggtgaaggacatcgtcgcgcgctcgggcaagggcaaggtgaacctcattggccacagccacggcggcctggacgtgcgctatgtggcggcggtgcgcccggacctggtggcgtccgtgacgacggtgggctctccgcacaagggcgcggacctggcggactacctgcgcgccaacctccggggcggctccttcacggagagcgtgctggcctacttcgccaacaacctgggcaccgtcctggggctgctgtcggggaagacgaacccgcaggacgccattggcgcgctggcggcgctcagcaagtctggcacggcggcgttcaaccagaagtacccggcgggcatcccctccagcagttgtggccagggcgccgcgacgggcacgcagggccagcgctactactcctggtccggcacggacccccttagagcac

SEQ ID NO: 1215 - DNA, 25733 bp, Myxococcus xanthus
ctcggccagggcctggcggtagcgcagcaccaggaaccagagggtgaggaacagcatgccgaaggccgacacgcgcagggccagcgtcatctccgggtccaccgtcttcggcgtggactgcacctggtgcaggctgcgccaccagcgcacggagaaccagacgatgggcaggttgatggcgccgatgatggccaccaccgaactccacgtggcgcgcttctccgggtcctccacgaagcgccgcagcacgaggtagccggtgtacgtcaccagcatgatggcctgcgaggtcaggcgcggatcccacgaccagtagacgccccaggtcggccggccccagatggcgccggtgatcatccccgcggtgcccagcaccagtccaatctccgcggacgcctcgtcggcggcatccagcttccagctcgccttcatgaggtagctgatggccgccacgaagttgatgaccatggccaccatgcccacccactggagcgggacgtggacgtacatgatgcgctgcacgtcacccatctcgcggtccggcggtgcccactccagtcccagccaccaccccgcggcgagaacgaccagcgccagcgccggcaggccccacttgatgaactttcccatccgtcagtcctcgatgatccgcgggaacagcaagaagcctatgccccaataaatcagattgaatccgcccaaaagcccgacccatgagccaaactgattcatggggtctccctgaagtacgagcgtggtcgccttggccgcggagaggagggcggggatgaccagcgggaacaatagcaaaggcagaagcacatcccgtgcccgggcattgctcgaaatcgcggcgtagacggttcctggggcgctcaaggccaggctgccgagcaggaggatgagccccaggtccaccatgctggtgacgatgcgcaccccgtacagggccaccatgacgggcaccagcaggacgcccagggccgtcagcagcagggtgttgcccagggccttggacaggaagatggcgcgggcgtcggcgggggccagccggatgccgtccatgcacgcgttctccgactcgacgcggaacgactcgcccagggcgagcacgctggcgaagaggatggccaaccagaagtagccgccggcgttcttctccagcagcttcgtgtcggggcccagcgcgaaggagaacatcagcagcgtggccagcgcgaagaagatgatggcgttgaggcgcgcgcgggtgcgccactcgatgagcaggtccttgcgcagcaacgccagggtcgccgtcaaaaggccgatggggcggggacgcgaggtgctcatgccgccaccgcccggccttcctgcaggtgaaggcgttcttcacacagcgtcaggccttgctcgatgaggtgggtggccaggatgacggtgacgccgctggccttgagttcggcgatgatggcctccatgtcgcggatgcccgcggggtccagctcgccgaagggctcgtcgagcagcgcgatggacggcgccttgagcaacaggcgggcaatcgccaggcgcttgcgcatgccggcgctgaagctgcggaccgggctgtcggagcggcggctgagtcccacccgggtcagctcgtcgctggcggcgtccgcgggcgagggcagtcccagaagccgggccagcaccgtgaggttctggtgcgcggtgaggtcctcatagaggaagctggcgtgcgacagcagcgccacgtcccggcgcaccgcgtcgcgctccaccaccgcgtcgcggccgagcacttccacccggcccgcggtggggctcagggcggtggccagcaggcgcagcagggtcgtcttcccggaaccgttgtggccggtgagcagcagcgagcgtccggcggggagcgcgtacgtgagacgcgccagggcccaccgtcgaccataccgcttgctgacgtcgtgcagggcaagcgcgggggcggcggagaggggaggcatcggcggggcgttcgtatccggaaaccagaacgtccaccagtgaaacccaagatggtggcctggatggagaaagggcgaccacatcgggaggaaaggttttcctcccgatgtggtcggaggtgcccgccgggggcctccggggttccacggaggggaacgtccactgctcgccacgcgacccgttcggacggctggccctctcgactgcccggtccagggtgcccaacctccctcctggcacctcccctgcaacggtgcgcgggcatggcgaggcggactcagcggatccgcgcggagggcgtgaatggcgacgggcaaggtgttgcgtagagcggtcaaggcggcggcggcggggatgatccattacagcgggatgcggcgggcaatggccgcgtatcggcgctcccagtctggcgggaggcgcatcctcatcgtgagctaccaccgcgtggtgagcgacttcaccggggagctgcagcgctcgattcccgggctgctcatctcccaggagaccttccgccggcacctcgaggaggcgcacgcggcgggcttcgagctggcctccatcggtgacgcggtggacgtcatgaatggccgccgggtggcgaagaaggacttgtgcgtcgtcacgttcgacgacggctaccgcgacgtctaccggtacgcctatccggtgctcaaggagatgggcgttccggccatcacctatctgcccacggcgttcatcagcaccgataagcgcttcaaccacgaccggctgttccacctgcttcgccgtgtccaggagcgccgcttccggccgttctacgactcgctgcccgcgcccgcgctgcaactgctggggcccatcctctccgggcagaagacggtgtcggcgtcgctggacgacttcatcggcgagcaccccacgcgcgtgctgacggagatcatcgatgcgctggagcagcagctcggcggcggcgcggacctggtgccggagcagggcgacgtcatgaactgggacgaggtgcgccgcatggcgcgcgacggcttcgagttcggcgcgcacacgctgggccacacggtgctgacgctggagccacaggaggtggtggagcgcgaaatcctggagtccaagcgcgccatcgagcgcgaggtgggcatcaccgtgcgcgacttcgcctactgcaacggctggtactcggacgaggtcatccgcgtgctgtcggccaacggcttccgttccggtgtcaccacggaggacatgcccaaccgcattggcggtgacccgttcaccctcaagcgcaaggtgctgtgggagaacttcagcctgggcatgctcggcgactattcgtcggcgctcaccggctgccagctggatgactgcttcggggtgctgggcatgagcagcccggtgccggggaagcgcccccatttcatcagcgcccccaccgtgggaaaccagttgagcagcgccccggtgcgggtgggccccaagcccgcgaccagtaacgaaatcgtggtgggcccagagtccgccacgaccatccaggaggctccgtgagcggaggttccacgtcggccgcgtccgggggctcgttcctcgggcgcgccggccccttggtgttggcccggctgttcaccgccgggctgacgctgtccattcccctcgtgctcgcccgggtgctgaacctggacgactacgggacgtactaccagctgttcctcatcgccacgacgctctactacgtcctgccgttcggcgtggtgcagagcctctactacttcctgcctcgcgcggacgcgaagcggcccttcctggggcagacgctgctgttcatgtccgccatgggcctggtgggcgcgggagcggtgtgggcgctgctcgggtatgtggcgggctggttctccaatcccgcgctggccgagtaccgcctgccgctggccgcgtacaccgcctttctgctggggagcttcccgctggaggtgtccctcacctcgcagggccgcacgaaggcgtccgcggtcgtgtacctgatatcggatgcggtgcgggcctcggtgatggtggtgccgccactcctgggcgcctcgctctacggaatgatgatggcggtggcggccttcgcgggcctccgctacctggcgacgtgggtggtgtcgctgcgcggtgccaccggaccttgggtggacggccagcgctttcgcgagcaactgacctacgcggcgcccttcggcgcggcgatgctcttggccattccccagcagaacgcgcacctgtacgcggtggcgggcgcggtggcgccggcgctgtatgcgctctatcgcgtcggctgcttccaactgccggtggtggacctgctgtacacgccgaccagcgaggtgctgatggtgcggctgggcgaactggagcgcgaaggccgcctggaagagggcgtggaggccttccgtgaagcggccggaaagctggcctacttcttcctgcctttcgcggcgttcctcttctcggcggcgccggagttcatcggggcgatgttcggtgagaagttcctgcccgcggtgcccgtcttccgcatcagcgtgctgggcgtggtgctctccatcctccccatggacgggacgctgcgcgcccgggggcagacgcgggccatcttcgcgtcctatgcggtgaaggcggcggtgacggtgccgctggtgtggctgggggtgaagcacttcgggctgatgggcggcatcggctcgtgggcggtggcggaggtggtgggcaaggccatgctgctggcccgcgtgcccgcggcgctgtccacgccggagcggaagctgggcgtagcggacgtgattccctggcagtcgctgggcaaggccacgctggcggcgtgcgcggcggcggcggcggtgttcgtcctgcgggctggtgcccacggggcctgggcgcacctgcccacgggctttctgtggcgcgtgctgcctctggcggtggccggggcactgttcttcatcggatacctggtggtgctgcacttcacgggggtgcgaccgctcagcttgatcgcggggctgcgagcgcgaagggcggggtagcgcacttccctccctgcggggaggtacctagtttggtgcggtcggaacaaggggattgggaggcgtgatgggtgtcgacgcgatgacgttctaccggctcgcgcgcaggctgaagaagcggggtgtgcccctgctgccagccgtgctgcgcaaggccatctactatctgcacagttcgtacatccccgaggacgcggagatcggcgaggggacacagctgggctacggcggcattggcgtggtcatccacaaggccgcgcggattggacgcaactgcctcatctcgcagcaggtgaccatcggcgggcgctcgggcatggagggcgctcccgtcattggtgactacgtgcggatgggcgcgggcgcgaagatcctgggcaacatccacatcggtgacttcgccgtcattggcgccaacgcggtggtggtgaaggacgtggctccgggcacggtggtggccggggtgcccgcgcgggtcatccggcaggacccggatccgctcgggacgtaccagcgcgagatgggggagctgccgccccgtgtgtcgctggtttccgtgccgtcgtcttccaggctgcgccagtagtccgcgggagtcacatcgatgcgcgtgctcctcgtcggggattacccgccaccgcatggtggcgtcgcggttcatgttcaacagcttcatggctacctgcgcggctgcggggtcgacgtgagggtgctcgatatcgggaaggggggccggccggctccggatgtcatcccggctcgcggcgccgctccgttcgccctgtggctcgcgcggcacgttgccaccgggtggacaattcacgtccacaccagtggcaacaacccgaagtcctgggtgctggcggggatggtgggaagcctgcccgggccgaagtctccccgggtcatcaccctccactccggactgctgccggactacctcgccgcgtccgacacgcgtcggagcttcgtgcgcgtggcgcttgcgggctatgcgcgggtggtcgccgtgtccgacgcggtgaagtccgcgctggtgggctgcggtgtgcccgcggagaagatcgacgtgctcccggctttctgcgcctcgcaggtgcggccggggcccgttccctcggcggcggaggccgcgcgctcccggcggcgggtgctgctgtccatggcgcaccatccatcgcccgtctacgggcgcgcgctgatgttccgggccctgcgcgagctggcgcagacgtggccggacgtgggcctggcgctcttcggtccgggcctggaatccgaggcgttcatccgcgacgtccgcgaagcgcgcgtcgcgggccacctggaggtgctgggggagctcgagcactccgctgcgctggggctcatcgcgcgcagcgacgctttcgtgcggcccaccacacatgacggggactccatctccgtgcgcgaggcgctgacgctgggagtgccctgcgtggccagcgatgtctgcgtccggccccagcccgcccgcgtgttcgccgcgggcaatgccagggagctggcgcgggtgattcgcgaggccgtggcggcagggctcatgcatgtgccccaggtggatgcggggccggagctgctctcgctgtacggggagctgtcctccagcaacggattgaagtcgtcacacgaacaaggttcaggcctggggcacactgagacatccgtctcagtgatgagttggacttcgcgcgcagggcactgcgcggacgtgacctggtggtgttctccaccgactgggatggggacccgctgtcgaaggtccacatcatgcggattctctcccggcagaaccgcatcctgtgggtgaacagcatcggcacaccgcgcgccgaaggccaacgcgcatgacgtgaagcgcatcatcgacaagctggtccgcttcaccgaaggcgtccgcgaggtggagcccaacatccacgttctgtcgccgctggccattcccttctatggctcggagctggtgcgcggcgccaaccggcagttgctgcggctccaggtgctgcgggcgatgaagaagctgggcttccagaagcccatctcctggagcttcctgcccgcgtccgcgccggtgtccggcacgctgggcgaggcgttcgtcatctaccactgtgtggacgagttctccgccttcagcgacaccaatggccgccacatcgcggagctggaggagcggctgctcaagcgcgccgacctctgcatcacctccgccgagcggctgcgtgagaacaaggcccgcgtcaatccgcgcacggtgctggtgcggcatggcaccgacttcacccacttcgtgaaggcgtgcgacccggccacgacgattcccacggacatcgcccgtctgcccaaacccatcatcggcttcttcgggctggtggcggactgggtggaccaggaggccatcatcgccacggcccgcgcccacccgggaggctcggtggtcatcatcggcaagacgacgccggactgtgacgactccgcgctgcgcgccgagccgaacatccacatgctgggtcgcaagcggtacgcggacctgcccggctacagcaaggcattcgacgtggcgctcatgccgttcaaggtcagcgagctgacgctcaacgccaatccgcttaaggtgcgtgagtacctggcgtccggcctgcccgtggtgtccacggacctgccggaggtccgcaaggtggggctctgcaagattgccaaggacaccgaggacttcgtgcgcaaggtggacgagtgtctggcggacaaacccggtccgaaccgcgagcgcgccgagcgcatcttcggcgagagctgggacgcgcgcgtggatgagattcgccaccacgtgggcgcggcgctcatggcggacggcaaggcgctctgacgtaccgcccgcctaggcgcgggcttcgcggcccgccagcgcccgctccaggtgggcgtagcggcgggccacccgcgcgtagtccgccggtgccacggtgggctgcgcgtgggtccgcgtaaggtcggccttcgcctccaggtactcggtggcggagacgcctccgtcctgttccatcaggcgcgcggcgtcctcgtccgacaggcccatggggatgcccaggcgctcctgcatctgctggcgcagggcctggtccagctcgggtagcaactccttctccaccttcgcgcggcgcatcagccagcccatgctgcgcacgtactccagcgcggaccggtggcgttccacgcgcaacgggcgcggcgctccgaagcgtgtgcctcgcgacacgacgtagagcagacccaccgccagcacctgcgccgtgaagacccagatgccacgggagaaggggggcggcggcgcgagctggtggtggtactcgtcgaacagcaggggcccgcgggcagccagcgcttcccagaagcgcaggttgtccagcagctccaggcgccggttctccagcaggtccgaaccggccagcacgtacacctcgcccttgcccatggccctgcgccacaccgccaccgcgccgcccatgccggcgacgggcacggcgtcatcgtggcccatgcgcaggccccggtcctgggagactcgaagctgggagagtccgtggaggggacccacgggcagccatacgtccacggtggtcccgcccacgtcggacagcgtcgagtccaggccgcggctgctggcgggtagcatcagcccggactccagatgcagccatccctcgagcgccgcttgatgtttccccaactcgcggggcgacaggtacacgagcgtcccgccttcctggacgaagcgttccagctcggtgacttcttccgtcgtcacgggccggccctcgggcgccgcgagcaccagggtgcgcgtgtcagggggaatggcttcgagcggcgtcagcagcgtgtccacggcccggcccccctcgcggaggtacagatagagcgcgcgagcaccctgcggcgccgtgttctccacagtgggcaccggtgagtcaggcgcgtccctgcgcgtggacaggcccaccgccagggccagcgcgatgagcactccgaagaagacgacggtccgggagttcgtcaccgtgcgccctccgtggccagggttccattcagcgactcgacctcggtgacgaagcgggcggcttcctccggcgccaccggcgcgagcgaatagaaggtccggtcgtaccagcccatcagccgctccacctcgcgcaccagcgccgcggacgcgccgcggcccggcagctccgccgccagctcacggttcgttcgcacacggtctggccgggccagccgccgctcctccagtgaggacagcaggctcaacaatccttcccggatggcttcgcgtgcatccgtggagagcgccgcccgggccctgcgcaggtgttcggccggggagtccaggaccaacggctccgcgttcgctgcggaggaggcggagacatgcgccgccttgcgtccacgccgcgcgcggagccggagcacgctccacaggatgagcgcgagcgccagccccagcattaccgcgcgcgtggccaccgcgaagccctgagctcccctggattcgaagaggccctccagccacgccgtcacctctcgcatgatgcgcttcagggcatcgccgtgccgctggcgcgcgcgggcgaactcgggccggtcgaggatggcctccagccgctcgggttctgtcggtgggggcgggacggcgctggggctgttcgccaacgcctggacgtcgcaggcctccttcaggaagcgcgcgatctgctccgcgcgctcgggggcggtgtccccgtcctggacgggaggcagcgggattccgcccaggcgtgctgacagcgtgctcgcttcatcggcgaatccggccgggcggtattcggccgtctcgcgcaggtccagggtgatgtcctcgcgctcggcgcagggcagggaggccagcagcaggaggaggggcaggctcggcacggtggagtccagagggcgccgtcaattggcgggcgtcatcgtgttgagctggtgctccaggtccagggcttcgcggcgcacgcgcatgtccaggtagaagagggcgcagaagacgaagttgatgggcgtgaagaaggactgcgccaccgtctgcagcagctccaccgggacgagcagcaactgcggcgtgcgggccatggtccccgggtcgaaggggctgccgtagggcatcatcaccagccacgagggcaatccggagacgagctggacggagatgaggatgagactcaccacggtgaagagaatcatcgcccgcaccatcacccgtcccatgaagcccggctccacgcggcccgacaggagctgaccggagcgccggaacgtctcccaggcgcccaggtcctccatggccagcaccgggggcaccagcaggaagcgcagcatgtaccagagcgccgcggccagcagtcccaggctcgcgagcaacgtaccgaccacgcccagcacgacggccagggtgttggaacccgaggccactccgacggcgatgccgatgatcgcgaggatgagcccgggcagcatgagcgccatcgtcaccagcgcggaccagccgagcgacagcaggtacaccccggtcagcgtgcccagccgcgagaagctccggcgcagtgcatccgcggggcggaccggctctcccaactgggaggtgaggacgtagcgggacgcggccagggtggccagccagtacatccagacgaggaacaggaacaggctcatccacagcgcgatggtgatgctcgcttgcggcagcatgaccgccgggtccagttgggcgcgcgactccgcgtctcccgtgtagagcagtggcgccaaccgttggccaatcaccaacgtcgccttggtcgcgatgtagttcaccagcgtgaagccgaagctcagcaggaagaggggcttcaggtgggagcgccagaaggtggcggcacggtcaatcatctcccccatggcgagggggcgcagcgcggcggcagcgggagtggagctcacggggtgcgcagcatagcccgcccggcgcgcgcggccagcaggctccgagccgccgccgtcgggtcgtcggcctccaggacggacgagatgaccgcgaagcccgccgcgtccggtagcgtcatcgcccgcgcgggggtgattccgcccagggccagcgcggggcagggcaacgccgcggccagggcgctgaacccctccggcccgaggggaggccgtgtgtctcccggcttggaaccgggcgcgaacaccgggctcaccaaggcgaggttcgcgcctcgggccgcatgggcctccgccacgtcatgcacggcggcgctgatccacctcccggcgggaaggtgcgggcggacgtccatgggggaagggccatgggcgggaaggtggatatgggcgccgacgagcagcgccacgtcgacacgcccattgatgaagagcgggttgccacgtgggtggcacaacgcggcaagctcccgcgcctcgtcgaggaatcggcgcccggtggcctcgggatggcggtgctggacggccacctcgggcccggcgtcgagcgcccgggtgagcgcccacctcagccgttcggacggcaggcgccagtcggtgatgacgacgagccggggaacggttgaaggcaccaccgtgcgcccccgaccgtcagtggtggacgagcccgtcaatcgggctggacgcggagccgtaggcctttcgcgggatgcggcccgccagatacgcgtcgcggccagcctccaccgccttcttcatggccacggccatgcgcaccgggtcctgcgctccggcgatggcggtgttcatcagcaccgcctccacgcccaactccatggcgatggccgcgtcggacgccgtgcccacgcccgcgtccacgatgacggggaccttcaccgtctccaggatgaggcggatgttgtgcggattgcggatgcccaggccgctgccgatgggcgccgccagcggcatcacggccgcgcagcccgcgtcctccagcttgcgggcggtgatggggtcgtcgctggtgtacggcagcacggtgaagccctccttcaccaggatgcgggccgccttcaccgtctcctcgacgtccgggtagagcgtcttctcgtcgccgagcacctcgagcttcacccacttgctcatgcccagctcctcggcgagccggcaggtgcggaccgcgtcatccgccgtgtagcagagcgctgtgttggggagcaggcgcaggcggttgcggtcaatccagttcatcagcgacgcctcgcccgtggccttgaggtccaggcggcgcacggccacggtcaccatctccgtgccggaggactcgtggcagcgcttcatgatgtcgtggctgggatacttccccgtgccgaggatgagccgggagctgaacgtcactccggcgatggtgaaaggcttgtcctggatgctcatgtgcggactcctggctagccgccgccgacgaaggtgacgatttccacgcggtctcccgcctggaggtggtgttcgggatggcgggcgcggcgcaccacctccgcgttcacttccacggcgacgccggggccgcccacttgaagcgactccagaagtgccgaaagggtggtgccttccggcacctcgtgcgtctctccgttgacccagacctgcatggcctcacggctccttgcgacgacgggacctgggcacgcactacaagggtgactccgcgctgtcaacgcgctcgcggacccgtacgcccgctaccgtcaccggtatactcgggggcatgatcgttcgctggacggcggggcggatgtgggcagcgcctcccaggatgacgggggcgtggtgcgacacggacggagggaattgagattccgaccacacgccccatgaagagacttctcgcgagcgcatccttctccgtctgcgtggccatggcgtgcacgccggacgccatcgatttcacgggcaagacgtgcgaggacgcacaggattgcccgccgccgtacgtctgtgtcgcggcgaggccaggggaaggacgcacctgtgaggtgctgggactgccgggagtgccggacggcggtgacgcggggcccgtgcccacgtggtgcgaggacatccagcccatcatggcggcgagttgcgtgagttcgtgccacggcgccgatacgagcgacagcggcgtgaagtcgttccgcctggactactacgcgcccgaggatggaggtatcccaggcgcgcacgcgatggcggcgcgaatccaggcgcgcgcgtacgtgttcaaggacatgccgccgccgtggcgtccggtacccatgccgacggcacaggagcgcgagcgcatcgcgcggtgggcgcgagaaggcgcgccgctgtgcgcggacgctggctccgaagaggtgcccggtggcgtggacggtggcctctagccgctcttacggctgggccccgtatctccgttttctgtccttgttccctggtagggcaggcaggcggccatgcgccccgtggtccgccgtgtgcccctaaggcatccgtgtgcgccagacaacccctgttcaagggcggggggagcgcccagtttctgcccaacgccgggggaaacgctctctcggccgcatgtgagtgaggggggaaaccttctcccatttccacgtgaaaggagcaggaacaaatgcgcaagctcatgatggcggtcactgcggttgcgggtatgtcgttggtcgtcactggctgcagcaagcgcgacaacgtcgagtcgcagcgccaggacgtcgccgaggctcaggtggaggcgcagcagaagacggcggaggtccgtcaggacgcgcgggaggacatcgccaggacgcaaatcgaggcccaggaggacatcgctgggacgcagcgtgaggccgcggaagaggtcgccagcgcgcagcaggacgtccaggacgagcgccaggacctggccgaggccgaggctgatcgccggacggacctgaacggcgacatggccctgggtggctctggcgcagcgggtgccaccgctgccgcgagcagcgtcagcggccgcgtgctctccaccggcaacgatgagctgaccgtggtcgacaccagcaacaacaagcagctcgagctgaagacgaacgaccagacgcgcatcctgcacaacaaccagccgctgaagctggatgacatcgaagagggtgcccaggtccgcgcctcgtatgtccgggacggtgaggacatggtggtgcgcgagctgaccgtgacgcagccggtgctgaagaagaagtagtagtcaacgcgtcgagcgcagcgggcggctcgtttcctcacggaccgctcagagacggcctctgcttcggcgggggccgtttccttttttccctgaatccgtgctgggaggttgtaagggtgtgtcggacgtgggtggtaggagggatgcgtgaggttttctcacgccttcccaacccaggggaggacttcctgcccaggaggcatcactcgagatgtccactcaccccccagatccgcccgcttcaaagccattcatcctcttcaccaccggggccacggcgtatgagttgatccgctacctcggggcacggggctccggagagctgctgctcgcccggcggcactatgcgggcgtccccggcgacctcgtgctcgtcaaacgtttgcaggacgtcggagacgcgcagggtcgcgcgcgcctgcgcgaagaggtcaagctgctgatgcggctcagccacccggccatcgtgcaggtgttcctggtgcgggtgcatgaaggattgccccacctggtcatggagcacgtggacggaaagtccctggagacgctcatcagctacgcggccctgcggcgccggcccttctcggaagcgttcgccgcctacgtgggcgtggaagtggcggatgcgctgcaccatgctcatacgctggaagacgcccggggccgcccgttgggcatcgtccaccgggatgtgtcgccgcggagcctgcgtctggatgcgcggggccatgtgaagctgtctgacttcgccatggcctgggcgaagctgccggggcgcatcgtcacggagacccatgtcgtccggggcgacctggcctacgcctctccggaagcgctggagcgaaagccgctggacggccgcgccgacctgttctccttgggggtggtgctgctggaggtgctcaccggcctgcacctgttggatctggaggacgtggagcgggccgcgcttgccgcggggccgctgcctgacgcggaggtgctgctggcggaggtgccaagctggttgcccgcgcccttgatggccgcgcgcatggcgtgtctggcgccggcgcatgtggaacgcgccacccagggattgtccccggccatgcgggccatcctcggccggcttttgcgccgggagccctcagagcgcttccagtccgggcaggaactggcggacgccctgcgcgccgtgttggccggtcaggggtacgcctacggaccgaccgaagccatgcgggaggccacccaggtccgccgcgacgcccgctgccgccggcagatggcggatgtgctgcgctgggaggactccgtgcgtccggaggccccgccgcgcacgacatccgggtcggagccttgagggacggcaggggcaaagggggcagggcagggcccttgagtgagcatcgggacgcgggtggtgcttgtttcgcgcacgcgggtgggcagacttgcgcgcatgggtgacgtgaaagagttccaccagcggtggtgcatcgcggacggccatgcggattccctcatgtggaaccgcgacctgtgtgaacgctctgaagagggccatgtggacttcccccgcctgcgagaggcgggggtgaagctccagtgcttcaccatcgtcacccggggcttccccttcatcggaggcttcccagtgttcgcagcgtggcgtgggtggccccgggaggcccgggcgagcgagtggacccgggcgctctggcagattgagcagatggcgtccttctgtgcgcgctccggggatgccgcccgcatcaccacgaccggcgccatgctggaggacaacctcgcgcaggggcggctgtccgcggtgctgggcgtggaaggggggcacgccatcgaaggccaggtggcgcgcctgtcggagcttcaccagcgcggggtgcgcttcatgggcctcacccacctgtccaacaacgacctgggtggttcttcctttccgatgatgggcaaccggggcctcacaccgctgggccgggatgtcatggaggaaatggcccggctgggcatgagcgtggatgtggcgcatgcctcggagtccaccctcaaggacctcttcacccacccctcggtccggttcttctgctcgcacacgggcgtccgcgcggcgggcggcggctggcgcaacctctccgacgaatccctgcgcttcatcgcagaccggggcggggtggtgggcatcatcttcgcccccgtctatctgggcggtgacaccgtggatgacgtggtccggcacatcgagcatgccgtggacgtcatgggggagggcggggtggggctgggctccgactacgacggaatggtgccgcttccccgtggcatgaaggatgtcaccgggttgcctttgctcacagaggcgctgttgcgccgccatccaccgtcctgggtggaacgcgtcatgggtggaaacttccgtcgtttcttccaggagacactgggtggttgaccggcggcgggacgctcgaaatattggctggtgcccatgaaccgctcacttctcgcactggtcccgttggttggctctctgctcctcgctggttgtggcccgagcgcgggaggcgactgcgacggaggcggcttcgtctgtcaggagcgggtgctggcgctggagtgccggggcggcaaatggcgtgagttgccctgccgggggccgctgggctgccgtgagacgtcggaggccgtgcggtgtgatacgtccaacaacgtcgcgggggacgcctgtgcctccagcgccgagggcacggggctgtgccgcgcggacggccaggccgtgttggagtgccgccagggcgtgttgacggagacggccacctgctccgcctgcaccgtggaaaacagccaggtgacgtgccagccctgaggttggcgctggccgggatgtcaggcccctcgcctcgaatcgtgtggtagcctcggcgcgccgctcgcgggactccgatgcgacttccgattcaagcctttggagcctgacccgcggtcgtttcactcttccccgagcggcgcttcctttcccaagcccgggtgcccggggaggacgtgcacacgatggccgcactggcggaagcccgagtcgagcaggtcgcccgcgaagacctggtgatgttcgtcaacgcctgcttctcctgcacggggcagcgggagttctacggcgacgcgcgcggccagtccgtctccatcgagttcctgcaccagtacatcctgggcaactaccgccggttgtatgcacggacgctcgcggcgggcatcaaccacttcaatcaagcgcagatcatcctcaacctgctcgccagtggcagcccagcggatgcccgggacaaggcggaggagggcgcgctcattgccgccgcgctgcgcgccctgccgccccagcgggccttccgtgtcctggagtccctgcgcggccggcgcatcaacaaccgccgggcccgtgcgattgctcgggactacgtgcacggtcgcgccaacctggccttcgacgccgtgaagtaccgttccaagctgcgcgccgccgtgtcccacggacacctgaagctggagggagagctggggccgttcctcttccgaggctggaagaagcgcttcttcacccagcccctgctggagacctttcgccgcgcgcactacacccacgaggccctgtacgagctgccgtacacggtggcggagggcctggcggtgaagcacggcatctcccgcgaggtgttcctccggcgcatcgagccgcgcctcacggcggcagagcgcctgcgcctgcaagaatccgcggcgcgtgagcgcgggacgccgcccccggtggacctggggcgggcatccctgacgaagctggcgctgtatgtcctggccctgtcgctggaggttcgccgggagcgccacgcggagctgcacgccgcgctggagcaggccgcggcccgcgtgctgcgcagggccccgtcgccgttgcagcgggtggccgcgattctggacaacagctattcgtcgtccgggtcgctggagaagcgccgccgtccgctcggtgtggcactggccacgcactacctgctgtccgctgccgcccgggagtaccgcgcgtggtggacgtgcccggtggaggagccgctgctcgtcagtgcacgagggcagacggacattgccacgccgctgttggatgcgttggcctggggcgccgacctggtggtcatcgtctccgacggctacgacaatgacccgcccaaagcggtggccgagctgacgcgcgtgttccgttcgaagctcgacccggagcgccacacggcgctcgtccacgtcaatccggtgttcgattcggaggggtatgccccccgctctttcggtgcggccgtgcccacggtgggagtccgggacgcggaggacgtgcccacggtgctgggcttcgcgcgcttcgcggagggggtggcgtccctctccgaactggaggcctacctcgcgtcgcgcgtgggcgcgatgttgcagcgggacgccggggaccggcggggcgatgacgaggggcgccgtcaagaagcgccgtcggcggaggagggcgaatcatgacggacgcacggctcattcaacggctggagcccgcgggcttgcggttggctccgtctcaggtctggggcggcatccggctggtgccagtcctgagggacgaggtgcgtggcgacctccgcatgagcttgcggacgtacgacgacgtggccgcggtcgtctcggtgaagggtgggctgaaagagcctggcctcaagtacatctcgtatgttcctcacggcctggtcatgacgtggggaaaccgtcaggcggaagccgtctatggaacgcagttgcaacccgaggacgggaagcgcctgaaggcgggccccttctccatccggctgctgcatcggatggtgcaccgtgaagaccgccgccagcttcggatgctcccgttgcatctggccatggagggcttcctgtccttgcagtttggcgggccggagattgcctgggctgagtattcacgcgagggcctctcgcgaggcctggcccctcgctccgagggctcggtccctgggtgggcttcgcccatgctggatggggcgctgcgcaccttcgaaatccatccacagcaggtgggtctgctgctgttcaacgcggacgtgttgctgtcggccttcgtcgtcgcgcacccggatgactaccgcgcgctccacaggacgttggtggaggacttctatggtgacctgctgctccagtacggattcctgggggacgcgcccgaactggggctcaccctggatgacgctcgggtgtccagcttggaggacttgcgcaatgaggtgcaccgcatgcgccaggactgggccgacttccacggtttcatggccgggagcctcttcggtgccagcatgtcgtccaccggtgtctacaaggcgggcgggtttctcctccagcgcttccacacctcgctggacccggcagaggagaaccacatcggcgaggccatcgtcggtacggacggcaccctggagtacctcaagacgtatcgcttgtcggcggcacagacgcgccgggcttacctgctgtcacagcttgcccagtgcgactggcatctggaggacacggcggagcgtctgcgaaccacggtcagtgacttgtccctccgcctgcgaaacgccggattcggctatctcctcaaggactccgtcctcgaagccgtccagcggaagcatcgccgctgagcgctcgcgcggcggtgttactcctcgggcttcgcgggtggtggcggcggcgcatagcctgtggcggccatccgctgcccgctgcgctgatacatctccgcgggcatgtcctgaacgccggtgccgtcaatccatcgattgtagaagttgaagagcgcgcacaccgtcacggtgtcgaagagggcttcgtctgtccacccggcgtccttcaagtgtgcgatgtcgtcccgtcccacctgcgccgcacggtggttgagggtgtccacgaaggcaaagagggccttctcggcctcggagatgggggctgtcgccacgtcctccaggaccgctttcaccaggtcgggattgcccagcagttccgccgcgaccgcggcgtgagagcccgttcaaaacaagcattggttgccgcgcgacgtgtacgcggcaatcagctctctgagtccgggcgacagcggggaagggccccgcatgacttcatgggtgaagcgggacagggcctcgcccaatcgcggcttgtacgcgaacaggtgccagatttgcgggacgggagagcccacctctcgggccatgcgaatcagtcgaccgtagtggccatcggattcgcggtcctcgacgtccttcagatgcatgcggtccacggcaccctcagcggcagcggactggactgtccagcccgcatgctcgcatgggccacggcgtgccaccagcctgcactcaggcgccgcgcccctgaagcgacgtcaggaaggcatccagcacggcgttgacccgatcgggctgttcctggttggccaggtgccctgcatccggaatgacctccagcttcgctccggagatgagtccggcgatttccttcgccttggccggcggggtgagggcgtcgtgctcgcccacaatgaccagtgccgggcccgcgtaccgcgccagcatgtccttgctgtccgggcgcagggccatgccgcgcagcgcggccgcgacgctcgcgggggaggccgcgcgcatcagtgccgccacttcctgcgccaccggtgagtccggtcccgcggccaccatcttggggagcatggcctggatgatgggctccacgccgacctccagcgcctgtatcgcggaggtctcccggcgcgccttgccctccgcgtcatccgcggtggcctgcgtatccatcaacaccagcccgctgacgcgccccgcgtcctcgcgcagcagggccatggcggcgtagccccccatggacactccacccaccaccacggtgtccagattcagcgcgtccagcagcgacagcgcgtcacgcgcgatgcggaacatctccgtggggccgtcgcccagcgcgctctctccgaagcctcggatgtccgggatgatgaagcggtagcgccccgacagcgccttcacctgtttgtcgaaggtgctgccattcagcggaaacgcatgcagcagcagcacgggtgggcccttgccctcgtcccggtagtgcagggggacaccatccacggtgacggtcagcatgtttcctctcctcgcggaaatgtcagaaccactctttgtgcttgaaccagaagaccatccccactggcagcccgagaatcgacgcccacatcaggtaccaggcgttgttcgtgtagagccggtcgaagttctgcccgaagaagccgacgatgcaggacagcggcaggaagatggtggcgaagatggtgagctgcttggagatatcgttcgttttgttcgccaccatggacaggtagccgtcaatcacgttgccgatgatgtcgcgcccggcatcaatctgctcgtacagccgcaccagatggtcgtacacgtcacggaagtagagcgtcgtcttctcgtggacatgggagatgcctcgccgggacagcaagcccaccacgtcgcgctggggcgacagcacccgccggaacgtcacgagcatccgcttcatggcgaagatgcgttgcaggtgggacttctccggcttgtcgaagatggcggcctccaggtcctcgatctcgtcactaaaggtgtcgaggatggggaactgcgcatccaccaacgcgtccgcgagcatgtagaagacgaagtccgtccctcggatgagcgtcgcctgcgggtcctccttcactcggcgcatcacggtgtcgtggcccgcgaaggggagctcgtggacgctgatgagccagtccttcgccaggaagaagtggtgctcgtgcagcgtcagttcgcagatgtccttgcccgtgacggtgaatccctggaggacgacgaactggtggttggggtattcctccagcttgggccgctggtccaggtggaggcagtcctccacggccagcttgtgcagaccgaattgggcggccagccgggccagcacctcctcggtcggatgaaggacgtcgatccacttccggccttcctcgcccagcagctcttcaccaccggtgagaagttgaccgtccttcacaagacagacctgaatcatcccgtagcgctcccaagccagcggcatggcccgcatgcgagtgctagaactcccccgcgcggaagtcgagcgctagagtgtgacacccgtgtctgaagccgctgagacccccccggcctcgctgtccgcgaggctcgaagaaatcctccagtcccatccggatccggcgttcgccggtcgcctgcgcaaggtgtacgtcgccaccgcgcacgccatctcccggctgagcgacctcgacctggtgcggtacgaaacgctcgtcgtggattcctcgccggacctctccttgtgggaagagatggcgcccgtcatccgtgacacggtgatggacgtcaacgggctgctgaacgtcatccgggaagagttccccgtgccgtccccgggcggcgcgagcacacaggcccccgtcggcatcctccaggaggcgatgagccagattgcccagggcatcacccaactgggcgaggccatgcgcaacccgtcggtgatgagtgaccggtggacgctgctggcggaagttcagcgcatccgcgcccggttccgcgagcagatgagcaacctggtgttcgagtcggcgagcctcttgggcgaggcaacgcgggcccaggtggtgccgggctacgcggtggaggtgaaggccgcggtaacggtccgcgccatcaccgccgacctgggccgcatcctcaccgcgcgcctgaagaaggtccgcgaagcggaggcgcaggacgtgcagtggaatgcccagcagctccagacggaaatggacgccttcgggcgcacggccgcgtaccggaatctgcgcgcgcaggacaagcggcacatcgtggagatgcgcgccgaggtcggccgcctggccatcctcccgaacccctcccgcgcggagttggtgacggtggtggaggccctggacaccttcgtccaaggcctgtccgcggtgaaccagcgacagctgctcatcatccatgaccgcgaggtgtgggcgtcgtgcggcgtccggctggagcgcgccatgtcgctggtgggttctgaccccgcgggcgcggcccgggccctggccgaggcggccggcagtggccagtccctctacggccgtgcgacggagctggacgctttcctgcgcaaggcgcgcaaactccaggtgggccagctctcgcccgacgagctgcggtccaccatcgtcgccttccagggactgctcgccggtctggacgtgatgtgatgaaggcgctcctgaaggcacgagtcccgcgcccgcttcgcgaggccgacctgtcccgcgtggagggcgtcttcaccgacgtggatggcacgctgaccacgggccacaagctgcgctcggagacggtgcgggcgctggagcgcctgtcgtccgccggcctgcgcgtggtgctggtgagtggccgcccggcgggctggggagaggcctgggcgcggcagctccccgtggacggtgtcatcgtggagaacggtggcctgttcttcctgaagggcgcgcatggccggctgcggaaggtctacgcggaggcgccggcggagcgggtggcgaaccggcggcggctccagtccgaggtggcccgggtgctcaagcaggtgcccggcgcgcggctgtccatggacagcgcgtacacggaggtagacctggcggtggactacaacgaagaggcccgcctgggggccgcgggggcggaccgcatcgagtccctgctggtggcgcgaggcgtgacggccgtgcgctcgtcgatccacatcaactgctggctgggccgcttcgacaagctgcgcgccacgcggcgcttcgcgcggacggcgtggggcgaacggctggacccgcgtgacggccgttatgtatacgcgggggattctttcaacgacgccccgatgttcgccgcctttggactgggcgtgggcgtggccaacgtgcgggccgtcctggaccgcatcgaggcgccacctgctttcatcacccgggcgcccgaggggcggggcttcgaggaactggctcgcgccatcctggcccggaggggccgcggcgcggcccgtgaggagtgacaccgtgaatgtcgtgaagctggaactggcgcgcggactggggcgccacctgcgcgcggggcacccgtgggtgttccgcaaggcgctggagcacgtgccgaagattccggccggcagcgtggtggacctgacggagaacgggaagttcgtggcgcgcgggtattacgacccgcactcggccatcgccgtgcgtgtgctcacgcgcgactcgcgtgacaccgtggatgcgggcttcatcacccggcgggtgcgtcaggccctgtccgagcgcacggcgctcatcgacctcaccgacacggacagctaccgcctgattcatggcgagggcgacggcctgccgggcgtggtggtggacctgtacgcgggctgggcggtgatgaagctgtactccgcgggcctcacaccgtaccggccgctcctcatcgaggcgctgaaggccggcgtgcccgggctcaagggcatcatcggccgtgacgaggtcggccgcgacgacgtcgacgaggacgagggacgcggctccgggaagatgctcttcggccacgaggccccggagctgattcccatccgcgagcgcggggccaccttcctggtggacgcctggaaggggcaaaagacggggttcttcctggatcagcgggagaaccgctacctcatccgtcggctgggcaagggccgcgacgtgctcaattgcttcagcttcagcggcggcttctccgtcaacgcggcgctgggtggggccaacagcgtcttctccgtggatcaggacccggacgccatcgcgctggctcgggagaacttcacgcgcaacggcattgccccggaaaaaccagactttctggcggcgggaggtcttcaagatcatccagtccttcaaggacgagggccgcaccttcgacctcatcatcctggacccgcccgccttcgagaagagccagcgcgcggtgcaggcggccattgacgggtatgcgtccctcaaccggcaggccctggccatcctccggccgggtgggttgctggcgacggcgtcgtgctcggcgcgcgtgagcccggacgacttcatgggcgcggtgcgcgaggcggggttcaaggcgggcgttgacctggcgctcgtcgaggagcgctaccagccgccggaccacccggtgcgcttgcagttcccc

SEQ ID NO: 1216 - DNA, 23694 bp, Myxococcus xanthus
tctcaagcagcagttcgtccacctggctctggctggcgcctcgggccgtccaggtccgagggctctgcagctcgatttgctcgtagcgcgcccaggcgcggaggaagtcatgccccgggcggttggcggcgcgctccagcgccgcgtggttggggtgaacgacgatggtgacggtgtcgtcgaaggtgccccagcgctggagacggggaatggcgcgttcgacggcgagcttcacctgcacggccgcttcggtgtcgcgcggttggtattcgacgtcgatgccagcgccggtgcccttgctgacgagcacgcgggcgctctgggaggcgtagcagccggtgagcagactcaggccgagcagcacccctgcccagccgggactgccgcgacggcaccttgttgctggtgactcctgactcactccgcacccaaccagcgaaccaccgcgcgtccgacatcggccacggtggagaaggactccacctcaggcgcgggtgggccgaagtagagcacgggcacggggtgaagcgtgtgtccccgagtggagaggtcttccacgttgccgtggtcgctacagacgagcacccgggcctcgacggggcgcgtggccaccaacgcgcgggtgaaggcgtcgaacgcgtccagcgcggccagggcggccgtccagtcctgggcgtggccggcctcgtccgccaggtagtgctcgaagaaggtgaagtccgcgcctgacgcaatgtcccagaacacagcggcggcttcctcgggcgtgcgcgctggcgcgggcagtccgtaggctcgggcgctggcgccggtgatgtcgtgggtgagcccgtccccggcgcgggcgtcatcgagcgtccgcagggggatgccccccgcggcgaaggccagcttggacgcggagggcttcaccttgcggcgcgacttgcgggtcaggacgaactccggcggggaggtgctgggccggcgggggacctccagcgcgtccagatagggggcgggataggcgttggcgaaggtggaggtgcggcccgtcgcgcccacccatcggatgatggagcggtccgccatctacccccgcaacggctcgttggggtatccgaagacgtggcggcccaccaccgcggaggccgggtcttccctcatgatggccgtctgatttgacacctactgcaggcggccggggacgccgaagtggtgtccgtggggatgcagcggcctccgtaggggaggggcgggctgggggcgtcctcgaagtgggatagcaggtgttcccggtgggcgagcggattcacggccgggtccttccggccaatccccacaccatcgatgaacaggagcgcgacgcgcacggctggggactgtatcctcgaatccgacacgcatggccctccacggcgacctcttcagttatccgcttcccgagttccttcaatggctggacagctcccgcaagacggggacgctccagctctcctgggaggccggcgagcgtaagctcttccttctctccggccaggtgggtgccaccgcggccgaagggctgcgcggacgcgtggcgcgggtgctcacgctgtccaagctggcgtcggggacgaaggtgctggctggcttcgacgagctggcgcgcacgccggacgtggacgccgcgttcgacatccacggcatccaggcgcggtggattcgggacctgggccgtgaggagctgttcgccgcgatgacggacctgaccatcgccggccgcggcaccttccactggacggaggacgcagaccgctccggtgaggactgggtgccgtccgatatgggcatccgcgagctgctcttcgagtcgctccggtgggtggatgagcagcccgacgtggacaaggcgctgcccatcgacgcgctcagcgtgcgcgcgctggcgccgccgagcccgagccagcccctgatgcaccggatcatcctggggctgtgcacgtcgccgcagaacctgggacggctgcgcctgtccatgggcgtgtcccgctcctcggtgacccggcgcgtgcacgagctgctgcggtcgaagctcgtggaggtggacggggcgccgcaggtggaggcggacccggtggcggagatgttggagaagggcgcggtgctgatgcgcgagggccagtacgacgccgcgggcatcgtctgtgcgtccttgctcgccagcgacccggcggaccggcgcgtgcgcgaattcgcccggctggtgcagcgcgagcacgtggcggcgctctactcggacatgccgcccctgatggtgcccctcatgattcacgacccgcaggggcaggcgctgctcaagcccgaggagcggcagattgccgggctggtgaatggcacctgggacgtgtccacgctggtgctggccagtccagcgcgagagctggagacgttgaagacgctggcgaagctgcagcgcatggggctgctgcagctcgtcttcccgcgctgagcggggcggaggctactccccgttgggcaggcccaccgcgttgaggcggatgaagacctgcatcatcacgtacagggagaaggcggcgtcatccacgcgcaggtgctgctgcgtgcccagcccctggagccggagcaggtcggcgccgtccacgcggagcaggaaggcctgctgccccagggaaccctcgcccgcgaatgccagcgcgcgccggatggcgtcggtgcaggcggtgacgcaggtggcgtagtcccccgtcatgaacgcggcctcggcggcgcgggcatggtcgaacatgtcgcccggcgccagggcgctggcggcgcccagcagcttcggtccgggctggggcgcggggatgggcgtcggctccacgcgcggaggcggcatgacggccaccggggccacgcgaggcaccgggccgccagcctgcaccggctgagacgcgacggcgccgggctgctgccggtgttgcaggtgctgggtgagctgggcctccaggcccgcgggctgtgcgctcgcggtggggcggggcggcgggacgatgcgcttggcgcgcaggtccttgatgaccagccgggtgatggccttgagcgtgtcgagcaccccgcggccattggcggcggacgtctccagctccgggacgcctcgggggttgagctccttgcggagcacctccaccggcagcacgccgtccaggtcccgcttgttccactgcatcaccagtgggaagcggtccaggcggatgccgtgctcgaagaggttctcctccaagttggccagtgattcgcggttggcgtccatggcctccggctgcgagtccgccacgaagaccacgccgtcggcgccctggagcaccagcttgcgggtggcgttgtagaagacctggcccggcacggtgtagagcgccagtcgcacggagcagtcgcccacgcgctccaccttcacgggaaggaagtcgaagaagagcgtccggtccccctccgtggcgatggacatcatctcgccgcggtgtgcggggcggacagtctcgtagatcttcctcagcgaggtcgtcttcccggaaaggcccggtccgtagaaaacgattttcgcggccacttcacgggccatcagattgacgctgctcacggtgtcagcttacctagaacgactggacacctcgcgccagttgacggcgagacattcaccccaggtccgcgaggttcagcgctggaggtgaggccgcgggctcgaggcaggctcgccaggatgcgcgcccgcaaggcatccgcgacggctcacaccgcttccctgaaaaggaatacggcacgaaccgcacgaatggcggccaatacgtcatgccaccggcgaaccaccgcactgctcgaaagccaagcagggctgcgacgtccgcacggaatgaaaccgctcgtggggggcagtcgcggtggtgagacgcgcgtcatgccctccctcgagcgagaggacctcaagcggccttcgtcaccttgcccgccttgatgcagcgggtgcacgcgagaacgcgctgggtgctgccctgaacgctggcccggatcttctggagattcggcagggtccgcttcttggtcttgttgttcgcgtggctgacgttgttacccaccagcggacgcttgccacacaagtcacacttccacgccatgacctctaactccttgaaaactggggcgttggacgcctgccgattaaaagagcggcggaacctgccagataacggcctggaaatccagccttagatccaggatcagcccttgagcggatccttcttcttcaacatatcctgcaccagccgtgcggcccggatgcccgcgagcagctcgccttccaaccccaacccggggaggacttcgcggttggcgagcaggatgttcttggccggcgtgcgctgagtcaaacccgtgacgcccaggaccgcttccgactcgaagctgaacaaggggtgcggcatcagccggctgccacggactccgccggcgtccaggtagggggccgagcgcagcacgcggtgctgggcggtgaagggcatcagcgcgtccaagtgctcgtcgatgcgcgtcgccaggccctggaggtgctcctcgcccagatccctcgccgaagccgggacgaaggcgcccgcgcacaccacgcgcagcccttccgtcgccttggcctccttgccgccgtgcgccggggccgcgcgcgcggggtggacctggatcagcacggggcccagctccgcgtcgcccgtgtccagcagggccagctcacccaggccgcggggcagcgccgactccggcaccacccagttcacggtgaagagcagggccttggtgttggactggtccaggtgttccagcaagccgcggtggtgcttcttgtccgtcaccagccgccgcagcgcgcccgcgtccgtggccgccactaggcaggacgcgcggtacatggtgtccgagcgcatcagcttcatgcccgcgaacttgctgccgtcgaaggccagctcctccacgatgaagcccgtcgggttgtcgcgcccgagcacgtctccgcccagctccgccacgcggcgggcgagcagctcgcgcaggccctcatggcccccggggaagtaggaaggcgccgacagcacctgggacatggcccgagtcagcgccaggggcgcctctggacggtccaggtgggtgacgaagggccgcagcccccgcaccagggacaccgaagcgctgtctcccgtgagccggggcggcgttgccaggccgggatgggctcggatgagcttcttcaggccccagccctcgaagaagccgtccggtggcagggcggggcccgccttgaagaaggcatcactggcttcgtgctgcgcggcggcgccggccagggcgcccaatagggattcgccttcctcgcccagctcccgcgtgacctcggccttgcggcgggcggcatcgccatggaggtccaggcggctgcgaggcatgaggagctgcagctccggcgcgtggggccgcagcgcgcgctggacgttggcgttgaggcccagctccgtgagggcctcctccaccgcgggcatggccttgagcggcggagcgacgaagggggcataggggagcacgtagccaccgtgctcgtaaccgggccccatgccgtcgtgctccaccagcaggacgcggtggttgcgcttcgccaggagggccgccgcgagcgcaccgcccagctgactgccgagcacgatgacgtcgtagacatgccgggacggcccggcgggaagcttgagcttggcagaggacgtcgccatgaggcgggcaacactacacaacgtgctcgccgctggcgcccttttcaccacggcgcgcccgcggagggcggatcagcgggcctgggcgctgaagaggcgctgctccagcgcagggggcaactgggtgaagtcctggaccacccagtgcgcgccggccttgcggaggtcggcctctggcgcggcggtggtcaatcccaccaccgtcatgccggcttctcgggcggatatgatgcccaggacggcgtcctcgaaggcgaggcactcggtgggggccacgcccagcgccttggcggcggccaggaagatgtccggggcgggcttgccgcgcgtcacctgttcggcaccgacgatgctcgcgaagaggggacggatgccgagcccgtccagcaccagctcgcggttgccctggggcgccgcggtggcgatggccgccgggacgtgggcctccttcaatcgctggatgaaggcctccgcgccccggtgcagcttcaggtgcggccggtacagggtccggtagtggttctccttctcctcggcgatgcgctccacttcatcaggggccaccgggcggccgagcagctcggggatgatctcctcgttcttcctgccggcgaagcggctctggaagtcgttcgcggtcagcggcaagcccagcttctgggcgaacgagacccaggcctcgttgtggaactgcatgttgtcgacgagggtgccgtccatgtcgaagacgacggcacgcaggggcgccagtgcggaggtcatgcgttccccatagcgcgtctgctcccgcggcgggccaatgaatccacccaaggggctgctcgcctgatatccccggccgccatgacggacgaccttctgctcgagacgcgtggcgcggtaggcgtggtgaccctgaaccggcccaaggccctgaacgcgctgaacctgggcatgtgccgaaagctgcacccggcgctcgacgcctgggcggcggacccgtccattcaggccgtggtcatccggggggctggcggccgagccttctgcgcgggcggagacgtacgcgcggtggcgctgtcggtgggggacgcgtccgctgaagcgaaggagcgggtgtcgcgggagttcttccgcgccgagtacgggctgaaccaccgcatccactacttcggcaagccgttcatcgcgctggtggacggggtctgcatgggcggcgggctgggcctgtcgattcacggcacccaccgggtcgtcaccgagaagctggtgctggccatgccggagacggccatcgggctcttcccggatgtgggcggcggctggttcctgccgcgcttcccgggtgagtcgggcacgtacctgggcctcacgggggcccggtgcggcgcggcggacgcgatgtggctgggctacgccacgcaccacgtggagtccgcgcggctggaggcggtactggacgcgttggtgggggcgccctggggcaccggcgcggcgagcacggtggtggacacggtgctggccggcttccacgcggacgcgggcacgtcgccactgggggtgcagcgcgccgccatcgaccggtgcttcgcggccgagcgcgtggacgacatccagcaggcgctggagctggagggcacgccgtgggcccaggagacgtgggccacgttgcttcacatgtgcccggccagcttgaaggtgacgctgcgccagctccggatggggcgcacccgcgactacgacgagatggccaacgtggagtaccggctcagccagtcgatgacggcacggccggacttccgtgagggcatccgcgcggtgctcgtggacaaggacaacaagccgcactggcggccctccacgctggcggaagtcaccgaaggcatggtggaggcgctcttcgcgccgctgcttcacgacacgtggaaggttccggcgcgcgggtaggggctgttgctagaggtcctcgtcgctgaggacggtgatgtccttcgcgcgaagtagcgccgtggtgatgccttcgcccgcgcggagctggccggactcgtagactcgctggctgccgcacgaggggctcttctccttcagcagcgccaccgtcgcgccgaagcgttgtgccgcttcaagcgcgagccgggcgccctgttggaaggcctccgtccggtcgatgcccgcggcgcgctccactgcaactgcgcgcccagcccagacgtctaccccggtgcctcctcgcaggtcgacgggagggcgcggcacgggcaggcccgaggccacctccgggcacacggggatgacgtccttgtccgccagcgccgcgaggacgcgctcggagcgctgggagcggccatcgtaccgacacgcctcgcccagcaggcaggcactgaccagcaccacgcgagcttcctggagcgcggcgattcgttcggcctgcgagggcagggcggttgaaccttgctcgtctcgaggggacgcagggtcgcccagggggcaggtggactgccgctcgtcggcgattaccccgtccttggtcagccccaaagcggcctccggtggctgaacgtcaccgtcatcccctgatgtggcgctggggaactccggctcctggtcgaacgtcttcggtccgctcacgccgggtcgaccgtcgcgccgggattccgaagcgccagttcgcccaccgtggcccgcgcctccacgcgcgtgcgggccgcgtccagcgtcaccttgcccgtcacggcgagccgcacggccagcgggtagagccggtgctcctccgcgaggattcgcgaactcagggccttctcgtcgtcatccggcagcaccggcacggccacctgcgcgatgatgggccccgtgtcggtgcccgcgtccacgaagtgcaccgtgcacccggccactttcacgcctcgctccagcgcctgtcgctgcgcatgcaggcccgggaaggcgggcagcagcgacgggtggatgttcagcacccgccccgcgtagtggcccaggaagtccgcgctcaacaagcgcatgaaccccgcaaggcacacccactccacgttcgccgcgcgcagcgtgtccagcagggccttctcgaagccctccttcgtcgcgtgggccttgtggtccaccaccttggccgtcacgccccgccttgcgcgcccgctccagcgcgaacgcggtggagacgttggacaccacgcaggccacctcggcgggaaagtcctcccgcgcacaggcgtccagcagcgcctggaggttgctcccgctgccggacacgagcacgcccaggcggactcgctggccgctcatgggtcgatgaccgccgtggcctcgccctggcccgcttccacgcggccgacctcgaaggcctgcacgccccggccgctcagcacgctcagcgcctgggcgacgtcttccttcgccacgacgaggatgagccccaggcccatgttgaacgtgttgaacatctcgtcgcgggccacgctccccagcttcgcgatgaggtcgaagatgggcggcttgggccaagtctgctcactcagcaccgcgcgcgtgccgtccggcaggcagcggggcaggttgcctggaatgccgctgccggtgatgtgcgccaggcccttcaccttcaccgcctggagcagcgccagcacgtccttcacgtagatgcgcgtgggctccagtagcgcgtccacgagcggccggtccaggccctcgggcgtcgcgtccagggccagctttccgtcgtccagcagcaccttgcgcgccagcgaatagccgttgctgtgcaggccagaggaggggagcccgatgagcgcgtcacccggcttcacgctcttgccgtcgatgatggccgcgcgctccaccacgcccacgcagaagcccgcgaggtcgtattcgccgcgcgcgtagaagcctggcatctccgccgtctcgccgcccagcagggcgcacccggcctgctcgcagcccagggcgatgcccttcaccacctcggcggcgtcgtcgacctccaggcgcccggtggcgaagtagtcgaggaagaagaggggctcggcgccgcaggtgaggatgtcgttcaccgacatggccaccaggtcgatgcccaccgtcccatggcgtccagcggcgaaggccaccttcagcttggtgcccacgccgtccgtgccggccaccagcactggctgctggtacttgcctggtggcagggcgaacaggccgccgaatccacccactccgcccatgacttcagggcgcatggtgcgcgcggcatggggcttgatgcgctcgacgaacgcgtcgccggcctcgatgtctactccggactgcttgtaggtcgttcccacgggcggccttctacccggcccccgcgccggtgtctcgcgtggcgtggcggctgtcccaccggtgcgcacagaaaagggaatttgaccgggcgagtgtgggctgattgactcctttgcaggatgggcgccgaggaaaccctctttcaacgtttcggcaaggagttcccccagggcaccgagctcttccgcgagggagaagccggcaaggagatgttcgtcatccaagcaggacgggtggccatctccaagcgggtccgtgacgtcgagaaggttctcgccgtcctgggccccggtgagttcttcggggagatggccatcatttccaacaagccgcgcaatgcctcggccacggtcaacgaggacgcgaggctgctggtcatcgaccccaagacgttcgaggggatgatccgcggcaatgcggagatcgccgtccggatgatcaagaagctggccgaacgcctctccgaggcggacgcccagatcgagaacctgctgcacaacgacccggccagccgggtggtgcaccagatcatccaggcctgccagagccggggccgtcccctggacgagggcgtggagatcgacttcgcgatgcgggaactgccgcgccagattggtgtgggcgagcccgcggtccgcgccgtggtggaccggctggagcgttccggtctggtcgagcggaacggggaccggatgaccgtgccggacacggccaggctgcacgacttcctccaatacctggagatgaagtggaagttcggagacctctagcgtgaagctgcgagtcctcggctgccacggcggcgagctacccaactgcaagagcacctgcttcctcgtcgatgacgtgctggcgctcgatgcgggggcgctcacggggacgttgtcgctggatgagctgtgccgcgtggaccacgtcctggtggggcacagccacttcgaccatgtgaaggacctgccgctgatggcggacctggtcatcggccggcgcgacaccccggtcaccatctacgcctcgcgcgagtgcgcccgggccctgcgcgacaacatgttcaacaacgcgctctggccggacttcacccgcattccgacgaagcgcaagcccgtgctgcagatcaagacgttccgggctggcagcagcttccaggtgggcccctacaccgtgcgaagcgtgccggtgagccaccccgtggagtcgtgcggcttcatcatctccaacggcaagagcgccctggcgatgagcggcgacaccggccccacggacaagctgtggaaggcgctgaacgagacgaagaacctcaaggcgctgctgctggagacgtccttccccaacaagctccagtcgctggccgacatctccggccacctcacgccgcacacgctgagcctggaactccagaagttcgagcgcaacggcgcatcggtactgctgtatcacctgaagcccgccttcgtgtcgcagctcaagaaggagctggccgagctgccggtggaagtgctggagctgggcgataccttcgagctgtagacgcgtcgcgccatacggaagggttgacggccgaaagcggccggattaaccccgcccaccccatggcctggttctcgaagaagccgcgcatcgccgttgacaccgaaccgcaagccgagccccgcccgtcccgcatggagggtctgtgggcgaagtgcgagacgtgcgacgaaatcatctaccgccaggagctggagaagaactggatggtgtgtccgcactgcgagcaccaccactactgggcggctcgcgcgcggctggcggcgctgctggaccccgacagcttcgaagagttcgacaaggagctggagccgcaggacccgctcgggttcagtgactcgaagaagtacaaggaccgcctgaagtccacccggaagaacctgggcgagccggatgccttcatctccggcgtgggccgcatccagggccaccaggtgtcggtgggctgcttcgtcttcgagttcatgggcggctccatgggctctgtcgtgggcgagaaggtggcccgcgtcttcgagcgcgcgcacgagctgaagtgctccgccatcgtcttctccgcctcgggcggcgcgcgcatgcaggagggcatcttctccctcatgcagatggccaagacgtcggcggccatcgcccgcttccgcaccggcacgcggccgtacatctccgtgctgctcaaccccaccactggcggcgtcgccgcgtccttctcgtggctgggcgacgtcatcctcgccgagcccaaggccctcatcgggttcgccggtccgcgcgtcatcgagcagaccatccgccagaaactgccggagggcttccagcgctccgagttcctgctggaccatggaatgattgacgccatcatccaccgcaaggacctgcgcgcgaagctgggccagatcctggggctgctgggctgagcgcgcctcggacaccggaggaggcgctggccttcttcacgaagctcaacccctccggcatcaagctggggttggagcgcgtgcaggaggccctggcagcgctgggccacccggagcggcggtatccggcgctccatgtcgccgggacgaacgggaagggcagcacctgtgccatgacggcggcgtcgctccatgccgccgggcaccgcgtggggctctacacgtctccgcatctggtgcgcgtcaacgagcgcatccgcgtggacagcgaggacatctccgacgcggacttcggcctgcgcatcctggaggtgttggagcgctaccccagcgccgtgtcctctcccatgacgtacttcgagttcggcaccgtcgtcgccctgtggcacttcgcccaggtgcgcgtggatgtggccgtgctggagacgggcctgggcggccggctggacgccaccaccgccgccagcccggtggtgacggcgattacccccgtgtccttcgaccacatggagtacctgggcgacacgctggcggccatcgcgggcgagaaggcgggcatcctcaagccgggcgtgccgtgtgtcgtcgcgcggcaggccccggaggccttggaagccatcctccgcaaggccgagcaagtcggggccccggtgcggctggagggacgtgacttcacgggcgagcgtcagcccgatggtggcctgtcgtaccgcggggcgacctggtccctggatgggctgtccgtcgcgctgcgggggccccatcagcggcagaacgcggcggtggcgctcgcctgcctggaggccttgcaggagcgcggcgtcaccgcgccgcccgaggccgcgcgtgcgggcctggcgtcggcgtgctggccggggcgtctggaggaggtggggcagcagcccatcctcttgctggacggcgcacacaacccggcgggcgtggaggtgctgctcgcgtcgctgaaggacctctacccggggcgtcgcctccacctcgtcttcggcgtggtgggggacaaggaccggggaccgatgatgcgagcgctgttgcccgagtgtgcctcggtgcagctcacgcctttggagacgcctcgctcactggctcccgaggcctacctggcagaggcgcgcgcgctgtgcgcggacgtgactgcctggccggatgcggacgcggcccttgccgcggcgcgcaagcgggcagccgcgaacgacctcgtcctttgtacaggttcactgttccttgtcgggatgatgaaggctcgcatgtatcgaaaccttggcgcgatgcatcagccgccgtagattcaagacatgcgcctgccggactggagagccgccgcgacatcggggccacccatcccctccatcgacgaagtcgatttcagggcgctttactcgaagacgaagtacgtcgtggagacggcggacggctggtcgctggtcatcacccgctaccgtcctgtgaagcagccttttccgcaaccgttgtttggtgagcccctgctgctggtgcacggtttctcacagaaccggcacacctggaccagcgggcagttcgtcaagaacctgctcttcttcggggtggacatccacatcctggagctgcgcggccacggcaagagctccatcgcgttccagaaggagcgcgccgagcgcttcaagcgccccctgccgccggacctcgactacggctgggatatcgacagttacttcctctacgacctgccagcggccgtctccggcgtgaagcgcatcacccggcgcgagcgcatcttctactgcggccactccatgggcgggatgctgggctacggctacgccggcatccacaatgacttcgaaggcctcatcaccatcggctctccggcggacctggggcgcggcttcatgctgctgcgcctgctggcgcacggcgcgcccatgctggccgggatgatcgacctgacgctcgccagcctcaacgtgggcggcaaggtggagggggcggggcgctcgctgctcgcgcggggcgtgggcgtgttgaacaagggcctgggacgccggctatcaccccgcgcgcggcggacgctgcgcttcgacgcggtgccggtggacatcatcctcaagacgctggagcgccagctcgcgaaggccgaggactcgccgctgtatcaacagctcaccacgcggttgaaccgtctcatcaatccggagcgcgtgagcgcggatgacatccgctggttgcttcgtgaaggcggggagcgggagccgcgccgggtgctggagcagttcgcgcggtggattcgccggggagagatggtctgctaccgcaccggcttcgacttcaagcggggcttcggtcgcatcgaggtgcccatggccatcatcttcggggacctggacccgctggcctcgctggagtcgacgcgcagcgtgtatcgcgccgccaagagtgagtatctgctctggcgtccggtgaagggcaatagccacatcgagctgacgatggggcatgacatccggcagatctgctacgacatcaagaacctcatcgagtacgcgcggacccaccggtatcgctcgccgagccttccgcggctccgctagacgcgtctggacggaaagttggaggcatgctggtgcgtgatagcctccacgctcttctgtcaacgtgaaggggtgtggtcgatgaagccgtttgccgcgtggctgctcggtgtggtgctcgtgcccttcgtggcgctcgcgcaggcgccggccacgaacctgaacaccatcaccgcggtgcaggtgaacggtgggacggtgaccatctccggctcgcagaaggccaacttcaccacgttcaccatgacggacccgccgcggctcgtcatcgacatctccgaggccgtcttctccgaggtgcccgaggaaatccaggtgggcaatggcacggtgacggccatccgcaccgccagctatggctccgaggcgtcatccatcgcgcgcgtgctcatcggctacgagcgcgaggtggaggcggacatccaggcccagggcaaccagctcgtcgtccgcgtcgcgggcggcggaggtcaagccgtggcgcaggcgccgggtaccgagaagccccaggcgggaagcagcgccgcggatgccgccgcggccgccgcggcggagcgtcaggcccaggagaaggccgccgcggatgccgccgccgcggcgcgcgccgagcgtgaggcccaggagagggcttccgccgaagccgccgctgccgcgaagcgtgacgcggaggccgaggcgaggcgtcaggaggaggctcgggccgcctctcagcgtcagcaggaggagcaggctcgggccgaggcggagcgcaagcgccaggaggaggcttcgcgtgcctcggcgcaggccgccgccgacgagaagcggcgccaggaagagtcggcgaaggcgtccgctcaatcggcggcggaggagaagcgtcgccaggaggaggccgcgcgcgcgtccgcccaggccgccgcagacgagcgccgggcccagcagcaggccgccgccgaggagcaggagcgacgcaaggccgcggcccgggccgaggccgagcagcggaaggccgctcagcagtccgccgccgaggagcgtcgtgccgccgcgcaggccgcggcggaggagcgccgggcccagcaggaggccgccgccgaggagcgccgtcagcgtcaggctgaggctcgtgcgtctcgggagagccgccagaatcaggcggtggagccctcccggccgagtagctccggttcggaggcctcggtgtcctcgcgtcgcaagacgctgacgctggtcggtttccagcagcagtcgggggcctcgcgcgtgttcatccgcaccaacgagccggtcagctactccgtgtcggagcgggggcgctccgtggtgttggagctggagaacacccgcgtggacgccagcaacaacacgctgccgctggacacgtcctacttcgcgacgccggtgctccgggtggacccgagcgcgtccgggcgggatgtgcgcatcaccatccagctccggcagtccgcgccgttccaggcccgccaggagggcaacgtcatttcattggacttccagcgcacaggccggtgaaaagagcgggccgctcggcctgggcgcggcataccctgcacccctgaatgagcttcttcgttccgctcgccgccgcgctgctggtctccacgtcgcaggtgccactcgccaccccgttggctttgcccaacggtgagacggcgcagctggctgcggacctggtcgtctacgaagcggacacgaaggtcgtcaccgcgcgcggcaacgccgtgctgcgcacggagacgatgcagcttcgcgccgacgaggtgacgtacgacgaggtgaaccagctcgtcaccgcctcgggcggtgtgatgttcgtgggccccagcggcctggccgcggtcgccgacaccgcgaagatggatgtgcgcacctacgaggcgaacctcgagggcggcctcttcatgcagaagcagggcgtcacccaggaggccctgttcacggcgaagacgccccaggagctgcgggccatgggggagacgcccctcctcatgagcggctcgcgcatccgccggacgggggagaacaccttcctcgtggaggacctggccttcacgccgtgcaactgcagcccgggtgagcctggctggcgcatggaggcctcgtcggccaccgtcgtcctgggcgagcgcgccacgatgacgctgcccgtggtgtacgtgaagtccgtgcccgtgttcgcgctgccgtggctctacatgccgctgtcccagcggcgcaccggcctgctgctgcccaagcccaccttctcctcgctcaatggcttctccctggagcagcccctcttcatcacactggggcagagctacgacgtgacgctcacgccagggtacttcagcggcggctacgaactgcataccgttcccggcgccaccgagcaggttcgggagccgcgctacctgggcgtgaaggggccgcgcctgctcaccgagttccgttatgcgcccagcgaacggacccggggacgggcgacgctggggttcctctacgacctccggcccatccgggatccgcgcagcttcatgttctaccggcggacggaggacggtgtcgcctcgcctgagttcgtcgatgagcggcgaggactccggggcgaggcgtcctggcaacacacccaggacatggggggagggtggcacaaccgcgtcgatgcttcgttcgtctccgatggcaactacacccgtgacctcacggccgacctcatcacccgcgagttcacctacctgcgcagcacggggacggtgttccaacgccaggacgacctctatgcgggcctcgacgtggcgctgcgccaggacatccggtgggggtaccgcttcttccaggacaaccgcatcccggcggccacggacccggcgcgcccggacctgaaaggccccaacacgttccaacgcttgccggccatcaccctggccctgccggagcggcccgtgctgggcggaatcatggggggcctgtcggttcagtacctgcggctcgcgcccctgcgaggcgggtacggcgacgaggggatcgacggcatcttccgggccgacgggttccatgtcccgttcggctctgccgggtggccgtttcccgcggacaccacgcagtctgatggcatcttcaattcgaacgaccgcgaagcccgcgaccgcgtggacttcttcccacgcctgtcgacgtccttcggtctgggcagtctgatgcgcgtgtcgccgtcgctgggaatgcgccaggacgtgtggctgggcgaggtgtcgggccggacgtggcagcgggggtaccccatcgctgggttgctgctcgaaagccaggtggcgcgcgtcttcgagggccgtgagacgagcttccgccatgccatcaccccctcgctggagctgcgctacgtgccgggcgggtggggccgtcttccctcggccggggcctccggggagaacctggcccgcccctatgacgaagtggatgccgcggtgccgttccagagcgacggccgcacccggggcttcctccacgcggtgctcgccgtggaccagacgctgcgcttcaagcgtggcaacgacatccgcgagccgctgcgcctgcgcatcggacagggcttcgacctcacccgacacgtgcccgcggcggggaaggtggacgatccggggcccgtgctacgcgacaccttcgcccgcctcagcgccaccgccggaatcttcacggccgcgggcaccgttcgctacgaccccaacgcgggccgcatctctggtctctccgcggaggtgaatgtcgacaacggcaaggggcacgccgtgtacgcgcgcttcgacgacctgctgtggaccgggggagatgcgctcaaccgcggcgcggatccccgttccgtggggcccgatgtgctccgccgctcgctggataccttggtaggcggactatcccgagtagagcccggcttccctccggccgaacgggctcaagccctcatcgcgggtacgcgtttgaagctcggatttgggctgggagtgcggtacgaagcaattgtgcacccgctttaccaggatccaataactcgagaaaatcgccctcttgctcagcagacgttcggcctctcgtatgggcctgcatgcgactgttggcgggtagaaggggtggtgacgtcgcggcgagatttggggctggaattctccggcatcaacctcattgtggcggatttcggatcctttggttccggaggctaggaatcaccagcggtgggtggtggttcctccaaccccgaaacagccaggagaagtacttcgtgtcggacctcggaaaacgaattgggcagcgcatccgcgagcttcggacacagcggccggagcgctggacgcaggaagagctcgcggagcgggcgcagatcagcgtgtcgttcctttccatgatcgagcgtggcgagcgtgtcccccatgtggagacgctggcggccctggccaacgccctgggcgtgagcctgggcgagctcttcacgggaacggagcagacccttgctcagacggaggacctcctgcggcccctgtctgacttcgcgcgcgcccgtggcctcaccgcccgggacgtggaccgtctgctgggcgtggcccgggtgatgttcagcggcaccgccgcctgacgttgccccctgggattccaggccctggacgcaagagggcgccggtccacctgtcctgtccttgactggacggtaggtggcccgggaagatgcggaagatgcgctgtgcgctgctcgcgtacagcccgcttccttcatcgccttctcaaggagtttccactgatgcgtccgggtctggccccgtgggtggccttcgcgagcctgctgtttgtcgcatgctcgccgtcggcccccgccacacttgaattcgtggaccagtcaccggctcagccgcgactgggagaaatcaccacgctgcgcttccgcgcggtggactcccgaggccagccgcaggcgggtacgccggtgtccttcacgctggagtcccccgttccgggcgtcgagctgtcgcccaccgagggtgtcaccaacacgggtgacggcatcgtgtccgtgcagatgacggcgcgcggcggccgggtggcctccgccgtggtcatcgccaccgccggcacgggtgccgagatgaagcgggccgtctcgccggtggtcagcttcgcgggaaccaactcgaactcgcgtcagttcaccttccagtgcggctcgttctcgggtgacggctccggtctgcaccacgccgtcggcgcctgggacgagacgcgcgccctcatcgcgggcgtgaaggtccggtgcatcgcccatgtgggtgatcgaaacggtgacggcgtggtgggtgcccaggtgtccttcctcacggaggcgggcaccatcggtcccagcgccgtgtccgtcaccgacgtggtgggcaacgcggaggtcctctacaagacgtccctgccgctgccgcaggacgtggagccgggcatcttcacctggagcccgcagaaggacgcgacccacacgggcgagtacctggcgccgctgtggatgcaccccttcctctgggacgagaaccccattgccgcctacggcaacgccccgcagccccagcaggaccgtccggagccgcgccgtccggaccccatccgccccggcatcgtcctcaacccgcgtgataacctggtctcgctgattgccatcaccagcggtgaggaggccttcgacgacctcaacaacaacggtgtctgggacacgggcgagccgttcgaggacctgaccgagcccttcgtcgacaacaacgacaacggcacgtgggacccgggcgagcgctacgtggacaccaacggcgacggtcgctggacgggcaagaatggccagcacgacgccagcacgctcatctgggtgcaggagcgcatcctctggacgggcatgccccacgggctggacaaggaccagacgcagcggcagctcgacccgccgcccaacgcgccgccgccgctcatcaaccacttcggtggcatctcgatttcgttcatcgtctccgacccctggtacaaccgcatggcccagaacagcggcaatgacggttgcagtggcggagcgtccggccccgtcacggtgtccccggccaacacgggcatcgcgctgacctacccgtccttcaacttcgagacgtacctggtcagcgatgcgcacgagccgcccgccgaaggccccccgccgccggtcttcaaccccccggttgattggagggtgacgcccatctgcaagtacacggcggcacagctggagggccacgaggccatcgtccagggacccgtcgtccggggcaccgtggagtagcctccgtcgtttcgccgggcgggcccacgaaggcattgaccccagggcccgccctccgtaggttctccgctggttgactggcgaatcacccgccggtggaggacaaccgtgggtcagcagagcaagccggcggcggagagtggcacgcgcgaaagcgagcgccgccgcaccatcctccgcgcggccatcgacgtgttcgcgcgcaagggctaccacggctgccgcatcgcggacgtggcgaaggaggccggcgtcgcgtacgggctcgtctaccactacttcaagaacaaggatgagctgctcgagacggtgttcgacactggctggagcggcttcgtcacgcgcgtgcgcgcggtggtggagggcgaaggccccctggcggagaaggtccgcggcatcgtcgaggtggccttcgaggcctaccgggtggatccgcgcgcggtgaaggtgctcatcctggagattgcgcgcagcccggcgggctcgcgcatcaaccggcagacggccttcgtggatgccatccggctcagctcggcgctcttcaacgccgcgcaggagcggggcgagctgcggccggggttggacccgcacctggcctccgcgctcctcttcggcaacatcgaaatggcgctcaccgccttcgtcgtggggctggccgacgcgcgcgaccccgacgccctggagcgggcgaagtcgcagattgccgactccttcctttacggcgtcctcacgggtgcccaggcagcggaggtgtccgaatggaagccggagaagtccgctacgaagtccaaggcacccaagcgctcctgaccattgaccggcccaaggcccgcaacgccttgtccccggcggtggtgcgcgagctgatggccgcgctggagcgggccgaatccgacacctcggtgcgcgtggtggtgctgacgggcgccggtgagaaggtcttctgcgcgggcggggacctgggaaccctggccggtgacgagggcttcctgtccacgcacgagggccgccgttcctatgggcggctgctggcgcgcttccaggagctgcgcaagcccaccgtggcgcgcgtcaacgggcacgcgctggcgggtggcctggggctggtgctcgcgtgtgacctggccgtcgccgtggagggcgcggacctgggcacgcccgaaatcgacgtgggcctcttcccgatgatgatgatggcgctgctccagcgtcacctgggccgcaagcgtgcgctggagctggtgctcaccggagaccggctgcccgcgcgcgaggcgctgacgttggggctgctcaaccgcgtggtgccggccgcggagctggacgccgcggtgggcacgctcgcgggaaagctggcgggaaagagccaggcggtgctggcgttggggcgccgtgccttcttcaccgccgaggacctgccgctgcccgccgcgctggagtacctggcctcgcagctgtctctgaacgtgctggcggacgacgcgggggagggcatctccgcgttcctggagaagcgtcccccgaagtggaacgaccgctgacgccggttacggcgtgcccagctcggtgttgccgccccgggcgacgctgggcggcaggtgcgggaagaagtccagcttcagcaggcgctcaccgtccacccacagcccgtccaccttcacgccccagtgcaggtgcgggccggtgacgcggccggtgctgcccaccgtgcccaacagctggccttgtttcacctgggtgcccgtcttcacgtcgatgcgggacaggtggaagtacgccgtgtagagccccgcaccgtggtgcaccagcacggtgttgcccgccgcgtagttgtcgcgcgccatcaccaccgtgccgtcgttggcggcctgcacgggcgtgcccgggtccccgtcgatgtccacgccgaagtgctgactggacagctttccgttgaaggtgcggcggtcgccgaagggcgcggtgatgcggtccgccctcggccacacgaagttctgcgcgaagtgcggcgcgctgaagtcctgggcgaaggcttccgcgaaggcgcggcggtccgcggccatgcgcttgcgcaccgacgcgggcggcttcacgtacttgccggccacgcgcagctcgcgagacgggtagccggactccacgacgtccagcgtgcccgtcagctccacctgcggtgcgcccggcgtgacggggcccattgccgtcacctgcgccgcgccgggcgtcgtctccaccggcaggccggagacggccagatagccattgccttagagcac

SEQ ID NO: 1217 - DNA, 29272 bp, Myxococcus xanthus
ctctaaagcgggcgctgctcgaaggcttcgtgtaccgcttcaacgtgggtacggacgtggcggtgctcctgctgggcatggggcgtgtgctgcgggagcagggcagcctggaggcgttgttccttcaggggctccagtcgcgtgacaccttgcacggcgcgttggaccacttcacgacgggcctgcgcgccatccccatggacgccttgcgaaaggccctggggccggagcgcggcctgcatcacctgctgccctcgccgctgggcgggggagcggccaagcggctcaacctctacctcaggtggatggtgcggggtccggacaccgtggacttcggcatctggaagcgcgtgccaccttccgcgctcctgattcctttggacacccacattggtcgcatctcgcggcacctgggactgactttccgcaatgatttgacgtggcgcacggcggaggaggtgacagccgcgttgcgtgtgttggacccggccgaccctgtccgttacgacttcgcactgtgtcactacggcatgagtggggcctgccccgcccaacccatcgcggagaattgcggtcgctgcccgctgctgccggcgtgtgccgtggggccacaggtggtggcgacggcgacccgccgggtccaaggaaccaccgctcggaagcgcagggaactgtcggcgacgcgacgacgttgaccgtgaagcgcccgggcgctgcaatggggacgtggctccggctcctgcgcgcggaacccggggctcttggggccggaggattgacgccgtgtttgtgacgctggtggcattacctcccgaggtgtcggaggaggtcgagcgagggattctcgagtccgacgcggggcggaactgccagatcttgcgtgtgcccctggcgggtaccttgcccggggccatctccgagggactcatcgtcctgtgggacgacggcggcccgctgtcggagctgtgcacgagctgtcagcggttgaatgccctgcgccgcgtaccccgcacgcacctggtcgtcctcacgggccgcgcgcctgtggaagccgacgccctggccgcagccggtgcggatgagtgtctgaccgcgcccgggacacactggggcgtacggctcgcgagcctgcgccggcgcctgtcggcgctgtcggatggggatgcctcgcccgcgccgagcctccttgaagcctcggatcgcgcgcggctggagtcgcagtgggtgctggcggatcggatggcgtcgattggcacgctcgccgcgggcgtcgcgcacgaaatcaacaaccccctgtcctacgtcagctccaatctctcgtacctgcgcgagctgctcgcccagccggagctgtcccacgaacagctcatggagctgcgtgaggtggtggccgaagcgcaggagggcgctggtcgcgtcagcgcgattgtccgcgacctgcgcaccttctcccgcgcggatgaagagctgcatggtccggtggacatggtgcacgtggtggacggcgcgctgcggctgctccgcaaccagattgggttggtcgcccggttgacgtgcacgttggagccggtgctgcccgtgcatggcaacgaagggcgcctcacccagattgtcgtgaacctgctgttgaacgcgctccaggcgctgccggaccgtgcgcccgaggagaaccgggtgcgggtgtccctgcgcgccagcagcagccggcacgtggagctggaggtctccgacaacggacacggcatggcgccggacgtgcaacgccgcatctttgacccgttcttctctacacgccccgtcggagagggcacggggctggggctgtccatcagcctgacgctggtgcaggccatgggtggacgcatcgaggtctccagcgcgcccggctggggcagcaccttccgcatcgtcctacccgcgcaggccgcgggctggacggatggcgcggagcaaacgcaggttgtggagccggcgcccgctcgtatccgtcgacgtctgctgctcatcgatgacgagccctccgtgggcaactcggtgagccggctggtgcgtgacgtgtatgagattcacgtcgtccaggacgcgcgcgaggccctgcgcttgctcaccatgggagagcggttcgatgccatcctgtgtgacgtgatgatgccgggcatgagcgggctggacttcgtggtggagctggagcggctggcgccggagctcgcgctgcgcaccgggctgatgacggggggcgccttcaccgcgcaggcgcgtgagttcgtgggccgccgcacgcgcgggctgctggagaagcccttcgagcgcgagcgcctgtgcaccttcgtggagcacctcatccaatgatccgtgcggcgcggcggagtctggcggcgtcgctggtggcgctgctggccgcgggcttgttcgtggtgccggggtggctgcagggcttgtcgctggtggtgcgcgctgcgggcatgcagggtcgcgtggagacggcgctcgcggactggcgcaccgggcccttcgacgtgagcgacgtccaggtgcccacgcgccacggtccggtgcgtgcccggttgtaccggccggtgacgcagcgcggacgcacggtggtgttgacctcgggcgtccacgcggatggcatcgacgagcctcggctcgtgaagctggcggaggacctggccatgggcggccaggcggtgcttaccccggagccgccggacctgctgcgctacgaaatcacgccgcgcctgccggacatcatcgaggacgccgccgtgtgggccgcgtcgcaagcagacctggcgcccgacggcaaggtgaatctgttcggcatcagcttctccggcggcttgtcggtggtggcggcgggacggcccgccttgcaggaccgggtggcggccacgctctccttcggcggtcatggggacttgccgcgcgtgctcaccttcctgtgctcgggcgacttgccggatggaagtcacctggccccgcatgactatggcgtggtcatcatcctgctcaacgtggcggagatgctggttcctcccgaacaggtggagcccctgcgcgcgggcatccggaccttcctgcgcgcatcccatcaggccatggtggatggccgcctcgcggcggagacgttcgccaaggcgcgtgacctccaggcggagctgccggagcctgcggccacgttgatgggctacgtgaacacgcgcgacgtggcggcgctcggcccacgcttgctgcccttcgtgaagacgttcgccgcggacccggcgctgtcgccagagcgctcgcctccgcccaccgcgcccgtcttcctgttgcatggcgcgggggacacggtgattcccgccatggagtccagccggctggccgcggctctgcgtccccacaccgaggtcaacgcgctggccacgccgctcatcacccacgcggagatggacgggccacaggcactgatggacgtgttgcggctggtacacttctgggcggacctgctcgacgcctgagcggcgccggcctccgcttcgcgaggcgatgctcgcggcggtgcgcctccctataccttcttggccttgggcgcgcgtctgggcttgggagcagcacgtggggccggagctgccggttcggccgaggcacctcgagccggagccgccacgggcgcctgagccgccgagagctgctgtcgcgcacgggagctgaagttggggttggtcgtccaccagtccaggcccatctcctgtgcccgctccaccgagcagatgatcagtcggatctggatggtcagcagctcgacgttcgtcagattgatcttgatgtccccggtgatgacgatgcccttgtccagcacccgctcgaggatgtcagccacggagctgctgcgggtcgaggtgggcgggtagtgtcgctgagggggcggcgtcacgcgatcgtcgatttgggccatggctcctcgctctctgtccgctgctcggccagcctcacagcgtcgtgcccagcggcccgaggtccagattcaggtcctcgtccgtcaggtcgaattgcttcttcaagacatccatctgctcctgcaggcgcaggaaggtgacgcccagcctttcaatctgctcctcgctcagtgagccggcgtcgatccggcgcagcgcctgcctctccagcaactggcggatgagctcgacgacggcgagcaccagccgtacgagcccggcctggacgttctcctcgtccagttccagcttgggcggcttcgtcggctccaacgctcgggcgagctcctccaccgcctgtggtgcgccctcgactgccatggttcaccccgtctcccatcccgcgcgtgggcgggtcttcctcccgcctcactgcaagcgctgcggatgttcgggaagggtgcccacctccagcgccgtctccaccgaggtcaacagcagccgcaggcccaggtagatgaggtccacgtcggccactgaaatcaccaggtcaccgctgatgaccacgcccttgttgagcacccggtccagcaactccaacaccgaggcgcgctcctgctgtgcctcgggtgtcgtcgcctgcccgttcatctgttttcacctccagggcctgtttcaggaggcgcaggccctgccccctcctgcgctgccttcaacgcgtccaggcggtcgagcagctgcgactcctgctcatcgaactgctcctccgtgatctcgccgcgctcgagctcctggtacaggtcgctcaggcgggtgcggaggtcggtctgttcctgggcctgttcgtcctgaacggccttgtgcaccgagcggaagatccacgcgatgctccgaaccggggacatcaggatgtcgtccaggatgatcaaggcgccccctgcgctgcctcctccacctcttcgaagtggattcgcagatgggtgaagttgtacggcggccagggtccggtcacgttcacctggaagttctcgggcagcgtcgcgcccagcttctccacggtcgcgttgaaggcgtcgaccttcttttgtggcaccagcgcggccagattcaccacctccgactcattgcgcggctcgttgaccacggtctgcctggccacggactcgattccatcgagcaccttgtcggcggtcgcctcacggaagccgttgagcaggtcgacgaagtacttccccagctcgatcttctcttcgcgcgacggctccccctcgcggtagaggtcgtcccgcatcgccttgagctcggggaaggcgttgacgtagtacccgaacgcatcggggtcgctcagccggatccgaaggcccatctccacgttccctctcaccgcacggagctgcgtgaggaagtcgttcgcgtgctcggccagcaggttccgtacttcccgctcgctgccggcaatgatgccgaacgcgactggtagcatcggcgcctggtccatcacctgacccagcactgcgctgtgggtgctgaggtgtttgcgctccggccgaagcgtctgctgctcgatatcgctgacgatggccgccagctttccggacgtcaccgggtgcacgtccgcaccctggatgccgggagtgtcgaggttcagcgagtcgaccacctctatcggaaccaccgcgtacaggtagcgtccctccggggtggacttctcgtgtcgagtcttggcgcgtggcatgacgttgtcctgtcctgttcaggtgaagattcagaccgcgacaggcgcagccgcagcggcggtgaggccgatggcgtcggcgtacttgaggtaggtctcaatcgaagcgatcacgacgcgtgcctcgatagagagcacttcgatgccgaccagcgagaccttcacccaggcatcgaccacgattcccttgtccaggatccggtcgatgacgtcggccgtcgaggtcgtcccggtagaagttgagacgtttgccatgacgtattcatcctttctcttggaggtgctccagctcggcgagggccgcgacggcaggctttgccaggtctgcaacgaagccgtaggggggccacgggccgctgcacatcacattgccggggccgtctttctggaagcgaaggaaggcccgccggaactcggcgagcttggggcgctccaccaggaaggccatggagagcagctgcccgtctgggcgagcggcatggtcccaggtgcagcggacgaactgcccggagaaggccgcctgcgcccgctccgccatgcgccgggcagcgcggtccacacgtgtctgctgcgcgtagaagcgacgccggttgtccaggtaggcccgtccgcgggtctgggcgtccgccccggtgggcgcccctgcctgctccgggggctcggccacgtccgactcctggaacaggatgcgcagccccatctcgtcacagccctccacctgggccagcgcgtccgagaactgccgctcgtagcggtgcaggaactccaccacctgttcggggtgatggacgaagcagccgtagcgcatgggcaacaccgaaagtcggcggtgcaactgctcgaccacccgggcgtactccagcgcctgctcgatgccggccgaggaggccagctcctcctccaccggcgagatggccgcagccaggttgccgtgcttcaccgccatcagcggcgcctggttcagccccggcggcagcgactccttcgctgcctgccgtgcgtccaggatgccgtacatgattgacttcacggccgctcctccaggctggggcagaagctgtagggaggccaggggccggtcgtctccaccgtcaacccctgcggctggtaccgggccgcgagctgctgcacgcgctgggcgaaccgctgcacctgcccggagtgcaccaggaacgcggagttcagcaccatgtcgtcctgccggcccgagatcccgcgatctgccaggcgcaggggtttcaccgagagcgccgccggggcgagttcctcgcggatgtgggccgccaggctctgtccctcgttgcggctgcgcacgtcgagctcgcgctgcatcttcttctcgtggaagtagcgcgcgccgggagactcggggaggtgctggaggcgctggcggaactcaggcgctcgctccagatgcgcgcgcaggcgttgggcgttggcgtagaccttgactgcccattcctccttgtcggcgatgtcgtcgaggaagctggagatctcctgccggtgggcgtcgaccgccttggacaacgctcgcggtgaggagaagatcgccccgaagctcaccggaagcaccggcgaggactgcatcacctcctcgagcacgccctcgtgcctgaccgcccggggggccacccactccaggtcctgggtgtggtccgcaccctccggccccaggaactcctccatcgagagcggactgtagatggcggcaaggttccccagcttcagcgcccgcacgtcggcggcgccgctgataccgggaacggagaagtgctccaccgcccctgcccgcgtgaagccatagacgtacagggcctgctggcccttgcgtcgcccctgcacaccgggattgctgtgggctctcatggccggcgtgcctccttgtgccctcggatcgccttgagcaggctctcggatgtgatgacgagccgctttcccttgccgctgatgacgtgacgcacggcttcccaggcggcctgattgcacacggcctggatgtcggcgccggagaaggactcgctgcgtgcagcgagtccgcccaggtcgaggtccttctccaccggcttgtcgcgcaggtggacctggaagatgtcgcgccgcgcttcgcggtccggcagcggcacatcgacgagcaggtcgaagcgtcccgggcgcagcagcgcagggtcgagcaggtccgcgcggttggtggccgcgagcaccagcacgccggtcagctcctcgatgccatccatctcggccaggaactggctgacgaccctctctgtgacgcgctcgtccattcccccggcggagcgcgtcggcacgagcgagtcgatctcatcgaagaagatgatgcagggggccgcttgacgggccttctgaaaggtctcgcgcacccccctctcggactcccccacgaacttgctgagcagcgccgggcccttgaccgagatgaagttgacctggctctcgtgggcggcggccttggccatcagcgtcttgccgcagccaggagggccgctcagcagcacgcccttgggggggcggaccttggcccgcgcgaactcctcggggtaccggagtggccactccaccgcctcgatgagccgctgcttgagctgccccagtccgcccacgtccttccagcccacgtccggggtctccacgaacacctcgcggatcgccgatggccccacctcgtgcagcgccgcctggaagtcggccatcgtcacctggacctgtatcagctcgtcgtagggaatctcggccgaggcgaagtcgatgtggggaatcagccggcgcaggcagagcatcgccgcctcgcggcacagggcctggaggtctgcgcctacgaagccatgcgtcacggccgccagatggtccaggtccacgtcctctgccagcggcatgcccccggctggtggatggcgaaggatctcctttgcgcgccgtgcggtcgggggatggagatggcgatctcgcggtcgaaccgccccgggcgacgcagcgccgggtccagcacgttggggatgttggtggcagccagcacgatgacgtgccggcgttgggccaggccgtccatcagcgacagcaactgcgccaccacccgcttctccacctcgccctgcacgttctcgcgccggggagcgatggcgtctatctcgtccacgaagatgatggccggggccctgcgctgggcctcgtcgaagatctgccggaggtgggcctcactctctccgtagaacttgtgcatgatctccgggccggtgatggtgaagaacgccgccgccgtctcgtgggccaccgcccgggcgatcagcgtcttgccgcagcccggcgggccatacagcagcacccccttgggggcgtcgatcccgagccgctcgaacacctccggataccgcagcggcagctccacgatctcgcggatgcggcccagctcccgcttcagcccacccacgtcctcgtagctgacggcgcgcgcccgctcgtgcgtcaccttctccttctccggcgccttggcgacctccagcagggtgttggggtgaatcaccaccgcccccacaggagtggtctcgacgacgcggaagtcggccgtgcggctgccgaacagcagcgcgcggacccggtctcccttcaccaccggcagtccgtccagcagcgtgccgatgtaggccaggtcacgctgcgcgggggtgaactccaggggcgccagcacgaccttctcggcgtgtcgggcgggggccagggtcagcttcaccggttcgtccaactgcaccccggtgttggcccgggtcacaccgtcaatctggaggattccgcgcccccgggcgtccgggtaggagggcatcaccttggccgcgctgcggcgcttgccggacagcgtgacgatgtcgccgacatgcgcccccagccgcttcatgtcggcggggtccatgcgggcgaggccacggcccaggtctttgccgagggactcggcggcgcgcagcgtccgcgtatgttcccgtgtcgcgacggtcacgagcggcgctcctcctgggcggtgaggcggatctcgaggacgccgttgcggcagttggtgtgcatctgccggcgggtgaagcgcctggggagcaggacctccttgtggtacttgagcgcctcgtgctcggcatgcagggtcaggatgtcttcgcggagctccagcgtgatgtccttgcggtcgacacccggcagctcggccaccaccagcacgtccggcccctcttcgaagacatccaccaggggctcgcggatggggtggacgaccgccttgccggtctggtgatcctggcggatgttcccgaagggctccacgcgcggaatgccgctcggttgaccgggtgcgcctcctccgattcgcacgttgaagccatagacgcccctgagccccttgtcggaggctccgaactctccggagcgttggagctgttcgctcttctccgcgagctccgccagtttcgtgacgagggtggtgattccttcgaggaaccctccaccgctgatgccagtcttctctgccattgctccacctgtcgtgattcaaagctctggcagcccctcctccatgcccagcggcaagactctaaggtggggattccgcccgccccatgtccggcgaggagcggcacggataggggccggctggtgatgcctggtcggcgggtatcggcgcatcgcctgaggggggctcgtcagtcatgtcgccccctgcccatcgcccgggaggtggcagatcgatctgggaggggcggggccgcctcacctccctgaacttcgccgcctgtcgtgtctacgttctgcatggacaacgcatgcgcgtccggcacgcgtgtgcgtcagcggtgtgagtacccatggcctcggtcaaaggaattgcgaacggggggaacacgcgcaagcgcgtccagcaagagacgctcccccaggatgtacaggcgcaggaattggaacgcttccacgcgcagcgcgaggcgctcatcgccaacgttgcgcagtccggagcgaggctcctcacggtcgcggcccggcggttgccgaccgtgctgacgcggcccgtgctcgaggggggaagccgcattctccaggacaccaccctctacctccaggaagcgtcgatggaggagtggctccgcgccgcgcaaaaaaagctgaaggcgaggcccgggagctccatccttgggctgctgggcattggactgctcgctgggcggctgctccgtaaggtggcggagaaggggggagccgagtccttccaagaccgattgcgcgaaagcatgttcctggcgacccatggtggagtggggcggcccccagccgccgcacgtcagcgattgctcaggggtggcgcgggtggagcgccgacgcaaggaggcgtggccgagggcttcaaggagcgattgcgcgaaggcatgtccatggcgactcttggtggtggagtggggcggcccccggccgcgatgcgcctgcgcctgcagaaggctggagggtcgaagcagggggcgccacgcaagcgcgacgtgaaggagcgagcgccgcgcgagcccgcggtgagggcgaaggaagtggcgcgagacgtcgccgagggcgcccgggacgcaacacgcgccttcgacgaggtcaccaagagcgcccagggtgcaacacgcgcgttcgcagaggcgacccggggcgcagcgcgcaagggcggtgaggctgcgagcggcgcgcgaaaggcgatgaaggacacaacgcgcgaggtcgctcgaggggccgcgaagccagggggaaagaagtcgccggccagcaccgaggccacgtccacgaatgcgccctcacaagcgccgagcggctacctcgggatgggggccttccccgtccggctgccggagaagctcgcgaagacccatggcacccagagcggcctcaaggtcgcgagcgtggagccggatggcccggccgaggaggcggggctgcatccgggtgacacgctgctcacgctcgaggggcagccattgcgagaggtggatgacctggtcgcgcagctgcctccggaacgtgtgggccagaccgtgcacgcaaaggtgctgcgcgccggggctgccaaggtcatcgacctcaccgttggcgcgcacccctgagccggggggcgcgagcgctcatgcggctcacgatgacttgacggggccggaggaggacctgcggcgcgaggaggatgtgcggggcctgggcgctccctgcgaacgaaggcgcgccagccccgcgagccctttcaagccacttccggagtgcttgcctggcggtggacatctcccagccgaggaggctcgggacgtgtcgatgtgtttcgaggctccggatggaggaactcccgggcatagactggtggccgttgtcctcgcatccttcgaaggggccctcgcgcgtgcgtccattcttcatcgtccttggttgttccttcgtcctcgggtgcgcgtccacgccgaagcccgtcccagcagcgcctcctgaagccgccgagacgtcccaggcggagcacgagacaccggcgtacctctcgccctctgaaatcgtgaaggtgctggaggattccaaggtcgcctatcgggtcgagggcaaggactcacccccgggcgggtggggcgaccagttgtggcctcagcgcgtggccctgattgacgtcccccaggtggaggtggaggacggccgccgcaccatccgcgagtggcccacgcccgccgggatgaaagccctgctcgatgaggccgagccccacttccaggcgaagcgctacgacgaggccgcgaagctgtacgcccaggccacggacctgtgtcccgagtgctacgtggcgtgggtcttccggggtgacgcggactacttcgccggagacgcggccaccgcgctggagcactacggccgcgccaccaccctcaacccctatgaccaccgtgcctggttcttccagggcaatgccttggcgaagctggggcgcttcgaggaggcgctggatgcctgggcgcagtgcctggcgctgagcccgcgctatcccatcatccgccagttcttccgcaccaacgcccacctggggttggtcatccgcggtgacaccattgttccgcgcgggtacgccgagcgcgacgcggagggcgtctccatccagttcgaccccaaccacgaccctgcctggctggcgttcgccaattgcaaggccctgtggctgggcgagccgtcacaccgggcgaagatgacgggctccaccgaggagcagttcacctccgtggaggagatggagtgcctggcatcggcgctggccgtccatgagagccagaaggcggagggcaagacggatgccttggaccccacgctggaccgcctcttcgccatcgcccaggaggggctgctgctggaggcggtgttgttcgaggtgggcgcgcgcgtccaccctcaaatcgcgctcaccctggaggatgagctccgccggcgcctcaagaagtacgtcctgacgcacgtcctggtgccggcgggaggccacgggggctgagcgccctagcgcggcagcttgagccgcagggtgaacacgtaggacacgctcaccgtccggccctggaactgcaccggggtgtagcgtcgggcgtggagcgcatcgagcacggcctcattcatgtgaggcaggcccttgatgatgcggcagtccgtcacgtcgccgcgcaccgtgatgacgcacttggcgatcatggtgccctccacgcgggcggcgagcgcctggtgcgtgtactcgatgcccgggtttcccatcagtctgggcggtgacatgccctggccaaagggcatgatgtcggtgcccgtggcttcctgcccagggaccaggccgggcacgtactgcacgccaatcacgttgctatccttgtagccctccggatgcccacccggcacgccagtccccgggtcgtccgccacctcgtccgtcgaggtgctggtgtcggtgctcgccaccgcttccaccggcttgggcggcgcgtctaccaccggcggcggcacgcgcgcgggcacgcggtcccggttgcgcgggcgagggcgtggcgcggtggctgctttcggctgcgccggggcgggggagcccttcgccacgcgcgggagctgcgccacgcggagcaccaactctttcggctccggaggctcgctgggacccggcggcctcgcggagatgaagagcaccgccccgaacagggccgcatgcagggcgatggacacccacacgcccgtgccaatacgtccagcccgctgccgctcgatgaccgaattgaacattccggatggcctccctcagcgtctggcgctcccggtaacggccgtgcaagacggacggcaccgacggggacgggtggctgcggagcgccctgtccacgcaagagtcaacctacggagttggcgtcttcgaatggcggtgggggcggccatcgcttcgtcatggttgtgtcatgacgaagcgacctccatgcggtagcccacgccccggatggtgtggatggagaatccagaggtgctcgtccaccccagcttcttcttcaggctggagacgaagttgtccaccgtccgcgggtccaccaccacgtcgcggccccagacggcgtccaggatttcgcctcggggcagggcccggtcctggtgccgcagcaggaaggccagcaggtcgaactccgtgcgcgtcagctccaccaccgaaccgtccgcgcgcgacacctgccgccggcccaggtccagggtgaagctgctgaagcccatctgctccggcggcgccgtgccggagcggcgcaccagggcgcgtacccgggccagcagctcccgcagccggtagggcttggtgaggtagtcctgcgcgcccacctcgaagcccctgaggatgtcgtcctccagagagcgcgcggtgagcatcagcaccatgctcttgttgccctgcgtccgcagccggcggcagaagctgtagccgtcctcgccgggcagcatgacgtccaggatgagcaggtcgaacgcacgctcttgcagcagccgctccgcgtcgcgggtgctgggggcctcggcgacgaggtaaccctcgtccagcaggttgtcccggaggccgacgcgcaggtgggcgtcgtcctcgacgatgaggatggcgggacggaggggcggggtggatgtggcggtgttcatcgagccggctcgttgaatatcagcgcgaaggtggtgccgtcgggtcccgaggcggccacctggatgtcgccccggtgcagcttcatgattttgcggcacagggcaaggcccaacccgctgccatggacctccggtccgggcaccgtcagccggtagaagtccaggaaggcgttctcccattcggactcggggatgccgatgccgttgtcctggaagagcaccgtgcagccgtagcccggaatcatctgcgcgcggatggagatttcgacggggcttctccggttgtaggcgcacgcgttgcggcccaggttggagaacaccatccgcagcaggcccgggtccgcttccagctccacatcttccagatccgaggtgatgtggacggggacgttggtcgcattggccaggtcgtcgcgcaacggggggatgagctcctccaaccgcacgcgcgaggtccgcagcgtccagcggcccttgtcgatgcggttgaacgacaggatgttctccaccaggaagtgcagcccgtccgcggcctggacgatgcgcgccgggtagtcgcgcacctccggtgcctgcgccagcttccgctccagcgtctcaccgagcaggcggatggaggccaggggcgtgcgcagctcgtgggagacggtggccacgaagtcgctcttgagctccaggaagcggtacttgcgctgctgggccaccaccgcgagcgcgaagatggccaccgcgagccctccgcacacggccaccagcagcgtcttcagcccgtagcgcgcgtcgatgtccgcctcctggcgcgcccactgaggcatgtccaccgccagcttcagcgtgctcaggggacggacggcgccgcccgcgcgcagccgcaggcgccccgtcgcgtcgaagaggccgcgcgcctgcatgtcctgggtgatgggctggagcatcgcctccaggtccaccgcgatgccgtacaccgtcttgccgagcagcgccacgtaccaggactcgcccaggagggtgggctcgtagagctactggggaatcaccagcatgcccgcgcccgcttcgcccgttctggcgaggaagtcgcccgtgggctcgcccagtgcggcgctcacccggacgatgcgcgcatggaggaagtcgaagtccgcccgcgtgaagcgtgagcgctcgcgcagcacgtcccgctgcagccccgacgcccgggcgaagccgcccaggtcctctggaaggccctcgcgcagcagggcccgcaccagcggcatggtggcagggccgcgctggagccgctccaccaccagcagcaggaagggcagctcctgctccggtgtcagccggttcgccgcgtggtagcgcagcagctcctccacgcgggtggccgcgccccgcgcgtcccgggccgccagcgccgcctccaccgcgcgcagccgcgtgaggcggggctcccattcccccgcgggggcgccgtccttcagcctcgcgcccagcagggcatgcacgtcccgcgcgggcgtcccggtacccggcatggggatggtgaggcgcggcaggaactggtagccgcggaagttgatgtagtagccctcgccgggctcgagcgggtcgcccacggcggcgtggaggggggggatgctctcatcgagcttcttcgccaggttctgccgcagggcctcttcggccgcgtgggccagcgcgtcccggcgcgagcgcagctgcgcgtgggcgtcatcacgctcctggctgaagatgcgctggaggctgaccagcccccagccaagggccaggaggccacaacccagggcgacgagcgtaggaaggagccggcgcagcatgtggagccgccgctgactatcgcacagccgccttcccccagaggcttttcacttcagcctcctggccggggcgagtgtcctgggccggtgagcgggcggacttcgggtccacgtccggacagccccggtgccgcgcggctggcgtgggacgtccccaccggggaggttggggatggaggttcacgcatgcgcgtcgtgtttcccttgtcacggccctggccgggggggccggtggtgctctggggtggagcgcttccggcgggcagtctgaagtacctgacgttctcccatcacctccagtccgcgcccgcggagacaaagggcctggtggagctgtccggtgcgtcgtcggcgctggcgctggatgcgctgggccgcgagcgcgggctgccggtggtggccctcacggacacgatgggcaccgcgtacctacgcgccaacggctttggtggggaggtgcgcaccgtgcacggcttcacgcaggcctgggagctggcgctggactacgagcgccagggctggttctggccccggcagctcgccaacggcgcgctggtggagagcgtggagtcatggaccacgcggctgctcgacatcgtccaggacgtgtatcccgccgtgcgcagcgtggtgtgtggcttcggcacgggcgccaccgtcgcggggctgtaccggcccttctccgccgcgggctacgaggtggtgggcttgcaacccgcgtccggcaggacgatgcccggctggcggcgctgggcggagcagagcctgggctccaaggacctcttctatccgtaccgcgaggatgtgcccctggagacggcggatgcgaaggcggtggacgcgctcgccgcgctgctggcctgggcgcgctcggagcggcggccagaggaggtgctcgtcatctcccacaacgcgaggcccccattcgaatgatgggggccttcgtcacggcgcttcagcggccgcggccctggccaccgcgctgaccgcccggggggccacccacgggccggtcctcgcggcgcagcgactggtactgggagcgctggccttcgtcgaggatggcgttcatctcctggtcggtctgctggctctccgtgcgcagcgcctggcgcatgtctcgcacggtcttcgtgccggcgcggacctcctccatgagcgcctggcgcttggtggactccgcctccagccggcgcgacagcgtctgctcctgggtgtagttcagccgagcgtcggtgatgaacttgcgcacgcgctcctgctgttgcgcctgctgctgaacctgcgcctgctgccactgctgctgccgctcggcgcgctgctcattgcgcatctcgttctggacgttgcgcaccgcgtccttgaggtagtcgcggccgccctcggagttcagcgcttcgccggcgaccatgccgcgcacctcggcgcgcagttgctccacctccgccgcgagcgccgcgggcggcggcgaggccaccaccttcccatccgccgtcaacgtggggcgccgctccacctccatcagccgccgggacaggctgatggacgtgtcctccagggctttgacccggcgctccaggttgatgacgtccgcggcgacgctggtgggctgctcgggcggaggggacgggggcggagcctgcaccgtctcacgtggactccagagggccaccacgagcgccgtggcggcaaggaagagggcggcgatgctggcgagcttgttcacgtctactccgacggaagctggaacagcttattccatatcaggtgctgtccagccctgtccgccggccaacaggggcggaaagtggctccccggcgggcccgttctggccgcccggatgcccgccccccgcgcaaggggccttcccagatgaagcaggcgtgagccctagtccgcgcgcagggactccgacggggagacgcggctggcgcgaagcgcgggcaccaggcacgccagcagggagagggccgccagcgccacggccacgcccaggaagatgtccggggcgaagggctccacgccatagagcgtcgccgccatgaaccgggtggcgccatacgcggcgatgagccccacgcccacgcccagggccgtcaaccacagcccctggctcagcaccagccgcagcacctggaggggatgggcccccagcgccatccggatgcctagctctcgcgtccgctggcccaccgaatacgccagcacgccatagacaccgacgccggccaggatgacggcgagcccggcgaaggccgccagcagccgcgtcgtggccctgggccgcagcaggagcttctccacccggtccgtgaagggcagcaagtcgtagacgggctgctgggcgtccaccgccttcacctcttcgcgcagcgcggccagcgccgaggcgggcggcccctgggtgcgcaccagcatcgtcatggctcgcaggggaaactgcgcatagggcagatagctttcgggcgtggcgggctgggtgagcgactcgtgacggacgtcctccaccacgccgatgatttcccggaacggctgcaggtcattccaggtcagccgcacccgccggcccagggcatccccgccaccgaggtacctctggacgaaggcctcgttgacgatgatgacgggggcgctcttctccgtgtcctcgggcccgaagtcgcggccctgccgcacgccaatgcgcaacgcggagaagtagccgggcgaggccacccggtaggccgtgatgtggcggtcaccgggcgaggccgacatcccttccaggatgaagtcaccattcgagctcgagcctcccagcggggcatcgttgacgaagcccaccgcttccatgccgggccgcgccatcagccgctccgcgacgccttcgaagaaggcccgcttgcgcgcgtcctcctggtacgcgtcgggggcgagcgtcaattgcgcgccgacgaccccctccgcgtcgaaacccgggtccaccgcctggatgttctgcagcgagcgcacgatgaggcccgtgcccaccatcagcaccagcgcgagcgcgagctgcaccatgacgagcgcgctgcgcagcggatgcccggagcgcgcgcccacggcgctgccggattgccgcagcaggggcagcacgttcatccccgacgcatgcatcgcgggcgccaggccgaagagcaggccggtgcccaccgacagcagcacgctgaagcccaggacggtgccgttgagctccagcggcgccacgcgcagcatgctggcgggcagcagggtgcgcaccagttccatgccccacagcatcagcaagagccccagcacgccgccgaagagggacagcagcacgctctccaccagggactgctggagccgccgtccctggctggcgcccagcgccgcccggatggcgccatcccgctgccgggacaacgtgcgcaccagcatgaggttggccacgttggcgcacgcgatgagcagcacgaagcccaccgccacccacagcatccacagcacatctcgcgtgttcgtcgtgaggtggtcctgccagcccgtcacccgcacggtgtggcgcttctgccctggctcggggtggccaatgccctgcgccgcgcgctccaggtccgctcgggccgcctccagtgagacgcccggtgccaaccgtcccagcaccgactggtagtggttgccatgccgctgtgggtcctgccactcggggacccacacatccgtgtcctcggcgaactcggggaacgagaagtcctccggcagcacgcccaccaccgcgtggctccggccgttgagcaccagcgtctggcccaccacgtccgggacgccgccgagcgcccgctgccagtagccatggctcaccaacaccacggaggtgtcacccccgggcggcgcgtcctcttcacgcaggtcgcgcccctgcgcgggttgcacccccaacacggagaagaagttgggggtgatgcgcgccgcccgcacccgctcgggctcgtccgttcccgtccggttgaggctggtgcgtccgaagcccgcgagctggctgaagcccttcgaatgctcccgccagccgagcaactccggtgccgccaccgaggcgtggctcaccgactcctgcacgcaccagatacggaccagggattcggggaggggaaagggcaggggccgcagcagcatcgcgtggatggcgctgaacaggacggcgttcgccccaatgacgagcgccagcgtgaggcccgcggccagcgtgaagccgggggttcgtgtcagcgtgcgtatcgcgtagcggaggtcctggaggagcgaatccatggctgcggccatgagcgaaggacatgccaaccgcctcgcgggcgcaaccgccggacatccggagggtgtccttccctgagcgagccaggcgggtgcgcgaatgcgggaaggcccgtcccggaagcggacaggcccggggcgggacgcccgctcaccagcgcgtcagtggacgtcccaccgggcggcgatttcctcgcacgccaaccggacgtcgttcatccggcgctgctgggccttgggcgcctggaagagtcggcccgcgaagacgtcgaacacgcccaccagccgcgggtccaccgggccgcgctgctccagccgctcctcggcgtaacgctggagcaccgtggcgatgtactgcccggagcgctcgtccagcggcgtgtgcttggagaagtagagcttcagcagcccggagcgcatcagcccctgggcatccacgctgcgcagcagcacgtccgggcgcacgctgatgtccacgcccgccagcgccagcggcggcaggtccgcgtccacggggctggcaatcgcgcgggtggccaggtcccccgcggacaccaggcaacgctggagcgcctccgcgcacagggccagccggtgcgcgtcgtaatcgaattccggctcggcgtggaggaccctcagctggtggtagcggaggatcacctcgtccgggccttcgcacaggaactcgatgatggcctggtagacgccggggtagcgcaggtactgcgggtccaccgggtgcgtcaggccctggatgaagcgctgttgcagtcatgatgtcgcggtgaggtactggcccagcttgttgacggaaacgcgcggactctcacgggtgacggtcatggttcggccttcctttccggcttcgggaatgaaggcagactaccggaagggtctgacattcccggggcggccagacgggccagccgccccatgaaaatcacacccgtggggtaggccctgtcaggcccgtcgtggtgggccccggttggacatggaggcgatgacggccatcagctccaccggttcgatgggtttgggcacgtgggtggtgaagcccgcgagcagcgcgcgcgtccggtcctccatgcgggtgtaggccgtgagggccaccgcggggatgccgccaccctgttcctcgggcagggcccggacgcgggcaatgaagcggtacccgtcctcctcgggcatgccgacgtcggagacgagcacatcgaacgaggcctcgcggagctcggccagcgcgtcctccgaagaactggccgtggtgacgatgccgccacacgcctcgatgatgctgcgaagcagctcacgcgtgtcctcctcgtcgtccaccacgagcacccgcaggctcgcgagctggggcgggcaggggatgtcctgctcctgcaacgggccgcggagggtggggggcaccagcacctcccgcctcagcgccacggcctgcggcaggctgacgatgaaggtggccccccggccctcgccctcgctggtggccatcacggtgccgccgtgcaactccaccaggtgccggacgatggccagtcccagcccgagcccaccggccttgcgcgtggtgctgccgtcggcctgtcggaagcgctcgaacacgtgcggcaggaactgcggggagatgccctggcccgtgtcggccaccgtgatttccaccgaggagttccgccgctccaccagcacctggacgcggcctcccttgggggtgaatttcacggcgttggacagcaggttccacaccacctgctgcaggcggctcacgtcgcccatgatggtgccgcccgaatcgagcgcggcctggatgcggatgcccttcgcctcggcggccggccgcagtgactcgagcacggcctccacgacctggctcacgtcgacggacgacacgtccagcttcagcttgcccgtcatgatgcggctcacgtcgagcaggtcctcgacgagctgcccctgggcgcgggcattgcgctccacggtggccagcgcccgctcccgcttctctggcggcagcgtgccggtccgcagcatctgcacccagccaagcaccgccgtgagcggcgtgcgcagctcatgggagacggtggcgaggaactcgtccttgagccggttggcctcctccgcctcctcgcgcgccacgcgctcccgggcgagcaaccgctcccgctccgcttccagccgcttctgggcgcggatgtcgcggccgacggtggcgatgcccatctgccgctgggtgtcgtgctctaccagggcgaaggtgtggtactgcgccgcgatgggctcgcccgtcgggaagtgccggaagcggaacgctccctcccgccggccgccctggaggatggcggcggcgatgtgttcgtcgacgtaggtctggtcttcggccaggaagaagtcccgcaggtggtaccgggtgatgtcctcatccagtcccaggcccagcagacgccgccccgcatcgttcacccacaccgcccggccggatgggtctcccacgccgatgaagtcgggggattgttcgacaatggtggccagccgctcgcgttcccgttcagcgctccgctgctccgtcacgtcctgcagggcgccgacgacgcggtcaggctgcccctgggcgtcgaagtgcgtcttcaccatggccagcaggaagcgctgcacgccatcccagccttgcacgcggcactccaggcgaatcgcctccgcgcccggacgcagcgcctgttcgatggtgcgccgtgcgcggttcacgtcgtcgggatgaatccgggccgcggcttccttcagcgtcggagacttgccggggggaaggcccaggtgctgcaaggcccgctcgtcccacgacagcacgccgcgctcgtactgcaattccacgacgcccaactgaccggcggccagggccatccgcaggcgttcctcgctggcccggagcgcggcctccgcctgggcccgccgggccacctccgcttcggcctgggcccgggcttgcttggcgtgtgtgtaggcctcgcgctcggcgcgcttttcctgctccacggccaggtgggtggccaactcgcgcgccaggtcctcgaagaactggcgataggtgtcgtcgaagcgcagccgggggctgatgcccaggacgaccacgccccggaggctgtccgtgcgggtgcggcgcaggggcagcaccagcgccttctccgtcggctcgggccaggggccgaactggcgggctcccaggagggatggcaccgactccaggaggacggggacgttcgccgccacggcctgcttcgtggcctccgtgattcgtcccaggtccaccacggcgtgctgcgccagcccgtcgagccccgtggactccgccagctccagccgctgttcgccctcgtcccagtggtagatgagggcgaaggggatgtccttggggttgtccgccagggcccggatggcatccgtggtggcgctctcggaaggcccgttcacccggggcgccagcgcgcgaatcgtggccagccggcgttcgctgagcacgacgtcggtgacctcgaagacgacctggaggatgcccgcgatggtgcccgcgtcgtcccgcaggggactgaagtcgaaggtgaaataggcctcttcattgaacccgtaacgggtgagcatgaagtaggtcttcgccacctgcgtcacttcgcccgtcgccaggagcttgcgcatccagggcgagatgacgggataggtgtcgggccagcactcgcggtaggtagcgcccaggtaacggggatggcgcgggcccatgatgaccgcgtagccgtcgttgtagacctggatgagctcgtgtccccagaagatgatggccggggccggcatctccagaatcatggtgacgaaggccttcagcgggcggggccacgattcgtaggggccaagttgggtgcggctccaatcgtgcgagcgcagcagttcgcccagttcgccaccagggacagggagttcagtctgggaagtgagttgtttcacgcggtcggtgggggtgcagggcgggggcgtaatcttgcgtaatctagcgatgcagcctgccgcgtcctggctggatgcgttcggccgaatcgcgatgaagcggggtggcaagcgctcgagtcgcgcccagcgtcgtgccgtgaacagccctccgccgtccgggcgccacctgtccccaggggaagttgatggaggattcatggcgcggcgcgctgtgaaatgccctgacagtctctggctggactttgtactttttatgcaggggagccgtccctacgttcgcgagaggaagcgctcccgaccagggggcgcttcggcgactcgcgcgggccgtgaaggcccgcgccccagcaacgcacggaggcggcgtcatggcggatacggcagagaaccctcttgggctgaatggcttcgagttcgtggagttcaccagcccccagcccgaggtgatggagcacctcttcgagcggctggggttcaccgcgtactccaagcacccgtccaaggagctggtccgctacaagcagggcggcatcaacctgctcatcaaccgcgaggcttccgggcaggccgctgagttccgcgcggagcacggcccgtccgccagcggcatggccttccgcgtggcgaacgcgcgcaccgcctacgagatggccctggagcgtggcgccaaggcggcggacccggagcggggctcgctgggcgagggctcctatgtcctggagggaatcggtggcagcctgctgtatctggtggaccgccacggggagaaggggacgctctatgactcctggcaggagattcctggcgccgaggcggccgaggcgaagaacagcgtgggcctggagacgctggaccacctgacccacaacgtgcgccgcgggcagatgcgcacctggtcgtccttctacaaccgcatcttcggcttcaccgagcagaagtacttcgacatcaagggccaggccacgggcctgttcagccaggcgatgatcgccccggacaaggccatccggattccgctcaacgagagccaggacgacaagtcgcagattgaagagttcatccgccagtacaagggcgagggcatccagcacctggcgctcaccacgccggacatctacgacaccgtggagcggctgcgcgcgcgcggcgtggtgctgcaggacacgctggaaacctactacgacctggtcgacaagcgcgtccccaagcacggcgaggacctggcgcggatgcgcaagaaccgcatcctcatcgacggcagcgaggaagagggcctgctgctccagatctttaccgagaatctcttcgggcccatcttcttcgaaatcatccagcgcaagggcaacgagggtttcgggaacggcaacttccaggcgctcttcgagtccatcgaactggaccagattcgccgcggcgtcatcaaggtcgactagtccgctcgccgcgcttgcgaggagaatccggtgaccacccagccttcctccgaggtgtcgccggggagcgtcctcaagacggctcccggcgcctatctgtctggctttggcaacgagttcgccaccgaggcggtgcccggcgcactgcccgagggacagaactcaccccagcgggcgccgttcggcctctatgccgagcagttgtcgggctcggccttcacggccccgcgccgggagaaccggcgctcgtggctgtaccgcctgcggcccagcgccaaccaccctgcgttccagccgctggcgcagggactcttgcgcagcgggcccttcgacgaggtgcccgcctcgcccaaccggctgcggtggagtccccagcccccgccggcccagcccactgatttcgtggacgggctcgtcacctacgcgggcaacggggacgcggcgtcaggggcgggcatcagcatccacctgtacgcggccaaccgctccatggtggaccgggtgttcttcgacgcggacggtgagctgctcatcgtcccgcaggcggggcggctgcggctggtgacggagctgggcgtgctggacgtggcgccgggcgaaatcgcggtggtgccgcgcggggttcgcttccgcgcggagctgccggagggccaggccgccggctacgtctgtgagaaccacggtgcgttcttccggctgccggacctggggcccattggggccaatggactggccaacccgcgcgacttcctgacgccggtggcggccttcgaggacgtggaccggcccacggaggtggtgcagaagttcctgggcaatgctgtggtcggcgcggtattcgtactcaccgctggacgtggtggcgtggcacgggaacctggtgccgtacaagtacgacctggcccgcttcaacaccatcaacacggtgagcttcgaccatccggacccgtccatcttcacggtcctcacgtcgcccagcgaggtgccgggcacggccaactgcgacttcgtcatcttcccgccgcggtggatggtggccgagcacaccttccggccgccctggttccaccgcaacgtgatgagcgagttcatggggctggtgcacggcgtctacgacgcgaaggcgggcggcttcgccccgggcggcggctcgctgcacaactgcatgagcggccatggcccggaccggaccagctacgagcaggccatccaggcggacctgaagcctcacaaaatcaaggacacgctggccttcatgttcgagtcgcgctgggtcatccgtcccacgcgcttcgccatggagacgcccgcgctccagcaggactacgacgcgtgctgggcgggcttccagaaggcgaagttgccttgagggccgcgtgagcacggggggggagacggcggggcgcaagcgcgtctggtcgacgccggccaacgtgaagctgctcccggtgagcgccctggaggaccccggggcgcgcaacctcgtcctccagattggggacgccttcttccacggcttcctggtgcgcaagggtgacgcggtccacggctacgtggaccggtgtccccacgcgggtctgccgctcgcgcgcgaactggaccgctacctgacgccggacaaggggctcatcgtctgtgcctggcacggggctctgttccaggtggaggacgggctgtgcgtgggcgggccgtgttcgggcgggcgactcacgccgtggccggtgacggtgcgtgacggcatcgtcgtcaccggctgagcacgcggctcaggcgtgcgctgcgacgggcgcggcctccgcctccgtctccgcgtcgagggagaccaggacctgcttctcccaggcgcggctcttccagcgcagccacatggtgatgccgcgcacccattcatccgcggccaccgccatccacacgccggccagtcccaggcccatgtggaagacgaggtagtagcccagcggcaggctcatgcagaccatggacgcgatgcccatgtagacggtgaatgtcgcgtcacccgcggcgcgcagggcgttgatgagcaccaggttgaagcagcgccccgtctccagcgcgagcccgatgacgatgacctgcgctgtcagccggacgatgtcggcgttctcggtgaagagcgagacgatggggacgcggaggaggacgacggccacgtccacgaccagggtgatggccaggccccacttcaggctgcgcagggcctgctggtacgcgtcgtcggcgcggttggcgcccaccagcctgcccacgatgatggacgtccccatgccaatggccaggctgcacaggaagacatactgggagatggcgtgtgcgtactgccgggacgccagcgccaccgcgcccaggaacgtcacgtagtacaggaacaccgtctggcagccctggtacgtggcctgctcgaaggcggagggcaggccgaccttgagaatcttgcggacgtagtccttggagaacgtcacgtagtcgcgcggcgccatcttcaccggcatcacccggtacaggacgtagacgaagacgcccagcgcgatggcccggctcacgacggtggagatggcggcgcccgccacgcccatcgcggggaagccgaagtggccggcgatgagcacgtagttgccacccacgtgcagcacgttcattcccagcgagacgaacatggacgcgcgcgtgaagccgtaggtgcgcagcagcccggcgaagacgttgatgagggcctggatgaacaggaagccgccgacgatgtgcaggtacgtcttggcgtacgccagcatgtggccctgaaggttcatcccgcccaggatggcatccccgctgagcagcagccccgcgctgacggtgatgccgagcgcgaggttcagggtgacggcgatggc

SEQ ID NO: 1218 - DNA, 23677 bp, Myxococcus xanthus
atccgtgccggcgtagaaggtctgcgcgtgcgccaggtcggcggacgcgcggcggtacagcgtgtccagcgtgcgcagctcgcccagcttcagcgtgccggagcgctgcttcgccagcagggcctggagcgcatcccagtccgcgcggcgttgggccacgtaggcgggcaggggcgtggccatctcagcgctctccctggacgcgggcgcgcaggaaggcctcggtgcgctcctcggacgccagcaccgccgcgcgtgcttccgcgtcgtcaggccccacgcgctccaccagccgcgcgcccagccgctgccgcacctctggcgccagccccggcgcgcgcgagaggaaggacagcaccagctccacgtcctccggcgacaggggccgcgcacccgtgctctgtggcaagggcacggacgcggccggagcggcggtgtacttgtccaggtcgatgcgctcctcgcgcaccagcagcgtgccggccagcaggtctcccaggcgccggtgctgacgggtgagcagcatgctgacacaggcggcggcgtacagcatgggcaggaagtccaccgcgcggcagaggttgcgcaccgcgctctcgtagacacccacgggcgagccgtccgtgcgcaccacccggatgcccagcacgcgcttgcccaccgtctggccgtggaagaagacctcgctcaccgtccagtacagccactgcgtggcgaagacgcccaccaccagcagcgtctgccccacgcccgacagcgcctggaagacgccgagcacgtccgacaccagcaacgtgaagacgaagtaggccaccagccagaagaagaacagcaggctcgcgtccaccagccacgcgaggcaccggtagccgatgcccgcgatgggaagcgtgagcgccacgcgttcgggggtggcgacgtcgagatggggagtcggagcggagcgcatgcggggtcggcagcatacacgtctgccttcctcccacgcctccatgtcgcaccccctttttttgcttggacttgcgggactttcagggcccagacgcatgtgtcacggttgacagacagcgccgtgcgggagggggctttcatcgacttgtggacgcccgggcgtgtccggctccggacagcgatgacgaaccaacggatgaaacccctgtaacgggctctgattcatgcacactggacactcccattggggctggttcgcgtctgcgctttcccggtgatagggtttctgcgttggaccatgaacctgggccgaaggaggtgcggcccgcagggacgtcaggagtagctgaaagtcaaaaacagccaggagtcgagtcgtacatcggtaggccgactccggagtggctcagcggacgcgctcgttcttccctgtcatgcaacccactggcccaggtggtaccggagccggctgtggtcagttgtctgttcatgcagttttcgccatgacggctggggggccttcgcatggcaaccaatcaagcagcgattcgtgtatcgattctcgaaggaccgtgggcggcctggcagggcctggccgacgggctccgtggtcaaggcgcgcaggtctcctcggtcacgaggcacgtgcgcctgttcctcgacagcctggggacagacccgccgcaggtcccggtgatgcacgtgcaggcgcacagcgagcccgccgtggcctgctccgtcacggaaggcatcaatctcctgcgggaggcgcgcaagcgccggctggaggtgcggatgctgctgctctccgcggtgagcacaccggaaatcatctcgcagtgcttcgacgagggtgcctccggctacctgttccgcgcggggctgggcacgacggcggtggcgtccgccatcaactccctggtccgaggcgagcggctgtttccggtgcagctcctgaggaacgacttcgaacatccaccggtgacgtcacccaccgcgagcgtgctgctggcgctcacgcagcgcgagcgcgaggtgctggcgtatgtcgcgggcggcgcggacaacctgaagattgccgcgcacctgcaaatcgccgagcgcaccgtgaagtcccacgtcacgcaactctaccggaagctgggcgcggagaaccgcacgcagctggcgctgagggcgtgccacctgggcgtccggccgccgccggacctctaggcgtcgctgtcgttccgctcatgcagcacgccccccggaccctggcgccgttgccaggggtcgcgaggggcgtgcgcacggacggtgccgtgactacgacttcagctcttccatcttcttgcggaggctcagcggacgcatgtccgtccagacctccttgatgtactccaggcactcggccttgaggccctgcttgcctgcatccttccagccgagcgcgttctcgcggtcggccggccagatggagtactgctcctcgtggttcaccacgaccttgtagacggtcgtgtcctctcgctcatccgtcattgatttctctcctggaacggggcgtattctggccacaatccaggaaaaggggtcaagacacggaaggcgtgggtgcggtcggcgtctgaagcccgcatatactcgccggccatgcaaagagtcttccgtgtcatcacggcgctgctcctcgcgctgggcgtcacctgggcggcgctggccctggcgttgacgggggcgggccccgagggcgcgcacgtcctgcgggcgttgggggccgggctgctcgcggcgggcgcggtggttgcctggcggcgtcactcacaaggggcggccctgtccgtcatgggcgttgggtgtgtggccatctgggggtggacccagacggtccgacctgcgacgcaggcggactgggcgccggacctggcgcgctccgcccgggcggtggtggagggctcccgtgtgacgttgcatgacgtgcgtgacttccgctaccgcaccacgtcggactgggatgcgtcgtggtactcggccacgtacgacacgcgtgagctcacgggcgcgtggttcatcgtggagcccttctccggcgtctggggcgcggcccacaccatggtgagcttcggcttcgcggatgggcgctacctcgtcttctccgtggaggtccgccgggagaagggggagaccttctccgcgctgggcggtctgttccgccagttcgagctcacctacgtggtgggggacgagcgggacctggtgcaactgcgctccaaccaccgcaaggatgacgtctatctctacccggtggatgcgtcgaaggagcgcatcgccagcttcttcctcgacatggtggcgcggatgaacgcgctgcacgagaagccggagttctacgacacgctcaccaacaactgcaccaccaacctggtgcggcacctggagaaggtgagccagagccgggtgccctacgaccaccggaccttgctgccggcgtactcggacgccctggcgtatgagctggagctcatcgaccgggacgcgccgctggagcaggtacgccagcgctaccacatcaacgcgcgcgcgcaggcggcggatggacgcccggacttctcgcggcgcatccgcgagccgctggccgccgccaccgccgacgccgtgccgtgacacgccaggccctttacggggtgtggcgcgccttcaggtgcgtgtcgtagtgctgttgcagcgcggcgaagtaaccgcgctcctcccagagcgcggcgatgaggcgctccgtcaaggtcttcacctcggcgctctcgcccggctcgggcgtacgggggccgagggcgtcggagctgaagaaggcgcgagtggcctcggccatgagcaggcggctgccgacgaagagccggcggagggcctgattgacggggcgcgggtccaactccgcgcaggcggcgacgatggcgtcgtgaatcttcccgggcagcgggccctccatgtcctcgggcctcaggtcgccacggtccatggcatggttgagcaggtagccgtggtgcagcgctgatgacgccacgtccacgcagtccttcacccacaagacgaagaagatcttgcggaacaccttgcgcaccgggaagagcaccaggcccttcatgtagctcatcagtcggccgcccgccgtccggccaacgtgtgagccggcgaggacctccaccgcctgggccggcctgggaaggccgtgttcggagaggatggtgaggaccatgctctcgcgggcctgccgtagtgcgtagtcatccagaaaggggacggggatgagcggcgtcaggccggacacgacggcgagaaaggccacgcggcccaagacggggggcagctcgttctcggaaggacggggcttcggctcggtcatatgacgttcatatgcccatcgggcccggcgattgcgcgagccctgaaggcggggagggtgttggctggcctccagccgggcgtcgtggctcaggcctttcgttccccctgggcgtggggctgcagcaggacatagagggtgctcatcaccggcgtggggacgccccgcgcgcggccccggcgcaccaccgagccctggaggtattcgacctccagcggcttgccgttctccaggtcgcccagcatggatgggcgcatgtgggcgggcagcccgtccatgtactgcaccagggcgtccggcgtgcgcgtggtggtgatgccctccgcggcggcgacgctgagcacctcggcggcggcttgccggaacacctcgcggaaggccggattgtcccggagggcgcccacgggcagccgggacgcggtgctgaacgcggacatgcaggcgaggaaggacagcttgtcccagagcgctccgcgcgcatccgccacggcctccacggtgatgcccgcgccggccagcgcgtcccgcagggactgtgcccggtcggagatgcgcgaggtgtcaccgaatacttctccgagcacgattcgatggttcgttccggtctgggtgatgacgcctggctcgctgatggcggtggagatgtacgtggtgccgcccaggacggcggcttcgcccacggcggcggccacttcggaggggctgtccacgccgttctgcaaggtgagcacgaagggcggcgtttcgcccggcgccggtgcgcctcgcgcggagagcaacgtcttcaccgcggggagcacggaagcgacgtcgtagttcttcaccgcgaggaccacgacgtccacggggccgaagcgctggacgtcatcgtcggccttgaccgcgaccgtgaagtctccttcggcgccgtggatggtgagcccgtgttcccgcatggcgcgcaggtgcgctccgcgcgcgaggaacgtcacgtcatgcccggcgcggaccagcttcgcgccgaagaaaccaccgacgcctccagaccccaagatggcgaatcgcatggcgcggaagataaccgcacgtccccagcggggcagggttgaatcacgcgctcgcacttcgcgcatcagcgagcgaggccgctgtgttggagcacagtcgcacgacgaggcggcctgctcgagccgcctctccgcgacgacttcaatggtcctcagcgggtcaacgacacagtgaccttgggctcctcgggaggcgggtgccacgccagggggctcggaggcggcgcggcctcgcggaccatggggcggtgccgtgcgatgaacgccgcggagttctccgggctggcgcatgcggagaggatgagctcgggcgtcacgaaggcggtggcgatggcgtccgcgacccgtgcgtccttgctgccagcggccagcaaatcaatcacatgcggaggcggcggctggagcagggtgttggtccagtgcgtcgccggcgcggtggcggcccacgagcccgcttcggcctcccgacagaagacctcgtcgaagggccggttgtccgccagcgcggtgacgatgtgctccgccaacgcgaaggcggaagcggaccccgcattggcgccctggcccgcgacggggtcgttcgtcacgtgcgtgtcgcccaccgccagcgcgaagcggccgttggagaggggcgcccagccctggcgcaccgtcggcgtgaaggaaccctggaggtagtccatgggacctcgcacgccgaagctcgctgaatccacgcgctcgtaggtggtgggcgcgaagcgccgcaggaagttcatcagcatcgcctcgaaggcgcgcgggtcttcgtcgtagcgctgcgtgctgagccgcgacagctcactgccgggaagggcttcgatgagcacgctggggacccggccgtccgcggtgacgacctgggactcgaagatctcgccctggcccggaatcaggttggcattcatcccaatgggctcctgcatgcgcacgcccttgagcagcgcggcgaagagcatgcgcggcggctgcgtgtgcggcgacagagcgggcacgcgagggaacaggcgtgtcaggccattgcggccggtggcgaccaccatcagcgcgtgctgctgggccaggcgctccagcacgtcgaggtccacgggaaggacctccagcttgccgccgcgcgccacgaagtcctccgcgaggcgcggctggtattgccggtagtccacgaagatggtgggggaatccaagcgaccccggaggctgaacgggtgagggccgccgttcacatggatgccgatatagaacatgtcagcgttggggccgctccagtggtccacgcccaggatgcgctcgcgcatgcgcgtgggggcatggtgcgccaccgtgttgagcagacgggaaacccgtagcctgctcggctcctgctccgtgtagatcgtcacgggcacaccgtgggacagcagcttcagacccaggtgaagtcccgcggtgccggcgccaacaattgcaatgcgctccatatgactttcctccgtgccccgtgccgtcatggctgtgtcgggatggaccccccaagggccaggggcgttccttaacacaacacaaacggagatcttcagacaggacgtacttgatagccgagaaaaagagaggcgcattgcgtcatgcactgatgggcagacgtggacgtcgggttgggaacagcagacgcaaggctttacagtgggacgcaatggcccagttcctcgacgtggcgttgaaggtaggagacctgaccgagttcaccgcggacgcggtgctgttcaaatacgcacaaagtctctatggcgcgacaggtcaagcggcgcggcgcctggagcaggcgggtgttcccctcgcgcagctcgagctcgcgccgggcgcgacgcgcctcgtggagacgcggggggcgctgaccgcgcgacgggcgctcttcgtgggcaccgttcgcctgggggagttcggctaccacgagattcgccagttcgcggtgcgcgcgctggcggccctggagaaccactcgggcctcgcgcatgtcgcgggcaccgttcatggccccaactacggattggatgaagacgaggccgtgctcgccttcgtgggcgggctcgttgaagccttccaacgtggctccgggccccaatccctggcgcgcttcacggtggtggagcggaacgcgagccgggcacaaagactggcgaaggccttcgcgcgcggcctgagcgcaacgcctggcgtggagacgcttccggagggtgtctttcgtgtgcggcgaatgtcttccgtgacgcaggcaccacccctggcgacggcgggcaccgtgtccatggcaaagcctcacgccttcgtggccatgcctttcgcacccgagctggaggacacctatcactacggcatccagggcccggtgaaggccgcgcgcatgttgtgcgagcgcgtggaccaggagctgttcgacggccccatcatccagcgcatccgcgagcgcatcgagacggcgaaggtggtgatcgccgacctgtccctggccaatccgaacgtgtacctggaggtcggctatgcgtgggggcggggccggcccaccttgctgctggtgcgtgacgtgaaggaactccgcttcgacgtcgcgtcctatcgctgcatcgtctatcgcaacattcgcgagctggagcagtcgctgacgaaggagctccagcgcatggactgagtggcgcgcgtcaccagcctcgcgcggtgatggcgtgcgtgccggcccaggtactctgacgcagcaggtgcaaccggtcgtgcaggttgacggaggcgcaggcgtggttgggcaccacgcgtacgcggtcgcccacgcggggccgccagtcggtgctggagaggtccagcaggccgtgctcctcggacaggccgcgcaccaggacgtctggccggtcgagcagggcgccgtagacgcccgtgtcggtgaagccttcctccttggccagggccttggaacccgcgtcgatgacggcctgtcccggcaccgtggtgctcaccaccgtggccagcacggagtaggcacattcctcccacgggcatgcacccaccgatacggcgttgcggtcattgaagatgttgatgcccgggcgaatctccgtgagcccggcgacttcatgcgagcgccacagcgtcggcgtggagccgccgctcacggttttgggccgcagtcccgcgtccgcaagggtgtccacgtaggtggccagccgcacggattgctcacgcatcgcgtcgcccagctccgcctgtggcatacgcaggtgtccggcgtagaaggtgatgccccggtactccaggccactgctggacgtcactgcgcgggccagtgcgactgcgtcctcgggggactggactcccacgcgccgcatgcccaggtccagctccaccaacacgcccaccgtacggcccgccctccgggccgcgcggctcagcatctccagcgcctcgcccgagtccagggccacggtgagccggacgtgtggtggtagcgccatgagccgggtgagcctgtcgtcgcccacgggaggataggcgagcaggatgtcgtcgcagacggtggccatgacctccgcctcgcggacggtggccacggtgacgccctgggctccggcggcgagctggagcgcggcgaactccggtgtcttgtgcgtcttcgtgtggggccgccaccgcaggccgtgctggcgggtgtacatggccacgcgcttcaggttggcgtccacacggtccaggtccacgagggcggcgggtgtcgtcatcatgtcgagccagtccacattcatgccgtgcaatgtggcactccggtgtgccgggctccaggagtaccgggcatgttcgcccttcgttcgtgaagtgctacacctccgcgactcgcgcggcgccacgacccgccaggtgccccccgcgagcgaggccacatgccagattccccgttgaccctcagggccctcaaccgcgcgaccttggcgcggcagatgttgctggcgcgcgagcagacgtccgtgctcggcgcggtggagaagctcctggcgcttcaggcccaacaggcgaagccgccgttcatcggcctgtggtcgcgtgtcgcgggcttcgagcgagacgcgctccaggtgctgctccagcgcaaggaggtggtccgcgccacgttgatgcgcggcacgttgcacctggcgagcgcggaggactaccggcacctgcgagccagcttcacaccgctgctcgaagcctctgtggcgtcggtgctgcgcgagcgcgcgaaggggctggacgtagctccgctcgtcaaggaggcgcgcgctatgttccatgaagccccgagcaccttcgaggcgctgcgcgaccacctggtggcccggcattcccagaacgacgaacgcgccatgggcttcgcggtgcgtatgttcctacccctcatccaggtccccacggagacggagtggggctaccccggcaccacggacttcgcggtcgcggagtcttggctggacgcaccgctgcgcgccgaagcggaccttcccacgctggtgcagcgctacctcgcggccttcggtcccgcatcggtgacggatgcccagacctggtccggcctcaagggcctgaagtccaccttcgaggcgcttcggccttcgctgcgcacgttccgggacgagaaggggcgggagctgttcgacctgcccaaggcaccccggccggacaaggacacggccgcccccgcgcgcttcctcccggagttcgacagcctggtgctcggccatgaggaccgggcccggctggtggatgacgcgtaccgctccaagctcatcaccaagaatctgcgagtccccgccaccttcctcgtggacggcttcatcgccgggacgtggacggtggagcgcaagcgcgcggcggctacgctcgtcgtcgagccctttgcgcccatcaagaagaaggaccgtgacgccctggtgaaggagggcgaggcgctcctgcgtttcatggagcccgaagcccgcacgttcgaggtccgcgggcactaacgccttcgcgcccgacttggagcccaccggcgccttcacacgctcgtggtacagctcgccatcgggccacttgaacatgatgtcggaccccggaagcggacgaagctcactcggcctgaagcccccgctcaggtgcccgagctgcgctccgcggcgagcaccctctccagcgcctccgggctccgccccaccacagtcgtcccgtcgctggcggtaacgatgggccgctgaatcagctctgggtgctggaccatggctgcaatccagtcggcacggtgtgtcgcgtctctgggcagcatctccagcgtggccttggtcgccgcggcctcacccatgcgcaccagctcccagggctccatcccgagccgcccgagtacggcctccagctccgcagcggtggggggcgactccaggtagcggcggacgacgtaggctgcaccggacgcatccatcgcggccatcgcggcgcggcactttgaacaggcagggttgatccagagctccattcggccagtctcgcacgctgcggagccgcccgtccgcactcttgccgggctgtcggtgctgcggcaggcagaagcgaggcgcgcccccgcttggtctgcccgtggaggtgcccacgcgccccgcatcaccccgcgggcggcgggcccacgcacttgccgctgaccttgttcccccagccggtggtgctcgccgctccctcgtaggtgctcccatcccctctcagctcgagatggacggtgccggacgtgccctcacgactgacccaggttccatcgaaggcctggcccgtgaccttgccgttgatggcgccgggcgatgtcgttccggaataggtgccactggcgttctcgccaatctggaccaattgcatggtcccgaagatgttgtccgaccaggtgccggagaatccccagcagccggcaggggtgggggcccccggcgtcgggcctcccggggcagaagcgggtgcacaggccgccgcgaccgcctcttcaaaggcggcgaaatcgcgtccgccgattggctggctccagtcgggtggccggatggcccgaactcccgggcggttgacatattggtagatgtagaactggccgccgttctcacccgagccattgcagttgatgatgctgacgaccgactcctcgacgaggagttttcccgtctcatcgcgcgactcgggctggcgaaactgctgaatgacctcggcggcattcgcgcttcctccgaagaggaccagcgacgacagcaaggcccgcacgctgaggaactccaggtggggccgcgccgctttggactgattcgaattcattctcggctctccattggtggtgcggcgtcgattggccgcacgccgccggagtttgtgtacgtcgtgcctgcgatgggaggcacggcgcgcttgagctagcagcgggacgccgggccctatactccagaccgctggtggggccaggcatggcagcgcgcgtcctgctgacacgcggccgcacatgcagtggcgttctgcgttgaggcctttaggaagcgctcgcctggcacgcaggcttcacgtggctcgcgtgaacacatgcctgtggctcacctgccatccagcgaaggaccgagaccggagacgtcttgtccgccgagatgagggcgacgctgccgatgccgaggagtcggtccagcaggctctgctcgacttgctggcgtgacgtgtttttccgcttttcctcgggctaggctgcccatgcagcttgctcaggaaaggtggtttcgcatgcgtggttcactgaagcggttcgcgcttcacggtgccgtgttgctggccgtggcagggctcacgggctgtggcgtggtggacgaagaaggcgcggcgtccgacggcgtgagcgaagaggcggcgctcaatacggggtgctgcacggcgctgacggggacgacccaggccttctgtgactcgattccccagacgccggggcgctgtaatgaagtcaaccagggtagctcctgcatctggacgtgcacgggctgctgccaggcgcttccggggacggcgcagagcttctgcgactcgattccccagacggaagggcgctgcaaccaggtgtggggcggcacggcctgtacctggacctgctgattcgcggtgcagcaccgcatccaccgccgcgccagcgtccgggcggcggtggatgcaggcctcacgcggctactgcggcttgggcgccgcgaccttcttcgccgggggctggtacttcatgcccagggcgttgaacacgaacgagtacacgtccacttcctcctcgatgcgcgcgttcagcggcgtgccggcgccgtggcccgtctccgcgttggcgcgcagcaggatggggttcttcgccttggtggcctcctgcatccgggccaccatcttccgcgagtggaacgggtccacgcgcgggtcgttcgcgccggacgtgaagagcacggaggggtaggccgtgccgtccttgacgttgtggagcggcgagtacgcgtgcagcgccttgaactgctccgggttcttcacggtgccgtactcggtgatgttgaactggccgttgggcgtcagctccacccggagcatgtcgtagatgcccacgcgcgccacgacggcgccgtacatctccgggtgctgggtgacggccgcgcccatcaggaggccgccgttgctgccaccctggatggccagcttcttcggctgcgtgtacttctggtccaccagcagcttcgcggcggcgtggaagtcgtcgaagacgttctgcttgttcgtgagcgagccctcggcgtgccacttctcgccgaactccgagccgccgcgcaggttggctaccgcgaacacgccgccctgttccagccagaaaccggccagcgtgttgtagttcgggctgatggagatgttgaagccgccgtagcccgtcagcagcgccgggttgttgccgttgagcctggtgcccttcttcttgaggatgctgacggggaccttggtgccgtccttggacgtggcgaacgcgcgcaccacctccacgtcgctcaggtccagcggcgacgtgcgggccagcgccgtcttcttcaccgagttgtccttcgccgagtaccggtaccaggccatcggctgggtgaagctggtgttgatgaagagcacgtcgtcatcgccctggctcacgagcccgcccacggaagacacgggcagggtgggcaccatccccagcgccttgcccttcaggtccaccatgcgcaactgcgaaggcccgccgagctgctcgctcacgtagagccgcgacttcgtggggaagaagccctggatgctggcctcgccctccggcaccaccaccgtggccttgtccagcgtgggcgtggccagcggcagccgcagcaccttgccgcgcggcgcgtccttgcggctgagcaggtacatggcgccgtcgtggccgaagcgcgcgcggatgactttgtcctcgaacttcgatacctgcgaccacttcccggcggcgtcgcgcaggtacagcatgtactcgccgccgtcgccgttggccacgacggcggagatgtgctggccgtcgtgagacgtgtccagctccgtcatcgcgatgcgcgggaagtccttgcccagcacatacgtgtccttctccgtgggcgtgccgagctggtggaagtagacctgctggaagaagtcacggtccgcctcggggcgctcctcgccgcgcgggtagcgcgtgtagaagtagcccttgccgtccgccgtccacgtcaggctgccacccgcggtgccaccattcacgcggggcacggtctcattcggcagcggcttgccggtggccacgtcatagacggtgacgtcgccgctctcggtgccgttcttcgacatcgacacggcgatcttcttgccgtccagcgtggggacgtaccagtcgatggtggtgtggcccgaggcgtccaccaccatggggtccaccagcacgcgctccttggacgtgtcatccaccgagtcgagcacgaccaggaaggactgctgcttgggcggctgggccttcatggcgaacaacgtgccgccggcctcgtgcagcccgccgtagccaggggacttccagctcagcagctcggagacgcgctggcggatggcatcgcgtccggacagcttgtccaggagggcgcgggtgtacgcgttctgcgcgtcgttccactgcttcacctgcgcgtcggacgagtcctccagccactggtacgggtccttcaccgccgtgccgtggtaggtgtccaccgtctccttcttcggcgacgcgggcgccttggaggcagccttgcggggcgccgtcgcggccggcgcgggggcgggggcggctggcgcagccagcggcagggtcagcaccgccgccgtcaatgcggtcttcagcttcacggttcacctcggggttgggaaacgcgcacgcagcctgccacgtcccttgggacgggaaacggcttcgttgcgtcgggaatgccgccgtgcgccgggtgttcgcccgcgcttccgccgtgcaaccgttgggaatgagacggtgcgtcctggccgtcagcgcagcggcagtgtgaccagccccgcggtgaaccggtcgaacgcctcattggcgggcagagcggtgccgtcgtccatgttccccagcatcagcgcgaagacgacgcgtgggtgccgcgcgtctcccggccggtccactacccccacgaagcaccgctgaccggacagcgtgcccgtcttcgcgcggatgtggcccgcggtgtcggcggtgacggggcgggccgcgagcgtgccgtccaggccggccacgggcaggctgtccagcagcgcggtgccgtaggcttcacgcaggctggtgaagatgacgcgcaccagtccccgcgcggtggccaggttgtaccgggacaggccactgccatccaccgggcgcaagtctcgcgaggggatgcctcggcgggtcagttcctccgtcagcgcggtgcggagggcgccatagctctccgtgccggtgagctcgcgcgcgaagcgcaggcccaggcgctccgcgtacaggttgagggattccttgttcgtcaccttcaccaactcggacagcggcgggctgaccagggtgaccaggggtgcgggcaccgcgggttgccgcggcgtgggcgcctccagcgtcatgggcagccgagggatgccgcgcgcgagcagggcggcctccacacaggcggagaagagctgctcgggctcgtccaccgacagcctcaccgcggcggagcgggggcaggtgtccgcggtggagcgccacaggcagcgcacgccggggccgccacgctggcgcacgcaggccagggaggggcgctccgcgttcgtgtccacacccaccacggccggcagcgtcgcgaaggtgggggtcacctggatggtggggggctgcgcgcaggccgcgcccgccgcccgggacagcgccacgtccaccacgttctcccggaagacgaaggccgttggcgccgcgctgtaggcataggcggcgtcatcccaggcccagccagggccgaacgggaactccgcctccttcgcgccgcgcacgcgcacctgcccgcgccactggcggatgccgcgcgcctggagggcgtccgccacctgctcacacgccagcgccgtctcggggaagcgccacgagcccagggacgggtcccccgtgggctccaccacgatgtcacccaggaagagcccgccatccagcgtgccctccagggccaccggcgtctggaagcggaagtccgcgcccagcgcggagaggaccgacgcggtggagacgaccttgagcgtggaggcgggcaggagccggacatgctcgcggtgggtgaagagtggctcgcccgtctgcgcgtccaccacgtaggcgctggccagggcgccttcggcctccagggtttcgaagagcgcgcgggccagggagggaagggtgtcgccctcggggcgcgtctcgcggaagcagccggagaggaccaggggggccacgagcagcagcgaggcggacaggatgcggcgcatgtcgcccgccacgctaccgccgtggggcggccctgtcattcggccggggactggccgcctggaaagggagcgcggccacgaggaaggcgccgccagccacatcgagtgccttgacggcacggcgctcgcgccccatcctgccgcgccccatgcctgtccttcgtggtgctgtcacgctgtcgcgcttccgggtcgaaccggcgaaggaagcgccttcggatgtcaaacgctggctgacgcgcggcctcaaggcgcacgcgttcgagcccatcgaccgccgctccgaagaagagcgcgccgtcggcttcgtggagctggagaacgaggagtccagcgagttctccgccggccgtctctattacggcgagtacgccctattcgccttccgcatcgacaccatcaaggtgccggccgcggcgctcaaggcggagctggcgaagtgggccgccgccttcgagaaggagaatggccgcccgcccagccggggcgagaagacgcagagccgcggtgaaatccgccagatgctgcgcacccgcgccacgccccgcacgtcgacggtggacgtgagctggaacctgaagacgcagcaggtgcagatctggtccgcgtcgcgcaaggtggtggatgaaatcaccgtcgcgctggagggcgggctgaacgtgaagttcttcggcatgacgccgtcggccatggcgcagacggcgggcatcgacgagtccctgctggggcccaccacggagctgattggcatggacctgccggcgacggcggaggtggcacatggcgaggcgtgacgaggcgcgggccgaagcggccttcatgcgcggtgatgtcggcgtggacggcggcgccaccgaggagacgaaggacgaggccgaagtcgaaaagggcaaagcgcaagatcagttgctgcgtggccgcgcctatctgggccgcgagttcctcacgtggctcctgtggcgcaccgaggccggcgggccgctcgtcgaggtggagggtgaaggcgtcagtgtcctcttcatgggccgggtggtgctgcgcggcgtgtccggtgaggtgacggagatgagcgccaagggcaccctggcgccgtactccgagcaggtgaagcactcgctggaccgcgggctgttggtggcccaggcccgcctgcgcttcacccagggcgagagggagttcgaggccacggtggactccgagttcctcgacattcgcgcgggcaagctgccggcgctgatgagcgaggaggaggatgaccagctctccgagcggctcttgctgatggagcaactggccgccatggtggacgcgctggtgcaggactacctgtccgtgcgcgccagcaagggttggagcaagacggtcgtccccgcgatgaaggagtggatgcgcggcgacgagcagggcgcggacgcgctcgccaaggcggcccgcgcccggggccgtgacgctcgcacggcgcggagctgagcgggccgtctagcgtgtcgccgggtccggatgcggtggtgtccttcgccgcatccaggccagcgccaggccgggcagcaacaccatgcccgcgaagagcagcaggaacgactccatccgcgcggcgctggcgcccagcgcggcataggtcaccgacacgcccaggttggccagggcgctcacggtgaggaacgtccgggggcgcatgcggctggttcccgcgaagagcacggacgtctccgccagcaccggcaccgcgcggaaggcgagcaggaaccagggccccatcctttcggcggcgcgggtcaggcggcccaactcggcgtcacccgccatgcgccgcagcgccgccgttccggcccgcgcgcccaggcaatagcccaccacacagcccgccatcatccccagccaggatgtggccgcgccgccccagaagcccagcagtccccctgcggcggtgcccaccaggctggagggcaccggcagcacggcatcaccggccagcagtcccccgagcagcagcgccacctgccaggagggtggctgcgtggccaggaagtgtccggacgccgcctccaggctgtccccgaaccaggcgaagggcaccaggatggaggccagcagcagcccgctgaaggccgcccagcccatgatggcgcgaccggacagccggccttcgcccgccgccgtcaggcccggcgtgggctcagccatccgcgatggggagccgggacgcggcggccatcagggacgtctcgcgctcagcggccagcgagccttcctcggtgaaggcgatgcccaccaccgcgcgcacacggcctgtcgcatcgagcactggaatcgccaccgccgcgcgcgcgtccaccgccttcgcgccgggcttgatgtcgctggacgtgtcctccttcaggttgcacgtctgcacgggttgcttgcgcacctgggcgagccccgccatccccttgccgtgtggcacgtgctggacggccgccatcaacggcggcgggatgttgagggcagccacgaggaagaggtcgtctccccgctgaaggtggacggtgcccgcggtggctccgtgctcgctggcgaacgactccagccacgactggtaggacgcgctcttttcattcatggcgcgcaaaactgtgcgccccggcttcgcccgcagtcaacgcgccccggcctcgagtcgacgttcgaacccatcctccgcgagactgttcagcccacgtcacttccatgtactggagggcgactcgtcctcccgcccgtgcaggatgcggcgcgatgctccgctggaaggtcgcaggttctatctcgggttgctcgcgctcggcctgctggtgccgctcgtgctcttcggggcgggggcggtgaaccgcttcgcggcgtctcagcgcgaagcccgggcccaggtcatgcgcgagacggcccgcgctggaggcgggcttcgacgagcacctggtgaagccggtggacctcacgcgtcagcgtgagttgctgctgccggggaaacgagccgtgccggctcactccacgttgccgggacaggtctggaccgcgggctggcataactgcaacacgcgcgttggggccgtgaaggtctgcttccgggcctggatgtaacaagccgcggggtcttcgtcgggcgcggcgaactgacacagttggacggcctggctttgcgtgagtgagccttcatcctgggcgcgcacgaagcagtcggcgggcgtggatgaccgagcgccgcggcagagttgcgtggccaaggcgtcgtcgagtccgccgtcggtcgcgcgctggtagcaggacacctgaggcacgacgccctgggcggccgcggccgctggcactcccacgaggccgagcacggcggtgagcgcagcgcccgtgaacggacgaaagaatcgggatgtcgccccaatgcctgtcttcatgaggcctcctgtccgagcaatctaggggcttatgcgcggtgaggccggctcccgcccggccgtccgccctggggcaatgcggcaagggaaggggtcgttccgccgcctgccttatgcgggaagattgtcggatggcgcgccgcgtccggggcgcgacgtcgcaggaacgatgcgcgggcccacttcacgacgactgtcacccacgcggtccggcatccagcagaggacgccttggacgtgcggtccggcccctggcgttccgcgccttcccgaaccaccacagcatcgccatgaaacaacgacgatcgtctgtcctgatgctgctgggcgtggtggcgctcgctatgagcttgctcggcatttcgctcgcatgtcctggcgcttcgggtgacggttccggtcgcccaggggacgaagttgaaatcaccgacccctcaccggaaggggagccgggtacggacggagacgggagcgctccgacggcgccagatggtgggggcccggattccctggggctcttcgggctcgacgtgcgtcccgcgaaccctacgtgcgtagcgcctccccggcccccggaccccgcgggggccaccatctcgcgcgcattcccggagctgagcttcacccagcccttgttcgccctccaggcgccgggggacagccgccgcatctacgtggtggagcgagggggacgggtgcgcgtgttcgacaaggacgccacgccgcccgtcagctccgtgttcgtcgacatctccgggcaggtgaacgtggagcatgatgagacgggcttgctcgggatggccttccatccggcgttcgccaccaatggccaggtgtttctctcctatgtcggaaacaacgccatgggcagtctacgctcgtccatcgtccgctaccgcagcccggatggcggggccaccctggacccggcgagcgcggaggtcgtgctcgaacaggaccagcccttctccttccacaacggcggccacctcgcgttcggaccggatggcttcctctacttcgccttcggtgacggtggcggacgcgtagacccgaaccggacggcccagaatccggagctcctgctggggaagatgctgcggctcgacgtggacagcgcgcggccctatgccattccgcccaccaacccctacgccaccgccggcgggcggaaggaaatctacgccaccggcttccgcaacccgtggcgctggagcttcgaccggagcacgggcgcactctggctgggcgacgtgggcgaaaagctcctcgaggaaatcaaccgcgtcgagctgggaggcaattacggctggagcatcctggaaggaaccgagtgcgcgcgtggtggcggctgccgcaccaccgggctgacgccgcccgtggccgtctatggccgcgcagaaggtgtctccgtcaccggaggctacgtgtaccgcggcaccgccgtaccgtcgctcgcgggcaagtacatctttggcgacttcggctcgggccgcatctggacgctgccgggtgacgcccttcccggtgccgccgcggcgccccaattgctcgtcaccacggcgctcagcatctcctcgttcgccgagctcaacgacggcgagctgctggtggtggacttcgcggggggaggactgcacagcatccacgcgtctctgccccccgcgccggggggcgaggcgttccccacactgctgtcggccacgggctgcgcggacccgacgaacccgaacctcccctcggcgggcctcatcccgtacggcgtgaatgccccgctgtggtcggacggcgcggggaaggagcggttcatcggtgtgccagacggggcggtgatgacggtggggccggagggcgtgctggacgcgccccccggcaccgtgacggtgaagacgttcctcctgggcgggaagcgcgtggagacgcgcctcttcatgcgccatccggacggcatctgggcgggctacacctacgagtggaatgacgcgggtaccgacgcgacgttgctggagacgggcaaggtgaagacggtggggacgcagacgtggacgtaccccagccggggggaatgcatgcagtgtcacaccgccgccgcgggcttcgtgctgggcctggaggtcgcgcagctcaacggggattacacatacccgggcgggcgcatcgcgtcgcaactccagaccctggagcatattggcgtactgaaattgccggccccggtggagcaattgccccggatgcctgcctacgccggaccggagcccgtggagacgcgcgcgcgggcctacctgcacgccaactgcgccgtctgtcaccggcccaatggcctgggccgcggtgagttggacctgcgcttttccacgccgctcgccgcaacgaagatttgtggtgtggcgccagaccacggtgagctgggcgtgcccggagcgatggtggtcgcgccgggagacccgtcgaagtcggtcctgtcgcggcgcatgcactcgctgtcgacgccacgcatgccgccgttggcaagcgcggtgaaggacaaagagggcacggggctcgtggacgcgtggattacgtccctgcccgcgtgtcccacgggtccctgaggcctcgcgggacgggggcgccagcatctgtgcgagactggcgcctcaggtgggccgctggacggtgccgggggcgggcttgccgtccttcaaccctggcgtccgcacgtcgtagtgcgccaccacgggttggtggtcggaggactcggtgctgcggtccacctcgaagaggcgggggaccagtccagggctggcgtagaggttgtcgaagcgcttgcccgtcgcgggcaccacgccattctcatccggcagcgaggtgagggtggcgctgtccgcgatgtcctggagccgcagccattgctcgctgccgcgttgcacccggccggagcgcagctcggcgcacgcctgcttcggcgtcatgagcgagccatccggcaggcgcacctgtgcggtggtggcatgggcgatggtctccggcaggctctgctccagcacgtggagctcgtgtcgcaaccgcgggtcggcgatgttgcccaccccttcgtcccccacgctggcgtggggctcgccgtagcgaacctcgtattcctccaccgtgtcggtgtcgtcgtaggtccggaggtgggccatcagccaggagccgcctgacttgatggcggtgttggcgttgaagtcgcccagcgccaccgcgtgcatgacctcacggtgctgtagcaacgcgttgagctggcggaggttgcgggcgttgatgccggagtcgcccagggtgtggtgcacgttgtagagcaccaccgggtgaccctccacctccaggcgcacgtacagcgcgccccggtcctcgggaatctcgcaggggtctccgccacgccgcatgatggccgcgtcccgctccgcgtcgggcgtggcgtacgtgaagtgcgccgcgtccaccagcgggtgccgggtgaggaaggcctttccgttcatcagccgcgcgccggggccgccgtcatgcccctggtacgccaggtggaagccgtagcgctccgccaggagcacggcgatggggacgttggcctcctgcaggcccagcacgtccggcagccgtccgcgggcctccaggttgtcgaagtagtccagcagcgcctggcggcggtgcccaccgagcaggatgttgtacgtcatcaccgtgagccctggcccgcgcggcgagcgcaccgcggggttgcggatcaccagcgtgcggccgtcgcccagcgctcgctccgtattgggcagggacaccgcggcgaagtccggaagcgtcacggggctttagagcac

SEQ ID NO: 1219 - DNA, 22761 bp, Myxococcus xanthus
  unsure (1)..(22761): unsure at all n locations
gcgcgctcgggcccttcacggacatcgaccggccgctcgtgcatgacaccgcgatggggatgattgacgccaccttcttcacgagcaccaccggggcgccctacctggtgtggaaggcggacggcaatgcggtggggcggccgacgcccatctacgggcaggcgctgtcagcggatggcctgtcgctggtgggctcgcgccagacgctcatcagcaacaacctctcgtgggagggcggagtcgtcgaggcgccgtgggtcgtcgctcggggcggctactactacctcttctatagcggtaacgcgtactacaacagcacctacgccgtgggcgtcgcgcgggcgacgagcccgctgggcccgtacaccaagctgggctcgccgattctcaagacgggtggtggctgggtggggccgggacacaactccgtcgtcaccggaccgcgcggtgacatgtacatggtctaccacgcgtggaacagcgcccacacggcgcgggtgatgctcgtggatgcaatcacgtggcccaatggctggcccgcggttccgtccgcgccgtcggcgagctcgcggcccatgccgtagcagcttcgctgtgacgactgcctccgcgccgcggcctcatgcgcctcggcgcggaggtgcgcgtcggcgggggagggcggtttgcccgctgaaggcaatcgacagctctgcgtggctcgaggcacctcgcagcgcgcggaaaatcgcgcccctcggtcggagcatcggggcggacatcggcgtaatcgtgagccagagtctctctttcaccacccgaagctcagtcggtcggctcctgccccgacgggatgaagacggggagcacctgtccttccagccaggcgtccatcatccggttctcaagcaacttcccgacgacgtggtagcgcgacaccatcgcgggggaggtgagcgcgtcctcgcagacgaccgtggcttcgcgcaggtaggacgcgtgacacatccacacccgcgcgctgtcgttccagaggaacccgacgtggtagtcgagcccgacgacgtagagcccctcgccggcgcgcctcacactgtcgaggaccccggacacggggcggttgcgaaacctccagattttcttcggaggtgccagcgccttcacgatgtactcggcgcgctgctgggccatttgcgtgcgctcgacacggaagccggcgtcccgcagcaccgtggagacgaagtagccacaggcgatgctccctgtgcgtggcgtctgcctcggcgcggttgcggttgcacgcggccttgtcggcgcagccgcggaagtagtcgccgtcaggaagttgggtggaatgcgcatcggcgcatcggctacgttgcgccctttcgacgcaacgaaaggcgtgcaggaagcttcgccggggggcgacggttgcttgccggatctgccgctggaaggagctggagatggagcgcaacgacgagaaggggttcttttcctgggtcaccagcctggtgcgcgaccatcgcggcgcgctcgcggcggtggctcgaaacgagggcctgctcgccgacgacgcgctcgacgcggtccaggacgccttcgcgaccttcctcggcctgccccacgcgcggaagctcgcgtacgaggaggacgacagccgcaacctccttgcgatcctcgtgcgcaaccactcgcggaacaggaggcggcgccacgaactcgcgcggccgcatctcagcgacagcgaagtggtcgagagcctgcccgacgatcgggagagcgtcgattcgctcatcgcgcatgccgaggcgcatgtgctcgccttccaatgcgtggagaagctcgccgcagtgcagcgccaggtggtgacgctgcgcctcctcgaggatcagccgggtgtccgtgtggcggatctccttggcaccacacctggcaacgtcgcggtgctcttgcatcgcgcgaagcgtgaactccgcgcgtgcatggaggagtagcgctctcaggcggcggcgcggtggaactgctcggccggctgcggcttgcgctgcgccagccagacccgcgcggaatcggccatggtgacgatggcggcgccaatcatgattgcatccttgaccaccagccgcccgcggccgctcagccacggaaagccgtggtgggcgtcgccgagcgccggcacccagctctcaggtgtggtgacgagaaaagagagcgttactaccgacatgccgatcacgagggcgctgccaatcgcgccgagctccgggcgccaccaatgggcggcgatgagcaggccgaatagcacgatcacgccgccgagcaggtaggagaacccataggtcccgttcgcctcgtgccatgcgcggttggcgggaacgagcgcgccttcggcattcatatgctgccggtattcgggggcgtcgtacgcatagacgaagctcatgaccgggctgttggccacgaacgggacgatgccgtcggcttcgtattcggcgaccttgagcgagccaatccagacgaggacgacgatcaggccggcgcgaaggacgttcattccgatgcggtcggcacgggcggcgagacggaggagtgactcgatacgggacaaggatggatctcctgctgtgggaagcgctcgagcccacggtttcggactcgaacgctcgcgctatgcagtcatcaggtctcgtcccgcccgggcattacacggagcatgcgaaaggcgagcgaggcggcgtactgccagccggtgcgagcacctgaggtgggccgcctcccgcggaggcgccatgccagcgcgagggtggcgtcatgttgagcccgcttggacgccgctaccgcgcgacctgggcaaactgggacacccagtgcatcaggtttttgagtacgctcatggaaaacaccgaaatatttcagccggcgaccccgggttcctcgaatgaagcgctcctggcaccgtcattgctatcgagggcgaggtcgttcctaaagaggagtgctacttgaactcggatcaactgcgtcggctcttcgctcgagcgctgagtgcatcactggcgtccccgctgctgctcaccggttgtggcagtggggatatctccctggaaggctacacttcccccacctgcgataatggaagactgtcggtccgagggctgtctcccgcgacacagacggacttcgtcgcgatgaagctcatcgccgacctgtacaccacgccccggcagcagaccctcgtctcctcggggacgccgtgcgagaccgccacgcagccggtggcgtgtaacgcggagctcgaggccctctcctccgaggaggggtttcgctcccgctgcgatccggactgctacgcgttctacctcgtgacgacgcgaggggatgcggtggaggcccacacctctcaagaggcgctccaggccttcctgggcgacatcgacacctctcaggaggcgctgctccaggtcttcgcggggggctacgacctgagctgcaccgagttggagaaaggcgcggtgaaggccaacgcggacgggaccttcaacgtcgtcgcctcgaaggggtttgcgtgtggagagggctccaacctgacgcagtatctgctggaggtgacaccctcgggcgaggtgcacgtgaagcagacccgcatcctggagcggggcacgaaggggtgcaccgtggggcgcaggcccgcgggactccgctcggatggctcgattgcatgcgcggatgagctggggcagcacttcgcgctcattgcccacctggaggaggcctccatcacggccttcttgaggctgcgggacgaactggcgctccatggcgcggcggtcgagcttcagcaggcggcgctgcgcagcgcactcgatgaggtggctcacacggaggtgtgtggacgactggcgcgtcgtcatggcgcgacgcctgcgcgcgcggtggtggcgccgctcccgcccaggccgctgaacgaggtggcgctggacaacgcggtggagggctgcgtgcgcgagacgtacggcgcgctgctggctcaccatcaggccctgcacgcggaggacgacgaggtgcgcgaggcgatggtccgtatcgccgaggacgagacccggcacgcggacctgtcctgggccatcgaccgttgggcggtagagcgactgccgtccgccgagcaagaggcggtgcgcgctgcacgtcagcgggcggtggcggcgctgcgtgaggaggtctccgcgccgaccgatgcggcgctcctgcgggcgctggggctgcccgaaccggaggtcgccgtcgcgatggtggacctgctctcgcgggagctctggaattgagggcccgggcctgctcctgaagcggccaaggcgtcgagggtgagacaccggagcctcgcacgatgcccttgtctggagcaggccgagccttgaggcgggagtcctcgaacgaggtttctcccgccccaaacctcacgtggcccgaggtgcgaggcgaggtctcacgggaacgccatgatcgtcggcggcgtggtgctggtgaagaagtccggatacctcgctgtgtagtggctcccgctgccgctctctcccgagatgacgccggtcttcgagcccgagacggttaccgtggtgccgtccgcggcaatcgccacgttctccgacacgatgttgcccgcccccaggaagacgcccaagccgctgctccggatgacggtcagtgtggccgggtccacgtggtgcacgctgagggtgatgggcgcgctgccgctgaggctcgacttcttggtgtagctcgcggcgattcccagcgcgttccccgccacggatcgcgtcggctcatagacgatggacgtgcccagggtcacgctgccgtaaccatacacacacgtcgggatgggctggcggaagagcttgacgtcatagacagtcggcgtcacgttcggctgcgggtacgcggagatgctgtagatgcatccgtcaagcgacacggatgacaccgctgactcttgctgcgccagcgcgtcgtcctgcccggtcaccccatcctctccgccgcaggcagggaagagaacagcggtacaaagatagacagacattttgaagaatcgcatcgtgcaatgactcctttgctcgcgggggaagcgagggaagggtaacagcaaagccattctcttcgtgggcaatctgcgcgcatccactcgctcatcgatgaccccagcggtggagctggtggcgctcaggcctgacacacccgggcgctctccgtgtttcccctggggtaccttcgacacgcttcctcccggtgtcttcccaggaaatggagcggctttgggccacgatgattgtcgaagccggctgtgtcgctccctttgtcgtccggggccggttcagcgaggggctcgaaggcgaggcgaacctcaagccctgcatctgcgaatgggacgcagcgcacgtcccgcgttttccctccgctggaaacgacgaagcccccgaccctctacagggccaggggcttccagggatgccttctgcgcagcaggcactacacgatgggcatgaagaccttgaagcccgtgcgcccgctgttggtcgtgttgcgctcgatgaagtcgctcgcggacgagtgaccatcacccagggtgacggccgtgtggccgtagatgctgcccaggcgcgtggaggtgctctcccaggtgaggacgaggcccggaatcttcagcgcctcctccagcgacatgttgacctgcttgaacttgtcgcgcgggaggttgttgtcaatctggttgccgttgcccgacacgccaatgcccagggaattgcggatggcccggctgacgcccgtggcgcacaggccctggctgttgtagccgcccatgcccatggccgccgagcgggccgcatccgccagtcgacgcatcgcgtcagacgcgttgctgggccccgcgcccgtcgggccgccgacgtccgctccaccgctcacgccaccagaggggcctccaccgcgaacgccctgacggccgcctccggcgtcgaagctgtcacgaccggagtgcccgatgcgcagcgtgttccccgcgtagatgaggtcggggttcgtgatgttgttgtcacgggccagcttctccaccgtggtgccgaaacgggccgccaggccggagagggtatcgttgggacggatgcggtagttggacatggaagctcctacacccattctcgcgacttccccggtggagttgcttcacccttccaagattcttggattgtttggggagtctcgagatttcacccagagcgacgctcgtgcctctccatgtgcggacgcacccatggcgtgccaggagccggacattcggagaaggcccctgccgagtccctcctgtggcgcggtcatcgcgccgcgcgtctacgactgccccctctgcgcctgatgcggcgactggtcagtgacgtcaatgactggagtgacggttctcctgcgtggacttcggccaactgtgcagcaccgtgacgttcatcctgtccggaggccgcgtggcgccgtcacgactccgtcacagcaaccatggtctcatcgcatggtgtccagggcggacggtgggggagcctgctccgacgtgcccgcattcctttcatgaaggccacctccgcccagggtgcgtgaagcgaagtccttcgtttcctcgttgagcggaggtattgagatgatggctcgtctgatgcgcgtcctggtcatggggctggtgtggatgccgttgctggcgcgaggacaggggctttccaaggaggaagtccgcgagcctcccgtggacatggcgtcacagtcctctaccgagtcgccgcccacagcctcgccgatgcagggctccggggtggcggcggatgatgactactcacttggagggcacctggtcgtcgggacgctcctgggtggcgttgggctcttcactggcacgctggtgggaggattggtcggcgcagtgctggatagcgattgcccgctgacgcgctgcggagacacattcgcgttcgccattccaatgagcctggggaccgcgctcggaacgtcgctcgccatctacctgacgggggacaagttcaacgggaggggcaacttcggccccaccttcctgggcgccgcactgggagcggttccattcgccttgctcacgaccagccgccacgatcgcgtggcgaggattggcaccgtcgggatgctggtcactcctctcatcggttcgttcacgggctactggctttcgcgatcgccgagcccttcgcgcgggacagcgcgcgccgagctgccggaagcccaggctgctccggtgctgggcctgactcgaggcggtgggctcgtcggggtgatgggacacttctgagcctccgcgatgcggatgagacgcagttcctctacggcgattgtttgggggaggcggagcactgctttctgtacgatcaagagcagggcttccggtcagtctcgcccggccaggagcttgggggcggttcaattcggcggagcctggcgaacaccacgacgaccggcacgcgccgcgcctcagcgaatccagcccgccgcgcgaaagatccgcgcgtagaggtcgcggatcaccggctcctttcggcggttgtattccatcacatcgtccatgccttcggcggaggtgtacttgaccgccgcgtagcgctgccggtcgtcgtcgtgctcgcgcagccagtcgcggaacatgaggtggcgaatcacctcggggcagtccgggccgaacacatgcaggttcacgcgtggcgcggcgagccgcaggcagcggtgctgatgccaggacggctcgcggatgatgaggtcgtagcccaggctctcgagggcaggcacatagtcgtcctcgcgcgtggggtcggcgacgatgaggtcgatgtcgatgatgggcttggcggaaaggcccggcacggcggtcgagccgacgtgctcgacctgcatggccgatgcgcccatcacaccctggatggccacggcaagctccgcgtagcgcgtcggccatccggcatcatagggagcgactgcaactttctcaggagcgggctttccttttacccaggggttctcgcctgggtcggcatcgtaatgacgcatgatgtcttcggggcgtggcatgctgggcattctcgttcagcttcgcgttgtggcccatgcgaatctcgccatgcgctgacgcggagcccctccgcaagcactggcacctccatgagctgagtcagtggtcgcgcggtatcgctgatgcgcatgacctcctccggcgaacacgggccaacggtatcggccggggcattccaatgaaggaagtgggccatgagcttctcgacggtaaagcgccacttcggcgtggtcggctgacaaattcactcggacgaaatactccgccttctcaggggcgctccccgaggcgctgtgcgccagcagcactccgctcccgcgggaattcagtcgtcgcgcacgttccggacatccggcttcttgcatccgggcgtcaggcacaccccgcccacgactgcaccgcccccgaaccccggctgaaggtccaacgtatgcgtgtggaagcgcacgcggacgaagggatgaccacaccgcaggtccatgtccagggcagggtcatgctcctccgggagcagcggcagcccgccgatttgaagcgcgagcggatgtcactcgtgttgacgcgtgaggaagcgctcgtaccgccacggcacgaagcccttgggaaacggcttcttcagcgcggcggcgtcccggtactcgacgaaggcacgcgcgggcgtcttcggggcgcgcgctggcttcaccgcgcgggcgaacagcaaggacctgtcacaaggctcgcactcgtagaggcgcacggtgcgcgcctccatcccagcgtcgagcgagggaatgtggagtacgcggctcggcttcacgcgccggttgcactcggggcaggcagcccgggccttcaggtccgcggcggagaggcgacccggctgggcgtcccagcagcgcgcgcccgtgagcccgaagggcgcggggtggaggcgggcccgctccgcgctctcgaggatggctttcggcaagcgcttcgcgcgcttgagcgcctcgagttgctccaccagccagtcgccctcgacgtcctccagctcgggccggcgcccctccaccagccattcgacgacggcgcgcgccaggttcacgcgtgcgctcggcgcggagcccttcgcgtccggactccccgcctccgcgagcaccgccgcgagcgcatgggcttgcgacttcgccttcgcgctccgccgcttcaggtagtccccgaagcccgtgccgtcactcagggcacggcggtccaactccttctcgtgcagcttctgctccttctcggtgaccaggtcaggcgcgatgtgctggagcacccccaggagctcggcggagagcgccacctttgcccccgcgaggcgccggaggaaatccagggcctgcttgacctgctcgaacctgtacgaacctggaaccgagctcccgctgacatccctcgccgcgagccacccgggagcccagggagccacggccgctatctccttgaaccgatgcccttgctcccgagccagccgctccaggggcttgcgcgccgagggcttcgtcagcgtttgcagggacgcgcaccacgaggcgaagctcgactcatccagcagccccggcggcgagtagcgcttcggccaggtctccacctccgtgagcagctcgatgcgtcggcgcagctcacgagggtccgtcgtttcgaactcgaacctgggcagcagctcctcgtacgtcagcgcctcgaacgcgttgcgcggccggaacacgttggcgaagaagacgtcgttcttgggaagcggaatgttcagcttcaccagccgggtgcgcagcagccgcagggactcatcgtcttcgggacgtgactcggcgccaatcggcgcggtgaagtcccgctcgcagctcacgcatgccacggcggtcggagcggtggctgtgccacacgcgcagcgcaacacggtggccttgcgtggcacgtacttcagcgccgcttcccggcagtgcttctgcagcatgacgaagtcggtcttcacgcggcggtcggagtgagccaccgggagcgcgcgtttctttccctcccagaggaagcaccgcacctcgccgtcgagggtgaactccgccagctctccacgccccccgagccgcagggtccaatcgagcagcgcctcgagcatcgcgcgctgcgccggagcgtccgcctccggcacggcgcagctcagctcgatagggcagatgagggtcgacacgtcgaacaagggacgccgctgcagctcttggaggagctctcctaccgggagggactgcccttccaatcgaccggcggaccacttcttctgagaggccccagcggcatcgattcgagccgccagcccccgcaacccctggattcgcacacgcgctcctgatgtgaactccggcgacagcgtctacccgagggcaactgtcatcgtccatccgggacgccacgagcaggatgcccctcacctccgcgccagcccacgaagccagcggtgaagcacggagccgcgtcccagtctcacgctcaccgcgggctcgtgcttcgccagagtgctggagagcgctaccttcctggcgcggcgcgagccgttctctcaggctggaggcaggctgacgaccttgcccggtacgtgccccttcttgagtcggggctcgaccgctgcttgcaggtactccagccagtcgatgagggcctcgtcggggaggtgatgggagcggctcttccagagtgcccgctccagtcctcggggtggacaaaggcgagacgtcagttcccgccggactgtctgctccgggtacgcgcggaggaatgcctccgccagggagcgagcttgctccagcggcgcgcgtcctctcaggtccagcaggagtacgaggaggtcgtccgcatgccgttcgctggcgtcgaggctggtgtcgtgttccgtctcgaagtcgatgagccaagcgcgctgcttgacctcgtcatagaggaggttcttcaggtggacgtccccatgggaccatgcccgggaggcgccgggtagcgtcaggccgtgggcccggtgcaattccctcgcggcggcctccatgatgttcggcgtgagtcgaccttgctggagcagccggtcgaggcgctctcctggaagggcctccaggacaaccgcgcgtccgccacaaggctcggcaaggcggcccgggtgcaggagcgcgaaggaggccaactcccgacctcgccagcgtgagactgaaggatgcatccggatgcggctgcgcgacaggtgcaggaagacattgcctacggcgatgaccgcacccatgccgaggcgtcgctgcttgtgccagagggagacgcctcgccggacttccagggacaccgtgttgatgcgcaccgcgtccatcgcgagggcgagtccgtggttccagcactccgggagggaccgcgcgcggctcacgttcgtagatcctcgtaccagagcacgaccgcgagacagcccagacaccaacagcggagccatccgcgtcctaccacccctccgagcaacatcaccccggccagcatgagcaccgttcccatggcgctcggcgtaccgcctgcccggcggagcagggcgcgtccgcttcgccaaggatgctccgtgccatccaacagcagtgggaacaggaagagcccctgggcctcagcggcatagaacgcgagccccgccactacgagcgccaccgcgagaggtgccccgagtccggatgcgaaccctccggcgactcctgcggagagcagtgcgccaccgtacttgagggcgccccatcgacccacgttgggcggcacggtggccgcgggctgacctcgtaccagggccagaccgttcgccatccacgccgcgccgccagtgaagcccgttcgccatgcgcctcgtgcctcgtcggcgagcaccgagccgggggcgtcgtagaggcaggccgcgcgcttcagcaactcggtgcctcgctgccatgacgaggatgggctatccgccacgaagattctcacggacgaagcagaaatgcgcccacgcgaggaaggccgccgcatggccggcgagcagcgtccggtgcagcagggcctcccaccggtcgcaccgccgacggtgaaagacgaactcgtcgtagcagatgagggccaccgtcccgatgaggacgacgagcacggggagcagatacatctggggcctgtgcgccaccgacgcggcgcacatcaaaaggaacagcgggagtcctccgccagccagggccaggaactccgcctggtgctcccttggcccgactcggagccgggccacgcggtggtagcgccagtccgccacgccggccgctgtcgccgtcgttccggccagccccaccacccagaactcccaggggtagtggaggggctcggcgagccaggagaatcgcgtctgctgagacaccaccagcagcgccatcacgaacagcacgcccggtgcgagcgaggccagcaagttggcggcatcccggacgcgcttcagggatgggcgactcagcagcggggaagggcgagaggatgcatttgccatggtgggctctcggaggactcgcggaggagcttgccatggatagacgcctccctcaccgggagatgcagggtgcccacatgagaggcctatgaagggagtgctgcatgccagggaagtgcttcacgtcaaatgccaaccacgtcgttgctcttttcggccatggcctgcttcctccccactgtccgtgcgcgtggctcgagggatgagccccgggcgctaccgccaggagtcctggacgcggagctcgagcggggctggcgcctgaagctgaacgtgctcgcccgagcgcgggtgctggaaggtgagcgactccgcgtgcagcagatagccgccgtctccgggcaggccggggttctccgccagcggcaggccgcccacggcgaagagcgggtcacccacgagcgggtggccgatgaaggcgaggtggatgcggatctgctcggagcgccccgtgtggatgtccacctcgaagagggtgtgctcggtgcgccgctccagcacccgggccgtgctgtgagagggttttccccgcgcactggcaccatggacttcgcccagccgcggatggggcaccaacccgatgggcgcgcggatgtcgtaggactcctgggcggcgagtccctgggagagtgcgcggtagcgcttgtgcacgcggccctcgcgccaatcgctcgccaggcgcgcggctgcgtcgcgggtgcgggtgaagagcacgaggcccgacgtcgcgcgtcccaggcggtgcatgggaaccgcctcgggccatcgtgcctggacgaaggagagcagggtgttcttcaggaagcctcccgagggcagggtcggcagtccgctcggcttcaccacgacgaccaactccgcgtcctcgtacacgagctcgaaggactgcggagtgtccgcctcctcccatggcgggcggtgccagcacagccactgccccggcctcagcggctccgagccgtcggcggtgacgtcgtcgagtcgcacctcgccccgcgcgaagcgtgcccgccactcctcctccgaggagtgacgatacttgtccgtcatatgggcgagcgcgctgctgcccggtcggcgcccgagcttctcgcgatacacatagccgtcgttgagcagcactcgcacaccctacaccgcgtgggctcgcggtgggaggcactccgcctcccgtcgccgtcctccgcgtctggcttaccctcaaagcggcggcagcttgtccaggtagcctgacttcgacagccacatcaccagcgcgaagctgatggtgttgaaggccgcgtgcgcgacaaccaggggcagcaggcgtccccggaaccagaagacgaacccgaaccaggcccccatcacgaaggtctggaagacggcgagcgtgccttcgtagaagtggcccacggagaacagcacggccgcgaccagcaccgcgggcacccagcggcccatcaccacgcgcaggcggggcacgaggaagccccggaagacgaactcctcgaagcctgtcaccagcaccatgatggccgcgaaggcgggcacgtccaggccggtgtcgatgagcgcggtggccaggcccttgcgcgccagcatctccttgtcggccagcttcaacgccacggcgacggccgccatgggcaccgacgcggcgatgtgcaccgcgtaggtggcgacgagcaccggtacgccgagcagcagctccttcgcccagccctcgcgcgccagccctacctgcgcgggcccttgtctgtcgcgccacaccagcaccgccaccagcaggatcatccccagtgcgcggatgcacaggggcgccatggacagggagatgcccttctcctgctccgccgcggtggcgacccaggcgcccgcgcccgtgccgcccagcgccaccaggagccccaggacgcccagccaggcgcctgcgcgcgtggcctcccaggggcgcagcagggccagtccccaggcgagcagcgcgaccgcgagcacggccaggacgacccgacccgcggggcccgccgacgagggcccgaggacggcgaggaacacgaacgccgcttctgacagggcccggcgccgcggcggggcgttctccagcagcacggcgacatcacgacgcacggggcgttcctccggtccaggccacggggcaggggcctcgcgggattccggacacgctaccggcttcgccctcgggtttctgagccctcctcggctttccgttcatgcgacgcgtgcgttccagcgggagcgcccggggagggaagggtggcatcctcattgacggccgcgaaatcgcacgtggccttgctggacacgcgggagcaggagccgctacggcccttgcttcggagggcgagtggcggcggcagcggcggcttcgcgcagcttgtccttcttgctcttgcgccgacccttcactccgccgtttggatcccggggcggcgtggtcgtcgagacctcttccgtcggctcgaagcccggcacctgctcgcgcgggaggtcgagctggtggcgtttctcgatgagtcggaagtgggcttcggtgcccgcgctgacgaagctgatcgccacgcccttgtcgcccgcgcgccccgtgcggccgatgcgatgcacgtagtccgcggtcgaacggggcaggtcgtagttcacgaccgccggcagctgcgcgatgtccaggccgcgagcggcgacgtccgtggccacgagcacgcgcacgcgcttcgccttgaagtccgcgagcgcccgcgtgcgcgcgccctggctgagttccccatgcaatgacgtcgcgacgatgccggcgcggttcagcttcagggcgacatggtccgccgtgtagcgactggccacgaacgtgagcacatggctccacgcatgtgtttccaacaggtgccgcagcagcatcgtgcgccggggcacatccacctggagggctcgctggaggatgaactccgtcgagggcagctccccgtcatcgacgtcgatgcgcgtgggctcgtgcagcaactgctccgcgaacttccgcaccgcgggcgggaaggtggcggaaaacaacaggttctggcggcgcgtgggcagcagcgccagcaggctgttgagctcatcggcgaagcccaacgagaacagacggtcggcctcgtcgagcaccagcgtctccacctggtccagccggagcgcgttttgatgcaccaggtccagcgcgcgggcgggcgtggncacgacgatgtccgcgccgccccgcagcgccagcatctgcgggttggcggagacgccaccgactcgcgaggcaggtcttcagcggcttcttcaggtgttggccgtaccgctggattgaatcgacgatctgcgcggcgagttcccgcgtgggcaccaggatgaaggcccgcaccggtcggaccgaccctccgggacgtgcccgcagggcttccaggatgggcagcaggaacgcggcggtcttccctgagcccgtcttcgccgaagcccagacgtcgccacctcgcaggaccacggggatggtcgcgcgctgcaccggcgtgggttcgtcgtatccgagtccggccacggcgcgggtgagcgcgtccgacaggccgagcgaagcgaatgtcatgggatggaagccttgggtagcgcgaggacgcggaagcctaccctgcccgggaggtccgcccccggaattcctacccccctctccatccaggcaaggtgtcgcccggaccccgaggggggcggggggcgtggactcgccccgtcgcgggacggcccgacgtgttacgagcatgcgcatggcgatttccacattccctgagcgtctgcgtgccgtcctcgtcggtgtccagcttccgggcgtctcggacgaagagcacgccgcggacttcgcggagctgcgccggctggtgcacacgctggggtatgacacggtggcgaccgtgtcccagaagcggacgcggctggccacgggcacggtgctcgggacgggcaagctcaaggagctggcggccctcaccggaggctcgggcgtgattgcatccggagcgagcgaccggacgtccaaggcccgcgagaagtgggaggccgccgccaacacggagcccgactccgaggacgaggttgtcgaagaggaggccgacggcgtggagacggaggacgcgctgctgcctccgccttcggaagaagacgacaaggcggagccccggcccaccgtggtggtcgtggaccacgagctgtctcccggccagctgcgcaacctggagaaggccaccggcgcgatggtgctggatcgcgcgggcgtgattgtcgacatcttccaccggcacgcgaagagccatgaagcgcggatgcaggtggagatcgcccggctcaactacctggccccccggctgcgcgaatccaccggaggccgcgagcggcagcaggggcgtggcgcgggggactcggcgctggagctggaccgccgcaagattcgcgaccggctggcggagttgcgcgagggcctggcggccatccagaaggaccaggaccaccgccgctacgcgcgaagggacctgctgcgggtggcattggtgggctacacgaacgcgggcaagtcctcgctgatgcgtgcgttgacgggcagcacggtgctggtcgcggaccagctcttcgccacgctcgacaccacggtgcgcgcgatgcagccggagacccgtccgcgcatcctggtctccgacacggtgggcttcatccagaagctgccgcacgacctggtcgcgtccttccgctccacgctggacgaggccctggaagcgtcactgctgctctatgtggtggatgcgtcggaccccacgtgggccgcgcagttggaggtcacccgcacggtgctccgggatatcggcgcggacgccgtcccgagcaagcttctcttcaacaaggcggaccggctggacgcggcggcgaaggaagcgctgctcgcgaagcacccggacgccttgctgctctccgcgcacctgccggacgacgtggcgatgctgcgcaagaacatcatcgccttcttcgagtcctcgatggtggaggcagacctggtgattccctactcccggcaggggcgcatcagcgaggtgtacgagcacaccacggtggtgtcccaggcctacgacgagagcggcagccggctgcgcgtgcggggccttccaggggccatcgcgaagctcacccagtcgttccaggaataggccttctctggggccaccccagcgaaggtcgtccactccgcctgcctcacgggccgggaaaccggaggcccctgacgcccgcgctccggcacggcaccggaggcgggctgttccagcggactactcggcgcggcagacggccggcgcggagaggttggggcgaatcatcttgaacggctgaatcaggtccgggacgcggagcagcgcgtcacggcagctcgcctcgtcgttgccagacatctccaccttgaagctgcagtcctgcgcgccctcgcagaccgtcttggccagccgcgcatagcagtctacggcgcgggcgcaggtgccctcgcccaggtccactgacgcggaggatgacgtcgtcgaggcagaggccgtgttcgtgttcgtcgacaccgacgcgccagcggacagggagtcccgcgagttcgcgtccggggcgttcaggttgatggtgacgttcgtctgcgcgggcgcgtgggtaggggcggcgacgaagcgcgggttgatgcggtcctgggcgcagaggtacagctcctcgcccttcttgcgcaccgtggcgagcttcgcttccagctcctccggaggaacctgcttgtcgtccacggagacctggaaggtgtacgcgtccttcccattgtaacggtaatacatcgtggaggtcgcatcgtaggtgacggcgatggccgtgttgtccatggactgcgactcgagaccgctctccagggcgcagacgccgatggacgtcttggtcgtcgaggcgtcatgcgagtcgacgggcagcgtgtagtacttgttggcaccacaagccgccagagagagacacagagacgtcagggacagtccctggatgagccgcttcatgaggtttgctcctaggtaggggaatgggtccgcgctggtgaagcccggcggagtgacgcatcgacgcgtgcaccggttgctcattcaatcctgacacgaaaaggcccgccaccggaagtctcggggacgggcctgtcgcgggcgtttctcgaaacctggaactggtgcggcgtcggcggcgcaggtcgtcagcttggaggtgatgtcgatggacgcggggctcgtcggcacggcgatggtcttgccgttggcgcccttgaagtcgagcgtcttgaggttcaccgaggtcccaccttcaaggaaaggccgtgcatgtagcgcatgaagcaggggacgcggtgggcatcgtcgcccgagagttctcgcagcgctcgtgcggcctcttttgtgacgttcaaatcgcgctcgatgaggcgctacgccacacctacgtcgcagactcgacatgggcgttgtgcactcgcgggacatacggggcgttgggcttgcagtgagtgggctacgtgcccaactcacctcttttccaggggcgcggaccaacgcctgcggaaggtgccggatgattgatgttcgccagccgctggagccgcccgcgcgtcacgggctgccgagccttgcgaaggggagcgcatgcagtccatcggtgagttcaatgaagaccgcccgcaggacgcctcgcgacgccggcatccgtggcggtccacggtcgggctgaaggtgctgatggcagcgactggcatcgtgctggtcgtgttcctcgtcttccacctgctcggcaatctcctcgtttaccgagggcgggatgccctcaacgagtactccgcgtttctcgttcgggagcccccgctcctgtgggccgctcgcgcggtgctccttgcctccgccgtcatccacatcggcgcggcggcgctgctctggaatcgtgaccgcttcgcgcgcccggtggcttaccgccgactcaggccacgatccacgaccgtgcccgctcggacgatgcgcctcacgggcgtcgtgctcgcggggttcatcgtcttccacattctccatctgaccactgggaccatcgcgccggtgccgttcgagaagcatgacgtctaccacaacgtcgtggagggcttccgcgtcccctgggtggtggccatctatctcggcgcgctggccttcgtcgggatgcatgtctggcacggtgcatgggcctcgctgcggagcctcgggaggtcgcgcccctcgcctcggccgaaacggcgaccggttgcgtggatcctcgccctggtgctctggggcggcttcagcagcattccgctcacgatctggctcggaggtgtgcgctagccatggatctcggcgcgaggattccgagcgggccgctcgagcaaaagtgggagcgccgactgcgcgaaggacgcctggttggtccgagcaaccggcgcaagtacacactgctcgtggttggctccgggctggcgggggcttcggccgcggcgacgctcgccgagcttggctaccgtgtgcactgcttctcctttcacgactcgccgaggcgcgcgcacagcatcgccgcgcagggcggcatcaatgccgcgaagaactaccgcaacgacggcgacagcgtgtggaggctgttctacgacacgctgaaaggcggcgacttccgctcccgcgaggcgaatgtctacaggcttgcccaggtgagcaaccgcatcatcgaccaatgcgtggcccagggagtccctttcgcccgcgaatatggagggctcctcgccacacgctctttcgggggcgcgctcgtctcgcgcaccttctatgcgcgtggacagactgggcagcaacttctcctcggcgcctaccaggcgctcgagcggcaaatcagcgcgggccaggttcgcatgcatccgaggaccgaaatgctcgatctcgtcatggtcgacggacgggcgcggggaatcatcgcgcgcgacctccggacgggcgagctgagggcgttcgccggcgatgctgtgatcctcgcgacaggaggctacggcaacatctaccatctctcgaccaacgcgcgaggctcgaacgcgaccgcgatctggcgcgcgtaccgaaggggcgccggcttcgccaacccttgcttcacgcagatccatccgacctgcatccccgtcagcgggcctcatcagtcgaagctcaccctgatgagcgagtccttgcgcaatgacgggcgtgtctgggtgccgaagctcaagggggaccagcggacaccgcgcgatatcccggagagcgaacgggactacttcctcgagcggcggtacccaacctacggcaacctcgcgccgcgtgacatcgcctcgcgctcggccaaggaaatctgtgaccagggcaggggcgttggccccggcgggcgcggcgtgtatctggacctcggtgatgccattgagcgtctcggggccggtaccattcgcgaacgttacgggaacgtcctcgagatgtacgagcgcatcacgggcgagcacccgtaccgggcgccgatgcggatctaccccgccgtccactacaccatgggcgggctctgggtggactacgacctgcgcagcaccctgccgggcctctacgtgctcggcgaggcgaacttctccgaccacggcgcgaaccgcctcggcgcgagcgccctcatgcaggggctcgccgatggctacttcatcgtcccgaacaccatcgcggccgagctggcgcgtttcgggccagggtcggtcgaccttgaccatcccgcgtttcgagacgccgagcgcatcgtgcaggcaaagctcgagcgcctgctcgcctcgcgaggcacgcgaaccgtcgaggaccacttccgcgcgctgggtagcctcctctgggaacaatgcggcatggcgcgcagcgagcgcgggctgtcctccgcgctcgagagcatccaggcgcttcagggcgacttcgagcgagatctccggctgccggacaccggcatcgagctgaacgactcgctcgagcgagcagggcggctcgccgattactacgagctcgcggagctgatgtgccgcgacgcgctcgagcggcgcgaatcgtgcggagcgcacttccgcgaggagtttcaaacggcggaaggtgaggcgcgccgagatgacgagcacttctgccatgtgtcggtatgggaataccgcggccaggatcgacctcccgcgctccacaaggagccactctccttcgagtcggtcgcggcggagaccaggagctacaaatgagcacgacccgaaaggcggcccggtcctgggtgcgcagccgtccgcgcaccctctgccgccggaaccgataggagaccttcgacatggaacagcgactcgatttcccccagaaatcatccagcgcctaccaggcgatgctcggattggaacgcttcgtccgcaactgtgggctcgagcaccccctgctcgatctggtcaagactcgcgcgtcgcagctcaacggctgcgcctactgcatcgacatgcacacgaaggacgctcgcgtcgccggggaaaccgagcagcggctctacgggctgtcggcctggcgcgagacgccgttctacactgaacgcgagcgcgccgcgctcgaatggacggaagcgctgacgctcatctcgcagaacgatgtcacggatgagctgtacgaccgcgtgcgccaacacttcagcgaagaagagctcgtcagcctcacgatggcggtcatcaccatcaacggctggaaccggatcgccatcccgttccgctccgtgcccggcagctaccaaccgccggcccgcgcggcggcgcatccgtgatgggcaatctgctgaacacccgcgcgacgagtacctccataccgaggcgctcgtgggcgaagggggaaggagaacagcgtgcgcttcgttctgcagatctggagacaggagaggccgcggtccctgggcgccttccgccgttacgaggtgtctgacatcaccgccgacatgtcctttctcgagatgctcgatgtcctgaacgagcaactcgccgccaaaggcgaggccccggtcgcgatcgagagcgactgtcgcgagggcatctccggga

SEQ ID NO: 1220 - DNA, 22512 bp, Myxococcus xanthus
ggtgtcccagctcgcctgggcaccgctctggagctccagccggtgcaccttgcggcccgggatgtcgagccagtagagcgcgccctcggtggccatccagaaggggccctcgccgagcacggctcgtgcgggccagatgcacctggcttcgtcgtgcctggcaacgtccgtggtgcgcatgcgtggctcctccaagaaagcgagactcaacgtccgtagccaaaataggcacgccgcacgcgccggacatgcacgcggcggcggacgtggcctcgtcacgcagcgatcactccggctcgcccggctggccatgcatgcgtcctctgactgacccaccaggttgaggtccgttaacccgacgcacagaacagggttatcccagaacttccggtgatagcgggcactctgggttcccgtaccttgggcacgccttcaacgatgcacagacaccatcgcgaatccaggcacggggggagcgcggcatggtcagtccgaggacggcaccaatccggacaggaaacaccagtaccttcatcttgaagcagcgacggctgcacctggtcctgttggatccacaggaagtgccctacgcggagacggaatacgtgctcacggtcggccgcaccgagcactgcggcagaacggcggcggatggctcgttgagccacgaagtcccgggcctcgccgcgggtgagttgctggtgaagctgtccaaaccgccagcgccaccgccccgccggagcgcgcctcccgccgccaccaagggcgcgccaccgccctacccacccgccgtcaccgatgaggactttccggacgccacgccgaccgccgcgtccgaaccggtgacgctccgctgggcgctgcagctccagtcgctcccaggattcgagtccgacgccctccgggccgcgcaggagcgattgcacaacctgggctacgccattgaaggtgagcgcgggtcgcccggagcctcgacgaagtccgccgtgcgagcgttccagcgccgccatggcctgccggaaacgggacagctcgcggacatctcccgcgaactcatccgcctgcacgacgcctgaggccaccacccatggcacgcatctcactgacggccagtgtcgccctcgctgcgcccggaggacgcaaccgcaaccgcctccgtcccgccagtcatggcatcgcagacttccggctccgcagccctggaggtccccaatcccgctgccaccgcccggttcccttccccgcgctgacagggggtgatgacggcttccacttcgcgcccgaagtcgagcccgtggagttgacgtggcgtctgctcaacacgagcgggctggtgcgcgctggaaagctggagctcttcacgcgctaccgcaaggcgccgctgtggtcgcgcgagctgagccgcgaggaactcctccaaggcgagcaccgatgggcatgggatggccgcgtgcccgagtcggagacatccccggatggcgtcgtcacggtggagcactcgccatacaagctgaagctgacgctccaaggcagtggactggcgcaggcgcccgtggcgtggacgttcttccacgtcctggtggcgggcgttgacctggagctgggtgagccccgggtgctctcgcgaccacgcgaccgtgagctgacccagtcgttgaagcggctccccgcgcccgacgagaaggccgaaatccggctggtcgggaacgtcttcaagacaaagccgtcggagatgtccgatgacacggaccaccaactgcaccgcaaacactggggtagcggaccggagcttccgctgttcgcccgagcctggctgaaggactcgcgcggcaaccgggtagatgcgccgaaggccctgggccgcgtgcgcttcctctgggactgggaggacgagacagaggccatcgaacaccatgcccccacggcccgggccttcctcaaacatgcgctggaccgtcactgttcgacgtcacaacccaagggcgacaacgcgcaccgggacgtgggcggcaagcgcggtgcgccgtcgcttgcggtgtttcccagacaggccggctacgcgccccaggccgagccccgtgacggcgccttccccttccgcgtcacgccctgcaacaagcgcggttgggcggcctacagccaggcgtggaccacaggggctttcgcgggacgcacgggcgtggtgttccagccttccagcatcgcgggagacgcctggcgagtcacagtgcagcttgcctatgaccgccgaaaggatggcggcgtggtgctggacgtggacgatgatggaccgctgcccgccgccgtgcgcgccgccaccggcgtcttcgaatcctggcgcgaggtccacatctcccgcctcttgtgcaaggacacgggcgcctccgggttctcgctctccgccgtgcagggccatttcgaacaagcctttctgcgcctggaggaccgcacgggcggcgtctcgggatggtgcgcacgggaatacaacgcgtgcatcgcagaggccgtggcggcatcccggcactgggagctccgggctgccatcgaccctgcggtggaccagttcgccgcaggcggccacgcgctcaccttccgcactcacgcggaattcctggccgaggtgaagcgcgtgaagcactgcggcgatgcggacctcccccggtggctggcgcccacgcgagagcgcaggctgcccctgctggaggctcgcgagtaccaccggcagtgcaaagactgggcaaaggcactgctcacccgggcgctggactcggcgctggggacggctgcgggcatcgcgctcttccagttctccgggctctacaacctggagacgacggtcggcggcattcgcgtgaacggtttcgcgtcggagttcccctcgcggaagcgggaccgctgcgccgtcatccaatgcgccgcgccgggcaactaccgaaacggcttcaactcgctggaacaaacgctggcgcatgaaatcgggcaccagctcttcctgccgcatgcccccttccccgcgcaccgtgagattggcggcgcccaggcgaagcgccacgacgtcgacgggaaggactgcctgatgggctacgacttcacgacggagcggcgcttctgtgggctctgtctcctgcgcctgcggggatggaacacccacgccctggaccgcgacggtgcccggaacgcgcggccatgagcgcctccgtcctctccgggccgtggctgctcgtgctgaccctgtcggcggcgaaccccgtccccacgccgtcccaggtcaagacggcaccgtccccaccctctggaggtccgcccatgcgcatccaactcagattgtccaaggcgcagctcgtcacttcagaagacatggacgtgcgcatcgccctgtccaacgagagcgccacgcccctggagtttcccgaccccttccggcactcggaccaatccctgacatacaccgtcacgggccccgagtacccgaagggccatgccgtcaatcactacactgtcatcgagcgtgagggcacgcagccgctcggtggcgtcgtcgcgccccaggtccgactgggctcgggacgcgtgctcgagtccgtcgtgccgctccaggaatgggcgcccatccgccagcccggccgttaccggctgaccgcgagacttcaggccgcgggaatcgatacggtgtccgcgccggtcgaattcgaggtcgtgacaggacggccagactccgcgtcggcgggagtgatgattggaggcgggccgtactccggggttggcaccgtgtggctccagcacctggaggagcagaccctgctgatgcaggccgtcttcgtggacgagacggacgaggccggacgcggcgtctcccggcggacctcgaaggtgctgggaacggtggcgccagatgcttccgacgcgctggcgccgtggacgaacgatgcgccgagcggtgaggccgtgagctgggtcctgtggcgccagggcgcgtcgattctcgccctggctccgcccgcgacgatcacagcgcccttccgctttgacctggaagcgccgccagagaggctcatccgtccgcccctggagacacatgccggagagctcttcgtccccatcgtggaggctggggggagagggctccgactcctgcgatttcagtcgagcatggatgcccccaaagtcacacccggaaaggaagtggggcgcgtgaggctcccatccgtgcccctgagtgctcgcgccactctgcagcccgggtccgtggggaatggcatcagcatcgtgctcgtgagcgaggccgcgggaggactggaagtccagcacgtgcgagccacgagcgccggccgtctgagccgagtggcgagctcgctcctccgaggactgagcgcgcttcctgattccgagccgggcgtctggattgatgactcgggccacgtccatgcggccctggtggcggtgtcgctgaagaaccctcggcagcccatgctggcggaagtccgcttccgttccgacggaaggctcgtggcgcccccaagcatgacgccgctgcccgagctcccaatgagtgcacgcgccgcggtggcgcgacactgccatctcccccactccgacagagcaggcgaagtgcgctgggccattctcctggaagacgggaggttgatgcattcggggcaacgaggttcaccctcgtcaccgaagcagcctgtggcgggtccactggagttgatcgaaatgctccagggcacgttcatcctcaccacggaccccattcggggccctgagtttgaatggctttaggctccgggggcgattcccgaacctgcccgaagaggcagcctcgattgtctgtcctgacgtttcccacttgaaacgtctactgtgagcgcttgcctcaacggcgcgcttccaccgatgagttccctcggtactttcggcattgaagctcggggaatgatgcggcggggtcggcatgggcacggcgagcgccgacctcccgcaggatgcggaccatctgctcctcggtaaacctgctcttcctcacgaccgacctacttcctggccgcgaggactctctcacgcttcaactggtccgaaaatcagggtgcagaccagccgggtccgggtgacgcggtcatcaaaggagaagagcgcaccgcactggcggtggcgccaggcgtgacggtgcgcaccgtcttcctcctccaggagatggcatcgcggagtattcccaggagaaatgggggcgctgtcacgccttggcgacttgcgccaaggcatcgttgaaacacggtggcgagatccgcacgcggcaacgcctctcacaaaggtcaccgtttggttccgctaccgcctattcatccccccttttggctggcttcaccaggaaggactcacgtgagtcgctacccgtcaccgcgagcgacaccgtccttcccgtccgacagatgccgcaccgcatcacgcccccctccgcgacatccgcctgaattcaggtgatgaaagccaaccaacactccgcgcgcgggatgtcagaaatgttaaagtccttccatgctcgtcattcgggatgttcaactcgcagccctggccgagccacggctgggggcattgcgcgcgtggcttcatcctcatctgcgcaagcatttcggggagcgactgctcgagacagacgacgccgcgctgaaggacttcattgacgccagcgtcgcgagggccatggaacacggcgtgaggagttcacagggcatcgtcaggttcgctcacctgcgggtgctctttggcgagggattcgaagcgcttccatgggcggcggaaacgctgtcgcgaaccgacatccccacaccggagagcaagatcgaaattctctacgggaacgcgcgccgtgcactcactgcgaaagggggcgaatgatgaagcgcagcagaagcccgattcgggatggcgagtccgaggaactggcttggctggacctcctgcgactccacgccgccgagcaagacctggcaaacgcgccggaggtctccgtcgtcgtgccgtgcgagcaaacggtcacgaacgacgtcacggcgaacgtcgccgtcgcgcatgtaccaggctggttcgacgacgcagggcaagggacacgcccggcgatcgtcatgctgtccatcatagagacgcacccagacctgccgtatcaggggagcgggacggtgagcgtcacaggggacgccgacctgttctgcgatagcaactgcacgactcccgcagctgaagcgttcacggcggaggcacttcgcgcgactctcccgctcttcgtgcggggcaattcagccggcaacgtgacggtgacgctcaccatcactccagacgccaacccgaacgttcgcgtcatcgtaccgtcagcgacagaagtcgtcggcattcaggccatcaacgtggtgaacccgacggtgacagtgggagaggccatcgcgtggcaccacgaggaacagttcgcggccgcgcaaattacgctgggcctcgctgagagcacagggcagccgccgtacgcgggacgaggacggcccaccgtggtgggtggttcgctcttcaccgatgcgaactgtgagactcccgtcgacgccttcgacgcgggcgccctacgtcacggcgtcaccgtctacgtcaaaggcgcgaacgtgggcaacgccagcgtccagctcgcgctcgatgccgttgactccccgggcatccgcgtcgcgcctcctcaaactggagacatccccgtccaggccatcaacgtggtgagcccgacggtgacagtgggagaggccatcgcgtggcaccacgaggagcagttcgcggccgcgcaaattacgctgggcctcgctgagagcacagggcagccgccgtacgcgggacgaggacggcccaccgtggtgggtggctcgctcttcaccgatgcgaactgtgagactcccgtcgacgccttcgacgcggacgccctacgtcacggcgtcaccgtctacgtcaaaggcgcgaacgtgggcaacgccagcgtccagctcgcgctcgatgccgttgactccccgggcatccgcgtcgcgcctcctcaaactggagacatccccgtccaggccatcaacgtggtgagcccgacggtgacagtgggagaggccatcgcgtggcaccacgaggagcagttcgcggccgcgcaaattacgctgggcctcgctgagagcacagggcagccgccgtacgcgggacgaggacggcccaccgtggtgggtggctcgctcttcaccgatgcgaactgtgagactcccgtcgacgccttcgacgcggacgccctacgtcacggcgtcaccgtctacgtcaaaggcgcgaacgtgggcaacgccagcgtccagctcgcgctcgatgccgttgactccccgggcatccgcgtcgcgcctcctcaaactggagacatccccgtccaggccatcaacgtggtgagcccgacggtgacagtgggagaggccatcgcgtggcaccacgaggagcagttcgcggccgcgcaaattacgctgggcctcgctgagagcacagggcagccgccgtacgcgggacgaggacggcccaccgtggtgggtggctcgctcttcaccgatgcgaactgtgagactcccgtcgacgccttcgacgcggacgccctacgtcacggcgtcaccgtctacgtcaaaggcgcgaacgtgggcaacgccagcgtccaactcgcgctcgatgccgttgactccccgggcatccgcgtcgcgcctcctcggactggggacatccctatccaggccatcaacgtggtgagcccatccattcgctgcgatgagctcgtgctcgtccatggcaaccatgacaaccggtcgacagatccctcgcggctgatcctcgaaatagatcagacggacccaacacatacatgtggagacctcaatctccggctggactacggagcgcagattgcatgcttcagggaccaactgtgtacaaacgcagtggcttccgggacgactttcgcggccaatcagctccccgtaacgctctatatgcgcggagtgacggccggcaattgcgacgtgagtgctgaagctcgcggaacggcgggctccgcctggcggcttgccgcgcgcgcatcgaagacggtttgcgtcgagaagatcgagctgcaagtccccaccttcgctgggggattgtccctcaatcccgacccgctgctcaacgcccccaagcagcgcgagctccacgccaaaaacaaccaagccttcacattcgccaagatgacggtgaccgccccaagcaatgcgttctggcagaaggccgaccaattgtcgttggagcacgccaacctggaggtcttcgatgacgcggctggagcacttgcggggaccgctctcctcaatcaggcccacttcggcggccatcctgtcgttcgctacttcgccacgcaaggcaacaacccagcatgggatgcaatcccaacgcatgggcacggaattcccgccacgcgcaatccggtcaaggttgtcacagccaggtacgtctcgtgcgccgctcggataagtgcagccgcatccgcagacggcatcccgcgaacactgaaccatggggacgtcgtgtgccttgataccttcagcttcgatcagcacctcgatagactgacgggcaacgagtgtcggacacgagccctggccggtcccgccaacacggatgtcgcgcttgcgctcgccgcggcgcacaaatactacggccgacgaaccgctttctgggtcaaccgcaactatcgagccattgggggatcgccatttggtctattcctcaattcgatgaacaatccgcacgggaacaacaacacctgggcgaccgctggcgcgaactggattgagaacttcctcctgaacgaccacggcatcgtcctcaatgcgcagatgaagacccggatccgcaaccacatcttcgcggtcatttcgggagctacggtcattccacatggtacaaatgccgcctatggcttcgccgccttgtacggagtacccggagttcatgcggagtgcctcgcgaccaatcagctcctcgccgcgggcgtcgcagcgacagacgtcacggtggccacctacatgctacaggagcagcatcaacgtcaggggcgccccttcgtggcgtgtccaaactgctccggcatcctggtcgcccccggccagttccgggtgattacgggatgagggcaagaccatgaccatggaacccatgcgacgtatccgcacgagcaccctgaccaccgacgacaacggccgtttgtcctatgagggagcaggcttttcgggcctcgcctatcgcgtcgaggacgacggggtcgttcgcgagctcctcgctgtctcggagggaagtgtctcgggcacatcggacgactggctgccccaactcgaaggtgcgcggttggatcgcgcgtgcctcgaactcgctgacgcctatggaccgttgctctggcgcggtgcgccagtcgacggcatcgtgtacaccttcaaccgtcagggactgtgtctcgtcgaagaagcgtatgcctccggccagcccgcagacacggcgcgcagagagtggtacccatccggagcgccgaaagcggacatgcggaacggcgatggttgggcgtggttcgaggacgggcgggtgcgggcacgggccacccccgaacagacgttgctcaatctgccggtccgtgacgacggaagcctcagtggcatcgtactgcacgaccccagcctgctcgacgtgacgtccgtcaagccgatggcgttctcaaacgagttcctgctcaccggacggggagtcgatgatcgcctgcttcaaacactgcgcgatgagaccgggcttggaacggtgctacgcctccatttaatcgacacagcggtcactcctgccagtgttgaagtcctggcgtcgctcaagagcctcaacgagctctggctgcgcaggaatcgcgcgctcggcccagggcaagtggaagcactgagggcgcgccggcctgatggggtggtccattatgaagaggaccccactacgtgatgtagcgcccccaccctcgcgtccggcgatgacttcggacgagccattcgcagaagccattgggccgcttgctgctggccccgttcaaggcgctgtacgtgtggatgaacgcgcacatcaccgaggtcgagcgggcgcgaaccgcgcatgaccagcggacggtgcctcttgacagggccgacgcagtccagacgcgccggcccggccttcgcgaactaccagcgcccactcgagccgccgcccgatgaacgcccgccgctcgaagagctgctccggctggatgagctcgacgatgtggaccgcgtgagcttcggggtcgagtgacgggaagtcgcggtgtggtgacagtgcgtgcaacgcaccgtgacctcgatttctccgccagaggagtacgtcgcgctgcgaatcgtccggctcgtcttgttcgcggtcacataacggcacttcgtgcaccggacatgacgcgtgaagagcgttccatagcgctccaccaccgcgtcctggcatggctcgcaccaccacacgtcgtaatccaccgagcccaactgctcctcacgaacctgccccggcgccaggtgggcatcgtcggcatcctcatcgagccgcgccctcgggttgcggcacttctggcaccggcgcggtctgcgacgaagcagcgcccggcccgcaacccccacggcccccacgaaccccgcccctcccgccagggcgggaacgttgaggtcaccttccggctcactcggtccttcagacccgatggtgacggcggagtcctccgaccatgcggactccgcgagcctgggatcccatgccgatgcggcctcctgggcgttgcgaggctgattgagctccgaggtcacgatgagctgatgcagcccacgtgcgccttccagtaccgcgtcgtccggactgccccgtttgaaggctggaactacgtcgttcgccatgatggcgtcactgcgagcctgctcattcgggccatccacgccatcacccaggatgatctccgccgcgcggtcctcgagcgcgatgaagagcagcgcgccgtcgtcacgaccggccgtgcccagcccccaccgattgaagagctccagcgcgaaggcgcgtggcggctggcgtcccgtcgtgtcgaccaccaccaccgcgagctggccttggccatcacggaccaaggcattgccgagctggtccacctccgccagcgtctgcggcgtgagtgtcctggtcgtgtccacggaccatgcgttggccgcgagccgcggcacttccttcacggtgacacccagggctggaacgccaagggcccaacaagccaggaacacccagcacatccaagtgcgcatgggtgtcgacgctatcccattcagggtctatgcgcccgtgtccgtcgccgcggtctcaaccagcatcggcacgaaaccgccgtgggacctgcggccctcgtcaaagggcatgctgcccgggtgcatgcgcggatcggccatggccttcccccacccggcgttgcgcgcctccttcgacggccactcaatccaagcgaagacaacctgctcatccgcggtggccttcaccgcgcctttgaagtcagtgaccttcccgtcggggacgtcgtctccccacgcgtcgacgacgcgcgtggcaccatgctccagcagcaccgccgcgagacgggaggcgatgacatggtaggcctctttgtttccaaccggcaccggcacgagggagccatcgacatagccgggcctgcccgctccgccctcatggaggctgggaacgaagccgccgaagatcatccgcttcccatcgaaggatatgttcgcgcccatcgcctgcatccttgggtcacgcattgccttcgcgttcgcttcgtcgcgcaccgccttgctggggtactcaatccaggagaagacgatgacctcatccggctcggccttcaccgcgcgccgcaggtcggtgaccttgccttcagggacgtcgtccccccagttctcaacgaagcgcgtcgcaccaaactccttgtacagcggcgcggcagcaatagcggcctgccggtacgcctccttgttcgccgaggggactgcgatcacgaatccgtcgatgtaggccatggcaactctccagcgggggcactcttgctttgacaagaaaggttgatatcaacacaattacccttgtcaatgtccagagccgtcccattcgccacgacgcttcacgtccgtgaccactgcctgtgcctggtggtccagcaggccgcgcgcgcccttgcgcggcgcttcgatgaagccctgcgccccgtgggcctcacgcatggacagttctcactgctgatgtcgctcaatcgcccccagccgccgtccatcggccccgtcgcggagctcctggcgatggaccggaccacgctgacagccaacctgaagccgctcgaaaggcgcgggctggtgaagaccaccgtcgacccagccgaccgccgcgggcgattgctgacgctgacggacgcagggctccagctccttcaatccgcgctgccccactgggagaagatgaacgaggagacggagcgattgctggcgcaaaccgatgtcgacgcccttcgggctgggctgcgggcgctctcctgagtcctcgtctagccgccggcgcgatgatgcgcccggaggcagcggctccagactcggtcgcctgcgccagggtgccctggcgccggcagcgtgcgccgcacgttctgctatagggggcccgtgagcatcgcgacccacgaagaaggcccgctgcgaggaccgagcttctttttcagccgcacggcgctccgctcgctcgcgctggcccatcgcgccagctacggcgcggcgcggcctcatccccacgccgtcatcgatggcttcctgggggggccgctggcgtccgaattggccgcggtcttcccgggcgcgaccgaggcaagttggaagcgacgcgaccaccccgaacaggcggctcgactggggcagcttcagcgcaaggcattcgaagacgtccccggagcgctccggcacctgctttcggagttctccggcatggcgttcatcgacttcctggagtcactcaccggggtgcaagggctcatcccggatccgcatttccgaggcgccgggctgcacctcacgttgcgtggggggcatctggcgctgcacgcggacttcaaccgcgatcgcttccgcgcgctctcccgccggctcaccgtcctctactatctgaatcccggctgggaacccgcctggggaggggaccttgagctgtggagctcggacctctcccggtgcgagacgcgaatcgcccccctcctggatcgcctggtcgtgatggcccacggcgacgaccactggcacggacaccccaccgcgctggagtgccccgagggacgagggcgcgccgcggtcgcggcctacttctacaccgcggaggaagcccccaacgcaccggagccccacagcgccatctgggcaccaccgcgctcgtagctggcacgtcgatacgcggtacggcgctcacccgcgctggcgccaaccctcaagccgcgggagccgcggccttccccgcggcttccggatgcgtgaagcggtccttgagacgcagcaagggcttctcgaagaagcgccacgaaacgagcgtgagcgccagcagcaccgcgtactcgaacaggatgcccaccgcggtagcgacgaaggtcgagggaatgaagcggtagaacagcggccgcgtgtaaatgccgccagcggggatgacgagcgcatggaacaggtagagcccgtagctcacctgccccacgaagcgcagtggccgccattgcaacacggcctggagtacccgcgcgcgcccggagagcacccaccccagcaggctggcgaagcccaccgcccaaagcgtgtacaggcccgccaccagcagcacgcggaccttcgggccgcccggccccgtgagcgccgttgccatgtgaatggcggcgccctggccgaagaagacgagggacaacccgcaggccacgagcaacgcgggcaccgcgagccgcgcgccccaccgtgacaggccgtccgccgtagcgcggccatccaccacgcccagcgccaacagtccaccgagcgccagtccatccaaacggaacagcgtgaaggtgtagacctggatgggcgctgcgccctcccccagggccgcgaggcgcgccacgggggacagcagcacacacgcccacaggagcgcgcggagctgcccgttccggaggaagaacacgagcagcggccacaccaggtagaactgctcctcgatggccagggaccacgtcacgttgatgggagcaggaccgaagtccgtcatccaaaggttctggaggtacagcgcgtaggtcacccacgagtagcgctgggtatcgaaggccagggccggcagcagccgccccataatgccaaaggagaaggccagcaccaggaagtacaggggccagatgcgcagcgcccgccgcgcgtagaaggtacggaagtagcctccacgctcacgcgtctgcacgaggatgcgcgtaatcaggaagccagagaggacgaagaagaggtccacgcccgcccagcccacctggaagagtgagcccagtgacgcgctgcgcagccctgtcagtgagtgataggcaatcaccatcagcaccgccacgccgcgcagcccgtccaacgcgggaaggtactccggcaggtgcagcggctccgagggtccggttttcatctcggggcggaccatagctggaaacggtggaggcgccccacccgagcttttcagaagctgtacaccgaggcaaatcctcgcacgtcgcggcaggcaagcacgtcaggccatggccttgcagtcgtcgtggcacttcccatatgaagcgcgcgctcatgctccgattcgtggcaatcattgccctcctgaccaccactcctacgctcgcgaacgaagaggcggaaagccccgcccccatcgccgagagcggcccgcccctcagccgagaagaggctctggagcaatatgagctccggcacatcgggttcgatgagtacatcgccgtgacgctttcgtattcgccactggccgtcaggagcccgccgagccgctggaccgtcccgtatgaggggaaatacaagaagccactggagggtgcggcgttctatcagaagctcggccgagacgacctcgttgcggagtatcagtcgagaagcgccacgaagctcaccctgaagatcgtcgggggagtcgtgatggttggcgggctcgtctacggaatcgcctcgccaggcgttcggaccgaagactgcgagctcggccccgacttctcggcctgcattgaccgcaacttcgcggctggcgaccggaagcggaacatgttcctcgtgggaatgggcgtgagcctggtgggagtagggctgctggggtggggcatcttttacaacccccatcccatcgcctccagcgaggcccgcgaactggcggatggccacaacaaacgccttcgccaggagttgggcctgacggatgtccccgctccagccccaggcccacgaaagcggccatacgtcatccaggcccgcctgacgcctgtcttcggcccgaactccgggggactgctggtggacgggcgcttctgattcccggcagcgatgtcaggaagcgtgcccaggccgggtcggggcgcctcacgcatggctcgccggagcccgtctccccggcgaccatggtccccccgaagccgtggcccgcgcggccggcgtgatgaccgtgcaggcctgaaaggacgccctggatgccctccgccccgaacgatgccccccagcttgtcgagctcgccggccaccacggactgaagctcaaaccccacaccctgtcggtcaacgaggccggactggactatcgcgtcgtgatggcgcgcgacctcgaagacacccagtgggtcctccgcatcccgcggcgtgaagacgtctccgcgaagctcccggacgagaagaagattctcgacttcatcaatccccggctcggcgtggcggtgcccagatggaatgtcgcccaccgggacctcatcgcctatccggcgctgccgggcaggcccgggctgacgttggaccccgcctcgggcgagcccgtgtggcacttcgaccgcgagtcccccgtctatgcccgccagttcggccagctcctggcccggatgcatgccatcgacgtcgaggatgcccggcgagcgggcctcatcgtcgagacgcccgaccaggtccgcgccaactgggcctccgacatcgctcgcatcaagcaggccttcgacgtggcgcccgccctcctccagcgttgggagcgctggctgggcgacgactcctactggccccgcttcgtcacgctgacgcatggggagatgtaccccgcccatgtcctgctagcgccggacgacaccatcaccggcgtcctcgattggacgaccgcgaaggtaggagacccggcgcgcgacttcgtcttccagaagatgctcggcgtggacgccgtgttcgaggccaccgtggacgcctatgtgaaggcgggcgggcaggtcccagaccgcctgggcgaccactgtgaggaactgctcgcggcttcacccgccggctacgccctcttcgcgctgctcaccggcctgccagagcaccgggcggccgcccaggcgcagttgaaccccgaagcggccatgtaggcacagcgggccgggcggcgggccagccccccgccgctcaggtttcactgtccaatcacggcctggggcgctaggtagggacggctcgatggagcttcgatgaccgctgccctcctgtccctgtccctcgccttcacgctcgtcaccggccagttcgcgccccagcaggcgggaagtgacccgctcgcgccggagctggagacgcgtgcccagacgctgggcaagcagctccggtgcgccgtgtgccagggactgtctgtggcggacagcccgtcctccatggcgcgcgcccagctcgacatgattcgcgagctcgtctccgaggggaagagcgacgccgaaatcgtcgagtacttcgtcgcccgctacggtgagtgggtgctgctgtccccccgcgcggaaggcttcaactggttcgtgtggctgggcccggtggggctcgtcgccgtgggcgccttcgtcatctggcggcagctccagcgcggcgcgggtaccccggagcagaccccgcccgcggccacgacttcggaagaaacggcggccccggccgcgcccgctggaacgcctccagtggatgaagaagacccgtacctccaggccgtgcgccgggagctcgagcgctaggagcgccaggccatgcagccccagacgacgaattggttgcccggaatcatcgtgctcgccgtcaccttcgtgttggcggcgggctggatcctctttcagcgccgcaagggctccctggcgtcggccgagccccgcgacggcgtgctcgatgacctgacccagcgcgcgcagtccctcatcgaccagctccgcgcgctggaagcggagaagcacaaccagagcgccgagcagtatgccgccgagaagtcccgcctggagcgcgaggccgccgcggcgctgcgcgcgaaggacgagcacctcaagcgcaaggcctccggcgaaggcgtccgcgcccgtccccaggctccggcccccaccgggtgggcgtctcgcaatccgcaactggtgggcgcgctgtggggcgcgggcatcatggtgttctttggtgggctgggctacctgctcgtctccgagcagcagacgcgcaccgacggcatggaagccaccggccgcatgcccccgggcggcgccgccgcgcagcagcagggcgcgggcatggacgaccagatgcaggaaggcccggagatgcaggaggctcgcgcgcggctgaacgccaacgccggagatgtggacgcggcggcgctgctgagccacgagctcatccgccgtcagcagttcgacgaggccgtgaaggtcaccgcgaagggcctggcggcggaccccttcaacgtcgagctgaaggtccaccgcggcgtgcttcgcgccacccagggcgacatggccggcgccgaggcggagctgacggagctggtggacacctggccggacgcgcaggaggcgctcatcttcctgggcagcctcgccctgcgccgcggcgacaaggccgccgcgctggcccacttcgagcgcttctccgtggaagtgccgcgcaacatgcagccgccgcagctcggccccgcgattgcacagcttcgcgcggaggtcgctggcggcatgccctgacgcccagccccctgccctcaccggcaagcacccgcggcgccgccccaaccacccggagtggtcgaggcaggcgccgctggcgttttcgacgctcagtgcaccgcggcccgccgacggcggaagcgccgcaccttctccaccagcgtgtccggcatcgccgccttggcgccgttgcgcagcaggcgcgccagggattcggactgggagaaccagcgcccctcccacgtccccgcatggacccgcacggacagcgtgcgccgctgcttggacacccagtcggacttgtacgtctcggtgccccggaggaagtcgtactccgtcaggccggcctccattgcgtcgcggaacgtctcgcccaccagcaccaggcccacgctgcgattgcgccacgccgggtcataaccggactggaaatacacgaaggtgtcgcggtggaggatgccgtacaccgacgccacggcatggccgcccaccttcatcgtgtagaggcgcagccggccccgctccgccaggaactgcgtggcatcccggtggaacgcctccacgccggagcccttgatgccctgcgagcccccatccgcggcccatcgcgccgagtgcaggcggaagaagtccgtcagcggcgccgccagctcgcccggggcgtccgtgcgctcgatgcggtagccctcctgcttcgccagccacttgcgccgccgcaggaagttgtcgcggcgtcccgtgcgcttgaggaacgcgtcgaagggttcgcccggcgtcagcgtgtcgtacggacacacgtagcgcggcgccacgcggacgtcctgcctggcgaaggtctcccggagcacgtccacggtgggcgagtcctcgcgcaggtccgacaaatccaatacgtcccattcgtcgcgcagcgcgtgcagcatccgcgcgaaggcgcccgccacctcgcgctcacggccccgccgcgccacgacgtccaggtagtcgctgccgacgtgtgtctcccccaggaagctcagccgccgcaccgggatgccggtgacgcccaggtactcgacgcccagcggcatcaggcccaccagcgtgcccaccgcgtcgcgcgcggtcagcaccagcgggcgccggcccgtggcgatgcgccggcaccacgggtacacccactcccaggcgttgaagggccccgcgtcgctcgcatccatcagcgcggcccattcctcccgcatccccgccagcgtggagaggctgcccacggcgcctacctccaacgggtgcgcggcccacgctccctgcgacagctcatccacccgaatcaacgcccgtcctcccgaaggggcagccgcccctcccctgttccccgaatgagcttcaccccgcgcgcttcttcgaccgatggtccgacttcaccgcctcgcgcaccgcctgcgccacgtccgccatgacctccggcgtcaggtcctggtggcacggaatctccacgatggagcgacgtagctgcgccacctccgggaaggccgatgcgtcacaggccgggtgaaagcgcttccagaagtcgatggcgtcgatgccctgcacgcgcagccgcgccagcacctccgccttgtcctgcaccaccagcgggtagaacagcgggcacgcgcccggcggcaactggttgaacagcggcgcggagatgtcgcgcagccggcccagcaggaagaagtagttgcggcgccgctgctcgacgatggattccaggtcctgggcctgggcaatccgcttcgtcagcgggctcatgcccaggtccacatgcttgcggtcgaagtgctgcgtccccgtggccacgcgctcgatgttggccgccttcacggtgccatgccccaacgtgcgcacggcgctgcgcagggcccggccggccaggccgccgcgcaactccaggttctgcagcagcgcggacaccgtgtggctgaaggtggacacggacggcggcgcgggcggctccggaaggctgtactggcgcgggccgttgacgaccagcgcgcccccgttgggaaccggaagcgtcttgtagaggcagaaaatgcccacgtatcccgtcgtccccaggggcaccgcgccgtcggaggacagcaacgacagcgcacagtcctcgatgaggatgagcccgtgctggtccgccagcttgcgcatctcccccacggggcccgggaagcccgcgtagtgcgtcaggtacagggcccgcgccttcgggccgatgcgccgggccacgtcgtccaggtccacgtcccagcggctgcccacgcggtagaagcgcggcgtggcgccggcgtccaccagtgcctcgacctccacgccgtggtggtaggcgggcatcaacacctcgcccgaatccagccccagcatcttcaccgtcagccagatggcattgcgggcgaagtagaagtagcggacgttgggcgaggagaacggcggcagctcgccgggcttcggccgagacagcagcatgtgcggccacagcgtgggcagtgacggcacgaacagccggccagagtgcttcatcgtctccatcgcgacaccacctctttcaccgcgggcccccaccggaacttggccgcacacagcgcctggccgaagggggagtcattgaacacgtagagccaggtgtggcgccggacctcgttcgtccagtcgcgcttccacaccatgtcgggccccaggaagtcgaactcgtgcaggccccggtcgatgcagttcccgatgacctcatccaccaggagctggcccgggctgcactcacgcaggctttcgtcgtagccgggcttcagcaggaagtagcgcccgccgtattccaggccgtactggaacgccaccggccggccgtccagccgcaggaagtacagcgccagccgctggcggtaggccgagtcccgcgccagttccgtgtagaagccgcgcgtgcgcgcatcctgcgccatggccgtgccgcgcgcgcccttccagccgctctgctccagcagaaagccctcctccagcgcgccctccaggccgagcccgctgtccacccgctcgaaggtgagctggcccttctcctccagcttgcggcggcgacgacggcagttggccttgaacttcgactgcaatgtcttctgcaaggcatcgcgggtcgccggcagcggcacatacggggagcgcagggactcccactcgcccacgggcaggccggactcgcgcgccaccgcgtgcagccgccaggcggccccaccgtcggggacatccgtgagccgcagcacatcccagccaccggccgagcgcaggtgggacacgaaggccgccgcggcgacctccggttccttcgccaccaggtcgaaccggcaggagtgggcgttggccgccacggacagctgccgcgccggtacccccagcagcgtcgtacgctcctcccacagcgggagcaccgcgccgaggctcccgtccgtgtcccgcagcgtcagcacgcgcggaatcacaccgggtacgaagttgtccatccagatgcggatgaactcatgccggtagaacagctcgttggaggtgacctccacgagcgcgttccactcggactccagagatatgaaggccgcgcgtcccgtcacttcggtgacgcgcggcgaggcagaaaggtctcttgcttccatgaggtgtcgggtgcccaaggtggtgatgaaggttcgcggctacaacccgctgcgggccatcttcagcaggcaggcggcgaccttgcggctgtcgtgtcggatcctggaccctgccttgagcaggtccgcatgcaccggcaccacgcccgcgccaatcaagtcccgcgggttggccgacaccacgaacgagccgcgacgggcatagcgccgggtcgcctcttccgtgggcagcgtgccgttgacgagcaccgcgtccagcaccggccccacgtggtccgtgacggcctgcacgtggtccaggcaggacatgccgtccgtctcccccggctgcgtcatcaggttggccaccatgaccttcagcgcgcgcgtctccttgagcgcctgggccacgccgtccaccagcaggttgggcagcacgctcgagtacagcgagcccgggccgatggcgatgaggtccgccgtgtagatggcctccagcaggccctcggtgggcggcggcgagcgaggactcaccgtgacgcg

SEQ ID NO: 1221 - DNA, 28172 bp, Myxococcus xanthus
aggtagtagtgatggagcgcgagcccccagatgaaacattccatcagattgcgcagcgtcagccccgcgcccagcggaaccttcaagtcgaagccgccgcagcccgggtgcgcgccgaagccgcagcccaggccccggtacaacagtgtgaagatgacgccgcacaccgcgtagatgacgaagcgctggctcaccttcggcgcccagccgaacggcgccgggtctacgcccgccgcgtggtatcggttgcggtgatagaaccagaccacgccgtggtactgcacgttgtggaacgccgtcaccgccacggcgaacatgatgaagtccatgcgtgccgcgaacggaggccagaacaccacggccgacagtcccatcgccgcgcccatcatcagcagcttgggaccattcaccttcagccccgcccggtgtcgctgcacctgccggcccgcgtagagcaccaccagcgccagcacggtcgcgaagcaggctccggccaccaccggctcccatgtgggcgggcctagcagtcccaactgcttgcgtgcgcccggatgtgacactgcgaacgcgacgaagggcgccagcagccccgtgtacagcgtcacgctgtcgaaccgccggtccaatggcagcgactcgccgctcttgcgctggtacagcaccatgatgccgtagtgctgccgcaccacgtgccagtaggcccagagcgccgccgccgtcatgaagagggcgaagggcagcttcgtgcccagcagcgccgacagcccgaacgacgccgggcccgctgtgaaccacgccaggctgcccagcagcaagcgccgccgtgtctgccattcccgcgcatccagataggtccgcgataccgtggcgaacaggtgcggcccatccagtgccagcacccatgcccaccacaacagcaggctgctgacgccgccccagacatggagtccgaccagcgccaggctcaccccgaggccgccccccgtggaaatcaggtcgtgccgccggtcgacgagccagcccgcgcgtgcggggcctgggactgcgagagggatggcgctcatgagggctcccgagggacgccgcggaggatataggaaggtgcaggtaggtggtctgcccacctgtcgacgccattcgtggggcaggggatcgaggggtcaaaacctacttgagcggcggggcgcgtaccgcgattgtcctcgccatggatcaaggcaggcgcaccacggacaggaaggcagttggcctgctggtgaagctgaagcatgagagcgtggggagcttcgcggaggagttcgccaccaacctgagcccgggtgggatgttcatccgctcgcgcaccccacaggcggtggggacccccgtcaagttcgaggtgcagatcgcgggaggcgtgcgggtgctgcgtggctccgcgctggtccgctgggtccgcgaagtcggtgaccccgcggggcctccgggcatggggttgcagttcgaggagctggacacggcgagccgcgcgctcgtcgaaatgatgttgatgcggaagaccgtcgcggattccaacgcgcccgccgttcagcccctgcccgccatcgcgccatccgtggcgcctgcgattgcaccgtccatcgcgccgtccgtggcgcccgcgattgcgccgtccatcgcgcccgccgtcgcgcccatggcgcagtcccgtcccgcgcctccggtccaggcccgtcccgcgccccctgtgcaagcgcgccccgccgccgcgcccgcggatgtgggtggtatcgcgctcgactccctgttcgatgacctggagccggagggtggttcctccgcgccgattccggacgagccgctcgacctggttccgtcggtggtggaggagccgaggacaccgcctccgagccgcgtgcccgtctcctattcgccgccgcctccggtggccgcggatgacgtggacattccgctcgacgagctcatcgcgagcacgccgcctccgcccgtggccgcgctggacatcgatgagcccctgccgggcttcgagttcgaaatcgagagcccgtcgggtgatgcgcccgtggccatgggcgcgccgctcgatgagccgcccatcgaggtcggcatctccctggaggtcgagccgtcgtccgcgccggcgggtggcggggccctggagttcgagctcgacctgggtgactccgtcgctgagccgcctcgtgcgcccgcggttccacccgtgcgagtggtacctccgccggcgcctgtctccagtgacggcggcttcgagttcgacctggacctgagcgatgcggaggccgcacctccgccgcgtgccccagtggcccccaaggcaccgccggctccggtcacgtctcccgcggggagcggtggcatcgagttcgatttcgacctggccgaggacgtgagcccgcctccgcccgtggcgcctccaccgccgcgcgcaccggcggcgccacctcccgcgcctgtctcagccgggggcgtcttcgagttcgacttcgccctgtccgatgacgcggggacggtgccgcctccgccgccgcgcgccccctctccggtcagcgcggggggcggcggcatcgacttcgacctcgacctgtccgaggacgtggaggaagcacctcccgtcgtgcctccaccgccgccgcgcgcggcgatggttcctccgcccgcgccggtgcagccgcccatggcggcccgcccgttgcctccgccgcccccggttccgccgcttcttctcaagggcttccccaagtgcgccgtgaggcgcctcgggcaccggagccggcggagacgccctcggtgctcgcgcccgccgtggcgaaggccgccgcgcaggcgcccgggcctggatgaacacggcctgccgaagacggtgttcctgcctccaccggtgccgctcagcggcacggggcccgtcatcggcattgacctgggcaccacgaactcgtgcgtggcgttgctttccaacggccggccgctcgtgctgcgctcgcgcgagggctacaacacgattccctccgtcatctcgctcaacgcgcagaacaagctgctggtcagccaccgcgcgaagaaccagttggtgctgcgtccccagcacaccatctacggcgcgaagcggctcgttggccgtccctacgacagcgccgtggtgaaccaggtccgcgagcgcttccactacgacatcgtccctgactccgctggccgcgccgccgtgcgtctggcggacacggccctgtcgctggaagaggtgcaggccctcatcctccgcgagtgcaaggagatggcggaggcccacctcaaccagaaggtggagcgcgcggtggtgacggtgcccgcgtactactccgagccacagcgtgaggctgtgcgcaagtccggcatcctcgcgggcctcaaggtggagcgcatcctcaacgagcccacatccgcggcgctcgcctacggtctcaaccgcgagctcaacaagaaggtcctcgtctacgacctgggcggcggtaccttcgacgccacgattctgaaaatcgagaagaacgtcttcgaggtgctcggcaccggaggcgacgtcttcctgggggggatcgacttcgacaacctcatcgtcgactacctgctggcgcgcttccaggagaaggagggcatcgccttcacgggggacggcatcgccttgtcgcgcgtgagtgacgcggccgagcgcgcgaagatggggctgtccgagcgcagcaccttcgaggtccacatccccatgctgatgatggacgactcgggcaggccgcgtgacttgcgcgtggtcctcagccggcaggagctggagaagatctgcgagccgctcctcagccgcaccatcgacgtggtgcgcgacgtgctcctggacgcgaagctgaaggccgccgaggtggacgacatcatcctcgtgggcggcatgagccgcatgccgctggtgcgcgacaagctcaaggggctcttcggcaagggcgcgcaggccagcgtcaacgcggacgaagccgtggccctgggcgcggcgctctactcgggctccgtggacaaggtgagcagcgtggtgctcatcgacgtgctgccgatgacggtgggcgtggccatgcccggtggcgccttcaagcgcgtcatcgagcgcaacagcccgctgcccgcgcagcgctccttcgccatcaacacgacgaaggacaacgaggtcttcctggagctgtccatcttccagggcgaggacagccacatctccgccaacgagtacctgggcaccgtgcgcatcgaaggactgcccaaggggccgaagggctcggtgcgcgtggcggtgacgctcaagctggactccgaatgcgtgctgcacgtggaggcgcgtgagtactccacgcgcaaggaagtgaaggccacgctggccacgcgctactcgccggaggagctccagaagcagctccaggtcagcaaggagtccgtgaaggccgccgaggagcgccgcggcgccgacctcaaggagcgcgcgggcggcttctggagcttcgtgaagaaggcgctgggcaggaagtagcgtgtcgccatgacggccaccgcaccccggtacatgacgcgcttcaggtgcctcgcggatgcctgcgaggacacctgctgcgcggggctcgtcgtcctcgtcagcgagccgcgcttgcagcgcctgaagcaagcggtggcgggcacgccggacgcggagcgggtggagaccttcatccggctggagcccgacgccagccccggcgacgacgccgtcatcgcgaagcgcgaggacgggcactgcgtgttcctggatgcgcggaagacgtgctcgctgcaccgcgcctatggcgaggccgcgctgccggatgcatgcgccaccttcccgcgagtcgctacgcgctgggcgcacgggctggaggtgacccggttcgctcgcgtgtccggaggtggctcgcctgtgtctgctggcggaggacgcggtggacaccgtgcccgtgtccgaggacctcgcgctgcgtccggagactgcgcggtccctgggcggcggcgattccgaggacgcgtggacgcagcacgcggcggccgtgcgttccaccgcgttgtcggtgctccagcgccgcgaactgccgttcgccgcgaggctcttcgcgctggggcagttgggcctcaggttggacggcttctactgccggggcacggaggtgttccacggcgacgcgcgcgagggcgcggaggccctgctgacggaagtgctgcgtgccttcaccctgcccgagacgctgacggcgctgcacggtggcttcgcggcgctgtcgctgccgggaggcccgtgggtgggcatctgcgccgcggtgctgaagtctcgcctgggcgcggtccggagcgagcggttcctcacgctggcggagctggtgctggagtcctacggcggcgtggacctgctgcccgacgatgcatggcgccgctactcggagcgccgcgagcggctgtcacccgggttggcgcagcgggtggagcagtacctgcgccaccacgccgtgaatcactggctgcgccacccgttcacggacgcgccgcgcgtgctggactacgtgttccgcatggcgctgcgcgaggccgtcctctgttggacgctcttcggccaccccacggtggtggcgctctgcgcggaggtcgcggcggatacggccgagtcacgcgcccggctcgacgccgccgcggtggagtgcttccagctcatcgcgaagcacgtcgagcaggcgccccagctccacgccctggcccaggggctggcggggagcgggggcgacgagacgctcggccggatgctcgtgctgctcaaggggctctgacgctcacggttgcgcgcgaggcgtcgcgccgagccgccgcatggcctcctggaacaccgagtactcctgcgcgccctggagcccgaagcgctccccgagcacgaaggtgggcaccgcgttgacgccgatggtccgcgcctcctggatggagtcctccacggccttcgtgtagcggccctcctcgacgacgcgctgcactgcgtccgggtccaggcccgcctcctgggcggcgccgcggagcgtgtcccactgccagaggtcctggccctcgctccagtagcggcgcaggagggcggcgtggaacggctccagccggccctgctcccgggcgtactcggtggcctcgtgggcccggcgggtggacggagtgagttcccgcatcaccagggtgagcccggctgcctgggcgcggagcttcagcgggttgttcgggtccttcatcttctcgcgcacgtaatccggcagggggagtccctcggggggcgtctccgggcgcaggtagaagggacgccagtccacctggacgtcgtactccttcttcagcttctggacctcggcgtagcccacgtaacaccaggggcagacgtaatcggaccagacgcggacggtgatgggctcgctcatgggcccgtgtctaaccgcgtcgaagcgccgcgtcatggtggactgcgccggggatgcgcggaggtggtaccccgggtacgcggaggtggacagcgcgggccgtagcaggcagcgtccacccccgacaaccgtgcccgtgacgcacccctcgggtggggtgacggcggggcgactgaaccaggagactcccttgccgctgtcgcttctcgcggccctggccctgagcgccactccggcgccggcccggccccagccgttcacccaccacgacatgatttcgctgcgccggctgagcagcccgcgcgtctcgccggacggcaagcaggtcgcctacgtcctgcgcaccacggacatggaggccaaccgcggccgcacggacctgtggctcgtcggcgtcgacggaaacgccgcgccgcgccagctcacctcgcatccggacgcggactccgagcccacctgggcgccggacggcaagagcctcttcttcctgtcctcgcgcggcggctcctcgcaggtgtggcggctgcccgtggacggcggcgaggccgtgcaggtgacgaagctgcccctggacgtgggcgccttccgcgtgtcgccggacggcacgcggctggccgtggcgctggaggtcttcccggattgccccacgctggagtgcaccccgcagcgcgaggaggaacgctccaagcgcaaggccaccggccgcacctacgacaagctcttcgcgcgacactgggacacgtggaaggacggacgtcgctcgcacgtcttcgtcgtccccgtggccggcggcgcgcccgtggacgtgatgaagggcatggacgcggacagcccctccaagccctttggcggcgcggaggagttcaccttcacgccggacaacaagagcatcgtcttcgccgcgcgggacgtgggtcgctccgaggcctggtccacggatttggacctcttcgtcgcgccgattgatggcaaggcgaagccgcgcaagctgacggagaagaaccgcgccaccgacaccagcccggtgttcagcccggacggtaagacgctggcctacctggccatgtcgcgccctggcttcgaggcggaccgctaccgcgtcatcctccgcacctggcccggaggtcaggagcgcgtgctcacccaggactgggaccgctccgtcggcagcctcgcgtggagcgcggacggcaagacgctcttcgcgagcgccgggcacgtgggccagcagcccatcttcgcgctggacgtggccacggggaagcccacccagttgacgaaggacggcgccgcggacgcgccgcagccggccgctgggggccgcatcgtctacgtgtatgacgacctggattcgcccgcggacctgcacgtgatgaacgtggatggctcggagtcgcgccagcttacccacgtgaaccaggacgcgttggctcgcatccgcttcggtgacttcgagcagttctcattccccggttggaacaacgagacggttcacgcctacgtcgtgaagccggtgaacttcgacccgaagaagaagtacccgctggcgttcctcatccacggtgggccgcagggctcgttcggcaatcacttccattaccggtggaacccgcaggtgtacgcggggcgtggctacgtggccgtgatggtcgacttccacggctccaccggctacgggcaggcgttcaccgactccatctcagatgactggggtggcaagccgttcgaggacctgcagaagggcgtggctgcggcgctcaagcgctacagcttcatcaacccggacaagatgtgcgcgctgggggcgagctacggcgggtacatgatcaactggattgccggtaactggccggacggcttcaagtgcctggtgaaccacgacggcatcctcgacgagcgcatgggctacttcgacaccgaggagctgtggttcccggagtgggagcacaagggcacgccgtgggagaacccggagggctacagcaagcacaacccgattgagcacgtcgcgaagtggaagacgccgatgatggttatccacggcgggcaggacttccgcgtggtggagacgcagggcctgggcaccttcacggcgctgcagcggaaggggattccctccaagctgctctacttcccggaagagaaccactgggtgctgcgcccggccaacagcgtgcagtggcacgacgaagtcctgggctggctggaccagtggacgcgcaagtagccgccgcgtgatgtcgtaggactcggggctcgcatcgtgagatgcgggccccgctgtcgttcagggctcagggaacgccgaagcaggcgccgatgcaggcggtgcgaatctgtgagcaggtcttgctgccgacacagtccccgcacgcggcgagctggtccctgcggcggtcctggtcctgccgctccatccaggctttgaggtcgtcctcgcacgactggacgttgagtgtgtccgtgaagcactccttccgtttctcgcagatggtgtccgtgtcgctgaagcagccggtcagcagcgcgctcacggtgatgacgaaggtcagggtcagcgtccgaggcatcatgcggaccatcatgcctcgtgcgcgtgcctgtcttcatcctcgggattcaggtgtgtacggggtgagaaagggcgccgcgcttcgggtcagggcttcggcgggggcgcgtgcgccgggccggagccgcccacgcccgtttcgcctcccagcttgcccagcatgttccaggcctggtgccggtgggcgggcacctgcttgctgaggtcctcgagcagggcggcgagctcgggcgtggccttgggcatggccttctgggcggtgaggaccatgcccaggacggcgtcatgccccgtgacctgtgaggccagataggcggagtcgaagggcgcgccgcggatgacctggagctgctccatcgtggccttgtccttggccatggaggcttcttccgcgtcgttcatcggcttgggtgattcggccagcttcaggcccttgctgcgcgcgtaggacgtgagcttctggtccagcgcggtgtgcgccttcatcatgatggtgccgaaggccttcacgtctggattctgggagcgttgctgagcgagctggcccgacttgatttcgtgttggttcgccaggtgcagccggtcgagcagcgccttctcgtccgtgggggcggtgtagccgcggtacgtggccatgcccttttgaacggagaccgtgtcctgttgggagggcgggctgtcgggcatgccggactgtgcgaatgacgcgccctgggtgaacagcgaggcggcgaggacgagccccgggaggggatgcttcatggggtgctgctccttgtgcgtgaggaaaggcgggcgcgcacgttggagcggcgtcggagcgggatgcacggtgcgagaagacgcgtccgtgcgccacttcacgcagagggaggagagggtgtggcggatgacggtggcgctgcccacgtggccgacccactgcgttcagtgcttcaccggacgtggtgcgtcgggagcgggcggcacagggtgctgcggggtggacgacgttggcggaggatgaacaggaccggcgatgtccttgcggtgttgccagggccagcgtccctccagctccacggtgagggtgaagctgaggaaggtccggatgaggacgatgagcccgagcaccagcacgccatccagcgtggggcgctggctcacggtgcggatgatgtcggcggcgacgaggaactccaggcccaggaggatggcgcggcccaggttcagccggaagcggcggtaggcctcaccggcggggagctgctgccgcgtggcgagcaccacgagggcgagcaccgctcccagcaccatgctgcccacgccggcccactccatgagttgggcggcaagcgagatgagggaatggacctccatcaagcctcccgtgcgagaagctaggcatggtggagacttcagtcatggagcggcctgcgtaaggggcgcatgcccgctcccgtgaagctccagggatggaggcgacgagaaggttcacgaagtcgcgaggccgtcgtcacgccgttggttgtcgaggcgtaacgaagcccgtttcagttccccgcgtccggcttctcgggctgcgcttccttcggtgcctccgcgtccggcgtgcccgacacgttcatctccgacagcccgctctcgtcacgcaggaactgctgcgccacgcggtccacctcttcgaccttgagtcccgtgagcagcgcgctcgcctgccgcgcgcggtccgccagcgccgtctcacccatggagccgtggatgcgcgtcagggccaggtggatttccgggtcgaacgggtccgacgccagcgcctccaggtaggccgtcttcgccttcgggtagtccttccggtacagcaggatgcggcccaggtggacgttcgtcgacggtgagcccgggtgcacacgcaggctgccgcgcagcacgccctccgcctcgtccagccgccgcagctccagcagcgccagcgcgtacttgttggacacggattcgtacttgtcgcccaccagcttgtgcgccttggcgtactcctccgccgcggccttaacgcggttgcgctcgcgcaagagctcgcccaggtgcgcgaacttgcgcgccggcacctccgtcacctcctggaagtcgccaaaggagatttcacgccccttcttctcgctctcgtccttcaccttgcccttggcgttctccttcaggaccacgcggtcctcgcgcggcaggagctcggtggggaagggctgcttcttgatgtgcgccagccaggacttctcgaagagggcgaagggcatccccatggccgtctccaccgccttgcggtccttctgcccggccttcagctcctggatgatggcgcgcagacccgccgtgcccttgacgctgtgcacgtagtcgatggcgtagaacacctccgcgaacgcggtggccgcgtcctccgccgtgggcagcagcgcgatggaggggtgcatcttctcgaatgggatgagcgtgtccgccttcacccgcttgcccagcagcgcctgggtggacggcgtcatcgccaggcccgccttgccgcgccagcgcgactccaggaacttggccagtccctcatgcaaccagatgggcaccgtgttgcggctcatctggctgatgaccagatggatgtactcgtgcgccagcgtgtcctgccagtcgtagccgcgcgccaccgccttggggctggtcaccatcagcttgttgaacttgcagatggcgatggtgcccgtggtgccaatctgcttctccgtcagcgtgctcacccgcgccagctcgcgcgcgttgctcaccacctccacgcgaatcttgccgcccggcggcgtccagccgaggtcctccttcatcgcccggtggatgccctccagcgtctccagcgcatagggcaccagcaccgcttccttccccttggggtactggaagatgaagtgctcgctctccgcgcgctcgtggtccttgacgatggcgcgcgtgtccttggccagccgcaggtagctgcccggcttgtcctcgatgttggcgccctccaggagcaccaccgcgtcgtcgtagcggccttcctcgaaagccacccggccctggaagtacttcagcggctccacgtcggcggggaggagcttctccacctcggacagctcgcgccgggcgccaggcacgtcccagtcgtccagctccgtctccacgcggcccagccgctccttcacctcgtccttgagcgagctggactgggcccacgccgcctgaggcacgcagaggagccccacggccatcgccgcgacgagggccccgaatccggaggaatgcttcagcgcgtggcggctcacttcaccagctcctcgtagtagcgcttcacctgctcccggtacttctccggagccccctgcttcatcgcgtccagcaggtccttgcggaactccttcggcgcctggaaggcatcctcgtccggcagctccaccttctgcttcgggtctctcccgttgccctgctggcggcggcccatgcccatgggcagcgggagcccgcccttgccgccgcgctggccttcctgcatctgttgctggaactggcgcagcccttccagcgccgcctgctgctcgccgtagccacggcccgggtccttgccctgcatccgccgggcggcctcacccatgcgctggccggcgccctccatctgctgcgtggcctcctcgccgaagatgggcgccatctgctgcatctcatccatctgctgacgcaggccctgcgcgcgctcctccaactgcgactgctgttcgcccagttgctggagctgctgcttctcctgctgcgacagctgcgagcccggaggcgggaagagcgactggagctgccggttcacctccgacacgttgcgcgcgtcgcggttgaggcgctgcgccagctccgtggactgcttcaccacctcttccgggttgccgaacatctcatccaggtggcgctgctgctcgcccatcatcgccagttgccgggccgcgtcctccgcccgcgccgccgcctccgccgccaggtcgtagtcgttcaccttcagcgcgttctccacgttctggagctccgcctgggcctcctccagcggacgcgcggcgcggctgttgagctggctgggctccagcgccttgtagtcctcttgcgcctgctgcaccttgcgcatcaggctgtccttgatggcctcgcccttctccgacagccgctcgcggttttgtgagcgggcctggtcgcgaagctgcttcgtctggtccgcgacgcgctgctgctcctgcacggtgccctgcagctcctccatgaacttgccgaacttctccgccagctcggggtgctgctcgccgccgaactcgtcgctcgcctggtccaggttctcgagcatctcatccatctgcatgcccaattcctggagcttcgccagggcttcgtccgccttgccctcgcgcatcagcttctccacgtcgtcgagcgcgctgcgcaggtcctggtccttcatcatctcggacagggcctcggcgttgaggtgctcgtcgcggatgcccttgcgcatctccgccatgcgctgcatcagctcctggatgcgggacttgagctgctgaatctgctccatcaccgcctggcgcgcggcctcgtccgggttggacttgtactgctcgatgaggttcgccagctcgcgccgctcgttggatagctgcctggccatctcctggagcgcctccagcttctgccggtccagcagtgactccaggtagaggatgtccttctccagctccgtaatctcctcgttgaccacggcggtgaggcggttgcccgtgccccagtcctcgccgcgggcgcgctgggtgcgcaggtagagccggcgcagctccgcggtgccgcggatgtggctgcccagggactcggagatgttgctcagcgcggagaccagctcggtgggcacgtcgcgctcgcgcgccagctcctgcgccagcgtcttcatgtcggcgacgaggctctccccgctggtgtccaccgtggccccggcggtgatggcctgcgggtccttctgcttcgcgcgctccgggccttccagccggtccgcgaggtggtccaccatccggccccacagctgctccgccttctccagcgctgcgcggcggtgctcggccgcggagtacacgcgcagcacctgcgtgcggctgacgcccttcttggggccctccaccgcgtcgttgtcctgcgcctccacgtagtaggtaatccggtcacccgggtcgagcttgaggttgtccaggctccacgagtacgtgccccggtggcgccgtccgtcctcgcgcggcagcggcacgcgcgtctcctgctgggcgccgggcgcgcggaacacgagcgccatgccggacagcccgtagtcatccgacgcctcgtacttgagcgccacctggtcgcccgggtcgatctccagctccaccgtgggcgtgagcagcgacacctcgggcgccttgtccgcctccacggtgagggcgatgtccggccccaccgcgagcgccttgtcccgcgcgccgtagaaggcgaagcggtagtggccggactgcttcgtgacgaagctgccctccaggtcccggttgcccgtcaccgtcagcggcagcgcctggccgttgaccaccagctccgcgcgctccaccggacggtccgagcgcgtcttcagcaggatttccgtccccgccggcgcgctgatttcaccgttcgttccgggcaccgtgcgcggggccagccccgtgtacgcggggtagcggtacgtcagctcgatgtcgccggtgatgggctccacctgcgcctgggccttggggctcgccgccacttcgcggatgcgcgccatgccggcggaccagcggtcaccgagcgcgaccatcagcaccagcagggccagcagcgcgccacccgcgcccagggccacgtgacgcaccgggcggctgtccaccacggtgcggacatccaccgtgcgcgcccgcgcgtccatctcccgcaggaaggcgctcgcgagcgccggagagccgctgcccggcgcgtccggctcgcgcatcagctccaccgcggccagcacgtccagcgacagttccgggcgcttttcgcccaccatgcgcgcggtgaggacgtcgtctcccacgcggcggcgcgccagccacaggccgaagacgcacgtcacggccacgcccaccggcagcgccgtccacagcagggacgcgcccgcgcgcggcgccaccagcgccaggaagccgccggccaccagcagcagcgccacggtggccacgcccagcatgacgccctggagccacaggtaccggcgctggcggccctggacggtggcgagcaacgcctccacgcccggggcttccaggggagggcgggcttgtgacgcggaaggtgacggagggggagggggcggaggcgggagctcggggcctggtgtctgcggtgtgtcgaggttcacgctgtcctgtccgctcagtgacgaggcaacccctggtggggctgcctatttcccgattttctagcagccggcctcttcttgcgaagcataacgatccaggagcccattcgaagggctccaggtgtctggcgctggaaggagacacaagggcgagggtccgggatgtgacgcggtccaccgggctcgcccttcctacgaagcccaccacacgcatccccggcagcgacaagggagcgggcgggccgccggctcatcggacgacttgcttgcgggcgcccgcctcgtcgtactcgacttcaggcatgggaacgccgcccagctcccgggccagcgcggtgagcacttcctgcgtcgcgacgatgttggaccgcgaaaggcgcgacagcacgcgctgcaccgacgactccaccgtgccctcggaggggatatcgagcgcgcgcccctcgtccgtcagggagaacagcgccttgcgcccgtcgagaggatcggacttgcgctccagcaggccccgcttctccaggcgcttgagcacgcccgtcagggtgctgggatggacgtggaggatctgcgcgagcatgcccgcggtgatgtcggggaagcgccccaccaggcggatgaccaggcgctgtggacccgtgagtcccagcgtggactccatgcgcttcgatgtggactggagcccgtggtccacggcccagagcagtcgcatgaattcgagcacttcaccaaggggcggccctttgtaggtccgctcgccttcgtggggtcccagcggatcttctgccggtcccttcggggattcttctgctgtcacctgctgcctccgtgtctcaagccaatggtttgagtcgcagcaggtctatcgcgtcgccgtccgacctgctgctgaaaaaccgttggctgttgaccgctcgcaagccagacgtcaagccggaggcttttcgaaggctcaggcaggccccgggcggcggcatgggccccagcgggcccggtggggagggccgccgtgggccatccccccgccgtgaaggccggatgccgggtgggcgggcgctcagagctcctcgagcgtgagccggaggatggagcccgtgtcgtcccggtccaggaccttgaaggtggcaccgggcgggatgagcacctcctcctcacccggcttgagtgaggcgccctggatgtcgcggcccgtcttggtccggatttcgaggatggcgtcgccatcgaacttcgcgtccgggttcttcgccgtgctggtgaaggcatcccgggtgatgacggcgtccttcgtgtaggcgtcgtagtactgcttgctgtcgccgcggaacacggtgccctggaacttcggcagttcgttgagggccgcgcgggtgacggcaatgccatccaggttgttgcgcagcgcctgggacgtggggccggcgccattctttgccagcgggaagaggacctggccgttgtacggcttgaacttctcttgtgtgtatttgtagagggagaccttgccctcgtcggagagcccgttgatgttcgccacggtgaagccgtcgtcgaacacgctggccagcttgacgcgctccgcgtcacccgtcttcacgtgcggcccaccctggggctggacgtcttcgtcgtgttgttcgtgatgcgacccatggctctgtccccctcatcctggtgagtgccagggggctgatgtgcgctggttccccattctcgacgccggtgtggccgaggttgtggccggagggggtagagcaggaatcatcagcctgatgacggatgcctagggctgaccgcgcacgggacgcagcgtcggccgtggagcggggagaaggctccccgctccaggatggggtgttacggcgcgggagccacggtgggcttgggcgccggcttctgagcaggggcgggcgccggagccggcgcggcggcgggctccgcgggcttggcgggcatctgcagggccttgccattctcctggacgatgcgccggtaccaggcctcctggaacttgggatggttcaccttgcccatctcatcgcgcacgttgccgtcgatgtacttcacgagcagcgtctcaccgagcttgcgccagcgggtgtggaccttctcaccctgctggagcgagtagtcggtgaggtactggcgcgcttcctcggggctgcgcttgaactgctcctgggcgcgcttctcgatgtcggcctggtccgcgaggaactggccttccagtgcgccctgctccttctgaacgtcattcaccatgtcgctccagcgcccgtaggcctggttcgacacccagttgaacacccagaaggaggagtcccaggagaactctccgcggctggccacgccctgcgcgaagttgcgcggcacctgccggattccggcgtacatgggcgtgtagacggtggtgaaggtgtcgtccacgccgaaccagagcacgccgccaatgggcgccggcagccagtcccgcatctgcgcgacgaaggagaagcccgtctgctgcgtggagatggcgcgctcgtggacgtactgcttgccgtccagttcccacgtcattggccgccagcggtacggcgccgcgtaggggcccgcgcccacgtccttcgtcatgtccagcggcgtgcccgtgaagtggtcccgcatcagcgccatggtgtcctgcacggacagcttcttgtccggcttcacccacagcggcagccgcttctggggcgccgcgccgtccgcgtactccgcgcccagcttcatcgacggcgccgcgcgccggaagatgctccacacgcgcgcctcggagaaccgctgcccgccgaagtcgatggggttgtacgtctccgcgaagttgaagtccttgtccgcgcccttgaaccagcccttcgcccgggcgaaggagatgacgtccggcgagtagaacgtcgtctgcttctcgttctgcgggaacgtgccgatgcgcgactggttggcgtgcgcggagaggtacccgtcgggcagcttgcgggccacccacaccgcgcccttctcgcccttgcccttgccaatcatctccagcagccaggcctccttcgggtcggcgatggagaacgactcaccggtggaggcatagccgtgctcggcgaccagggtggtcatgacctggatggcctcgcgcgccgtcttcgcgcgctccagcgcgatgtacatgagcgagccgtagtcgatgatgcccgcgggcccctccaactcctcgcggccgccgaacgtggactcgccgatggagagctggtgctcgttcatgtttcccaccaccgaatacgtcgcggcgggctgggggatgcggcccaggaacttgccggtgtcccactcgatgatgtcgcgcatggcgcccggcgcgtggcggcgcgcgggcgtgaagtacagctcgccgtacagctcgtgcgcgtccgcggcgtaggtgatgaaggtggctccatccgccgtggctcccttggagaccagcatgctggtgcaggcgagcacgggcggagcaaccagcgcggcggtgacaggcagcgcggtgagcaggttcgtcaggcgtcggttcatggcggcggatggtaccaatccactccaggatggctaccgctcccaaggggcgctcccctgtttgcccctcatgggcccgtccacgacagggccgccgcaccaggccacgagagaaatcccgggcagcggccccccattgtcggagctttcagtctcagtcgttcgtcgcgctcacctcctttctctcaggaggggcgggcacctgttcgactcgcagcgtcgtgggcccgctcagcgccaggtgcgccttgagcttgaggaacttcttcttgccgaagcccttcacgcgcaccagttcctccacgcgtttgaaaggccgcttctggcggtgctcgatgatgcgctgcgccgccttctcaccgacgcccggcagcaaatccagctccgccgcgctggcttcgttgaggttgaccgtccccgtgtgctgcgtgcgcagcttcgccgcctccgccaccccgggcccgcacaagagcaggcccaccaccaccgcgcacagcgccctcacgagtggccacccaccggcgccgcgtccagccccagctcgcccgcgtagcggccgccgctcattcccgccgtgtcgcgcttctccgccgcctcgcggacgtgcagcttcccgtccaggggcagcacgtccagcaacacgttgagcgagccgtccttgttcacgaaggcgctccccgcccgcacccagatgctcccgcccttgccctcgcgaatggagaagaccgccagtcgcttacccgccgtcagcatcatccacctccacactccgcatcgcgccaccacggcgcggctgcctcgtcggcttgaccgcctgaggtcggggagcgcttgagcagccggcgtgccagcggtgttctcctcggggcgcgctgcgcacaccgtgcgtggatgtgagaaccgtccagcggcgaggacggacagtgacgcgccagtggcttctcagccgacgagaacgcggcgccaggcaggggagggcgcgagcgcgcactcatgcatggttcgcgtccaggtgcatgtctgctggagccggccgcggcgcggcgggtccgctgcgtggaagcgcgaccgtgaaggtggcgccgcgtcccgcctcgctctggacccggaccgcccctcccagcctttcgacgagctgactgacgatgtggaggcccaagcccagccctccgtagtggcgcgatgacaccgcccgctcgaaggcccggaagatcaacgcctgtcgttccgtcgggatgccgattccctggtccctcacttccaggagggcggtcctggcgtctccgccgacctggatttcgatgggcttgccctcgccgtacttgatcgcattcgagagcaggttggtgacaatctgatcgagccgcgaccggtcccagattcctggcatcggcgtgtcggcatgaacctggagcgtggcgccggagagggccagctcgggtgcgaagcgtgccgcgatgtctcggaccagcgcggcgaggtccacttcctccagctcgagttcgagccgcccggcatggatgcgcgagacatcgagcagcgtgttgacgagcttcgccatccgcatcgcctggcgttcgatgccttcgaccgattgggtcacggtctccgccgacgcggtgcagagcgctcccgaccgggcgcggcgcagcagtccctgcacggacaactggagggaggtgaccggggtcttcagctcatgagaggcaacggagaggaattcatcacgaaggccaatggcctgctgggcttcccgatagagccgggcgttgtccacggccatgggcgcgcggggggccagctcctgcgcgacggagagctcggccaggccatagcggctcccgtcgtccagccgggcgagggtgagcgcgccgagcgtccggccacgcgcgagcagcggcactgacagccaggactggaactcgaggacgccgcactcgagagcagaggagccgcaaccctccaggcagaactccggctcgccgcggcggagcacccgcccagggccatgcgtggcattgaggtccggtggcgcgtgggcgtccttcgcgggccacctggcccgcagtatctgggattgggccaccgcgattcgctggggggaatggtcgttgtccagcaggtcgaccgtacaccagtccgcgaaccgctggacggtcagcgccgccacgtttcgcagcgcgtcctcgggggcgagcgagcccgcgagcagtcccgaggcttccgccaggaacgcggaccttccttcctgctcctcggcgcgggtccgcgcttgctgctcacgcaggaaggtctggtctcgctcccgctcggcccggcgttgctcggtgatgtcgatgcccgtgccgatgatgtactcgaccgctcccgacgggctgcggaggatgttgctggaccatgcgatgaggcggcgctctcccgctcgcgtgagccagcagctctcgtactcctcgtgcccctggcctgcggagagctgggcgaagtcccgctcgacccgcgccgcttcttccggggcctggagctgcttccagaaccgcgcgccgcgaagctcctcgaaggagtagccggtcatctcctggcatgcacggttgaagcggacgattcggccctccacatccaggacgatgaacagcgcgcgggctgtatccaggaccgccgagctgaagtcccgctcgtgctggaggtcccgctccgtgcgccgtcgagcggtgacgtcccggaagtaggcggcccgcccatagtagacgccgtcagcactcaccaccggagcgtcgtactgctcgaatatccgcccatccttgagccgaagctcgtcgtgccccgacgcgtcgcggtgctcaatgaagaaggctgcgcgcgccatgaaccgggcaggctcctccacgagctccgccgccgcacggacccacgccccgtagggtgcggacaggagcgcctcctccagcccccacatctgcacgaggcggcggttgtgcgtgagcgtccttccttcctgggtggagatgaggatgccctcgtcggaggcctcgctcagggactccagcagcgtcttcttctggtggagcgcgcgctcgctctccaggatgcgggtgaagagctgccggtgcatgagcgcggtacggagcacgccgccgaggcgctccatcatgcctcggtaatgtcgcgggagctgcggctcgcggtcgaagtacagcagcagcgcgctggcgctgtgcgcagcgtccgccccgatgatgggaatggaccagcgcacgagccctggcatttccaactccggaaagggcaggttcacctcggcgggcccttgcttccctccgggctcggagcgggcgggaatcggaagctggcgggacgcagcggagagtccacttgcgccctgaaggatgacctgcccccgcgcgttcacctggacccagagggcgaccatgcaccccagccgctccgcgacacggtccatgaaggcgtccgcgggcttgctcgggtcgaagaggtcgagcgccgcgacggtgagctcctggagcacgctcagcagcgcgagtcgctcctcggtgagcttccggtcctcgtcctcgcgggggtccgccatgtccgacctcgtcccatcaccctggaagggcgagcaccaccaccgtcttgttgtggaactgcggaacgccacctcccatggcccccacctcgcccagggtcagacagcccacgagcggcgtggcctccccgagcgctccctggacgcgtgagagctcgtcttggatttcctcgcccaggatggggtagcgggagaaacagtcgaacacgaccgcgccacccagcgcgccaggggttcctgtccgagccagggtggccgcccctgcggccgcgtccaacaggtccgcgcgcgctccctccatcacccggaccaacgagccatcaggtatctcggcgacgcagcggaccgagccgtcgggtccgatggagattagctcgcgaatcacgaactccccattggcctggggaatccccagcgggtgggtcatcgcgaagcgggcgaagccctgcacgtccagcgcgtctccgcggctcgcggccgtgcgccggtagacctcgaacgcgctctcgtaatcgagctcgatggcggtcgcgccgtgggccttcgtgacctgggtcggtgggccgtatggataccagccgtgctgaatcccgacgccgatcggcgcctgggcatcaaaggcaatcaccaccacccggtcccggtatgcctgcccattcgtgaactgggccgtcatggcgctccggaggtcgcctcccgctccgccccccgcccagacgacacccgcccctgcctcctgctgcgccccgcgcacgacttccgttggattcccgctcagcgcgtccgggaagacgagcagcgcacggcggcgccccggccgcatgggaggcagcttctcgatggcacgcgccaccgcatcacgcccggccgctcgggggtccttgctcacgggcccacccatccccgttccgacctgcaagtccatcccgcggaacagcgcgaccaccagcccctggtgcagcagctcggttcccgcgaaaacacccgccgcgcagcatccggcccaggggaggtcccggagctcccgccggagcgccgacgccaggtcatccgcgtcatattggtccgtgcagaggaccaatgcgaaggtgggcgcgtccgcgcctcgcagcgcctccgcgcccgcctcccgggcggcgacttcgcaatcgggagagcagctctttccaatctgcatccgcatcccactggaatcgatattcacgcgcgtactggcgtgcaggtggagctggcttcgtttggccgaagcaggcgcctttcgggcctgcctcggttgacacctccctcgtgcgctcggttgtatctccgtgctcatcgagtgagcgcagcgtgcgctcgaaagggggaccttgtgagacgcggaaccattctcttcgtcctggccgtcgtgacttccgtggggtgtggcgatgccgcggacccggacccgggcgggtgtcccgagacaggcacggggacgttggagttggccatcgagggactgcctgcctccgccaaccctcacgtcatcatccgccggggcagtgagtcccgggaggtgcgcgcgggcggccagctggcggggctcgcggcgggcatgtggacgctctcccccgagccggtggcggggagcggcggccgggttcgcgccgcctatgatgcgccggcccgtcaggtatgcgtcctggatggcgaagcggctgcggcggccatccaatacgcgctcatccccagcagccagcggctgtggctgtccaccagcaacggtgcggcagaggtggaggccttcgccgccgaggaactggaggtcacgggcgcgccgcaggccaccgtccggctcggttcgagcccgggcattccccgggcttcagggctcgcgttcgacaggcgtggcaacctctgggtggcgctggggtcgggggagctgcggcgctaccccgccggcgacctgggcgcctccggcgtcaagagccccgacgtcatcatgagcggcggcgtgttgagcgccgggagcccggggcccatcgccatcgcattcgatgccgctggcgacctgtggacctccatcgggttcagcaacaccgtcatccggtttggcgcggcccagcttgtctccggcaccgctccggcaccgcaagtcgtgctgagcgggctgggagacccctccacgctcgcgttcgacgccgtgggcaacctctgggtgggagacgtgacggccggggcctcccgcatccacaaggtggccgcatcgagcctccaggcgtccggcgcggtgacgtccgtcacgagcatcgaggtgctggaagccgctccgggcaggagcttcgcgggccccgcggggctcgccttcgatggggagcgaaacctgtgggtttcctacggcgcgagcggcgtcgtcgtgcggctcacgcccgatgaccagggcggctccggcgcggtgagcgtcgtcccgggtatccagattgacgcgggcggtcccaaggaactcgccttcgacgaaggaggggggctctggatggcctacaactccgggaggatttcccggctgagcccgagccagctcagcgtctctggcgcgcccacgcccgacgtcgtcatctccagtcccgacctcggggccacgcatggcgtcgcggtgtatcccgcccccgcgaacctgccgctgttccatcgattgccgtgacacgggccggttggcgtggggcgctggccgctcgacacttccagcgcgcaacgaaccgttgaatggccgggcgggggacttccttcccccgttgccgggacagtagcgttgctcgcatggcatcgggcaccgtcttgctgcgactcggcgtgttgggagggctgctcgcgggttccgcagcgttggcggcggacacggcggatgtgccccgggcggaagccgctccagtgggcccggagtcctcatccgtgcagtggcagctcctggcgggcggcctcgcctcgctcgacggctatgcctcaacgggttaccagggatggctgctcggggctggctgggagttcccccggctgcgcttccgcttccagttcctggcgggcctcccgtcgagcatggtggagacccgcaccgaggtgaagctggagcagtacgtcttcggcttctggctggacacgcccatgctccgctcgggtgcgtggcgttggagcgtgggcgcgggggcgggcttcctcctcttcggccggaccgcttttgcccgcgtgggcggactggacaccgcgggcccccgcttcgtccccgcgctcctcacggggccggatacctccctgcgctggcgtttctcgaagtacttcgccgtggagggctcgctggcgatggacatcgtcttcggccgccccctcatcggcttccagagcgcgcaggggttcgaaccgctccatgagggctgggccgtccggccgcgactgagcgtcgcgatgatggtcttcccgtgaaaggtggccgcccgatgaaccgcactgactttgcatcgcacgcgcctcacgggacgttccggcacctgctcgtcctggcactgctcgcctggagcggaggctgcgccgtggaggaccccgtcgcgcgggtgcgtgtcgcggacggtgggacgggcaccttctccaccgatgacgacgaggccctgctcctcggtgaggatgacctggagctggcgcttccggattgcgcggaggtcgagccggatgccggctcgggcgtggcttgcgaggactcggggacgccggacgctccgtagtcgcctggtggcaggcgtgggtggacatcccacgcggtgggattcgacagtgaatcgcacgtcccgaggctccaggaactggcgccgccggagtctcgtgtccatgttgcacgcgtccatccggtgaacaggaaggtgcgcgtgttccagccagctcctcgcgatgcgcgagcccatgatgggagctggcccgtgttgctgtgggagcctgctgccacgcggccgcgcggtggagcgtcccggtcattggagagggcatcgacgccctgcgccatggcgcccgtggtgctggaggtgcgcccgcgggtccgcacggcggacgccgaggtgacggtgggcagcggcgccgagtgcgacatcgtcctcgccgagcccacggtgtcccgcctgcatgcgcgccttcgtcgtgagccgcacaccgggctgtggtgcgtgacggacctggagagcgagcgggggacgtaccaggatggggtgctcatcctgccgggccggcccgcgccgctgctgtgccgctcccggctcacgctggggaacgtggagctcctgttcctccagacgtatgccttcgagcagtccgtgcgcgtgtcctcgctgacgcccccggtgagcttgacccgccggaggtgacctcctacaaagggcgcgcccttgggtgcccatgtcgggctttcaagagggaagccggtgagagtccggcgcggtcccgccactgtgaacgggcagccctgaggtcagggccgggggcttcggtttgtcgccactccatccgcggccgagcgccgttctgggggaaggcggaagtcctcttctggcatgacgcagcgtgcgccagtcgccagagcccgtcagccaggagacctgcccaggggtgcggccgagcctttcgcgggcccgggcggttggccttctctcttcgtcggagggagcggaaggcggagcatgcggtggaccttcctcgctgggcctgccgtgtgcctggtgctcagccttccatgtcccgtcagggcgcagccttccgaggccgagcccgcccccgcgcgcaccacggtggttcgcggcaggacaccccctccgcctgagtctccggagcggagggacccgacgggcgccatcaccgtcattgatgcgcgagagcgagcaggcgaggcgcgcgacacggcggagctgctcgtgggctcggtggggctcgcggtgcaggactccggtggttacggacagagcaagagtctggtggtgcggggcgcgtcgtccaacggcgtgctcgtgttcctggatggcattccgctcaacggcgcgggcggcctgtcggacctgtcactcattcccgccgcgctggtcgagcgcttcgaggtgctgcgaggtggcgcgggcgcgcgctatggctccggcggcctgggcggcgccatcaacatcatcacccgcgcaccggggccgaacctgcgcacgagtggtgaggtgacctacgggagctggaacacggcgctgggccacgtcgccgccacggggccgatgctgggcgggcaggcgctgctgctggtgcatgcgggccgctcggacggtgacttcgcctacgacgtggacgaactgcccgccgtggacggcaatccccaggtctccgaacggcgcgcccgcaacaacgcgcagggcggtggcgcgctcctgcgctaccggcgacggctcgtggggggctcgcggctggatgcgctcgcggagctgtccctggagaaccgcgccattccgggcaccgtgcagaatccccagtccaccggagaccaggagctggggcggaccgcgtcgg

SEQ ID NO: 1222 - DNA, 28320 bp, Myxococcus xanthus
ctgccgttcttccatgggccagacattcagagcggtggcgcggtcgctcacgatgacgccaagtttctggccgtatagcggggcaagtgtccgagacttgctgtccggcagaatcttgaagacggtggccattgacgaggcgatggtccatagcgtgcgcgccaggccggcctcaagccactgcgtgccgtccgtgtgcttcaccggcgccaacaacacccgggaccaggcctcgtccaccgcgggcttcaccgcctcgctgacgcgcgcctcgacggcgctcactgcccccagcgaaatgtcgatgcccagcacatcccccagaagcctcaccgccgagcgccgactcaggtggtagacgcccgtcaaaaggccaacgacggcggacagccgcgggccgaaggccgacgtcggaatcgccgcggtgcttgcccacgtctcatgcttgcacctggggcactccacgccatggcgcatccactgcgtgacgtgggccttgagcggcggcaattccacggactggtagcgccgcacccgcgtgccaccttcgggcgagagaggagcccagcaattcccacacgcggacgggaagaggtgcttgaactcgctcaccttctcctcggcaacaagcgcgcgtgtcagtcccacgtgccccggctggccaccgcgcttcttctcactgccgctctgcctgcgtcgcacggccttctgccccggcgtatcgctcgacggcggccggttcgagttgcccgaatctcgccgcaactgctcccgcagctcctgcaccagtcgagtcagctcctcgacctgacgctcaagttccgcgatgcgcgcatccttggggtcgacctcggccacgacggggtgtgtcccatgtcccacgccgcgtcagcgagcgacaggcctcccgccgactgctggcctgctccttcttcagccgcccatcacccctgaacgcttaccgaaacctctagcagaatcgcgcccttacctcgtaaccgcccggaatgctcaggagtcgatatcccgccgcgtcccgtcctgttccagcccattccgcacgttcctgcgacatacgtgcaacatggcgaagcccgtcgcctggtcagcgagccggggcagacgctatcgcacgcccgccgcccggatgccgtcgacctcgacgaggaggtggaggggacctcgcaaggccgggttgggccggtaggggggcgggtcggcaacgagcctggggtgctcaaggcggcaggcgaattcggtcaaagcgatctgtgcctccaaccgcgccaagcggtgcaccaaagcagtagtgaatgccactgccgaaccccaggtgcgagttgttgggccggtcgggcatgaagcggtcggggtcgtcgaagcgctctgggtcgcggctgcccgcagcgagcatcagcacgagcggcgagccctggggaatggtggtgccggcaatgtcgatgtcggccagagtgactcggtcaggcaggaactgcaccggtggttcatagcgcagcagctcctcgaccagcgggatgctcagctcggggctcgcggcgcagccgctcgaacacgccggggtggcgcagcagggtgagcatgccattggcgatgaggttgacggtggtctcatggccagcgacgagcagcaacgcggcggtgctcaacacctcttcccgcgacatccgcccgtcggggccgttatccgtcaggaacccggagagcaggtcgccgcccggctggcgcaggtgggcatcggcgagcgcagcgaggtactgccccagctccgctttcgtccggtcgcgcttggcctttcgctgctcgatcgtccctgtggtggggtcaagggtctcgacgcccgcgtcggccaactcgtgaaagcgcgcttcgtcctcgcgagggactcccagcagcttgcagatgacagtcacagggaatgggtaggccacgtcgccgacgatgtcgacttggttcttgcccgcgagcgcgtcaagcaggcccgtcgtggtctcgaccagccagggacgaagggcatcaatgcgtccgggggtgtgcggcggcccgaagggcctcatcgccagcttccggagccggtcgtggtcgggagggtcgcgccggatgaagggctctggcagccctggagggccctcctggggggagggcgtggcaccggcctgccggacgaggttgcgtatgtcggagctgacccgtgggtcgtggagcaacgcgacaatctcatcgtaggtgctgacgatgtacgtgccgtcggcctcgcgcgccacgggagtcttccgcaactcggcgtagagcgggtaggggttggcccggttggccgggtcgaggatctgctcgaagatgctggcctgtgccatgaagcggtctccttgagtccgttggaggggtggggtgacgcggctgccgacattcggctcaaaggtgccggtacacccaccggacccgccgctcgtagggttcacggccggtgaccatgacggtggcctcgtgctcggacacggcccgtttcggaaattcgggagggacgggccgcatctcggcgggctgatggacggtgcggaaggcgggcgggaacggcgcggctgcatcgatcaagccctggtagaactccagccatttgggctggtcgaaagcgaccgcggcggtgacacgccccttgtagccatagacggcgacgaatcggcgctcggcgagtgagccctgggtgatgacgagcgcgtccgagaaggtcggcacacccaccgatttgatgttgacgccgaattgcgtggaccagaaggtggggatggtcaggtgtggccagcggtccgcttccgggctgagcatgttgtgggccgcaatcttggcctgggtgaccgcgttgccccagtgctcgagggacaggaactggtagtcgtagatcgggtgagggacgcgggccacgtccccggcgacgaagatgttcctggtcaccaggccgttgatgtcgaacgcgtggcaggccgcatcacaggccactccccatcgagtcaccgccagccccgagtcgcgcagccactccacgttgcggatcgcccctagcgcgaccacggccacgtcgacgttcagtgtcgagccgtcggagaagtgggcccgccgcagcctcccgtttgcatccccctccagccgcgtgacggtgacgccgcagcgcaggtcgacgccatggtcgcgttgcaaggcggctgcgaccgccccgacaactccgccgagcgcccccaccagtggagtggccccccgctccgtgacggtcaccggcagacccagctcgcggcacgcggaggcgacctccgagccggtgaacccgccgccgatgaccagaacccggccgggtctggcggccagacggcgctgcaactgggccgcatcgtcgcgggtgcgcaccacctctacgccctccagcgacgcctccgcgtcgttgggccacggccgggcacgcgcccccgtcgcaatcagcaaccggtcgaactggaccctgttcccgtcagcaaggaggacctgcctgccggctaggtccagtcccatggcacggactcccaggtgccagtccgcatcgagctcgtcgctgtaaggcaatagggtgtggtctgccttcacccaacctgtcaggacctgcttggagagcggcggccggtcgtacgggtcgcaggcctcatccccgatgagggtcaactgacccagcaaagccttgggtgcggagcatgagggcggcagtcaacccggccagggatgcgccgacgataacgatgcggccaccgcgcttgaacgccgcttccgcgtcggtgagacgcacgggccccctgggcttccgtcgctgtgcaggctctttccgcatcgccgccagggtgcccatcccgccaatgtggatggcctggacggggcacgccgcagcggctcgcttgatctgctcacgaagggcgtcgtcggggttggagtcgtacagcagcgcatccccgctctgcatcctgaacacgctcggcgcaaggaaggcgcactgcgcatacccctggcagcgggtgaggtcgacgacgactctcatgggcacacggcctcctcaaaggggtggcatttcgcatgggaggcgcacgggaggaatgggccggaagttcgaagggaatgaccggtggtgtccagcgagcggcgtatgaacgcaatctcctcgcgcgtgagcagcctgctctccgcgtgtttccaagtggacccgcacctctactggcagcaggtcgatccgtatccgtccggccaaggacgtgctgagagacgttgagtgaggagtcggcgccgtggaccctggcgtgcatgtcgaagccggaatggtggcgggttgctgaggccttcgaggcgagcggactgacgcagaaggatttctccgcgcagcgaggcgtgcggatggtgctgggggcgcagttcaactcgttcctgcaccccgtcacggtgctcaccattctgccgctgtcggtggcgggcgcggccttcgcgctgctggccacgggcagtacgctgaacatcttcagcatgattggcctgctgctgctgatgggcatcgtgaagaagaactccagcatcctggtggactacgcgctgcaggagcgggagcgcggggcggatgcgttccaggccatgctgcgcgcgggcccggtgcggctgcggcccatcctgatgacgtccaccgcgacgatgatggcggcggtgccggcggcgctggcgctggcgcgggctcggagacgcgcgcgcccatgtccatcgccgtgctcggcggcctgtccgtgtccaccgtgctcagcctgctggtggtgcccgccttctacgtcatcgcggaccggatgaagacgcgggtgggagcgaggctggggaagaagccggatgccgagtcgggcccgcacccgcctcgcaccgacgagccccggccggccacgcacgactgagaggcggaacggagcttccgttccacgcacgccgccagcacccccgtgagtccaaccgggtggggctggcggcgtcctcgtctcagggggccacgagccccaggccctcgaaggtgacgtcgacgtcacccaggcagtcggcgagcttcagcggcgagtcggggcggaggcggaagtcgcccgcgtcggcgtccctgaagagcggctccagcaccacgttgccgttctcacccaggacgacgcgcggcgggacggcgtgggtctccgcgacgtgctggtcgttctggaagaagacgttgcagcggatgtcccccgtctgcacgtacatgtggctgaggcccacggccgagccggcgatgacgttgcgccggatgtcgacctggcccgcctgcacgccgagggcgagcgaggtgttcttccagaagatgttctcttcgacgaccgccgcgtcctggaggtggttgaaggcgagcgcgtagtcattcctccagaagaggttgcggcgcacgtccgcgagcgcgtggaagtagagcagcaccccggtgccgttgccctcaaagatgttgttcgtcacgagcgcggacgtcgtcgcgtcatggccgtccgcgaagatggcggaggcgtaccagttgccgccgcaccagcggtccaggtcggacgtcatcgtgcaccacgtgtcggagcccacgttccggaaggtgaagccggagatctccacgtcgctggcgccggagtagtcgatgaggttgaagggctcgcccaggccgtcccagagggtgatgggcgcgcctgcgccgatgagccggatgccgctcttgaggacgacgtgctcggagtagacgcccggcgcgacgtacaccgtgtctccgtgctgtgcggcgtcgatggcggcctggatggtgtcgtagtgcttgggcaccacgagggtgcgcggctcccggggctcgggctgctccggggccgctcccgcgggctgctgcacgtcaggtgtgtcgagtgccgcgccctcggcgtcgagagactcgttgcccgtggggcttccacaggcggccaggcagagcgtgagcagcgtgagtgagccagggtgcttccaggacatggtttcccctcccaatggagtcacgagacagtcggcccctgtcgcaccacgaagtgttacccgaatccgaagcggaatggctcctcgaagatctgaggctcgcggccgttgaaccctcagagttctgagagagtgtgtcgtgtcctgaacgcgccgcacgctacgctgcgttcctgattcccttcggaggcttcgtgaagcggcttgcccctgtgttgtccctgctcaccctcatcctgggagctgtcgccacggcccagcccgccgcgtcgccgtgcgcgccgcgcggatgctcgacgtgaagagcggcaagtacgtggcccagtcggtcatcctcatcgagggtgaccgcatcgtgaaggtgggccccgggctgcaaatccccgagggtacggaggtggtggacctggggacgtccacgttgctgccggagctcatcgactgccacacgcaccagatggcgcgcgaatcggagacgccgaacggctacgagctggccctgctcaccaagtcccaggccacccgcgcgctggagggcgcggcgaatgcgcgggccacgctgcgcgccggcttcaccaccgtgcgcgacgtggagaacgagggcagcggcttcgccgacgtggccctgcgcgacgccatccgccaggggctcgtggaggggcctcgcatgctggtggccacccgtggcatcgcggcggtgggcgcctaccacccgtttggcacctctcccgacgtgaaggacctgtccacgggagcgcagttcgtcagcggtggggaggaggcccgccgcgccgcacgtgagtaattggggcagggcgcggacctgctgaaggtctacgcggactgggccatgcccacgctcaccgtcgacgagctgcgcatcatcatcgacgaggcgcacaaggcgaagcgcaaggtggccgtccgcgcgataacgcccgagggcatccgcaatgcactcgccgcgggcgcggtatccgtccggccaatgacgtgctgagaggcgttgagtgagaggccggcgccgtggaccctggcgagcatgtcgacgccggtggagaagcaggagtggtttcgggtcgccgaagccttcgaggggagcggactgacgcagaaggcgttctcccagcagcgaggcgtgaggttgagcacgctgcagtcgtgggtgtaccgacgacgacgccagcagcctgagaaagctgagacggtgcgcctgctgccggtggaggtggctggcatggcgcagccggggccggcgttgctggaggtggtgctggccagcggtgcgtgcctgcgattcgcctccggcaccaacgtggagtacgtggcccgcctcgtcgcggcactggggcggtgaggcggtgttttcgctgcccgcgtcggtgcgcgtggtgctggccacaacgccggtggacatgcgcaagtcgatagacggcctcatggcgctggtgcgcgccgagtggggcgaggacgtctactcggggcacctcttcgccttcgtctcgcgcaggggcgacagagtcaaggtgctgacgtggagccgaggcggcttcgtgctgctgtacaagcggctggagacggggagattctggctgccgccggtggacgcgggtgcccaggtggtgcacctggacgccacgcagttggcgatgctgctggacggcatcgacgtggcccaggtgaggcgccagcccgcctggacgcctcccgggcgcacgggcacctgagacgagaggcccgggacgcagtgcggcggcgacgtgttgtggcggagtgccccgcgagcttccgcaagaccacttctgcccctggcgcgaggaggccgaggaactcaaagagcgcctgacgtcgctggaagcaaagatggcgacgctggagcgccacgtcttcagccgcaggacggagaagctgccgacggtggcctccgagctgcgaggggatgcggacaccacggcggcccaggccgaggccgcgaagaagaagcgccgagagagagcggcccggaaggccgagcaggccccggcgcgggagattcgccacgcggtgcccgccgaggagcgctgctgccccgcatgcggcggcgaggacttgaggccgctgggcaagggccgcgcctcggtgctcttcgagcacattcccgcgcgcttcgagcggcaggtgcacgtgcaggaagtgctggcatgcacgtgcggcaagggcgtcgtcaccgcgccgcctccgccccgcgtggtggacaggggcgagtacggccctggcttcatcgcgcacgtggcgcacgtcgaagtgcgcggacgccatgccgctgcaccggctggcccagcgggtggagagaagcggcgtgcccatgagtcgcagcacgcgtaacggacctcttccaccaggccgcctcggtgctgctgccactgtcccagcacctcttgcagtgcattgcctcggcggacgtggtgtgggcggacgagacgcccttgcacgtgctggacgtgaagaagacgaagctgggctacctctggactttcctcacccagaatgaggaagggcagtggctcatcggctaccgcttcagcatgggccggggcggcaagacacccagggaagtgctgggcggcaccgcgggcgccctcgtggtggacgggtacaccggctacaacgcggtgacgctgccaaagggccgggtgcgcgtcggctgctgggcccacgtgcgtcgtcgcttcttcgacgcgctggccaccgcccccgaggcgcgtgaggccctggacttcatcctcgaactctaccgcgtggaggcccaggccaaagacgcggacctggtgcgcacggccgcccaccgcgagctgcgccaactgcgcagcgcccccatcctcgcgcggctgcgcgtctggctcgaagcccaggccccgcgtcacccgcccaagacatgggcgagcgcatccgcgaggtcggacagggcccggatggcgccatctggctgctccaggacggcaaggccggccgcctgctcaagctcacgcccaagggccagtaagcgccttcgcacacgtaaaaggccgggcattgcccggccttttgcgtggatgacaccgggtcggcaggcccggcctctcagccgcgcaccaccggcgtggcacagtcctgggcgcgctgcaggcccatgaacatcgcatcggaggactgctggaacacgcgcagaccgaactcgggcaggatcgccagcaggtggtcgaagatgtccgactgggtcgcctcgtactcggcccaggccgtggaggcggtgaaacagtagatctccaggggcaggccgtgctcggtcggtgccatctgacgcaccagtagggtcatgttctggttgatgcgcgggtgggtgcgcaggtagcgctccacataggcgcggaacgtgcccaggttggtcagccggcgggcattgacgggctcgggatgcacggcggccacttgggcattccactgccccagctcctcgcgcttgctggccaggtaatcatcgagcaatgcgaactggtagatgcgtggctgcaacgcatcatccaggaagcgcacgctgtgctgatccaggtagatcgagcgcttgatccggcggccaccgctctgccgcatgccgcgccagttcttgaacgagtcgctgatcaacttcttggtcgggatggtggtgatggtcttgtcccagttctgcaccgtcaccgtgtgcagggcaatatcgatcacatcaccgtcggcgttctggctgggcatctcgatccagtcaccgatgcgcacgcgaccatcgccgctgatctgcacgctggccaccagcgacaggagcgtgtcctggaagatcagcatcagcaccgccgtggccgcgcccagaccggtgagcacatgcagcagcttcacgccggccagggtggccacgatggacaggccggccagtacgaagacgatgatcttggccacctgcaggtagcccttgatcggcttgttccgcgcatccgggcggcgttcgtagaacgcgttggaagcgtcgaaggcatggctggcggccagcgcgagcgtggccactgtccacacgtggcaggcgccctggagcaggaccaccagcgctgccggcagacccggcaccagcgacagcccggaggcgatcaccaccgacggcaccacgttggacaggcgctccaccgcgcgcaaggccagccgggtgtcgtgctcggggccggacagccgctcgatcacatggtgcaggccgcgcagcaggatcttcttggtgacgaagttggccagccaggccacccccagcagcgccgccagcacagtgaccggccaggccatcggccagggctccagctggcgttgaagcgcgctcagccacggcaggatcgtcacgggttgttgcacattcatgagcaggtaatacctccttggcttgggtgcggtcagccgtcttgacggctacgttcgatgagcacccccaccgcgcgcgccacgtaccgcgccgggcttggacagcttcaggcgcagccactgcacgccgaactcctccagcacgatggccgcgcaacgctcggccagggtctccaccagaccgaagtcagactggccgacgaactcgatcagtcgcttggagacggccttgtagttgagggtgtgcgcgatgtcgtcggtggcggcgggcttgcggttgtcaacgcccatttccagatcgaacaccagggtctggcggatgcaggaggacgtcgacgtgttcggctgcgtgaggtgtggaggcaggcggcgggtcttggcgtacgtgaagtgggcccccggggtgcgggcgattctggagcacctgggcttgcccacggcctgtgcgaggttggccccggcacgagggccaccccaggccgcgtggtgttgaggcgcaagacagccaccgggccggcggcccctgccacgcacctgatgggagcgcggcctgggcaggcgtgtaccccaagggggttcaagcggtctgtccaccggccgggagcatcgctcgggaggccccgtcagcggccctcctcggcccctccgctccagccctcaccctcaacagggcctctatcccgccgatacgttgacgcccccgggacggtgtgtcccggaggcgccagcacaccttgcgcgacgtcagctgccgcgcgccccgttactcgggaatcccaccgaaggcgcccgactcgaagtcgtggatggcctggatgatctcccggtggttgttcatcacgaacggcccggtgtgggcgatgggctcgtggatgggctcgcccgcgaggacgatgaagtgcgtgtcctcttcggcccggagggagagggtctccccgtcgttggcgaacaccgcgagttcaccgctccggatgctctccgcgtccaccgtcacgcggccgttggcgacgagcaccagggcgttgtggttcgagggcagcgacaggttgaagtcctcgcccgcgcgcaccttcacgtcgagcatggagatgggcgtgaaggtcctggcgggccccttcgcgtcaccgtagctcccggcgatgatgcgcacccggctgtgctccgtggcctccccgcctccttgaacggggaccaccggaatctgctccttcgtgatgggctggtagcccggagcggacatcttgtgctggcgaggcaggttcacccagagctggagcatgtggaacgtgcccccgcgccgggagaagtcgtgctcgtggtactcctcgtggaggatgccggacgccgccgtcatccactgcacgtccccgggactgatgacgccggagtggcccgcgttgtcgcggtgcgcgacgtgaccctcgaacgcgagcgtcaccgtctcgaagccacggtgcggatgccagccgacgccccgctggcccttcgccagcgcggggtagtcatggggcggatggtagtcgagcagcaggaacggactggtccgctcctggcgcaggccgccgctcggcacgagggtgtggacgcggaagccgtcacccacccagtgcagctcgccgccaccatggacactttccagggtgcgggggcgggaagtggttcgaggagaagtgggaacgctgacttgggtcgtggtgctcatggttccaaacctaagagccgagccccgtctgtaaatcgctccaggtcgtgatgcttttcatcacgtcgtgtgatggtccgcgcccccgagcgcgagctggcacagcgaggtgagccggttcgaggcccacgtcgccaccgggcccagcggcgtgcccttgcggcgcaccagggcgagcgggcgctggggtgggggccccccctcccaggccgccagtcgcagcgccaccagccgtcctgcggcgaggtcgtcgcggacgaggtgctcgggctcgaggccccagccgataccgccgacgaggagtgagtgcttggtcatcaggtccgcgacacgccagaggcgcgagccgatgacgccccggtccgccgtgcccgtcttgccctccggcagtcgctcgctcaggacgatttggatggcggaggcgaggtgcgcctccgtgaggacgcccttcaccgccgcgagcggatgcgagggcgcggcgacgggaatcatcttgaggagcgcgatggggcgctgctccaggccggtgaggtccaggtccgcgccggcgatgcccagcgtcgcgcgccgctcgcgcacgcgctccgtcaccgcggacagcagctccacctccagcgccagctccacacccgggtgcgtgcgcgccagctcccgcacgaagtccagcagtgcgtcggtggggaacatggcgtccaccaccagcgccagcttcgtctcctcgccgctcttgagccggcccaccaccgcctggaacgaggcgatgtcctcgtggagtcgctgcgccgccgcgacgacggcttctcccttcgccgtcagacgcgggacgcgcccgctccggtcgaagagccgcaggccgagctgcttctccagccgctgcatggcttgactgacggcgggctgcccctggccgagcttccgggccgccgcggagaagcttccctcctcggccaccgcgcggagcgtgcggagctggtcgatggtgacgctttcgagcaccgcgcgactgcatcacatcgacggcgatgatgcacgcgcgcgccctcgcgctacttcttcgaggacagccaggagacgacgggcgaggccagtgtcgcggcggcggtgctctccgggagggcgccccggagcatctcgcgggagatggccaccgcgcgcgccgatgatgccccgcagcgctgtcgcagcgtgtcccggggcagcttacagaagggcaggaggacgttcgacttcgacgtgttcggctgcgtgaggtgtggccatccgcacgcaagggcgcgggacttcgcgagccccctcaatgccgaggccagcgcacggcggggagcaccgccggcccaggagtggcaccagcgagacatgcctgccaaaaatgacgtggaacccgcccagcccgctctcacggctcagccatacagctcgctcagcggtcccggcgcgatgcgcgtgctgccctcctgcccgaaggtgttgaagtccgcgtctccgaacgcgtggccgagcgtgttgaagaggttcgagacctgccggttccgggccgcgtcgtactttgggtacacgaccgtgcgtccgtcggtcttcaggcccagcgcgttgccgcccaccacgagcttcggccactcacgcgaggtcgagtggtgctgctcgccgttgtcggacatgaagacgatcgcggtgtgatccaacatcgagccgctcgcgccgacctcgggcgtggtggccagcgtcctcgccaggttcgccaccagttgcacgtgacggcgggtgacctcggcgacgcgatcccagttctgccccgcatccaggccgtgctgcaggctgtgtcgcgggatgtcggtcacgtccgggccgtaggccacgtcgaagcccgaggtacccgtcgccagcaccaccgtgttcgtcagcccgcccaggagggacgccgtggcgatctggaactgcgcctcgaaccacttcagcgagtcgggcggtgagcccgcgccggtgatgagcgggttgtccttcggcgccggtggcaggtagggccgcacgcggtccgccatgccttcgagctgatcctcccgcgtgcgcagcgactcgagcgaggagacgtagcgctccagtttcagccgctcgttggagttgccgctgaactccgccagtgccttccgcgagtcggccagcgcgaagtcgaagagcatcttgcgatcgcgcccgttcgtcgagccaccgagcagcgagccgaaggtgctgtcgaacgcgagcgacgggttgacgatgatgcccgcgggcttgcggggtccgagcgcgcaggtctcgtacacgatcgacacgcgcgcggagctggtgcccaggcgcagcacgtcgaacggtgcaccccggcgcaggcgaggtgcgatcaccgcgtcgaaggtcgcgcccgcgccgttcaccgcgcagctcagcccgcccgtcccgctggagtgcccgccgcccgcgatgaggttcgagagccccagcagcacggcggagcggttcaccaggtcgatgttgccggaagacgccgccagcggcccgagactgatcgcgctggcgagattgtcgccctcgcgcaccatcggcgtgtccttgtacgcgtcccagaagatgcggtcggaggtgttggctcgcccccccagcgccgcgcgggtgcccgtgctcaggagcgcgcgggggtagacgccattgcactcgaggaccagcaccaggcgcgccggcaacgctgacgactgggcgtagacgtcgtggaagtagggtgcgaagaggccggcggccatgcccttcaggacggttcgtcgcgagaacatggcggtcactctccagcctgcggcacacgccgcgtcttccaggtgtcgctggtcatcagcgtggtcagcatcttggagaacgagccgttgttctggtcataggcctgctccatctgcgtcagcgtacatgcgtcgctcgcgttctccgggcggcccatgaagtagcggaaggcctgtcgcaggaagcagcgtttcacgtgccgcgaggcagccaggcgctcgctcaactccactgcgtcgcgcaccgggccgtccagcgcggggtccggcatcgacgtgagcgtcgagcttccgtccggcgtggtccagcctccgctggtcgagtgatcccgcgcgcgcaggaagcccgcgtggttgtagatctcgaagggcaggccgagcggctccatcaggcggtgacagctctgacactgcgatccggccgtcgcctcctgcaggcggcggcgcgcgttcttgtcggcagcgtgagcgccgacctgggctgccacctgcacgctgctgagcggtgggacgaagccgcacagaaggttctcgcgcacccacttgccgcggtggacgatggacgggtcgtcctcgaagttgccgccgtgcgcggccagccacaccgggtgggtcagcacgcccgcgcgctcggtggcaggcagcgtcttccagcggcccgcgacggtcgccgggagaatctcgctgacgttgtaggggtgcgagaggcccttgtgcgagtcgtacgccgcgtgctgcatggagggcacgtagaaggtgcgcgtggtgagcaggttcgccagcacgtctttatcctcgacgaccacccgcgcgatcagatcgtcgaactgctggatgaaggtcggctccagcggatggaagttggtgagcaggttctcgtatgagaccgagctgatgtagccgagcccctcgagctcgaagcgcgaggtcgccgcgggggactccttgaacaccgcggccacgtgcccgtagccgagccactcgcggaagaagcccgcgacgccgtcacccagccagtactgcccgcgcttggagcgctgctcctcgttgtagtcctgcaccagatcgaagcgcggtgtcccgttctggtgggcgtcgacgccgcccaggtacttctcgatcagggcggtggtcgtcgcatcctgcgtgagcgatccatccttcgcggcggtggcaacgtccgccagatgcccctcgaggggcgcggagaagtagggccacacgaagcttggcgtggctgagggcgcgcgccccgccagcgcgtaggccagctgcgagcccagctcgaggctggtcagctccacgcgaccgtcggccggctcggcgcccatctcgcggcggaacatggcgccggtcatcatccacgcggcgttggagatccgcgtgatggagtccgcgcggtttcgcgaggagtagctcggctcctgcgcgatgacctcggtcgcgaaggcggtgatgcgggtgagctcatcctcggtgggcgggcggaagaagacgccgaactcgagcatctggccgaggtggaagcgcttgcaggagtcgctcgggttcgcgtcgtcgaacatgcacctgaagcggctgttggtgtagacacgctccatccggtttccgtccgggtagttcatcgtccacggcgcggcggcctcgccgaccaccggcaggaagagctccaccgtggcctcgtccagcgtctcgtccgtggcccaggagctgtactgctcgatggcgctgggatcgagcgggttgtcgtagaagctgaacccggtccagctgcgctcgaccgagccaccgacgttgcgggtgaactcgcgccggttcaagcggcggatgcgcgtcggcgcatccgagcgcacgccttcggtgcagctgaagagcgcagactgatcgagcaggttgggctcgggcaccacggttacgggcgggccgcccaggacactgcagacgggcatcccctccccgatccaggtctcgagcgcggcgaggtcggctgcgctcgcgcgctcatgcggggccggcggcatcggagatgcgtcgtcgcgcatgcggatgagcgcgcgctgggcgttgctgagccctccatccatcaccgaactcacccgcatgtcgtgcagggtgcgcagcggcatcgtcgccccctgggtcggcagcgcgccgtgacagctggcgcagcgctcggcgagcaccgactgcaccacgcacgcggcgcccaggttccccccgggcccaccgggctcccctgggttgttagggcctccggtgttggtgtttggctcgttggagcccttgcacgcaacgaggctcaacagtccggccagcaggaggacgcggttcatccggccagactggcacggacggcaggtgggatagcaagcagtccctgcaaatcgggctcagtcctgcctgggcatggcagcgggcgtcgcccaagcgccccacctggcagcatccgtatttcttcccccgcgccggaagcatcgcggcaccatctttcaccaggtgcggcaggtgaagaccggagacaccacggcgctgggcgagagcgcgatgtcggagcgcagccgcaccctggagccgcgcaccgcccgagccgaccgcgtagaacgcttgaaccccggaagctcgcgccggaccacgccttctcgcccagtccttttgcaacgctcgccgagcacggcacccaaccgtcttcaacatctcacgccacgtcattcgccggacggttgcggagagaggccgcgccagcaggtctggcgcggcccttcgacggggcacccggacaaggtgagacccggggggctaccggggcgtcagtgcccgcctgtggctcacggaacggtgaccgtcactgcgttgctgcgttggctgttgcccacgcggtcatacgcgatggcgacaatgacgtgcgtgccggacttgcccgtcgtgtcccacgtacgggtgaagggcgcggtggtcgaatagggtgtctggatgacaccgtcgatctcgaaggcgacgtagtagagcgattggctgtcactcgcattggccgccagcgtgacgacaccactgacgacgtctccgttggccggtgcggtcaggacggacgtgggcggcgcgttgtcgacgatcagcgaacgggtgtgcgtcgcgacattgcctgccctgtcagtcgcgcgcagggtcaggctgtaggatcgattggccagcacccgcgtgtcccacgggaaggtgtacccaaggctggtggggctcgtcagcgagcccttgaggtacccctcctggaagaactcggccaggaccacgcctgagagggactggtccgtcacggtccagcccacggtgatgttgccgcgcacatagttcagggtctgcgggttgtactggggcgtgcccgaaagaatgatgggagcgaagttgtccaccatgacgctcaccgggtcggagatgcccatgttgccgtccgcgtcgaaggcctgggctgtcagcgcccgggtgccggaaggggacgtcgtcgtgtcccagtccacgatgaaagggggctgggcgtcggaggcgatgagggtggaccctgagaagaagtccacgcgcgtgacgccgacgtcatcgtaggcgctcgccgtcagggtgatggtgccgcgcacggcactgtccgggctcggcgagaggagcgtcacggtaggggctgcgctatcggtgcacagcaggtttccgaagtccttcgcgaggcgccgcgcgtcggtggatttcgagcgcgctgagtcgaggaccgattccgtcgtgctcacctggagccggcctggggcggcggtgaatcggtcggtgacggcctggagggtggtgttgaatgcctccgtacccggagtctgcgtggcgagtgcatgccattgccgggcccagtggagcgcgtccgagggcttggatgcatgcaggtcgtacacgagggtggcggtgaggggcagtggcttgccgtccgcatcgattgcatcgaagaccaggtggccctcgccagcgctgtgccggtccgaattgtgggtgtccacgtggttgacgatggccttcagccgcatcggtgccttcgtcatgtccagggtgccatccgcgagtcggggccacgcttcgaggagctggggcacgagcgtgcgggcgaccgcgtcctgttccgcaccccgctggagcctgtcgcggacgaactcggagggcgcgacgtctccgctcatctccgccagtcgtcggccgaagctccacgcgccgtccgcggccccgcgcaccatgggcatcgctccggaccaggccgtacgcaccgggtcattcagcacggtcgcatcctggatgagcagctcccgctccggtttgatggaggagaggcaatccagaggcgcgcttgtctgcaggagctcggcctgggagctctccgacgcgtccgggacatcaccacaaccgatggatgccagggccgccgcgccaagcagtgcggaaaggccacgggcccctttcgaaacgatgcgcatgtggattctcccttgaggaggctgtgctcgcatggaattgagagcggcagcgcgcaacgatatatcaaacaatcggctggggcgcgccaggggaggggagtggatgtcgcgaccgagccctagtgagggcccgtcctattagtgcctgtcattgtggggtgtaattcttcagggaaagcccgccgcgaggactgtctctgtcccggggcgtgatagagaacgggcatggatgcgacggtcgcgctgtgcccccttcatcccgagcggcccgcggaggggacgtgcagccgctgcggcaccttcttgtgtgaaggctgccgcaggtggcaggtggggcgcatgctctgccttcactgccacaccgtcgcgctgggagagaaaccctccaaacgcgccacgctggcgctcatcttcgccacggtggggttcatcgggttcgtgccgggcctcgtggggctcgtgctgggctaccaggagctggcggccatccggcgcggtgccgctcctggctcaggggagggatgggccgtgctcgctcgcaacgttggctggttccacatggccatgctggtcatcatcggcctcggcgtggccctgcgaggctgagccggccccggggcttcgccacggcgccgcctgaaatcgcccgtgactttgcaatgtcattcataggacagctagcttcgcccccctgacccggtttggggtcgacagagggggattcacgtggggtcgaaaaagctggcactggaggcgggtggcccgcctcgcttggagttgtcgtggggctgggggtggaagcagttcaccgtcaccctggatggaaaggtcgtgggaacgttgaacggtggggcggccgagctcaagcggggcgtgttcttcacgctccctgacgggagttccctgaacgtcctgctcctgagcggcgtctttcgcacgggcctggcggtgtcgcgcgacggggaggcacttccaggctcggacacggacccgtcgcagcaggtcaagcgcgcggcgaacatgctctacttcctggccggggtgaacaccttgctcggcgtcatcgggctgctggtggagagcgaggccctggaggccgcggggatggggctgggctccatcctcttcggcgtggtggtcgcggtgcttggcttctttacctaccggggcacccgggcggcgcccatcctcgccggcatcctgtacatcgccgatgcgctcaccacggtggtggataccgtcacggagggagggcgcgtgcccgtcgtcgccctcatcatccgcgcctatatcatcatcacactcttcaccgcggcgaaggctgcggcggagctgcgccgtcgcgaacaggaaggcgcgggcgtgtcgcttcagccctgactccaggaacgatgacgcccccgggccagagaaggccagggggcgtcatggacagcgcgaaagcaacgactcccggcctatcgctcagccgcctccgccgcgctccgctcttccttgcagaacgccagtcgctgcttgatgacgtcgagcggcaccgccatctccagcttgaaggacgtgccatccggctggacgcgggcgaagtcgagcaactgcgccaggtccttctcaccctccgcctgcgccttgatgcgcgccatgctcagcgcggcgcccagcgtcttgcccaggtccgtgacttcgtcgccattcgcgccgcggacctcggcgaccatcgccacatcgccgctcgcgtccacgtggagctccacgttctgggccacccggcggatgcggtccgccagctccgcctgctccttgggcaacagccgcgcgagctggtccacggacagcacgccatacatctccccgtaggtgctgccctcggagatggcggggggctcgtccggaccgcggccctccacccggtccaccaccgccttcacctcgtccggcgacttgccaatcaccagcaactcgttgttccacgtcgccaccgcggcctcgcttcggccacgcgccgtgctcccatccggccgcgtcaccgtcatgtcgcccggctcgtacacccgggcgccttcgccgtagtccatggacacgcgctcgcccagcagctccttgaacttcgcgttgccgaagttgcccgacagcatcatcccttcatcggtgatgaccaggcggtccaggtcctggagcgggtccacgccactgaggttccgcagctcctgcagccgctttccgccatcccgcatcaggcagtccagcagcagctcaccaatgggcgagtgccgcagtgcgttcgcctcgatgaccaccgccgtctttccctcgccgcggggcagggcggccagcagggggtccctgggacgcgcgcgctcctgcgtgcccgcgtccacctgcacgggcatgacgtgtgtccggcgccgctccgcgcgctcccgctcgggggcccgcatccgccgggggaattccaccttcggcgtctccatggcgggctcttcaccctgcccggtgaacatcaacaccgcggccaccacgaacagcatcgccgccacgacgagccacacccggcggcgtccacggttgtccatgtcagtaatcctttccctcgaagcgccagaaccccaccgccaaggctccgaatccaaacaccagcacaccgagcaacagcaagcccagcgagcgcacctccagcggcgtggacgcggcgatgtcgcccgcggccacggccagcgcggacagccgcggcaacaccagcgtcaccgcccggaaggcttcgcgtccaaatccctcctcgaagaagggcgtcatctgctgccggtagcccgcgatgattcctcccaccaggaagacgaagccggaggccgcgcacagcgctgcgctgcgcaccagcgtcgccgccgtcagcatcaccgcgtacaccgccgcgaatcccacgcacgccagcaatccggcgatgagcggccccgccgtccagtaccccgccttcacgccgaagatgagcaccagccccgtcgtcccatacagcgtcccacccagcgccagcaccatcacgcccaggaacgtccccgccagcaggtgccaacgctggatgggcagcgccagcaggtgctcgatgcgcccgggtgacatcagcgacggcgcgaagtccgagcacgcgacgatgccgaacaggatgccgccgtagaacaccaggaacgccgcggcctggtacacgggccgcagggccacgtcgacggagcggatgctcgagcgaatctcctcgccgaacagccgagacgccgcgagcgctccgtccaccacttcgatgcgcaagctcagcgccaccacggtcagcaccagggtgatgcccaccatgaacgccaggatgaacttgcgcgacatcgcctcacggagcacgtagcccgcgattcccaggacgggcttcacgccgcggcctccactgttcccatcagcaccgactccaggtccgttccgtcacgccgcagctccaccatcaacgcccccgccgcgcgcgcccggtccaatgcccggttgagcgccgccgggtcctccgcctcgacgacgtattgtccctccgcgacgcctcggacgaagcctgccgtcaccagggcctccgcgttggcgcccggggcgaagcgcaccagccaccggacgccgccgcgcgccaggtcctccagccggccctcgcgcaccacgcggcctcccgcgaggatggcgacgcggtcacagacacgctcggtctccgccagcaggtgggagttgaggaacagcgtcgtgcctcgctgcacctcgtcttggaggatgcgccgcacttacatccgtcctatggggtcgattccgtccgtgggctcatacagcaccaacaaggaaggtgtacccaccactgccgctgccaatgacagccgctaacgcatgcccttggagtacccgccactgcgccggcccaccgcgtccgacaggcccacgcgctccaggaggcgcaggttcaccgcggggtccacggggaggcccttcagccgcgtcaccgtcgccaggaaggcgggcgccgtccaggtgccgggcaggtgcaggcgctcgggcaggtagccgatgcgggcgcggatgcgcgggtcctcgggcgagccccccagtacccggatggacccctccgtgggctggacgatgccgaggatgctcttgatgaaggtcgtcttgcccgcaccgttggggccgatgaggccgaaggcgcttccttccggcaccgtcaggtccatgcctcggagggcctcggtgccgcccttccggaaggcccggtggtacgtcttcctcaatcccctcacttcgatggcgggttcctggtttgtcacggtcgggactgtagacgactggacggtccatccattgcgtcaggttgccgggcggtcgtcgggacgggcggaacggtctcctggccgcgcgctgcggcgctccgttcgcgcccgtgggaaagccgcttcgcacgcctgcggtgcctgccgcgccgcggtagctcgttgttccggggacttggcggcttgcagattctttggagctccacggtccggcccatgcatcggccggcggcacactcaagccacgaggagcaccagacatgacgtacgaggaccgcatcgaacagcagctgctggatgcccgccgcgagctggagcaggccgacaaggacctggcgaccgggacggaggcggcacgcgtgcgctacgcccgcgccctgcacgaagcggacatcgccgagcgccgcgccctgcggcacgcacgggaggctcggaaccatcagaagagctggaggctcgtcgcaggctgagcaggcgggccgggggcgcaaaacgatgaaggtgcggcgccgccggtttataccggcgaccgccatggcctatcccatccaccgaccccgccgcctgcgccgcaacgccgtcctgcgtgacatggtgcgcgagacgcgcctcgacccgggcgacttcatctaccccctcttcgtcgtggaaggccgggacgtgcgccgtcccatcgtctccatgccggggatcttcaacctgtcgctggagcacgtcgtcgccgaggccaggcacgcccggaagctgggcgtgcccgccgtcctcctgttcggcatccccaaccacaaggacgcccgcggcacccaggcctacgccgacgacggcatcgtccagcgcgccattcaggagatcaaggcggccgagccggacctccaggtcatcgtcgacgtctgcctgtgcgagttcaccgaccacggccactgcggcgtgttggaaggcggccacgtcgtcaatgacgccacgctggcgctgctggcgaagatgtccgtgagctgcgccaaggcgggcgcggacatcatcgctccgtcggacatgatggatggccgcgtggccgccatccgcgccgccctggacgagacgggcttcggcgagctgcccatcatggcgtactcggccaagttcgcgtccggctactacgggccgttccgcgaggccgcccagaacacgcccacctccggtgaccgccggggctaccagatggaccccggcaacgtccgcgaggccctcaaggaagtggccctggacgtggaggagggcgcggacatgatcatggtcaagcccgcgctggcctacctggacgtcatccgcgccgtgcgcgagcgctgggagctgcccgtcgtctcctacaacgtgtccggcgagtactcgatgctcaaggccgccgggcagaacgggtggattgactacgagcgggtgatgctggagacgctcacgtccatgaagcgcgccggctccgacctcatcatcacctaccacgccctggaggcggcgaagctcctgtaggcaacagccgggcggacccgcggcgggttgagtcttgatccgccgcgcgcgttgcgtccaaatgtgcgtcgcacgatgccaaccaaaaagcggcctggacgaaagtcccagaagcccccgccccaacgccggtccaccgcgaagaagcggtccggcgccggtcgcgcggcccgtgtcacccccccaggacccttgcagtacaaagtggtcgagctgtccacggtggacgagggctccttggagcgcaccctcaacgagtgggcggccaagggctggaacctcgacggcatccagttcgcgatgcgcgagtcctccaagcgcccggccatggccttcgtcctcttcacgcgccagggcagccccgcccagcatgatgaagacgcggcgcgcgggcggctgatgcgaatgtcggagacgggcagccccaccgcggcgctcgcggccgagtacacgcgcgagcacgtcgagtgggccgcgcccatgatttctcctttgagcgcccacgaacggctcgcgcgtctggcggggctggatgagcccgagccgcgcgaggaaggactcacgctggagccggaggagtgagcaccccgcgaagccgcgtgttcatggcggcaagccggcaagggggtggccgcgccttgcggttggtgtccggagacgcgcaacccgattcgccctatcccaaggcctcgctctggctgcgcggcggcgcgcgggcggtggacgtgtcggtggcgtggggcctgtacgtcgtgggaggggcggcgggcgcggtggtggcgctgctgttcctgctgctggcggatgggatgctccagggccagagcgtgggcaagcgcatcttcggcgtgaaggtgatgcatctgcccacgcgctcggcggcgcggcaccgcgacagcaccctgcgcaacgcgccgctggcgctcatcgtgctgctgggaatgatgcccgcgccgcatgggacggtggccgcggccgcggggctcattgtcatcggcagcgtggaggcatggtgcgtgctgagggatccgctgggctggcggctgggcgacacctgggcgcagacgcaggtggtcgacgggaaggtcgtcgcgggcgtaaccgttgcagctcgcacgccggtcgcgcatgagcgcgcctccggcaggctcatgtccgcggcgaaggtgcgccgtggacgctcgtcgttcaggaagcgaagggggtacccatgcgcatcgcgctgacccacaacctcaggctgtctgatttggaagaagaggcggagttcgacacgcaggagacggtcaacgcgctcgcggcggccatcgagagcatcggcccccggctggagcgcttcgaggtgagcggcccggcctcgcgcaccgtggcgcggatggaggcctacagccgggacctcatcttcaacaccgccgagggccgccgcggccgcttccgcgaggccttctatccggccctcttcaacgacctgggcttcccgtacaagggctcggaagcgtacgcgcagccggtaacgctcgacaagcagctcaccaaggtggtgctgtccaagcagggcatccgcacgcccggctggcagtacgtggagaagctcagcgaactgtccgcggagaacctgcgcttccctgtcatcgtgaagcccaactgcgagggctcgtccaagggcatcagccaggactccatcgcggagacgctggacgaggttcgcgccaaggtggccgccgcgctggagaagtacccgtccggcgtgctggtggaggagtacatctccggccgcgacctcgccgtgccgttcctggagtcggtggacaatgactacgacggcgtgctctccccggtggagtacgtcatcgacccggccgtcacgcagggccgcaagtacgccatctacgactatgcgctgaagacgtcgcgggagggcacggtcagcgtgcgcgcccctgcgcagattccgcctcgcacggcggaggacgtccggcggatggcgcaaaaggtgtaccgggcgctcgactgccgcgacctgggccgcatcgacgtgcgcctcagtgacgccggcgtgccgtacttcctggagatcaacgcgctccccagcctggagccgggcgcgggcatctacgcggcggcggagctggacggcctgcacctggatggggtcatcaactccatcatcaccagcgcggcgaagcggtacaaaatcaaggactcgtcgcgtcgccagggcaagccagcgcgcaagagcggtccgctgcgcgtgggcttcagcttcaacgtgaagcgcgtgaagcccacggccacggcggaggcggtggaggacagcgaggccgagtacgactcgccgaacacgctccaggccatccgcgaggcgattgcgtcgtggggccacgaggtcatcgacctggaggccacggccgagcttccctcggtgctgtcgagcacgccgctggacgtggtgttcaacatcgcggagggcttcaagggccgcaaccgagagagccaggtcccggcgctgctggagctgctggacatcccgtacacgggctcggacccggccacgctgtccatcgccctggacaagggcctggcgaagaagattgtccggcaggctggcatcctcacgcccaacttccagctcatggcgacgggcaaggagcgcctcaacaaggagttcaccagcttcccgctcatcgtgaagccggtggcggagggcagctccaagggcgtcgtcaccaagagcgtctgccacagcgaggcggagctgcgcgaggtggtgcgcgagattgccggcaagtaccagcagcccgcgctcatcgaggagtacatccgcggccgtgagttcaccgtgggcctgctgggcgagcggcgtccccgcgtcctgccgcccatggagatcgtcttcctggaccgggaggagaagaaccccgtctacagcttccagcacaagctcgattggacggaccgcatccgctacgacgcgccggcgaaactggagcccgcgctgctggagcggctgcgcacggcggcgcgcaactcgttcatggcgctgggatgcc

SEQ ID NO: 1223 - DNA, 20740 bp, Myxococcus xanthus
  unsure (1)..(20740): unsure at all n locations
gaccagcaaccagacgctggccgagcaggtccacgtctcgccgcccacctgcctgcggcgcgtgcggcggttgcatgagctcggcctgatcgaaaagcaggtggccctgctgcagcccgaccggctcgcccaactgcaggggcacgggctcacggccattgtcgagatcacgctggatcagcagggcgcggagtttctgcaggcctttgaaacccgtgtggtcgccgatgcccaggtgcagcagtgctggcgcgtgtcgccggggccggacttcgtgctcgtggtgcacgcgcacgacatgcccgcctaccacgcgctcgcccagcgcttgttcacgcacgacgccaacgtgcgcaacgtgaaggcattcttcgccacgcaccgcgccaagttcgacacgcgcgtgcccttgctctgaggcgccgcgacatcccgctgccggcacgcttgaatcgcgtacgttgatctccatctagagacattggcactccacgcccccgcaccatcgcgatgcggtatcggcctacgagctgccccaaagcgtctcccttggagtgtttcccattgccgcacgcccgatgaccgggcggcggatcaggagctggtgcatggagttcaaggaccatgacaagatattgggcgtcgacaaagcgccacagcggacgagatcaagaaggcttatcgcaagctcgcccgcaaataccatcccgacgtgagcaaggaagccgacgcgtcggcacgcatggccgaggtgaacgaggccaacaccgtgctgtccgacccggaaaagcgcgcggcgtacgacgacctcggccaggaaagcgcccgctaccgcagcggtgccggtggcggtcaggacttccgtccgccacccaactgggatgccggattcgaattctccgaccacggcgacagccagggcatggacagtgccgccttcagcgacagagcgccgtggggcacagcgtcggcttcaactcgcccaccacgctgccgggcaaccccaactgcgggcacctggtcacggcgagcttcatccagaaccctcatgcgccgccggacacctcctgcctcgcggcgatgtcgccggtgcccttcgatgaccgcggcgcggcgcgcatctacttcggcgccgccttcaccagcgtctgggacaaccccgcggcgccctgaggacagcggacccgtcgttgctcaggcgggcccggcgacgcagtagatgtcgaagctgatggtcgaccccgcccgtgcaccgctgggccagccgatgatccaggcccattcgttgtagcccacgggcgtgatgtccagacggggcccatcaccgagcacgaccattccaatcttggcggcgaggttggggaggaacccaccgctcgtggcgaccgggtaggccgccgggcacgcgtagtggaagaactggtcgacctggccggtgggaatggtgagcgtgtaccttccctgccagcctttgccgccagggattgcgtggctcacgccaggcagggtcacacccagggccacggccccggtgagcacgaacgtgagaagagaacggctcctgcggcgcgcggccacttcacgggtgctgaatggcgacaggctcatgacgaccccaatgattgattgttttgctgctttagctggctagtcagctctcgggcaaggtgctcctccttgcattgtctgtcaagcgaatgggattggttttggattggagggaaacgcgtacgtgattgtgcttacggatgtctcactagcgcgtttccctgaggtggcaccgtcctgctcactgcatcatttgatgtagggccggatggtgaagacctggctgggagagtccgtgcagtttcccgccaggtcgcacgccctcacgaaccaagtgtgctcgacgtagtccaggagctcctccaggtagagtaccgagtccgaatcggagatcgcgtactcctggtcatcgatgcccacgtcgtccgtggcgggcgcccaggagaactcgggtcgaggggtggcgacataggtgcttcccgtgggggccaggggcgccggggcggtgggctgcgttccgacgacctcgaacgagcggaccggcgtcgacccgcagtggtcgaagcggtcacacgcggtgacaatcacgaagtggacgcccggtgacaggtcggcggtcaggacatgggaggtgacgctccctccaagggtgatggcggctccgccatcgatgcgcaattgctggtacgtgacgcccgtggcgtcttgcgcggcctgccaggagaacgtcggccgggtcgcggtgagcgcgctttccgcgggagcctgctatgcgcaatttcgggttggaatctccgcgctgcttctgagcgcgtgtggtggcccgcttgaaatggacggcatcgtcggatagttcatccccgcgaccagcgcccgctacatccgcctgcgcagcaagaccgacaacggcgggctgccgctgagtctgaccgagctctcgctgtggtgacgccgtccccaaggcgtcggtgcgctggctgagcgatggcgcatccctgtggtcgacggtcgagataccaagagtgcgcttgcagggcgagcgggcggacgagcggacgctgtcagggcgcaaggcagctcgagcgttgacatccacggccaagtctggtgaaggtttgaccccataggaatccgttttcgcgcgctcaggtgtgcgaaacgctcctgcgtcgatggcgccctcgctcgcgtccgacgttccttgccccggcctctgcgccgctcggcattccatccacccggagtccacggactccggtgcatggggcgcgtgcgcccacgtgcatgaacctgcgggacggtcgccggcgctcaggtgcgccgggcagctcccctgctcgaggtgtgtccagatggctcttcgtgtcgcgatcatcggagctggccccagcggcttggcccagttgcgtgcgtttgaatccgctgcccgcaagggagcggagatcccggaaatcgtctgcttcgagaagcaggaggattggggcgggctctggaactacacgtggaggaccggcctgggacgctacggcgagccggtgcacggcagcatgtaccggcacctgtggtcgaacggtccgaaggaggcgctcgagttcgccgactactccttcgacgagcacttcggccggccgatcccgtcctatccgccgcgcgaggtgctctacgactacatccgcgggcgggtggagaagtgcgatgtccgcaagtacatccagttcaacaccatcgttcgttggctctcctggtccgaggagacccggaagttcaccgtggtggtcgacgacctcgccaagcgcgaggtccgcgaggagtcgttcgaccgggtggtgaacgcaaccggccacttctccacgccgaacgtgcccttcttcgagggcatcgactccttccccggtcgcgtgctgcacgcgcacgacttccgcggcgccgaggagttcgcgggaaagaacctcctgctgatcgggagcagctactccgccgaggacatcggcgtgcagtgccacaagctgggcgcgaagtcggtgaccatcagctaccggtccgcccccatgggcttcaggtggcccatgggcatgaaggaggtaccactggtgaagcggttcgaggggaaccgcgcgcacttcgcggatgggacctccgcgacgctcgatgcggtcatcctgtgcacgggttaccagcacaagtaccgcttccttcccaatgcgctgcgcctggagagccacaaccggctctacccgccggggctctacaagggcgtgttctggcaaggccagccggagctcgcctacctggggatgcaggaccagtactacaccttcaacatgttcgacgcccaggcatggctggtgcgcgacgtgatcatggggcgcaccgcgctgccgtccgccgaggagcgcgaggcggacatcgcggcgtgggtcgagcgcgaggaggggatccaggattcgttcggggcggtggacttccaaaccgcctacatccgggacctgctcgaccgcaccgactacccgggcttcagcgtggagaaggtcgcggagctgctgaagcagtggctgcgcgacaagcaggaggacatcctcggctaccgcgaccgcaccttcacgtcgatcgtcaccggcacccgcgccacgccgcaccgtcgcaagtggatggacgagctggacgactcggcggagagcttcctcgccgaggccccggagcgcaggaccgggtgaggggccccggagggatgggccccggcgccggggccgcgcggccaagaagcgtcgctcgacgatgacctccttgggccttccgctgccggcatccctacaggcgacaaagggcgtttccgtgcaggcattggcgtagacggggcggcaggtccgcagcggtggacccggcggcgtggagggcctcgtcttcggcggagcgctcgaggccctccgctgcggagagaagcgcgaaggcgcaacggaacggggcctcatggttcccccactcccggagctctcgcgccacctcgccaactcctgcgcgtgcagtcaccgggtccggatggaggacggcgacgcgtccggccatcgtctcgtatcgcccggagacccgggaagtccccagcgcagacaatgtaacagtccgcgaggccttccgagcttcgaatcttgctggctggcatccccggcaaaaacgtttgaggcacgaatcactgcggagcgcttacagtattcgggtgaacaactctccggtattggtcaatatgattgcgggtccaatcaccctgattcccgcaggcacggctccagaaccgcaccgctacgcgtgcttgaaggagggtgcagtcaggctactgaacagcaatcttgatgtgattgccgcttacgacaccgatgccacgcttctcctcgccgcccgcggcctcgaacgtctcgtgttgtcagacgggaagaacctgctcatcgtaggtgaccacgcagttgtggttcctgatctcgtttgtgatgctgctgcatgtgtcgaggaactgatcatcgctacggcgcctggcgacagcacgcaccgtatcctgctgatcgatcccgcttcggggaagatcttggacgacgttcaggtggcggctgaagatgcgaccgcgttcatcacccgccatccatcatcaccgacgctcctcgtggagctgccgatggggcagtcaggaaccagcacctacaagatcgaactcgctggtggttcactgcgcgttgaagaaattctggctgggcaggatcctgtcatcgcgggcttcaatccatctggcaccaagctcctcgtaaccccctacccggacgatcctgaggttgctcgcgtctttgcgtggccttcgttagaagaaacaggtcgcctcactgcggacgaattggatgcagaaaacggcatcggtcttccgggttgctgggtcgacgaggagagcattgcgttgtacgcggtcgaagactccctcatcctcaccgatcaagaccttgggagccccgtgcgcgcggacttccccattgatctacgtgaaagtggagacatcgagtcactcaaaagcctggaacctggcagggtagctgtcggcgtgtgggagcctaagggtcgctcaatgttggtgcttgaggggtagacataccgcaacccagctcaagcggctcaggccgttcgcactgcggtaatcgcaccatgtcttcgagcgcctgtgtcgattcgcgattctgtctggacctgaacggtcctgatgcgcgaatggactcgcgtcccacggggaagcctggtgcacgcgatgccgttgagcggatggatgatggtggccgtggcgatggtgttcgcgccgatggctgcgcgagccgagtcacaggcgttgccccaggacgagggcgcggcgcaggtgtcggaagaggccccccgtgacgctcgagccatcgggcctgcagctcgaagacacgcgtcacgcggaccaagggttgctgagcgtgaacctgccccgtctcgtgctcgcgtccttgggggagcggttggtggcaccttcctgggcgcgaccgggatcctcgtcatcagcggcacgtgcggtgtcaacatgctctgctccttcctcgggggcctgggtggcctctttgctgccaccgcgggtttggtggccggctcgctgccggtgggccactggatggacggagccggcgcctggtggagcatgctggctggtgtggccgtcggcgtggccctcggcgtcgtcgcgagcgctttcatccgtagcgagtacgccggctggggagtgctggtgtccgcagtcggcgcgccgctgttcggtgggctggcgtacgagttgacgtcacacgacagcgccaagcggttcaacgccacgcgcccgcgcggcgaggtggtgggtcagcgcggttcacccgcgtccggtccggcgcgtcggcgtccctcagggcgcggcggccagcgcctgggccttggcccttcggccccgccaccagagcgccagggtgatgggagagacgagcaccagcatcatcagcgagccgaccactgcgcccgcagtgatcgctgcggcgaagcgaagcgcggcgccgaggcccgctcggtggggacccgctccgatcccgagctccgcgcgcaggtcctcgacgttgcgctcgagcagcgcctcgtagtcgcgcccgtaggtggactgctcgtcgagcccgcggacgaacgcgcgccaggtgcgcaccggggccgtcagcagccccccggtcatgcccgagaggttgagcacccaggccgcgtggaagtcgccgcagcccgcgccgatctcccacgcggagatctcgaactcgcccgtgaggtcggtgcgatagccggtgaggacgtggtgcagatcgtggaagcgcaccgcgcgcttgcgagcctcggtgttggggagcgggaaggggagggggccgagcttgaagtcgacccaatcggacgcgtacccgccgtcctctccgaagccgctctcgtcgaagtagcgtcgcagcgccgtggccatggtctccatcgcatggactccctcgcagcgggcgcagctgccccgcgggttcgcaaggagtctgacgcggagacctccgtgctgcacgtcgcgtccgaggagaggcatcaggcccggcgatgcgcgcggggaccggtgctcatgctccggcccgcgggtgtgcctgggcctcaggcgggacgccgtgtgtgcgaccgcgtgaacggcggcaccgagcgcgagttcccaactcggaacagcaaggccggccatggggacgtgccccacgaccggccttgctcctcggcgtgtcgacgcggtcctacagcaggggcacgcgcttgagcttgaagggcgaggggctctcgctcatcgtgaagtagctcgcgccgttggcctcgtactcgatcgcctcaccctggccctcggtggtgtcggtcagcgtgacgggcgtcgcgaagacggccgactcgaagccaagtcccggcgtcgcacggaactcgtagacagtgcggtaggtgcgaaggaggaagcgatccgcgcatgggtggatcgccgccgcggtcgcggccgagaagttggcgtctccgttcagcggcagctggatcgtgtggacgtggatcagcgtggcctgcacgcccggcgtcagcggctgggggaacttgtacacgccgctctgccccgtgcccccgttcttggtgacgacgtagatgtccccggtggtggggtgcaccatcagcgactccgcgtccttcgcgccgtccggatagacgaacgggaaggcctcggcgacgagcccccccgaggtctggccgttggcgagatccggctcgggcacgcggtagatcgtgaacgacgtggggctgccacccgcagggaagttggcgctccacttcccgatgtcaccgatgaagatgcacgagccgctcgggcagggcccggttgcgaggtcctcccagtcggccggcgtcacgttggtcacgttgaacgtgccgatcgtgctcgcgttgagcgtgtcgatcgcgacgatcgcggtggtgtcctcgttgtgcacgtagagcgcgttgccgaccacgcggctcgcggccaggcccgagggctccacgatttccggcgcggtcacggtgccctgaagcgtgaaggtgctcgcgtacgtgtcgccggccatgcaggtgggggcgttgccggcgcgcagnacgatcacgtgcgcggtgttggtctgcacgaacgcggagctgccggagaggcccgcctggagccccggcgcggtgagcgaccggtaggccgcattgaagagcagtccgttggtgtgacccaggcacgcgtcgaaggcctcggtgaagccgagcggcggctcgatgccggtggcagggcaggtggcgtccggccagacctgtgtgccgtaccagacggcgaggccacccgcgctgccggtcaccacgtcgggcacggtgaacgacgcggagtcgccgttcttctggcctgcgtgcacgtcgattggctggaccggatcgacgccgctgaaggcctccacgctccccgccatgtgggtggtcgcgtccagttcgaacgcgtagctcgcaggctcggaggcgcccgcgacgcggtagaagatccaggtgcggatggcccaggcgctctgctccgagcgcaggaacgtccagccggcgggcggcgtgacggtcgcggagatgttgttgcgcacggtcacccgcgcgatgagcgcgtcgttggcctcggtccccgacggcttggggatcgacagcgaagcgatcgacaggccgctgtggtgcgagctcccacgcaacgcgacccccgaggacggcgcgacctcggcgcggcgaagggcgacgacctgcgcgacgttggtctcggcgaacgtcgagctcccgttgaacggtccttggaggccggcaccggcgaggggcatgaaggcggcgttgaagacgaggccctgggacgaggacaccaggcaggtgtcgtaggtctcggcgaagcccacggggggctcgatcgccggggtcggacacgcggcgccggtccacgcctgcgcgccgaaccagacggcagccccgcccgcggtcgaggtgctcagctgcggcgtagtgaaggccgtcgagccgctgttgctcttgccggcgtgcgtgtcgatcgggttggccggatcgacgccggcatacgccacgaggttgccgacgaggtagctcgcgatggcgctctggaaagtgtggctcgcgggctcgctggcggtggcgacgcggacgaagacccagccgcggatgctccaggtgctcatgtcggtgcgcaccagcgtccaacctgcaggcggggtgatctcggcgccgatctggttccggttcgcaaggtgcgccagcagcacgttaccggcggcgacgcccgtaggggtcgagagggtcaggctggtgaccgtcttgccgctcgcgtgcgtggtgccgacgagggtgatctccccggtcgccggcggctggaggggacgcagcaccaccgcgtgcgtgatgttggtgttggggagcgtggagctgccggtgaaggcgggctgggcacctgcggccccgagctccgaggtggcggcgctgtgcagcacgccgcgcgacgacgagacgaggcaggtgtcgagctgctcggtgaagcccgtcggaggggtgtggaccgcggggcacgcggcgcctccccagacctgggccgagaaccacactgcgaggccgttcgcggacgacgtggtggcgacgggcagcgcgaggctcgcgctgttgccattcttctggcccacgtgcacgtcgatcggctggagcggatccgcgcccgacaccgcgaccagggtggccgccatggagctggcgaggtcgagggtgaaggtgtgactgctcggctcggccgcgctggccacgcggaggaagagccaggacttgatggccgaggcgctctgctcggagcgcagcagcgtccagccagcgggtggggtggcgacggcggcgacggcctcgcgattgctcagctgcatcaccagcacatctccggcggccgtaccgacgggggtggggatggagagggcggtgatggccagaccgctcgcgctggtggttcctcgcacggagagcgtggagatgccctgggccgtcgtcgcatcctgtacgtcgtcgggctgcgcgagctcaggcgttccacaggcggccatcagtagggcggccgcgatccacagacttcggaatgggggcatggggttttgatcgggtgtcgactcaccagactggaggtccgggaatcggccatgagaaggaccccgaagcgagaagcgcaatcgactgtcatgacacgggaaagctgccgtgaaacggctgggatcgtcgggtgggatcgaaagaaggtggcagtcctgtccatgcggtcacgcggagtacttggagaacgcgaagtccaaagacatctgcgcacggtgcaagggccgaagggcggtcggcaccccgaggggtgggcatccaggcaagcctcgtgaccgtggctgtgaccggctcgtgacgtcagcagaacggtgctgacatcctgtgatctggagcgtgcccgagggcttcttgtcagcgtccgagcacgcgccgagcacggcgcatagatggcgagtcatcgttcctcctcgcgcctcagtacttgacccagatttccgtgcccggatgaatctccgtcagggcgtcgtgtcgtgaggtgtggaggcaggcggcgggtgttggcgtacgtgaaggggggcccccggggtgcgggcgattgtggagcaccagggcttgcccacggcatgtgcgaggttggccccggcacgagggccaccccaggcctcgccgcgttcatggagcggcatggcctggagccgggacacacggccttccagctcggggcctacgcggcggcacggggggctggtggaggccctcacgcgcaccggcgcggacgtgacgcgggccagcctggtgcagcacctggaggcgctgcgcgacttcgacacgggcgtgtctccgcccgtcaccgtcggcatcaaccggcgcgtgggcgtgcagggcgcgcagttcgcggcgctggacgtggccacgggcgggctcgtcgcggcgtcggagtggattcccctgacgccgtgagccagcatgggggtgcaatcctcgaaggagcacccgttgctcctccccctccgaagaggtcgcccggaatgactttctttcgtgcccatgcaacgccccgtcgtctcgcgcggctgctgctctgtctggtgacggccgcgacaggcggatgtcgctccgagggcggagaggaaaagcgccccgagccatcccggacgccgacggaggcccccgcggcggagcagcccgccgacctccatggcctcggaggggtcgaaggcgtgcaggcctcgtatgaccagtcccgtcagcctgccaggttcatcgccgcgctgggaattacgccgggacagcggattgccgatgtcggagcgggcctgggctacttcacgcagcgactctcggaggccgtcggtccggcgggacaggtggtcgcgaccgacatcaacgacgaggccctcaagcggcttcgcgcacggatgtccgagcggaagaacgtcgtggtgcgcaaggtggaaccggacgagccaggcctcgaacccggcgcgtacgacctcatccttctctccgaggtggaccacttcctctcggaccgtgtggcctacctgaccaggctgcgtctcgccctcaccccgaatggccgtatcgcggtgacgcaccttcgggcgatgcgcccgccgctcgtcgccgccgcccagcaggcgggctactccatcgtgtccgagtacgacggccttccggaccactacctgctgttcctgcagcccgcgtccagtcgatgaccctgggggagcggcggcgcgagggcctcgcctcgcgcgggtgacgttccacgagggctcgtgcacacgcacgggcccttcgtcgtttcaggcgacggtccatcctcggacgtcgtggcgaagaaagaccttcgagggctccgcctcgacgacgcgggtggccatggccctcagccggagcttgtcccgcttgctcaggtccctccagggcaagaacaggtgcgagttccgcgagcgccagagcaccacgcccctccagccacccttcatcgcctggtcgtgaaggaaggaatcgagcttctgggtgagcgtcacgggcttcagctcggggctgagcaggaagtcaagcacggcaacctgtctggattcgacggccctcacgatggcgctcgcgacgaccaccgagcgcaggttcgggaaggcctgcttcgagaggatggcctggacctcgctcacggccccttcgtcgatggcgcggtagagcgtctgggtgtgccgcttctcgcgcgagaccgagaagcgccagagcaggaccagcgccgtgaacggcatgaccgccaggagccactccttcagcgtcgtcatgcgtctgtcatagcatcgggtcctggcttgcaggagtactggagctgactctcaccgctccgattccggacgtgctcgggcgaatccagatagccgatgcagtcacccgtgagcgagatgacgcgggttgcgccgcccgctgcctcgagcaggcggcccgctggaagcgtcacttcggctggcacgaacagcaagctcacggaccccaggctcagtcgagaggcctcggcctggcgagggcccaggtggcacagggcgttctcggtgacgccgtgcaggccgacgggcacgagtcggcttgcatcggggcgcgggagttcgagcaggactggccacttacggacgattgctctccccgttcgcggctgtgccatggaactgtcatggtcaacgccaatcatctgacgcgccacgttgccctccaagccgatgggctcttcactctcccggaacatggccatgccatcctctcgccgcgttatgagccatcattccggtgactcctcccacacccccatgcgaatcctcctcaccgctctggtcctgctgagcgctccagtcctcgcccagcccaagtccgtgcccactccgaaggcggcgccgaagtcggacggcttcatccgccagctcgtggagacgcgctacttcaacatcggccgtcccatgggcacgagcttcaccccggacgagcagacgctcttcttcctgcgcaatccggagggctcacgcgccctcgcgctccacgcgttcgacgtggccacgggacagacgcgcgagcacctcaccgcggagcgccttctgcagcgtgcccgggagaacctcgccgtcgagccgaaggcgcgccaggagcccgcgcgtgtgtcctcgcggggcctgagctcctatgccctgtccgaggacggcgagaagttgctcgtgggcttgtccggcaagcagtacatcgtcacgcgcgcgtccgggaaggtgacggagctgaagacgggccccggcgccatggacgtgcgcttctctcccgatgccacccaggtggcctatgtgcgggggcatgacgtgtatcgcctggacctggccacgaacatcgagcaccaggtgacgaagggcggcacggaggagaagagccacgggctggcggagttcatcgccacgagcgagatgatgcgcttctccggctactggtggagcccggacggaaaggccctggcctacacggagtccgacacgagcggcgtggagaagctcgccatcgcggacgcgctccacccggagaacgatgcgcggcggctcgccttcccgcgcgccggcaaggccaacgcccgggtgcgcctgggtatcatccccatcacaggcggcaagacgacgtgggtgcgctgggacgtggagaagtatccctacctcgccacggtgcgctggccggcgaagggccctctgacggtgctggtgcagaaccggctccagacggaggagctcctgctcgcggtggacccgaggacggggagcacgcgcacgctgctcgtggagagggacgacgcttggctcacgctgcaccagacgttcccccactggctggaggatggaagcggcttcctctggtacacagagcgcaacggcgctggcgaagtggagctgcgcgacgcctcgggcaagttcgtgcgctcgctcgtgccgcccggcgcgggcttctatgacatggcgggctacgttgagaaggacggcaccgtctacttcaccggcggcccaacctccgacgagcgctacgtgtggcgcctgagcccgggcgggaggcccacccgcgtcacctcggagagcccggcgctggagctggcccggatgtccaagcggggcggcttgctggccatcacgtccgagggcccccggcgcatgcgtcacaccactgtgatgaaggcggacggcactcgcgtgggcgagctgccctcggtggcaatggagccgccgttccagccgcgagtggaggtgcggtacgtgggcaaggagcgctaccccacgtcgctggtgcgtcctcgcgacgcgaagcccggcgtgaagctgcccgtcatcgtggacatctacgcggggcccggcatccccatggtgtaccagagcatgcagcagcacctcaccaaccagtggctcgcggacgagggcttcatcgtggtgaaactggacgggcgaggagtttcgcccaccgccgacgcgaagctgcgcaagccgaagtacgactggccccggctgctgctggacgagcaggtggccgcgctgcgcgcgctcgcggccgaggtgccggaaatggacctgagccgcgtgggcatcactggcgcgagcaacggcggctacatgtccgcgctggccgtgctcacccgcccggacgtcttcaaggccgcggtggccgtgtcctcagtgacggactggcgcgactacgactcacacctgacggagcgcttcttcggcctacccgacgagcacccccaggcctacgagcaggcctcgctccttactcacgtgaaggccgaccagcccatgggaaagctcctgttcatccatggcactgcggacgacaacgtcctcttcttccacgccctcaagctttcggacgcgctgtttcgggcgggccagccccacgagttcctgcccctcagcggcatgccgcacatggtgttcgacccggtgctggccgagcgcatgtgggaggagaccgcgcgctacttcaagcggcatctctaaaccgcctcggcaagtccgctaaacatggagcccggcatgctcgagcgtgtcgccgcagccaagcgctgaccgccttggaacggtgcgcctgaaggcggtcccagataatgacgagggggcgtccgaggcgccgacggaagtaccgcattgcggcgatgacttccttgtcatggacagcgccgacgaagtgacgagcgaacaccttggggcgttcacgcccccgcggggcagcgtcagcagcacgacgctggacacctcacggcgcctgctcagacgcttgaggactcggacttgccccaccggcgcccaggtggtgcccaggcgggcccgaaacgtgtgacccgtctcatccaagaaggcaatcgtcctcctgcttcttcgagcccctttttgatgcgaggccagtctcttcttccccaggcttcgatgagcgcatcatcccgctcgcgagcctggggacgagggcggtgcgcggagaaccccagccgatgcagtggcctcgacaaggagcgcgggtggtaccgcacgccccagcgttgctcgatgagacgtgcgatgcgtggaagggtccatcgctccgtgggaaagacggcccgaacggcgccggccttgaatgctcgggccacttgcttccactccgaggagctcagccgtgagggccggccctgatgcggcttgcgccgcagcctcctgacgcctccttgcgcgagggctttgcaccactgcgacaccgctcctcgggtgacgccgcactcgtccgctacgtccactgggcgccaacccgatttcagcagcgaagcggcgaacagtcgccgctcctccatctgcccgagcgtcagtctgaatggctgctgccccatcaccacccctttcatcggaacaaacgctccggtgtttaggggattcatcgaggcggtttaggcgctcgtaggtccgctaggccccgagtgtcttgcgcatgttgcggtgggggacgcccacctcggtgtagggggcgccgaagacggcgtaacccagtcgctcatagaacgggaccgccggttcgcgcgcgtgcaggtggacatgggtgaagccgcgccgcaccagctccgcttccagcgtacgcaccagccgggcgcccagcccctgcccctggaggtgggaggccacggccatctggaacagccgtccgccgtgggcatcctcggggttgaagaggacgcagccgagcaccccctcctcctggtgcgccaccaggtgcaggctgtccgcctcgaagggaaaggcgacgtcgtcacgggtgtagccgagcggctcgcgcagcacgcggaagcgcagctccatctcgcccgcgtagagcggatgcccggggtggatgaaggtgaaggtggcgccggccgtcacgtcagaaagtccccgtgagctgaagcgtgaaggtgcggccgtactggggcacgggggcgatggagttctcgtccgacaccggcagcgagtagcgggcgtccagcaggttgtgcacgccggcgaagtagcgcagggggccgtagtcacccgacaggccgaagcccaccagcagcgcctcgccgctgtccgcgccgcccgggccggtgggccgggcgctctggtagatggcctgggtggccacgcgcatgtcgccggcgccaatgggcagcatcatccggcccgccaccaggtgcgcgggcgccgcgttggccacttcctccgaggcgttgcgcagcgtcacgtaggagtagctcacgtccaccatcagccagcggcccggctgccagtgcacgccggcctcggcgccccaggcgagtgtcgtgccgtcggtgttcatgaagcgcagacaggcggcggtgccgcagtcgcctgaagccgcgtcctccgcagtgagctgcaccaggctggagatgcggttgtggtagcccgcgacggtgaggcgcagctcgtccgtcaggtcgtgcgagtgctccagctcgaaggtggtgatggtctccggccgcaggttcagcgccgcgccctgggagatgccgtccgcgtagtagagctcgtagacgttgggcgcgcggaaggcgttacccgccaccagcttggtgaggccccgctcgtagggccgggcgatgacggccaggcgcggggtgatgggcgtgctgtccaggtccacgtacttgtccagacgcaggccggctgacacgctcagccgtgggtggatcttccactcgtcgagcaggtacgcggacaccagcgtgcgcgcctgtgtctccaagggcaaatcaccggcgtcctgccggacgcgaagctgcgcctgaccttccacgccgagcgtgaagacgttgccctcgaacaggccgatgcgcgcgcgtgcctcggcggtgagccagtccgccgcgccgccctcggtccgggcgccgccgtcctcctccgggtagacgtaggtgccctcgtagcggctgatgtcgaacgcgccgcgcacggacaggctgaagcgctcggtgaactggcgctcgtagcgggcctcggcgaaggcgcgcatgtcctccacgatgttgccctccgtgccgggcacggtgccgtagggcgcggtgggcaactccttggtgcgcacgttgaactgggcctggaaggacaggtcgcccacgcgggcccggagggagccaccggcggcgcgctccgcgtccagcccggtgatgatgggaccgctggagcccagccgggtggtgtccgcgcccgtggacgtcaaggcggcggcgctcaccagcaccgaccggttgccgtcctcccacgacgcggcggcgtgtccccgggtggtgccgagcgcgcccaccgcgcccgtgacttccaggtgcttgtccgaacccagcgattcacgggggaccacgttgatgacggcgaagaaggcgcccgtgccgtacagggcgctgccagggccgcgcaccacctcgatgcgctccacttcctggatgtccacgctgaggtcgcgggcggcgaagccctggccggcccagacgtcgttcatggagtggccatcccagaggatgaggatgcgcgtgttgaggtcgcccggcggggagaagccgcgcacgcccatgtacgtataggtccggtcgtcggtgagatagaagccgcgcacaccggccacggcctcggcgacggtgcgccagccgaaggcgcgcagctcctcctgtgtgagcacggtggtggaggcgggcgcttcgtcgacggcgaccaggctcttcgatgcggcgcgcaccggaggcggcgcgtagcgcagctcggcgtggaccttcacttcttcatcggccaccaccttcaccgtctggcggagcggccgcacctcgcggctctccacctccagcgtgtgctcgccttcggggagggtgacgacggtgggggtgaagccggcgggcttgccatccacgcgcaccgtggcgccgtcgcggttggcggtgacgacgagccgcccggtgggccggtcctggggacgcagcgccacggcgacaggcacgttgccgtcggcggggacatccaccacgtattggctgggcgcgtagccgggggcgcgcacgtgcagcacgcgctggccgggaggcagtcgcacgcggccgggcacgcgggccaggatgttgccgttgggggcgtcgcgaatctcggcgccctccggcgtgcccgtcacctccacgccgccggtgatgagcgtgaggtcgaaggtctggtccgtctcacggccgcgcaccagggtgagcgtggcctccgcagcgcggtagccttccttcttcaccatgattttgtgacggccgggcgtcagcgcgagcgtctgtggagagcggccccgactgcccaggtccatgcggtccacgtagacgtcagcgcccttggggttggaggtgacgcgcaccagcgcgaccttgggacggagccggtccacggagcgggagacctcggcggcgtcctccttgggcaagtcctcggcgagcaggtcgttgtagtagcggtacgcctcgttgaacttgcccagcgcctcgaagcagcgggcgatgttgaagaggacgttccggttgggcaccaggcggtagctggtgaagtaggagcgcaacgcctcggcgtactgccccttggaataggcatcgttgccgagctcgaacgcgatgtccgcttcatccgcgttgttgtccgcgagcacgggcgcggacaggaggaacaccgagaggacgaacgcgaaagaacgggaggaacgcatgggacgccaagcattcttccctctctggggtgagaggtccatgggggcttatgggttggtagctgggtgtcggacctgatgggtaacgtcgagcctggacatgcaacgaggagtggggttccactccggggatgcgggggccatgattcaggagctgtcggccatcacggtgagagaggaacgggacacgggaatgggccacgagacgaagcgcccggcgacctacgaggacctggtggcgctgccggaacaccaggtggggcagattatcgacggggagctcatcgctcagccgaggccgacgagtcgacatgcgcgggccaccacccggctgggtggtgagctgtacggccctttcgaacggggacgcggcgggcctggaggttggtatttcctggatgagccggagctgcacttcggcgcggatgtcctggtgccagacctggcgggctggcgccgcgaccggatgccggaagtcccggatacgccttacttcacgctggtgccagactgggtctgcgaggtgctgacgccctccaccgccgcgttggaccgcgcgcgcaagctgccgctctacgcgcgcgcgggcgtgtcgcacgtgtggctggtggaccccgccgcgcgcacgctggaggtgtaccagcgcgtcaagcggggctggctgctgacggggagctacgaggatgacgcgctggtgcgggccgaccccttcccgtcctcgacactggagctgggctcgctgtggctgcccgagggcgccgagaagccctctctgctggtggctgttccgtgatgcgcgttggcgcccgcgctgaactcacgggcgatgtcgcaggcatcgtccgtcatcgcgtcacgcggcggctaccaccaccggcttgaggacgtagcggccgtacgtcacgaaggcgagcagcacacccatcacgagcgaccagagcatcgggttctcgggcagtcagcttcgtcgaatgacgcgcgtacagcacggcgagcgcgaacgtctcgaacgtgagcaccgcggccgcgtgcgcggtgaggctgggcatccacttgaacgccgccgggatgatgagcagcacgccaccggccatctcaaggaagccgagtgcccgccatgctccgagggggacctcgctgaactggctcgcgagctgctggaaagagaatgccttgtacgacccgcctgcgagaaacagcagtgcgaggacggcctgaagaatccagaagacgatgttcatgggtgggggctcggtgttcaggccttgagggccgggtgtcg

SEQ ID NO: 1224 - DNA, 25497 bp, Myxococcus xanthus
ttcgccgtgggattcacctcgaggaacagcgcggccagtcccgtcacgtgaggggtggccatggacgtgccgctcatctcccggctctcgcggtcgccgtagtgccaggaggacttgatcttgttccccggcgcgaagacgtccacgcagtccccccagttggagaaggtggcgcgcttgtccttgttgtcggtggcggcaacggtgatggcctctggcgcacgggcgggggagtgcttgcaggcgtcgttgtcttcgttgcccgcggcgacgacgtaggtgacccccgcggcgatggagcggcggaccgcgtcgtcgagcgccgggtcctcgtcgctgcccagactcatgttcgcgacggcgggcgagatgtgattccgggtcacccagtcgatgccctcgatgacgccagaggtggctccggagccgtcacagcccagcacgcggacggaatggacaatcgcgttgcgggcgaggccgtaggaggcgcccgccgccgtgcccgcgacgtgtgtcccgtggccgttgcagtcattgccccgcatgctgtcgccaatggcgtcgtagccgatggaggcccggccaccgaactcccggtgcgagaagcgcacaccggtgtccaggatgtagatgtgcacgccctggcccgtcgcggtgaaggtgtagaccttgtccagcgggagcttgcgctggtccatccggtcgatgccccacgtgggaccctgctggctttcggcgattttgaccacgccattctcttgcacgtagtccactgcggggtcgttcgccatggcccgcgcctgggcttccgtcatcttggccgcgaaaccacgcaacgcattctcatacatcgcgaatgcggtgccaccgtaagccgtgatgaggctcgtcgtggcttgctggacctcgacctgttccaggctttgtgcgggcgacttcaggacgacaatgtattcacccggaatcttctttcggacagtgatgaacttgccggtctgcttctggcccatcgtgggcctgctggccgtgcggtccttgcagggcacctgccgcgatgcgcacgcccccatcagcaacatcatgcccacggagacgaacagcttcagtgtgtgtcgattcatgttttacccagaggaaaatggttgtgatgggtaaaacgggtgtacatcaaaaacggcttattcatgaatcaacccggagggatgagacggcggtccgtgattgaacatgccatggcgcttcaaggcgcgatgtctggccatgacctaccaaggacgaatggtggttccccattcgtacaagactgcttccagtggacgtttcccggggcgtgacaggatgtcgttgatgcccatctctcgtgctgcgttcaccaggtgggcatgccacgtgccatgcgcgtcggagagtcgcgtcgcggcgatggccagcgcgctcgcgcccacggagtagccgccaaagacgagcggaccgctggcggagtcctccttcccgttcactccgcgaggccactcccggcaggccgccaaaggtaggagcgagcccgcgggccgagcgcagtaatcccgcaccagggtggcggtgaaggttcccgcagcggggtgcgcggccatggcgaggaaggcgcccgtccacgcgagcgtggtggcccgttgcgtacgctccacgacgcgtcccttcgcgtcgacccgggtgggaaagccggagggcagggcggacagttccaccagtctcgcgatgagccgctctgccgcggcctcggagggcgcatggcctcgcagccggccatggagcagcagcgccgcggcggccggcgcactgtcacacggccagatggaggtactgaagctgggcagcagcaactggtgttcgagcgccttcacgacctggctggccagggcatcgaagagcgccgtggacgcagcgtcctgcatgcccgcgcgttcgatgcccgcgagcatcagcagcacatagccccggtagaggatgctccgtggcagggcgtggcccaggacgacgtccgtcccaccgcgcatgaagggggcccgggcccgtcccagcgcgtccgcgaggagcgcatgcagtcgtcgctgcgtgtccggcaggggatggccgtccagcgccgcctgaacgaggatgaaggacaggtggccatcgcagaggagctgtgactcgacgaagcggcgcttcgcatcgccgagcaacatcgtctcgcaccccttgccgaggatgcgctgttccagtgcgtccagcgcggatgcggagagctgtccgtatccctgggatgaggaatgaggacggggcggcgcatggtcgctccctaccgggctctccgttcttgcgctgccggccaggcatgcacagagcgccaggaggggaaggcccgtccggcggaagcgggcgtgggtgggtcgtggcatgagcggagagctgagcacgcacgcggatggccaaggtcatccggtgggctcgccggtcgccaggacaggctcagcggcttcttctcgcgcgtggagggtcgcgggttccaaaggggaacggccagttcaccagtccacgctgaagggacgccatgggttgcccttgaggtcagagccttcagattggcagtggaggttgcgtgtgcatggcgcttcagcccgaagtgagcaggtgggacgtcacgccttcggaggcggtggagctgcagcgccggctgcgtgagcagttggtgctccggccgccccctgggctgaaggtggagcgcatcgcgggcgcggacatctccacggagaaggggaaggacaccggctttggtgggttcgtcgtcctggacgtggagacgttggcgccggtggcccagtctgaggccgtggtgacgttgcactttccctacgtgccgggcctgctgtccttccgcgagctgcccaccatcgccgctgcctgggaacggctcacggtgcgccccgatgtggtcatcttcgatggacaaggcaccgcccatccccggcgcatggggattgcgtgtcacggagggttgctgttcggcgtgccatccatcggctgtgccaagtccctgctggtggggacgcacggaccgctgggcgaggcgagaggctccaccgcgcccctcatgcaccggggcgaggtcgtgggcatggcggtgcgcacgcgcaagggcgtgcagcccgtctacgtgtccccgggccacctgatggacctgcccacggcggtggagtgggtgctcaaggtgagcccgaagtaccgcgagccggagaccacgcggcatgcgcaccggctggtcaacgcactccgtcgcgcggacggagaggccgccgaactggagtaggtgccggcccctgattttgaccgccgtcccaaccgactctatgtccggaggtggctccatcgcgtggggcctcaaggaacggcggctcgggcgtctgtctccctggccgcccttcccgccagcccgtactggcggtagcacctcaggccgcgaaacagggctggggccagggcgggagatgtcattgggagcgccaatgcggaggttgtcgtcaccttggagtgagctggcgtcgcattacgccgtggtggtggtgggctcggggtacggaggggccatcaccgccagccgattggctcgcgcgggccagcaggtctgtgtcctggagcgaggccgggagctcctgcccggtgactacccgcgcacggacgccgagttcatgtccgagttccaggttcacttcgaccccgaagccgccgccgatgtgggcagtccgacggccttgttcgagctccaccggggcggggatgtctccgtcgtcacgggctgcggcctgggcgggacgtcgctcatcaatgccaacgtggccatgcggccggaccctcgcgtgttcctggatgggcgttggccggacgcgttccgcgccgacgtggacggcttgctggaggacggcttcgcttgggccgagcacatgctgcggccattgccctatccggaatccgcgccgccgctggccacgctgtcggcgctggcgaaatcggcggagaagctgggcggcacctttcgccggcctcccctggccgtcaccttcgaggagggcgtcaacgccgcgggggtgcgtcagggcgcttgcacgttgtgcggtgactgcatgacgggctgcaacttcggcgcgaagaactccgtgctgatgaactacctgccggacgcgcaccgccatggggcgaagctcttcaccgaggtgggcgtgcgctacctggcgcgcgatggtgcccggtggcgcgtgtactaccggccgatgaacgccggccgcgagcggttcgatgcgccagacctgtggttgaccgccgaccgcgtcatcctcgcggcggggaccatgggcaccgcggagctcctgcttcgctcgaaggcgctggggttgtccctctccgggcgtctgggccagcgtttcagcaacaacggggacgtgatggcgttcggttacaacacggacgtcccggtctatggcgtgggtctgggcgaggcgccctccgcggggcgcgagcccgtgggtcccaccatcaccggtatcatcgatgaccgggccacgctgcggcaggaagacggcatgatcatcgagaacggcgcgattcccgccgcgctcgcgcgtcccgtgacggcgctgctcgccgcggcgtcggccatcgccgggcaggacacggaccggggcgtcatcgaccgggttggggaactggcgcgcatcgcggacagtgccgtgcgcggcccgtaccacggggccatgcgcaacacgcagacgttcctcgtgatgtcccatgatgacggcgcgggtgaactgcgcctgtcgggtgaccgggtccgcgttcactggccaggcgcggggcggcaggccgtcttcacgcgggtggatgaacgcctgcgtcgcgccacggaggcgctgggcgggaccttcgtgcgcaatccgctctggaacaagctcaccggccacgaactgctgtgcacccatcccttgggcgggtgcgccatgggcgagcgcgcggaggagggcgtggtggaccacgagggccgcgtcttcgcggggcccgagggcacggaggtccacgagggcctctacgtcagcgacggctccgtgattcccaggccgctgggcatcaacccgctgctcaccatctccgcggtggcggagcgcaccgtggcgctgatggcccggcggcacggttggagcgtggactactcgccggttccggaggccccggggccgcggcccacgcagcccctggccgtgcagttcaccgagaccatgtacggctacatactccgcgggggccgacgaggacttcctgcgagccggggaccccgcgcgcagggatacgtcgccgttccgcttcatcgtcacagtggactcccgggacctggaggagacgctcgcgcatccgctgcaccccatgcaactgtcgggctgcgtggtggcgcccgtgctgtcctcccgtccgatgacggtggagcggggcgtgctgcacctgatgacccacgagggcgctcgtcctggcggacggcggatgcgctaccagctcccgctggtctccgagtccggcgagcgcttcttcgtcgacggctacaaggacgtccatgacgacgacggtccggacttgtgggtggacaccacgcggctcctggtgtccatcttccgcggcgaggacgcttcggggcgctgcatcttcaggggctacctgcggctgaacgccaaggacttcgccgtgcagctctccaccctacgggtgctccatgcccagggtacggtgcagcggctggccgcgctcgcccgcttcggacgtttcttcttcggggaactcttcgagacgtacgtgcgcagcaaggccgcgtagcgggcggggaggcggcggcacggctttcgtaccgctacgtcgtgctccttctggatggcgtgggcaccgtgaggcgcacacgccatttcatgaaggaaggacagcccatgcccaatgaccgtgagcagggaaagggcgctccgcagggcagcgagcgtcaggccagccgccgggatacgcccatcgaggtccgcaggcggctgcggcacgagtcacgcacgagccagacgtacgcggccttcatcaagcacctgtgcgagcgaggcggcatgtcacccgccgtggccgagaaggccgcggtgtccgtcctctgcgctttggaacagcgaatcctcagtgaggaggcaagcgacctggaggaccagcttcctcgcaagctgaccctgctgctgcaccgctgtgagaagcacgaggaagagctgcctcccaagttccaccgcgagcaccttctgcgtcgggtcggcgaggacctgagccttcatccagacgcggtggagccggtggttcgcgcggtgatggatgccgtccgccaccagataaccgaaggggagtccgaggacgtcatgggccagctcccgccggacatccgcgacctctggacgcgcaccgtctgaagactcaagcgaggccgctgggggtatggcggatgccagaggcgctgcgaagcgcctccgcccaccagggctcggccgccaccaggacgtctcggcctcgcagccgcgccaccatgccctcgggcgccacgacggagaagcgcaggggcttcccgagcgcggaggtgagcgcggccgtggtgctttcatcctcggcggagaagccgagtggaccgtcggggtgactgtgcgccacctcttcaaggacgtcacgcagccgccagatggcttcccagcgggcgcgtgagtcgggcagttgattcgggctgtcggacgcgtcgcaccacagcacttcgccgccgtggccgatgagcaggcagacctctcgtgtggacatggccgtctcctcaggcatgccgggtcaccaccaggacatccgtttcaatggcctcgcgaatgacggacggcaggctctccagcgtgacatctccgtccgcaccggccaggcagatgcccgcgtccaggacctggagcgagtccgccgcgacgatggagacgaagcgctcccccatgaaggcatacgtcacctccaatcgctggcccgcgagccgccgcaggtccagcggacgagcgcccgcgttcaccagcgcctgctgtgcgcgctgcatgccatcctccctcggattcccgcggacgccccgcgtcgccagacgggccatgcgtcgctgggcttcctcaatcaactccgcggaccgggcccgccgctcggcgtcctctcgctcctgtctcgtccgtgccgcctgggcctcacgttcatggttcagacgccgcaggcagtcctccgccggaacgcggccgccctcagccaccgcgagtatccggcctcggacctcggcgggtgcgaagcggatgcccacgtcgcgcgagacacgctccagcagggcgtagccaaacgcggcccgcaggggggcactcacgccccgaatgtgggcgaggggttggttctgctccagcgcgaggcgtgccgcgccctcggcttcgctttcgaaatccacgccttcgaagagcagggcgccgtcaaaccatcggcgcgcgctcaccggagccaagcgcggcggctcctcctccggcatcagttccaggggctccgccacggcgccatctcgcaccagccggcgtccccaggcatggccccgcacgcgcggcagcgcctccaggcactcgggctcggagggttcacgcggcgtggcgtctcgtcccttcacatcgaagcgccaccaccccggggtgaccggggtggtgacacggaggcgtcgcgaggctgaatccacggtgccaccgcccagatacggcagcaccaccgactccaccttcccgaggaacttccggtagtccacgacgcctcctccttcctcactgcgttggcgtcacgccaccttcagcagcggcgtgcgcatcacccgctccacccagccggactgggcggttccaggcagcgtgggcgcatccatcagcgccttgagcacccgggtgacctggtacgggtcctcgaactggtccacgttcacctcgctgaagggcactcgcaactgcgcggcgcagcttcgaaccgtcgagccccgcgcatgtgccaccgacaccagcagggccatcgccgacaccgggatgcggaggtcacggaatgcccgggcgaactggtcgcctgcctctccggcctcgtctcccaccacgatgaccaccagcttcgcgtcctccggcacgcgaacgccgtcacgatgcaacgcgtacagcgcggacgcgtgcgccgttcctcccgacgcccgcagccccgccagcatgtgctggacggcgatgcggttggcggccttgggacgcagcaccgttcccagggtgtcgaacgcggcgatgtgcagcttgtccatcgggaagcccgcgaggatgcgcgacagcgcctccttcgaactctcgatggccccctccatggagcccgacttgtcgatgaggaacatcacccgcacgtcggtctccgccgtcgcctccgccacggcctgccgtgccgcgttgtcgctggcctcctccaacttgcgccgcagcaccgcgctgcggacgttcttcgcgatgttcagcgcccgctggtccgtggccgtgtgcaccgccttctcccaacgcgcgcggatggccgggtccgtcagcaggcccagttcctcgagcgtgggcgtcatcagccgcaggtcacggtccgacagcgagggcagcagcgccgccatgatggccggcgtgagacccacgtccttcggcagccggcccacgacctccttgtaggagaggcgctccaggtcgatccactcgcagatttccgcctcagacaggccgtcgaagcgctcgcgcttgaccagcgtcagcccattcaggcccacctcgcggtggccctgcgcggactgcttctgcttccagccgagcacctcgaagaagccctgcgcgcgcggcttgtagcctgccttgcgcgccagcttcttcagcgtctccttgtagcccgccttcaccaggccctggagcatgggcatgttggcctcacgcgccgccagccacttcgacgccacgcgcttccagcggcccagcggcgcctttcgggacgccgggtcaccaaagcccgcctcgcggttgagtcgagcgatctccggatgctccagcagctccgccacgcgcagcaccgccttgggcgtgagcatgcgcgtcgacttgcgctcgtagtggagcaccatcgcctcgccaatggctcgccagtcgtcgtcgtggaaggccacgccgccctgttcgtcgcgcacgggctggcccgcgtgctcctgcaccagcatgagcgcgcacgtcgcgaccttgaggtcgcgccagtccgtctgggtcagcgcgtatgacgcgaagtgcgccatcagctccgcgttgagccggtagatgtccaggagctgccggtagagcttcaccgcggcgggcacgaagaggcccggcttcaccggacgccccttgtcacgctggaacggcgtggcgtgcgccgccgcgtaccaggtgccattcacatccaggccaggccggttgtgccacaggtgggcggagcctccgagcaccaggtccagcaggcgctcggcgggaccgcgctgcgactcgggcagcagcgcgttcgggttctgcgtctgggtcgtcatggtgtccccctagggacgtgccgcgggtcaggcgcggggcggaccactcgcgacgaagcgagcggagtgcaccgcgcgtggacgcacgagtgcctttcgcttcagcgaaggcggcccgtgcgaagtgaggatggagaggaaagggtgcgcccgagtgacgaggccgttcttggattaacggtcccagtgctctaccgctgagctacggagccacgaacggctccggcgggattcgaacccgcgacagctgtatggcgtgttggaccccgtcggccgggcgcgaaattgattacgagaagacggacacgtcgccgtggaccggaatccgggccacgtccttgccgccccggtacgtactccgggccggcaccgagacgagctcccaggtggggagcaccaccgccgtcagcgaccgtccatagacgcacccggtgtcgatacccaccgcgtgctcggtgacgagcggcgcgtcgaagacggtgtgaccgaagatgacccggtccgggcccttccagtggtgcgtccagaaggtccagccatgaggtgccttggacggccagtagctcttggacgccggaggccggatgcactgggcatggagcaggtggtacgggtcctgtttctcgacagggatgtccggcagcatgccggcgtgcaccacgatggcgttgtgctccggcagccgcaggtagcgtggcagccgggccatccagtcgtagtgcccgggttggagcacccggcgagtctcgaggtggtcgggatgcaaccgctcgtccgcccggtggcgctgctggaggtgcttctcctcgtggttgccgaggatggcctcgtgccgcatggccaactccacgcactcgcggcgcttcgggccccggtccaccaggtcacccgcgaagatgatccggtcgctggaggtcgcgcccaccttgccgagcagctccacggcttcgtcgtagcagccgtgaaggtctccgatgacgatggtgcggcgggacatgacgcgaatcctcaagaagcgaaaaatgagcgcccgagtgaagaagccagttggctgattccaggatcagtgacggaccacccgtcggcatacgcccatggggcatatgtgtggagtcgaaccacggcttgtagggccgcttcggccgggcgctcgaaagcgatgggggcgaagacgcgggcccccgctgttcctgacaggtgattttccggggcccagcttccgccgcctgctctataaatcccgtcaggaacgccgcgcggctttcgtccgacttcgcgggtgccaattgtccggtgattccgccgggttggcgccccctgcttgtctcggaggctgcctgcggatgccaacgtggtaccttgccgcgccacatccccgtaacccaacatcccggggcgacttccccggcgcagcccccaggtccttccggtgtacgagcagctcacggatgacgaattgttcgcggaggtggtccgccgccgcgccactggcgagcctgttggcggcccgctcggggcgttggtgcagcggtgggcccgaccctcgcggtacgtcatcagcaagattcaggcgagctacggccgtggttccccagcggacgcggacgagctcttccaggacgcggtcgggaagttcatcgaccggggtctggaccagttccgcggcgtgtcggagcagatgcccggccggagcgcgtctcccaagacgttcttcctgcgcatcgtcaagcacgtggccatcgacttctaccggaagcaccgcgaggaactcgcggcgcctccgtcggaccccgatgacgccatggaagagccaccctccgaggtggctcgcgccgtcgagttcgggaagcggcgtgaagagcgcgccgaagcccaggagctgtattgggcggcatttgcccgcctccagcaggagcacccgaaggaagcttcggcttgggacctgtaccaccacgaagacgtcgaggatcacgaagaatgtgcccggcgcctgagcatcaccgtggtgaacagctacaagcgcgtcagccgggcccaggcctacctcaagctctacctgctggaccttcatcgcgagtcgcatggggaggaagcgtgagccgcctccttccccgccacacccggggtacccaggaggaatgaacccatgattgttggagatacgctgtcccgctattccgcccgccgctcgcagctcctgtcgggcacggcttctcccggtgaagtgctcgaggcggcgggtgacctgctgcgccgccgctcccggttggagaccgaaggtgtggacgccgccctgcggggcctgggtcgatctcaggtggaagcctggttgaaagcgcagaagccccagtcgctgcagccggtgctgctgagggcggcggaagaagctgtcgaggtggcgctcgacggcggtgaagaggcggacatgtggcgggtctccgcgctggagggactttccgctcgcgaccgggccgcctccgccgcacacgccctggccgtctgggagggctttcacggtgccctcgacggcgagtccgcgcagcttcgagaccgctttctcgccgcgctccagagtctggactcagcactccgtccccgagcgcgttggttcatcccactcaatccgcagcgccggcaggagcgcgacctcatcgagcccgccgagcaggacgccgcctggtggttctccgcgcgcgccggctgcgatgacctggtcgccacctggacggccaatccccagacgctgacggcccatcttcaggactgcgacgcgtgccgcgcggacatggcggacgccgcgcccgtggacatgcccccccgccggcacctcaccgcggacgacctctggcgcctcgacatggggctgctgtccgaggacgagcggacccggctggatgcgcacaccgcgcgctgtggcgagtgtgcccaggccgtgctggcgctggacgagggcgaggcggccatcgaggaagcgctggacatggaggaggacgggacggtggcccgctccgcgcgcacctcgcgcgcgcctgtctcccaccgcgctcacgccgcccgcctgccggagcagcgcgaggtgctggatgagcgccgcgactttcgcgtggtgctggtgcgcgagcgtcagcgcgtgcgcctgctggtgcagcccctgtctggccggacggtgacggcggcggtgttcctgagccccggccgtccctcgctcaagccggcccatgggccggagggcatcgcctttgatttgacgtccgcgtcgtccaccggcgcgcgctctgcccacctgtccgtgcaggcggggagcgaaaccctggagcgcgacttcgccttctgacgggaggtccccgtttcacgccggggcccgtggtcacgggccctccgcgctcagggcgacggggggagcgcggtccgctccgtgtcgagcgcttgacggctgcgcacggggggccgcggaatgggaatgctccccgcaggcaacgtggggctgaagccattcaccaggagggcgatgatgagctgcgcgttgggtgggcgggtgccgagcgccgcgccgcagacatccaattggtccagcacccgggggccttcggtgcgctggtagcggttgcacgtggtgcccacctgcgggtccaggtgtcgcgccatctcacgcatggtgcggccccagcgcatggtgagcttctctggcgtgagctggatgttgacgggctccccaccccacgtcccctcgatgagggtgcgccgtccaccagccttcagcttcagctcgagcgcgcgctgtcccagcgtgcccgtcaccgcgatgccgtgctcgtagacctcctcgccgaggatgcttacccagacgccgtccttgcgccgggtgtacggcttgtccgcggcgatgcggccgtggttgaaccagacgtcacccacgcggcccagtggcagttggtcgttcttcgccaccggcgcgggttcgtcctccagtcctgacggaccggcggcggccaccaccggccgcgaggccagcaggtccgtcaccggcacggacgtgtcgacgacctcgaagcgcacgccgtccagccaggcctgtcccgtaccgctcatgatgaggccagccatgatggtggtggcttccttcgggacgtccagcaccacgtcgtagcgcttgcagcccgcggtgcccaccagggcgcgtgactgcatgttgtcgaaggccaggggctgcttcgggtcgggcccttccacgcgcatccacaggcctgcccagccctccacgtccttgatgcggagcgcgccggagaagcgcagccgcttgccccggaagtcatgcgcgccgaaggcctgcatgaaggtgccgtagccattctcatccggcgacagcgagcggaggtaggcgctgcggttgccttcgcacgtggcgctgctgtccacgccggcctcgtagcgcttgggggcgctctccgtcacataccagccgactggcagcttctgggcgccttccgacggctgcgcaccggccccggtggaggccagcgcgagcagcagggcggcgagtttcttccggaagtccatgacgggaatcctcacagcgacacggggcggcgcgcgctcagcgcaccctcggggaggccagtgcgggcctcatagcgcgggacttcacccgtgccccagggatattggacgagcagcccacgctcctcggccgcctgggtacaggacgcctgtgtggccaggtccgggcacgccacgacgatggactgcggctcggcaacctccagctccaattccaccgagggaggctcgacgtgaagggccagcgtcctgggagaggcgggcggttgccggccaccgggcaacacgacgaaggcccaggccgccgccgcggccagtgcggcaccggccaggccggccgtgagacgtcgagtctcccagcgggccgggcggaggacgtggacggcgggcgcataggtgttggcgacttcgtggagttgctccgacagcagggcttcttcctggagcaggcgggcgcacggctcacattccagcgtgtgcgcctcgaggctcgcggccttctccggtgccagcgcccccaggacgtactgctccgcggagtcgcgggtgaggtggggcttaagcatgggtttcctcctcgagcgcggtgcgcagcttcttgcggacctcgcacaggatttgccgcacgcgctggaccgacaggccaacgcgtgaggcgattgcggcatgagggagctcctggccgtcacaggccaggaggaagacgtttcgtgcgctgggagacacctgcgccagcgcagcatgtgcgcgggagagttgctcctcggtcagcaggcgccgctccgcggacacggacgggtccaccgggtggtgacgctccggcagttcatccaccgccccggcaatggactcgcgacgggcccgtcgtgcgtcgtccgcggccaggaaggccgcctgggtgagggcgaggttgggcaggcgaagctccgtcagcagcccgcgctgctgttgctggatgagccgcgcccaggtctcctgggccagctcttgcgcccggtccacccggacgccacgtgcgagcagcgataccacgacccgccggtgatggcgtgcgaccagcgcgtcccaggccgccctctcacccgtcagggcgcgccgcgcgaggagggcttcatcctccccgggcgccgtcgcctcggctggctcgtcggcttcctttgacaatcgcagcgtcgtcatccgcaggccctgcacggctgcactcatgccgtcttcccgtcgctcagaggcgtccggggagcacgcctgctccccggtgtccccagaacgtgtgtccggcgcggacatatcgatgggggcagggaggatgtggggcggggtgggcaagggtcagttgactgcgggactgtctcccgacgcccagcggaggttggagagcttcaccacgccctggcagcggccgcacacacggccttcaccgtcgtacacccaggcggtggcgaagaggagggacaccgtctggctgtcgatttcggactccacgcgcagactgtcgccggtgacggcgcgctcgaagctcatggacaactgcacggtggcgcagcgccggcccgggtccactagggcgccggtgcagcccacggcgtagtcgaagagggcggcgaggatgcctccgttgacggcgctggcgctgccggcgccgccccggtgttcgggccgaagttcggggatggtgacgaccaccttccggccctccggaaagctgagttgcgcgccgaagaggcgcagggtgaggctctgggagaactgctcggcgtaacggtccaggtcagcctgggatggcctcggaggggcgccggacgtggagtcggacatggagtcgcaccattatataagcgcaccgcatgccttgggggccgagcggccgggcgggactgcggaagggcgcccattggtgggggaaagacgttagaagcatgggttccctcccgaatgtctcccgcgaacccacacgaatccgccctcctcgaagacctcaatgcgccgcagcgcgaggccgtgttgcatggtgacggccccctgctcgtcctgtcaggggcgggcagcggcaagacgcgcgtcatcacccggcgcgtggcgtatctggtgaaggtccacaacgtctacccgtggcgcatcctggccgtcaccttcaccaacaaggcggcgcgggagatgcgcgagcgcctggtgcagttgctgggggcccaggcgaacgagctggtggtgagcaccttccactcggcggcggcgcagattctccgccgagaggcggagcacgtggggctcacccgctccttcgtcatctacgacgactcggaccagctcaacgtggtgaagcgcgccatgcgcgaggcgggcatcgagtccatgcagccgcgcgaaatcctccaccgcatcgaccaggagaagaacgcggcccggctcccggagcacatgcaggtcgcgcccggcgacgagcggggccaactggtgcgcaaggtgtacgcggcctaccaggagcggctgcgcgcggccaacgcggtggacttcggagacctgctgctcctgctggtgacgctgttccgcacccggccggacgtgctggagaactatcggcgccgcttccaccacgtgctggtggatgagttccaggacaccaacccggtgcagtacgcgctgctgaagcaactggcgccgcccccttccgccaacctggtggtggtgggcgacgacgaccagtccatctaccggtggcgtggcgcggacgtggacaacatcctcggctttccgcggcagtaccccggcgcgaaggtggtcaagctggagcagaactaccgctccgaccagaacatcctggacgcggcgcatgaggtcatccggaagaacacgcggcgcatggagaagaagctctggtccgagcgccagcggggccagacgctcaacctgatgctcaaccgcgatgagcgggccgaggggcaggaggtggcgcggcagattctggcgctgcagcgggagggcttcatcaagctctccagcatggcggtgttctaccgggccaatgcgcagagccgcgtgttggaagaggcgctgcgtctggcgcgcgtcccgtacaccctggtgagcggacgcagcttctatgaccgggcggaagtgcgggatgcctccgcgtatctgcggctgatggtgaacccgcgctcggacgcggacctgctgcgcatcatcaacatcccggcgcgtggcattggcgacaccacggtggagcgggtgacggacttcgccaacgcgcgcggcgtgagcctctacgaggtcttgtcccagccggagcagattcccgcgctcaatggtgccgcggtgaagcggctcaagggcttccgcaacctgctggagtccctgacggccttcgcccagacgaacgaggaagccgcgggcgcggtggaccagatgcttcgcgagacgaagctggtggagacgcttcaggccgagggcagcgacgagtctcagacgcgcgcggagaacctccgcgagttcctgggcgcggcgcaggagttcgacctgaaccgggcggccgcggcggtggcggccgcggcgaatccccccagcgacgttcctcccgaagtggacgcggccccgctgacggcggacgtgccggcgctgcaggccttcctggagcagatttcgctggtgggcgaggcggacgcggaggtgggcgacggccgggtggcgctgatgacgctgcacgcggccaagggcctggagttcgacgccgtcttcctcaccggcatggaggagaacgtcttcccgcactcgcgcgcggtgaagtccgagtccacgttcctgaacgaggtcgcctcggcggatggggagccctcggaggagatggccgaggagcggcgcctctgctacgtgggtttcacgcgcgcgcgaaagcggctcttcgtgagtctggcccagtgtcgctcgctgttcggtgagctgcgctacaacgcgcccagccgcttcctgcgggatgtgccgccggcgctgttcggcatcagcgagcaggaagtccccgaagcgcctcggcccatggtgccctccacgcagcgcaggcggacctgggacgaggatgacgggccgcgcatcgaccgctcgtactcgcaggcgtcgtcggacatggacggcgtgggcggggacgtgcgcggcatgcgcgtgcgccacgagcagttcggcgtgggccgcgtggtgtccgcggacggcaacggccccaacgcgaaggtgacggtggagttcggtggaggcgtgggcctcaaacgcatcatcgcccgtttcctgataccgggctgagaagcgggcacccgagtggacaagccggtttggagacttgtgggagcgacaaaagaaagcccgcgcgcctgacagggcgaatgcgctggtggcagagtccggcgtgtgagactcgcctcgctgacctggtgcctcctgctggtgtggtgtggcttcggctgttcgcgaagcttctcctcgcaggacctcggtgtgcggtacgagccgccctcgggcatggacctgcgctccgtggaggccgggcccccggcgctggcccgctttgacgggggattggagctgcgctcggtgcgcggcgcggcgcccgccctggatgcaggcccggaggccgtgctggcggcggcggggttgaaggcgcccggaaagttgcttcaggacacggagggtacgctcccggcggggcccgtggcgcgctacgaattctcacagacgggcggcgcgcgcacgctggtgtacttcgtgcccaggaaggacggcttcgtcctggttaccttctccgcgcccgagcgtgactacggcacgctgtccgcccgcgtggagcgctcactgtcgacactgcgaatgtggtgaagcccgcggcggcgtcgtcctgattggaggctcaagggtcggtcttgcgcagccgccacgacagcacgcggccatccagtcccaggacgatgacctggtcgccgagtaccacggggcgggtgcgcagcggcgtatccgcgcggaccgagaaggcctgcgcccaggtcgtcgtgttcaacgcgatgagccgtccctgacgcccgctggtgggcaccagcagcaggtcctctctcaccggcgtcacctccgagatgagcgggtcgggcagcgtgatgcgcgccacctcctttccgttcgaaggggacaggccgacgagcgcggagacctctccagccgtgccgacccacaccgttcccagcgccagcgaggggggactgctcagggcctccgcgggggcctgctcccacagggacgtgccgtccccgagccgcagcgccaggacgtgaccctggcgggtgctcacgtagagcgtgtcccgccacaacgtcatccccagcacgtcccggaggtcccgctgccagcgcttcgccccatcctgggtggccagggccatcagccccgcgtcacccagcgccaccacgagcaggccgtcctggaggaccggcatgggaaatccacggggcgcagccgtcggctcgggctttccgggtggggggcgctcccagtccgtcttccccgtgtccgtgtagagggagcggacggacccatccggcgcgaccaggaagacgaatttcccctccgcatccgccacgggtgcggtaaggacagggggctctccggtgaggcgccattgcaccgcgccatccgcgaggttcagccggaccaggtctccgcccaccgtcccggcgatgacactgtctcccagaagggccgggcgtgtggccacctccctgtccagggagacccgccagacgactcggccgctccgctccaggcggacgacggtgcctgcctcattggcggtgaggacgccgtccggcagggccaccagccctgctcgagacgaggcgtccgtggaatggcggaagtcgctcgtcgcgggctcccggcaccccatggcggccaccaatgtcagcgccagggcgggcagcaagggcgtgcatggacaggcgcgagacgacatggtttggaggatgacgcaaggaaggaacttggaccatgcctaccattcgtgatgacgagattcccagcgccaccggcattccttcgtccgcccgtcggacggacttcgtgccgccgcccaccctggcggtgacggaagagctgttgcgcgcactgcccaagacggacctccactgccacctggacgggtccatgcgcctgaagaccatcctggagctggccgagcagcagaaaatcaagctgctcgccgacaccgaggatgggctggccaaggccatccacatgggcgaggtgtgcgagagcctggaggagtacctcgtcgccttcgacgtgacgctctccgtgctccagacggccgagtccctctaccgcgccgcctacgagctggccgtggacgccgccgcggagaacgtgcgctggctggaggttcgctattcgcccgcgctgcacctgcagaagggcctgaagatgactacggtcatcgactccgtgctggagggcctgcgcgccgcgaagcgggagacgggcatcaagtgcggcgtcatcgtctgcggcatccgccacatcaacccgcagacgtccatgcggctggcggagctggcggtggcctacaagaaccgcggcgtcatcggcttcgacctggccggcgcggaggcgagcttcccggcgaaggaccaccgggacgccttccagctcatcctcaagaacaacgtcaactgcaccgcgcacgcgggcgaggcctacggccccgagtccatctcccaggccatccacaacctgggcgcgcaccgcatcggccacggcacgcggctgcgcgaggacggggacctgctcaactacgtcaacgaccaccgcatcccgctggaggtgtgccccacctccaacgtgcagacgggcgccgtgacgagcctggcggcgcacccgctgaagttctacttcgactacggcctgcgggtgaccatcaacacggacaaccgcctcatcaccgacaccacggtaaccaaggagctgtggacggcgcactccgcgctgggcctgtcgctggaggacctgaccaccatcctcgtctccggcttcaagagcgccttcctcccgttccgggagaagcaggacatgctgcgggcggtgaacgaggagatcgcccagacgctggcggccttcgaccagaagcggcacctggtgaagcagcccgcttgatgacgtgacgtccggcgtcccggccccgtgcaaggtgcagtcgcctcgcggggccggcgctggccgcgaggaggtggcgcgtggacctggaactgggtggcaaggtggtactggtgacgggtggctcggaggggctgggcgccgcggtggcccggcggctcgtccgggagggcgcgaaggtggcgctctgtgcccgtggggcggagcggctggaagccaccgccgcggccctgcgcgccgagggtggggacgtgctcaccgtccaggccgacgtgtcgcgtgcgtgggaggtggagcacttcgtggatgccgcccacgcgcgcttcgggcgcatcgacgggctggtgaacaacgcgggcaccgcggcgggccggcccttcgcctcggtgagtgacgcggagtgggaggccgacctccagctcaaggtcttcgcggcgattcgtgcctcgcggcaggcgctgcccttcctgaaggagtcggggagcggcgccatcgtcaacgtgctggccatcgcggcgaagacgcccggcgcaaactccacgccgtcgtcggtgtctcgcgcggcggggctcgccttgacgaaggcgctgtccaaggagttgggcccgcacgccatccgggtgaacgcggtgctggtgggcatcatcgaaagtggccagtgggcgcgccgtgccaaggaggtgggtaagcccatggagtccttcctgcaggagatggcgcgtcacgccgggattccgctgggccgggtggggaaggcggaggagttcgccgataccgtggccttcctgctgtcgccccgtggtggctacatcagcggcgcggccatcaatgtggatggcggcctgtccgcggccgtctgatttcccttcgtcaggaacgggccgggtgcccgtgtgtggatgatgaagacggcttcgcgccgtctggcgaccgcggctgctgacccctggtccctcatctctccgtcacgtccccctgggtgtgcccgtcttcgggccccggggcattcctgagttgggtcatgcagccgaaactgaaccggcttctccgggcgctcgcccgcgaggggctcgaggtcgcctatgacggccgcctctattccgtccgcctcctgggtgacgctcacgcgccgcccgccgaagtccttctcccgccggacctgcccgtggagggcaaggccttccaacaactcgcccagctcgcggccctgaggcaccccggtggtggcgaggtgctgcgggtacgtgccacgcccgacttccacccgggagactccggggtggccattggctcggtgctccacacgcgcgggctggtggtgcccggcgccattggcaccgacatcaactgcggcatgcggctgcacgtcgcggacatctccgtggaggactttctggcgaagcggtcggccttcgtcgagcggatgaagggccactacttcttcggtacgcgtgacgtcaccatggcctcacgggcctccgaggcgctgctgcgcgacggcgtgcagggctggctcctggagacgctggagcagccgctggggtgcgcgggacgggccgacctggcccagctcgacgcggaggtgtcgcgcatccacctgggcggcgggctgaagggccatccgcgctgggcgcccgagtccttcacgcgcgaagggctggtgcgcgacgcgggcctggccaccattggcggcggcaaccacttcgtggaggtgcagcgcgtggaggctgtggaggaccgggcgcgggcgtgggactggggcgtgcgcgagggacagctcgcgttcatgattcactctggcagccgggacgtgggcaagcacgtgggcgtggcctggcaggaccgtgcgcgccaggcgtggcccgcgggaacgccgcttccggccagcggcatcctccccctgggggatgcgcggctcgtcaccgaatacctggaggcggaggcgacggcggccaactacgccttcctcaaccgcctgctgctggcggaactgctgcgccagacgctcagggagctcttcggggacgtggaggcgccgctcgtctacgacgtgccccacaacctgacgctgccctacgagggcggctggctggcgcgcaagggcgcatgcccggcgggggcggagcaacccgtcatcatccccggctccatgggggccacgtccttcctcatggtggggtgtggggatgcgcgggcgctggagtccgcgtcgcacggcgcgggccgcgcgcgctcccgcttctccctgtcgcggggcggcgcggaccagagcgaggccgccctggggctgaccggcgtggactgcatcacccttcgcgcggagcgtcgcgtcgaggaggcgcccgcagcatacaagcccatccgtccggtggtggatgcccaggtggaggccggcatcgtccgggaggtcgcccggctctcccccctgctcaccttcaaggcctgagcggggagggaaggggggcacgtcatttcacttggcgtgctcccctgtctgcgagtggaatggccgcgcggcgggcccattgcccgcacggcatctcacgcggcatcgaggggactggggaccatggagaacacctacggaacgatgaactctcccggcggagcgggcgcgaaggaggccgtgtcgctgccggccatcctgctgatggtcctttccgccatcaccgtgctgctggggctcatcaacgtgctccaggcctttggcggcgcggaccccgccgtcgaggaggcgctcaacaaccccgacctgcccgagggggcccggcaactgctcgcggggcatgacgaccacgggcggcaagctgatgttcgcgctgcccacgcaggtgctcaatggcctcgtcttcttcggcgcgctgaagatgaagaacctgcagaactacgggctggcgatgaccgctgccatcatctccgtcatcccctgctgcggcccctgcgcctgtctgggcatccccgtgggcatctgggccctggtggtgctgaacaagcccgaggtgaaggcggccttcacctagccgcggcgccaggccggccaccgccccatggccgtggccggccgctgcttctgcatccgcacgcacgccaactggacgtcgaccgtgagtgggcgccgggaggcgtggacggaggcatagccgtgccgctgatagaagtgttcggcgttcaggctggcatccagccccatcagcggcgcgctgccccgccagacggcggactccagggccgacagcaatgcggggcccacgccatggcccgcctcgtctggcaccacgtagagcgcttccagctcacctagcgccgcgtccacctggccgaagcccaccgcgcgccggccgcgttccgccaccagcaccgtgcgcggacgctccggccgcaggtagccctccggtttcaagagccgcacccaggtgctcacctcgtgcggcgcgtacgcgcgaaggcacagggcttccacggcccgggtgtggatgcgccacagggtgcggcggtcggactccttcgcgggcctcagcaggagtccttccgcgcccatggccgtctcaggtcaccttcatgcccttgggaatcaccacgacgcccccgggcgtgacgtggaagcgccgccggtcctccaccgggtcgaatccgatggtcatccccggcggaatctccacgttcttgtcgatgatggcccggcggatgcggcagcgccggccgatggtgacgttctcgaacaggagggagtcctctacctccgagtacgagttgacgcgcaccttcggcgacagcaccgagcgccgcacgctgccgccggagatgatgcagccctccgccaccagcgtgtccatggcgtggcccacgcggtggttctgctcgtccgcgaagacgaacttcgccggcgggtagttgttgggctgggtgtggatgggccagcggtcgttgtagaggttgaacgtcgggtccacctccaccaggtccatgttggactggtagtagacgtcgatgttccccacgtcccgccagtagccgcgctccttggcctcctggccggggacctcgttctgggcgaagtcgtacacgtacaccggcgcgcgcttgtacagctcgctgatgatggactt

SEQ ID NO: 1225 - DNA, 24905 bp, Myxococcus xanthus
tgctctcaggctgactcgctgggcgtcgggctttgagcgaagagcctctagcgtcaccgcctcaaatgccgcctcatcccgtcgagcctgctcgggacacaggcactgcttcgcccgcacgaacgcccccagttgccccggctcagtcaccgagtcccgacgctccgtcatcttctgtgccgccaatacaggatggctcggagcaagtgccccctacgtcagtgccttcccaaacggagtgagcttggcccgcttcggtggctctcccgcacttcgtatcgacctggataccgagaggtaggggcgtcaaggaccggcgtgaagttcacgagggtgtagcccggacacgaaaaagcccgggccgccgtgaaggcgccccgggcttcttgctacggcctgcgccgtgcgaactacagcgcgccgatgatggcgtcggtgaactcgcgggtggtggccttgccaccgaggtcaccggtgcggacctcgcccgagccgtacaccttccagatggcgttctccatgcggcgcgccgcctcgcccagctccaggtggtccagcatcatcaccgcggacatcatcagggcggtggggttcgcgatgcccttgcccgcgatgtccggggcggtgccgtgcacggcctcgaagacggcggtgcgctcgccgatgttggcgcccggcaccacgcccaggccgccgaccaggcccgcgcacaggtcgctgagcacgtcgccgtagaagttctccgccaccagcacgtcgaagcgcgtcgggtccttcacgagctgcatggcgaggttgtcgatgatgacttcctcgtaggtgacgtccgggaactcacggcccaccttgcggcagcagtccaggaagagaccgtccgacagcttcatgatgttcgccttgtgcacggcggtgaccttcttgcggccgtgcttgcgggcgtactcgaaggcgaagcgggcaatccgcgtggaggccttctcggtgatgatcttcagcgactccaccacgcccgggacgatgatgtgctccaggccggcgtagagactctccgtgttctcacgcaccacgacgaggtccacgccctcgtagcgcgtcttcacgttcggtacgctcttcacgggccgcagcgacgagtacaggtccagccgcttgcgcaggcccacgttggccgacgggaggccaccgcccaccaccgtgcccgtggggcccttgagcgcgatgccgctgcgcagcaccgcctccaccgtctcgtgaggcaggttggtgccgtacttggccaccacctccgtgcctgcgtccttgtactcgaaatcaagggggaccttgagcgcctcgaggacgcgaacggtggccgccatgacttcggggccaatgccatcgccattgatgatcgtgacagttcgtgtggtcgccatgggtgcggagtcacagcacaatttccctggtgtcgaaaggacgaaaacgcccgggattcagccggaggcatggcggccatgaggtaggcacaccctggtgggtcacccggccggtttccgggcgggagggcatccgctccgagcgtcagtgctcggacgtggaggacggtcgcggacgccgggtgggcttgcgccgggtgtggatggcgtagggccggtagaaggactcccacagggccgcccggcgtccccggggccgggtccgcagctcgcccaggggtgcccggatgaagaaggacgacaggaacaggtaggacgcggtcagcgtgagcagcagcaggatggccgtcacggcctcgccaggaatccaggccacccccgcccgcgccaggaactcgtcgaggtccacgggtggcttcgggtggctgtagaccttcacgaaccacgtcatcatcaggaccatcaggatgggcccgtaggcgcggttgagccgggtggagatggcggagaagagggaaagctggatttggggccgttccagctccagggccagctcgcgcagggcgtccgggtccatcggctcgtgccggagcatgggggcccaccagccttcctccagcaggcgcacccggcggttccacaagtcgtagtagcggtagcgccgcgcctcgatgaggaggaacgacaccaccatccagatgcccaccaggaaggtgacgtgtgaactctgcgtcgacgcgaagccgaaggagatgaccgccgccgtcgtcgtgattgcccagttggtggtggtgtccaggcgcgtgcgccaggtatcggagcggctcagctccccccggaacagttgggccatggcctgctgggagagccagggcgactccagcacatcggtcctgtcacgttcacgcacgggcatccttcgccggaaggtgggctgggcagtgggcgtttgcaacgcaggcggggtgggggtggcaggcgggcgggcgagcgcacgggtggccatggcgggcgcgcgtgtgcagcttgctgacttgaacgtgcccgacgtgaatcccatacaggccctgtcccacctcctccaggaggagcgcgagcgcctggcgcgcctgtgggccaagcgcctgcgcgcggagacatatgacgtggaggtccccgggagggacctgcgcgctccgctgcgccggttgctggacgagctggcccgcctgctcaaggaccggcccgacgacgtcgtccggctctggccggaggtggtccgcccgcacggcgccttccgctacacccagaacttcgaccccgaggacctgacgcgtgagttcaagtccctggaagaggtgattctccacgtctacgcgcgccgcaacggtggcttcatcgagtcccaggtggcggagctcgtggcggagctggtgtgggaggcggacgccgcggcccaggcgtcctatgcgcgcatcctgaagacggaggaggtgcgctttcgtgaagcggcggtgatggagtcggtgctcaaccaggtggacgtgggcatcatgctggcggaggtggacggcaccgtctccttcgctacgccgccggtgagccgcctcatgggggtgcccatgcgcgcggtggtgggggggcgggcggcgaacaccatcaatcccgtgctgacgcaggtgaacgcgcgccacctcacgggcgagcccttcaagctggccgacatgcccttcctgcgggcactcaaggagaaggggcccgtgcgtggggtgatgatggtggtggagcgccccggcggcgacaccgcgacgctggagctgagcgccacgcccgtctgggaagaggagggcgagctggccggcgccatccagaccttcaccgaccgcacggaagcggtgaacaagacgaaggcactccagagcgcgcacggggaactgcgcagactccagggccgcctgctccagcgcacccgccagcaggcgctgggacagctcgccagtggcgcggcgcatgcgctcaacaacttcctcaacgtgctgcggctgcgaatcaccctgctgcaacgcgagttcaagcccgagcacctggaggcgctcgacaagacggtgcagcagattggcgagttggtggcccggctccaggagttcaacatccagcgtacccaggagcagcccaccgacgtcccggtggaccagacggtgcgggaggcgctggagctggcgcgcggcgagctggagcagcgcgagcacccggtgtacgtggacctggacctgggcgatgtcggcaacgtgcgcgcggatacgggcttcttccgcgaactggtggtgaacctgctgctcgtctcgcgcgaccggatggaggccggaggccggctgcacgtctccacgcgcgcggaaggctcctcgtggctgacgctgcgcatcgaggacgagggcacgccctacgcgcccgatgagctggcgcggctgttcgacccgctgcgccgggacgcgagcgcgccgcagttgtccctgttcctggcggtggcgcgggcacaggtggagcgctggggcggcgagctgacggcggaggttccggcctcgggtacgggcacggccttcgtggtgcgcctgccccgcgtgcatgaaggcgccgtgtccaccgcgccacgtccggagccgtcgcgcgcggaggtgatgcggccggcggggccccggcgcttccagcagacgcgcagcgtgctggtggtggatgacgacctcgacaacgcgcggatgatggcggaggtgctgggcgaggaaggctacgaggtccaggtggcccacagccccgcggtggcgctggggatgtgggaccggcgccgctacgacgccgcgctgctggacgcggtgatgccggagatgagcggctgggagctggcgcgcgagctgcgcaagaagacccctcaggcgctgctggccatcgtcaccggcatggacgtgcgcggacagaaccgctccaacctcgcgctggtggacgccgtgttccgcaagcccatcgacgtgggcgcgctggatgacttcctggggcagtccgacaccgccgcttccgagaacggtgcgtcgaccacgggttccgcgccacccgcctgagcgcagcggacaggacgacgtggggtctcagccgggccggtagctcgcggcgttacactttccactcaaagtgttgcggcacgcgtcacaccgcgaagcccattccgccgggcggggcccgtgtccgaggggagcgggtgcttccccagtgcaatctccctgtctggttagaactgcgagtgtggctcgtcgcttgctccaggaccgcgggcccgccggtgcccgcggtcctgattcgggcgtccacccccggtggttgccactcccaagaggtgctgcgtgagattcaatctgagaggcctgttgctggccggaatgatgctggccggcggcggtgccatggcggaagagagcgcggtctgcgaaggccgtacgtcacaacctcccctgcagcgggatgcccaggggcgcgtgaaggtgggtgaggacgtcgtcgccaccttcaagtcacgtcagcccagcgcgcgtccggagggtgttcgcgccaaggccgagctggcctggacggaccgcgtcagcagcccgggtgccacgtacatcgcgccgcacttcagccagttcgcgctcgcgtcgggggactacgtcatcgtccgcgcgccggacggctcgcgtgagtaccgctacgagggcttcggcaagggcgagggcaacgcgccggtgaggggcggcttctggagtggtcacatctccggtgacgtcgccatcgtcgagttgtggagcacgggcggccaagcgaagtccggctacaccatcgaccggttcgctcgtggcttcgccaacctggcggcgctgggcgaggacctggacaacaaggccctctgcggtccggacgactcgcgcaacgcgcgctgctaccagacatcggacccgcgtcagtacaagcactcgcgcgcggtggcccgtctgctcatcaacggcagcggggcctgcacgggctggctcgtgggcaaccagggccacgtgatgaccaacgagcactgcatcgccaacacctcggacgcgctcaacaccgacttcgagttcatggccgagggcggcgcctgtacctccgcttgcaacagttggttcggctgtccgggcacggtggtggccacgagctccacgctcatcgccgtggacgcgccccgggactacgccctggtgcggctgcccaccaaccccacggccacctacggctacctccaactgcgcaacaccaccgcgttcgtggatgagcgcatctacattccccagcaccccgccgcctggggcaagcacatcgcccgcaactccacgcacgcgtcggacgcctcgggcttcgcggaaatcttcgccctcaaccggcccgcgtgctcgccgggtggcccgctggacatcggctactacgcggacacccagggtggctcgtccggctctcccgtcatcgccaactccgaccaccgcgtcgtcgcgctgcaccactgcgccaactgccccaaccgtggcgtgcccatcacctccatcatctcccacctgggttccctgttgcctcagtgcgcgctgcgcagcgccacctgcccggacccgtatgacgtctggatgcgcgacacctggtccgacaccggcctggagccggaccccgccaccgcgggccaggacatgtgggccagcccgtacatctggattcgccgcaacccggacggcgtcgccaacccgcacgtccaccagaaccccgagttgggcgcgacgaactacgcctacgtgaagctgcacggcgggccccgtccgggcgccacggggcgcctcaagctgtactacgccaacgcctccaccggcctggcctggcccacggactggacgcagttcggtgacgtcgccgtcaacggcttcacacccgacacgcacatcgtccaggcgccgtggagcagcctgcccggcgagggccactactgcctggtggcgcgctgggagtccgcatccgaccccatgtcgttcaccgagacgacggacatcgacaccaacgtgcgtcagaacaacaacatcatctggcgcaacgtgaacatcgtggacctggagtccggcagcgaggaggtccacttcatcgtgcgcaacgtgcacgagggaatccgggcgctgcggctggcggtgcgggtgccggaaacggaccggcagcggcccttcccggggaatggcggccgtgtcgtcgtgcgtctgccggacgagctgttcaagcgctgggtggaggcgggcggcaaggccgagggcatgaagatgctgcgcgagggcgagttcgaggtcgtgtctccggaagggggcgtgttccacgagctgccgctgggcttccgcgaggagcaccagttgcggatgttcttcgagcgctcggcggatgccacgccggagccctaccacctggaggtcgtgcaattcgaccaggacaagcctgagcgtgagagcctgggcggcatcggctacgacatctacacccacggcgagccgaagccgaagcagtagccgtcgcttcgtctgacgcggcttcgctcgcgtgccttcctggcgcgggcggagccgtgacgtgtttgcatccgtccgtcgccgtgctttgtctggtctccggcgcggcgcttcccgccgcgtcctttcccggaggcagtgcgtgcgggtggatgacctttgcctggtgctggtgtcctcgctgttgcgggaggaccgtgcccggtggcctcagcggctcgaggcgctggaagaggaactgggcgcgtcctgggcgctgcggcggctcgaggtgccgagagcgtactccctgggtgtgcggctcctggatgggcgtgagctcccgctcgccacgtggctcgactcgttcgaggaaggtggggtgcactccgttcgcgtggtggacctcggcgcgtcctcgaccgaggcgcttcccgcgcacatcgccgccgcgttcgccaactcgggaggcgtggtgctggaggtgacttcgggtggggcgtcctcgctcttcctcctgcgaatgcactccagccgcccgcacctgctcaccgcgcggcaactcgtggacttcgcccgtgcgcagtcgcacgcggaccgcgtcttcgaggcctgggcggagtccatctccgagaacaaccagctcaacgaccggcccgcggtgccggcctcggaggtgccggactacctggcctcgccggacgggttcgtgcactacgacttgcgcggcggtgacctggtggaggaactccaggccacccttcgccgtcacggcgcggacgtgacgattccagacgcgctccgggcctgcttctacaccagcgacccggacgcactgtttcgcgagatgctgtctcccgagcagcaggcggagttcgtcccgtcggaggagcagctcctcctcaccgacaccaccacgccccagcagttcgctgacctggtggccgcgcagcccttcgccgtggatgcctggacgcgcatcgcccgggaccagaactcgttcctggcggagggggagtcacccgtgacggcggagggtttcgaggcccgtctccggacgatggcgccggatgggctccagtcgatgctgaccggcaacctgatgctggcgttgcagcaggcggcccgggtccatggcgcggagttggtcatccccgagtccttgcgcggatgcgtccggcctgcgttctctcggggagaggacccggggtggattccgggcaaggaattgctgcgcctgcagtccaatcccgacgtgtaccagatgtacctgttccacgaactggcggccgggcccgcgcccgtggccgaggggccgtcctgggacgaggcgcggcgtggcttcacgaaggcattgcgggaggcagttgccttctcggccgcgcagggctcgaacttcgcggatgcgttcaagctggcgctgttcgcgctcgaagggcaggcgccgcgctacgacgaactgtcaccggagcgggtgccggattacctggaggcggtgaaggccgcgggcttcgacgggcggccggtgcaggtcttcgaggacaggttgggctcgttgggactgttccagtcgctggggatgtccgaggagaagctgcgtggactgctcgcctacctgctgtccgatgtatttggcggcatgggctcgtggaacgaccagtacttcgagacgcccgaggcgcagcagcaatacgatgcggtgtcagcgcggctgttcagcgagcggagtgcgttcttcgtggccacgctcaacgcgcgttgaggcggaaggtgtgatggtgggcacggcagccgggccctggctgcctgtccctcccttgtggcgctggatgacggtgtccacctctgagggaggaggagacaccaccatgtcacgcaagacgatggactgccggaaggcgcccagtgacacccactgcacgctgacgatttcgggcgaggaggacgaggtattccaggcggccatctcgcacgcggtctccgcgcacggccacgaggactccggtgagctgcgcgagatggttcgcggcatgctcgaggacgaggcgcccgaggccagcatgggccagcccatgtcgatgcaggagccgcagcagccgagcaggcactgaaggccgcgcctgtcagtgtgtgggcagctcgcggaacgagactccgtccagttccaggcggcgcaccgtttccatgaaccgctcggtgccgacaatcatcgtggcgaagttgcccacccggaacaggtccacgtccaccgggagcgaggccgcgtcgaggatgggctcgtcgggtcgacggaacccgaggcgtccgcaagtggcgcaccgagggggcaggtcaggaggcatgcagtccgcgtgcagttggccacgcgggtcgagctgaagctccaggagctcgggggcgtccttctgccggaaccgcagctctgttcgcgcgccgagcagcccgcggatgccttcctcccgaagtcgctccagttcttcgtggcgaatcagcaacagactgctgcccagccatgcgaaggaaccgaaccgcccggaggcggttcccaccaacgggccgaacgtcgtccccgggggaagcagggcacctggtggtgccaggggccgtaccagctcccggagccgtgagaactcggtgaatggctcaggcctggctttcaagaaggcgctctgctcgggcaggacggacaaatcaacggcgggatactgatgtcctgagctggcccaggtttcaccgcagcccgggcatcccgcgaggccgggcagcccccacttgtgcgcggcgttgaggctgccgttggtgtgggcttgcaccgtcgagtcttcgcgcagccagaagaaacgcgtcattcgtcctcatgctccagggcgagaatagtagggctggatgggaccgcccatgagctcaaagcggtgaatcagctcccctgcgtgtctgaaaatctcggttggggtcgcaccctcgttcgcgtctttgaactcacgccaggccctgttccactcgccgcccccttcgccgccccggtgaatccgctgatggacgtggcgtggaatgggcatcgtgtagtcgtggattttcactccctgccgttcgaaccagcgggcgaggtcctctgcctgcgggaagatgtggtgtttctcccagcgcccaggtgtgagtcgaggtggcgctgagaagaagcgctcaggggcgccattccagttggggaacaccatgacggcgccccgaggcaggtgctgtcctccgccccggttcctccgggggcctctgccgggagccgcgaccgccgcgggcgggcgagccggtgggaagcgcgcgaactccaccgcgccatccaggtcctgacaccggtagaagccacaggcgtctcccatgcacaagagcgagacgcactggtcctcatctggcgtggcgcacgcctcctcggcgccgttccatgcttgctgagtggacgcctgtggagccgacgcgcagcctgcccacggtgccgtgagcagcagtagccagagtgacaggagtgttcgcatggtttggggaacctatcgtccagcgccgagatggtcgttagagtcccgccagtgagtgcccccctggacctggagcgcgtccgccgcaaggtggaggcgggtgagattctgagcgacgcggagctggccctgctccgtgccgaggcgcagcgtggcaccggctccgccttgcgcttggccctggcgcacgccctcatcaacgcgggcgctgaacgtgaggcgctgcccctgctggagaccttgcggcgggacttcccacgcgacctgcctgtgcggctgggactggcgcgggccctgctcggactggagcgccacggcgacgcggagcggctgctgaccgaggtcctggcccaatcgccaggagacccggaggtgctcaaggtgctcgcggtgctgggactgcggcgcggtgaagcggacaaggcgcgtgcctatgtcgcggatgcgctggctcgcgaccccttcgacgccgaggcacggctgctgaaggaggaactggagtccgtggacctgccgcctccgtccgttccccaggagcaggtgctgcgcccggagttcaccgccgcgctcaccgccgcgctgggccgcgcacgggtggcgttccgacggcaggggaaggacctgctcgtgaagctcgccacgggcggtgttggacgcgtggacgtgggctcgctgtacgcggcctaccaggagtccccgggcacgcaggggctcactgcctacgcggatgcgctggcggcgcggctcggcgggttgtcttcgggcctgagcgcggaggtcgcggcgttggaagcgcggctgcgcccggtgctgcgcccagcggacttcgcggcgcgcgccgtgggcgccttgcaccggcccggtcccgcgggtctggaagtcttctacgtgctggaggacgcggagttcgtacgctacctgcccgaagccgcactggcccccgcgggactcacgccggagtcggcggacgcggcggcatggcgcaacctcgcctcgcgtctggctccggtgcggcccgtgctcgtcgaccagggggaagtccggctggcggaggccttctccggactctgggccgtggcggagggggacggccatgacgccgcgcggctgctcctgccttcgcagcgcgaggagctggcactgctcgccggagagggccccctgcgcgtggccctcggacggcgtgagctggtgctggtctgccgcgagtcggatgccgccgcgtgcgaggccctggcgcgactcatgccctcgccggatggaatcccgggcaccttccgcctgacggaagagggcctgtccgcggtgtgaggcggtttcagcccgccgtgcccgcgggcaggtggtccacgaacagcacctcacggtagcccagcgtgagcagcagcgcccgcagcgaacgctccgctgactcccgcgcccgccgctggagtttcccgttcgagcggacctcctgctcgaaggcgaggcgggccttctccagcaactgcgccgtctgctcgctgtccaggttggagtcgatgacctccgtctcgccaggacgcagctccaccttcacctccatgggcggcagcatcacgtagacgcgcgtgcccgtcacctggagatgagagcggtcgaagcgctggaagtcgaagcccaggtgcgcgttcgcgaagacgatggcgcggccatgcggattctggagcgcgtaacgcgcccagttcagcacgtccttccagagcgcatccgtggcctggggctccggcgtgaaggtcaccttcttgtagagcgagacctccagcgtctccagccgggccacgtcccgcatctgctgcacgacggacggcgtgtccggcagcgacggcgatgcgggcttcatcaacacccaggcccccagcgcgccgagcgcggcgcccaggacgacggtgaggactcgcgagaggtgcgccatgggccccagtgtacctccccgcgcaggcgcttccggcgagctcatatcgaaggcgccagcaggacgaccgagtaacccacggccgtccgtgctccaggattctcgtacgagtgcttctggtccccccggaagacgaccacgtccccgggctggaggtggaagcgctccccactggcgacgagcaccagctcccccgactcacacgccaggtactcccgggtgccgggggtgtgcggaacgccggtgatgcgcacctgcggcggcagctccacgcggtcgaactccatgcccggcagcgggtccggcagcagcttgcgcagcattccgccaccacgcgtccggacgggcagggtggcgcgcgggtagtgccgggcactggcgcggggcttcgcaatcagctcctccagcgacacctggagcgcggcggccacgcggtgcagcacggacagggtcgggttggccgcgccggactccagatgggcccaggtggcgcgcggcacgcccgccagccgggacaactgcgcctgtgtggcgcctcgcgtttcgcgcagggaacggatgttgcgggccagtctgccgggcaggtcatcgtcgttcatggattggcaatctgccaagcccttggaccacatgccaacgcaatggcgagcggcgtgtatctcccgtcgcaaggagaacgcacgaatgattcgcatcgacaagagcatcctgattacgggcgcgagccggggactggggcttgcgctgatgaatggattggctcgccgaggcgcgcgggtggtgggcgtggcgcgtcatgccgcggagatgggggccgtcgcggaggcgctgcgctgggaggggttggaggcgcacgcgctggcctgcgacgtgggggacaaggaggccatctacccgatggtgggcgcggccaccgcgctggtgggcccgctggacgtgctggtccacaacgcgagcacgctggggcccacaccgctgccgctgctgctggacaccgcctgcgaggacctgcagcgcgtgctggaggtcaacgtggtgggccccttccgcctcaccaaggcggtggccgggaacatgtcggtgcgaggcaaggggctggtcatgcacatcacctcggatgcggcggtgtccgcctatccccgctggggcgcatacggcgtgtccaaggccgcgctggaacacctggggcgcgtctgggccgcggagctggagggcacgggcgtgcgcttcgtctcggtggaccccggggagatggacacgcggatgtaccgtgacgcggtgccggacggggattactcccagttgagccggccggaagcggtggcggcccggctggtggagtgggtggcgtggcagtcggagtcggtgccctcgggcgcccgcctggaggcggcgaagctggaggccgcatgaagcccgcgcgctggcccgcggaccgccccgaggagggacgcctgctgcatgtggagccgcgcgcccgccgctatcgcgacacccgcgtggcggacctcccgtcgctgctgcgcgccggggacctgctggtggtgaacgacgccgccacgctgcccgcgtccctggtggggcgaacggagtccggagaacgaatcgagctgcgcctgttgtcacgcgagccggacggcacctggacaggggtgctcttcggcgcgggggactggcgaaggcgcacggaggaccggccaccgccgccggtgctggccgtgggcgcggggctcgtggtgggaggcctgaaggcgctggtggtggcggtgctgccaccgtctccccggttgctgcgtgtggccttcgacgcgacgggggcggcgctctggtccgggctctaccggagcgggcgtccggtgcagtatgcgtacctggaggcgccgctgtcgctgtggcatgtgcagacggcgtatggcgcgcggccctggtccgtggaggcgccctccgcggggctgcccctcacctggagcgtgctgctgacgctgcgcaagcagggcgtgcggctggcctcgctcacccacgcggcggggctgtcctccacgggagacgcggcgctggacgcggcgttgccttggcccgagcgttccgacattcccgccgccacggtggaggccgtcctgcacacgcgggcctccggggggcgggtggtggcggtgggcaccaccgtggtgcgggccctggagggccgcgcggcgcggcacggcggctggttggtggcgggggaggaggtgacggacctgctgctggggccgggcttcgtccctcggctggtgcacgggctgttcaccggcgtgcacgagccagggagtcgccaccacgcgttgcttcaggccttcgcgccgctgccgctgctccaggaggtggccgcgcacgcggaggcgcgcggctacctggggcacgagttcggagactcgtgcctgctgctggacgcgtgagcggtgtgggcctcggggccctactggagctgcgtgggctccagctccaccttcacccagccgggcttgcgcgcgtcgaagttgcggtacgcgtcaatggcgctgcccatgggctccacatgggacaggatggccgtggggtccaccacgccagtgcgcaccagctccagcagcttggggatgtacttgcggtggttgcagttgcccatcttcatcgtgaggttcttgttcatcgccatgccgatggggaacgtgcgcacctgcgccgggtagacgccgatgatggacagggtgccggccttggccagtccctccacggcccacatcagggcctgcgcgggcgcgtcgccgggcacccagttgtcacccttgggattcgtcttcggggcggcttccttcacctcgcgcttgaactcggccttctcctggtgggccttcttcgccgcggggccgtggtgcggatgcatggcgtccacgcccaccgcgtcgatggcgcggtccacgccaatgccgttggtgaggcgcttgagcgtctcgagcgggtcttcctcctcgaagttgatgacctcggcgccctgggcccgcgccaggtccagccggtcctcgtggcagtcgatggcgaagacgcggccggcgcccagcagcttcgcgctgacgatggcgaagaggcccacggggccgcagccgaacaccgccacggtgtcaccgggtttgatttccgccagctccgcgcccatgtagccggtggggaagatgtcggagatgaggatggcctgctcgtcgctgacgccctcgggaatgcgcaccaggcccacgttcgcgaagggcacccgcaccttctccgcctgcatgccgtggaagggccccgtctcctggggaccgccgaagaaggccgtgcccgcgctggggccgttggggttggcgtcgttgcactgtgcgtggtacccggcgcggcagtacgagcagttgccgcaggcgatggtggacgggatgaccacccggtcgccgatgttgaggttgcggacgtcatcgcccagcgcctcgatgacgcccacgccttcgtggcccaggatggtgcccggcttcatgcccggcatggtgccgcgaatcatgtggaggtccgtgccgcagatggcgctcgccgtcaggcggacgatggcatccgtcgacttctcgattcgcggctcctccacgtcgtcgagccggatgtccccaatcccatggaaaacgacagccttcattgcgcgcgctcctgccccctcggggccccaagacgaaaagggcctgcgcggacgcagacccgcgtgacttggagcctgggcatcgccccgggtgagggcaaagcgagcgccgccccctcttctgctcggcggccgggggagcgggggctagcggccgctggatgcgtggtggacgtggaaggtgagccgcttgccgaagacgcggcggaagttcaggacctcgcggtccgcgttccacagctccaggtccacggggtgccgggtgtgcaggtgcagcgccacgccatcgcggccgttggtggccttgaagtccttgatgggctggtggtggctgacgtccagcgagttggccacgcgcagcaaggtggccagcttgcgcaccgtccgtgcctcggccggattgaggcccgccatgccggcgtgggtcagctccggcgggctgcgccggtggtagcgggcgacgcgggccaccagctcgcgctcgcggtcggcgaggcccggcaggtcggcgtggcggatgaggtagtacgtgtgcttgtggtgccgctcgtagctgacggcgtggcccacgtcgtggaggagggcggcgacctccaggtgggagcgcaccgacagcggcaactggtgcagggcggccaggttgtcgaacagggtgagtgacagccgggcgacctggcgggcgtgcttctcgtcgaagtagaagcgcttgcccagggccagggcggcgtccgcgaggctgtggtcctcgcggtgctcatcctgccggtagagcaggtccacgaggatgccgtcgcgaaggccgcggttgacgacgctgacggactcgacgcccaggtgcctggccacgccttccaggatgacagcgccggagacgatgatgtcagcgcggcgcgggtcgaagcgcttgcggcggcgctcgggaggcatctgcgccagggtgtccaccgtctgcgtgagctgtcggacggtggcgttgccgctgttctccgcggcggcgaaggacaccacggcgttgatggttccggacgagcccagcgccacacgggggacgttgggcaccgtggggggcagcgtcttttgcagcacgtccgagacgaagctgcgcatgaggcgcagttgcttgggcggcacggtgcgcgaggcgtcgaagacctcggtgaggcgcacggagcccagcgcgaggctccaaaggttgtcgggcttctcgcccatggcggtgacgatttcggtgctgccgccgccgatgtcgatgaggagcgagcgcgtctgggacggcttgcggtggagcacgcccaggcagatgaggcgggcctcttcctttccgctgacgacctccaggttgaggccggcctcctcgcgcacgcggcggacgatgtcggcgctgttcttggcctcgcgcatggcactggtggccacggcgcgcacctgggccttgtggcggcggcagagggcggcgtagcggcgcagggtggccagcaggcgctcggccgtctcctccggcatggagccggtggcgaagacgccctctcccgggcggatggcgtcgcgctcctggtgcatggtttcgagcgcgccgtcggcgtctggccgtgccagctccagacggacggcgttggtgcccacgtcaatggcggcgagtacgggcggaggggggcgagaaggcatgggtggttctcgccggagtctacggggctccggtggtaatcgcagcgggaaccgcaccggcaggttggcccctcgcttcagtgcgtgacagccctgtatcagttgctcagtcgaggaagcggcgttcccagcggcgcgctgcctcgggtgtgagtcccaggatggattcgccctctccccacagcgtccatggttccaggatacgagccagctcccggtagctggacagtgactcgccgtgctcgctgtcacctgtcgcgggcgcgtcgcccagcgtgacaacggcgcttgtcgcctccatcgtctgcacggtggtgctgggagcgttgatacgggagcggagttgggcggcccctccaagttggctcagcacgggggctcccaagaatgtcagccaggaggggcctcgaacgcgcgtgccaatgtgaagggacgtcatgccgagcctgaggacatccagccccggatagcgaaggcagtcgcgacgcacttgccggatgttggccgctacgtcgagggagccgttgaaggccaggcctgcgttgcccgaggaaaaggggaggggggcggcaagcgccatcagcagctcccgggtctgccgtggaccgtgccgttccaggtactcggttggaagccagaacgacacggcgctgacttcaccgagaccgctcacggaggttacgtcgacgcgttcacgtcccagatagtcaaagcggaaggacgcctctggggatgcgtcggaaagatggacgttggcccatggctcctcctgcatcccacgatgaacctccgcccagccctgcgagtccaggaggtgccactctccatcttcgccctcgtatgaggtcagagcgcgtgggcccacggtccgctggtagacctccagggcttgcagcaccgcggttgccacggcggaatgggcatgggggaggtagaagctcgcactgagccccgtggacacgcccggcgtatcgtctcggtcctgaggttggagccttggagggcgtgcgttcatggcagggttcccaggcggggtgtgacttggagcggggcctgctttggcttcagggcccgttggtacatcgcatcctgttgctggccctcgtggggatgtcctttggggtatcgaggccagttcgacgggcggttgggcgtcacgcagggaaacttgaagtcgtagatggccaggacctgcatctccgacccggtatggatgacgacgtccgggacaagcgttcccttcaattcactgccccgcccatgtctcagcagtgcgcgcacgtcctcttcccgcatgggttcccatctgcctgagtccgggttgtagcgatagcgtggttcgaggcgataacctcctggacggagttcgctcagccatttgtgtgcgcacgggagtgcgactttgtgcatctcggtgcccagttgcatcgcgagcgtaacggggcgcccctgcgcgtccaccgtgacctccgagcggcattcttccggagtcgggctcctgccgttgaacaacgcaatgagcacggtcgaacgcgcgtcgtcgacgcaggcttccagggcctcttcaatggcatcccgctcctccgccttcagcagtcgcagcgccgcgtcgcccgcggttccaatggaggccgccacccgcagggcccgggtgccagggaggacggcctcctcgcccgccattcgcgcgcacaccgccggattctgccggcacgcgctggtcgctgagtcgaagccgtagcgctccgggcgcgccgcgcaaccggcgaccaggccactgaccaccagcgtcatccacgtacgtcgcggcatgtcccctcccatgcagggccatggaggccacgcacacacggggatacgctaccgcttccgccgccggcccatgaagctggcgaagcgctccgcgaggcgggcgacggccagccccacgatgtccagcagccactgctggagtccggagcgcgcgcagtcctccaggtacacccgccgcgagccgcgcaggtgcttgtcgagccaccgctgcgcctgcgccgccacgccgggttcctccacctccaccagcgtatgcaggttcacacatgcgacagcgggtccagattgaagctccccaccagcagattctttccgtatcaccagcgccgacttcgcgtgcagcgcggagtccgtccactcgtggatgctcaccccggcgcagcaggaagtcgggcacaggcgcatggtcgcagagcgcacgaacaccacgtcactgcgcccggccagcatcagccgcaccgtcacgcctcgccgcgaggcgcgcttgagcgcccgcatgaagcccttgtccggcaggaagtacgcgtgcgccagcaccacctcgtgctccgcgccgtcaatcgcctggaggtaccgcttgcgcagccggtgcccacccgcgaagccggacaggaacagcttcaccgcgcccgactccagcgcggaggcccccgcgtgcagcgtggcccccagctgccggcagatgtcacctcgcagctccagcgccaggtcggcccagccgggctggtccccattcgccgcgtacgcgtccccgatgttgatgcctcccaggaacgccaccgagtcatcgacgaggagaatcttccggtggttgcgccaggagcggccggtgcacagggaggtgagcgggttgtacacgcgcaccttcgcccctgcggcctccagcgtctgcttgaggtgccggctggcgccaatgctgccccagccgtacaccaccaccttcaccgcgacgccccggtgcgccgcggccaccagcgcttcgaggaacctcgcgccaatgccatcccgctcgaaggtgtagacctccaggtgcacccgcacctgcgcggtggcaatggcctccagcatccgcgggtacgcctccgtcccgccgtcgagcagggtgacgcgctcctcacggacctcgttgaggggaaggcggagaccaggagcggtcaccggcggcagtgaggcttcggcgcgcatgagcgccttccaccctaccgctccaagcgtctcgacgggacagcctcaccgtgacatgggagccgtcccgccacgagccgtcatcgcccgtcgtgcttccgcgcgcccttgcccttgcccttgtgcttgcactcagtgccgtcccagtactggctcgggtggcagtgcttgctgctccgcttggacttcttcgacttgggcggacgcgagtcgtagtggtgatggtggaagcagccactgaaggtgaagagcgcgagaacggggaggaggagacgggctttcatcgtgcggggccaggacatgaatgctcggacccggcccggaggcgcgcggccacatcctcccatcgacgctgtgcgcttgcttcgatagcctgcgcgccgtgccccctgctgcgaagcccgttcgtcatcggaagattggtgcctaccgcgtactcggagagctgggacgtggtggcatggccctggtgtaccgaggcctgcacgagatgttgcagcgcgaagtcgccatcaaggaactgctcccggatggccagcgcgacagggagacgttgtcgcgtttccggcgcgaggcgctcgcgctcgcggccttccgtcaccagaacatcgtgacgctctacgacatggtggagaagggtgagagcctcttcatggtgatggagctggtggacggccccaccctccacacgctcatcaaggaaggcccgctgcccgcggatgtcaccggcgtcatcgccgcgcgcatcgccagcgcgctggaccacgcgcacttccgccacatcatccaccgcgacctcaagcccgccaacgtcatgctcaccaagtccggtgaggtgaagttgatggacttcggcatcgccaaggacgtgggcatggaggcgctcacccagcagggcatggcggtgggaacgccgtcgtacatgtccccggagcaggtgacgggcgtgccggtggatggccgcaccgacatcttctcgctcggcgtgctgctctacgaagccctctccggcgcgcggcccttccacggcaagacggcgggcgaggtcttcgcgaagattcgcgacggcaagtacacgccgctctccaaggtggcgcccaacgtccccgcgccgctggtgcgcatcatccagcgcgccatggaggtgaagccggaggaccgcttccccgacgccgccgccatgcgccgtgaactggacgtcttcctcgcgcaggaggtgcaggtgtcccacgcggcgctgctggtggccttcctgcgccaccgtcagaagctgacggagacggaggcccagcagctcatgcggccgcacgaactggacgccgcggtggaggtgttcgacacggggcgctcccgccagggcgggaagctgcggtgggccctggccgccgccatcgcgttgatgacggcggcgggcaccgggctctacttcacccaggcccagtgggcgccgctggtggagcagctcacccgctgaggccggcgggtggctcaggcctgctgcttggacttgtcgtgcgtgacggtgacgatggttccgatgccgccgcgcacgaagaagtcgcccaccacggtgagcttgcgcggctggatggccttgatgatgtcgtccgcgatggtgttggtgaccttctcgtggaaggccccctcattgcggtacgcccacatgtagagcttgaggctcttgagctcgatgcagctctggtccggcacgtaggtgattttgaaacgtgcgaagtccggctgaccggtgagcgggcagagacaggtgaactccgggacgtcgaacacgatttcgtagtcgcgatcggcggcggggttggggaaggtctgaagttccttggacggctgcgagggcatggcgctgtcgtctaccacaccaacgccgcgtgtcatccctcccttcgatgtccgcccgccaacgcgcccggcgtccaacaggggggaatcctgggggggggccggttgccgctcgggcggaggcccataatcaaggggagcctcttccccctgcccgagcacatgccgcttccctcggacgtcgaagatgcattatcgtgcctgccgctggcgctggttcgcgtcggtccggacctgcgcgtgcagtggtgcgaggaaggattcgcccgcaagacgggcgtggcgctgcacgccggtggcgacatgcgggacgccttggagcgcacccggagtctggacgccctggagcgcgccatccgggacggtgcgtcccataccggccacgtcatcacccgcgcgctgcgtcaggtccgggtgcaggtgaagcccgcctcggcgggcgaggcagcgggcgtctggttggtggtggagccctcgggcgtggacgacgagggggccttctcccaggcggtgcaggagattgcccgttcggtgggggagacgctggaggtggacagcgtctgcgccgccgccgtggtggccctggtccgctgcgcgcacgtgcgccgcgccgaggtctttctctgcgaagaggagggcgggagcctgcgccgggtggcggtgtcggacctggccggctcggagtcccccgaggcgaccttcgactcccagtcggacccgttccggcaggcgctggcgctgcgtcaggcgcagttgggcatccagcggggctatggggattccatgggctccattttcgccgctgtgccgctgtgcgcgccgcgccggacggtgggcctgctgctgctctacaaggaacagggcacgtccttctctgtgcgggagctggacttgtggagcgccgcggcgaaccagttggcggtggctgtggagaacgcgcgcctgctgcgcgaggccaaggcggcgctccaggtgcgcgaggagttcatctccatcgccagccacgagctgaagacgccgctcacgccgctgaagctgggcctcttcaccatggagcggcgcctgtcgtcgggccagccggtggacctggccacggtgctcaagtccaagcggcaggtggatcggctggtggggctggtggatgacctgctggacgcgtcgcgcctggacgcggggaggctggcactggacctggcgccgctggaggtggggcaactggtggcggaggtggtggaccacttccgcgcggccttcgagcggcccttcgccgtggaagtgccccgtgagcgcgtctgggtgcgcggggacagggacaggctggagcaggtgctggtgaacctgctggagaacgcgcacaagtacagcgcgccggaagagcccatcgtcgtgacggtggagcgctcccagggcgaggcgcgcatccacgtccaggaccacggcatcggcatcccgggcgcggaccagtcgcaggtgttccagcgcttctatcgggcgcgcaacgtgtcgcaccgccacttcggcggactggggctgggcctcttcatcagtcactccatcgcccggcttcacggcggcgcgctgtcgatgcgcagcgcggaagggaagggcagcaccttctcgctgagcctgcctcgcatggcgccgcacgacgtgaggcggctgccccaccggctgttgctgctggacgaggaccagacccaggaggccgcggcggagcaggtgctgctctccgagggcttcgaggtgctgacggcgcgcgacggcgccgaggcgctgcggcgagccacgcacctgccggtggacctcatcgtcctgtccaccagcgccacgcagggacagacgagcgtcttcctggagaccttcgccacgctgccgcgcgcgcggccggtgcccatcctgctggctggggatgagcgcccctggtgggcgcatgagggcacgtcgttgtgtacgcgcccctacaggcccgaggacctggtgacccgggtgcgcaacgcgctctccgtggagcggcggtccacggccgaggcgccgctggacctgctcagctcccggacgtgagcacgcggaagtccaccgggacgattcccgcccgggccaggacctcgcgcgcctgggggtggaggaaggtctccagttcgacctctcgctgggccgcgtagccgctcttcagcgtctccggccggtagcccgggtggcacatcagctcgatgacgccgtcctggggcagggcggcgagctccgaggcgaagcgctccagcgtccaatacgcctccgggcccgcatccccgacgaagt

SEQ ID NO: 1226 - DNA, 27707 bp, Myxococcus xanthus
aaagtcgggttccagctccacggcgcgctgcgccagccctcggctttcggctgcatcctgccccaacaggttccccaggcgggcgcagcgccaggcggcctcggcgttccggtcgtccagcgagcaggcgagccggtaggccgacatggcgccatgcgtgtccccatgccgctccatctcccgccctcgagcgacctcgatggtcgcccgctgcgagtcatgcccccggcgtgccttgaccaggagaagagcgacttcgcggttcttcgggtccatcgtctggacctgatggaagtcgtgataggcccgctcccagtcgccgctggcgatggcggccttgccccgggcaatcagctcggccagtcggcccgtgcgggccaggtagggatgccgggccaaccgggcctgccgctccgcgcggcgcgcttcggacgcgccatcatccggcggtggcgccagcggacgcgacggcggcggaatggatgaaggcccgctggacgccacgggcggacgaggcgccgggggtggcgatgaaagctgatgcaccggcggcggttctggcgtcagcaggtgctgcgcaggcgcggacggaggcggcgcggagggtggcggcggcgcggcggcgcgttcggcctgagccagtgccggattcgcgcgcaggtaggcctcccgcttgtcgggctgcatgagcacgttgtgcgcgtccgtgaggcgccggaagatgcgctccatgcgggcgcggaagctgcccaggttcttcccgaagtagcggtccggatggaagcggcgcgaagcgttgtaatacgcctgcttcacctccgacgcgggagccccgggcttcagccccaacacggcgaagtggtccatcgcgtcgagcgagcgctccagctcgatgatctccttcttccgctccggctcgaggtccacttcctcggccatggccgcgtccaccacgggcgcgggcgccccccgaggcaccacccgggcggggacgatggcgcccttggcccgcagcgccagcagcacggcgatggtgcgcggctcgcccagcttggagcgcgccagcacctggtcgatgcgctccacgcgccccacgagctggagcaccgagccctcttccgcggtgagctggagacgcgctgcatccagttggggcaccgtggcgatgtgatccgtcagggcccccagcccgatgatcgtgtttggcgcactcacagtgacagtccgaggaaagccttccggagtttccagactagggttccggacgcagggcgtcaaacgtccgtgaacccttccccatgcggtggaacgcggccacgccggtcagttggcggcgagcacgcgctcaagaatggacagaccttaatccaactcacgcaccgtgactatgaagggcggagcgaaaagcattgtgcggtcgcctgcgggattcaccagcagaccctcttcgtgcacttgggcgatgacgggcgccaccttgtgatccaactgcacgcccaccagcagcccctggccgcgcacggcctggatgcgacccgcaggcagccggccctggagttcacgcgcccgggcgagcagataggcgcccttctcctggacctcgtccaggaaaccgggacggcggaggatgcgcaccacggcattggcggcggccgcagccaccgggttgccaccaaaggtggagccgtgcgtgcccggcgtgaggctggcgcccagctcttccttgcagagcatggcgccaatcggcaggccgttgcccagcgccttcgccacactgatgccgtccgggacgatgccctcgtgcatgaagccgaacggcttgccagtgcggcccatgcccgtctggacttcgtccaccagcagcagcagcccgtgctcgtcacacagcgcgcgcagaccgacgaggaaacccaggggcgccatgcgcaccccgccctccccttggatgggctccacgaggatggcggcggtcgccgggcccacggccttgcgcaccgcttcgaggtcgccgtagggcacgtgggtgaagccggcgggcagcggctcgaagcccttctggtacttcgcctggccggtggcggtgacggtggccagggtgcggccgtggaagctgctgtcgaaggagatgacctcgaagcgctccggcgtgccgcggtccttcatcaccttgcgcgtcagcttgagcagcgcctcgttcgcctccgcgcccgagttgcagaagaacgcgcgtgacaggccggaccactcggtgagctgcgcggccaggtcaatctggggctgcgaatagaacacgttggagacgtgccacagtgaatccagttgcgccttcgcggcagccacgacttccgggtggcagtgtcccagcgcgcacgtggcgatgccgccaatcaggtccaggtactcgcggccatccatgtcccagacacgagccccctggccccgagccaggacgaagggcggctgcttgtagttctgcagcaggtggcgcttcgccttctggaccagggcgtcggtggaggagtcggacgatgcggagagggacggctcggattgcgacaaggcagtcatccttcgtgcggtacggtacccctccgcatatagcgcgctacaggatgtagcgcgacaggtcctcgtcctggacgatggcggccaggcgctcgcgcacgtaggcggcgtccacctggaaatcccgggggcccatctcactggcggagaaagacacctcgtccagcagtcgctccaggatggtgtgcagccgccgggcgccgatgttcgccgtgctctcgttggcctgctgggcgatgcgcgccagctccgtcaccgcgtcgtcggtgaaggacagacgcacaccttcggtgctgagcagggccgtgtactgtcgcaagagcgaattcttcggctcccggaggattcggaccaggtcctcgcccgtcaggggctccagctccacgcggatggggaagcggccctgcaattccgggatgaggtcgctgggcttggagacgtggaaggcgccagcggcgatgaagagcatgtggtccgtcttcaccacgccatacttggtgttgatggtggagccctcgacgatggggaggatgtcccgctggacgccctcccgggacacgtccgggccgcccccgcccttgccgccctcacggctggcaatcttgtcgatttcgtcgatgaagatgatgccgttcatctcggcgcgggccacggcctcgcgctggacgcggtcggggtccaccagcttggcggccttttccttgcgcaggagctgaagcgcctcgggcacgcgcacgcgacggcggcgcgtcttgttcatgcccggcacgttcttgaagaggtcctggaggttgacgccaatctcctccatgccctggccggagaagccccgcatgaaggtgggcgacgactccgcggtctccacctccacctccacgtcatccagggtgccggcgcggagctgggcgcggaacttctcgcgcgcgctgtcgctgacacgctggaccggtgggggtggcggtggggcgaagccgaacggcggcgtcgcggacgacgacttcacgccgccgccctgcatcagctcgatcaagcggtcctcggccagttcctcggcgcgggggccgaccttctcggtctcctcctcgcggaccagcgcgatggcggcctcgacgaggtcgcgaatcatcgactcgacgtcacggccgacgtagccgacctcggtgaacttggaggcctccaccttgacgaagggcgcctgggcgagcttcgccaggcggcgggcaatctccgtcttccccacgccggtggggccaatcatgatgatgttcttcgggtggatttcgtcgcgcagatcgtcatcgacctgctggcggcgccaccggttgcgcagggcaatggcgacggcgcgcttggcggcgttctgcccgacgatgtagcggtccagctcgctgacgacctcgcgaggcgtgaaggcggacaacttgcgcgattcggccacggggtgtgtctcctagagctcttcgatggagatgttggcgttggtgtagatgtcgatttcacccgcgatggtgagcgactggtgcaccacgtcgcgagcagacatctgcgtgtgcgccatgagggcgcgcgcggcggcgaacgcgtaggggccaccacttcccacggcggcgatgccgtagtcgggttcaatcacgtcacccgcgccggagaggatgaacgtcttctccttgtcggcgacgatgaggagcgcttccagccggcggaggaagcggtcggtgcgccagtccttgcccagctccacgcaggcgcgggccatgttcttctgatgctccttgagcttggcctcgaagcgctcgaagagcgtgaaagcgtccgcggtgctgccagcgaagccggcgagcacctggccttcgcccagccggcggaccttcttcgccgtgttcttcatcacggtcttttcgagggagacctggccgtcgctggcgatggcgaccttcccgtcacgccgcacgcagaggatggtggtgccgtggaacataggacccggggtttaacaagccgggcgcggcgtttccaaggaacagtgactggctgtctgctctcagacttcaaaaaggaagcacccacggcaccaccagcaccgccagcgcgacgatgagcacctggagcgggatgcccacccgggcatagtcggcgaaccggtagcccccagggctcatgaccagcgtgttcacgggcgacgcgatgggcgtggcgaacgccgccgacgcggtaatggccaccgccatcaacagcggctcgggccggagttccatggactccgcgatgcggagggccaccggggccacgaggacggcggtggcggtgttggagatgaacaggcccagggtggacgtcacgatggcgagcaccgccaatacggcgtgggggctggcgccagtgaagagccgctccaggcccgccaccgccagttgcgtcacgccggtccgctccagcgcggtggccagcgggaacattccggcgatgagcacgacactctcccaattgaccgtgcggtagacgtccgcggagcgcacgcaacccgtgagcaccatggccaccgccgcgagcagcaccgcgaccacgttgggcagcaggcccaaggccatcacggtcagcatcgccagggtgatgatgacggtgagcgtcgcccgccgaggatccgcgaggcggtcggtgcgcgggtcgggctcggcgagcagcacgaggtcctttcgggcctcggacaggttgcgcaggtgcttcttgcggcccttcacgagcagggtgtccccgcgccgcagcgtgaagtccttgagtgcgggggacgaggcatccaccacggcgtccgcgccccggcgaatcgcgagcaccgtggcccggaactggtcacgaaagcgcgcctgccggagcgtccggcccaccagcgccgagcggcggggaatcaccacctccgcgagcgactcctcgggtggcagcgacagcgactgcaaggacgggagccgctccaacccccagtgctccaccgtcgcgacgacggcatcctcatggccctggacgaccaggacctcgtccgctccgaagggacggtgcggaaccaccggatgcgcggcgcccatcaatgagatgcccaccacgttcactccgtgcgcggagcgcaggttggcctcgccgagcgtccggcccacgagcttcgagccacggggaacgcggagggcatgaagcaacgttcccaggccgtactccgtggcgaagtcctcgggcgacagcacggcctgcgccgcgacctgcccctgcgccgccgagggcagcaggtatttgccagcgaagatgaggaacagcatgcccacggcgagcatcaccacgccgatgggaaagaaggtgaagaagcggaacggctcatggcccgcgtcccggagcgccccactcacgatgaggttgggcggggtgctgatgagcgtcagcatgctgcccaggtgggcggcgaacgcgaagggcaggtagatgcgggcaggcgcgattccgcggcgaagggcgagcgttcccaccaccggcatcaggatggccacggtccccgtggagctcatgaaggcagacagcgcggcggtggccagcatcaccacggcgatggtgcgcccctccccttccccagcgaggtgccccagccgctgccccagccacccggccagtcctgtctccgtgatggcgccgccaatcacgaagagccccaccagcatgatgaccaccgggttgctgaaacccgcgagcgcatcatccacaggaacgatgtcgaagaggaggagcgacagcagcgcgagcaacgccacaatgtccagccgcacccggtcgctcacgaagagcaccagggagacggcgaggatgccaagggtgatgagcgcgggagaggtcacatccagcagctatgacacctcacgtagggattcgctacgcctacgcccagcccacgccccaggctcgacgtcacgaccgctggcgcgccaatagcaccggcaagccccactgcacgcccagatggacgaggcagagcgcggcgaggacgggcgcaacacaggacaggttcgcgatggcaattacggtccccgtcacgcggcgtcgcctggtcgccgagcactcacgcccgcggatgcgcggagtcgtagacctgctggagctgctcccacgtcacctgggtataccgctgcgtggtggacaagcttgaatggcccagcagctcctggatgctgcggatgtccgcgcccccgcccagcaggtgcgtggcgaaggagtgacgcatggcatgcgggctcaccttccgcgtcagcgcgcacttcagcacgtatgtatccaggtgccgcgcgatgctcctcggcgtcaggcgtcctccccggaagttgaggaacatcgcctctggcgcctggtccttccgaatcgtggccagcagctccccccgccgtgcgaggtacgcctccaacgctcggatggactgcgcgttcacgggcacgagccgctccttgctccccttgcccatcaccctgacgattcgcccgctgcggtcgatgtccagcaggtccaacccgcacaactcactgatacgcaggccgccgccgtagagcagctccagaatcgccctgtcccgcagcccgagcaccgtcttcacgtcgggcatgtccaggatggcgaaaacctcctccaccggcagcaccttgggcagcgtcttcggcagcttcgggctcttcaccagcttcgcggggctcgcgggcaacagcttctgccgaacgaggtacttgtagaacgacttgatgctcgccagccgccgcgcccggctcgccggggcgtggtccgtgctcaacgtgcccaggtagccacgaatcgccgcgtgcgtccccgacaggagcgacagcttcattcgctccaccaggtagcgctcgaagtccaccaggtcgatgaggtagttgcgcaccgtgtgcggggacgagcccttctcgtcctccaggtgggcgcggaacttctccagcagcggcgacaggctcgtcatcgaggacgagcctacgggccggagaaatcctggcaagattcgcggtgggcctacggcgccttggccggagccgcggcaggcgctgccgccgccggagccggttccgcctgggacggcaacagcgccaggcaggtgtcctgagacaaccagcccgcgtggcagaaccaggtcaacagcggaatccggacctgccagagcaacacgaaaaccaccgccagcgtgatggccagcttcgtccacccggacgcgccctccgcctcgtcgtcctcctgctgccggaccagcgccgagcgcaccatgtccaagcggtccacccgggcgttcgagggcagcttcggacggcgcgtcaccagcgaggacagctccggtgtcagcatcagccggtcattcagcgcccagcccgagccttccaacagcagcgccaggttgcgccggcgcagcttcagccagcccagaagtcctgccggggccatgacgacaatggcaatcagcgtcgccgcggagatgaggtccaccagcgtcagcgacttcacctgcgtcatgatgaacgcgaaggacgagcccagcgccgcagccgccaggccgcccgccgccacgatgcccgcgagcccgccgcctggaggtgctgcggctgctgcagcgggagccgcgcccgccgccggagaaggcgccaccggcggcgcattcgtcgcgttcgtgtagcccttctccagcgtcgaatcgaacgtcttctcgcccgccgacgccaggccctccaccttactggtgatgaattcgccgatgcgcgcgaagggcatggtcatcgactcccacagcgacacgggctgacgaaccacctgcgtcacgatggcgtcgctctccacgccgtccacgtcgtagaagacgccccgcttgcccaccgcgagctccgtgctccggccgctcgtcaccggcaccgccacttcatacccgggcgtcccgtccttcggcgccacctggacgtagaggatgcaggtggtccccagcgcggtgagcgcggagtgcgcggcccggttcgtcaccagcaccgacagcgtgtacttgcgcccgcccaggatgagcgtccccttctccaccagcgccaaccgcttgggcatgtagaggttgggcatgctgatgaagttgttcgcgaacagcagcagccagcgctggtagaggaccaaccgctccagctcgttgacggcatccagcgtgggcttgagcgcgaggtccgccgcgctcgccgcttccagggcatccaggtccgcgtccgaaaccgacggcagcgtgtccatcagcgtgcgcaccgggttcgcctcgagctgcgcctgccacgccagcacgccatccgccttcgccgccagcccccgccacgccgagtccgacagccgctgcgaatcccccgtcatcggcgtggcgacgtccgtgcggaacgcctccagcacctcgtacgcgggcccgcgcaggagacgggaccactccagcacacccgacgcatccggcggcgcgatgggcaggtcacccgccgccttccccagcgccgccatgtcgcccagtgcaccctccacccgctccgcgcgcaggcgcaggctcgccgccgcttcgggctgcgcggccaccagccggcactgcacgaagtacgcatccagcaacggcgccacgtcgcgcacgcgcttggctgtctccaggctgatgtcgccccagacgaacgccgcgccctgcttctcccggtgctcccgcagcttcgcgcgctcctcgcggaagcgtgccaccagcgccgcgtccacgcccgccttgcctgcccgattcgtcagcgcgggaaagctggccatcagctcctgggccaggggccgcaggtgctcggacaggtgctcaggagcgacgatgccatcgccgttctgcccggtctcgcgcagggccttctcgctctcgcgaacctgcgccagggagatgcgcccggcgtccgtcgccttcagcgtccggagaatcatctccgccgcgccgcgcaggggccgcgcctcctcgctgagcgcgttcaactccagcacgtcactggaagcatccgcgccgcgccggtccttgagctgtttggcggcccagtccaccgccgtgcgcacctccgccacgcggatgcggccgttgccgtccgcgtccatcaacgtcagcaggcgtggatcacagctcaagccctccaacgggcacgccgtggcaatccactgcgtttcggggatgcggatcgcctccaccagcacatcgaaggagggaatgtcgacctggagcgagccgccgtagcggcgatagatgagcgaagccatacaggcggcggaagtaagcacaccgcccgacgaatcgcacgatcctcaacaatcaaaagctacggcgtcgcggggacgctgtagatgccggccttcgggccctgcgtaatcgcgtacacggccagcgagtcattcttgcccccgaaggacaccggcacctggatgccctgatccagcgtcttccgcgcctgggtcttcacgtcgtacaccgccacatcgtaggtgtccgagtccatgcgggcatacgtgacgagcacccgctggccatcatcggacagcttgtagctgaagatgccttgcagccacgtgcgagggtccgcctgccggggcaggtccatggccatgaagtcacacgagcgtccattgcggatgcagttggagcggaacaccacctgcccgttgcccggcgtgaagccatagccaaagacgccctgctgcaccttcgccgcccgctcctcccccagggtgtacagcatcaggtccaccgaatacgcgggcttgaggatgcgcgagaggaacgccacatagcgcccgtccgagccccagacgaagttgggcacgcggccgcccacctgcttcgtcgtgccgtccggcagcgcggccaccgacatcagccccgcgttcgcagtcgagtcatacttctccaggaagcccaccgcctgcgagtccggcgagaaggccagcttctccacctgcacgcccagcttgcgccccgcgccccccgccgccgggcccaggtacaagtcccctggcacgttcggcttgccgttctccgtgcgcgccagccacttgccatcgggcgaaaaggcaaacacacccgaggccaccgccaaccgcttcgccttcagttcgggcagctccgccaagtacaagtcatacagcccccgcaccgactcgctgcgcacctggaaggccacgcgctgaccatccggggagacttcgtagtcccccacctggtcccccaccttcatgggcggcgcgtctggcttctccacggagatggccgccatgccccccgccgcggacagccggcgcttgaagagcagcgtcttgccgtccggcgtgaactgggcggtgctgacctccgccgccacgtccgtgaagggtcctgacggcagcgtgcccagcttcagcttgccgccatccacgtaggccagcttcgtcccgtccgggctgggcagcatgtagctgaccgccgtgcccagcacgacaggcgccgccttcgcgtcatccagcgacgccacgttcagcgcgcccgactgcgtcgccgggttgtagccagtgaggaagaggacgtacttcgagcccggcgccaccaactgtccgccggggacgttcgtcacgccctcgcccagcttgcgcggctcgccgccctccacgggcaccgcgtacagctcgcccagcaccatctgcggcggaatgccgtccagccggggcttctgcccgttgacgaggtacgtggcgaagcggccgtccgacgtcacccgcaggtccgtcacgcggcccgaggccaggagcgtgccctgccccgcgccgggggcaccgggcggaggtggcttctccgccgccgcggcggccttggcgcgccgcacgcccggggcctccgagccgccattttcgccctgcttgcagcccgtgcccgccatcaccagcgaggccatcaggcccgcggtccacagccgcccctgccgcatccgcatcatgcgctcctctgatccacgtgctcgggggcgcccgccgccgggacgcccgcatgcggcagccatgccgccaggtcctgcttcgctcgcgccgaatacgccgcgcgcttctccgccttcttcatccgcccggtcagcggcgaaaagatgccgaagctgatgttggagggctggtgcgggtagtccggcgggtgcgcttcgcccgtcacgtgccgcagcagcgcgcccatcgccgtggtggccggcggcggaacgaactccgtccccgtcagccgtgcgtgcagcgccaacgccaccaggtatccacatgccgcgctctccacgtagccctccacgccggagatctgccccgcgaagtagagccggggctccgtcttcagcgacaagtccttcgccagcagccggggcgagtcgatgaaggtgttccggtggatctgccccatccggaggaactccgcttgctgaagtccggggatgaagctgctgaagatgcgcttctgttcaccccaggtcagccgcgtctggaagcccaccatgttccaggacgtgccgcccacgtcctccatgcgcagctgcaccaccgcgtagggctcctggcccgtgcgcgggtccctcaggcccaccggcttcatgggcccataggccagggtgtcgtcgccacgctcggccatcacttcaatgggcagacacccttcgaagtacttgggttcctcgaaagcgtgcggcaccaccttctgacccgccttcacctcggcgatgaagcggtagtactcgtccttcgtcatcggaaggttgaggtagtcgtccccgccgcccttgccgtagcggctctggcggaacgccacgttcatgtcgatggagtccgccgacaggatgggcgcgatggagtcatagaagtagagccgggtgcccacgtggcgctccagctcccgcgtcagcgcatccgacgtgagcggtcccgtggcaatcaccaccgggccgtcctcgggcagctgctccacctcgccggccaccagctccacgccgggctggcgcagcagggactccgtaatcgcggcggagaagcgctcgcgctccaccgccagcgcgtcccccgcgggcacccggttcgcgtccgccgcgctcagcaccaacgagcccagcgcgcgcagctccgcgtgcagcaggccaatggcgctctccgggttgtccgagcgcagcgagttgctgcacaccagctccgccagcgtgtccgacttgtgcgcgggagaacgcttctggggcttcatctcccgcagcaccaccggcaccccgcggcgggagagctggtaggcgcactccgtccccgccaggccgccgccaatcaccgtcacccgctgcttctgatccgccatccgcttcctccaggcccgcgccgcgcggcgtccagcaactgttagcaggactgacacgccctggcccagcgtcgattcaaccgtgtgtgaccccacgctctcgcaccggattcacgcatggccggctgcccaccggcccacctccgcctcccgctggaaggcgcggtttccctacctgggttgcacccctacgtttctcgcgttcgccgctcgggggcggcctgcatccgggcgagcgccactgaactcgtagactgggaggaccgaagccatggcgacccgccgaaccctggacctgaaccggatccgcgaactcctgcagcgccgccgcagggagatcctcagcgccaacgagggggcgcaccgcgagctcaccgccctgaagaaccaggagcgggaccccgaatacgaagaaaacgcccagtccgagctggccgactacaccctctccagtctgatggaatcgcagcggcgcgaaatcatgctcatcgacgcggcgctgcgccgaatggacatgggcgtgttcggcgagtgcgtggactgcggcttcgagattcccatcgaacgcctggaggccctgcccttcgccatccgctgcgaggaggacgccagcatccacgaactcgagacgcgcggcggccccatggccagcccgtctctctgaggcggtgcgagcgcgcgctcccggtgccgccccgggggcgtgctactcgccctctttctggagcaccacgaagcggtagttctccagctcgttctgccccgccgtgtagagcacggtgaggagcatgtcgtagggaatcttcttgtccgcgatgacggacagctccccgctgaagggcgccgacgggttgcgcgcggcgatgtacttcagcttctccacttccttcttgagctgcgcgtccagcggcagcaccagccgcccctggagcttgtcggccgggaactggccgttctgcagccgtaggacctcccgctcacccaccagcacgttcctgggcgtgatggtgacggccacggtgtccttgggcgtggcgcgcgtggaggacacgggcggacgcacgtcctcggacgccgtcaccgccgcggacgacgaggcgaaggacttgagcaggaacaccaggaggatggtcatcatgtccatcatcgcggtgatgttcagctccttgatctcccccgccgcctcgcgctccttgcgcttcttgcgcgccagggcccggcggtagctcagccgcgccacggcttccgcgtcgggcgtgtccacggcggatgtcgtcgggtcggccatggctcagatggctcccagggtgacgtccgggaacagcagccggcgctcgcggccctgcgtctcacggatggcgtccagcgtctgcgtcagcgtctcgtaggggacgtccgggtccgcgcccacgatgaccttcgtctccttggggaaagcggacttgatctccaccatcttcgcgttgagcgcggagaagtcgtgcgcgccgtccgccttcacggggatggtgggcgtacccgcctctccaaggatggcgttctcgctgctgacgaagtgccccttcttggagatgagcacggacagcgtcagcttcggcgcatcgtccgggttctcctgggccatgcccgtcgtcggcgcaccataggcgggggcgttgacgttgatgatgccgaacgtcgccaggccggtgatggacagcagcatgaagatgatgaggttcatgaggatgtcgaggtacgggacgatgttcagctcgcccgcctcttcttcctcacggaccttcagcttgcgccgggagtagtggaacgccatggccgcgtgcccttgcgcgctacgaagcgcgcgcctcgagctccgtggtcgccgggtccacggaaccgcggcgcgacaggaggttctccagcttgagcgcgttgagctccagcccctccaccatgctcttcgcgtacgacgtgaggaacaggtggaagatgatgcagatgacggcgatggagagcgcgaaggcggtgttgttcatcgccttggagatgccgtccgacagcagcacctgcttctgctccgccggcacgttgcccagcgcctggaaggtgccgatgaggccgaagatggtgcccaccaggcccaccagcgtggcgatgttcgccagggaccacagccaggggatgcgcttggacacgttcgggctgtgctcgacgatggcctcctccaccgccttggagacctcaatctcaccgcggttggcgttcaccaggcccgcgcggaccaccttggccagcggcgcgttgggcgccatggcgcacaccttcaccgcgcggtccaggttgccgctgcgcaccagcttggcgatctgctccatgaagggcggcgcgttcaggttgtagcggaacaccagggtgacgatgcgctccagcgcgaccgccagcgagcacgccagccagaacaggttcacgaacatgaacggtccgccatccttgaagaacttgatgacggagtccgtgacgcccagcttgcccccttccgtggccgcgagggtcacgtccagcagcagctcgcttaccgagggaatcattgcgcccagagtcctttcgacgcccgccccccggggcgcgcccatccggaggcgggcacccgttcgacgttcccggggagggagcagcctggacttctagggcgggcccgccaaggctgtcaagccgaggacgggccatgcccatgtaactactgggctttcaagcagccgaggaggcttcgggtgacccacccgggcccccgggctgctcggtgatttcgcgccggtagtcgcactccttgttggggcacgccacgtacgggccgtcccgcttggagaacttctggagcaggtagggggacgcacaggtggggcacggctcggccagcggccggtcccaggcagcgaacttgcagtccgggtagcggttgcagccgaagaaaatcttcccgcggccactgcggcgctccgtcaggtagccctccttgcactccgggcacgacacgccaatggagatgggcttggacgtcttgcagtccgggtagccggaacaggccaggaagcgcccgaagcggccccgcttgatgaccatgggcttggtgcacttctcgcaaacctcgtcggtggtctcctcctccaccatgacgatcttgccctcggcgtcccgcttgaagtccttcgtgttcttgcagtccgggtagttcgagcacgcgaggaagtgccccatcttcccgaacttgatgacgaagaggttgccgcacttctcgcaggggatgtccgtcttgatctcctcccgcttgacgtcgcgcatctccgcttcggccttctcgagcgtctccttgaagggcccgtagaagtcgtgcagcacggacttccagttggcgccgccctcggagatctggtcgagcttctcctccatcgtcgccgtgaaggtgacgtccagctcgtgggggaagtgcttgaccagcatctcgttggtcatgttccccaggtccgtgggccggaagcggccctccagcttctccacgtacttcttgtcctggatggtggagagaatggcggcgtaggtggacgggcggccaatgccgcgctcttccagctccttcaccagcgtggcctcgctgaagcgcgggggcggctgggtgaagtgctgctcgtggagcagcttctggaggttcagcgcgtcaccgtcgttgagcaccggcagctcgcccaccgcgtcggcgccctcggcgttctcgtcaccggcggccttggccttctccttctccgcctcttcctccggcgtcaggccagcaccgtagaccgccaggtagccggcgaacttcagcgtgctgccggaggcgcggaaggtggcccggcctgcggcgatgtccgcgctggtctggtcatagacggcgggcttcatctgacacgcgacgaagcgtttccagatgagctcgtagaggcggtacatgtcctcctcgcccatggcctcgaagaagggcttcacccgctccggcgggtactccagcgacgtgggccggatggcctcgtgcgcgtcctgggcgctcttcttgctgcggtacaccatgggctcgtcgggcaggaagtccttgccgtacttgccgtcgatgaactcgcgcacctgcttcaccgcgtcgtcggacagacgggtggagtccgtacgcatgtacgtgatgagcgccgtctggccctcgtcacccagcggcacgccttcgtagaggcgctgcgccagcgtcatcgtcttcttcgcggtgaaggacagccggttggccgcctcctgctggagcttggaggtgatgaacggcgcgggcgcgttgcggcggcgctcgcggcggtcgaccttggccaccgagaagctggccgtctggagctcggcgaccaggctctccgtgaagacgcgctccttcagctccaccttcttgccgtccagcttggacagcttggccttgaacggcggcgggccagcggggccctccagcagcgcgtccagcgtccagtactcctcggggacgaaggccttgatttcgtcctcgcgctccacgatgaggcgcaccgccacggactgaacgcggcccgcggacagcccccggcgcaccttcttccagagcagcggggagatttgataccccaccagccggtcgaggatgcggcgcgtctgctgcgagtcgtagttgtcctggttgagctggcgcggctgcgcgatggcttcctggatggccttcttggtgatttcgttgaaggtcactcggagcgcgtcgggatgcgccagctcctccttgatgtgccacgcaatggcctcgccctcgcggtcggggtccgtggccaggaagacgcggtcggccgacttcgccatcttcttgagctcgttgaggaccttctccttgcccttgatgaccgtgtactcgggctggaagtcgtgctccacgtcgacgcccatcttgctcttgggcaggtccttcacgtggcccacggaggccttcaccgtgtagccggagcccaggtacttcttgatggtcttcgccttggcgggagactccacgacgaccaggtagtgcgggcccttgccacggggcgtggcctcctcctccgcgtctgcttccacggtggggagttcgtcctcgtcccccttcttggtgcggcggcgggccgccgtcttcttggcggcggtcttcttcttggccgcaggcttcttcttggcggccttcttggcggcggccttcttggcgggcgccttctcctcggccgcctcagtctcttccaccttcttcttcgtccgcgtggccatgactctcctacctagattctctcgtacagccttccggggtgctggatgaccagccccgtcaattccaactccaccagcgcgctggcgagcgccgccggtgagaaggtgctgccgaccagcacctcgtcgaagctccggggaacccggtccaacatcgcgaaggccccccttcgcttccgcggagaggtcctcccatgagcccatcgtcccaggaggaaccgccgccagagggtccactttcagcaccctccacacatcatccgggcccaggcaaaccgccgcctccccgttccgcagcaatgcgttgcagccggccgcctcctcctggcgtacgtcaccgggcatcgcgaataccggccgcccctgcgcccgccccgcctccgccgtatacagactccccgaatccttccccgccctcagcaccaagactgcgtcggatgccccggagatgagccggttgcgccggggaaacgtcgtggtgctcgcccggacgccgggaggcagctcgctgaagaacacgccccctcggtccaggaaatgaggaagcaggcgggcttgcgccgtgtcgagtgcatccagggcggaccccaggaaggcccacgtctctcccccctcatccagcgcgccccagtgacaggcccggtccacccccgacgccgcccctgacaccacccccacccccgacgccgccacctgccgggcgaagcgccgcgcgaacggcaggaagccctgatccggatggcggctgcctaccatggccagccgacgccgcggcagccccggcacgccccggtagaagagcaccggcggcgcatcctccacctccgccagccgctctggataggccgcctgcccctggaacgccaccttcatgcccgacgcccggcaggcctcccacacccgccacgccaccggcgccaggcgctctacggaggcgagcttgcgacgaacctgtgaggaaaccggcgcctgggacacccagtctcgcactggagtcgcggcgagcggcgcgaggcttccgtccgcgaacgcgcgcagggcgaccagcgtcctcggccccaggccgggaacggcccagagcgcgaggcatgcctgctgctccgccgtgaggatgtccgtctcagcgtccgccatacccgtcccccgctcgatacccacctatatgaaggtggggccgctgggaggggcgcgacacataaacaccggaccgccaccggtcaagcactcagcccctccatccgaggggcccattgcatttttcctgccgcgccgctcagcggctggccgagggcgacgcgcccgcggacatgtgggcgcggtcgccggggaccagctcctccagggagcgggtcatgaggcagttggaggtacgctccttgacctcggtcaccatgcacgcgccgatgctccgccaggggaaggactgctcctccttggacggcttgcgcacgtcgtggcccagcacgtggcgggacgggtcccccttgcggaggatgttgaaggtgttgcccagctccacgccgtccgcgctgcccttgtccacgacgatgctgtggttctcacccagcaccgtgaggtacggcaccagcgcggtgatgacggtgccgtccacctgcttcgcgttcggcttcggcgccacgcgctcggtgaggcgctcacccacggggcccaccaggtcgccacgctcgatgccgtcccacgtgtccatgatctgcgcggtgacgatgccgtcgcccacgcgctgcacgcgcagggtgcccacgaagtcggtgaggaagcccagcgggcgcccggtcaccgggtgcttcacggcctgggtggtgtggtagacgacgtagcggtcccccaccttcacgtcacccttccgcttgaagcgcacgtagacgctgtccgggaaggagagcatcaccgcgttggagggcgaaccctcgatgcggccggcctcgtccagttcgcgctgggtgacgaagcccgcgtcgtcacggggacggaatggacaggtcgacgccaatcttgcccgtcacgatgacctggtcgttggaggtcatctccatgggggccgtcacgtcgccctcgtcgaccaccatctccgtcacctgggtggggacctcctcgcccgcggcgaagaagcgcacctgattgccggggtagatccagtgcgggttggcgatctccgggttgtaggaccagaccttgggccagtaccaggggctgcccaggtaacgctgggacaagtcccacagcgtgtcaccggactccacggagtgaacctcaccgggagcgctctcacggccccggggcgcgccgggcggcatggcgacggaggtcggcggcgcggaatcgggcgcctcgtccatcacctcggcgccgcccatctccccgcccgtgtcctgctcttcctcgttctcctgctgggcgtacgcggttggcgcgacggcgaggctcaacatcagcgaggtgagaatccgggagcgcatcgcgggacgtcctttcgaaagaagcatcactgggggagcgcggcgagccgctgttccgcctgggtagcagccgccgtccccgggaactgggtgacgacgcgggtgtagagcaccttggcatccgcggactgattgagccgcatccggcactcggcgagccggagcatgccgtccagcatggcgtccccggcgggatacttgtcgatgagccgctcgaacgtcttcgcggcgcccttgaactcgttgaggccaatctggcccaacccgctgaaatagagcgcgttgtcggcgcgcgggtgacgcgggttctcatcagcgaagcggcgcagcttctccaccccgccctccacgttgccggtgcgcagcatgttcacggccttgtcgaactccgcgtcgagcacgtcggggtcctgctgctcccccgcgtcctcgttcgacgcaaccatggtcgcggccgacgcggcgctcgccgacacggcggacccttcgtccggcgcggggctgatgaacatctccatctgctcgtcgtccggctccatcaccgccacggcggtgggcagcttcggcgcgggctcatggcgcggcttgagcttcaccaccgccagctccggcgtggcgcccagcgactcctgcgcggacgcctccaccttcaccggaatgggacgcgctgacgggccctcactcgaagcccccgcgcgcgacacggcgtcgtgcgcctccaaccgggccacccgctccaccagccgttcctgggacgcgcgcagcgtgcgcagttcagagcgcagcgcactcacctccgcctccgaggaagcggtggtggcgcaagcgcccagcgcacacaggggcgcggcggcgagcagacggaagatgacggagcgcgcgggcacgggcctttttcagcagaggggtccccccgaggataggaaggcccgtcggagagcgtcaagaaatcggccccacacaccgggtggctagaagcggtgtaccacgtaattgaggtgccgccccgtccgccccgcgtcccgccggtgggagaagaagcgcgtgggctcacacgccgtacaggcctgtagcacatcgacgtgggccagcttgagccccgcccccaccaacgtctgacgcaccgcgcgggtcaggtccagccgcggcttgccttccacccaccgcaccacttcatccccgaagcgcgcgcggaagcgctgcgccagctcctccgacacctcgtagcaacaaacctggatcgacggccccaccaccgccagcagccgctccggcctcgcaccgcgcgccaccagcacctccacggcgcgcgcgctgatgtccgcgtccgtcccccgccagccggagtgcaccgccgccacgccgcgaccatccgggtccaccagcagcaccggcacgcagtccgccgtgcccaccgccacccagctccccggtgactgcgtccacagtccgtccgcctcgccctccgtggggcgcagcccctgggccccctccccgctccgggcctccaccacgcgatcaccgtgcacctgcgacacgcggctcagcgcttcgagcggcgcgccagcggcctgtgcaaggcggctgtggttctcctccacgcgcgcccgctcgtcgcccacggagaaacccaggttgagtgacgcgtagggcccctccgaacaaccgcccgcgcgggtggtgaagccgtgcggcaccggcaacagcgcggaggtgagaaactcggtcgacatggaatctccaggaatccacctgattgatgcatcaggaggtgatccagcgtcagcgcaatcgtaggatgatttcgccgcttcgtttgacaggtagcgtcagccacctgacaattcatggaccgtccaaactccgtgaaaccagtccgaacctccgcgctcgagagccgcgagcacccgtatgcccctgggtcccgacactgttggtcgcaagctgctgtggagcatcgccctgcccgggctgctcgtggcgctgctgggcgtcggccacttctggcgtgaggcgcgggtcgcggtccaggacgccacccaggtggagtcgctggcgctggcggagttcgtcgcatccaccttcaccctcccgcaggcacgcggggctccggcccatggcgcggtgacggaggtgatgcgctccgacacccggctcttccgctcggtggaggacgtccgggtgctgacgccggatgggcgcatcctctggtcccgccggtcgggtgaagaaggcacgacgcacccggaggccgcgcggctgacggcccctggcccggagcgggcgcgctcggtggcgcagatgacggaggtcatccgtcccctcggcgggcccgagtgcgccggctgccacacctccggcgacgtgccgggcgccagcatcctgcagctgcggatggcggagccggcgctccaccagcagctgtcgtccgtgttcggcgcggcgctcggctccatgggcctgttcgtggtgctgctggcgctcatcaccgggctggcgctgcacttcgtcctcacccgcccgctgcgcaagctgagcgtggccatgcggcgcgcggaggcaggcgacctgctggtgcgcgcggaggcgcgaggcaccgacgagctcgcgcagctgggctcggccttcaaccagatgctggcgcggctcacctccatgaaggcggaggagatcgacacccaccgcgacctggagctggtgaaggagaagctggccctcaaggacgagttggaggaccgcctcaaggagctgtcgctgctcttcgacgtggcgcgctcgctcaacgccacgctggagctggatgagctgctggacgccgtcacccggctggtgaccgagcggctgcgcatccccgagttctccatcatgttgatgaacccggagagcctgctggaaatcaagcacgcctggccggagggccgcggcgcggagggcctcaccttcgcgctgggcgaaggcgcctgcgggcgcgcggcggagacgcgcaagtcggtgtacctgccggacacgtcggaccgctccagcgtgttcgccaagccggacctggtgaagggcgggctcaacagcggcgcgctgctggcggcgcccatggtgcacatggagacgctgctgggcgtgatgaacttccagcgccccgaggtggccagcttctccgcggaggaaatcgagctgctcaacgcggtggcggacgtggtggccacggcggtgaagaacgcccggctgcacgcggagacggtgaagctcaccatgacggacccgctcaccggcgtgcccaaccgccgccacctcttccagcgcatggagctggagctggcgcgttcgaaccgcttcggcaccccgctggcgctgctcatggtggacgtggaccacttcaagcgcatcaacgacctggccggccaccgcgtgggtgacgagacgctgcgccgggtgtgcgacgtgctgcggctgcgcgtgcgcaaggtggacacgctggcgcgctacggcggcgaggagttcgtcatcctcctgccccagacgaacaaggcggaggccatggaggtcgcggagaagctgcgccgcgccgtggcggagtccgtggagctggtccagccgggcctgccgggcaaccacgtcacggtgtccattggcgcgtcgcacttcccctccgacgcctccgcccaggaagagctggtggactgcgcggacgcggcgctctatttcagcaagcgcaccggccggaaccgcaccacccagtacgaggccggcatggagctgcacccgggccgcgagcggggcccgcacacgcccacggccgagcctcccgccgtgactgccgcccccaatcctccgggtggcgtggccaaggcgtaggcgctcagcggctcacgagcgtctgcgccgtgggcagcagcaggtccgcccactcctcatagccatcggccgacggatggaagccgtcgtccgagaagaagtgggggctcttgggaatcatgtccttgctcgccgtgaagaggtccacgtggtgcatgccgtgcacccgggccacctccgcgatggcggcgttgaagggctcgatgcggccttcgtacagcgccgcgggcaccagccgcgccacgggggccagcgccaggtccgcgaggttcaccaccaccagcggcgctccggtctgcttcaaccttcgcgcgatgcggtccaggtcgtcttggaagtcctccacgggcgtgccgcgccagaggtcattcgtcccgatgcccagcgtcaccagcgtgggctgcgcggccacggcgcgcttcacctgccccgtgaagacgtcacggatgcgcgcgccgctctgccccaggttggtgaggcccacgggcaggccaacagcgctcagccgggaggcgaggcgctcgggatagccgcctcctcgcgccgcccccacgcccacggccgtgctgtctccaagcgcgacgtagttgacgctcatccgccgctcccacgcgccggactcacggcacccgcagggcgcgcaggttgcgagccccgcccggcgccgtcacgcgcagcagcaaggtgctcccggactcggcgcccttgatgatgcgggccagggcgtccgcgttctccaccttcttgcggttggcctcgatgacgaccatgccgggctccaactgcgcgcggtccgctggcgagccgggcaccacgtcggtgatgagcgcgccgctgctgtccgtgaagccggcctgctgcgcggtgcgcgcatccaggttctggaggctgacgcccacgcgccgggagctctcctgctggtcctccggccgctgcttccccgaggccacgccctccaggtctggccgcgtaccgagcgtcaccttcacgtcctgcttcttgccgtcgcggtagagcgtcaacgtggaggtgcttccgggacgcttgagcgccacggtgcgcgtcagctcgccgctggaggtgacggtccggccgtcgatggcgatgacgacgtcatcctgcttcaggcccgccttcgccgcgggagacgacggcatcacctgcgtgaggatggcgccttgattcacggggagcttgagcgcgctggccaggtcccgcgtcaagtcctggatgcccacgcccagccatgcgcgcgtgacggagccttccttctccaactgcggcagcagtgaaccgatgagattgctgggcaccgcgaagccgatgccggagccaccgccgacgatggcggtgttgatgcccaccacttcgcccttcatgttgaagagcgggccgcccgagttgcccgggttgatggccgcgtccgtctgaaggaactcgtcgtactggctggcgccaatctcacgcgccctcgcggagacgatgcccaggctgacgctggaggccagaccgaaggggttgccaatggccaccacccagtcccccacgcgcaatgcatccgagtcgcccagcttcacggtgggcaggttctccaccttctccttgagccgcacgagcgccacgtccgtgagcggatcacgccccaccacttcgccgctgaagctgcgtccgtcatccaggcggatggtgatgctgacggcatcctccaccacgtggttgttggtgaggacgacgcccttcgggtcgatgatgaagccggaccctgccccttggcgcagcggctcgcggcgcggcctgccgccctcgcggcctccaccgaagaagcgctcgaagagcgggttgtcctccatcccacgcggaacgccgccccctcgagcctgcacgtccacgttgaccaccgccgacttcaccgactccaccagcggcgccagcgacggaagcgcctgggcctcccgtgtcgcgggctggaggacgttcccggcgcccggctgggtggccgcgggcggcgactttggcgcctgcgagacagcagcagcggggggcaacgcgaccaggagcgcggcgacgagcgccttccggaacgagacggtcgaacggttcatatgcagaccaagctaaagccgaaaaccagccccgcaagccaaaccgtctgacgtggcgacaggaggacacatcaccccaccctactcccccctggcctcaggcaggcagatagaggcggtagtccagctctggatagaggttgtcccgcccctccacgagagagagccagccctcgtccagactgccgccgcgtagctgctcgtgcaggcgctggaagcgcaggatgtgctcgcgcgtgcggcgctgggcgtactccaccatggtgcccgtcttcatgatgaaggcccagtcggaggactgggcgagcagcagctccctggccgcctgattgagcgcgcgacgttgcagctcaccggcatccgggaagtcacgcgccagttccaccatctgcttcgcgcagtgattgaggtggcggtagatccaatcattgctgccgtcgagccacatgttggcgtaaccgcccgcgccccacgaggacagcggcggcgtcgccacctgattctccgggtgctcccgcaggtcatccaacggcgtcaccagccggaacgtcttctggtcatacgcgaccttgcggatgaggaagtcgaggaactggggcccctcgaaccaccagtggccgaagagctcggcgtcatagggcgcgacgaccaccggctccctgccgcccaggcgcgaggccaggtcttcaatctgccgttggcggttgaagaggaagttgcccgcatgcaccgaggcccgctcacgcgcggcgagcggatcataggggcgcttctcgttcgtcttcccggtgatgcggaagtacttgaagccggtgttcttgcgctcgccggtgggctggatgaacgggcggatgtagtccaggtccaggtcccagccgatgtcccggtagaactcgcggtagtccgggtcgcccgggtagccgtgctcggtgctccacacctgctggctgctctccgggtctcgggcatacgcggcgacgcccgcctcggtgaagacgggtgcgtaggggccatgcaggggccggggcacggcgt

SEQ ID NO: 1227 - DNA, 27490 bp, Myxococcus xanthus
  unsure (1)..(27490): unsure at all n locations
tctaaggttcactccgcaggccggcgcttcctgaagcggcttggcgtctccctgttgatggccctcctcttcggcggcgtgctggggctgctcgtgtacctgcgccccacaggcatcgtgccgcccaaggacccgccgtcggcctgggtcccctccgcggcggtggatgccgcgcaggcctggctggaaggctgggagcgtgtcacctacgactggcgcgtgcgggaactgggagagcgctccgagcgtcccgacgaggccgtcgtcatcgccatcgacgacgagacgctggccgaggcccgccaggatgtgcgccctggcgtcgccacgcagccctggccgcgccagctcgtgggccgcatggtgcaccggctggtccaggagggggcgctgctggtgctcgtggacttgcccttcacggacctgagccccaacgcctgtgccgaagcctcgcccgcgtcgctctcctgcgatgacgcggccttcgccgcgcagttggcgaaggacccgggccgggcgctgctgtcattcacctgggaagcgcagggcccccgggtgctgccccccgccaaccgcctgtggccgtaccgcgtgaagctgggtgtctacgacgcgtccgacgcggcctccctgcgcgcgcaggccgtgctcgcggcgcagcgtcccgccttcatcatccccgcgggcagccaggtggaggtgtgggggggcgccatggacgcagcggacggcaaggcgctgggctcgcgcctgggcgccaccgcgcacgtcatcgaggagcgccgcgccgcggatgacagctaccgcgtgggccccacggagctcttcgtcgcgctggcggaagtgcaggtggagggactggacgcggcgaacctcatcgagttgcgccaggttcagcaccccgtggtgccgctgctgagcggcagcgcggggttcggtgcatccacgctcgtggcgggccaggacgggcgcgtgcgcgccgtggcgcacctcatgagctacaccgtgcggggcaagcgccacatcctgccgtcgctgcccctggccgcggccatgcggctcgccggtacgcgctcgcttcgctacgcggacggcaagctgcacgtgggggaccagtacgcgttcccgatgagcgcctcgggcctgagcctgctgcgctgggatgcgcccaacgcgggccggggctcacgcggctcgctggcgcgctccatccgcgcgtggaatgtgctcctcaacgtcttcgacgtggcggacgagcgccccgcgcgcttcgagaatgacctggaaggccgcaccgtcgtcctcacgcggaccgccggcgagtccgcacacctgcgttccacgcccctggggccggagacgccggggggcgcgattctggggcaggcgctggccaacatcctccgttcggagggcattacccgcgcggcgccagatttggacctgctcctcacggtggggctggccttcctcggcgccttcctggcgctgtcgctcagcttcctgctgcgctcggtgcgcggcgccgtgctctacgtgggcttcctggtggcggcgggcgcgggctacgccttcggagccgcgtacgtcttcgtcgaacagcggctgtgggtggccatggccgggccgctgctggccatggtgggcgccttcgtcgccaccatccgctacgcctacgggacggagcggcagattcgcgacttcgtgcacaacgcgctcggccgctacgtcagcccggacgtggcccgcctggtggcgcgagacttgagcctgatgcgccccgagcgccggaagatgtccgtgtacgtctgtgacatcgaaggcttcacgcggctgtcggaaagcatgccgcccgagcaactggtgggcctcttcaacgcgtacctcaccgagatttccgcggtggtgcggtccacggcggggcaggtggacaagtacatcggcgactcggtgatggccttctggggcgcgccggtgcgcacggaccgccacgcgcacctggcctgcgaggcggcgctgaagatgcgggaggtgctgaccgagcgccagtccgcctgggagaagaagtacggccgccgcctcagcttccgcgcggccgtggacaccggggagctggtggtgggcgacctgggcagcgagatgaagtccaactacaccgtgctcggagacgccgtggggctggcctcgcggctggaggccatcaacaaggtgtacggcacctacgtgctggccggggacaccaccgcgcagctcgccagcggcagctacgtcttccgcgtggtggacctggtgcgcttcaagggccggccgcagccggtgcgcgtgcatgagctggtggcgcgccgcggagaaatcacgccccgcatgcaggagcagctcgcgctccacgagcaggccctcaccgcctaccaccagcgccgcttcgcggaggcgcatgcgctcttcgagcgcgcttcccacgagtaccaggacaccgtcgccgcgctctacgccggccgctgcgcccgcttcctcgtcacgccgccgcccgcggactgggacggcgtgcacggcatggaggagggcgagccctctgccgcggcggcgtgagtcattcctcgccgtcgtccgagtccggctggccgaagagctccttcacgggggcgtccttcgcgatgtgctccgccaccacgcggcgcatcttctcagaagtcatcgccgagtagtacacctctcccggccagcccatgagctggtagtcctcgggagagagcgggtctctcttgcggccggtgtcctcacggacgacgacgttgggccccatgtggcagaagccgtagcagccgccgcggtacagctcgcagcgcggcaccaacccctggccagagagggcgtcccgggcctcggcgtagacggcgtccgcgccgcccgccttgcaactggagcccttgcacaccgacaagcggtagcgcttcacggcggcgtctccgggaggccgccatcaagcgtattgaagaggttcagcttcaccaccagccccctgaaaaagcgccggcccgccttccgcttcaatgcgggagggcgggccgggaatccgggtgagaccgctacggcctcactgggaatctggactcacttgatgaacttcgtcacctggatggggccctgctgcgtgacgaccgcctggtggcccgcctgggcccccgcgggcagcgccttgccgtggccgccgtgctctccgtgcggcagcttcagctccaccaggccctcgccgatgcgagtgtgcgcttccttgtggacgtggtgcggctcctcggagccctcgcgcttgttccacgggtccgacgggtgggacaccggcgcgcccttgagcagcttcggaatgtcgtagacgaagttctgccgcgtgtactcgggtggggtgtgcgtgtaggtgtccatgcggatggcgtccttggggcacgcatccacgcagaggccgcacacgatgcaccgcagctcgtcgatgacgaactgggtggggtacttctcgatgacgcggtcctcggagtccgaggcttcgtcctcgtactcacccgcctcgatgtagatgcactgcgccgggcagatggtggcgcacatgtagcaagccacgcagcgcggcttgccgtcctcgcgcggaaccagccggtgcaggccgcggtagccctcggggtagatgggcttctcctcggggtacgccaccgtcgtcatcaggctggcgccggtgcggtccaccacctgcgtgttggtgtcacgcgtcccgaagaggttgcggaagaagtgcttcgcggtgatgcccaggccgcggagcaggttgggcacataggtccgctcgcggatatccgtgcgagggtccttgcttaccttgtaggccatgatggttctcgattcccggatgctggggccgaaaggggcggcctagtgggtggaggccggggccacgccgtgggcgtgcgccggcaggtcatgggcaccgtgcccaccgtgggcgtggccatgtccgtggtcgtgaccatggccggcgtgcgccccgtgcgcaccgcctgcggggaccttcgtcgtcgtggtcaacaccaccaggataccaatctccgcgatgccgaggaccgcgagcgcccgcagggacggatcccagaggaccagcgcacccgtcacgaacacgttcaccaggccgagggggaggaggatcttccagcccagcgactgaatctggtcgtagcggaagcgggggaacgtccagcggatgagcagctgcacccagatgaggaacagcaccttcagccagaacaccgtgcccaggatggtgcccagcagccagccgtgctcctgcatgatgggcaggttggccagccactcgttgccgaagggcaggtggtagccgccgaagaagaacgctgtcgtcacgccggccagcaccacgacctccacgaactcggagatcatgaagaggccgaacttcatgccggagtactcaacgaagtagccgatgatctccgactcgccttccggcaggtcgaacggggcgcgcttggtctccgcgaaggacgcggcgaagaagagcaggaagcccagcggctggatgaagatgccccacgcgggcagccccaggtcgaaggcgccgtccgtgcgccacaggtagcggccctgtccggtgccgccggtgagcgcgttgccgatgtcaccaatgatggccgggaactgcaccgaggagaacgtgaggaagatgccgaccagggacaggccgagcgcgacctcgtaggcgatcatctgcgaggtggcgcgcacgccgcccagcaggccgaacttgttgttggaggcccagccggccagcgcggtgccgtagacggccagcgaggcgatggcgagcacgtagagggcgccgaagtccggcgtggccaccaccatgtccacattgcggccgaacacctgcaccgacggaccggcgggcaccacggcgaacagggcgaaggtgggcgcgaaggccaggatggggcccaggttgaacatgaaccggttcgcggcggccggaatcaggtcttccttggtcagcatcttcagcacgtccgtgaggatgtgcggaaggccgcccagcgggcggttcttcaggccgggcagggcgatgcgggcgcggttgggacccatgcggtcctggatgaacgcgctccacttgcgctccgccatggtcagcagcgtggcgatgaccatcacgaagatgaggacgaggaacagcacgttggtcagccggctcgcgccagtgaaccagtgctcctccaccaggccacccacgaggtaggccgacgccatgccacccgccatcaggaagacgatggtgaacatggcgacgagaatcgtcagtacgcggctcatgactagatacccctcacccgaggcgtgccgaactcacggtaccccgcggggcgaccgtcggcacctgccggcagcggattgatgcccggcttctcccggtccgccggagacgccttctcccagttgaactccgcgaactcggccaccttgccagccagctcgcgccatacgtcgacggcgcgcttccaggtggactcgccacccaactcgcgcgtcagctccctgacccactcccagccggggacgacgtcgcccttgggcgggtacgccttgcggaagcgctggatgatgccgtcctgctgcacgaacgagccctcgtcctcgacggggacggaggccggcagcagcaccgtggcctgcgcggtgatggcggactcggtgaaggcctgcgccacgaacacgtccagctgacccgcggcctccgcgaaggcgtccacgttgcccggcacctcggtgccgatggcgtagagcgccttcaccgttcccgccttcagcgcggtggtgagcgcgtcgaaggtctccagcttgaggcccagccccttcgcaatgagctccaggcccttgcggttggggttcttgtccgccgtcatcaggaagtggtcggcggagcccgaaggacggccgcccacgtacacggtggacacgcccagcgtgctcttggcgaagttcagcccggccagcaggtcctcgttggaggccaggggcgaggccagcaccgccagctgcttgctgccctgcaccgagcgcagcgccttggccgcggcctggaccgcttccttgcgcgtggtgacgggcaccgcctcaccggcgcggttggtgcggcggcccacctgcgcctggagcacgcggcccaggttcaggtacttgtaggtgagccggccctcgtcgcacatccagctcttgttgatggcctcgttctcccgcgggcggtagcggtacgagtcctgcgacatccagtccacgtaggtggtgcagccgcgcgagcagccggtgcacaccgacggggtggcggacaggaaccacgcgcgcgccttgaagcggaagtcgcggctgagcagcgcgcccaccgggcacacgtccacggtgttgagcgagtagttgctgttcagctcgctgcccgggaacacgtcgatgcgctcgtggctgccgcggccgaacacgcccagctgcggctccttggccacctcgttcatcacgcgcacgcagcgggtgcacatgatgcagcgctcctggtcgatgacgacgcggggccccagcaccttgcgcttgttcttgagggccttggtgccctccaggcgcgagggccggtagtcgtacttcatgtagtagtcctgcagcttgcactcaccggcctggtcgcagatggagcagtcgaccgggtggttcagcagcaggaactccatcaccgcgcgctgctgctccttcaccttgggcgtggtcgtcttgacgacctggccttcggccatgggcgtctggcacgcgggcaccatcttgggcgcgttggacgcctcgatgaggcagatgcggcagttggccgcgatggagaggcgcgggtggtagcagtagtaggggatgtccgagccgaccgccttggccgcctcgatcatgttcgtccccggcttcaccacgacttccttgccgtcgatggtggcggtgatgaaccccgggttcttcggcgccggcttgggcggcgggccggagggcggcttgggcggcggcgtccccgtggggccgctggcggcggcgggcgggttgtccagcttcgcgccggcgggcgggttggacggctccgagccaatcttggccgcgggcgtgtccgtgggcgcccccttcggaggcggctgcgcatcaccggtgggcttcttcgtgtcgttgtcgctcactgctcgacctcgccgccgatcatgttgatggtgtcaaacgtagggatgaggtccgccagcatcttgccttcgatgatgtgggggacggccgcgagcaccgggaagcccggggcgcgaacgtggaccttgtagggacggccgcggccgtcgctcaccaggtaccagcccagctcgccgttggaggcctcggtggcgtcgtacacctcgccggcgggcacctggatgccctccatcaccagcttgaagtgcgacatcacgccttcgatggtgccgtagacctcgggcttgggcggcagcgcgatgcgccagtcatccacgatgatggggcccgcggggatggtgtccatggcctggcgcaggatgcggatggactgacgcatctcctcgagccggaccaggtagcggtcgtagttgtcgccgtgctcgcccaccgggatgtcgaagtcgaaccggtcgtagacccagtagggcttcgtcttgcggatgtcgtagtccacgccgcacgcgcgcagcgcggggccggtgtagccgtactcgatggcgtcctcggcgctgatgacacccgtgcccttcgtgcggtccacgaagatgcggttgttcgtcagcaggccttccatctcgtcgagcagcgccagtccctggtccagcgtcttgtggacgcggggaatccagccctcgggcaggtcgcggttgctgccacccacgcggccgaagctggtggtgaggcgcgcgccggtcagctcggcggtgcggtcatggagcagctcgcggaactccatggcgaggaggaacggcgcgaagccgcccatctccaggccggtggcgcccacgcacgtcaggtggtccgtcaggcggtggagctcggagccgatgacgcggatgtactgggcgcgctcgggaatctccaggccgatgagcttctccacggcgttgaggaacccgaagttgttcatcatcgcggacaggtagttgagccggtccgtgtagggcaggcactgcgtccacgtgacgttctcgcagctcttctggaagccgcggtgcaggaagccaatctcagggtcgatcttgacgatcgtctcaccctcgagctccaccttcagccgcacggtgccgtgcgtggccgggtgggaggggcccatgttgatgaccatccgcttggtctggaggtgggcgtccagctccgactcgtgggcgtacgcgtcggtgtcggggttcggcgcttcgggcttgagggtgtcagccatggatgtcctcgctcaggagagcccgctggtgccgggaccgcggaagatgtccttgatggggcgctcggggatgagcggctgccggtcacgcagcgcgtagtccttgcgcagggggtgcccctcgaactcgtcgtagaggaggatgcggcgcaggtccgggtgcccgtcgaagcggatgccgtagaagtcgaaggtcagccgctcccaccagttggcgccgcggaagagcggcaccagggtgggcaccaccgggttggcttcgctcacccgcaccttgagccgcacgtgctcgtgccgcttgagggagtagaggaagtagacgacctcgaagcgagggtcgttctccgccaggtgcagccgatccacggcgtcgatggagccgaacagcttgaactccagctccgggtcgttcttcaggaacgcggcgaccttcgggagcgagtctgcatggatgacggcccaggcgcctccggtccgatccacgtagcgatccgccaccgcctctgggagctgggcggagaccctgtccaacgcgaaagtgctcaagggtgccccaatgactaagggagaagaatccgcggctttataaggagccctcggcgggtgcgtcaacgtaaaccctcaaccatgtagcccacttaggaggcccagaagcgggcgttgcgcgaaaccgggtgggagggtgggcgacggcccggacagggggtggatcagccggccgcgagcacccctccaggttgtcctacactgagggtaaaggtggccacgggcagtcgcttgcgggcatccaggtgggatttaccggcatccaggcgaagctcctggctgtcatcaggatgggaaccgtgaggcggcgcagggccctcactggctgcccgtcgaggcggagtcaaggccgtccattttgcaatccctcgcgaggagcgcaggttggcgagggccggtcgtccggccggcacacgcctgtttcaatcgggtatagaagaggaggtcatgcccgaatcccccccttccggcattctccgttcctggtggccgcgcctgctcgtgggggccgtgctgggtgtgttgctgttcgccgccgagtcgtggctgctgctgcgctcgggtgtcgtgggcatggacatcccggtggatggcccctacgccgcgttgatggcggccgtgcggcctgtcctccctggcctgctgttgcgagtcgctgccgtgtacgccgtggccggcatggtgctggccgtagcggggacattgctggcgcgtgcctggggacggggcggcgcttgggcgacgttggggcaggggctgctgttattcgtgctgctggcgtgggaccgggccatcgcgcgtccggccctcttcgatgacctgcccgcgctccggttgctgctggcctggctggtggatcatggcgagccctggcatccccgcgcggtgctggcggtctggctggtgtcgcacgcggcggtgtgggtggcgcgcacgcggcagtggcggcgtgcgggatgggcaggcgcagcgctggcgggcgtggcggggctgctggtggtggggaaggggatggctggacgcggcacgcctgagcatccgctggtggtcgtcatcggcatcgacgcgttccggccggaccggctgaagtcgcagggaggctcgggcgaggtggcgccccatgtggagcgcctgctggaggaggccacgctcttcacccgcgcgtacacgcccattgcccagacggagcccgcgtggcgttcgctgctcaccgcgcggtggccgcatgagacgggcgtgcgctactcgctgacgtccgactcgcggatgcaactccagcgaaccttcgcggagtccttcgcccaggcggggtggcgcacggtgttcgccaccgactgctcgcgcttccacgcggaggggcccgcgtccggcttcgagacgcgcctgcagccgccgcgcggggcggtgaacttcctcctggagaagctgcgttaccgcgcgctgggcatgttcgccgaccacgcgttgggcgccgcctggttgcccgagttcatcgacaaccgcgcgctggccggtatccatgaccccatgggctacgcggagcggctggcctcacggctggtggacgaagcgagcgagggccccacgttgttcgccttccacgcgacggcggcgcacttcccgggcgacccggtgcatccgttctatcgccgcttcgtgcccgcctcggagccgctggagcgccggctgcgcatgcacttcgccccagtgtctccaggcgcgaagggcggctggaaccgggcgggcgcggaggcgctctacgacgagctgattgcgcaggcggacgcgcaggtggggacgctgctggacgcgctgcgccgctcagggcgctatgacgatgcgctcatcctcctgatgtcggaccatggcgagagcttccacgcggaccgcgaggacctcgcgggcgccacgccggtgcatggcgcgcggctgtcggaggaggagaaccgcatcctcctggcggtgaagccacccaagggacgggggacggcgccagccctggtggattcgctggtgcggctcgtggacgtggggcccaccctgctggagttgtccgagctgccgaacctgtcggatgtggacggcgtgtcgctggcgccgctgctgcgcggcgaggacctggggccgctgtcgctgtacgcggagacgggctttacccatgtgctgccggaggtgttcgacgcggggcactggccgggggcgcctcgctccttcgatgcgtaccgcatccgtccggatggcgtggtggagatggggcccgcggcccacgcccgcatcctccaggagaaggacgtgggtgccttcgacggccagcgctggtgggtggaccggccccaggccaacggcacgttgctgcgcgcctgccagggcgactgtgaagggccggacgccctcgcgctggaggcgtggttcgaccgcgtgcaggggcggacggtggcgggaggctggcgtaaggtggccggccatgtcgacgactccggacaccccgagccttcaggaacgctacgcgccccaaaacagctgcttcggctgcggcccggccaacgcccagggcctgcgcatccgcagccgcgtggagggtgatgccgtcgtcgcggagtggacgccgcaagagcaccaccacgccttcgagggcgtgctcagcggcggcatcgtcggcacgctgctggactgtcactgcaactggacagcggcgtaccacctgatgcgcgcgcagggcggggatgcgccgccgtgcaccgtcaccgccgagtacaccatcaccctcaagcgccccacgcccatggccgggccgctgcgcctggaggcgaagccggtggaaatccagggtgaccgcgccgtcatcgaaggcacgctcaccgcgggtgggaaggtgacggccacttgccggggcaccttcgtcgccgtgaagccgggccaccccgcgtaccatcgctggtagtggcgccagaaataccaaggccccggcgcttccaccgactgaggcgggaagcgggcggggccctggcggtaccgcgcgtggggcgcgttacttgttcatggacagcagcaggttgtgccgagcggccgtggggttggcctcctcgcgctccgcgatgcggtggacctggttgccaatcttgtcctgcaggagcatcaggccgtcgagcacctgctccgggcgcggcgggcagccggggatgtagacgtccaccgggatgatgcggtcgatgccctggagcaccgcgtagttgtcgtagaagccgcccgaggacgcgcacacgccgaaggccacgacccacttgggctcggccatctgctcatagacgcgcttgaggatgggggcctgcttcaggttgatggtgcccaccaccatcagcaggtccgcctggcgcggcgagaagcgggggaactccgcgccgaagcgggagatgtcgtgccggctggcggccacggacatgtactccatgccgcagcaggccgtggcgtacggataggtgaagagcgagtacttgcgcgcccaaccgaggcccttggagacgatggactggagccagcccatggactcgtcacggcgggtcgtcacgatgtttgcgaggtcagcgtcagccatgatgtctcagctctcccagtccagggcgcccttcttccagatatagataaggccgaccaccagcgtcacggcgaaaaccagcatctccacgtacccgaaccagccgagcgcctggaagttcaccgcccaggggtacaggaacaccgcttccacgtcgaacacgatgaacagcagggccacgacgtagaacttcaccgcgaagcgctgccgcgccgggccgctcgactcggagccggcctcgaagctggtcgccttgatggcgctcgggcggcgaggacccagccgcgtggtgatctggggaatgagcatcgccatgccacccgccagcagcaggacgacggccagcggcaggtatggcgtgaggggagtcggagtcatcgcgcgcggaacctaatgacaccgtgctcgcaatgtcaaagggaaagtccagggagcggcgcgccaaccccttgagatgacggcgaaaagcggtgttcatgggaccccggggcgcgcctggcgtggatcagccgcccgcacggctccagtctggccggccggtttgacgctccgcgaagggacgcctaccgtccgagaaccgtcggcatccatccggcgtgaaactttgctcaccggggagatggcaagcatgtggggccggctcggcttgcgaacgcaggtggccatcgcggtgctcgtcccgtgcctggcggtggtgagcttctgcgtcgtgtacttccccatgcaccagcgggaagtcacgctggagttgctccaaaagcgggtgcgggtggtggcgcggctgatatcgcagcaccccgcgctcctgtccgcggacagcacgccggaatccacggcccgggtgcgggacgtgttgtcgatgctggaggccccggaggcgctgaacgagcgcggtggcttcaccctgcgctaccaggggctggtgtcggcggaaggcaccgtgctccatgggcgcggctccattcccacggccatccgctcgctcggcgtggaggggctggagggctgcgccacgtccacccaacacgacgaggtgtcggtccgctgcgccagtggtgagcgcatctacgtggcgggcttcggcgtccaggaggcgctcagctcggtggatgacatgcggggcgcggtgctggccggcctggcgggcgcgctggtgctggggctggccctgtcgttgttcatcagccgcgccatcgccgaaccggtggcccgggtgacggaggtggtgcgggacgtggcccggggtgacatgtcgcgcggggaactggacgtgccggccacgggcgaggtgcgcctcatggcgcagtcgttcaacaagatgctgggcacgctgcgcacctcggtgatggagatggtttcgcgcacggagcagttgtccggcgcatcgcggggcctgttgggggcgtccgcggaccaggaacacgtcatcagccagcaggcggcgtacgcgcagcagattgccgccacgttcgaggagctgagccgcacggccgagcagatctccagctccacggaggtggtggagtcgagcgcgcggcgcacccacgaggccgtggcggaggccatggcggtggttgcgcaggtggtggcgggcatcaacgacatccgcaccgagtccaagggcgtcgcggacgcgattgtcggcctcaaccaggaccttcagcaggtgtcgaagattgcccaggtcatcaaccaggtggcggagcgctccgacttgctggcgctgaacgcggcgctggagggcaccaaggcgggcgaggtggggcggggcttctcgctggtggccgcggagatgcgcaagctggcggagaacgtgtccgcatccgcgcgtgacatcgcccgcatcgtggagaaggtgcaggactccggcgaggaagcggcagccaaggcccgcgtgggcatggccaccagcgaccggggcgtggaggtggccgagcaggcctcctccgtgttccagcgaatcgtcgagctggcgcgcggcaccagcgaggcggcccggcagatcaccatcgccacccgtcagcagcgccagtccagtgagcaggccgtgcagggcgcccgcaacgtcgcggagctggtgaagcagggcgtggacgcgacgggacgcaccacgcgcatcgcccaggacctgcaggcggtggccgaggggctcaccgccgtcaccagccgcttcaagacgacgcggaactgaggctcactcccgctgccagcgcagctggaactcgacctcgtccacgccgtccccgcgctcgtgctcgatgttgaagagcgcgtcggcggggatgcgcaggcgctcgccagcgacctggatgttgaaggccttgccctcctcgatggcgtccgccaaccgccgcagcttcgcgacgaagtccttgcgcgggtacgtcttctccaggtctcggttcgctcgcttcgccttcttttgcgccatcgttgagggctctttcgtccagggtttccccggatgatggcatcgcctgcgatggatgcgcagcctgaatcagcgcggcattcgagacacgcatcagctcatcagacggtggaggctgaggtccaggcggctctggaccaggcccaggaggctctccacctcgcgcccgtccagcttcagccgggcggccagctctcggtgggtcagcttcaggagccgctcacgggcctgggccacgtggcgtgcgacactggagcggggctccgcgtacagcgtggcgatgcggtccatggtgaggccgtggaggtggtgcaggcgcaaaagcgcgcgctcccgttcggacaacgtcgccagcgcggcctggagggattcggacagggcttgccgggagtgggcctggagcacgtttcgctcggggtcgtcccgggacaacagttgctccaaggcctccggaggcgtggaggactgctcgtggcggccggtctgctccagcagctcgccgccgatgcgcgaggcgacgattcgcacccagccgcccagcgagccccggccctagtactccgcgattttcggcgcgcagccgtgaacgtccagtagcagccgctggcgcgtcacctggagcacctcgtccaccatcgccgtgaggtgccgggacagtcgtgcggcggctttctggaggacgtgcttctcgaagagctgcaacgcctggggctctccctgggcacaggcacatgccaggtagacgtccgcggcatggagctgcttgagcgcatccaggggtgtgccttcctcgcgcaggtgccggcccacgtggtgcaacagggccgcgggcgccagcgccacggtgggccacgccgcacggccttggtcgagcagctccgtgagcagggcctccagcgcgggcgcggagcgcagcgtgtcgtgcagtgactcgggtgcccccgcgagcagcagcggcgtcagcgtttccggagcctggctcatcgggtgacctcgctcacacggggcaggtgccgcgtctgccatgccacgagctcgtcgtgttcgcgccgggcgcgcagaccctgggcttccagccacgctttcgcctcgtggatgagggccgtggcctgctcgcgcccctccggggcgggccgttcccatagggcctgtgcgaggaggaaggacactcgcgcggcttccttccggtccagccacacgcgagcatggatgcgccgtgcgcgctcgagcaacgggacggctcgctccggcgcgcgcaggctcaggtgggcctcgccgaggcaggcgaggtcgagcgcgacgtccgggctgtcgtcaccctgcgcggcttcatccagcgccagggcgcgctggcagcgggtcagtgccgcccggaatgcgcccgtctcgaggtccacccgggccaggtcccgctccacgccacatgccaccacgctgtcggtgccgttcgccttctggaggaggccaagcgcctgcgtcaggttgcgccgcgccaccgccggccggcccgcgcgcaggtgaatgaggcccaggttgcgcagcgacatctccaggcgcggcgagtcctggcccacgctgcgttggatgcgctccagcgcctgctggttgtgggcgagcgcctcgtcgagctggtcggaatcataggccaccatgcccagcccgccgagcgcggtgacggtgttggggtggtccgtccccttgctgcgctcgaagatggccagggctcgcgcatagtggctccgggcttcctccaggcgcccctcgcggcgcagcaggccggccaggttgttgaggggggcggccaggctcgcgtggtccttggagcgcgcggcctccagcagcgccagcgagcgttggaacgtgtcgagcgcttcttgcgtgcggcccagggcgagcagttcggtggcgatgttgttgaggttgagcgcgagcaccgggtgctcggggctccactgtcgctcctggaatgcgtaggcctgcgcctcctggtagagcgccagggcctcctccgcgcgaagctggcgcgagcggacgcgtcccagtccggtgaggaagtacgtcacgcgaggccgtgaggggcccgcggtcctccgcgccagctccagtccctgggtgaactccgcgtccgcttcgtccagcttgccctgcaccaggagcaagccgcccattcgcaggtgcaggtcggtggcgatgtgcgggaagcgctcccggcccagccgctccaccgcggcgcgggcgtggtgcaccagccggttcgcctcgtccatgcgcgccatctggtcgcccaccacccacaggaggaggttccagacacgggccacggtttcgtcgtcgcggcccgcctcggcggcccacagcgccttgtagaggtgctcctcggcttctttgggcttgcccgcgagcccatgggcatagccgtgcagcgtgaggacctctgcctccagcggccggtagtccagcccctggatgtcctgaagcaaggccgtcgtctccttcagcgcgccggggtggttgcccgcgtccatgtgggcccgcgcctcggccagcttgcgtcgcgccgcgtccacgcgaggccgcagggcatccggaggctgcggccggttcgccagctccggagcatcccggcagccggagacgccctccagggacgccaccatctgcggcgcgtgctgcaccgttcgcgcgtccgccttctccagcacgtcgacgacggcggccaggtgccacagccgcgtgtccaggcacgcggccgtctgccatgatgcatggggggcatcgcgcgaggccgtgcacgcgtcggtgcgcagctcgcgccacgtgtccgcgtgtccgtcgagcgtgctggcgacggcttcccacgcggcggcggcgaagggctttcccgtggccaggaaggccgcgtggattcgcgcacggcgctccggtccccagatggtggtgagccgctccgcctccaactcgcagcgggcctgcctccgatgcgccgccacgtagcccacggtgagccctacgagacacgccacggccgtggaggcgcccacccaggcaaggcgccttccagcgcggggggccagctcggtcagcagcgcctccatcgatgggaagcgctcttccggctgggctcgtaaaccccgcagcacggcgcgccgcactcgggccgggattttcgactcgcgctctggcgcgcggatgcgtccttcccgcgcggcctgacccaacgcctccagcgtccggccctcgaaggggcgcacgccgtggagcgcttcgtacagcgccacgcagaagctgaactggtccgagcgtgcgtccacgccgtgaccttgaagctgctcgggcgccatgtacgcgggcgtgcccagcagcgcgcccgaatgggtcagcggcgagtccaccagcgacgccggcgccgtcaccgtgtccaggctcgctggcgcggcgtggcccgagactccccggtgggaaggccgggccagaccgaagtccgtcacccgcacgcgcccatccttcccgaccagcacgttgcctggcttgaagtcgcggtggaccagtccggcggcgtgagcggccgccagtccccggcccgcgtccacgaagacgcgcaccacgtcctgccagggcctcggcgcctccagccactccgccagcgacgcgccctccaccaactccagcgccaggaagacacagtcctcgcagacgcccacgtcgtagacagtgacgacgtgcggatgggccagccgggccagggcctgagcctcgcgcagcagccgcaagcgcagctcctccaggtgtcggccctcggggcgcagcagcttcagcgcgacccttcggtccagctccgggtcatgggccgcgtacacctcgcccatggcgccccggccaatgcgctgctgcaccacgtagcgtgagagctgggtgcccgtggtcaccagcgggccctcgacgggcgggggcacggcctccgccgcgctggcgcccagggccaggtgctcctggcagcgctcacatccttccacgtgggccagtacgcgcgtgcggtgcgcgtccgggagcgccccttcgaggaagtcgctcagtgtcgtctcgctcgggcaccccatggaggcccggagactaacaaattcctggacttttcacttttacccgcctgggcggttcaggcctgggcgcgtgacttgaggcgggcgaagagctcgggaggcatggaggcggtgcccagccggtggtcggcggagatggcctcgccgtggaagtcgctgccagcggtggggaccaggcccagctccttggccaggctgagatacttctggcgcacgctggggttgtggtcctcgtgcagtacctcgaggcccgccagtcccgcctgggcgagcgcgcggatctccagtcgctccatgcgcgatgaacccgggtgggcgagggtggccgtgccgcccgcgttgcggatgaggcggatggcgtcctcgcccgtcagcttgaagcgctccacccaggcggcgccgcgcatgcccaggaagcggtcgaaggcctccttcacgtccaccacccagccgcggtccaccagcacacgggccaggtggggacgtcccaactgcgcgtcgccggccaccgcccggacgtgctccatgcgcacggggtagccgagctgccgcatgcgctccagcagggcttccatgcgctgctcgcgctccagtcggagccggtcggcgaagcgagcgatgtcctcgtcgtccggcctcaggaagtgccccaggatgtggcactcgcgtccatgaatgaacgcggagatttcgatgcccggcaccagctccacgccgtgggcgcgcgccgccacctcggcctcggccaaccccgcgacggtgtcgtggtcggtaatcgccaacaccgacaccccggcggcggcggcgcgggccagcagctccgtgggagcatattgaccgacgctggcagtggtgtgcgagtgcangtcaatcacgggcggctccagggtgtggggggaatgttccccatacgcgacttatgccgggtttcacaccaacttgcggcatggggggtgccgccgccactcaggatgtggctactgtccgagccctatgggcaagaagtccgatacgaccatcgagaaccgggtctacctcttcgagtcattggcgagcagctacgtggcgtccgccaccgaggtcttgtcctcggaggaccccgcggtgcggcagcgcgcgcgccgggccctggcggagctggccttcgtgtcctgtgtcatggcggacactgctcatctgccggccgagcaggttcgggcccaggtgctcggcgcgcccgagcgcgtcccggaggctccgtcgaaggtgtccggcggcgcggcccggaagcgcaacaagtagcggcctctgtcgcggttcgggtggtatgtcggcggagcccttttgcttcgaggagcgccgacatgagcccgccgcagacgcccgccacgggcgtggtgatgacgctggtcagccagccccagttcaagacgcagctcacccatggcccgtcgggcacggtgaatcagacggaggcgccgcgcgacaacggcggcaccggtggcagtttctcgcccacggacctggtgggcgcggcgctgatgtcgtgcgcggtgacgacgatgcacctgttcgcctcgcgtgaaggcattgccctgggcgaggtgagcgcccgtgtggagaagcggatgtcgccgccgccgcgccgcatcgccgagctggtgctggacatccagatgccggccggcctgtccgccgagcaccgggccaccctggagaaggtgggccgcgagtgcccggtggcccgcagcctccacccggacgtgaagctgccgctgacgttcagctatccggactgagggcgccaggccgcttgccctccagggggcctgcccgcgaatgctgcgggtgggccccttcgtgttcatcctccccgactgcggggctcgtcctggaggacacggcatgcatgcgaagcggctgggcatctacctcaatgaccacctggcgggctcggtgggcgggctggagctggcaatccgcacagaggtggagaaccgcggcaacctgctgggccgctatctggcgacgctcgtccccgagctgaaggaagaccagtccacgctgctagcggtgatggacgccctggcgctgaagcgagatgggctgaagacgcgcgccgcgtgggccgtagagaaggtgagccggctgaagctgaacggcacgctcgtgcgctattcgcccttgagccggctgctggaattggaaggcctgtgcgcggccacggagggccgcttgtccctctggcgcacgctggcgcgcgtgtcggtgaaagacgcgcggctcgcggtgtttcccttcgagtcgctcgtgcagcgcggcgaggcgcagcgctccgtgctccagcgcctgagggcccaggcggccgacgtggccttcgcggaggagccgcagcctttcggcaccggagagcctctcatcgcgggccactgacggaacgcccggggatgaaaaagccccctgccgcggcgagcgacagagggcgaggacttcattctggcgcggggctcaggtgcccgacgttcccgacgcgccggcgggcggtgtcgtgggccgggcgcccgaggcgtccggcgtgggcaccagacggagctggctggcgctgctgccgaagcttgcgtccacctcgcgctccaggtacgtgtagccggacaggccatcctcgtacatgcgcagcaggttgcgcgattcgtccagggtgatgcggccctggcgcagcgcggcctcagtgaacttgcgcagcttcgccaccaggtcgtccttggtgtagctgacgtagttgagcacctccgttaccgtgtcgccggccaccacattgtcgatgaggtagcccccgttgggccccagcgacacctgcacggcgtgcgtatcgccgaacaggttgtggaggtcgccgaggatctcctggtaggcgcccaccatgaagatgcccaggtagtagtcgtcatcgttgagcgcgtgcagctcaagggcgtccttcacctcgcgcttgtcgatgaagtgctcgatcttcccgtccgagtcgcaggtgatgtccgccagcgtcgcgcggcgggtcggcttctccgccagccggtggatgggcatcatcgggaagagctggtcgatggcccacgagtccggcagcgactggaacacggagaagttgcagaagtacgtgtcgttgagcgccttctccagggagtccagctcctcgggaatctcgccctgctcacgcgcgatgcgcatgatcttgtggcaggtggcccagtagatgttctccgccgccacgcgctgctccagcgacaggtggcccagcgagaagagggtgaggctctcctccttggcgtcctgcgcgtcgtgccacgcctccagcaggttcttgttggtgacctcgcggtaggtggaccagaggttgcgcaccacggagggggccttctcgtccaccttgtcggggaccggcgccgggccgaactcactggtgcccagcacgtccaccaccagcaccgcgtggtgcgccaccacggcgcggccggactccgacaccagcgtggggtgcggtacgccggcccggtcgcaggcctccatgacgccgaacaccacgtcgttggcgtactcctccgtggtgtagttcatggaagaggcgaagttcgtctgggagccgtcgtagtccacgcccaggccgccgcccacgtccaggtacttcagcggcgcgccctgacgggccacctccacgtagaagcagcccacctcacgcagcgcgttcttcacgttgcggatgttggaaatctggctgcccaggtggaagtgcagcagctcgaaggagttgagcaggcccgcgtccttcatgaagccgatgcagttcatcagctcggaggaggtcaggccgaacttggagcggtcgccgccgctggcctcccacttgccggcgccgcgcgtggacagcttcacgcgaatgcccagccggggggcgatgcccgtgcgccgggcgacctccgcgatgagcggcagctcgctgggcttctccaccaccaggatgacgttgcggcccaggcgcgagtagaagagcgccgtctcgatgtactcctcgtccttgtagccgttgcagatgacgagcgcgttctcgttctccaacagcgccatcaccgcgagcagctccggcttgctgccggcctccagcccgtagttgtagcccttgcccgcctcgatgagggtctccaccacgtagcggtgctggttcaccttgatggggtacacgccgcggtagccgcccttgaacccctgatcgctcatggccttacggaaggcttcgttcaggtggaccacgcggtggcgcagcacgtccgtgaagcggatgagcagcggcaggccgatgccccggcggcgcacttcgtcgaccagctccttcaggtccatgttcggggcctggggaccgtccgggtggacgatgacatggcccttctcattgatgccgaagtaggggttgccccagttccggattccgtacagctcatgcgcgtcggcgagggtccagcggtggggaggggcgtttacgggcatcggcgtctcgaggctccctggggtagatggggtggactcccgtgaacaacggacgatcacaggaatcgcgcgggaactatcggaaagcctctcggtattcaacagccgcttgtgcggagggcaagcaggctggcggggcggccgcccggtgctcctcctcccgcgggccgaccctccattcaattcctaccctttccccgtgagtcctgagggacgcgtggaaacaaggggagggtacatggagtcgtccgcacgcagggaagaggcgctgctgaccccgcgggaaatctacgagcggctggatcgcttcgtcatcggccaggacggggccaagcgcgcggtggccattgcggcccacaatcacctcaagcgactgctggcgcgaaggctgcgccggacgtcgctcatcaagaaatccaacatcttgctgatgggacccaccgggagcggcaagacgcacatcgcccgcaacctggcggacatcctccacgtgccgttcaccaccgtggacgccaccgagtacacggaggccggctactacgggaaggacgtggaggtgatgatctccgacctcctcttcaaggcgaaccactccgtggaggacacccagcggggcatcatcttcatcgacgaggtggacaagattgcccgccgctcccagggcgcccgcaacggcgcgggcagccgcgacatcggcggcgagggtgtccagcagtcgctgctgaagctgctggagggccgcgaggtgtacgtacccctcaacgtcacccaggcctggaacaagagcgacttcgtgcaggtggacacgcgcgacatcctcttcatttgcgcgggcacgttcagtgacttgcacgacgatggggatgaagggcgccgcgccatgggctttggcgcggaggactcggcgaagcgcagccagaagcgcatcagcacccgccagttgacggacttcggcatgctggcggagttcctcggccgtctgccggtggtggtgcaactggagcggctgggcgaggaggacctgatgcgtgtgctcaccgagccgccggactccatcgtgcgcgagttccgcgaactgctgtccatggacgacctggaggtggacttcgccgacccgggcctgcgtgaggtggtgcgttattccgtggagcgcgggctgggcgctcgaggattgcggtccgtcctggagcacgtcatggcggacgtcatgttcgaggcgcccgagcggcggcggcgccaggtgatggtggacgcgggcttcgtgcgagagcggctgcgggggctggattcgacgcagttggacgtgtgaatcagggctcgcgctcggaggcgcgggccgcggcgcccaaccgggccgccacgtccgggtcctggatgagctggagcacaccgtcgtggcgcagcagcgcggcggtgtctcctcgcgccagggcctgcttcagcttcgggtcctggagcaggcgctggaagcgagggtccttgcgcagggccttgtaggccgggtcgtcctggagccgacccgcgcgcttcggatcaccggcggccttggcgacctccaccagattcttcaccggggcgaactgcgtcatctcgaagaggttgtagcggcgggcgacttcgatggagagcgactccttcggggacaggcccacgcggcggcccgcgatgacgacgtgctgttcgaagaaggcgatggcgctgaggacgacccaggcgatgatgcccatcttcgcgccgcccagcacgaagccgaggaagcggtccacgccccggttctcattgtgctgaccggtggagaggatgcgcagcagcaacgcgcccagggcgtagcgcaccgcgagccacgtgcagatgaacaggagcaccgtgcccacgatggcgcccaggaagagcggactgcccagggcctcggccaggtgtggggccgccacggggcccaggcggcgcgaggcgaagtagcccaccgccaggcccaccacgttggcgacctggcgcgacgccccggtgatggcgccgatcatggcgaagaacagcaccagtccgaggatgatgaggtcgatgaccatgggcgccgccgccgtcagcggatcttgaacgagccgcccttgtcgcgcgcctcgtcctgggactgcttctggacctccgccagccgctccttgtagcgggcgttggagggctcataggtgagcgccatcttcagattccgctcggccgcggaccagttgccggcgtccgcgtccttctgcgcctgctggaagaactggcgtcccttggggtgggtgccgatctgctcttcctgctccttcttggcggcggccttggtctccgcttcggaggcttcggtgaagcgcagcttctgggcgcgctcggggcccgtcacgtcgacgacgtacttcttgcgcttcgtgtcgtcgcgcaggacgtagtaggcctcggtgacgcgcttgtagagatcgttgatgcgctccttcagctccttcgagtccatgtggaagaagcggtccgggtggtaggtgcggctctcccggtagaaggcgcgcttgatgtccgcgggggtggcggtcctctccagcatgagcacttcgaagtagtcgagttggtccagcttcgcgcagcgcgattccaggtcggcgagctgctggatgtccagtcccaggtccgttgacgcagcaggcgccggcggtggcgtgaccgccgtggccgcagccggggcgacggacgggacgatgggcgccacggaaggaatcgagggcaccgcgccggatggagcgtgtggggccggcgtcagcggtgcgatgcctgggacggcgggcgccacggacggaacggcgggcgccacggatgggggagggcgcggcggcgtggcgccggcgggcaccagcgctgggagggacatggtgggccgggcaccgggcttctgctgtggggccgtggagggcgtcacgggagggacaacctgtcccagcgcgagtacgggaggcggcctcagcgtcggtgctgttccttgggcgcgcgccggtgcggaaggtacggcgcctgcctgcggcgcggctgcggggattgccggggcgacgggcgggacagtcctcgtctgggccggagcgcggggcgctaccggggcaacggaggggacgacgcctgtcgatgcgggcgaagttggagcgcccacgggtgcgatggagggcactgcgcccgcgagtggagcggaggcacccacgggagcgatggggggagcgacaccagccgagcttggcgacgctgttgcacccacgggcgcgatggcaggggcaacggcggggattgcgcccatggtgggtcgctgcgccggaggaactgcaccggccgggcgcggaggaagcgtgtttcctccacctgccgggcgaggcgcgggcgtcggtgcccccgccgcattgggattcgagccctggcgcggggcggacgtgttggctccagtggcagtggcgccagccgtcgcgacgcgtggcacgggcgtactcgcgccagcggcgggggaggccggtgcaggtcgcgaagcgggcgtagtggtgcccgcagggggcacgcgggggacaggtgtgttggcgcctgcgcccgccacctggctcggtacgggcgtggcggcccccgctgcatcggtaggcggacgcggtacggctgtggcggctcccgctgcaccggcagggggacgcggtacaggtgtgccggttccccctgtcccggtggccggatgcggcacaggcgtggcagccccagctgctccggcggccggatgcggcacgggcgtggcagcccccgctgttccggtggccggg

SEQ ID NO: 1228 - DNA, 26930 bp, Myxococcus xanthus
atggaccacatgcggtaccgctactgattcacggatcgggtcctagacaaggtccgccggcggggtgggggacggttgctcagcctggggacgaagctcgtctttttgtacggaatgcatgacggctgggagcccgcgcgcatgcgcatccgctccgactcggacccggagggcacgtgggcgccggtgcgccaggctttctccgacggcatctaccatggcgcggcgttgagcgcggtggcggatgggaaagacggcatgcacctcgtctacaaggatgagctggagcagctctactaccggcacttcgacgggaacagcttcggttttcgggtgctggtagagagcagctcggactgggcgacccagcctgccatcacccgcatcggcgatacgttgtatgtcttctacaaccgggtgcggacgctcaacgcgaactacgagctgcgcgtgcgcacggtgggcgaggatggaacgcttgggagcgcggtgacgctcgacggggatgcgacgttcaagggttatctcaacgccgtggatgtcctgccggagggcagcggcgaggtgccctgcctctttggtgaggcggtggacgcgggctcgcggggctgggtatcgcgggtatcgctggtgctcgatgaagcgcctccgccggacccggacccggggccggggcctgggcctgggccggggccggggcctgggcctgggccggggccgggtcctttcgtcctggagctcgtgcgctcccattccacgcacgaactgctcgcggtggacggggccggcacgctgtacggcattcccgctgagggcccgcgttcgcggttgatggcgagcacggacggtgggcgcaccttttcggatcgagggcagcggggtggcaacctgtggacggtggcggcgatggagggggggacgctcctgtcggtggccagtcacagcggagagtatgtcctccagcgctccacggatggggggatgacgtgggggaacccgctgcgcctcggtacgtatcgtgcgcgggggccccagagcttcgcgcgcttggggagcacgtggttcttcctcgagtaccagacctttacctcggccgccgtgccgcttcggctatgggcctccacggacggcggggccacgtggtccgtgcgctccatgttcacggcgcaacggcacggcgatgccctggtggcggacccggcgacgggaacgctgtgggcgaccatggggagcagcgaggcgcaggcagcagtgcttcgttccacggatggggggcggacctggacgtcactgttgcgtggctatgaggccaatgcccagacgggggtggtgcacacaggcggggcactcctcttcggccagtcaacgttgttcgagcccgagcacccgaagctcctgagcctgtccccggaggggaccgtgagttcgctgatggagctgccggggccggcgtactcgctcaccgcggtgcccgggggcgggtgggtgatgggcacggcgtggtcccgccatggggacgtccatgcgtccggtgatgtgttcgcgcgactcttcatcagcgaagacggcgtgacgtggcaggagtcacgcaggttcgagcggatgagcggtgcggacctgacgcgcgcggatgtctggggcacgttgccatccggagagctggtggtgcgcgtggaggatgcaagcggcttcgggagcgcgggcgtgggcttccaggtgcttcgcgtcaagcgttgaggctggccgcgccgaaatggggcgggttgcgtctctgtaggtgtcggcgcgcatggcgggggccgcggcccggtgggtttgccactccaggcgataccaccgggccttgccgtagcgcccggcccagacgcactcgccggaaatcgtacgggtgaagtgagggtaaaaaatcccgccctccgttcgggtggcaagacgcccacgacggcccgttccaatgccacgctcacttgggaaatcgactccgccaggcgccggggcacctcacgttcgccaccacacttgccgcgggagggacctttcgatgaccatgaatgcacctcggaggaacttccacgtggagccacgacacaggccggcacaggccatggtctctctcccctcggacgtgctggagcggctgcgagaggacctggcccgtgcggtggcccgggtgtgtccgcctcggatggccgatcgccgcgatgacctggtgcagacggccatgatgcgcgtcatggagttgcagcggcgcgagccggaccgcagccggttgacccccgcctacctgtatcgcgtcgcatacacggcgctggtggacgagttgcgcaacgtgtcacgccgccgtgaggtccaactggaagaggtggagtcgctgtccgagccgccggtggcatcgagcgacccggagaaggccgcgggcggctcccagattgcccaggccgtgcgcgactgtctgcgcaagctggtccaggaccgtcggctggcggtgacgctgttcctgcagggccacagcgtgccggagtccgcgcggttgttgggctgggacgacaagcgcaccgagaacctcatctaccgcggcctggccgcgctgcgcctgtgcctctccacgaagggattcgagccgtgagcgagcgaggacgcgacgagacgaagcccgatgatgccaccgtcgaacgtctgcgcgccgccgtgcgtgccgaggacccggtggagcgcgcggaggcgccggtggatgcggacctcgtctggcgcgcggtgagcggcgagcttcccgccgaggagcgccgcgcggtcgtcgagcgtgtggcggcggacccggcctgggcggcggcctggcggctcgcgaacgaactgacgcgctctgccgaggaggccgcgcctcccgtggagcccctggcggatggttcgcgcacccggcgccgagacagtgacgctcggcagaagcgccgcttccgcttcgcgtggagccagcccctgtggggtgtggcggcgaccgcggccctggccctcatcgtcgtgggcgtggtgatgcgggatgagcccgagccgccgcggctgcgtggcggcgatacggcggcggtcgcctcccaggtgccagaggcggtgcctctcaagcgcgacgcctgtgtgctgcgctggagcggcggtcccgagggaacccgttggtcggtgcggttgtccacggaggacctgggttgggtccaccgcgtggactcgctggagacgcgtgagtaccgggtgcccgccgaggtgctggcgccgttgcatccgggaacgacgttgctgtggcaggtggaagcgcggttgccggacgggcaggtgcttcgcggcgccacgttcgtcaaccggttggagtgaagcgcgcgatccgaagtccacgggggacctcatgagaacggagctgggaatgaagacacggcggtggatgcgagcagggctggtggcgctcctgatgggagtggccggtggggcagggcaggcctggagccagtcggtccccgtcacccgcgcggtgaagacggccttcagttacggcgaggcgcgcgacctggtggtggcctcggtggtggagacgggcgtccgcacgggccaaagccagttcgtgacgctccaactcctcgaccactccggtgccgtcgtcgcgcagaccgcgggtgtggtggaccaggagacgcccctgcggctgacctaccggacccccaccgcgaccccggtgttcgcgcgcgccattgcgacggtgagcgcggaaaccctctccgcggcggcggtgacggtggagcgttggtccgttgcggagccggcctcctggaccggagccctcgtttgctatttcgagctggttccgatgcccaggcctccgcctcctccccccgggccggtgacgctcaagtgcgagcccgtcgacccgccgcctccgcccacccgctgacgtgccactccggacgcaccggtccgaatgcaacaacagaaggctcctctccttcctgatgggggccattctctcggtgtgtccggccctggccttctccgcggcgtcaggccgcccccagcctccctcgctcgagtcgtgccgggcgcgcttcgcctcggagccagagggccgggaggcggcgatgtgcttctaccagtgtgcccaggtcacttccgctcgtgacgctgtggtgcgcgagctgacggccttgatggagcgtcaccctgagcatggctggctgcccctggtgctcgggcatgtcgggatgctgtccagcggcaaggaggcggaaggtccctatcttcgcgcggcgcagacgttccgccggctccaggatgcggagggcgaggtgctggcggccatcaacctgcgcgccatcctcttggctcaaggacgaaccgaggaggcctgggattggacgcggcgcgtggtggaggtggcgagcgcctccggtcggccggagctccacgcacgcgcgctcatcgtcgaggccagccagctttatgaggtggagctcgacctgggccgggccttccgtgtgctcaagcgagccgagtcgctcgtcttcccggacggcgcggaagggctgaagaagcagtacctgtccgtcatgagtacggtgagcgagcggctgggccggttggaggaggcctcggacgtcaatgcccggctggtggagttgacccggagcactggcgacctcttcctggaagcgcatgcgcgcttcacgctcgccaacgtcacgctgcggcggctcgagcgtgaccatgtgccggcggaccgggcgcgagcgttggagttggcgcggcaggccatggccgccgcggagagggcggggaacccaacgctggtggcccgggcggtgcgtctcacggcggacctgttgggagacacccccgaggatcgccgtgaggcggacgcgctcatggagcgctgcatggcgctcgcggagtcgctggattcggacgagcggcggttggcgtgtctctggacgcgcgcggagcggcgggcaggcgtggacccgaccggagccattcaggactcggaggcgtcactgcgactggtctccgaagtaaacgacccgctgttccatgcgctggcccttcgaggccgcagcacggtggcgtaccggacacagcctttgccccaggcactggagcatgccgagcgcgccctggacgcgctggaggccctgcgccagacgcagagtgacgcctccagccaggcggagctgttcgcgacgtgggcccgcgactaccaccggctcgcggggtggacgttggaggctggcggggcgacgggcaagcccgctacgctccccttcagggaggctgtgtcgcgggccttcgccgtgagcgaacggctccgggcgaggacgctgctcgatgccctggtcgccttccgagcacgcgcggactccggggacacgcccgagcgccgggcgcagcgaagcgaggtgcaatcgcggctggtggtggtccaacgccagctcttggacccgtcgctgacgagcgctggacgcgaggcggccctgaatgaactccaggagttggagcaccgcgagcgggacctgcgcccggcgcctcacaagagtgtgcaggagttcgcctcactggcgtccgtggagaaggggctgagggaggacgaagcgctgctggtcttcctcgtgggggacgacgaggacctctccggaacgtcggcgggtggtgcgtggctgttcgtggtgacaggggagggaacccacgtccatcgcatccccgagcgcacgcggctcgcggcggcggccacgctgttctccgggctcgtcgagcgcagggatgactccgagcgcggtgcggcggtggcgcttcatgcgcagttgctcggcccggcgctcgcgggattgccacccacggttcggcggctgctgttggttccggacgggccgctgcatgacctgcccttcgccgcgctgcgggagcgtcgggacgggccacccctggtcgctcgctacgaactggccctggtgccctcggcgagcttgtggcggcactggcacggggaggccccattcacgcctatcggtgatgcactggtgctggcggaccctgagtgggccctgaaacagaggggggcgcggcctgcggcgcgctctcgggctggaatcttcgacgaggccgcgcagctcggcgcgctgcccgaggctcgtcgcgaagggctcggggtggagcgggagcttcgaggcacccgcgtcgtcccccggctgctggtgggcacggaagcctctgagcgcgcgctcaagcgcgcggacctgccgctgctccgggttctgcacctggcggcgcacgccgtggtggacgccgaagcgccggagcgctccgcgctcgtgctcgccccgggctcggaggacgaggacggcattctccagccgcgcgaaatcatccagctgcgtctcgatggcgcgctggtggtgctgtccgcgtgccgcagcgcctccggagcggtgctgccgggagagggcgtgctgagcctcgcacgggccttcttcgaggcaggctcgagcgcggtggtggccagcttgtggccgttgcgcgacgaggaagcggcggacctggtggagcatttctaccggcacctggccaagggcttgagtgtctccgcggcgctgcgggccgcacagctcgaggccatcgacgcggggcttccacccgcggcctgggcagggctggtggtgctcggcgatgccgcgctggtggtcgccgcgcctcgcgaggatggtgcgcccatggtgtctggactggctggggcgcttgtcattgtcgcggcgttcctcgggctcctcgcgttgcggcgctggggccgttcaagctccgaacgttccacgccagtgaggcgcgcgggagatgcccgaggtcaccgattcagcggtcgatgagttcgctggccgccttcttcacatgcgcgtcggcgacgaagcacgggaccgacgtcgaggcgtcagaccttgcgcggccccaccagccgccacgcgaggggcagcagcacggcggcgatggcggccttgaggagccctccaggaaggaagggtgtgaagccgacgccaagagccttggccacgccgagccgggcggacaggacaagccagggcaggccgaccgcgaagacggccaactgccccacggcaaagagcggcagcgcggtccacggccgccggtcgaatccacgctgcgccgccagtcccaccaggaaggcggctggaacgaagccgaccaggtatccaccggttgctcccaggatgcgttccaggccgctggcgccctccgcgaagaacggcaggcccaccgcgcccatcaggaggtacaggaactgcgcggccatgcctcgcacggggccgagcgccgcggcagcgacgatgacgcccagggactgacccgtgatgggaacaggtgaacctggtaccgatattgagacctgcgcgagccccgccgtgagcagcgcgccgccgagcacgagcgccacgtcgtgggcccgggaacgcgcgagcgcatcggcgagcacgcgggggcagtggcgggcagtggcggcgagcgtcaggcggagcctccagaatcggacaccgcgaggacacggcgcgccgctggggtacacgctcatgtctcgaggtgcaacgccggagaaacccgcattcctccgtcgagtctgctcctgggagcgcctgggcgacttcgataacaccgcgatgagacagccatgacgcgaggcggcacgtttgagcggcgcactgcgtgccaggaagggctgcgtgccggcacggcggtggagtacaaacgaagtgatgcggggcttggacgcatggtgcctcctgcgtgagcccccgcgcggaaggacaccaagacatgaacgcaacccgctggtttggactcgcttccctgaccctgctgctggcctcgaacgccttcgccgaggacaaggcccccgccgcgaccaatgccgccgtcggccggtggacgaccatcgatgacgagacgaagaagcccaagtccgtcatcgccatctacgaggagaacggcaagctgtacgggaagatcgagaagctcttccgcgagcccaaggaagagcagaacccgctctgcgacaagtgcgagggctcgctgaagaaccagcccatcatcgggatgaccatccttcgcgacctgaagaaggatgatgacgagtggtccggcgggagcatcctcgacccggcgaatggcaagacctacaagtgcaaggtcgccgtcgaggatgggggcaagaagctgaaggtccgcggctacgtcggcatgtcgctgctgggccgcacccagtactgggtgcgcgccgagtagcagcttcggcggacggcggaagcgggtacctcccgcttccgctcgccgtgcctacttcgagccctgctgcgtctcacccgcgccatccgtggacacgggcgtcagcggcgccggagcgccttgaggccgcgtggtggggctggtggaggcgccaccactgggacgcagcgcgttctggcccaggcgtgagaagttgatggagttgctcaggatgcgcaccgcctcctggtccgcgtggaagcccatggagttctccgcctccacgaagtccaggtagaattgagcgcgcttctgcaggtcgcgcgccttggcgagcgcctcctcggactgccccgccttctgcgcggcctcgatgtcatggatgaggtccaccagcgcatccatggcgatgttccgcgtctcgaaggtgcgcgtctggatggtctccgcgcgctggagcagctccgcctcgctccacttgtggcacgtctggcacgcgcggttgatgttcagcagcgggctgcgcacctggtggtcgctgaccttcatcgccccctcgcgcatgaacggcatgtggcagtccgcgcaggccacgccgctcttcgcgtggatgccctggttgtacatctcgaactcggggtgctgcgccttcagcaccttggcgcccgtgagctcgtgcgtccagtcggagtgtccgtcctcgtcgtagtaggccatgatctgatcgatgttgatgcccttggcccaggggtacgtgaggcgcttctccttgcccttgaagtagtactcgacgtggcactgcccgcacacgtacgtgcgcatctcctggcgcgtcgcgtcctgattcacccggaagttgggcacgccctggctggccttgagcgcggcgatgccctcgatgaagccaggccgcgtcacgcgcagctgcatcgtggtggggtcgtggcagtcgatgcatgagacggggtgctccaccagcttgcgcgcctccatgaagggcatctggttcatcttctcgaagcccttgatgaggtcgccgtcgccgagcttcttgtagggcacgtacacgctggcgtggcagtggatgcaggtgcccggctgctgcgtcacgtgctggcgctcggtgtagacctggtcgtccagcatgtgcgcgtggccgcgctcctcgcggaagtccgtggcgaaggcgtagccgctccacatcgtcaccagccgagggtcctcctcgagccggctctgcgcgacgacggtgcgtgggtccgcctgggacggcgtgcgcgccacggcttcactgccgccgtaacgggtgcgctgctggtccacggtgcgcttgtagctgtcgtactgaagcgggaagttccgtccccacacctcggggtcggtgatggtgtcgtccagctccaccacccggtagaagggattcttcgcctcctgcttgcgctccatgatgttgaccaggagcgcggtgacgccagcggcggccagagcggcggccaccgccacggcaatcaccagcttgacgccgctgaagcgccgttgcttctcgggctcggtcatcgttcaacctcctgatggatgagttcggggttcccggagccttcggggtgccccactgagttgtggcaggtgaggcactgcagcgagtctgcgtggggcgtttcgatgctctccacgaggctggcgtggcagttccggcaagcgctctccgtcacctgccggttggcggggcggatgcggatggggtccgggaaggtgccggtggtgaagtagaaggagtgccagaagccgttgctcgccttgttgaggtacttgggcaccagcgccgccggcgtgtggcagtcgttacaggtggccaccgcgtggtggctgctcttgcgccagccatcgtactgctcggtcatgatgtggcagttggcgcaggcggctgggtcgtcatgcaggtaggccgcgcccttcgcgtacgcgaaggtgtagccaccgatgccaatggccgagcccagggcgagccccagggccactgccaggagtgtgcgggaggccgaggacacgcggaacaccgtatcaacggttgtgcagacggctagccccatctcgcaatcgcgtgcgaatttccacgccgtttgggaggccggagccgggttgcgaaatttttgcgcccatgcgggaggcgcgcagcatttgcgtcgcataacacgcgtggtgaaacctctggatccaaggcacgggcccggaggttcacggtccacttcttggtcgtgcggagacagcgaggctgagatgcgtgtcgccgaggtcctcggtcagcacttgctcttcaagtggtagcgacgacaggctggcgttgagcgtgccgcgcagctcgcgcagcagcaggtacgcgccgagtgactgctgggcctcaaggacgtccacaagggaggcggtgcgccgcgtggctgtgcacgccgtccgtgttgaggatgatggcctcgatgtccgccagcatgggggacagggccggaccaggacagtcgaagcctcggcgcgtggggcgcggtggccacgtcggcgacgctcagacggaggaacctccatccggtgttggagcaacggggcgcctgcatcgcgtccctcagggcagtccaacgcaatgacggcctgcttgcgctcggccaggacaaccccgaatacctccgagaggaacccccgcacctgctcttcgtcgatggccaccatacgcttcctggtggccgtccttctgcccaggcgccagctccctcgcacgtggcggccaggcaggcgctggctgatccacttgctagatgacgggagccctcagctccgaccccctcctgacgaactacacgggattcgggacttgccccccggcggcgactcctcactcaacgctcctctgcacctcattggccggacgctgacgatcgccgccagcagcgcgcagacggccaaggcaaaatctaggcgctgcccgtagccggcaatcaccagtcccgccccgaggaggttgtagtagaagagactcaggactgcgccagcagttccgaaccgatcagcataggctcgcagggcgatgcccagcacattggggatcgcgacggcatatgcggacgagatcagcgtcacgccgctcaggaaggccaggctctgcggcagaagcgcggtgagcaggatgacgagcgcggtccccgcccccaggaggaggacgccgagcgcgatcagcgcttccgccgtccaaccgcggcgcaacagggcacggttcatcagcgcccccgccagcgcaccggcggcgagcaggaaaccgctctggccgaatgagagccaggggttctccaacccggcaaagaggaaggggccaagctggtaccaggcgaagatcgcggcattgaatgcggcgatcagcagggtacagcgccaaatgccgggatcgcggagcatgactcggaaggtgggccagaatggggcgacagacaaagtagcggggcgggtttcaggccagcgccagagactcaacccgagcatgaacgccgcaagcaggccgagggccgcgaagacgccactgtgaccggccttggccgcgagcagttggcctgcgaagaggcccaccgccgggctgatagccagcgccagcccaagcaccgcgaagacccggcccagctccggcccagcatggctatcgcgtagcgcggtctgggtaacgatcgatccaaccgccgccccgaaggcggaaataagccgtgcggccagcaaatgtgagaaatcactggcgaccatggcccaagccgcacccgccgcataaagcgcaaggcccgcaagcagcgccgggcggcggccccacagatcggagagccggccccaggccaccacgccgaaagcgaaggctgcgaaccagagtgacagcgtctggcccgtttcggctggggtgacgcgataggccgtagcgatcagcggcagggctgggctgtagatggtttcaacgatctgcggaaagctcaggagcagaatggcgagcaggaacggcggacggggggacatggcaacctcaacgacgattcgccatcacgtctagccgttcgggcctccgcgtattacaaacggaaagacaatttccatcggaaatcggacaagtgccctggctagcgcccagcgaccctttcgaccccgaccagcaggcggcgccggtcagcggcatcgcctcgctgctggtgcgccacgattccggcctgcacagccatcaaagagggcagctcctcttcgcctacgccggctcgatccgcattgcgctacccggcatgatttcgatgctgccgccgatccgggttgcatggattccgccggcgaccgcgcatcgcgtgttgatccgcggtgaggtggaatatcgctcgatctatctcgacacgtcccgcatcgcgcccccgaccgaggggtcggcgatcctgtcgatgacaccgcttctgcgtgaggtgttcgaacggatcagccatgcgccctttgagaccgactggaaccagggggctgcggcgaacctgctggcggtctgccttgatgagctgcggacggcccggcgcgagccgatgctcttgccggtgccgagcgatccgcgcctctcgcggctcaatcttgacgaattgccgcccgaactctctgggctcgcgaacctggtgggagccagcgctcgcacgatcactcgcatcttccggcgcgaggccggtatgagttaccaggcttggcggcagagctggcggcttctgcgggcggtggacttgctggcctcgggagagaacgtgagcggggtggccttcgatttgggcttcgccagcgacagcgcctttatcgcctttttccgccagatgaccggcgaaacgccaaggcggtatctgcgcggcaggacatgaccacatagaaagccaaagcatgctcggtttcgagggttctcgtcgtggggggcgaagatggcacccgccaacttgccacggcggaggcatacgcgccctgagcgaacggcctctctgaaggtggcatcccccaccgctgggagctgacggcaagccgaggccggtcaggtgcgggagcgccgcttcggtagacaggttggctccgctgcctgcttccgcccctcaaccgttcgcacgtactccacagggctttccactggcggcgctgaaggtgggcaccgcgcctcgtgtggcattcgaggcgcggtgcttcgtcgagacgagctgttgacccgggcgggacgggcgactgcgggtcccacccggcgttcaccgtcatccgctccatcgcgcgtacggtgacgtagggcacgaagcccgcggcgcgtgagcgggtgtatgcatccgcgacgtgcgcggagtgcgtggcgtagtcggtggactggtgtctggccaccagcttcggcgaggccacggcccaggagctgctggacacctacggccggcgcttcaccacggaggagacgttccgggacgtgaaggacctcaaattcggaatgggcctgaaggcggttcgcgtgaagacgccggagcgcagggacaggctgctgcacatctgaggggatgcctcagggaatgccccgcatcgcgcaagcatcatcctggcaccggcgccgacaggcgcgtcatgacaggaatgtcatggcaactccgactttgaggccaagggtgtgtcgaaaacccttggaaacaccgggggtatgggttggcgcggtcgttgctgatgagggggcactgtcaacccacccccaaggagcaacaccccatgcagaactccaggtcctggctcgcggccgtcgcggccgtcgcattcgtcacgacgggctgtgattccgatgaagctcccgacgcgaagaaggtcgccgacatcgccgcctcccggtcggcggagacgctgcgaggtgtcagcagcagcatgaagaccgtgagcggcctgtcgacgctcaatggcctggacgacgcgatggcgctgttcggcgctggcttcgagggcgtgccgctccctgggctgcaggtgggtgacgaaggcgaggcgctgtccaccttgttcgacgcggatgaagtggacgcgcaggcggacgagttggagcggttcctgcgcgagcgcgtcttcaccgaggccaacgtggagtccacggaggacaacgccaccgtcttccgcttgaagggcgagcagatctgcacggacggcagggcgcctgcggacgcggactgtgtccgcttcgtggatgatgcgcagctgcgcgttcgcgcgacgaacctgggggacgactccctggagttggagttgctcatcggcgcgaagcgcgcggagccgctggcgctgcgcttcctgccgaaggccgtctcgctggtggtggacctgggcggcttgaagggggcggtggagcagctcgacgccgagtcggccgggttcctgccgaaggtgatggtggggcaggttgagctcaaggtgacgaaggagggcgagtcgcactggattgtcagcgcctccatcctggacgcgctgcggctggagctggcgctggaggggagcaccttcgcgttctcctccgcgcgggcggtgccgctcgtggcgttcgaggcggacggccaggcgaagcgcgcgcgcttctcgctggacctcaacaccacggaggttcgccttccttacacggggttggcgccggcgctgcgtggcaaggattggacggtgtccctggccggcatctcgtactccgtcgaggcgacggagaaccagacggacttcgtggtgaagaacctgggccttggcgacgcgcagacccacctgagcctggggaacgacaagctcttcgcgctggacctcaatgagcagtcgggtcggcacttcgacgtgacgctgacgcgcggggcggacggcgcgccgctgctgaaggtgcagccggagttcgacctggtgacgcgcttctacctggcgccgctgaaggcggaccccgcgtcggagatccccgcggcgtatgaggacgcgacctatcggctgcgtctcagcgggggcgcagggggaccgagcttgcgcgcggcgcccgccaacagcgccacgggcttcaagggcggcctgcaggtggtgacgggcgagctgctgctctccgcgaatgactcgcaggtggtcgtcgcccaggggcagtgcctggtgggggcggagccggcttcagagaacgatgcttcgctgttgtcgtacctgcggcagggcagctgcgagtagtccttcaacccttcgatgccgcacgtgagggccgcgcccattccaaggggggcgcggcctgttttttctttcgggcggctccaggagtcgaccctcacgaggccacgaagccgtggccccggaccttgtccggtgtggtgcctgtcatccgccggaacatcgcgatgaaggcggaggcgctgctgtagcccaggtcgagcgcgatggcctccacggagtggccctgctccagcctcgcgagcgccttcaccacgcgcagccgctggcgccactcgctgaacgacagccccaggtgctgctgacagcgccgctccagcgtccgctccgtggtgtgcagcacccgcgcccactcggccagggagcgctcatcctccgggtgctgctcgagcgccgtgaggaccggctccaggagcgagtcatcggacatgggcaggtagctcccatgggtgggggccagcgtcagctggtcgatgagcacccggaacagtcggcgctcggcgctcgtgcgaggctgcgccagctcatgcgcgcggaggtgctccagcaatgacttcaccagagggctcaccgccagcgcgcacgtcgtcttgggcatgccccggcaccacgcctgcgcgaggtagagcgagcagtggctcgcctcgaagcggttcatgccccggtgctccacgtcgggtggaagccagatgccgtactgcgggggcgccaggtagtggctgccggccagcttgagttccatcaccccgctgaacgcgtagacgaactccccccaggggtgccgatgccgggggtacgtcgccgcggcaggcaggctcgccgtccggaaatacacggggtgtggaaggtttgtggtgaaaggaacctggagctgcttcgccatggcgccttctcgggatgggttgtcggaatctcgctatatcaatcagccccgccatgcgcaggatgttcgcatgagttctcatcggaaacccgcggacggcttcgcgctcgcgagcatgctcgcgttgtgcgccatctggggcatgcagcaggtggccgtcaagctggccgctccccacatcccctccatgatgcagatggcggtgcgctcgggtgtgggcgcgctgctcgtggggctgttgtgctgggtgcgcggcgagcgagggctcttgcgccgtggcccctggcgtccagggctcgtggtgggcgcgctcttcgccctggagttcctcttcgtcggcgaggggctgcgccacacccacgcgtcacatatgggcgtcttcctctacaccgcgcccatcttcgccgccctgggcctgcactggctcgtgcctgccgagcggctgcggcgcacgcagtggttgggcatcgccgtggctttcgtaggcatcgcgctggcctttggcggtggctggctccaaggcgacatcagcccgggcgtgctctggggcgacgcgctggggctgctggcaggactggcctggggggccaccaccgtggccattcgcgtgtcggcgctgtccgatgcgccccccacccagacgctcctctaccagttggtgggcggcgtcgcgctcctgctgccggtggccctgctcaccggtcaggccggcccgatttcaatggcgcccattgcctgggcaagtctgttgtttcagggcgtcatcgtctgcttcgccagctacctcacctggttctggctcctgcgccgctatcttgcctccaacctgtcggtcttctccttcatgacgccgctgtttggcgtcagcgcgggcatcctggtgctgaatgagcaggcggatggcttcttcgccgtgggggccgtgttggtgctcaccggcattctcatcgttagtggttcgagcctgcttcggcatcagcccacgctgaagacggggacgacctgagccttccgcgccggggggagggagagcgaggtcgatgtgctgtccacgacgccctgaatccacgttggccgacaacccgcgtagagggtcaggtgcgcaacctgggtcttcccctgggtattgaaggtgatgccccagcctggctgctgcgcgttgtaccaggcaccactcaaggtcatgaggccgggcgccgatacatgaggtcggtgcgcagcgcgtacttgcggccctgggtgacggtggcgccctcgtgaagcaagcggtgattgaagagcagcgcgctgcccgtgcgcggcgtcacggagtgcccaagcgacaggaagttcgttgcgcctccgcccggacattcattgaggtagaccatgaaggtgaggaggctccgctcgtcgcgcgtcctcacgaaggcgccgtcgaaatgcggggcgaagtattcacccacgtcatatcggtagcagcgcaggcgctcattggcaccacagagggtccactcgtgttcgagccggtgcggcacatgcggagcgacacgctcgaacaacgtctgcgccaaggggacgtcgtcgaacatcacccgggagttgttccggatgtccgggcgcatcacgaagcccgcggaagtggtgatgggggccgccgtgggcccctctgcttcaatccgttcgatgagcgcggcgcactcctccgcgctgagcaggtcacgcaggacgatgacgagcgggttgtgcgtaccgagcacatcatccgggttgggcaggacgggcgtcatggtcttcgcgaggcggaatgtgggggcggccacggccgggccgtggggcggactctatcccggttgacccgcgagcaaccaggcgacggcacctggcatccatccacggggtgactcctgggtgactgggttttcgccgaaaggcaggcgctggtcagggaggttcatgcatgccggcggtccatcacaggacggtggatgcggtttcgtcggtgaattcgagacgctacgctgaggtccatgaaggcgaaccgaatcgtcctcgtgtcgggcccgtcaggtgctggcaagtccaccgtggcacgtggactcgcggagcagtctcccctggcgcgtgcggtccacctgcatgccgacgacttctattcctacatccgcaagggtgcgctggcgccctggctgccggagtcccacgctcagaacaccacggtgatgacggccctggcggcgagcgcggcgagttatgccgtggacgggtatgaggtcatggtcgatggcgtcattggcccttggttcttcgaaccctggcttgtcgccgcccggacgcatcggcttgacttgcgcctcatcgtcctgcttccgggcgaagcggagacggtggcgcgtgccacgaggcgtgtccacgcggacgcactcaccgacgccgacgtggtgcgtaacatctggcgcggattccgcgaggtggccctccccgaggggcatgtgctcgacaccagcaatcaggacgccgcggagaccgtgggcgccgtgcgccgtgggttggcggacgggcgcttccggctggagtcaccgtagggcatcggtgcgttccgcgcgttcgttggccctccagcaggccttcaatcgttccaggtccgctgtgatggcttccgcgtcccgacgaatcgcctcggcggacatgtcgcggcggcggcggatgatgcgcctcatgtgcaggcgcatcatcccgcagcatctcagtacatgaagttcaacgcgacgatgtcggaaggggtgaactcaccgtcggtgccagacgggtagcaggtattcatgatggacccgcccggcgttgcccccgttggcgttccggggatgtgcaatgcgcccgtgcccgtcggctccatcgcgccactgccacagctgatgctcgggttgaaatggtccgtgtggcggaggcccagcgtgtggcccagcgcatgggtgatgacatgctcattcaggtctacgccgtagctgttcaggccggtgccaatcgaaatcgccccatagggaagtcctcctgagggaaagcccgcgacgtgaccactccccgccatggttttcgcggtgatgttcgcggtacagccggtggccgggcctcgaacaaaggtaatcctgagtcccaaggcattgtagttggcgagtgccatatcgagaccttggatgagccggacatagctccggaactccgtcgtgggattgacgcaaatcctcgtcacgctggagccgacgatgttggtcgtcatgtagtgctctttgcttccctctccgcgctggagcatctcccgggaggccgcgagcgtcacatgcgcgtcgcccccgacgtagacggcgtcatcgacgacggtgatgtcgtcggggcgaaaccctgcctcggtcagattggagaggagttcagcgttcccggtatgtgagtcgggcccgcagccggacagcaaggcgccacagttcaacatcaggactgccgctctcttgaacatggttcgatgggctcctgtcgtgaatcgggtttctgctctgctcgctcgagcaaagcatggcggaagtcgaggcggcaccgtgcctggccactcctttggcgactcccgtcgcccatcatgcaggcggctgaccatgacgggccggtgcggcttccctgccacaggcacgggacttgctgggagtgtggagatgtgtctctccagcctcgtgcttacgtgggtcctttccctccaggcaagtgccgcgccttcatcgcccaagccagtcacggtgatgacctacaacgtcctctactccgctcccgaggaggacgtgcagaagtcgctcgatgtcatcgagaaggaggcgcccgatatcctgtgcctgcgtgagctgacgccgagattcgccagggcctttcggaagcgactggggaagcagttcccccacgtgcggctggtgccgcgaaagggaacctggggtgtgggtatcgccagccggtatcggctgttgcgaacggagcacttcccccagacgccacacaggatgcccgcgctggaggcggacatccggctcggtgagcattgggtgaaggtggcctgtgtgcacctgatggcgccaggtgccaggcatcagcgggcagatgacctgctcacttccatggagaagaacgcggtgcttcggcatcgtcaggcggaggcgctggtgcggcgctatgcgcggtggcgaggaccggtcctggtgctgggggacatgaatgaaggccgctcaggcaaggccatgaaggccttcgcctccgcgggtttccagcacgcgtgtgacggaccggacgccgcctgcggtgccacatggcctggcactgcctccgtcctcccgagcgtcgtcgaaatcgaccatgtccttggccgcgaacttcgcctgagcggtgcgaaggtgctgcgtgcgggaggctcggaccacgatgcggtccgggcgacgctggactttccactgtgacgttccgtggaccggggcccgcttcgccgatgtttcatcgccagaggagacggaaggtgagggcatggcgcgaagagcgccgagcccaccagggccgtgggcagcctgggagagattggcgcccagcagtcctggcgcagtagcgggccaccacgccttgattccaggtccggcgtgccccgagcctcaagcctggacgcgcagcacgccgccgaagccgcgctcgcggcccaaggcgggagacacgccggcttcattcaccgcttcgcgcccggagatgagcaccgccttcaccgcggcgtcgttgcggttgaccaggcggacgaatcccccgaagttctccatgggcgcctcggccaccttgtcgagcttcgcgtccaggccgtcgggctggatgaccaccaggtccgcgcggcggccctccgcgagcacgcccgcatccaggccgaaccacccggccagttccccggtcagccggtggacggcgcgctccacgctcatgaagggctcgccgcgcttctccgcctcgcgcaccagccgcagcagccgcagggggaagttgtagtgcgccatgttgcgcaggtgcgccccggcgtccgagaagcccatgaggatgtccggatgccggcagatgcgctccagctcctcgcgccggtcgttggccatcaccgtgtaccagcgcagggcgtctccgtgggtggagatgagatccaggaagacgtccaccgcgtcacgcccctgctccttcgccacctgggcgaaggacttgcccaccacgctggcgtcggggcactggaggatgcgcgactcgttgaagtcccggtggaaggcccgcggcaggaagcggttcgtccactcgcggcggaagcggctgcggtactccggcgttcgcagcagccccgcgcgtgaggctgcgtcctggaggtgaagggcagccgcacccgcgccgaactcctcgaagacgaccaggtcgatgccgtccgcccagaggtcgaagatttcgggcagggcctgccaccggaagtccgcccccagcagccggttggccacctgggacagcacgccgatgaggcggtggatgccccggttggcgcgcgtgtccatcatcgagatgacggtcgtcttgaggctcgggcggaacaacccgacgctctccaggaagaacagcaccacgttcaccttggtgctgatgttgggcacgccctggaatacacggcctcgttcgcggagcagccgcgtcaggcggcggtattcgctccagcgggcataggtggacggcagggggcggctgcggatgtcgcgcgagccgcccatcttgtcccatttgagcgtcatgatggacaggcccacgtagccgagctcgagcccttcgcgcaccagggactccatggcgcgcagctcgtcctcccgtgggcgcaggccgggctccaggctgcggtgcaggcccatggtgtgggctcgcagcgcggagtgccccaggaaggacgcgacatgggggcccagcggcaattgctccaggtgcgtcaggtagtcaccgagcgtgttccacgtcttgcgctcctccagcagcgaccggacagtctcgtagggaatggcctccacgcggcagaacatgtccgccaggtcctcgggcgtgcccagcgcgaggctgagcgagcagcttcccatcagcaccgtggtgacgccgtgtcgtacggactccgacagcgagggcgccagctccacctccgcgtcgtagtgcgtgtggcagtcgatgaaacctggtgtcacccagtggccggtggcctccatgacaacgcgtatgtggggcgcgcggaatcggtgcttccgaaagcgtggtgacagtgtttccccggatgcccacatggagcttgcgcgggggattgcccagaccatcgaatacgaggccgttctcgacgatgaggtccatgcacagagcctaggcaccgtcgagtgtcagcttccagccagaagacgcgccgacagttctctcccgcacatgccagcgtggatgtcattgcctgggcgcaccaggggagcgctcggcccccgggcagccgcaccgcaagggcgtgactaccttggcctgcggaaggtgcgaacgcaccaagagccaaggaggcgtgcaatgcaaggcaaggggtggaagtggctcacgctggtgggcctgggggcgtcgctcgcggcgttcaccgggtgcaatgagcagtccgcgcgggagaactcgcggcaggtgggccgtgaagtagggaaggcgacgaaggaggttcaggaaggcgctcgggaggccgcgaaggaaacccatggcgcggcccgggaggcggcgcaggggttcaaggaaggccggggcggctcggggaatcccgacgccggcgtcgacgctgattgaggatccgcgcgagggacttgtgcgcggcttccgtcgctagcgccgccgccgcggggaacccgtgcgttgggacggcgccgggtcgggcctggttcgggcgagccagtcctccaggcgctccgcggccttcagctcgtcggacaactggctccgtgcctcctcgggaaggggcacggcctgcagttgctgcttcaaggcacgtcccgtcgtggcatcccccagggcaatcgccagctccatccgggcggccagggcacgaacccggtccaccacgggcgcctccgcctcatacctggcgagtccgatgtcgagcgcccgcgcggcggctttgtcgtcattcttgaactcacgcaggatgcgcgcgttgtcgatggccttcgccaggcccgtgagcttcgcggagccgccgtactccaggtcctccggctcatcgcgctggatgaagatgatgttgttgccggtggggtcaatcagtgagaagcggctctggccgggcctgaaccgggtgatgcgaggcctgcccgtggccagcaccttgccgtacttcgcgcgcagcgcatccgtgaaggcccggtggtagggctccaccgaatccaccatgaccaggcagccacccgagttctcttcgctcgggtccaggctcttggcgcccttgccgaagtgcagctcgatgtcactccagcgcaacgccaggtacaggtacggcttggtcatctggtacgtcacggtgaagccgagcgcctggtagaacgccagtgtttcgtcagccgagacgcagggaagcaacggaacagtcgtttccttcccgctgatggcggtggccttcgtctcatgggtgggcatggcccgatgataaacgagcgacgttgccgggggcacctcttcgcgtcatgcgcccaggtgcctgttcctgcgtatggcggcgctatgagacgcacatgcgcggcggctcgtggcgcacgaagccgctcagggccgcacgacatcccggatgaaccaggtcagcgcctccgccatcttctggtgtgtggccgccgacgggtgccagtcctcgccaacgccgtccacgttgggattctgcacggccatcacgtgccggtagacgcgggcgtctccctgttgctgtcgctctgctacaagctcggtgagccagtcaccgacatgggccgaagtcgtcgtgccgttctgctcgagctgcttgcggccgtccgacatgctccccaacgtgcagacgagatgggcgcgcgggtggagcgtccgcagccgcgtgaggaacgcgcggtaggcggatttgaaggccgcttcgtccggaaggtaggcgtcggtgccgctgccggcgaacgtgtcgttggtccccgcgttgacgacaatcacatcgggcgacgggccagagaagtcccaggcgacgccgtggccggggaccgcgagctcgtagagcgcgggcaccaggccggacgtggacatgtccaggttgcggtacaccccgtggcccgaatagcagatgagcaccgcctccgcgcccaggttccccgccgtgagccaggcataggtgcgccggggattctggttcttcgacgtgaaggtgggcgcggtccaggagggcgagcccgggatgagggcgacgtcgcttccgtagccacaggtgacggagtccccaacgaactccatccggagtcccgagcgggcgggcggctcccggagctcgccatgaacctccagcgccacgagttcgctgtggccgaccagggactcggtgcgcttgatgagttccaccgtgtgcagccccacctccaggccggtggcgagcaggtagctggactgatggcggctcaccgcgagctgtcgcgcgggcgccccgtcaatcacgacatcgaagtaggtggtccccacctcgccaccctggcccgcgtcgtggagctccatccgaacggcgtctccccagaagcgggcacggatggtcactccggggtgggagaagacgacgccggtgtccgaacggtacgtccggcccaggtactgcacgcgtgcgtcgcaggcgggaatgcgcacccacgccagtgcacccgcgtctggcgcgagcggcggggtgtgcgaggctgacttgcacccactcaccagcagtccggctcccacgctggcgaccagcagtccccgcgccagggccgcgccgatgccacgcaccgcatgaagggcgttcctcatgcgctcagtggatatcgcaagacggacacgcatgcgctggggacgcagggcacccggcgtccaggggacgtcagcgcgggcatcgggcaccatgccggcacgaggctcggcacggtgccacgtggcgcgctacgggccggtcagccggtggagcgggaaggagggatggctccacgtcccgccggggatgctcatgttcagggaggacggcatggcgcccggaatgcccgccgcgccgttggtggtgaacgtccccgcgggcgtcgagcgattgtttcgtggccgtgcgagtccgcctctgggcctggcggcgtacgtccaggcccgggccgctgacgggctcaccgggcctgggtctgccgcgcggcctggagcgtgttcgccagcagcatggtgatggtcatcggccccacgccgccgggcaccggggtgatggcgctggcaatgggctggatggcatcgaaatccacgtcccccaccatgcggtagccgcgcggtgagctcgcgtcggacacgcggttctgccccacgtcgatgacgacgacgcccggcttcaccatgtccgcggtgatgaggttctgcttgcccaccgcgacgatgaggatgtccgcctgccgcgtgaatgacgcgaggtccggcgtgtggcggtgggtgatggtgacggtggcgtcggggcccggcgccatcagcagcgacgccagcggcttgctgacgatgaggctgcggcccacgatgaccacgtgtttgccccgggtggggatgtcctcgcgccggagcatctccatgatgccggcgggggtgcagggcacgaaggcccgggggtctccgacgaaggcgagcccggcgttcaccgggtgaaagccatccacgtccttcgccgggtggatgtgctccaggacggccttgtagggcaggtgggccggcagcggcagttgcaccaggatgccgtgcacggacgggtcggcgttcagccggtcgatgacggcgaacagcgcctccttcgacacgtcctcgggcaacgtcagcgtctggccgcgcatccccagggactcgcacgctcgtgtcttgctcgcgacgtacgcctggctcgccggattgttgcccaccagcaccacggagagcccgggggtcacgccggcggcctggagcgccgcgacgtcctgggccatctccgcccgcatcacccggctgatttcggttccatcgagggtccgcgccatgcgcggcttcttacgccagattctccaggttggcgcagcgcttcttcttgatgtccaccccagacggtgtcctgggacacgctccccgtcgtaccccgcgggccctggattcgcggtgagcaaaaagagcagggcccgcgcgcactcggggcttgggcggcgaatgaaagggcgaggacggcgcgacgccggacccgcttcgcttcccggagaaacccatgacgtccatgcattgtcgtgttgccaccacccagcgcgagctcgat

SEQ ID NO: 1229 - DNA, 29384 bp, Myxococcus xanthus
ctgcgagccgctgaagctggacgtcgccttgtcacccgaggcggagcatctgctctccgtgctgcgcgagcatcccacacccgccgaggcggccagggtgcttggccttcccgtcgtggacgtcgagcgccaggcgctgccgctcgtgaagaccgcgttgttgctctggggcctgccgttccggccgaacgacttcagcacattcgagagcgtgcgggacgcggtggcggcgctccccgacctggaggcgcgcacacgctggctggagcggtttgagaccctggcgcgtctcaaggcggacttcgaaagtggagacctggcccagcggcgcgagctgctgccgcgcctggaggctgccttcacggaggtcacgggcaagcccgcgcgccgaggtgacggacaggtctacgcggaccggctcatcctttacgaggaggcgagctcgcctttccggttgcgcttcggcgcggccttcaccgcggagctggaggcggcgctgacgggcgcgctggagctgtcggccgcctatggcgagaaggtgcaacagggcttccgggagcaggtccgcgacgcactgggcccggatgcgggccccatggacctgctggactacgccgtgcggctgcggcccgatggcgtcacgggcagccgcttctcgcccgtgccgccggtaatgctggagtccgaggagggccgcgcgcggacgctgcccgtggacttcctgggcacgtccacgccgggcgggcgctacgccttgccggacgtgtgcctcgccgcgaagccggacggaagcggcttcgaggtgatgctggcgcgggtccaccaccacctgctgctgtggagctggctgagcgcgttccagcccgagcgggagcggtacgcctcggtggcttcgcgttggttggaacaggacgccgcggcgcgggggctcgtggggctggccatccgcaggcgcaacaagggcttctacgtctatccgggacggcggttggtgtactcggtgtcggacgtgctggacgtggacgagggggccctgacgccgggggacgtgaaggtccttcccacgcgtgaaggcccggtgttggtggacgggcagggggagcggctgagcctgtacctgccgctcgatgatttctcgtcctatccaccgttcgcggcgctggcgcattcccaggtgctgcacgcgccgctgcggacgcagggcagtcacctgccgcggctcagcgtgggtggcgcggtgtaccagcgcgagcgctggaacctggcggcggagcggctgggaaggcccgcgggcttcgagctcttcctcgccgtgcagcgggagcggcgcgcgggtgggtggcctcgcttcgtgttcatgcgcagctcgaaggagcgcaagccgtacctcatcgacaccgcgagccccttcgccgtggacctgctgtcacatctggctcgggacgcggagcgcctgtccgtggaggagatgtacccggcaccggagcagctctggctgaaggacgcgcggggccgctacacctgcgagctgcggatgcagttcacccgctggagcgaagtaccggcctgacgccccccgacaattttggcgctttttttaccagaatggtccctcccccggcctggaggtgctgcccgacttgccaggatttcgggtccttttgaggagacagtcaatgcccggtgaaaacgtcgtcgctccccccgtcaagaagctgaagcggccggtggaggaggttcgcgcggagctgctggccgacgcggacgtgaaggagcaggcccgtctgctcaaggtgcccgtcgaggagtacgtcgagaaaatcatcgactatgccctcaacccggagaagccaccccagatcgagatcgtccccgacgaggagctgaaggccaaggaccccaacgtgcccaccatcgaggagcttcaggggcacctgcaggacatcgtcgacggccgcgtcgtcatcagccgggcgcatcagcgggacggcttcagcgaccaggacgcggacgctcgcttcaagtcggcgctcgcgtccgacgcggcgcagacgggcgctcccgagagccgcaaggggacgtccgccagcgatctgcacgccgcggagggcaagaagccttccaccgacaagaattgatcggcggtggacccggcccggggagcatttcccggaatcctcggtgccttgtctctgcgctaagtccctgaatttaaatgggcttttgggtggcgtccggttttttcgggtaacagggaaacaaatctgcccgtctcccgacaattctcacatcggacgcacttgatggctgcaccgcagccatcctctcaaggggaactaccatgggcggtctcaagggaatcgttggcaaggtgctgaacgtcgtcaagccgttcgtgtctgcggtcaacccgctgctgggcgcggcgatgggcttcgccagcggcctcatccagggcaagaacccgctccaggcgctcatgggcgcggcgacggacctgattccgggtggcggcgccttgaagaacacagtgggcaagttcgccagcaagttcctcatggacggcgcgggcggcaacagcctgctgagcggcgcgctgaatctggccacgggcaagagcaaggtcaccgacgtggtgggcgacctgctgaagaacacggcgaagacgggcctgagccagctgggcatgaagaacgcggccgagctgtccgcgcagcgcatgtcgcagttcctggtttcgtaatagcatcgccggatgacgcccatcctctacgttccagagctgcacttcgctcaagtgcaggagtggctgcagttctggaacgatgccgtcacgccagagacgcttcctcagacgggcttcatcattcctggcaaggcggcggggtttctctaccggaccgacagctcgctggccatgattgaaaccctggtggccgcgccggggctgtccaaggaagagcgaagcgccgccgttgacctcgtggtggccgccatcagtgaggagtccacgaggctcgggttccaagtgctggtgggctacacccagttggacgcggtggtgaagcgcgccgagcggcacggcttcatctacgtggatggtggctttcacgtcatcgccaagcgtctcaggtgaaatgaagcctggagccgacatcttgattctcggagccggtgtcgtgggcctttcggccgcgcgccggctttctgctttgggcgcgagcgtcacggtgctggacgccgtggatccgggaggccggggctcgcgcgccgccgccggagtcgccattccgtccgtgcggttgttcgatgacccggtgatgctggcgttcgcccgggcaggccgcggcacgttggcggaggacctggcctcgcttccgggtggcgaccagcttcgccgaggcaacggcatcctccgcgtcgtcgcggacgcgaaggcgcgcgatgcgctggcggcgaaagcggtggcggacgcggaaggactgggcacctggcgggacgccgcgagcctggtgtcgctcgagcccgcgctggaaggtacgccgctgttcggtgccttcgagacggaccagggccacctcgtggacacggatggctacgtcgacgcgctcctgaaggccgctgcccacgtgggcgtgcggttgcggctgggcgtggccgcgcgctccgtttccgaatcctccacgggggtcgaggtccagacggaaggggagacgctccgggcggaccagttgctcgtgtgcgcggggccctggtcggcgggcgtggaggggttgccttcgctgccgttgaagcccttgcgtgggcagatgctggtggtgcaccagccgggattgcacctgacgcgcgtcgtctcagggccttcgtacctggcgccgtggcgctcgggcgaaatcgtcgtgggggcgacggaggaggacgcgggcttcgtggagcaggtgacgcccgcgggcctgctgcacctcagtgccaccgtcgcgaagctggcgccgcgactgcgtgacgcccggttcgtccgcgcatgggcggggcttcgggccgcgacgccggatggccacccgtacatcggccgtcatcccggcacccggcgcacctacgtcgccacggggctgggtggccagggcatcctgaccggtgcgcataccggtgccttgctcgcggagctcgtggcgcacggccattgcgccgccgccgagccgttctcgcccgcgcgtatcaccgacggttctccgctcgcaacgcgctgagcaggtgctcggcgctcacggatgcgctgatgcgcgccggcggggcacacgcccggggaagggcgcccgcgccccagcgggacgtcagtacaggttcaccgggtcgaacgggcggttgagcttcgtccgggcgcgaggcagcgcttcgtggaccgccttcgcatctccctgtgcgagcgcggccttcagcgcctccgtctgcttcggccacgtcgtgctcgcctccgcgcaccgcaccgcctctgaccagtccgtgcgtccagccgccacggcctgtccagccaggctctccgccgtcttcagcgggtccccaatggcgcgcgcatgctcctccgcgcgagcgaaccagtccacggcgacagcgggctgctgctcgtccaggaacaagcgtcccagctccgcggcaatcacctgccggtggaacgagtcacccagcgcatcggcgttggcgaacgcctcggtgaagtgggccaccgccgcgtcacgctcgccagcggccagctccagccccgccaggcggtagcggtggtgcttggcgaagttcacgccccagctctcgctgatcttctcgaaccggcgccacgtggagatggcatcgccgaactgccgcgccgtctcctgcagatagctggcgttggagatgaggttgattttcaggtgcgtggcgctggcgtcgtgcaggtcccccacgcagcgcatggcctgcttctcctccaccaacgccatgtccagcttgcgctccaggaaccacgtcagcgcgcagacgttgcgcagccagccctcctggagcgcccggtccggcgatgtgctgcgctccagcgcggccagtcccgcggccacctccgtccgcgcgttgggaagctgtccgaagcgcttcgtcagggtgagcgcgcggaacatgtgcagccgcgccaccagttcaggaggaatccggcacgccagccctcgcccgaatgcctccatcgccgcgtcgtgcgcgccggtgtagacatggaccacgcccatgctgcgcgcgaacagggccttcagctcctcgacgtcacccaggctggcgcggtcaatctcgatggcgggcgtggcgaagcccgtgtccagcgtctcccaggcctggaccacgcgagacgccaacgccgcgtccgtgttcgccgccagcaccgacagcccctgctcggcggccagcatggcgccttcgtagttggtggtgaagaagcagctccggatggcgaggatggcggcggccacccgtgtttcgggcgcctgggccgcgtccacggcgacctggagatagcgcccctccaggtccaccggcgcttccagcgcgcgcgatgacaccggaccgggcgtcggcacgcggggcgcacgcatccggtcgcacagcgcatccaggtaggcctgccgccgggactcgaaggactccgcgccatggggccggcgcacgttccacccggtgaacaacagggtgccatgcagcccttccaagcggctccactcggccgcccgcatcaccgcgcgcaggctcaccaggtcacattcgcccgcgccatggagcaccaggggccggccgctggcgcgcagcgtctccacgatggccttcgcggccacgttgaggacccagaacatctgctccgactcgcggtggaggcggcgctcggagggcgtcagcgccaggtcaccgaggtccggcacgccgtcgatggcgccgggaaacagccggttccattcggagggatgggcgcgggacagggtgtggacgacctggggcgcggcggcttcacacgcgcgaaggacctgtctcagcccaccgaacgcgacaggcagggccacccccacgtctacttcgatggcgtgcgagggcagcgcggcgggcagcgacgtctccacggtgacagccagctcgcggggacgcgcgaaggggggactcacgggaggctcctcggaggggcgcaaggtgggggtgagacacgacatctgtctcacgcgcatcttcacaccctctcaggaactgagcaatctagcctgcccggaaaatatcaggtgaaacgtcactttctgggcggagccggatgtgtcgagcccagcacctggagatccgttcccagcggagaacgggaacgtcagtcatgcgtgccgatgtgctgatcgccgtggtgagcgcaaacccagtggaaggcgcaggagcaggccacggcgcgggcgcgggtgcagcaccggccgccgaagtgctcaggaagtgccgtggcctcgtcgtcctcgggaggctctggcaggcaccggggcgccgagcggccggaatcggcgggctcattgtcgcagcagccgcgctccatgcagcgggggcacagggacagctcgcagtgggcgcaccagtcgaacacttcaccggcgcctccgcggcgctcacatcctccacaactgtcgaacatggacgacctccagtcgcatgccgatgaaggtagagagggggtctgacaggtgaagcgtccgatccgtcacgctccacgtgtgaaggcttccatcggtgaacgcccggcgggggggaatgtggggcaatgaaccgtcgtgagaggaatacggcgcgcggttggaacaagctggaggacgggcccgtcataccgggggaaggagcagagcccatgcgcaggccacggcggatcatcggtgtcttcggttctggcaaggaggaccacgcggagcgggtcatcccgctggtccggtggatcgccgaggcgggcttcgacctgctcacgggggcgggcagcggggtgatgcggacggcggcggatgccttcgtccaggtggcgtaccggcacggcatctccattggcatcgtcccaggcacggtggagggcggcgagtaccggccccgttcgggctaccccaatcccaacgtggagctgcccatctacacgcatctgccgctcagcggagagcaggggacggagccgctcagccgcaatcacatcaacgtgctcacgccgcacgccctggtgtcactgcccgggggcgcgggcacggtggccgaggcggtcctggccctgcgttatggcaagccggtcatcctctacggaccgccggagtcgttccggcgcttcccagcggagctggagcggacggactcactggagcgggtggccgagttcctccgggccgcggtgcgtgatccactccgcctggccatgccgtagtcgctggaaagcgtctaggatgatgcactcgggggaacgtgcgggggccacccaggcagggcgggccgcgtcgtctcgagtgcgccatcatgatcagtcccgaccatccgctcgccagttggttcctcatcatcgccgggacgctcttcctggtcgtcttcgcgattcccctgctgctgatgcccctgacgtgggcgcgctggttcgggtggcggctgccggaggggaacaatcacctcacggtgtacttcgggcgctgccttggagcggtggcgctggccatcatcctcacggcggcccgtttcgtgtcacggccaggccccgccatcttcgacctcatcggctgggtgtgtgcgggaatggtggttgtccacacctggggcgcgctgaagaaggcgcagccggtgtcggagacggtggagattggcttctatgcggtggtaggcgtgctggccatgtggatccgcttcaacgccttgagctgagcgcacggccatgtctccggtggacatcgaccccatcctcgcgacgctggcgccctacatccccggcgccgtgctccggcgtctggagcgcacggaggcgcacgcgctgccgctcgtggagccggtgcgaggcgccatcctgcttctggacatcgcgggcttcacgcccatcgtcgtcagcctgagcggcgccgggccccggggcatcgatgcgctccagcggctcctgacgagctactacacggagatgatcgacgtcgtgaaggaccacggcggcgacatctaccagttcgccggtgactccatcctggcctgcttcgaggtggagccgggcgtggacgccagcggcgcggtgcagcgcgcggcccggtgtgcgttggacgtccagcagcggctgtcccgcttcgcgcagttggagttgctgggccagcgcttcagcgtgtcatcgcgcatcggcatcgggttcggcgaagcccaccgggtggtgttaggcgccacgggcatgtggatgcaccccgcgctcatcggccagccgctggcgcaggcggtggcggcggagaagcgggccaccgtgggggaggtgctgctcagcccggaggcgtgggccctgctgccggagccggcccgtcaaggcgagacccgcggcaacgcgtaccgcctggcgcccaccgtgccgttgcgcgtgcctccagcgcccggcttcgtgttgccctccgggccggagatggtggcccggtgctcgctgctgctgcacccggtgctcttcacgaaaatcacgacggcgcaccaggagttcagcggcgacttccgcgacgtcacctgcttcttcctccgcttcgacagccagcgcgcgtccgcgcggccggaggacttcacccgcgacctgaacgccttctacgaatacgtccagcgggagagcgcgcaccacggcggcgtgttgctgatgacggacttcaccgacaaggggaacgtcctctacgtcatcttcggcgcgcccacggccttgcagagcaaggaggtgctggcctgccggctcgcgtgcaagctgatgcgggagcgggagtccttccccttcgtctcatcgctgcagattggcatcgccaccggtccggcctatttcggcgacatgggctctccctggcgcaaggggtactccgcgctcggcgaagtcgtgaacatggccgcccgcctgatgacgcacgggcagggcagcggcatccacatcgacgcgcagacggagcgcaagctgcaccagggcggcttcgacaccgagttcgtggaggacgcgcggctcaagggcgtgtcacgcgcggtgcctgtctaccggctgtcggcggaggtgcgccgcagcctgttcctcaaagggaagggcgacatcgtcggccggcagcgcgaggtggcggcgctgcgccagtccgtcgacgaatcgctggagggccacggccgcatctgcgtggtgtcgggcgaagcgggcatcggcaagtcgcggctgggcgcgaaggtggtggaggtggcggaggcgcggggggcccacagcctctacggcatctgctactcgtacgagatgttcacgcccttcttcccgtggaaggaggtgctggtccaactcttcggactgcacgaaggcgacgacgtggagacgcagctgtcccagctgcgccagggcttcgcgggcctggaggacacggggccggaatggatccccgtgctcgcgggcatcctggggttgcccgtggaggagtcaccgctcacgcgcgacctggatgcccggcggaagaaccagaagctcttccagatcatcctccagctcctggagaaggtgtcgcgccagacgccggtgctgctcttcttcgaggacctgcactgggccgacaacatctccgtcgacctcatcgagtacgtcgccgcgcggctgtccccgctgcgggtgacgctgctggtgacgatgcggccgggcgagcacctcaagagcctcaaggggctgcccgggctgcgatggttggacttgtccagcctggatgacgaggacacgcgggcgctgctgcggctgcacctgcgcatggagacgccggacacggcgctggaggacctgctgctggccaaggtgcagggcaacccgttcttcaccgagtccatcgtccaggggatggtggagaagggctatctgggaccggtggcgccgggcgccgagcggttggagctcaagcgcagcctccaggggctggagctgccggactccatccaggacgtggtgctggcgcgcatcgacctgctcacggagacggagaagttggtggtgcgcgtggcctccgtggtgggccgcatcttcacgctggaggcggtggccgcgctggcgcccggctcggtgtccccggagcggattcgcgaggccatcgatacgctgacgcggctggggctcatcctcctggagttggaggagcccttcacctgcatcttcaagcacatcgtcatccgcgacgtggcgtacaccacgctgctggtgtccgcgcgcgaggacctgcaccggcgcatggcgcgcttcatcgaggcccgcgccggggagaaccccgtcaagtcggcgggcatcctggcctaccactcgctggctggaaatgacgaggtgaagggcctggagtacacattgatggcggcgcgcagcgcgcgcgagcagtacgccaacgacgacgccgtccaccactacaaccgggccatggagattctgggcggcaccgtggcgttggacccggaggaggtcctacgcaagacgcacgtcgtgatgaaggaactggcggagaccctgctcaacgcgggcaactacgcgggtgccatcctcatgttcgagcagtgcctggcggacgaggagcaggtgccgcgccgcgcggagattcacctgggcctgggccgggcccaccaggagaagggcgagtcgaagcgcgccatccaggagctggagacggcgctggagctcatggggcgcacgatgccgcggagcatggcggcgctggtgctgcgctcggtgctggccatggggctgcacctgctctacggcctgttcccctggctggtgcggccactgggcgcgcggctgccgctgtacctgaagcagttgtccacgctcatctcgctcatcaagatctactacttcgcggacatcgggaagctcacctgggccacgctggtggccacgacgatggcggagcgctcgcgcagtgagtacggcctgagcctggcgaccagctactacggctcactgctgttcggctcggggatggtggggcgctcggggcactggtgtcagcgcgcgctggagcatgcgcggcgctcgcgggatacggcggcggagggcgtggcgttgagccggctggccacgcagtccatcttcaccaacgagcaggcccgcgccaccgagtacggcgagcaggcggtgtcgctgctgcggcaggtgggggacatgtgggaggtgcagacgggcctgatgatgctggccaccagccagttcctggcctcgcgcttccaggatgcggagcgtgcgtacctcgagatgggccgcgtgggcgtggagctcaacgcgctgatgcaccagggctggtcccacgcctgggtccccatgtgtcgctacctgcgaggtgatggggatgtgggggagctgtgcgcggagctggaggaaggcctgcgcatcagtatcgacgtccaggacctggccaatcagtgcgccagcctcaatcacctggtcaacgtggcggtgcgcgagcaccaggtggaggaagccgcgctgatggcggtgcgcgccgacgaggcgctgtggcgctaccacgtgctggtgcccttcctccagattggtctcgtggacgcggcggagggcgcgctcttcgcgctggagcagggcgctgtctccgtgccgcgcgagcaactgtgggccctctaccgtcgctgcgcgctcaaggcgcgggcgttgggggcgctctatccatacctgcgcggcccggccatgcgggtgatggcgcgtgcgaaggcgctcaagcggggcgcgaaggccgcggagccgctgttcgaccgcgcgctcgaggtgctggaggccacgcccaaccgctgggagacgggtgtggcctacctggatgcggcggcggcgttgcctcaccggcgcacggcgttgctcgcccgtgcgcgtggcatcttcaccgccatcgacgcgcaggcggagctgcggcgggtggagcggatggcgtccggtcctcaggatacggcgccgatgctggcggcggcgctcacgtgagccgctgcggctgaaggccaagctgggccatctgctgcgtgtcccagtactccagggcgtcctgcccggcgatgtagcgccgtgccgtgttcttcaccgggtttcggatgctcacgatttcgggcccggagaagaggatggtctgcttgtaccggggcatgtcgctcatcgtgagcttggaccagtagtggcgggcgatgttgggcaggctgccgagctgcgcgcagagccggtggaagtgctccaccacctctgatgtgtccaggctcttgggacggtggcagagcgtgtagccgtcgtagtcgcggctcaaggtgcctggcagcaggcgattctctgcctggagctcgcggaagaagggcgtctccggataggggcagacgatgcccaggaaggtgacggagaagtactggaggtcggagaggtactcggggagcttctccaggtacgcgttggtgtctccgtccgagcccacgatgaggccgaaggacaacaggatgccggcggagaagacgcggcggatgacggcgtccacttcgctcagcttgttctggcccttgttcatggccttgatggagtcggggttgagggactccaggccggtgtagacgtagcggcagcccgccttggccatcagcttcaccagcgactcgtccttgaggacgttgaaggtgagggcgcagccccacgtcttcttgagcgggatgagggcttcgcacagctcgcgcaggtatttcggtgagccaccgaggttgttgtcgaggaacacgaaggcgtcatccatcagccccatgaagttggggttccagtgcatgtgctgctggatttcgtcgatgacgtgggcgacagggcgatagcggtagcgctcgttgccggtgaggacgcagaagttgcaggagaaggggcagccgcgtgaggcctcgataccgggcaggcgcagcttgttgtgggtgaagtcgatgaggtcgtagcggtagggccggatggcggcggggcccagcggcgggcgctggtagcgcggctggagctggcccttctcgaagtcctcgatgagcgcgggaacgttggcctcgggctcgccggtgatgacggcgtcgaagtactgctgggcgtcgtccgggaagtagctggcgtggcggccgccggcgaccgtcgtcatgcctcgctggcggaagagggtggagagcaccttggtgtgctcgtagaaggagtgcaggtaggagaagaagacgaggtcccagtggcggtccatcgggatgtcgcgctccttctcgttgaagatctccacctccacgtgcggcgggcacaggccggcgatgagctccggcacggaggactgcatgatggagggctctttgaggcgcagccgggtggggtgcgtgtacgtggcgatgacggcaatccgcatgcgatgacgtggctccaagacgaggcggcgtggccacggtgcggcaaggagcacttgtcacatggttcggctccccccggcctggccgtgaaagcagaatccccccgtttcaagcttcacgcaaaatgacagcggcttgatgtcgggggccggcgacgcgggcgatgcagggacgtccactccacaccccgcaacacgcgctcaagcggaaggatgagacggagccatcgcaagttccagactgtcgtgtttcgcgcgcgattcatcgtgcatccggcttcgtcacaccgtgtgcatggagtttcaatgagtgggtcattatctagtcagggtccgcttgcgccccccggcgcgcaccagttgttccccgcccccctcatccgccgagcgccctcccatgactgtcagcacctggaacatcgacgcttcccactcgtccgtcctcttcgtcgcgcgccacatggtggtggcgcgagtccacggtcgcttcgagcgtttctccggagtcctccgggtgaatcccgagcagcccactcagggtgaagtcgagatgtccgtggaaacggcgagcatctacacgggctcgtcagaccgggacgcgcacctgcgttcaccggacttcctcgacgccgacgccgcgcccaagctcacctttcgcagtaccaggattgaacccgcgggcggtgccagcttccggctcctgggcgacctcaccatccgcaacgtcacgcagccggtggccttcgacgcccggcacatcggcacgtcgaaggacccgtggggcaactcgcggctcatctactcggcgcgcaccaccgtcaaccgcaccgattacggcatccgctggaacaagacgctcgacaatggcggctggctcgtcagcgagaagatcgacctcgagctcgacatccaggccattcccgcgacggcctgagccggcctcagggcgcgggcaggaagtccgcgaacacggcggcgtggtccgacccgccatagccgccccgtgggtccctcgccgcgcggaacgagccgggcacatacgtgcccccgccgcgcgccaggtacaggtggtcaatggcctgggtgtcgccgtggtaggtgtacgtccacgtctcgctggccggccggtcgctggagacgcgcagcagcgcgccgtcgcgctccagcgcggtgatgggctccgagcccggtacgtcgttgaggtcgccgccaaggacgacgagcgcgtctggagccgcctgggccgcgcccgcgacgatgtcccgcgtcgccacggcctcggcgaagcggcgcccggcgtcgtcattggacttggagcggaagtgcgcggagaagacgatgaccttcttcccgtccacgtccaggtggacctccagcaactcgcgggagaaccgggtggcggagccatccgggcgccacagcgtgcgttcccgatgcccgcggacgtcggtgatggggtgaacagagaggacggccacgtccacggacgccgcggcgcccgtctcgcccagctccgaatagccgaagcgggggagccgtgacgtgagcgcgtcgagcgaggcctgggtttccacctcggccaacagcaccacgtcggcgttcagtcgcgagatggcggacgcgagccggtccgcctggagaccgaactcggagggagtgggcagcgcctcatagttgctgccgccgcacgcatcggagtcgcacaccgtgtcaaagagccgctgcacgttgaaggtcgcgatgcgcacactgccttcgagcgcggtgtcgggcggttgcagcggtccacaggcagccccgacacatggttcattcggccccggtggtgtttcacgcccctcgcaggcggacagcgacaagagggcggccagcagggccgcggcgcggaggcgcttgcggtccctcgacgcagagggaagggggcgtgacatggggccgtgagactaccccatcgcggccctggcgcgggcaggcaggcaggacgctgccgtcgctaggaggcgtcctaatctcacgcgcattgcttactgttgagcgttacgacatgaaaacgcacggcggtgggtttcgagattaccgtacggacagttcgtgcggaggggagtgcgcggcatggtggtcgagattctgatcggcgcagcggtgatgacgctcatcaccgttatcttcactgggcccggtatgtggagctccacctggggctaccggaagagggagggacaggacgtgtcgaggtcctccggcgagaagaacaagacgccgtagtctcccgcggccggcgtcactggcagatgccggggcagtccgttgctcccgagccaggcgagcaggcatccagcgggtcgtccacgcaccgtgtccccgtcgacacgcaatcgccatggaacgcaccgcagcattcgacgtacccctgaggcacgtcgcacggcgtcgcgaagctccggcactccgcgtcgcccgaggcaggccgcgcgaacacccgcacctgtgcgcaagcatcgccgtcatcgtcggaggttccgctgcaagccgtgaggagcagcggggccacggccgcgagcgcggccttcatgcgtcggttcatgtccgctttctggccagggctggcccacgcgtccaatccccccgcacccaaggtgtcaggaggaagaaacgcggggcgcgtgtcactccaccaacagccgcttcaccggtgcggggtccaccgcgaccatcagcggccgggtgaagttgctgaacgacaccagtgcctgaccgggggccaaccgtgacacccggttccagaggctctcgtcgatgctgcccgcggttttctgcatgcgcgagatgaccgagctgtcggcgatcttgtggatgacgaagttgttgatgaggcccagcacctcgttgggcaggtgctgtggaagctgggtgacgaagacgagccccatccagcgcttgcggccccgcttggcgatcttcgccacctgctcgaagagcacgggcatctgggcaattcggttcgcggagaggaactcgtgggcctcttcgatgatgatgaggaccggcgtgaccgattggtccttcgcgttggcccgctcgtagcgtcgctcctgcgcttcctggaggcctcgcaggatgtctgcgatgaccaggttgttgagctgcggtgagtccgtgtccgacaggtcgatgacggagacgcgcccgggtgtgagcatggactcataggccacgccttgctcgttacccacgtcgaagatgcccaggcgccgcagccggtggagtttgctggccagggccttccaactgatttcgtgccggctgctctgggccatgacgcgcgccatgacccggccgaagttgctcttgaactcggtgcggagcatcagtccgcgcgatggcgccttggccgtgacgtccgggtcggcctccgcgtcgtcgttctcctcgagcagggacgcctgcttccgaggggtggcgcgtgaccttccacgcgtctccgatttgccttcgtcactgaggctgtagatgtacgcgctgaccacgtccagcacgtggtcgatggtcatgtggggaaagcccgtggacaattcgtccacgtcgaggacctggcggcgctcttcttccgtctgcgggtagatgttgaagtcttcgagcaagagcttggtgacgtcgtaggccttgaggaaccgctcctgctgtgcgtccgacatgtcgagaatctccgcgagcgcgtacggagacaggctggagaacttgagcgagaaggcgtgcttgttccggtgtcgcggattgaggctgtcgcgcccggtgaggtggtggatgtgcaagtccttgacgccctgcggacgctggcctcgccgtttgagcgcctcgagcatggcggcatggtcggtgggctggtccacgtgcgtgtattcaccctccacgtcgaagacgatggtcgcgatgccatccgcttgggctcggtggatgagcgtggccaccgtggtggacttgccgccgccggttgttccgatgatgcccgtgtggcgtgggaggatggatttgtcccggggattgagccgggcctccatcttttcgtacccgaccaccagccccaggcacatgtcgccgccgacgcccagcacgcgagcgctctccgcctcgtcgagcaggaagacggggctctgcggccggggccggaagcggggaggcttcagcgtgccttcgacttcctctccgacaatctcaatctccgcgcgcccgtgatagtcgaatgtgtacgccagcttcttgccgtgggtgaccacgccaatggccatggtggagttggcgggcaccgcgttcggttccgcgaaggggccccgcacgacgacgcccaggtaggcgcggttgtcttccctcgacctcacccggaccagcgtctgggacgcgagcaggtgcaaatcctcacgcgtgagcagcacggtgatgaggttgtcctggctggaggtgacgtcgaagtgggtgaatcccaccgccgctgccagctctggatccacctggggaccggtatgggcctggttcctgagttcgtcgagctcgtgcagcgtctttgttggggtcggtcgaacgaccgcactgtcaggctcccgcggggacacgggcccaggggccttgccattcatgacaggtgctgccgccgtggggacagcgcggtgctgaccattcttcccgggcggcggcccgccaacgcccatgcctggcatggggacggggcgtgtgggcccgttggtgggcctcgcctctggcctgaacggtccatttcccgccgcgcggtggccgggcggtggatcgccccaattgcctggatcctccgacacgccaccagaccgggtcgcagcctgtcctgatgcggcgggttgtccccggaaagtcccggcacccggcgcgcgttgccccctgccgtcgtcagccatgctcatggtccccctggcctaatggcgcttgctgtgctcgttgaagaactcgaggttggctcctgcctgggcataggcgtcatgcacgaggcccatgaacccatcctcaccgaaggcgctccggcacgacgcttccgcgacgtcgagcagcatggggaatccccgatcgggccggaggatgctgtcggccatggcgactcgcgccgcgaggtggacgtggtcgcgatgcgcatagaacgagcgaggaggggttcgctcggatgcgcgaaacacaccggagatgacttcggggcagcattcctgcacgaacctcgccgcgaagttctggctgcggtccccgtacttccattgctcgatgacccgcctcccatagcgctcgagcgtttcgaagatgacgtactcgccagcctggagcgcatgaccaatggtcaggatgccccgctcctcgagcgtgcttggcacgaacacgaacttcttctgctggaggatgaggcgcctgagcacattgatggattcgcgcaggaggctcatgtaacccgagcccgtgatcagttcataagcgcatggattgccatgcccgatacgccactccgcttcggacttgtccacgagcacggcccgctcggcgtaggtcttgataccgcgacgagccagtttggagagcgacctctcgcgaggactggccgacctgtccatccgctggtcgatgcacgcgagtgcctcttgaactggattcgaacgctggtccgacatctccttccggaacagtcgctgagaaaatgttccgctcgtccctccgtaacccaccgcggcgattccaatctgggtgattccaattggcaggctctcgtgactcgtcgagatgctgttgacggcctccaccttcccagagaagagcaggctctgatggaccgtggccaattcttcgggcgtggccctgtagaccccagcctctttggcaccaccgcgagagttcgcggagattttcggaaggacttgttgccggatgatcttcttcacgacgccctccttgtccacggcactggcgatttcctttcggaaccgcgccatgacgctctccaggtcgagcccctgcgaccatgtgtcgaggttgagcgtcgtcagcagatcctctccaaacgcgtcgacgaagtcgtcgtcaccgacgagatccgctccgtcttcggcgtgaaaaccacccgccatgcctagctcctgtcttcgccaagaaattcgatgatggagaatcgctgagcgcgctcctgtcgcatgagcgcgcgggcatagcccctggccttgtcttcagggagaccgaagcggcgggccacccgcaggacgccgtcttctcctggggtgatacggagcatccgccgcacgagctctgctggcgcgaggaactcgagcgccagccggtcggcacgccgttcggcttccgcagtggctccggaggcaaggtgcccggacgggttcctgtccatgagcttgacctggacgcccagtgggacctgcccgaaaaccgaggacagtctttcctccaggcttgcgtttcgctttccgtcgaggacggggaggattccttctccgaagtagcgcagggctcgctcgcggggaatcacgtggtcgagcacgaagtgcgcgacctcatgtgccacggtgaagcgctgttcatcctccgagtcaccggtgtcgtggaagagcagggcgctccctttccaggcgaccatgcacccgtagagttcccggtgggtgtcggagatgggatgtggaaccttccgcttcgatgtccacgccgccacgtgcgctgtcgtgagcctggggatgggcaccgtctccacggacagttggtagggggcctcttcggccaggtcgcgtggataggaagtgcactcctggagcccactgatggccatggcctcatccagccaacgacccatcatggagtatcctcatcgtcacgaatgcggtccctggccgcgatttggatgcgactggcgccggtcattgcctcgccttcattatcggatgtcagggcgtcgatgacctcgacgtgtcgaagcactcggaccaggacccgctcgttgaccgcgaagcgctgagcgaccgcgatggtctgcctggcaaaagaagcgccaacgggacgtcggcagagggacagccagtgaagctcttccagcgagcaacccagttggttcgcgaggtcagtggtggtgatgccttcaatcgcgcggtaacgctcgaacgcatggccaagcatccaggctttctccgtgctccgcctggccgcagtctcaagccaatcaggattcgtcaccgaaaacctcccttccaaagcgcaccagccacttcatgatgcggtcacggttgcgcttcacttcgcgctggatgtcgactgcggggagcgcacccaggccgagtacctcggcgaaccgctgggtcgaccgttctccctggagcatgagtccgaggaacgcgcggtccacctgggagaggtcggattgttcgatgcgttccacgatgcacttcacctccgcggattgctccaaacagtctttcggagacctccccagaagttcgaaaaggaggccgaatttttcttcacgcgcctgccgcctcgtcgccgagcgctgccagtccgtgacggtgttcttcgcggattgcgccaggtaggagaacaggcgacctcgctgcggatcaaagcgctcgggggcttcgaggtagtcgagcaacacgtcgatggcggcgtcacgggccatttcgtgggtgcatcctcgggcgtacttcacggctgcgatgatggggtcgacgaagaccgcaaatgcgtccacgttcgccaccgactctcgctggaggatgcgcgcatgcaacgcgacgtcctcgtctcgtgttggaattcccatcctgactcctcatcggaagtttccgtggacgcgctcgatacgtgcgcgcatgtgctccttcggagccgcactggtgagttcgacggaaacatgcatctgcgccacccaaatggttcctggcaggcgcgctgcatgtctgtacctcccgggtggtatgttcatggacggtaatgcagacagtggagcgaatgcacctgggctccgttcgctggcttgggcgagtcaggtttgccaacgcgcaggtcgtcgcagactcggcgtctgcgaagacaccctgcttcagcgtctgatgttgtgatgcactgcgtggtctcctgccatcccggtcggaggggagcaggggattcgcgagacacggattgctcaggagttttgacgcgcgttgcccataccacccaggtggtaaagacagacccatccctcaactgcactcttcggggcggatgctggcgttgtccgatgcaacccagggcggctcggggggacgttccgggagcgcggccgacgcggggagcgccgtcaggcgcggcagcgcgttccttcgggagacggggcagggggctgcccggttccggacgtgggtgctgccggggcgaggtgctggagccgggcggcctggagcaggaggccgcccggcgttcggcgtgaggtggaggtgcgatccatccccaccttggtgacgcggctcagcagcccaggttgccgccagggctcacgccgagcatgttggtgaagtgctgatagttgttgatgcggctctgcacctggcccgggttgcgaccattgcactccagcgagccattgatggtgcggatggtctcaccgaagccgtggccgtcgaccatcgcgcggtgcgcggacatggttccggcgccggcctgcgtggtccagaaccagaacgcggagcgccacgaggcgttggcgtcctgggccagcaggtccgggttggtgtgaagcggcagccccagcgcggcgccggcggcgcagtagtttccgttccaggacaactggatgggcccacgtccgtagtacttcttgcccgcgacgcagtagcagcccggcggcccccatgagccgcagtagtcaccgcgattgatctcctccacgtacacgtagttgcccgtctcatgggccgtgttggcgaagaaggccgccacctcgcgcttgcgcgtctccagcgagcccgtgttggcgaaggccgggaaggtgctcgcggcggcgatgaggctgctgtacgtgtagaaggggttccggttcgggaacatggcgttgaacgtggactcgctcaggatggcggccagccccgtgccggggttgccaccgcccccgtcgatgcggtcgaacgtccaacgctggttcgtgcgctgctcgtaggggtactgcaccagctccgtgccgttggccgtgttgccccagtacacgtcaatggccatgtccgtgtgacgcgcgcggatgctgaactcgctgcccacttccttcacgaagcggaactgctggttcgctccgccgccataaccccactggtggaccagcgcgttcgccgcggtgctcgcctccttgatgtcgagcgccttgttgctgttcacgttgatgatgctgaagtagcccccggacgtgggcgtgacgcggaagcgctgcgcattcgtgccgttgcaatcccattgctgcaccttggcgccgtccgccgtgctcgacgaggcgacgtcgatgcacttgttcgtcatcaccgagcggatgacgtaggtgccttcggtgatggtgtcgacaatggcggcgccttccacctggcccaccggttcgagggcggcgggcactggctcggcgtcgccacagcctcccagggcgctcaggcccccacagattcccagcagggccagactgcgtgacacgaacttgccggacatgcttgtgctccttgcggtcgagggtttctcgggcgcgccacgcctggggcgggcggaggccttggctccggggggccggagccgcaaggactgtacggcagtctgtaaatcaagaataagctgacagtgccgctgggcgcgaagcgttgaccagcggacgcgccgcggcggctcaggcttgttgttgcgccgcggggagaccctggggcagcaacgcgtctgggagctcgtcttccacgccgcgcacgcgcggggaggacgcggtcagcatgacgcagcccgccagcaggaggcccaggacgacgtagagcagggcgatgcctcgacccgggccggtgcccagcacctggccgaaggtgttggccagggcgccgtccggcgccatccaggggtcgaagaccttgtccgtcaacgggcccgcgagcagcgcggcgacgggcggggcgaccagcgcgagcatccggcgcgtggcgaacacccgtccctggatggcgggaggcaccttgctctgccagatggcctgcgagcagcccatggccaccggcgcggtgaacatgaacacgaaggcggcgcaggcgacgacgaacacgctggcggggagcgccgcggccagcaatgccacgcccgcgacgagctccgcgcccagcacgcccaggatgcgccgcttcgggccgccccagacgcccatggtgattccacccgccaccatgccgacgccggagcaggacaccaccaggcccagtgtcgtcgggtccgtgaagctcaacaccagcggggtgatgagcaccgtcaccagtacggtgatcaggttgacggcggagctgaagcccagcaatccgagcaggccggggcgctcgcggatgaagcgccagcccagcgcgatgtccgtccacagcgacttcctgggctcggtccgcgcggcgtccggttcgggctgggggatgcgcacgctcagcagcgtggccaccgcgaagaggaaggtcgccaggtcgatgagcagcacgccttgcaagcccatgcgcaccaccagcacgcccgccatcgcggggcccaggagctggcccgcgctcatggccagttccaccatgccgttggcccggcccaggttctgcttggagaccagcaggggcgtggccgtggagaaggccaggacgcggaaggtgctgaaggcggcgctcatcgccagggggggatagaagtgccagttttgaaggggccacagcccggcgcggtccgccgcgacaaagcaccacatcaacccgatggctgtcatcgcgcccaggtccgccagcagcatcacccgctgacggttgctgcggtccaccatggagcccgcgacgggcgcgagcagcaccatcgggaggaacccgaagaacgacgccagcgagtactccgtgacggaatcgctgttctggtagacgtagacacccaccgagaactgggtgagtcccgtcctcagtgaccagatgagctgacccagccagatgagactgaagacacgggcagggttcgttaccacgttcctgctagagaatgccatgctgtcagcgggcattccatgggcgtgaccagctaggtgtcagaggcatggctagagtcttcgtgagcaagggcagggcgtctacctggataccgcgttctttttataggaaccgctatcgctgtaataatcgttattatcgtttatatggacaagcaggcaatgtcggtggcacaagctgcgctgtatcaagggggcgggctcaagcgaggtacgagcgtgcttcctcttccgggcgaagcggcatgttggctcggggggccttggccggaagatgtttgccggggggttctccgtgctcagccggatgtcgtggccgcgtgtcaacccgggccgtgtccagcgcaggagaagacatgaccgagcacatcgagccgcgagctcaccgtttccccaccctggtggacgtgttgtgtcaacgcgccgagtctcaaggcgacgcgctgttgtatcgcttcctggagacgggagacgtggacggcccggtggaggagtggacctaccggcggctggattcacgggcgcggtcgctgggggctcggctgcgtgccctgggggcgcagggggagcgggcgctgctgctctatccgcccggcctggagttcgtcgcgggcttcatgggctgtctgtatggcggcgtcatcgccgtgccgtgttacccgccggaccccacgcggttggagcgcacgctgccgcgccttcgcgccatcgcccgggactgcggcgcgcgctacgtgctgacgacgagcaccatccaggagatggcggagttcctcacgccacaggctcccgagctgggtgaattgcagtggattgccagtgacgcggtgccggaagccgaggccgcggactggaagcgcccggacctgacgtccgagtcgctggccttcttgcaatacacgtcgggttccacgggcaacccgaagggggtcaaggtcagccacgccaacatcctccacaacgagtcgttgattacgcgtgacttcgggttgcaggcggagcgttcggtgggcgtgggctggttgcccatgttccatgacatggggctcatcggtaaggtgttgcagccgctctacctgggcttcccgtgcgtgctgatgtcgcccatcgcgttccttcagcggcccttgcgttggctggaggccgtctcccatttcaaggggacggtcagtggtggacccaacttcgcgtacgacctgtgcgcgcgaaaggcccgcgccgaagacgtggcccgtctggatttgagccactgggacctggccttcaacggcgcggagcccgtgcggcgcgagacgatggagcgcttcgcggagacgttcgcgcccgctggcttccggcgcgaggccttctatccctgctacggcctggcagaggcgacgctcatcgtcagcggcggcgtgaagggaacgccttgtgtgcaggagcgctacgacaccggctcgctggagctggggcgcgcgaagcccgcgtccgacgcggcggaggggcccacggcgcgcacgctggtgtcctccggtcagggcgcgccggaccagcggctgctcatcgtggacccggagacgcgggtgcctcgggcctcgaacgaggtgggtgaggtctgggtcgctggccccagcgtggcgggtgggtattgggatcgtccggaggagacggcgcatgccttcggcgcgcggctcgccaacggcgaggggcccttcctccgcaccggtgacctggctttcctgtcgccggagggcgagctcttcatcaccggccgtctcaaggatctgctcatcgtccggggtcggaacctgtatccgcaggacctggaaatgaccgcggagcgcgcgcaccgcgcggtgcgtcccggctgcagcgccgccttctccgtggacgtggagggggaggagcggctggtggtggtctccgaggtcgacgtgcgcgaaggcttcgacggcgcggcggtggtgggcgccctgcgccgcgcgctcgccgatgagcaccaggtgcatgcgcacacggtggtgctgctccaggcccggagcattccgaagacatcgagcgggaagattcagcgccgcgcctgtcgtgatggcttcctggcgggctcgctggaggtggtggaggtgtcgggcgaggaggccgctccggtgccggaggccgtgccttccacgccgtccgcgcccctgcgcgagcgcctggccctggcgtccgaggaggcccgtccggcgctgctggtggacttcctccgcgtggaggccgcgcgggtgctgcgcgctgcgcccgcgtccctggcgccggagacgtcgctggccagcctggggctcgactcgctgatggcgctggagctccacggccggctggaagaggaactcggtgtgtcgctgcccgtggccttcctctggcagcacccgacgctggggaccgccgccgcgcatctggtggacgcgtggaagggctccgccgcgcccgccgcgccgccgctgaaggccggctcgctggagggagagctgccgctgtctcccggtcagcagcgcctgtggttcctggaccggctggtgccggagagcgcgctgtacaacgtccacttccagctccggctctccggcgcgctggacgtgcccgcgctggagcgcgcgctgcaagggctcctgtcgcgtcacgcggtgctgcgcgcggccttccccgaagtggagggtcagccgcgccagctcctgccgcccctgcgtccgctggacgtggcccgcgaggacctgcgggcgctgtcgcccgccgagcgtgacgcgcggctgaatcagttggcccgcgcccagggcgaggcgcccttcaatctctcagagggcctgctggtgcgtgcggcgctggtggcgctggaggaccaggagcacgtgctcctgatgacccagcaccacatcgtcaccgatggctggtccattggcgtcctggcccgggagctggccgcgctgtaccgcgcggaggtggctggcgccgccgcgtcgctgggcgcgcccgccttgcagtacgtggactacgcacgttggcagcgcgggctgggcggcgcgctggacgggcagcgtgcctactgggcgcggaagctggagaacctgccgcgcctggagttgcccacggacttcccgcgtccccgggagccgggcttccgcggcgcgctccaccgtttcgcgctgccggccgagctggtggattcgctcaaggcggtgggccggagtgagggctgtaccttcttcgttacgctggcggcggcctgggcggcgctgctgcaccgctatagcggtcaggacgacttcggcctgggcaccatcttcgcgcagcgggaccgggccgagctgcgtgacgtggtggggttcttcgccagcacgctggtgctccgcgcggacgtgtccggcgcgccccgcttccgggagctgctgggccgcatgcgccacacgttccacgaggccctggcgcacgcggacctgcccttcgaggaagtggtgggcgcgtcgcgcgcggtccgtggcggcgacaacccgctgttccaggcgaacctggtgttggagagcctgccgccggtggacatggacgtgccgggcatgcagtggcgcccggtgctgcccgtgccggacggcgcggtggagggcacggcgaagttcgacctgcagctcgccgtcgtggagacgccgcgagggctggagggcgcgctggagtaccgctcggacctcttctcggcggagacgatggcgcggctcgcgggacacctggaggcgttgctgaggggcatcgtcgctgctccggacgcgcgtgtggaggacctgccgctgctcgacgaggcggagcgtcgttctctgctggagcgctggaacgacttcacggcgccgctctcccaggacgcttcgcactgcatccacgcgcagttccgtgagcaggccgcccgcacgcccgacgcggtggcggtggtcgccgaggacgggacgctcacctacgcggagctggcgcgccgtgcgtccgcgctggccttgcatctgaggggcctgggcgtgggccccgaggtgcgcgtgggcctgtgcgccgagcgctcggtggagatggtggcggggatgctcggcatcctcgaggcgggcggcgcctacgtgcccctggacccggactatccccgggagcggctcacgtacatgctggaggactcgggcgcgcgcgtgctcgtcacgcagtcccatctggcggggacgctgcccgtggccggcctgcacaccgtgctgctggatacggcggagccctacgcggcgatgccggcgtcaccgctggccctggggaccacgccggacaacgcggcgtatgtcatctacacgtcgggctccacgggacggcccaagggcgtggtggtaccgcatgggggcgtggccaacttcttcgccgccatggacgtgcgcgtgggccactcgcccgcgggcgcctggttggccgtcaccagcatctccttcgacatctccgtcctggagttgctgtggacgctcacccgcggcttcaaggtggtggtgctttagagc

SEQ ID NO: 1230 - DNA, 24754 bp, Myxococcus xanthus
gctctacaggccctgaaaccggcaggtggatgagatggtcgccctgctcccgaagcaggtctacctgtccttcgacatcgacgggctggaccccgtgctctgcccccacacgggcaccccggtgcccggcggactgtccttcgccgaggccgtggccctcatcgccggcgtggtccgctccgggcgcaccatcgtgggcttcgacctcaccgaggtggcccccgaccccgagggcggcgagtgggacggcaacgtcggcgcccggcttctgtacaagatgattggctggatgctgaagtcgcagcaggcctgacgtctcgtcacgcgaagcgcccgtgaagggatgccatcgcgtgtcaggtgctccgcggcagcatcaggctgaacgtggagccctcgccgggtcgtgactggacggacagcgcgcccccttgcaggcgcaccagctccgaggccacgtacagctccggtccgcggacgcccttcgcatccatccggaagggcgtgaagaggtgggccagcgcctccgcggccacccccggccccacgtccttcacgcgcaccgtgagctgcgtctgggagatttcgagcgccacctccgcgtccccctgccggaccgcgttcgccagcagcacgtcgaacacctgccggatgcgcggcgggtccacctgcgcgtggactggctcctcgggtgcttccaacgtgacgtgtgcgccatgcgccgccaccgcgtcgcgcaggtgctggcccacgtccgtgtcgattcgcgccagcgtcgcctcgcccgaggacagccacgccagctcgcgcaggtgacggcccacggcttccatggactggagctgcgccgccagcgtgtccagcgccgcgcggtccacggagggcgtgcattccagccggcgaagctgctcgcgggccgtttcgagcgggccctggagcgtctgcgccacccactgccccagcgcgcccacgggggacgccgcgtgcgccatccggggctccggcgaggcggccagcgatttgtggatgaccgattcgaagtcggtgatttcaaagggcttgtggaggaaggcgaacgcctccggcgcgccctggggcagcaccgcgctgaggaggatgacgggcacgtccttgagctgtgcctcctgcttcatccggcggcagagctccacgccgctcagccgcggcatcatgtggtccgtcaccaccagttgaggatgccgggcacgcgccagaccgagcgcctcctcgccatcccgcgctctcaagacgtcgtggcccaggtcctccacgacttgactgagaacctccaacaccgctggctcatcgtccgcgaccaggacgagactcatgcttccactccctcgcctcggcacgccgcgactgcttgcgcgccgccaggataacaatccactcccacggtgtactgacactccgcgaggacgtgcatcccagagatgcattcgttcatggatgaccggagtggtttatgaagagcgagacaccgcatccaggggccccgggtaggctgcggccttcccgacaatcagaatgtccttcgcccgacaatccctggcggtgcacggagggttggaatgaagcacgcagtcatgaggtggagcctgctggtgatggccctgctgacctcgggcacggcgaacgcggacatggcgcggcggcgtgacgccatcgtcgaggtcgtgcagaaggtctcccctgccgtcgtctacatcggcaccgagcaggaggtggagtcgcgcttccgtggacgccgttctcccctggaggagttcttcggtggcatgggcgcggagccggagcgtcagagaatctccggcctgggcagcggcgccatcatcgaccccagcggcatcatcgtcaccaatgaccacgtcatccggggcgcttccgccatccacgtcatcctggcggatggccgctcgttcgacgcggaggtcatcggcagcgacgcggcgaacgacctagcggtgctcaaggtcaatgccaaggaggccctccccatcgcgaagctgggcaccagctccgacctgatgattggcgagacggtggtcgccattggcagcccgttcggcctcagcaagacggtcaccgcgggcgtcgtctccgcggtgggccgcaccttccgcgccgacaaccgcgtctacaacgacttcgtgcagacggacgccgccatcaacccgggcaactcgggcggcccgctgctcaacgtggatggggaaatcatcggaatcaacaccgccatcttcggcgccggcgcgcatggcatcggcttagcgattccgcccgacaaggtgctccgcatcgtcgacgagctgacccgcttcggtaaggtgcgcccggcgtgggtgggcatcgatacggccgacctgcctgtccgcgtcgcccggcagctcgggtgggaccgggcctatggcgcgctggtgacggcggtgtaggcagggagtccggccgcggaggctggcgtgaagcgcggggacgtggtgccgtagctgggcggctcgcgcatccaggacgccgaggacttcgacacccgcgtgcgcggctaccccgcccgctccgccttcccggtggtgctcttccgcgaaggcggcctgcgcaccgtccaggtgacgccggtggagttccccgctcgcatggtcgaggggctggcgtgggaacggctgggactccgcgtgaaggagattcgcggcggcctggccgtgtccggcgtgcgccagggctccgcggcggcggacatcgggcttgagcccggagacatcatcctccgtgtgaacaaccagcccgtgacgacgaacgacgccttccgggagtccctgctcaccgcgcgacggggacgtagcgtcctgttgctcgtgcggcgcgggcgctacggctaccacgtgacgctgcccttcgagcgggaagcaggctaccggctgtagctgtcgggaaagggcgacgggctccccgtatttcaggacccgcgtgactcgcactaacatgcgatgtcatgagttccgtccgttaccaatcccttggtcccctgctggctggggaaggctcacgtgccttcctcggactcgccctggaggacggcgcgtctccccgtcccgtggtgctcatctgggcaccgcaagatgtcgtgcagaaccccgagctgaaggcgaccttgcgtcgcgagaccgctcgcgcgctcgtcttcgagcatccgcacatcctccgtgtccacgccctggccgagcaggatggcggactggcccgtgtcaccgagttcgccgacggcgagcccctgcgtcgcctgctggaggcccacccccgcctgccgccgcacttcgcggcgctcgtcgtggcggatgccgccgtgggtctccactacgcgcacgtcgctggcaatgacgacggcacgccctttgtgcacggtgacgtccggcccgagacgttgatgatctccttcggcggtctgacgaaggtgacgggctatggcgcgctcggcgtggctccgcgcgagcgcggtggcaagcgcgtgaagaaccggcgtttgtacagcgcgcccgagcagctcctcggtggacgcgaggcggtcaacgtccagtcggacgtgttcctcctgggactcgtcctgcacgagtgcctctccgggaagattcccttcaaggatgcggcggacccggacaaggccgtgctcacgcgctcgctgccgcccatggcgcaggacgtgccgctgaagctggacgcggtgctgcgccgggcgacggcgaagcgggccaaggagcggtatccgacggcgctcgcgttccgcgaggccgtagtcgaggccgtcggctcgctgcccacgcatgcggagttctcggagttcctgtcgaagtacttcccgcccgagagcgaggctcgcgcgacgcggcggcgggtgattgaaacgggcatcgccgaggtgatgcagaaggctggcatctctccgcccgccgtggctgagttcctcgcgcgcggcgccctgcccccgggcttgatgcccgcgaagtggccggagttgccgggacagttgcatgcctcgggctcgcccgatggttcgggtgcgcaggctgggagtggctcggcggccggtggcaacgcgcaggcggcaccggctgcgggcagcacggggcagtccggctccggttcggcgggggctcagacgcagtccggtgcaattggccacgcgcaaagtggcgcgggtgcacagactcaatccggtgcaggcagccaggcgcaggctggcgcacaggcgcaatccggcgcgggcgctcaagcgcattcaggcgcacagactcagtccagtgcaggtggccagtcacaggcgggcgcaagcgcacaggtccactccggcgcgggcgcacagcatcagtccggcgcaagcactcaggcccattcaggctcaggcgcacaggcgcagtccggcgcgggcgcacagcatcagtccggcacaggcactcaggctcatcccggcgccacgggcacgggggcctcggcaggggccactgtccccaccggcccgacgggcgcggacgcacacgcggcccccacgacgcctcccgccgcgcagaagcagtcacgcacctggatggccttcgtgggcgtcggtctggcgctcacggtgggcgcgggggccgtcgtgctcagccagctgccctccaacatcgagtccgagctcgaggacgcgggcgtcaccgacgccctgcccgtcgacgccggcgtgacgcaggatgcgggccccgtggatgccggcattcccatgggcacgctggacgtcaccgtggacccgcgcgtggaggtctcgattcctgggcagtacctgggccgcacgccggtctccgcggccgtgcccgcgggccgtcacgtgctgacgctcagcaacccggtgctcggcatccagacgacacgggtcatcaccgtgccggcgggtggccgttcctcgcagcagatcttcctcaacaagggattcgcgaacgtacgcgccccggagggcgccatcgtcacggtggatggccggctcatcggtgccgcacccatcgaggaactggacttgtacgaaggcacgcaccagctcctggtcatcgtgaacaactcccggtggcagaagacgttcaaggtggagccgggccaacgcgtcaccttcgacgtcaacttcgagaagcccgaagaggagtaaccggggtagcaatctccgcggcgtgaacactcgtttcacgccgcggttgcggtgccttcggggcgcgaccagactcccgcgcccatgaacacctccgccacggagttcgacatcatcgcctggggggccaccggcttcaccgggcgactggtcgccgaatatctcgccaggacccaggacagccaccgcgcacggtgggccctggcgggacgcgacctcgacaagctggagaaggtccggcaggggctggcggcgattgcgccctccttcgcggagctaccgctgctcgtcgcggatgcacgcgacgccgcgtcgctggatgccctggtccctcgcacccgcgtggtctgcaccacggtgggcccctacgcacgttacggcagcgagctcgtcgcggcgtgtgttcgggccggcgtcagctactgcgacctgacgggtgaagtgcagtggatgcggcggatgattgacgcccaccacgagcaggcgcggcagagcggcgcacgcatcgtccacacctgtggcttcgactcgattccgtcggacctgggcgtgttgatgatgcaggagcacatgcgggagcaccatggcgggcacctggaagcagtccgcctctacatgggtcccatgcgcggaggcgctagcggtggcacggccgcgagcatggtgcaggcgatggaagaagcatcaacggaccgctcggtgcggcgaatcatggcccacccgcatgcgctggaccccgtcccaggccgctggcgacccgagtccaaggacgcgctgggcgtccactacagccaggaactgggccagtggaccggcccgttcctcatggcgaccgtgaacacgcgcgtcgtccgacgcagcaatgcgctgctcggtcacccgtggggagagcacttccggtacgcggaggtcgccagctatggcgccgggcccaagggcctgctgcgcgccacgggcgtcaccgcgggcctgggaggcgtcgtcgccgcgatgcaggtgaagcccctacgcacgctgctggagaagaaggtactgcccgcgccgggtgaaggcccgtctctggaagcccgggagaaaggcttcttcgtcgcgcagcttcgtggcgaaggcacctccccccgcacgggcaagcaggtgcggctgaagggcaaggtggcggcgcagggagacccgggctacgcggccacgtcgcggatgctcgccgagtccgcgctgtgcctcgccttcgacgacactccgaccacgggcggcgtgctcacgccggcctccgccatgggcatgcgactggtggagcggctgcgccgtgcgggcatgacgttcgaagtggaggagctgtccacctgagccattccgccgcgagcgcgcgatgtcctacgcgctcttgcggcgccgcatcatcgcctcgtacgagcggcccacgctctgcgagaggatgagcagctcgcccacgtcgggcggagtgagctggtccgggccgttgtccacgtagagcaggtgcacgaccttgccgcgcaccagcagcgggaggatgacggccgtcttcgggaacccgtcccccagcagcttgtagaacacgcccatggccgcatcacggcggacgggcccgatgtagtgcgagcgcgtgtcccgcacgagccggaaggtgctctgctcccgcagcggcacgccgatgcggcgcaccaccgcgtcgcgaacccccacccccatgccgtgccagcccgtcacgaggctgccctgcaccgacagcagcaggttccgcttccacttgcccagcgcgaagcgcagcaccgtgtgcgccacgtcctcgcggtccgagctgcgagccagctccgcctgcgcttccgcgaaggtcagcggcgtcggcggcggctccggtgcgcgcggcacctgcacaggcggtggcgagccgcccagcgcgggcgccgggggtggcacgtgcggctgaaccatctgcggtgggacagcgatggcctggggtggcggcggcggagccacgggcacctgcggccggaccgtcgcgggcggaggctcgggcgcggcctccagtacctctacgccggtgatgatctcctcctcgcccatgtccccgtcggagtcggcgccaccgcgcagggcggaggcgtagacggactggaactcctcctcgctcatcaagtctggcggcgtctccgcggccttggccagctcggcctgcgagcccgccgagggacgcggccgcaccgcgttcatgtcgacggcgcgcagcggccggaacgccttgcagtaacggcgcagcagttggttcatccggaactcggggatgaccaccggcaccacgcgcttgcccgtcttgaaggcaatcgcgtccagcgtcgagaagtcgtgcgggttcacgacggcgatgctcagccgcgtcgcgtccacccgcatgggcaggtactccttgtcgtccgcatggttcgaggagaccagctccatcgccttggggtccggaaccatctccccggacgcgaacgcgctgttgtggaccttccccagcgccttcgccaggtccacctccgacagcaggcccagctccaccaggttcgttcccaaccgcccgccatgcaccacctgggcctcgagcgcttcttcgagtccctcggcggtgacgagaccatccttcaggagctgctcacccaggcgcatggggccgcttgtagccgtgccccgtcccgctccgcaagcacacccgcagccgtggggcggtgcgtctagtcctccgggtgatgactgagcgcaacgcggttgccttcggggtcccggacgtacaccgaccaccgcgtctcgttctccagcggcacacccgcgcgggtgaaggtgtcgaccacacccgcccgagctgccttcggaatccggaatgccagcagcagaagacccggcgcctcgtggcgaaacggcgtggagacgggctcgccgcccgccgcctcgatggccaggaagccgcccccaggcacgcccacccagatgctccgcaaggagccgtccgggcggagatgacgggtcaactccggaaagcccagcaggtctctgtagaagccggtgacacgctcgatgtcccgcgcctggatggccacgtggtggaagccctgaacgtccatgacgcggatgctatggtctgcgcgcccatggcgcgactgctcatcgtcgaagacaaccacgagctggcctccctcatcgtcgccctggcgcaaagccggggacacgacgcgaaagccgcggccaccggcgaggccgcgctggagtcactcggccccggacaacactgggacgcggccctggtggacctgctgctcccggacatccggggcagcgaggtgctggccgcgctgcgtgcccatggcatccccgccatcgccgtcagtggtgtgtacaaaggggaccgtttcgcccaggaggccgtgcaggtccacggcgcccggagcttcttcgagaagccgttcgagctcatcaccgtcatggaggccctggagcaggccggtggcgttgcacctcaaccccgcgctcccccgcccatcgcggagagcgtgctgctggacgagctgctcgataccgaggacctcatcgtgctggaagagttcccccctgagcccagcgacgccgccgagcccctgcaggtcgtccccagtaccgacccgttgccagagcccgcggacacggagcacgccctccccctgcccttcggcaggcgcgagcaggtctggagcgaaagcaccgcgccttcgactccgccgccgcccaagcgcgcgctgcccgactggtccctgggcggcgtcctggaggacgccaccgtcgcgcggctgctcaacgcctattacgaagcccgccaccacggcgagctgaagcttcagcagggccaggtgctcaaggtcgtctacttcgagtccggccgcgtcgtgtacgccgcgtccaacctcgccgccgagcgcttcggccgattctgcgtccgccagggcgtgctgcccgaggcccggctcgccgaggtcgccgccttcgcgaaagagcgcggactgcgcaccggcgaggccatgctgcgcatgggcctgatggacgcggcccagcgagagcaactgctggtggagcaggtgaaggagatcatctggtccaccttcacgtggaaggaaggcggctacggcttcagtgccatgcgcccccgccgcacggacctggtgaagctgtccgtcttccccggtgacctggtgctggagggcgtggcgaagacggagacgctggtgacgctgcgtcggcacatgccgcgctcgcgccggctgttccccaccgccgatgcgccctacggcctgcacgagctgaagctcgagggggcccaggccctggtgctggcgtatgcggacggcagcaagacggtggaggacctgctcgccctcaccgacctgccggagcggcagacgctggccacgctgcggggactggagctcctcggtgtactggaggagcggcccgacacgccgagccgccgtcaccgcatcagcttcgggctgtaagcgccgccctacttccggcggcgcagcacccgcgccagcgccgccagcccgaagacggccgcgcccgaaccccctcccgagcagccgcatcccgacgtcggaggcggcaccgcggcatcccccgaaacgggcacgccgttgagggtcatctccccgcccagccgcggcgtggacagcagcggcgagcggcccacgtacgtcagcatctgcgtgctctgcgcgggcagccggatgtcctccacccggaagccaccgtccaccgcccgcgcctccaccgcgacgccgtccagcttcacgctgccgggcacccactccagcccgtccacgttctccaggtagtggaggccgccgacctcgcactcggaggtgttgcgcagctccaccaccacgcccaccagccccttctccgaagccgtgggcgactccatcgcgtgacgcacgtccacgaagcgctcggaggtaatcggcagcacgtaatccgtggtcgcggtgttgctgccgcccgcgtcggcgaggacgcgcagggtgatggactggcccaccaacgcctccagccctgtctcttgcgtgctcaccgtgacgctcgggcccgccagggagacttctgacagcgcgggccccgccacctgggaccaggagatggccacttcgccgcaggcattggccggaatcgtctgcgtcagcgtggcgctcgcgccttcgccacagcgtgccaccagcgccccggcttcgagcgctcccagccgcgccggcaggggctggttgggaatctccgtctgagcacggccgccctctcgcaccggcccctcactgtcgtcgaagagctcgccgcgcacgcggtaggactcgagggtgcaggagcgcgggagcgcggggcgccacgtcccgggtaccggcaccaccgccgagtccaacgcctcgccgcccagggtctccaggaacatccgcgccttcagcgtgcgcgcgtccacgcagttcagcgacgtgtccagggcgatgtccacgtccccttcgcccgacggcaccacgcccagctccaggctgcccgtggccacgtcctccagggaaggctccacccgaacgcggagctcggcgtcagcgctgtcctgcgtgccaccgccggtaacgggaatgcgattcctggcggtgagggccagcgtcccgtacgcgcactccgcggcctcgacgcgcaggcgctcgctcgacaccggcgagtgcaacgtgacggccgttccgtccgcggtcctcacggtgacaccgtcgggaatgcccgaaccggaagcgctcagccgccactccgtgtccacggtcggcaatccggacgtcccctcgcaggtgtgcagcgcatcggggaccacgtccacgctggcccctgggcccgacgtgagcgtccgctccgagcccgaggcgaagggaaccagcggccggccccagggcgcgacgtccacggtgaagatggcggcggcgctggacgtcaggccgccttcatccacgccacggacctcgtacgcgtagctggtacccgactcctggcacagcacctccggcggcgtgaaggtcgcctgggcgccgccatcggtggagagcagcggtgcgcccgactgtcctgagacgggagaccagacgtagcgcaccgccggacaggcctcgctcgccggctgcgcggtgaacacccgcgacgcgcccgacgcggtggtcgactcccgtgagggcaacaccgtgggctgcgcgggccctttggtgttcaccacccggtaggccaccgtggcctgcacgtcgtgggacgcgagcccgtccgaggcgtagacccgcaggagcccctcttcgtccttgcagacgggccgctgcggaacgagcgtcacgtcgagctggtcggggtgctccacgatgttgacgccaaccaggtcggcgcccggcgttgacgatgcatccaccgacacgcgcaccgcatcggagtcggcgtcggtggcggagaaccgagccgtcgccgtccccgtttcgttcaccacgatgggcgagggccccacgtccagcacgggggcgttggcgttgacgtacgtcacgacgttgaagctcggctggtccaggatgaacaggcagaacgaggagccgatgcacgacacctcgagcggcgtcgcctgcgaagcgcccggaagcgccgagccctcgaagaccgggtggacccgccactgagtccccgcgttgtccgcgctgctcgcgggcacggcccccagcaccacgggctccccgctgggatccacgcccaccgcgaggccaaagccttcgccatggacgctgccgttgcccgtgttcacgtccaccgaggtgatgcggacgtcgctcatgccgtcgggcaacatcacggcggagaaggtcgtcccggccgggtccaactgtccgcggaacaggccgtccgaattgccgaacaacgcgatgggatgcggtccgcttccggcgaagaggtccaccgtgagcggagcctcgctggtcaggtgcgacggcacgaccatctgcgcctgacgcctgtcccgcgtgtaccagaggaactccgtccgggtgacaccggtgacactgaagagcgcatggggcgcgccatccgaagtctccaccacgcctagcacgtccgtggaggacaggaggcccgcgccggcgctcagcaacgtccagggcgtggggcctgcgagccccgctgacgccgtcagcagtgagagtccaccgtcagagagggccaccgcggcatagcccgtaccagacggggtgtgcttcacccgccggatacccaccacggtgttcaccgggtccggggggatgatgtttccagccgcacggcagttctggtgactgatgacgtcacccgggcgcacgacgacggcgaagcagcccatcggagacaagaacgtgccgaagacgtcgctgtgcaggaagacggcggactggatgccgttctcgaacagctccgtctgcgtcgaggtgctcaccgagtagctgcccggagcgaagacgtccacactgcgggcgatgcccggcacctcatccacgtcccagtcggcgcgtgccgcagtggcaacacccaggcagaggctgatgatgacgaggggacgcacggattgctcctagtaggccacttcggctcgcaggtagagccggtcctgattgtccgacgagtcgggggacaaacccaagccgctgaagcccaggagtgtgtacccggtggccaagcgcagccgctcatcgacccgataggcgacttccgcacggagcgcggtcagccgctcgccctcgggagacgccgttcgccgtgccagctctgcccccagctccagaccgcccacgattcgcaccgcgggacggagggtgcccgtccacacccaacgccccgagtcctccgcccgggtgtgccccgcatgcaggcccgccgccacggagagccggtcgcccaggcgcaccgctggcaagagagagagggtctgtaaggcccggtctccgaaggcggaccggacgccgggcaacagctcgcgggtgatgccgtaacgcgccaccaccagccagggccccggccgccacgccaccgccgcgtagccttccaccagccgcgtctccagcacgtccgcgttgacggtgcgcgcgaagtccacccgcccggaggccgtcacgtcctccagcaactgcgcctgcgcggccagtgccaccaccgcttgcagacggtccaccgccgtggccgcgcctcgctccggcgtgccctcctcccggcgaagctccacacgcccgtccagccgcaagcgcgccaggacgagctgcccgaagacaccgcccgcctcgcgccgcagcgggctgtccacgtccaacaggctgcgcacgccgcgctcgtagcgcgcgcccacgctgaaaccgcccgtcacctgctgctggaagcccacggcgcgagccagccgcacggccgtcgcgtcgtgcgagcccacatcctccacgaagagcgcggtgccactctccggcagctccgtgcgggcacccgtcagcgtccgtcccgcgccgaagtcagggccgtccacgtcgacggagtaaccgccgtagaacacgtcctgcccccgccgcgactcaacgttggcccacgcccgggggcccagctccggtccccagcctccgaacaccccagcgcgcgtggtccggtccacctcgacatccacgcccgcggacgtgaaggtgtcatcgaagcgcccgggcccttcgccatgcagggccagggcctgccggtgcgctgcgcgaagctgaagccgctcgaacacccgcagcgagcccgccacgcccgcggaggtgcgaccaccgaagagcgtgggccccactcctgccacccgcgccgcgttcagccgcgagtcacggacctccgcacgcacgccccaccgtgcctcttcccaacccacacccgcggccaggacgcgagcggagaacgggctgtccatgaatggctcacgcggatcggccgagctccgctcgtccgccagcaacgtcaaccggagccggcccagcggctggctcacacggattgacgactgccggaagcgcgcagcgtcggtgtgtgcgccatcggagaaaccccgcccgcgcaggcggaacgccgcgtccaccgagccctcgccatgaagcccgggacctgacagctggagactcacggcctccgcgccggtgcccatgtccggccgggggcggatgaagctgaggccaccgtcatccgagacgccgaagaaggaagcatccacggcggtgccacggctggacgcgacttccgccgccatgcggtaaccaccgagcgccgtgctcgcgcgtcccgtgtagagcgtgtacggccgtccctcccggccctcgcgtaccgcgccgagtcccagccgcgagccgcgccactcgccccacacctcaccgcccgccgtgtcgcccgcgtccgcgatgcgcagcgcggcgtagtccaccaccagcaccggctcgggtgactccgtgggcgcgctggtccgcagccaggcttcgcccgcgaggaaggagagcggacgcgccaggaggatgcggccggcgaagtagtcgatgtcgtagtcgatgccgcgaatgaggtgccgctcgcccagcggcagaccggtgacgccgtcccgcagctccacgcgcaccaactcggagccctccgccaccgaggccgcgcccaggtagtagaggcttccgcccgtggcgcgcagctcctcgtgcgcgggcaccgcggacacctgccgcaccgggtccgtcaggctcccgccaaacgccttcacgcccacgcgcgtcgcctcctcgccggcatgaacctccgcgtaggggccgaagagcggacggtgataacggcccacttcacggtcgtgaagctgcgcgcggtaggtgcccaggcccgcgcggccgtgctccgcgtggcgcgcctcaaaccgaagacgtgcctccgaggcattgggcgtcagtgacaccgagtcgtccccccactccgcgggcgcgaggtccgggtcggcggcgcggtcgaagcgctccggcatgcgcgggcggagccagtctggcaggctggcaccgttcagcgtgcgaccatccgtgtcgcgcaggtccagctcgcccaccaggtccaccgcgcccagccggagctccgcgtgagcagagccgcgtccccgcagctgcacgtcgccatttcgcggcgcataggtggcctccaggtccagcaggcccacggcgaagggacgtaccgcggcggcaatctccagcgtctcgtcacgaggcggagcatccggcggcgacagccgcacgggcacctggttgcgccccggggacaacaccaccaggacatccgcacggccttcgggccccaccacgacttcgccctcgggcgtgcggatgcgcgtccccaagggcgcctcgacctgcacgcgggaggcgccactggccgcgggcgcgtcactgcccgcgggcaactggagcgtggcgaggggcagcatcggcctgggggccaccaaccaaccgccgtcacgcgggaccacgtccacgcgctggcggtacaggcgcaccgtgccctgggcccccgtggcggtgatggacagtgggttctctccctcgacgagcggcacctgcgcctgccatgcgcccttctcgtccacctgggctgccacacccgacacggtgacggcgtcgcccgcggaggcctgtcctgcgacacggaagcgcacgacgccctgccctggcgcgacttccgccatgggcggtgccttggcaaaggagagccgcacgggcgcggcctccaccgtgacgctgcgcacggcgaagtcctggaggacgacggcgccccaggggacctcgaccgtcgccgcctccgggctgacccggctggagatcggcaacgagcgcgtgtccaccttcagccgatgacgccctggccgcaggtgcagtccccccaccgaatccggcacgcgggcatcgacgccggtgatgtggaagcggccccgcgcgtccgtgcggacttcgcggccggtggtgagcaccaaccgcacgtcgggcaggcccggctcatccgcgccgcacagcccatcaccgtccacgtcctggcacacccggcccgcgatggtggaggcctgcgatggagtgtcctgcgacagcgcctgcgcccaggtgctcagcggcaccagcatcgcggcggcgaacaggcaggccagcatgcgcatcatgggcgcacctccgccaacgccgtgacgcccgtggcgacatccgcgacggagacactcaccggtcccggcgcccgcacggtgaaggaggtgcgcccctcctccacccgctcttcggctcgctgaccacccgtgagcgagacgaacacctcgcgccccatcagcacctgcccgttcgcatcctccacccagtacgtcacccgcgtcccgctcaccttgagccgcacgttcaccggaatctcaggtgccagtcgcacgcgttgggacgcggcggacgacaccagcgggcgctccaacggaaacacaggcccatccgcacccaacacgtgaaccgtccgcgtcaggcccgtccacacgccgtgcgaaatctccagcgttcccgggcgcgcgggccccaggcgcaccgtgccgtccgtgcccgtcgtcacctcgcggccatccacacgcagcggctgtcccggcaccggcagacccgccaggtcggacacgcccgcgtacagctcgcctgcggcccgccacacggtgatgcgcgccggctcatggcccgaaggcccccatgcgcgagcacgcaggtccacgtccgtcgctgcccccgtggctggcggagcccaggcgctgatgaaggtccccggctgtggctcctccgccggaccgaaggttcccaccagtgcgctcaactccaccgtcgcacccggccggggacggtcgaaagcatcccgcgccgtcacttccacacgcgtgcgagccccgtggtgcaccagcgcatcacccacttcgaggcgggtcatcgcgacgggcccctgcaccaactccagcgccggagactcgcgcgagccgggccctcgctgaggccacgcaacctcgatgcgctcgtcgctcaccaacttccgcggcgcggtgtagcgccactccagcaatcctcccggcgcgcgcgtggggccgcgcaaggtgccgtggcggacctgggtcgtaacgcgcgcgtcgtccacgggctggcccatggcatcactcgtcgcgcagaccagccgggcctgggacacgccgtccgaggggagccgctgcggctgaagcacgcaggccaggccatcggtgggcggcagcctcaggtcgatgggcatccgccgcacgttgcccaccttgtccaccacccgcccctgcccgatgcgatgtccgggcggcacgatgatgggcacccggaagcgaccgtcatgcccggccaccgccggaccgaacgtctggcccgcgatgtcgatggcaatctccgcgtcgggctccgtcgttcccggcagattcacggacgcggccagcggaacgagcacgcgcccgtaagccccatgcaccgactgcggactgggccacgcggagaaggccaccaggatggccacttcggggtaacgcgtgtccggcaggacgtaacgcgcgcgatacgtgcccggccccgtccgctccagcccttccacgcggcccacgctcaccctcaccacgggaggcgcgccgctgtcatccgcggtgccatccggccggaccaactggacggtgagccgcgcttccgtgtccttgcccttcacgggtgcgggtggctccagcgccagccgcacctcggcggccggtggccccagcacgtagcgcgcctgggccgccagtccatccacgttcgcgcggaccacgacgtcacgcgcgcccggacgcggcgtcaccacgaacgtgcgcagcggcggctccgcggtgtcctctcgcagctccgcgccgtctgcctgcaccgaaggcttccccatcggaaccggacggcccgccgaatccttgcggacgagcgccacggggaatccatccggcgccacggcggacgacggcccgagtatctcgagcgtgtccgcccaggccggggcacacagcagcaacaatccgaagaggagaaaccggttcagggccgcgtcagtctacagggcgcggtggctgtgccgaagcgccttccgcatccgcgcgctcggacgcagccaacacgccagcaacaggatcaccccggaaagcgtcaacggcccgccgcccgtgctacagccccgaagcgctgtgtcatgcaccggcccttcgggcacgaaggtcgccggcgacaccgccgaggacgaagatgacaccgccttcagcgcacgccccggaatgacgcgggctcccgtggaggtatccgccacgggctgacacacggcggggggaccatagacgcgcagccggaaggcactgccgggcttgccggagatgagcgccgccagcgagttgtgcccatccagcggcgcgcgcgtggccaccagcggaacaccctgcttgaagcgagacgggtccaccagctcgcggccgttgatccacacccagcccgcggtggagtcctcgccgttgtagccgttgtccacgcacaacacgccctcacccgtgcccgcgaacccgagcgccacgccgttgggctgaccactggtgcgcgccacttccagcgccgcgagcagcggccaggtaccgggccgcgcgcagaccgcctcgggggacggcgtgtccaccgccgcgagcttgcacccgggctcatcatccaacttgaaggtgaaggcatggacgttgaagtcgccgttctccgaaacggtccacaccacgcgcaccgtgccgtccgcgtccacgctcaggtcggtgaggctctcgttctccggcgtctcggtgatggcgtagagcgtctcggtgctcaagtcgtagagcacgatgtcgaagtcgttcctcaccgggtccctgcgttcgaaggcaatcagcgagccgctgatgctgggattcgcgtccatgcccggcagcgccagccgctgctccgtgccgccgttcaggggcttccagtagatgtcccggtccgtcacgccatccagggtccgcgtgctggcgtagacggcgatgtccccgttggtgtccggctgcgactcctcgccctcgctgcccgtcagcgcctgtgagctgaatccgtaggcgcctcgccgcgcctgccagatgtcgcaacgcaggccctgctcgtcgcacttggcccagaccaccgtcgagccatccggcgacaccgcgggcgcacggtcctggaacgtgtcatccgtgagccgggtgagcgtgccctggtccaggtcatacacggcaatctccggctgcgacgtcacgccggtgtagccgaagtcctgccacgccaccgtgcggccgccaatcaccgcggagcgccggctactgcccgcctccggagccagctcccgcggtgccgcgtccacggccacgtcgaacgtgtagatggcgctcgaagtactcacgcgcgtgaagacgatggtgccgtccgagatgtccgacacgaagtcgaacgcgcccccattggggatggccgcatccgcggaggtccgcaggtcgtggtagcgaatctcgctcgtgccacgggactcgttcgtataggccaccagcggtccgctgacgtgcgggtccgtctggtcacccgggccgccggccaccacgtgcagggtgcccgtcagggtgcggagctccggtgtggaggcgaagacgagcggggaaaacaggcagcaactcagggccagtgtccgcagcatcggataggacctcccgggggttccgaaatgaagacccatgcccgcccaaggcgcagtgggcccggaacctgtccggtgctgacttcccacggcggtcacggccggccggacttcaggccccgcggctttgcgcaccggggctttcgcccgggattgcccttgaacaggaatgactcctccccgaagtgtagggagcccactcgccgtgggtcaaggcgaacacccgctcgcacccacggctgctggttcagtcgtcgcgcggctgattccagatgttctcggtatccgtcttgagcggcggcggcgtggtgtcgacgaccacgtccttggtgtccttctgttgcgtccgccccacgccataggcctggacatcgacggtgttacggccttcgcgaagaaccacctttcgctggaagtttccctctgcatcggatttggcgctgacgccatccacctccacgcggctgcccggtgacgtctgcccgcgaacgaccagctcacgctcgcggcgggtgcgctcggtgggccagtccaccttgagcaggagactggtggggatgggtgacggctccgacggcgcctgccccggacggacgacggcctgctgtcccgcgcggacgatgacgaccttgccctgaccgagcagcgtcacctcgccttcacgcgtccccaccgccacggtgccgtcgccgttgttgctcatggtgaaggcaccggcctgctgcaacgtggccttggcatccgcgttcgccgccttcacctcgaaggtgtgacgctgccccggccgcacgacggcggtggccataccgcgcgagagaaggatgcgggacagcgactcggtcagctcgtccacggaaatctccgtgcccgggtccatgtgcacttccaccgcctcgccgccaatcagcatggcgtacgaaccgtcatcggtgcgcacgcgctcatcccggcgcagcgccatgcccaccgtggcctcgcgccatgagccgtccgtgttctgcacctccaccttgccggacacctgcgtgagctccagcaccagcggcttctgcgccacgggcgcctcgacgacggcggcgcggcgggaggaagtggcggccgaggtggcgggcgcaggaagacgaaccaccccactggcaacgccgcgagaatcagcacgaggccaatgaagaaaggcgcctgacggcgcgatgggcgggaatcagccatgggcagcctcgttagctatcacaggccccccaaggggcctcacgccttcggcagcttcacggtgaagcaactgccctgctcgacttccgagcggacttcgatgctcccgcccgcttccgtcaccacacgccaggccacgctgagccccaaccccacgttggaccacacgtccttcgtcgtgaagaagggctcgaagatgcgggagcggacgttgggggcaatccccttccccgtgtcctccacctccaggaagccgaagccgccgacttcgcccgtgcgcagggtgagccgcttctcgggtgaattcagcatcgcggtgcgcgcgttggacaccagcgccagcaccacctgcgacaagtgccccgggtcggcacgcactcgcgcgagcccgtctcccagcacgctggtgagcgccacgccatcgccgcgaagctggtgctccgtgaggctgagcgcgtcacgcaccaccgcgttgaggtccaccggccgcagctccgcgcgctcgcgctgctgggagaagcgcagcaggttctgggtgatttccttgcagcgcttggcgctctgctcgattttccgcagcgactccaagtccgggtcggcggcgcctcggtcgagcatcagcaactgcacgttgccgaggatgcccgccagcgggttgttgatttcgtgcgccacgcccgcgccgagctgccccaccgcggccagcttctgcgcctccaccaactgcgcctgggccgccttcaagtccgcggtggcctcctccacgcgaacgcgcaaatcgtcgttccagcgcagcatccgggcacgcgccgcctccagctcctcgcccatgcggttgaaggtggtggccagctcgctcagttcatcctggccggagaccttcaagcgcgtgtccagctcgccacgcccgtaggcctcagcgccgcgcaccacctccgccagccgcacgttgaggcggcgcgtgaagagggctcccagcccgagcagcaccaggaaggtggcgccaatggacagcaacaccgtgcgccgcatgccgtgcacgggcgccaacgcggtggactcatccacttccaccagcacgtcgaagcgcatgccatggggcacgcgcgccacgctgacccgccgggccggtgactccacgcggaagctgcgcaccagctccgtcagcggcagcgccggggccaacaggtgcgcgctcagctccggcgccagtgcctgcccccggcgctccgacgcggtgctggcgagcacgcgccgctcctcgtccaccaggtcgatgcggcccagcccttcgcccaggcgcctgcgcagcaccgcctccagcggatggagcacgacctcggcgacggcgaagggcgcgccctcgccttccgccagcttcaccgccacggcgaccgccgagcgcccctcgtccgagtgcacgtacgcgctgcccagcgccgcctggcccttgccgccgcctcgcagcgtctgcacgggaatggagcgcaccagccggtccagggactccagagagaaggccgggtgcccgtcgatggcctgcgcacggaagacgggcgcgcccagtggacggccctccgcgtccagcttcagcaccgcgctcaccgcgggagactggccgtaaagcagccgcagcgcgccctgcgtctccgcgtcgctcgcggcctgccagtcgatgagctccgccgagcgggccagcgcgtccaccacctccatcatggtggcgcccacggactcggcggtggcgaccgcctgcgcgcgctgctccgcgtcgattcgggcggccagctcggcctctgcgcgcgaaagcaacaggaagccgaccgcggccaggggaagcaccgtcgcggcgagcatgaacaggacgagttgctggtagagcctcatccggccacggagcgtaccacccgctcctggtcactgcgcaggaagacagagcccgcaatcgccttggcgcgcttcttcatgtccgcggcgcgccgcgccaactccgcgtggtcctgcgttccgtccgtcatcaccgccaccacggacacgctcatgatggggaactgccgcttctccccgtagcggtcctccgcctcgatgtggccgcgctcccggtcctgccggtcgtaataaagcgggatgatgcggtcgaacgtctcaatggccttctggcagatgcggtccaccgactccggcgaggtgatgaagacgaagtcgtcaccggccacgtggcccaggaagtcaccgggcgcgccgtcctgcgcgaacacctcacgcatcaagtcgcccgtctggcgcaccacgccgtccgccttcgcgaagccgtagtagtcgttgtaggccttgaggttgtccaggtccaggtagcagaaggcgaaggggcggcgcgcggagaggcgccgctgcacctcgcgctcgatggcgggggagcccggcaattgcgtggtgggagaggccgacagctcctgctccttgcgccgcatcacgctctccacgcgcgcccctagctccagcgcgtcgaagggcttggtgaggtagtcgtcaccgcccagcttgagcgcgcgcaccttggaggacgtctccgcgcgggcggagatgaagatgacggaaatgtgaccaccggcgctctccgccttgatctcctccaggaagacgaagccgtcgccgtccggcagcgtcacgtccagcagcacgacgtccggccggcgctcgcgcagggagcggcgcccctcctcgatggagcccgccagcgccacgtcgaagccgatgttctccagcacctcgcggcagatggcggcaatcttcgcatcgtcgtccaccaccagcacgcggccgtgcgccgggccctggcggccgcgcaccaacgagtccaccgtggccagcagcttgtccggcgccaacgggcgcaccaggaaggcatccgcgcccgcgcggaaggcgcgctgacgctcgtcgaaggcggaggacaccagcagcggcgcacggcgcgtctccgggtcgtgccggaggatttccgccagccgcagcccgtccacgtccggcaggcgcacggacaccatcaccgtgtcgggggcataccggcgcgcggcggccaggccgtcttccgcgtcgaaggccagccgcacgtcgtagccacgcccggtcatcagcgccttcgcgatgaaggccacctcgggctcgccatcaatgatgagcacccggccgcggctctcctgccggcgcgggagctggatggcgtccgccacgtcgtctccccggcgcagctccggcggcggctcggtgggcagcaccaccatgaagcgcacgccgtccgtacacggctcgcaccagatgcggcctccgtgggcctccacgatgttgcggcagatggccagccccaggccggtgcctcgcacggtgcggttggccttggtgcgcgcctgttcgaagcggtcgaagatgcgctccaggctctcctccgagatggggtctccgctgttccagcaggacaccaccacgtagcccggcaggctggaggtggcgtggatctcggcccgcatgtcccca

SEQ ID NO: 1231 - DNA, 28558 bp, Myxococcus xanthus
cgtgccgctcaggttccacttgaagaaggcagtggacagcaggacgacggacagcacgagcccgaagacggcgagcagcgccttgagcagcgcccggcctccggcgtgcctcgccctccccttcacggcaccaaccggagtcgtggggtgttgtcgagaaagaccgccgcgagccgctcatggagctgtacgcagtgagaaaggccggacaggtccacgggcgccttcgcgggccagcacaccaggctgttggcctccgtgcgagtcagtcctccgtgcgagccgaactcccaggcgaagcccacggtgccaccgcgctgcacggcttcgccgaagaggaccaggtcgcccgcggtggacatggtcgggagtacgcggaggaagtctgccaccgcgcgcttgctgaattcggcggacagtggggcacggtccagcgtgtccacggtgtagacgccgtcgcgcacgagcgcgaccgcgctgttgcctcgtctcagtgtgacaaggccaatgtctggactccgcgtcacccgggccagtacctcggggtggcgctcgagcagggccatggcttccagcggcttggactcaccagacaggtacacatgggcgaagttgccgcagtcgatggccacgggcgtgaatggcgctcgaggctgggtgtccagctccgggtgagccctcccgtcgcatagtccgcggactgcgtcgtcggagagaggtccgtcaccgtggggcgccgtcaaccactgcgccaggggctggcccttccgctgctcccagggcagacagtccacgtgtccgtggtcggagaggaagacgacgtcgtagggctgctccaccgcgcccgccacagcgtatagctccgcgaggtacgaatccacgcggtgcagctcggcgcgagcctgttcggagcgcggcccccggcggtgggccacctcatcatagttgccgtagaccagatagatgacggggacaccccgcgccatgtccaccaaggacttggtgaaggcgaagctccaacccagccgctggaggaagacgtggctgaagaggaaggccggctcgtggcgccaatcgtgaagcgcacgagcccagtgggcgacttcgcgcgctgcggcccaggtgtccatgcccagcgagcgcaggtagtcccagatgcaggcgcgggccagggcctcgccctcacggtccttggactcgttgaagagcatggcggcgcgggcaatctgctcgatggcgccgcggtggtcctcgaagttcgccttcaccacgcccagccccatcagggcctgcgcctggccgggcttgtacttggcctcctggaacttctcgagcgcctcttcgtagaattgccggctggcggcgtggtcctccagcagaccgtgcagctcggccaggttcaccagaccctgtcccacctcggtgggcgagccggtgatgcgcagcggcgccagcgcgttcttctgcttctggatggcgtcgaggatgtgggtgcgttgggtgtcttcgggcgggtggtgcatgggggggcctcaggcgtcgccacccttgcggcggcgggaggtcttgtccaacgaatcgtccttctcgctcccgtcagtcccgttggcggccacggccagggaatgggcgcccgggtgccggtccttctccgccttatcggccttttcgtggacgaggatgggggagaagaagcagtccttcttcgtgtactcgtcgaaggcgaaggcgaaacggtagctggccgccgcgcgctggttgcagtcggtgcgctcgcagaagcggcaggagatgccggacggaatggcgtccttgcgcaggtccgtcgtgggcaggccgtaggccaggtacttggcgttctccgcgtgggtgcccaggccgatggagtacgcggtgcccttgacgatggaaccctcaatcggctggagctgcaccttggcgaagcagaaataggcggtgccgtccggcatgatggagtactgccgcgtcagctgggacgggttgaggaaggccaggtgcacggcccacttggcgcaacttccgccgccggaggcgaagcggatgccggtgccgctgtatcgcttggagatgttgccggcgatgtccgcgcgcaggaagtggaacggaagcccggggcgcttcgggtccgacaggttgcacaggcggtgggccaccgtctcgtaggtggaaccgaagatgctcgacagcaactccacgtcgtagcgcgtgcgctggacctccttgaagaagtccccgtagggcagcatcagcgcgccggcgaagtagttggccaggttcaccttgatgagccgctgcgtctcgccgtggcgcatgcggcccgcgtccagcacgcgctccagcagcttctctcggtccatcaccagcaggccaatggacgcggcaatctggaacttcagcggctgttcggtgaggaagggcgacagcgtcagcgtccgctcctccgggtccaaccgccgcaccacggacgagccggagggggacgggtcgtcgaagaggacgcggtagccgaagcgctcctccaggagccggatgagctgaccgctggtgatctgccgctccagccgcacgtcgcggcgcagcgcgtccgcctgctcttccagctccgggaagtagttgcggtgcttctccaggaagtcgctgacctcgtcgaagggcgagtagtcgaagcgcacgccgggcgaggtgccgttgcccgggccgccctgggcacgcgtgcgctcctcgacgttgagctgtgccagcacgttctccaactgcgtgcgggtgttcttgtagaggttgaagagcgccgccaccgtgcccgcgagcttcggctccgcggagagggactggagcgactccgggtcgatgtcgaggctcttgaggagcggctcgtccagcagcttcgcgagcgcttcgtccacgcggccttcgcccagcgtggacatgaactgctcggggtcctggtcgaagtagcgcagggccttccagagcagggggaagggcatcacccgcttacccttctcgatgaggttcaggtacgcgggggaaacgcccaggtccttggctgcgtccgcctgcttgatgttccgtgcaaggcgcagtccccgaagcttcaggcccacgttggcgttcagtgcgttgtcgttcatggccgggtgcgttgatgccttcggcgatcgcgaatggccgcgcgcgcctcgggctctttacccactctgcaaatcgatttaccgatttgcaatgatccttttcatccacgaggacccctgtcgaccctgcgacggaccggctgaaccgtggtcggaagcagcgtgcccgggcactcaacctcatgaaatcacttccattttaggcgtgtggggaacctgtcgccgcgctctctacagcaccttgtcaagcatttactgatgcattgcggcatggtcgggtcgcgtttcggtaaagtgaaaaacgccggtttacaagaacagcccggggctcgggtgcgatcgaaggtgggggctgagcggggcgcccgctgccaggggacgattcacctccggcgcgtcatgggcgaaccttcgccgcgtatggatggtgggcatggctggccgcgaaggtggagcagggcaccgctgcgcatgtgtgcccgggccgcctccgtcatcctgctcggcctgtcgctgatgtcgtgtcagacgccgctgcgccaccaccccagggaggatgcggcggcgctgcgctacaacctcacctacgtgcgcgagcccgagcacgtggtggacgtggaggtggtgctggtgcgaggcacgccgcgcgagttcctcttcagccagccgggcgccgtgacgacggtgtccgcgcaccgggaggatgggggcgtccagacgttgcccgtccaggagggccgcgtcctgctgccacgggggacgcgcttcttgcgctaccgctacgcgctggacgcctccattcgcgagcgcggtccggacttcttccagggctccggagacggcgatgcgcggcacgtcgcgggccgcgcgtacctcatccggccgcgggtggtgaagccgggccttcgcgtggagctgtcgctggtgggcaccgatgcattgctgccgtggcagcccggggagaatggcgtgtaccggctgcgcggcgaggacctggtggactcgggcttccacggcttcggcggccgccggtgtcaggtgcgtctgccggacgcggtgctggacgtggccatcctgggacacttcacgcacctgagcgacgcggccgtctgcacctggttgggcaaggccgcggaggaagtccgcaccgtgcggcgcgccttcccgcatccccgcatcaccgtgcgggtcatccccgcgcccgggcatcaggggcccagcgtcttcggcatggtgcgctggagttcgccgcccagcatctccatcagcgtggggcaggaggcgcggccggaggacttcgcgcgggactgggtggccgtccacgagatgctgcacctgacccatcctgtcttcgtgccccgcgtgccgtggctgtcggaggggctggccacctactacacggaggtcgcgcgtgcgcgctccggacggcaggactcgcggcgcgcctgggaggaactgctgggcggctttgctcgggggctcgagggcaatgacacgcgaaccatgcaggaggccgtgtctcaagacagcttttcgctcgctgtctattggacgggagcgctcttcgcgttgcatctggatgtggaattgcgccgtatcactggaaacacgcgcgggctggatgacgtgctggagttgctcgcggctcgcggcagttcctcgaccttcggggcattcggggccgcggtggatgccgtcgcgggacagccgctgttcaatgctctgctggagcggcacttgccgcggcctgcttttgcggagcaggccggtctgctagaagcgctgggtgtccaggaaggacccaacggcgtctcgctggtacccgctcgagacagtctgttgcgtgattcggtggtcggtcggcgcagccacggcgaaacaccctgaatgcaaccgcgacctccacacaacacccccacgcagtaccgaaaggaagtctcatccatgaacgtcaaggcgcttgcagcggttgtcggcaccctgtccctggccgcgctggccacgggttgtgcgaccaagaaggcggcggagatggagcccgccacggccgaggagactggcgcggagagcagcggcgccacggagtcgcaggaggccgctccggccgcgaccgaggagaagggcgccgagggcagctgtggcgccggctcgtgcggctccggctcctgcggcggccagaagaaggagtagttccgccggacggaagtcccgagggcctggtgaaggctgggccctcgttgccgggcggttgagcagcgccgccgcccgggttgtttcccacgcttcgagagggcttctgccgtggtgacgtacgcacagcgacatgggctgaagccgctgggcgcgggcatcgggctgcgcaggcgcttctatgcggagctgccgcgcaccgaacggacgctcgactgggtggagatcatcccggagaacttcctgtcgctgggtgggcgctcgcagcgcgcgttggacgcatgtgcggagcggtggcccgtgttgccccacggcgtggggttgaacatcggcggcccggacgcgctggacgacgactatgtccggggactggcggcgctggtgaagcgggtggacgcgcccttcttctccgaccacctctgcttttcgcggctggacggcgtgtacctgcacgacttgttgccgctgccgttcagcgaggccgctgtcgagcacgtggtgccccgcgtgcgcgaggtgatggaccgggtgggccgtcccttcctgctggagaatcccagctactacgcgcggatgcccggcggcacgttgcgggaggcggacttcctccgccgcgtcgtggagcaggcggactgtggactgctgctggacgtgaacaacgtctacgtcaacgcgcgcaaccatggctaccacgcgcgggccttcgtggatgccctgccgctggagcgcgtggtgcagattcacctggccggccacacctgctacccggacgtcatcgtcgacacgcatggcgaccgcgtctgcgatgacgtgtggtcgctctaccgctacgtgctggcgcgcaccggcccggtggcgacgctcgtcgagtgggaccaggacctcccttccctggacgcggtgctggacgaggcggacattgcgcgagcatcgctgcgggaggtcgccggcccatgaagccgtccctgcgcgacttcttcgacagcatgggggactacctcgccgagcccggcccggagtcactggccgcgctgtacgcgaggcacccgggatgggaggcgccgcgcgagcgggtgtcgctctacggcggattcgtgctcggccatgtgcgctccgcgctggacaaggtctttccgctgacgcgccaggccctggggcaggacgcatgggacgacctggtggtggccttcacgcggacgcggcccgctcggcaccatgagctcaaccacctgtgcgaaggctttcccgcgttcctcgcggacgcggcggcctcgcgggggttggcgcccttcgtgcccgccctggcccgcttcgagtggaccgacttcgcggtgttcgcgtccctggagccttcgcccgaacgcgtggagcggctgatggccaaccccaccctggtggtgctggagcacgacttccacctctgcgcgtacgtgcgggcccgaggcgccgcgacgtcaccggaggcaggcgcggagctggcgctgctgtggcgccatccggagcagttgaagacgctctacatggccgctacgccaccggcgctgctggtgctgaagatggcggtggaagggctggccctggcggacgtggtggcggccacgggcatggcggaagccgacctgcgcgcgacggtgacgcgcttcggccgcgacggactggtgctcctcccggacgacagcgacgggggatgaagggcccgcgctgtctgggtgctcagtgccaggggtacgtcaccaggcctcgcgccgtgcccacgtagcgcggtcctcccggagccaccagcagggcgctcacgtccgggtccggcaagccctcttccgttccgaagtgggtggcgatgtctgctgacacgtcataacgcaccagcccgttcttcgtgccggcccagaggatgtctcgcgtgcgcgcgtccacggcctgccgttcgaagtggagcgtgcgaatctcctcgtcctgcagtctccagggcgcgtcgcgcagcgcgggaccgggttgtcccagcgcgctgaagccctttctcgtgccggcgaacacctggccctccggccccacggccacggagaggacgtcgtcatcggggatggccggcggagcgtgaagccgcacagagacttcggcgagtccgggctcgaagtcgtcgtccgcccaaagagtgatttccgccagaccgcccgacgtggccgcccaggccgtcacgcgttccgggctggagtccggggagatggcgagctggcgcacctcgcgtccctccagcaggcggcggcctcccacggtgcccgcgcgtcctccggaggcggggtcgctcgcgcgtgtgaggaccaggccccggcgggtgcccagcagcagcacgtccggggattcccatgcggccaccgcggacaccgccgcgcccgtggcccccagcatggcgcccgtgtgccgggtgcaggtgcgctggacgcaccggagcacgccgccgccgtcggtgcccacgaagagcacgttgtcgcctccaccttgaaacgcatggagcgacagggccggggcgttcacgtccagcaccgtcgtggacgcgcgttccgcatatacccggggagaggcgccatccgcgtagcggagcccgtccggggtgagtgccagggccaccacgggccgctgcgcgtccgggacgtcctccatcaaccgcgcgcgtcccagcggcagcaccgtgaaggacgtcgccgcgcggctcaccgcgccgtcctggtcggtggcggccagcaccgtcgtgtggcgaccggcgagggggaaggcgagggtggcggtgggcagcggcagcgcgaccggcaagaggctccccgccaggttgtccagccacgccagctccgcgatgtggccctggggggccgcgggcctcgcgaagccggtgaggaccacgggttgcccctccacgcatgggcctctgccgcaatccagcagtccttgcatcacgctctccacccgcacgtcgggcgcgccgttcacggtgacggccacggccgccgcgcaggccagtccccacgggtccgtcgcggtgagcgtcagcacgtggtggccgggcgtggacaggcggacggtgtgcgtgctcggaccctgggccagtgcgccgtcccgcgaggacacccatgtgtagcgcaggcccgtccgcgcatcctccgcgtccgacgccgaacccgtgagcgtcagcggcacacccgcgttcaccaccgcatccggaagcggtgcctggatggagcagcccgtgggcggcgtgttgatgatggcgcgcaccggccgctccacgcagccgcgcaacgcggtgtcctctgggtcctcggcgcacgcggacaccacctgcgcaccggccacggacagcacggcgctcacggcttcacccgtgcccaggggcgtgggctcggcgctggtggtccagatgggctccaccggttgctccgtctctggatccacgcagcgggcccgcagccggctggggacgcccacgagcacgcgtgggttctcggtcgtggggagctccagctcgcaccggggcggaaggttggtgaccagccgcacccgcacgcggtccgaggcggtgttgccgcgcccatccaccacccgcgccctcaccgtgtagacgccgggcgtggtgaaggcgtgtgtcaggaccgggcctcggcccagcggatgcccggagggcgccaggctccactccaccgcgccgtccaggttgcctgcgcccccctcggcgtgaaagtcctgggcggtggccgcgaatcggacggaggcgccgtggggcggggcctcgccttgcttcacgaagatctccgtgggctcgggctggaggatgcgcacgctgggggcgcgcgtggcgcggacggtgacgcgcacttcggcggtggcggagaccttcgtggcggagtcctccgcggtgcaacggagggtgtcctcgccggccacggacaaggtcgcccgcaccacgtcgccggcaggcagtggcccggacagcgcggacgtccactgcaccgcgcgtccctggagccgcacgccacgctccgtcatcgccatgcactccaggcccagcacctcgccgaggttgaaggtgctgcccggcgcggggcgcagcacggtggccacgggagcccccggcgcgaggacgttcaggtggagtgacgcgctcgcggccagtccaccggcgtccaccaccgaggcggtcagccgctgcgctcctggttcgcggaaggcgagggtggcgcgcgcgccgcgggccagttgcccttcgacggaggacacccacagcacgttggcgcccaacgctgcgccttcctccgcatcctcgacggtggccgcgaactccatggcctggcccacgcgcagcgggatgatgtccagggtggggctgacttcgagccggggaggcgtgttgtgagccgctgaaggagggcggggagctggctcacagccccacaacgtggcggcgtacagggggaccaggacgaggcggagccgaggggggccttggctcgccacggggtcacgtcccggcctggcagatggggcccgccgatgaatccacgcaccgccggctgcccgggcagtcgaggtccgttgcgcagggcgccgtgcaggccccgctgacacagcgcccttcgagcagtcccaactcgtggcagctcgcgtcgtcggtgcagggcgcgtccatccgccgcagggcatggcagcccgcgaagttcgcggcatccggcaggcaccgcccggactggcaggtgaagcccggcgcgcactgtgccgacccaacgtcgttcggccgtgcctggacggaggggggggcgtcatcgtcgccgccacaccgggtggcgcacgcggcgcttccttcgggcagcacctcgcagtgcgttccagcggcgcattgccagtcgcccgtgcagggcgcgcactggggaccggggccctcgcagcggttgcccttgcaggtcaatccctcgccgcagtgcgagttgccgaagcactccaggcacttcttgttcggcgcgcacaccaggccttcctcgcagccaatctcttggcagccctgtccgaggagcgactcgtccagcaccaggtcgaccttgagctccttcttctcgcccgggcccgcgcagtcctggacctgggtggctggaaatcccagggccgtcaccgtcaccgtgtagcagccgtccggaaggggccccacgcgcagccgccccttcgcgtccagcagcagccgctggaagggcgtgccctccacggacgcctccgccgcggacagccggaagccgttggtcgtcttcacgtgcaagtcgaggaagctcgcgggcgtgggcgccactggttgcacctggacggactggcctcccaatacccgcacctggacgcgggcggccttttcggtcgtggcgatgatgaagagctccgccatccccgtggggacgtcttccagggtgaagcgcccgtccgcgtcgacatggctgctcacgccgggctggcccaccagcgacaccatggccaccgcggggtcgctctccgtgagctgcccatgcacggtgcccacccggaaggggtcgttctccaggttgccgcagcccgcggcgcagcaggccacgagggtggctagcgcgatgtgaaacgtcgagcgcatcagaaacgatatcccgcgccggcccagccacccgtgaaacccacggcctgcccctgcccatccacaacgacatacgtcagcatgaactgggcctgtgtcatcagctccagccgctcacccacccgccacacgatgccgcccaccacgccggggctgacggtgaagaaccgttgcccgttgacggcggcctctacgtcaaaggaccgcctgaggtgcagaccggccacacgcggccccgcgaacaacgtcagccgctcccagcgccacaggtagggaagggccacgcccgcggagacggtggtgtagcggaagggcacctcgctgtccggcgtcagcttcagggcccggtctccggtgctgaaggccacgtcgaagagcagtccgaaatcctgaatcggctggtcctccagccgcaatgacagggcgacttcgggggacatgggcagcagctccgtgcggctgcgggcatccgcgaagctgaacatgccgcccagcatcgacagtgagcgccgcgggaaggcctccgccagcaggcgctccaggggcagacggtccccctggcccacctccacgtcacggcgcatgaggacggcgtcgcccttggtcaggtccaccgtgcgcttgccgggcgtcaccgtcgcgccgccgggcaggtccgtgcgctcctcgccgtccaccttgagcgtgaagccgtccaggcgcgggttgtaggagaacagctcggggcggcccgtccgggtgatgctgccggagagcaccacggggtccgcgcccacttccatgatttccgccgacggccgctgccgcccctcggtgaaggcgaaggtgcggcggcgtgcgtggtcatgggcctcggtggccgtgacggcgccgtcaccattgcggtccgccgcgccgctcaagccgtcgatgaggaagtgggtgtagatgtcgttgcgcaggctctcgtcctcgcgcgccgtctcgccccagtcgcaggcggcgaacaccatggacgcgcgcgacgactcctccagcggccgggcgtagaagccggacttgatgccctccagctccgccttcaattccttgggcagcaacgacttgccgctgccgctgtggcaggtggccagcaccagcatgcggcgccggctggccagcccgtcgaactccgccttcagcgtgtccatgctcagcgccgtctggggaatgtcccggtaggccgcgtcgcgggtgaccaggtagcgccgcagctcgcccttcgcatcgcgcgccagcgtgccgtgcgcggagaagtagacgaccaccacgtcgtcgggccggctcgcctccttcttgagctgccggagcgccgcgaggatggcctcgcgcgtcgtctcctcgcggcgggtgagcatgcgcacctggtcgaacccgccgcgcgcggggtccttcagcgcggcgcccagatcatgggcgtccttgacggtgtagcgcagccccttccagcgcgggtcgtcgaacgaggcgatgcccaccagcagggccatccggcgcggcttgtaggcgctggacagcgacgcttcatcgagcttcagcgggaccagtccgcccttctccccagaagaggaggagggcgtcgcgcacgcggccaggcaggccagcaggatgggaaggagtcgcctcacgtggaaccgttcaaggacgattctggctgcttcgcacgctcacgtcgaaccggatgatggccagtgggtcctgaccctgggggcctgccccgtttcgtccctccaacatttcactgaccgtctcggcctcgggcggcgcaccggtggagcccaccagccacagcgtcaccgggccttcctctcccgcgaggctcacgcccgcgagcccctgcggcccctgcaggtcgtgggtgcccgcgaccagggggaagtggcccagcagctccggcgccgcgccctgccgttgctcgaagagcagggcggtgcccgcctcggtggcgtggtagcgcaggagcaacacatccgaatcctccaccgggctgcccgggtccagacgccgcaggacgcccgcgctgtcgcgtgccaccaccgacagctccagggcgacgcgtgcgcgtcccttctcacccgtccattccgccgcggagccttcctggctggccggatccaccgcccgcatgcggggcagcaacaccaccgccagcaggcacgcggcgagtcctccggcgaccaggccccagtgcccggccgcgggccgatgggctcgcagcagcgcgccgcacgcgcgccagacccacgtcatccaggggcggggcggacgcgcccgtcggagcgagccccagcagcagcgagtccacctggccgtcgagcaggcccgggcccgggtgcgtggcgaggaacgcctcgcacgtttcacacgggtgcgccaggtgcgcggcgaagtacgccacgtcctcgggctctcggcgggaaagggcgcccagtgcgccatcgtccaggtgtttcatgaacactcactcccaccggccgacgaggactcgccgcagcagctcgcgcttgattcgagaccggaaccgctccacccgcatcgtcaccgcgctttttcccacgcccagcttctccgcaatttcccgcgcggacagctcaccctccacgtagaagaggtgcaccgtccgtttctcctcgccctcgggcagctccgcgatgagtcgccgcaccaccgcgatgtcacgctccagttgaagcgcctcgggaatgtggggaaccgattccggatccggatccgccacgtcctcctccagccgccgggtactggacttccgctccagccgcgtccgggcccggtttcgggcaatggacagcagccatgactcgaaggcccccggctccttcagccgggggagcgcccggaacgcccggacgaaggtctcctggatgacgtcctccacctcatccgagtccaactgggcgaagccgcccaccagccgcgtcaccaggggacgtgtgcgccggtagatctcgctataggcagacgcctccccatgcgctgcccgccgcacccattccgtcagtccctccgacgcacccacctgtcctccagaccctcgcaaaggcccgccggccacagggccggtggacgctaccgtctccatggaagcaagcgggcaaccttcttctcgctggcacccgggggggcgctggggggaagaatgtctccgcggccgttcatttcaagaagggacactgacatgcgcgtcatcaacttcaacgccggcccggccggattgccactaccggccctcgagcgggctcgggacgaactgattgacttccagggctccggcatgtcggtgatggagcacagccaccggggacgggaatacgagggggtccacgacgaagccatctccctgttgacccggctgctggggattcccgacacccaccaggtcctgttcctcactggcggcgcctcccagcagttcgcccaggtgccgatgaacttcctgaggcccggggccagcgcggactacctcatgacgggcgtgtggagcgagaaggccttcgacgaggcgaagtactacggcacgccgcgcgtcgcggtgagcactgcgcggccggacaagcgttacacgcgggtgccccgccaggatgagctgcgcctcgagtcgagcgcggcgtatgtccacctgacgagcaacaacaccatcttcggcacccagtggcacaccttcccggacgtggggaacgtgccgttggtggcggacatgagctcggacttcctgtggaagggcttcgatgtcagccgcttcggcctcatctacgcgggcgcgcagaagaacctggggccctccggcgtgacgctggtggtggctgacaaggcgttcatcgcgcggggccggacggacattccgaagatcttccgctacaccacccacgcggagaacaactcgctctacaacacgccgcctaccctggccatctacctggtgcgcaacgtcctggcctggattcagtcggtgggggggctcgcgcagttggagcagtggaaccgggaaaaggcggcgttgctctacggggccgtggatcggcacccggaattctaccgcgcgccggtggagcgcgaatcccgttcagtgatgaacgttgtcttccagttgcccacggaagcattggatgcgtccttcgtcgctgacgcgaagcagcaaggaatggtgggcctcaaggggcaccggacggccggaggaatccgcgtttccatgtacaacgcggtgagcgtcgaaaatgtgcgcacgttggccgccttcatggaccacttcgtgaagacgcgcgggtaggctgcgtccaaccgcacggattaccctcacccggaggattcatgaaagccacgctgaccgccgtcgtgctgtccctgatgttcgccgctccggccttcgccaaggaggtcgcgggggtgaagtacccggagaccgcgtccgttgccggcaaggagctgaagctcaacggcgtgggcttgcgcagcaagctggtgttcaaggtctacacggcggggctctacctggagacgccgtccaaggatggcgccgccatcatcagctcggaccagatcaagcgtgtgcgcatgtacatgctgcgggacctggacaagaagaccatcgtcgatgccattggcgacggcttcaagaagaacgcgggctccaagctgccggagctccagcccaagctggacaccttcaacgcggccatcccggacgtgaagaagggtgacgagctcatcctcacgtacatccccggccagggcacgcaggtgtccagcaagacgggcaaggagatctccgtcgagggtaaggacttctccgacgcgctcttctccgtcttcgtgggcaagagcccggtggatggcagcctgcgtgacgggatgctcggcaaggactgagtgactccggtgcgcgccacgtgcggcgtggatgccccgtgtctccgagcgaggcacggggcgtcgtcgtttcaggggccggatgcaatgcgtccatggttcgcgcgtacattcggaggacggccggccgctgcgcgagggcgggaggtctgatagcaaccggagggcacgaaggaggtcgtcatgggaatctgtacgtggttggtgctgggtggcatcgcgggctggctggccagcatcatcaagggcaccaacgcccgcatgggcatgttcgccaacatcgccaccggcatcgtcggggccatgattggcggctggattttcagtctgatgggcggcaccggggtgacgggcttcaacctctggtcactgctggtggcgacggtgggctccgtcatcctcatcaccattgtccaagccatccggaaatgacgcccgccgcccgcgtgcgcgctcagaagagactgagctgcggcgtaggcggcggcttgcgctccggacgccggaaggtgtccggagcgtcctcggtgatgtaagaggcgcggatgcccaccttgcgcgccgccgtgtggaagaggcggtggatggtctccgcgtagaggccgccaccgcgcatgcggtgcttgaagcggctgtcgttgagctccccgccgcgggtttcccggatgcggtggagcacccgttccgcgcgcaggggcagcttcgcgcgcagccgctccgcgaagacgtccttcaccgggccgggcagccgcaccaggatgtggtgcgcgcgggtggcgccggcttcacgtgccgcggccagcacgcggtggatgtcctcgtcgttgaggcccgggatgatgggcgccaccgacaccgccacgtcgatgcccgcctcggtgagtcggcggatggtcaacagccggcgcatgggggaggcggcatagggctccatggcccgggccagctccgcgttgtggaaggggaggctgatgctgacccacaggcgcgcgtcccgggccagccgttggaggacgtccaagtcccgttcgacgagcacgcccttggtgatgatgcccaccggattgcggtactcggcgcagacctccaggcagcctcgcgtcagccgtaaggaggcctccagcggctggtagcagtcggtgacgccgctgaagacgacggtttcacccttccaggagggtttctcgaaggcctcgcggagcagctccggcgcccggggcttcaccaccagcttcgtctcgaagtcggtgcccgcgcccatgtccaggtactggtgcgtgggccgcgcgtagcagtacgcgcaggcgtggaggcagccccggtacgggttgacgctccaactgaaccccacgtccgggctgtcgttgtgcgacagcacctgccggctgtggtcctcgaagacctccagcttggacggcgggatttcgtccaggtactccaccgcggtgctcgcccaggggttgggcggattgtcgatgggacgcgccttcatgcgcccaccgtgggcctgaaagcacgttcagtcaaggggcgagcgacaccgaaaaaggggaaccccctgcagagagttcccccagtgcatcatccggatggtgggctgctgaaacagcgcgctaccaggtccagacgtagagcttgtgggtaccgacggtgccgctcgtgttgctcacgtagagccgcgccccgggccacgcgcagttgaggttcaggttgctgtgcgtctggccgacgttgacggtaccggagatgttgttgctcccgcagtacgcgtaatacgacgtgggggcggtaccgacgttctggatggagaacggcgtcacgccgaacagccaggtcgagaaatcgcgcgtctgaccagcgtcaatccacgcggactccatggcctgctccacatcgctcagctcaggctgctgcatggcctgctcttcctccggcgtgtactccccaccgcagccaacggcagccagagacagcagacccacaactcccaacgtattgagcttcttcatgacttccccctcattgcgagttgtccccgaattggagacgcgcggtgtgtatgggggttttcacttaatgtaaatggtgtgtttttgacacccggtgggttgagacggattgcatcgctggatgacgcatcgcggtgtctgtgacatggccggagcgacccggcccttctcgtgagagggccgggcactgggggctcgggaaacggctgacgtccggagatacgggccgtctcgttgccgctacaagacttgtagccgacccaccgagtgaggctcgcgtctgagagttcaggcgggacgtgttcgttggcgtgaggcgttgcggaatgttcaaccgcggtgcgaacgacgccaggacatgcggttgctacggttcagggcacgctcgcgagtggccgcaatccgacgccgaccctcacgggaagcgcccgggtggggccgatgacaatgggtttctcgatgagctccgggcgggtggcccgtgtgtccgcggggtccggcacccacaccgggtctctgccattcgcccctcgcttccacgcgcgcgggacgcgccggatgcctactgggtagatcgtcaatccggaggcgtcgatgcgcaatcgcaggaagcacttccagtccggaatggccagtgaagagaacgcctcattcgcgtggcaaccaaacacgttgagggagctgatcaggtacagccccaccaggaccggagcgaccaggaagccagacgtgaatagcaggagccagcttgcgatgtctcggcgcaggcttccgggagctcccacgccgagctgcttcaccagtgtggcggccgcccgagtcagcagtcctgccgtgagcaggtgagtcgacccatggagtccgcccgcaagccatcgccaggatgcgccccggcgcgcgtccgcgaacgtgatggcgctcacgagggtgagacccccgaggaacaaggtccctgtccccttgagcgcccggtgaagcacgcgtgagagcttgtccgatacgcccgtgctgttcatgtcagatgcgagcccccacccaagctgcaggtagaaggcacccatgaagacgccgaaccatgggttgaggaagggaaacgccaggttgtgccacgtgagacgccgtgatttctggctcggcggaaagcactgccgcagctcgaagccctccgtctctcgtttctcgcccggcaggtgtgtggggtagaggtaggccccgcctccgccagcgatgatcttctgtcgtccgtccttgcccgagtgccgcatgtagtggtgaaggtctcccgaaaggaagatgctcaccttcttgcccagcaccagttgctccaggaactggaggttgccttccaatgccttgcgcccggcgatcgcctttatcttgctgacggcccactccggctctgcgttgcacaggatgacgcgctctccgtcctgcatgtagctgaccacctctttgaagaactccacctgcgtgttgtccaggtcggactccaactgcatgtccgtgccgaggagccaccagccatgcggcagcttgatggcgaagtagctacgtcgctggcgcgtccgccacgcctccgatgtccggccctggcagaacagccgaacgaaggagacaagcccgtcgtaccagtcatggttgcctggcacggcgaacagggagggcacgcgccgtcggtggttcagcgccgcttcataggggcccactgtccggtcgtagtactcctgtacgctcgcggtggggtacacctcgtcacccccaaagacgagcacttcgcctccctgcgtgtggtgagtctccccctccggatcttccagcgccagtgctgggttcatcaccgctgtcgccaccgcataggtggcgttccagccatcacccaggtcggacacgtagtcgagccacagcacgtcgcgcggccgattctcgtcgtccacggtgcagtcgaagtagggctgctccagcggctgcttcgggttggtcagcgcgtccagaaggcggcgatccgcctgcttgccaatgacagcggagaggaaggccttcacccccgtcttgaccagggtgctcgggtggaaccaccgcaccatcggtttgccatgcggcttgcgtggttcgtggcgtcccccggcgccgatggcggttcccccgccggcagctcgtatcgtcatatgcgttcctccgtggtggggtgtttgcggagcgccgtggttcgtggccagtgcgcaatcaagtggtctgagaaccggtccgcgagcgcggcgatggtgaggctcgggttggggccggtggggccaggcatcaccgagccgtccgccacgtacaggccggggtagtggaacgcctcgccatgggcgttcaccaccccttctgctggcgtctgtcccatggggcaaccacccagcggatgcacggtgatgacccggctcaagtaactgagggggttgtgcaccatcttcgcctccagcgcgtcggcgatgtcctccatggatttccgcacacggccgaagtactcgcgcgaaccatgcatgcgccagtcgatgtccagcttcccatctcgtgtcagccgcatgttcccgttggggatgtcccggcccatggcgagtagcggcagcgacgtggctgagcccaggcaatcccccagcgcttcagcaatctcctcgctgacatccgtgtcgcgcgtcaggccgatccagcccttgacgaggcgccaggccaggcgcatgcctcgcctcagaaggggggcctgctgcgagccttcatagagccagttgatgaactccgggtagcccgcgtcctcgatgtagtagccgcgcccggtgccgccctcctccttgccacggaagtggagcgcgctggtgatgacggggcctcttccgccatccagcacccgaggcagacgggtcccggagctgctgtccacgctgcgcagcaggaagcccagcaggtctccattgccgcagaagcgtgtgccgagccgggcgctcaggcgtggaaagtgcgcccggttcttcagcagcaggtacgtggtgccgaaggtgcccgcccccagtacgagccggtccgcggtgagcgtcacccgctggagttggtccgaggccacctcgcgccgctcgccttcgcgggcctcggcatggtccacgtactgaaccacgtagccccctccatccgcgggccagaactctttcacctccgcgcgggtgcgcaggtcagcccccgcgcgatgcgcagcggacaggtacgtgaagtcgagtgtgttcttgctgccgtagttgcacccgatgtcgcactcgccacacagccggcaggtggttcgcatgcggccgaagaggttcggcgccgcctcgcgaatgggctcgccgagcgcgggcgccgccccggcgttggcgaaggtgatggccagcggaggaagctgccagtcggctgcacggcccaggcgttcggcggcaagcttcatggccagcgtctttgccgtggcgtcgtagggagggtgcgccagcggaaatcgctggacgtgcatcatccgctcgacggcgtcgtagtgttcttcgaggtcgtcacgggtgacaggccaatactcataaccgccggtctgcggatgctcatggacgaaggtcttctcgtccttgcgcagcatgacgttggcgtagatgagcgagcctccgcccagcccggaggagacgacgccgcccagcccccggaaggaccagaggttgaacatgccgtgcaaccccttgctcgggtcccagaagttgttgcgcatgtcgtagggactgcgcgggaacgtgccaggtggataggcctttcctcgttccagaacgcacacgcgcaagccggcctctgccagtcggtacgccatcaccgagccgccaaagccagagcccacgatgattgcgtcgaagtgctcgggacgaaatgccattacaagctcctctccatggatgaggcggagggcgcttcccccgcctgccgggcccagggcgcatagacgtcccaaagcgtccccaggaagaacctgccgaagtggctcacggcgccgaatcccgcggtgccatggcgggacgagcgcatgctgccgaggagttcgacgagcgcccgtttgccaagcgtcagtacgcccgcgcccaccacggggcctcgggcatccgggccctcgtggaggtagcagtagagtcgcgtggtgtcccgccagaggtcgaacccaggctcatcgcgaagcgtcttggtgccctccaggaagtactcgcggcccttcgcgccgaagcgcaggccgtagctcatgagcttcgtgccgggctcctccgcattgcggaagaggttgaagtggccctgttgcacggggagttccttgcccaggggtgggtagctgacgcgcgcctccagccgggcagtgtgagctgcatcgcgggtgaaggcatccatgtcatccacgctgatggtgcaatgcatggtgaagcgcgcggcattggcctgggtcgccccctccatggggtctgtggcgcccatcgccagggggccggacatgcgctctctgaaggtgaggtcgggtgcgggttccgtcatgtgcatcatctccggggtgagggcagtccccgctcgccggccaccgtgaggtagcgtcaggcgtcggagcagcccaggtcgaaggaggaacgggttcgtggcgcctcatgtgtgtgggggccctggcggcttctgaggtgtcttcccctggcccatccccatcacgctctccagcccctccgggtacgtctccgcgggcagcacggcctgactgaggaaccaggtctcgaagtggtcgtcgagcaccccgctggatgtgggcaggaagctcgtgaagaacgcgcgccgggagatgcctagcgcccggagtggtcgaatgcgtggatggtcacccatgacgagccgtgcacccgcgcgcttccccagccggaagccaaacttccctcggaagtagatgtagcttttgaagagcatgccgcggaacgcgcagtaattgacggctgtggcgtacagcggcagccacgcgcggcgaggccggtcgatttcgatgagggccacctgctggccgccctcgtcgtagcggctgctcaccgttccgtcctggatacggaagtccaggtttgccaggtgtttgggcatgccccagatgcccttgcctcccttcacggagacctccgtgttgacgggaaggtcgaacacgtactggcccaggccgtggcgtttctggaacatgaggggcagcagcgggcgtgatggccggggaccgcgagtgcatgcgatggcaatgctgaactcaatgtatgcgccgatgtcggtggtgcgatagtcgatgacggtgacgagcagtacgcctctccggcgtgacactcgaagtgggtgcagttcgttgccgggtagcagccgggctgcctgctcggcatcgacagtgaatgcggccatcagcaccggcgaggacttggaattgataggcagcgtgtaggggatgccgtccacgcgcgagtaacggccggactgtgcctggatgcggctgggcaggcggaacaacatggcggcgctccttcacaccggtttgtcgagttcggcgaggatgagggggaaaacatcacgggaggcgtcctggcccatgaacatgtccaggtggccgtaaccggggaccagatgcagcatgtggtagccgggacggaatcgctccaggtgctcgaagctgcggcgctgactctccgagaggaagcagcgattctgctcaccggcaaggaagacgaagcgtgcgtccgtctccggctcacgcactgccaggtcctctggcaacgcctggaagccctccacaggcaccaggtgtcctgcgcgcacgcactcggacatctggtggaagaatgtgagggggaccttggcgaactcctgctggagccagtcgtgcgtctcggaattgaggttctcgtggcgccagagcacgggaaacccgacgccataggtgaagctggaccagcggcacaccaggttggtgcactcatggtggaaggctcggaccaggagcgtgagaagcctggctgtcagcgtgggcgggccaaaggcccactgtggatccaggtaaggcgtcagcctggccaccggagcgacggcgagcttcagcttcaacgcagccgcgtggggtaccactgggtgaagagacacggcgttggtgacgatgacgtctacttcaggaagcagcccggacaccgcggccatggcgaaactgcatgagccctggcagtggatgatggccttgacggtgtcgtgcccggattcgcgcaccaccgtgcggatggcagccgggtggtccaggacggccgcctggtcgagcgtccactcgctgggctcaacgtcgatgctggcgcgccagttctctagccacacgtcgtatccgtcggccacgagcgcgtcgacgagcgtctgccgtaccggcgcgcggaagatgttgctacggacgcccgcgccgtgcaccaagacgactggccccttgttcggctttgcatcaccgcggatgcggatcaggtgcaacgcacgcccgtcacccgctaggaaaggaatgacctcctccgagtaactggcggtgctgtggggttcagctggcatggcgccactcctccctgctcgagcagaacggcggccgacgtggcggccgccacctgattcctcctggccgcatgacgtgggtcaggggggctctgctcaaacgtggggcacggccgcaccacgtacaactgggtcggcttccatcactgtttgtgacagcaaggcgccgtccgtttcaacgcagctccgccctttcgctcgttgcgtgatgtcggctggctggggagggcggcggtggcgagcggagagccctcctccttcacgaggcgcagcgcccacgggttcacttgccggagcaacgacagagaggcgggtaggacacgggaggttcgcgaggcacgtgtcagcatgctcgatgggcgatgtctcgctcatgtcggacacgcatcggtgtggcggatggtatcaagttgcaaatcgccacgtcatgggcgcgcgggcgatggggacctcgtcgtcaggactccctccgggaagctcatccacggcggcaaccgggggcccggcattgaaacggaccatgggacgctggaccggattgcgtcagccggagtgctccccggagcacccggcgcacgtcgtgtccttcacgtaactcggtggtcggtagagggcgtcatgcgctgatggggcctggtccctcgcggcaccgcctgttgccgcgagagacgaggtgatgagccactttccgcggaagtgagacagcctcggtgtcgacgtgcgtcaagcagacatcgagggactggcgctatgctgccgcatcatgatctgccaagcctgcgctcggctccgtgacgtggccttgggggccatgtgtcaggagtgcggtgccccgctcgtgcccgccactgagccgaatctcgatgcactcgtcagggagaccctgcgtcgtcacatcgaaggttggcaggccagcgcgctcatcgacgtcgtcaccgcgacccggctcgccgagtccctcgcgcctggcgcagccgaccctcaccccgaaaccccgaaggcagaggagggcgagcaggcctccgcccaggacctcttcgaagcggtagctgtccctcccgtggacgcggcgacccgcgcggaagcctgggccgatggtgccgcgacctcgcttcgtgacgggggagaatggcggctctggggctggggcgctgcgctcgcgcgctcgttggacgaagccgcgaaggcggagcgggagcagagagcgcgcacgcgtcgagggctccggcctgactcggaggcgggggatgacgacctgggcgcggcgctggattccgggcagacgttcttcgaccggggtgcatcaggcccgctcagcggagggctcgaggccgtcgtggcgctcgatgcacggccggagagcgcgccccggttccaggagttcatctggtggttccttggcgcgatgctggtgctgggcggctcgctcatgggcgtgcgcgaagcctggcaggcgctcggcggcgttccgcgccagctcctcgtcacgggcgctctgtggggataccacgcgggcttcatcgggctcggtgtgctcctgtcccggcgctccatgccggtggggcgcgtgctctcgggcattggcctcgcgttgctccccgtcgccttcatcgcgctgtcgtcgctgttcgccctgtcacctgggctcggtgtcgcggtggcgcttggcgccgccgcgctgggcatggtgccgctgaggtcggcgggacgcctgctgcatggcacttccgccgcggccctggggttggcgctcctgccctccctgttcgcggggcttccactgatggcgctcgaggacgcgccctggctgcgcacgctctgtgcctccgtgggtgtcatggccctgaccgccacggtatggcgcgcacggaaggcgacggagggaaaaacggcgctcgtcagcgcgagcgccgcgctctatggcgcgctgtggctcgccgtcttctgtgtggtgagcgcaccgtcgggcttcgacgccctggagccaggtagcgccctgttcgcgggcctcacgctgtgggcccaggcattggccaccgtcatcgccgtggccgcgaccaccgacgccgcgcgcgaggcccatccgcgcgtgagtccggtgctggagattgtggcctacgcggtgctcgccagtggcgcggtcgtgggcgcgctgggcgcgttctccagcgagcccggaggggacttccaggtcgacctggcctcggcgctcgcgccactcatcgcggcgggtgtcttcttcctgctggagccacggcggcgggccctggtccacctcatggtgatgacgacgctcctcgccggagccttgttcgctcgcacgcaggcgccgacggatccgggctggtgggtattcggcggcacggtggcgaccgcgggcttgatgttcctggcgcgttggagtgcctttccgggacttcgtatccgcctgctcgcctggaccctccttgggtcgctggtggcaatgcccttggtaagccaggtgggcagcgccgcctcgccgtggccccaggtgctgacggggctggtcatcgctggggccgcgcacgttgctggcggctggcgctggcggggcctgcactacctgggcggcgtgggccttctcttcggtgtgctcgccttcgtcgaggggaccccggcgttggagggaagctggggccggctggcggtcttcgcgctcgtgagtgggctctacggtgtcgcggggctcgtgcagggcgcgtgggcgcagcctgcgtcgcgaagggatgggctgctgcccctggatgacctcgccctctgcctggccgcggcgggagtcctcctggccgtggattcctctccgagcgctccggacctgctcgtgtcagtcacggggctgtcagccagtgtgctctccgcgcttcccacggccgtggttacggcctggctgctgctgcgtgtccggcgggatggcagcaggctcgtcgggttcctcgcggcctcggggctcgcgctcgcggtctcccaggtgatgggcaccgtctccgacttcgcatccccgcgagccgccctggtcgccgcgtcattggcgctcggcttcgcggccttctccgcactgcgcggccgcactccgctggatgccgcggacaccgctgccgggcgcgagaggcggaggatgttcgacctcttcaggctgccgctcggtgcgcgggggctgccgctcttcacggatggtttcgccacggcggcgctggtgcagacggtcatcgccgcgctcacgctggccgggtggctggccaggcccacggatgcagagcgcgccacgtgcctgctcgcggccggtctgctcctcctggtcgcgctggtggccttcgtgtcgcgcggattcgaggcctggcacctgcgcggctcggtggtgacgctcgcgtcgctgggcgcgttcatcgcgctcaccgctctgctcaaccgcgcgggccggccgtcgccgccggacgtcgccgctctgcggacctcgctcatcggcatcgcgctctggggcgtcgcgctggcgacacggcgcttcgggccctggatcgccgggcttctggagaagcctcgtcacggcaagctctaccactgggttccccatctgggcgtggcgctcctggcatgtgtgctcctgaaaggcgcgctcctagtcggcctgccccggccgtcccgtgcgctggccctcattctgcccctgatgttgctggggcccgcggtgttgatgttgctgctctccgtgtccgcgcgctcggggcgagtaacgagtgtggggctgtccctcgccttcccaggtgcggcaatttggaccgcgaggcagaggcagttcgggcccaggctcacgcaagcgtggtcgtccgaaggcaggtgggtccgcatcggcgccgagtccctgcactggctcgataaggacgcgtggctcgcaccaggagacacagtgttcctgctgtggcagcgggctttcgcgggcatagccgccgcggggctcgtttatgccgttgcctcgctccgggggctgcccgactccttccagcgcctgtttcagcgccattcggtcatcagtgtgggcgaggtcttag

SEQ ID NO: 1232 - DNA, 28762 bp, Myxococcus xanthus
cgctccctgctggcgaagctgggacacggctcgggggtttggtccaatacgcgcaccctgctctccttcgcgcgcaagcagaagctggaagtggtgggcatcgaccgccgggcgcagggtgagcgctcgttggagcttcgcgacgcctacgccgccgaacgcatcgcccgcgccgcccgcgcgccggaccggccactggtcatggtgctggtgggccagtaccacgtggcgccctgccacctgcccgcgcaggtggagcgcgcgctcggcacggagacgcgcaaggggctggtcgtgtaccagaacgcggaaggcgtctggtggcggctggcgcgcgaaggccgcgttggcgccgcggaggccgtggagctggccgacggtaccctctgcctgatgaacgcctcccccgtggtgtgccagcagagcttcctggactacctggaggcggaggccggagacgccccgctgttggatcgcggcgccgccgagcgcttccgtgaaatgtccgcgctgatcggccggctcgccggcgtgcccgtgggccgttccctggacacggtggacgtggccaccgccgcggacggcgacgtcctggcgcgaatccagcggcgcgggcgcttcacccaggccgagctgacccagcttcgccgccacatcctctcccgcgagagcagctacatcccccgcgcgcgggtggcctacctggcgtcactgtcgctgaaccacgcggcggaggaagcggcgcacttcgtccggcactgcgccgtgggtgacgccatggacgcgccgcgcggcgcctcggaggccttctacgcgcgctgcctggaagaggcgctgggcttcttcggctcgaagctggtgaacccccggcgcacctgcctgggcgtggccgagtgggccaagcgcttcggcgagagccgcggcgtggagcggcagatcgccgccttcgtgctggcccacaaggccacggaggcggaagcgccggaagaagccgtgaagctcctccccctgcgcaaggaccgcctgttccacggcgtcagccacgccctgggctatctgctcggagaccggctgtaccaggccttcgacagtggccaggtggccaaggcggaggtgcaggccctgttccgcgaccccttcgtggacccgcgcgcggcctacttcgcctgggccgaacgcctgggcatctgagcccggctacaagtcaacctgtcccgagggaggcggaggcgcggcttcctcctccatgtcgagcgggccgaacgtcccatccggcctcaacgtccgctgccgctccggcacttcgctcagcacccggatggctccgtccggggtcaagaagtaggcgatgcgggacgcggcgtggatgaccgtgagcgcgcccagctccgggtagagcatcagcgtcgccagctccgtctccaacggccccccgaagaggacgtgggagtgggccgagccctggtacagctcgccctccggccccggctccagactgatggcgaagacgctctggtgcagccgcaccgcctctcgctgcgtgcgcccgtcggggctgtagcggaagcggatgtccccgccgagatagaagcgcatggggtcgcgagtcccctggaggacatagacggtgaggtccccatcctcctccacgaagaccaccggattgatggacccccgctcgaaggcctccaccgtggccagcatcgacgtcttcaccgctcgggcgacggggctgaagtctccgggcagttcgttgagtggcaacgaagccatctgctccgcatcgtcacgcggagccttgaaggcataggccggggtgaaggtccccgcgtcgtccaaggtgccgaagagggagtaccacccatcttcgcgaggcagcgtgaagaaccactccatgcgcgagcggtccagcgcgtcctggatgaggagccggtccgtggcgaagatggcggcgcgctccgcatcaaagaggtacttcgcccgcgtctgcacccggcgcagctccgcgtcatccggaacggcgaccgtggactccgggccctcgggcttcacgcggcccgagcgcgcgccgcaaccgaagaagagaacggcgacggccaacaaggggaacacgcgcatgaggacctcgtccgagaaggcagggccacccattctgcgccaggcgcccacgaggcgtcacgccgcgtgcgccagcacggtgcccgccaccgccggagggcttgcggcacttttccgccgcccccctcccctcgcgtgcggcacgggactacgtcttctgcggcgcgttcgcctgcatggccgacttcatcttctcgcggaaggcgcgcatcttcgaccgcatctcgtccttctgcgcatcggagagcttgccgcccgaggcttcacgctgggccttcatctcctcacgcagttggcggccctcggccttgaactgatcggcctgggcctgggagagcctgccttgggccacggccttgtccatccggtgctccaggcgggccatcttgtttccgtgcttcttgcccttgtgccggtggtgcccgccgcaccccttcccgtccgcggcaggcggatgggtggactcgggcgctaccgtctgggccagcacgggcgcggcgatgaacagtgaggcgacagcaacggaacgcagggcggtcatgagcttcatcgtggtttgctcctcagggtgactgaggcttcgggagccggccttcccgtcgcctcttgccctgaaaaaccccgcgcggcgcgaaaggttaaatccgcccgagcggacgcctcttcgcgcctgcttccctgccccacgccctaccgcaccgggagcttcatcgcgcgggtggcgatgaagccgttgtagtactgcgacagggcatcttccggaccgaacgagtcctcgaagaggccgacgatggcgagccccgcatccgcctgaccaccaagctggtcctccagggagtgcccgacacagagcggctcacccacgtccgtgaagcggcggcgctcctcgtcggacaggctggtgaagtccgagtagggcatccggtacttcagcgtgaagatgccctgcttctccaaggccaggtcgaacaggtagttcacgggattggtgaagccggtcagcagcacgccgccaggacgcagcacccgcgccgcctcacgccacacggggcgcaccgcgtccacgaaggagttggagcacgggtggaagatgaggtcgaagctcgcgtcctcgaaggcggagaggtcgcgcatgtcgccctccaccagccgcagctccaagccctcgcgctccgccaccatgcggtcctgaccgagctgcgcgggcgagttgtccagcaccgacacccgggcccccggcggcggcagcaccggggcctgctgtccacccgagcccgcgaggcacaggatgtccttgcccctcacgtcgccgaaccactcgcgcggcaccggcttcgtgggggtgaggacgatgctccactcgcccttgcgtgccgcggcgatgacttctgggctgacgggaagcgtccacctgttgcccgtggcccacctgacggtcccacgcctcgcggttgtacgtccgcacatgcaattcagtcgtcatgcagcacccttccttccatgcctccggcgacagtgccgacttcacccgtcacatgtggcggagattcggtccgactgcgagcgacaccaccgcccgctccacatccaccggctgcgccaccttgcgcagcggcatagtccgcgtgacgcgttcaacgaagcccggctgggccagcttgtcgcggctgcggtccaccgccgtccatcccgggcacacgacgttgacgcggcccaggggcgcgatgcggcccaattcgttcttgaggctcttgaggaagccactcgccagcgcgcccttggcggcggcgtagtcagcgtgtcctgcttcaccgaacagccccgccgtggagctgatgatgacgatgttgcccgtcttcgtggtggccacgtgccgcaggaaggcacggcagcacaggaagacgctgtccaggttctccgccagcgtgcggcgccagcgcgccagggacatctcccagacgggttcatccggggcgggccagacacccgcgttgcagaccagcacgtccagccgccccagcgcggccaccgccgcgggaaccagcgcgtccacgtcggcctccaccgtcaggtccgcgcgcagcgctgcaccgccgacgtcgcgtgccagcgcctgggccttctcggtactggagtggtggtgcactgccaccttcgcgccttcttccgcgaaggtatggaccagggcggtgccgattcctccggcgccgcccgtgaccaggacgcctctgccctgcagctccgtgtccatccgggtgttctcctcgggtcgtgctttcacgggaccgcttcgcggcggagtcccgggcacaccggtggcgtccggcggctcatgacgagacgaggccccagcgcctgacaagagcccgtccatggacatgaaggccagcggaaaaatccgccctggcaccccgcaccggggccggcttcctccccgcgcccaatttatgtttacctaagcataaccttttccggtctacatcaaggagtcgccattggcctcgcaccgcctcacgaccacgccccaggatgaaccttccatcttcacgttcgaacggcggcacgttctcttctcggtggagcacacgcggttcgagttcgtccgcatgctggagcgccgggccaacggcgaggagttgctcctggccgaccgctaccagcggcacgggctcgccggccccgtcgtcatcaagcgcgtgcgcagccccgcgagctccgcgcgccgacaccggctggtggaggaagtgcaactggcctaccgcctccaccaccccaccatcgcccaggtgcactacttcaagattcaccggggcaagccgtacatcatcatggagcacgtggacgggccgtcgctggagaccgtgctggacctcatggccatgcgggggcagcccgtgtccctggccttcgcgctccacgtcgccgcggagctggcggacgccctgcaccatgcccactcgctcaaggacgcgcagggccggtccctgggactgattcatcgcgacgtcagtccccgcaacgtgcgcgtggctcgcacgggcgaggtgaagctgacgcactttggcgtggcctattcgcacctagtcggccgggaggagacggcggaggcgctgctcaagggcgacgtggcctatgcgtctccggagtacctcgcgggcaagacactgaccgccgcctcggacctcttctcgctggggctggtgctactggagctggccacggggcggcacctgttcgcggccgcggcggaggcgctggagccaccgcgtgcgaagtcgcatgagctgcgcctggaggagcccccttccctgccgctcacacagatgctgatgctgctcgaggaccatggtccccaggacgtggagcgagccgccgcgagcctgccgcccaaggtgcgcgccgtccttcaagggatgctgcacaaggatgcgacgaagcgcttcggctcggcggaggcgctgtgcgaagcacttcgggaatgcatcgtccaggaagtccgtcgcaccggccgccccttcggcagggccgacatggccgcggagctgacgcggctcatcagcgacgccagcgcggtacgcgacgaggtcgaactgctcgacgagagcctcttcccatcgggcctcgaggcccatgaactgtcggggcggggccccaaggacgcctgaagccgggccctggtgctagcgggacagggcgctcgccatcacgacgagcgccttgagcttctcttcgtccagcgcctccgaaagcgtcatcagccggcgttgcagtgaggactgcttcttcgcgcccgcgcggccctcccgggcgaggcccagcagttcatccgtggaggtccgaagcaccatggccaccttccggagcgtggccacacgcggcaacatcttcccccgctccatccggctgtagaccatggggtgcatgtccaacagcgccgccacttccacctgcgtcaaccccagccgcgctcgcgcctcgcgcacggcctttccaaaagtcgctcccagttcttcgtccatggctcgtccggaagcctaacccaaaccccggggcctcagagtggatgccgcggcgctaaacccttcaggaccatgtcaggccaagcactttcatcttccctggcagtagcgggaacggcatcctcccggtggggtcctgctggcgtctggtgacacttcaggtggggcccgccgggtgggaagcccctgggagacggcatggcggaagcgcagaggcgagaagattcgccggggacacgcatcgcgggcttcaccctgggcaagcggctgggcagcggcgcgtgcggcgacgtgtatctcgcgatgcgcgacggcgaggaggtcgcgctcaagctccagtacctccaccggatggcggggtggccggagcgcgagtgcgccatcctcctgcgcctgcgccaccccaacgtggtggcctttcgcgcctgcggcaagttcccaggcgtggcgccccggttgttctacctggcgatggagtgcgtgcgaggacggaccctgcaccagtgggtggaagaggagaaccccagcgctcgacaggtggcacggctgctgcgcggcatggccctgggattggaggccacgcacgcggcgggcgtcgtgcaccgcgacctcaaggagtccaacgtcatggtgcgggagccggacggtgagcccgtcctggtggacttcggcgtgggcgacttcgccggagccccccgactcacccagggcgtcctgccgccgggcaccatgcgctatcgcagcccggaggcgctggcgtttcgcagggccagcagcgcggccacggcccctcgataccggtgcgggccagcggatgacgtctacgcgctcggcgtcatcttctattggatgctgacgggccgccctcccttcctggaggtggtaacccccacggaaatcgaggccgtcatttccgaggcgcctcacgctccccacacggtgaatccgcgcgtgccaccggcgctgagcgaactgtgtctgcggctgttggccaaggcccccgaagcccgagggagcgcggaggtactgagcgcggacgtcgagcgggcactcgcagccgccgacgcggcgtgggacgcgcctttgtgcgagtggcggcaggacgcggaaacacccggcaccgactcccggtccgaggacgacaatgacgccgcgctggcgatgtgggtcgaggcaggtgacgcccgctgggcctcgcccaggcgtgggcccctgccccacaagccaccgctggaaatacgtgcccccgaagcctcggcgccacgaacgcctgcgcgcgaacgtgcggctcgctgggccgtggtgctcgccgggctggcgtgtgcggtgggtgcgtggctctgggtggcgacacccacgctgggtggcgggggcaatcccatccgggaagtggctttgcccggtggcccgccggaaagtgagcaggccgcgcccctgcccagtcccgggcccaccctcgcggccgtcaccgccgaggtggcgcacccgaagaaggaagagctccccgtgaagcagatgcccgacagcgtgacgactccccagcagcccgcctccagcgcgcgggccctcaaggcagcggcccggacgatggtggccgtcgccgcctgctcgggcctgggctgccccagcggcccgcaggtgcgtccggcgcctcccggcgaaccttgtccccccggagcggtggatgccatgaagcgggccggtattcgcatcggtgacgccaccagcctcgccttcgtcgacgacaagcgttttggagagcccgttcccgttcgcgaaggccgcgtccaggtcgaactcggtacaaacttcggccccctgacctcgggaaaagccgtgggcgaactcatcttcgccgaccgcgtctatggccgcttcacccaggcctacacccgtggaggtgacttcatccccgtgtgcctggagatggtcgaacagtacggagtacgcggcatccggcggaagggcgacgacccaggcccaggcatcgccacggttagcaacaccgccgtgctctacgccgtgaatcgcttcgaatagtgacctccgccaccggcttgttccgcccgccagggaagtgattgtccgtgcccacgccactgcccatccctcttgctctcgctctcctgctggcggcggagcccacgcgcgcccagcccgccacctgccgggagccgacggaacgccccgttgagctgggcgcggagcggtgcggtcggccacccgaaatccgggtcggagaaggtgtcgccacggtgctccgcttcgacacccccctgatgcgcgcggaggtgtccggaccgggacggttccgtcaggtggtggaccgggaactcctcatcctggtgcccgaggagccagtagccgacgagtcccgcgcaacgctgaccgtctacttcgcggatggagcggtccccatccaggccacgcttcaactcgtcatcgagacgcccgcacgggcagaacggcaggtggagctcttccgtcgagcgcgcacggcagcctccttccagcgggagctgctggagacacggcgggtactgcaggaagtgcgcgaggagaatgcacggctgcgagcagcacaggcacgccccggtggcttgatggggctctgggtgagtggagacatggggcgcaccggcgtcgccgcaagagagttcctggacgtccgggagcacgcgaggaacagcctggtgctccgttccggcctgaccttccgggccaggagcattctggtggtggtgggcctgaagaacccgctgggcgcgaagccctggcaggccacgggcgcagcactggtggggccggatggcgcggagttgaaagtcgcgcgagtgtgggcacccgccagcctcaaccccggcgacgaaatggacgtcctggtggagaccgaacccgtggaaggcgcgccccgaggccccttcaccctgacgctgtgggcggaggacggcaagcgccccatcatcctcggcaacatcgaattcccgtgaggggacggggcggccaggcgcctcactccagtgccgacttcggacaccctttccatcacatctcgggtgtccacaaaacggttcaggcccaaccgaggggtctggccaccccacgaactacccatccagggtgatagacgcatgacgccggaccgtgattagtccgctattcatgcaaaatcagaacaatccacttaacctatcatgcgtcttggtcgccctggcgttaggttgctccagcagtgccaccggcaccgccagccgccgcgacgcttatgcgctggcaacctgcaccgacaccgtgacgtgctgcatccagcgcaaccccggcatgcccgaagcgtgcggcctcaccgcgagcgaagccgcgtcgcacatggcaggcgtcaagatggtcatagaggcggcggaagaagcgcccgccgaatgggacgacacgcacaacgcgaacctgccggagtggaagcggcgttgcatccgcgcctatggcgactgccaagaatttgactggactggctcgtgccacgactgccttcgttcctgcgagggccagcaggcatggccagaggacaagtgttctccgcgcaggaagaagaagaggtgacacatgtccgagaagattgattgggaccccatccgcgcattggcacgcagagtcatccgcgaaggtgcgccgctcgtcctcgacgatgatgtgcgcgcgctcctccggcgcacagcgcgagaagtaggtatcagcgatgcgaacgcggagcaggcactttctacggaggtgggggcgctagaactcctccgcgagagttcgcggcgcatcaccgacgggtccaacaggctgatggacgcgctgcacaggatgtatcgccaccagaaggctggcgacttcgacagcgcccgccaggaaatgcgggatgtgctctccgtcgaagtggtgccgcactaccgagaggtagcggaaggccagctcgaagacctcgaagatgagccctgaaagacaacagggcgccggctccacaggcggcaagcgccccatcatcctcggcaacatcgagttcccgtgagcggacggagcggccaggtgttgccgcgcacgtttgttgatggcctggagcgcctccacggtgaggtgaagcgccgcatccgttccgtgggcgccttcctcaaccgcgcctgcgcactgcgcctcatcaccaccgtcgtgctggaggtctccagcatctgggcagaccgccgctacctcgacatgtcactgcagcccaccgccctggtggtcgagatgcaaccgagcgccgtaatcagccctcaagtcttcgcgcacctgaatccggaagaatccccccactctgccaaggggatgaagcgcagtccttcggggggaggagacagggacaacaccttctccaccacggtgcgatggaataggtggaccacggactccgcgaggcggaaggccaagcgctcttcgaggggaacctctccaagcaccgcctcgtcgagcaccagcttgtcaaggctcaggaggaagtggccgtccgcgtcttcctcgaagactgaattaccccggtccatgcatgcaagccgccgccacatgtggacaagccagtatcgcaatacggattcccctacctgaacgtccgcaggaaccagttgaacaccatgaagacgctcccgctcgagcgcgtccttgactcggccggagaccacgggcgagggcagactgtggtagtcgaccatgacgggctttggtggcaccggctcgctcagcttcaacttcacaggctcaacgacctgcacgggcttccctttccgaaatgcggaggccgactggtcccacgccagcagagggtgctgctgagagcgggcgcgaatgaggacaaagtagtcgtcttgcatggcctactcccccacctgaagcgcacgccgctgtagcggtgccctggtgtcgctgtgactgcgcccgacggggcatgcacggcgcggcttgtcctggatgctcgtggcgccggcacaacctctccccccaggcaggtagtccagcccatcggtggtgagcgtccacttcccgctggccagcttggtgagaatctggcgactgatgcggtccaaggactgcgtcagcgccgcaggcttttggcagtagtcgccccgctccacggcatcagcgacagcttccagcgctcccttcaccgcatctgggtacgccatgtccatgtcgaaagcccaccctcctgaatgaggaccgatgtggacagggacgtggagttcgcatgccacggccagaaccatgggcagcatgacgccattctcccgccggttgatgtcgtagccgaactcccggcagaaccgggcccagttctcgtcatccgccatggcctccgagcagatgaggtggtgggcggcgatggaccagcgccccgtgtaccaggggtgctcgctggactcccggcccgcgaggatgttctcccgcaactccgtggagttccccacgtgccagccccacgcggcggcgaacttgtgccacgccttcccgcagtactcacacggtgggcgcggaggcggcttcggcccctcgcccggcttcgttttcagaaatcggactcgggcaccccggatgatgacgggcatgcctggaagcacacacccgccacgccgatcaatgaatggcacgcgggcgcaggcgaacgcgcactttcctacaggagtcctgagccacaccaagcgcctaccaacgagcgggctgccctacacataattcgggactggacccatccctgcggaggcgtggcgtcagtcacgcctcggtgtcggtcgatggctcgtcatcaagggactccacatatgcgtacaggctgtcccgatagatcggcaccacttcgacagccaatgcgtcatggagtagctggcgagcaccatcaacgtcccccgcatccctgcggcgcacggcttcgctcagggtgcgagacaggcgcagtgaccctttgcgaatgcggtcggatatcgcctcgaggagcttcagtgcgtcgacgtccgtggccagggcacgcccaacatcggcatcacggattgcgacctccctggcagagcgaagcaatagcgcgcgcacctcatcggacaatacgagcggctgtccttcgcgcagcacacgccgagccagcgcccggatggggttccagtcgagcgttttggacatggctatcccctcttcttcctacgcggtctgcactggtcgtcgggccactcgtgttgacctgcgcagtagcgaaagcaggcatagcagtcgccctcccacacagggttcttctcatccctccacaggacgtagttggcccggcactgttctttccacacctcatccgcggagtcgtccgcactcgcccatcagcctcggctccatcgagttcccgtgagcggacggggcggccaggcgcctcattccggatacgagttcttcgatgcttccctgcgagcaggctccgcggcctggtgcttctgcctctcgcgatcagccgcgaccttcgcctcgatggcttgagcaagccttgagggaatctcctcgacgaggtagggcgtgagctgctcgagtgtccgcttgagctctggaaatggcacctgattcttgtcgaccaggatcttccagagttcggagacggagctccgctccagatcgaaggcgacgccctctacctgtcgcgaggtgggaacctcgatgcggactcccgcgaaacggtcattctcacacgcgctgacccatacggacgtgtgagagcccgacttcatccgccgtccccgctccccgtactcgatgccacatgcccgcaagggacgcagttgcgcctgaataacggccaactcctgaaggccaccgacgtcggtcttcccgaggctcccaacgtcgctcggctgccggcccagcagaagggtcgctgcgccgatgccgccgaccactaccgcgaccgcggcgatgatgaggatcgtgttcttgccggacttctgcgccggctgcgtgggcactgtgctcatggcaaatggctcactcgggatacgaggtcttcgccgcttccttgcgagcacgctcggcagccttgctctcctgccacgcgcgctcactgtccacacggcgctgaatctccgtggcaagcgcctcgggatacttctccacgatgaggggtgcgagccgttcgagcgactgcttgaggtcggggaacgcggtctgatccttgtcgaccaggatcttccagggcgcggagacggagcttcgcgtcatgtcaaaggcgacttgagacgactgaagctcctccggaacgctgatggaaacataggaaaccgacgccccactgcacggcgtaacggaggcggacttccgggagcccgtcgagcggtgcggtagcgcgcctgcccgcactccgtactcgatgtggcatgcatccaggggcagcaactgcgcctggaccgcggcgagttcctgaaggccgctgacgtcggtcttcaagccgccccggccaaacccgccccccacggccagcatggcccccccgcccatgaggccaaccatcaccaccaccgcgacgatgatgatgacggcggagttgccgggcttccgcgccgactgcgtagacgatggattcattgaggcacgagcctaagtggagcgagcgcacaccgaaaatccgtcaacaggcggcacgccaaaaaggcgagacattcactccggataagaattcttcgcttcttctttgagagcgcgctcagcgtccttccgctcctgtctctcgcgtgccagtcgcaccttcaagtcggcgtctttctggcgctcgatggggtactgcgtgagcaagaagggggcgagttgttcgagcgactgcttgagcgcggggaacgcggtctgatccttgtcgaccaggatcttccagggcgcggagacggagcttcgcctcatgtcgaaggcgacgtcgcgcacctgtcgctccgatggcacacggacggagatacgataggaggacggagtcccgcagggcgtgacgtaggcatattcctgggagccaatccaacgtctcccgcccgatcctcttcgactcccgtactcgacctcgcatgcatccaggggcagcaactgcgcctggacggcggcaagctccggaaggcgccccacgttcgtggtccgcatccagcccatgggctggatgcccatcgtcaccaccccggtgagcgcgatgcccaccgtcacaacggaaaagccgatgatgttcttcttgatcacggacatccgcgcgagcggcgtaggcaatgtctccattgccgctgaaaactagccgagcccttgcagcctggacaatccgtcaacggacttcaggacggggaacgctccgtcagtcgcgcccctcggccgttctacggcgcgtcgtccactgcctgaaggtacgtgttcaggatgtccacgtaatgaggcacgacctccacggccaagacgtcctggagcagctggcgagccccctccaagtccccagcatcccggcgtctatcgacttcaaccaaggtgcgagacaggcgcctcgacccggtggagatgcgggatgcaatctccctcacaagaactgcggcgctttcgtcgtcctggagcgcacgcgctgtttcgctaggcgaaatccccacgtcgtgcgccgtggcctggacaagggcgcgcgtttcggtggtgaggaagggctgaaccgggtccgtgatacggcggctcaggtctttgaccgcgtcccaatcccgctgggtgggcatgtggttctcctagcgagggtgacagtctcggaagggccactctcgttgcccctcgcaatagcgaaagcaggcatagcagtccccaagccatcggggcttcttctggtctcgacaccggacatactggtcagtgcagtgcgctcgccacccgtcatcggcgccagcctcgtctccctccttcaccttctcgttcgtgaacctgaccgcggcatccatggtcgcaaggtgtgcggccgcctcgcccgctgtgaggccgcacgcctcgggcacaccggggttacgctgaatgcagcacgacaccgtgtcggtacaggacgccagggcataggcatcgcggcggttggccgcaccggtggcactgctggcgcagcccaacgacgcaacggccaagaggcacaacaggccaggtccagtcctcagcgctttcacggagcgccgactttacccgggcgcatggcaacaagaaccagccctcacaccccagagacgggcgccgcccgacaggactcgggcggcggccgtcgcgatgcatctggcggtgcttacgacaaccgcaacaacttgcgcgcctgctccggcgtggcgggctcgcggccatgggcacgcgcgcgcttcgccgcctctgcgacgagctcccagttgcccttcgcgagcacgcccttggacacgtagatgttgtcctccaggcccacgcgcgcgttgccgccccgcttcgccgcctcgtccacgtaggccagctggtgacgccccacgccggccaccgtccaggtggagccctccggcagcgaggcaatcatgaagtccagcacctccggacgcggctgcaacgtgcccggcacgccgagcacgaagtcgaagtgcgctggcaggtccaccagcccttccttcgccaggtagcgggcctcgtcaatcatgcccacgtcgaagcactccagctccggccgcaggccaatcgcccggatgcgccgggcgatgtcacgcacgagcggccggggattccagaagacctcctcgccgaagttcaccgtgcccgtcgtcaaggtggccatgtccggccggtcctcgccggtgagcgtcagcggcccgcagcgctggtccaccgtcatgcccaccgcgccgcccgtggacgtctggatgagcacgtccgtgcgcttgcggatggcgcggatggccgcgcggaacaactccgcgtcctgcgacggcttgccgtccggcgtgcgcacgtgcaggtgcaccatcgccgcgccggcctcgcggcaacgcgcggcgtcctcggcgatctcctccgcggtgatgggcaggtgcggcgtctgctcgcgcgtcgtctccgcgcccaccatggccgcggtgatgaccatgggcgtgctcatgtctgcccccgctgcttgtccttgggcaccacacacgtccccgtggcccggcacaccaccaccggctccgccaggacgtccgccgccgagtcattcacgtccggccgcggcttgatgaccttgcgcgcctcgaagcgcatcttccgagacgtgttgcccgcgctgatgatttcgccctccgcctcgatgaagtcgcccgcgtacaccggggccaggaactccaccgagtcataggcgcggaacaggccctcgtccccgtcgctgcggatgcacagctccgtggccacgtcgccaaagaggcccagcatccgcgcgccgtcgaccaggttgccgccgtaatgtgcgtcgtggctgctcatgcgcagccggatgatcgccttcgttcccgtgctcactggggctccccctgatagtgcgcgtccttcggctccttgccttccttcttgaggagcgcgtggacgatgtagttggccacgtcggacggcttggtgccgggcccgaagccggcgtcgaagcccagctccagcgccagcttgtggtccacgcggggcccgcccagtagcagttggaccttgccgtggatgccagctgccttcgccgcttcgatgaagtgccgcgagttgtccttgtgcacatcgcgctgggtgacgacctggctgaccaggatggcgtccgcgttgcgcgccatggccttcttgatgaggtcctcgttcggcacctggctgcccaggttgaaggcctcgaaccaggcgtagcgctccaggccgtagtcgcccgcgtagcccttcatgttgaggatggcgtcgatgcccaccgtgtgcgtgtccgtgcccgtgcaggcgccgaacaccacgatgcgccgcttcaccttctccttgatgaaggcgttgaggtcgtcgaaggacatcttcttcacgacgacttcgggcacgtcgatttcggcgtagtccagcgcgacggacgaccgggcgtagacgatgaagaaggtgtaggtgtccgcggcgcgctcggcggcggccaccttcacgtcagtgaagcccatcttcttcgtgaagacggcggcggcctccttggccttctcggacaacggcaccggcagggtgaacgacagctgcaccacgccgtcgtcccgccggtcgccgtagggacggatgatctgcttgctcggcttcaccatcggctcacttccctccggcccgctgaatcttgacgctggagcccaccttctgggccagcggagcgaaccgctccttcttcgtctgctccaggtagaagacgaccgaccacgtcgtctttccgtcgcagcccacatacgtcacggaatccaccgcgccactgccatccggcgccacgtccgtctcctgacgcttcgccgctggctgggcgcccaccttcagacgctcccagcccttgccgccaatggacgcgacaatcttgtccacgcacgtctgggccttcatgcccgccgtctgcacggcgcccacgtccaccaggaagtaggcgtccccactgggcgcctggaacttgttggtcccaccctcctcggtgcggttccatgaggcgggaacctggatggacacgttcttcacctggacctgcgccagcgcatccgcggagccgcccgcggagaggaccatggcaaggattgaaccgagcatcactgcgcctccaggagttccaggaacgggttgaaatagtccggcgccttctccagcacgccgtcgaggcccttgccgccggtctcctcgcgcttcacgtcaccgaagtggccccggccgatggcggtcaccatgccctcgtcgcggcactcctggagcaactgctccgcccggccgaacacctcgcgcgcgcggttggcgatcttgccgtcctcgcggacggtgaactcctcgtcgatgcctcgcgccgcgcggtggatgtaggccgcggacttgagcgccacgtagcggtccgccaggagcggcgtgtgcatggcctccgtcatcatgcccagcagctggatgccctgccgtgtccacatggccaccaggttcgccatcacgtcgtacgtgtggctgaagaagatgtccgtctccttgtgcttggtgggcggcatgtacttcaacggcgcgtccgggaagcagcggcgcaccagcatggcctgggacagctcgagcagcagcgtgtcctcgcggtacggatcgatttcgtacgcgtggccgatgcccagctgccagtccttgaggcccgcgcgcttggcgaagcactcgttgatgaactggctggcgatgacggtgtgggccgcgtcgtacgcgtccgcggtggtgatgtagttgtcctcgccggtgttgatgatgatgccggccagggcgcagatgcggcggctgaagtactggtcgatgaacgtgcgccgcatgttgatgtcacggaagaggattccgtacatcgcgtcgttgagcagcatgtccagcttctcgtaggccgcgcagaaggcgatctccgacatgcagaggccggacgagtagttggtcaactggatgtagcgcttgagcttgcggctctcgtcgtccagggcctcgcgcatgatgcggaagttctcctgggtggcgtaggtgccgccgtagccctccgtcgtcgcgccgtggggcacgtagtccagcagcgactgcgccgtggaccggatgacggcgatgacgtccgcgcccgcctgggccgccgcgcgcgcctggtccacgtcgtcatagatgttgcccgtggccacgatgacgtacttgtgcggcgccgggggcatggggaactgcttgcggagctcttcgcgctgggcgatgcgggccttcaggtcatcgagcgcggcgcgggcttccgcgcgcacctcctcacggaggttgtgctcctgctcgggcgacaagggggccagcttctccgtggggagcgccgtcagccgctccacggcctccagcggactcttcgcacccaactgcagcgcgcggccgtaccagtaggcggcgcccttgttgagcaccccggcggccttcagcttgtccaccatcaggttggcgagcggcacgccccgcgcgccagctccggagaggccgaagaagcgcaacacagtgcgctcggttgaaacagtggtgttacggcggatgaggtcgaagatcgggttgacgatttcgtccgccagcttgcgcgcatgttcaatccgcgcgtcttcaatgaacgggcctggcatggacgcaccttacccgcccgaacgacagcgggtagcgccgatgcgcacctgtacaacgttgccgcaccgcattatcggttccgggttcaaagcaccgaagggccggtgaccgtccccaccgacaggacggtgacgccaccggcttttcggtggccactcatggactcaacagataacccactggaatcattcagagtcgagcggtggcatgtcccctgctcaggacgggattgccttaccccctgagacaaggagagtcccttgcaaacccgctccctgcttctaaccgccattctctttggcggttcggccgccgtcgccgcgacgccccctcccctgacgacggacaccggatcccccgtggggaccaaccagaactccaagacggccggcccgcgtggcggcgtcctcctggaggacttccacctcatcgaaaagctggcgcgctttgaccgtgagcgaatccccgagcgcgtggtccacgcccgcggcaccggcgcctacggcaccttcgagagctacggcgacttctccaagctgacgcgcgcatccctcttctccgccaagggcaagaagacgccgatgttcgtgcgcttctccacggtcatccatccgacgggctcgccggagacgctgcgcgatcctcgcggcttcgcgctcaagttctacacggacgagggcaactgggacctggtgggcaacaacctgcccatcttcttcatccgcgacgccatcaaattcccggacatggtgcactcgctgaagccgtcgcccatcacgaacaagcaggacccgaaccgctccttcgacttcttctcgcacctgcccgagtcgacgcacatgctcacgcaggtgtactcggacatcggcatcccggcgaactaccgccagatgaacgggcacggcgtgcactccttcaagttcgtcaacgcgaagggcgaatacaagtacgtgaagttcaactggagctcgcagcagggcgtgaagagcctcaccgccgaggacgccgcccgcgtcatctccgaggaccaccagcacgccaccacggacctctacgccaccattggcgcgggcaagttcccctcgtgggagctgagcgtgcaggtgctggaccccaaggagctggacaagttcagcttcgacccgctcgacgcgacgaagatctggcccgaggcgcaggtgccgtccatcaagctgggcaagttcacgctcaacaagatgccggacaacttcttcgaggagaccgagcaggcggccttctcccctggcgtgcagccgccgggcatcgagccctccgaggaccgcctcctgcagggccgcctgttctcctacgccgacacccagcgctaccgcattggcgccaactatcagtcgctgcccatcaaccggtcccgcgcgacggtgagcaacaacaaccaggcgggcagcatgaacttcgccaacacgaagtcggacgtgaactacgagcccagcgtcagccgtgagacgcaggacgcgccgcagtacctcttctccaacgcgccgctcaggggcaccacgcagcagggcggcatcgagaagacggacaacttcgcgcaggccggcgccttctatctggcgctcgacgcgggcgggaaggaccgcctcatcaagaacctggccgcggacctgaatcaggtgcgtgatgccaaggtgaaggcccgcatggtgggtcacttcttcatggccaaccctgactacggcacccgccttgccaaggcggtcaacgtgaagctggacgacgccaaggccgccgtggccacgctcgccgcccgctgattcgttcttctccgggccctggcatggctgtctccgccagggcccggcgcttcccgccactccccctgggagaaggccgggatgtggcggcgcccagcgactcccccctctcgccgcccgtcgcatcccggtcttccctcagcgggggcaggccccctctctcttctggagtccgccatgattcgcaagctgctcttgggaacgctgggcctgttgatgctgggtgccagcgtgttgacggccgcgtggatgtccctgcgcgccacgcccgcgccgcaagggcgtctgctggccacgagcgaggcggagcgctacctgctggccgccgcccgtgccggagagacggacatcgtcgccgggctcgtccaggcgggtacgccggtggaggcgcgggatgctcgcggcttctcgccgctcatcctcgccgcgtaccacgggcacgcggacacggtgcgcgccctgctctccgccggcgcggatgcgtgcgcgggcgacaacaacggcaacaccgcgctcatgggcgcggccttcaagggctatgcggacatcgtcggactgatcaatcagcaaccctgcgcggtggaccagagcaaccgcttcggccagacagcgctgatgttcgcgtccctgttcggccgcaaggaggtggtggagcaactccggcagcagggggcctcccctgacgtgcgcgatggcagcggccgcagcgcccaggactgggcacgcacgcaggagccgaacgcgcccgtgccccaggcgcccaccgcgccggagacgtccgcctcggcgcgatgacacgaaggtgctgctccgcccaggatgaggcaaggaggccccatcccggtgaagacgccgctgggcatcgggccagacggctcgacggctagacgtatcgcgtgccgaagagctggagcaactgcggctcggtgcgcagcaagtccagcgtcagcgcggcgtggccgggcacgtacccgttgcccaccaccatggtgacatccttgcccacgccctcggcgcccagggccgccgcggtgaagctggtggccatggagaagaagatggccgtgccgccgtccttcaccgacaggatggtggccatctccgtgttgcccacgctggcgcagttgaccaccaggtcgcagagctgaccgtccgtcgcctggctcaccgcttccatgacgtccacgccctgagtcgcgtccaccttcagggccacgtcacacaggccaatgccggacagcaggtccagcgcgccctgcgacacatcgagcgccagcagcttgccccgactctccagtttgcgccgcgcctgcgccagacacagcgccccgctcttgcccgcgcccagcaccgccaccgtcatgcccggccgcacgtgccgggccaccagcgcgggcgcgccacacacgtccagcgccgcgagcgccaacgtgtccggcatgtccgtgggcagcttcgcgtagatgccgctggcgaacaggatcgcgtgtccgcggatgtccacgcggtcgatgtccgcgtgcaccgccttcacctcttcgatgaccagcggcgtcagcgtcaggctcaccagcgtggcgatgcggtcgcccaccttgagcagctcgcgcgcggggtgcctggcgcccagctccttcacgcggccaatcaacatgccgcccgagcccgtcacggggttctgcatcttcccccgctcacggacgatttcctggatgcgctcgccaatgcgcttcgcgtcgccgcccacctcgcccttgatctgcttgaaggacgcggcgtcgatgttgaggctctccacgtcgatgagcagctcggactcgcggcacggcagcgaaggatccaactgcttcgcgcgctggggcagcacgcccttctcgccaacgacgcgagacagcccgtagaggtcgatgctcatgttcccgtctccctgaaggttgtcgggcgcccggccccgccacggcggggcgcacccagggaggcgtctacccgctcgggcagggaaaaggccagcgccacgtcacgcgcggtgggccggggcgtcccccagcgggcatcccgaccaccgcgagacaggccctggccccgtgcgtcagtcctgcgccaggttcggcaccaggacggacagcgagcgtgcgaagcggtacgacacaccggagtggccgtcctcgaactcctcgtggacgcgctcgacgcccgcgttcttgaagtcctccgcgagcatccgcgtgccccagcggatgttgaactcgtcacgcgtcccacagtccagatacaccgtcttcagcttccggaacgcgtccatgaacttgggcacgaagcgcaccgggtcgtgcaccagccaccggttccacacgtcgagccgcagccggcccgtgttcgcgtcgaagggcagctccacgttgagcggctcgcccttcttcggagaatacgcggcggccatcgccagaacgttcaccaccgggaagtcgtccccgcgcatcttcgtctcactcacgcgcgcccggaactcggcgtgccacgcctccacgccgccggccttcagcagcgccgccgcggccttcgggaggtccggcaggtagcagtattcgaagtaggaatccgccgcgtgcgcgcccacgtgggagaacagttccgggtggtagcggcccatcaccagcgcgccgtagccaccggagctgtgccccaccacggcgcgcgaggcagccttcggcagggtgcggtaggtgcggtccacgaagcccaccacgtccttggtcaggtagtcgcggtaccggccaatggcgtcgctgttcacccactggctgccacccagcgacgtccaggcatccgggaagacgccgatgacgggcggaatcgcgccggactcgacgagggcgtccaggcgctgggggacggtgggcgcgaagcccgacgcgttcgtccacgagccgccgctgttgccgaaggcatgcaggaagtagacgacggggtagcgtctctcatccgcgccgtagcccggcggcaggtacacggtgagcttgcggcgagccgggtcccccagcgggttcgactccagcgcgggtgacagcagctcactcgactccagcaatccattcatccgtgcattcccttcatcgggcccgcggctacgcgcgcgaaccgggttgcttccccagcaccttcatcaccgcctggaggtcctcccatgccttgcgcttctccgccgggctgcgaaggaggtacgccgggtggaaggtgggcatcagttggatgccctcgtaggtgcgccagttgccacgcaggcgggtgatgggcgtgctgtcccgcagcagcgtctgcgccgcgaacttgcccagcgccaccaccaccttgggctggatggcggccaactgcgcgcgcaggaaaggctcacaggcggcaacctcctccggctccggattgcggttccccggtggccggcacttcacgacgttgcagatgtagacgtcgtcgcggcggtagcccatcgcgccaatcatcttcgtcagcaggtcgccggccgcgccgacgaagggcacgccctgcaggtcctcgttctcccccgggccctcgcccacgaacaccagctccgcgcggggattgcccgagccgaacacgaggttcttgcgcgtcgagcacagattgcagcgctggcagtcgcccagctcccggcgaatctcatccaacatcggccgctcgccgttcgccgctccaggcagagccccagcgggccgcgacgtgggcggcggcgcatccacacgcatccccgcgaccggcgttcgaggcgccggaggctggccctcaacggcgccgagagccatccccccaggacgcatgggaggcgtggacgggggcggcacccgggccggcgctgcgacaccgactcccggcggtgccactacaccagcaggagtcgccgggcccggccgctccgtgccgatggaacggtgctccggtgccgggcttgccagcggcggacggggcagcggagcctcggggcgagcaggaggcgcagcgtccacagttccctgtgtccgggcgaagcgcgcgcgcaaggagggagccgagcgttggagctcgagcgccgccttggcgtcaatcatcagcacccggccagcggcctcctcctgccagaggaggtggcggcgcacatcgtccagcagggcgctcaggtcctgcgaggcctcgggcgtgtcatcaatcacggtcctggatcggtatcggacgtggcgcccgtgcgcaaggaagcggacgcccaagccggctgttcgcctcccgccagagcagttccaggcccacgcccggagtcctaccccgccctgcccccagtcatccgccctggaggcaccccggacccacgctatcttgcgccccgaacccggtgtcacgcagcaaggagccgccatggcgcaccagaacccggattaccgccaggacacggaggacctgttcacatcggccgccttcgtcatggacctgggcatccagcccgtggacatccgccccggcgaggtggaggcccggctggtggtgcagccccgacacctgcagcaggacggcgtcatccacgctggtgtccaggcgacgctggcggaccatacggcgggcgcggcggccttctccgtcgttcggaagggccagcgagtgttgtccaccagcatcaccgtccacctgctccagacggcgtccggtgaagaactgcggtgcaaggcccgggtgctgcgcgccggccgccggctcatcgtcacggagtccgaggtccacgccgtctccggcggcacgccccggctcgtgtcgaagaccaccgtcaccctcgcagtgatggagccccgctaggacggagacacgagcagcagctcgatgagggcctgcgccacctcgcgcttgctgccctggagttcatgctgcgcgcccgaacgcgtgagcaccgtcacccggttggtgtccgttccaaagcccgcgccaggggccgtcacgtcgttggcgacaatcgcgtccagccccttgcgctccagcttgtcgcgcgcgtgcgccaccacgcgctccgtttccgccgcgaagcccaccagcaccggccgcttcggctgtcccgccacctggcgggaggcctccgcgagcacgtccggcgtgcgcacgagcgtcagcgcctcgggcgacgtcgaagcgcccttcttcaccttctgcggcgcgcgcgtctccgggcgccagtcgctgaccgccgcagtggcgatgaacacatccaccgtgcccacccgtgagagcacctcgcgcgccatgtcgtccgcgctcaccacgtccacgatgtccaagccgccgcgctccacggtgcccacgggaccaagcaccactgtcacctcggcgcccagggtccgggccgcgtgcgcgagcgccatgcccatcttccccgtggagggattggagatgaaccgcaccgggtccaggaactcgcgcgtggggcccgccgtcagcagcacccgcttccccgccagtgggccagcgccgaaacgcgccgcgaccgcctggacgatggctggaacgtccgccagtcgcccctcccccacgtcaccacaggccagcatccccgcgcctgggcccacgcgcgagaagcgcggataggccagcagggccgccaggttctcctgcgtcagggggttgtcccacatggccacgttcatcgccggcgccagcaccaccggcccccggaaggcaagcagcgacgtcgtcacggcgtcgttccccatgcccgcgcggatgcgcgccagcaggtccgcggtggccggcgccacgacgaacacctcggcccagcgcgcaaggtccaggtggccgaagttcccctcctgggcagggtcgaaatagtccgtgagcacagggtgcccgctgagcgcctggaaggtgagcggggtgacgaactggcgcgcggactccgtcatggccacccgcacctcggcgcctgcacgcgacagttcccgcaccagctcgcaggccttgtacgccgcgatgccgccacccacgccaacgaccacccggcggcctttcagagtcgtcacgtccatgcggcttcctaatgcgcggggaggcgggctcgcaaccgtcccggcagggcctcagtgggccatcatcacgacgtcactgctcgaaggcacatccacgacgcggacctccggtccgcctggggtctccacgtggaagttgccccacaccagcgtgtaccgcccgggccgcaggccgctcaagcggacctgctccgaccggggctggtacacgagctgcgcccagcgcgagcgcatcaacgccaccgccggaggattgcccaccgcccccagctctcccgcgacgacccacagcgcccggccccgctccggcttcacctggacggccagcgacgcggtgcccggcgccgggcccaggtccagcgacatctccgagccgccaacctgcaccaccagcgccggctcgccagagaactcccggttcgcgcccagcgcgaagcggtagttgcccggggagatctccacgctgtagccgccatccggcccggtgacgatggtgagcggttcgctgcggtccgcgttgacggcctcgacctcgaagcccgccgcggggctcccgtccgggcgatatacccggccactcaggcgcgtggcctgccgcagcttgagctccaccggcccccgcgcgccccgctccaacgactgggtagcgctcagccgccccttgcgcgccgtgagcgagtaacgcgtcacatagggcgggctggccaccgtgaaggtgccgtcctgcccggagagcacggagtcgtcacagacgtcgcacgacaccacggcatctggcaccggcccgccgccctcgtcgacgacgcggcccgacacacccggcagcttctccagcaccaggtctcccaggtcggacgacgccgggcgatccaccatcagcggctcgtagcccgacgcgtccaccgacgcgatgacgcggtcgcccgctgtgggcaacggcagctcgaagcggccatccggtgcattcacatcgtgctcgtccacgcgaaagcggcgcaccggcgcaccgtcatcgcccatgacgcgcccgcgatagacgtcgcgcttcttgagcaccactcgcaccggtgggccacccgccttgccctcggcgcgctcgacctggtcatagcccgggtgcctcacctccaagcggtagccccggtccggccgcagcgcgcggaactcgaaacggccgctcgcgtcggactgcacgggctccgcgccacggggcaccaccaccaacatggcgcccgctaccggcgcgttctgcccgtccaccacctcgccactgagcggcgctccgggcttcagctccgcctccagcttcagcgtctgcccatccgtcagcgtcacctcccggcgctccgacggctgatagtcgggatgggacgccatcatcgaatacgtgcccgcgggcatcccgcgcatcgggaccatcccatccgagccggacggccggtcgctc

SEQ ID NO: 1233 - DNA, 25254 bp, Myxococcus xanthus
cagcgccggggacaggggttgaaggctgacggcgcggtggctgcgctcgcggccggtagatggtagcagccggtatccggatgccggcacggatgtcccataagcggtgtcccggagagctggttggaccgagcaaggggtgggctcggcctccagggcctgggcgccagcatgtagccctcggtggagagcaccatgggcgcgtccaccgagcggtgaaggagcgtcatccggagctggaagcgctccccttgaggacgctcgtggtctgcgggctgttcgagctgaagcaagaagaagcgtgtgcccggaaagggcgagggctgctcgaggacaacgctgagcccgggaatggattggagccgggcgaggatgtcctctggctccgccgcggtctcgagcgcggccgcaggctgctccgatgaggctggctccgcgagggatgtgtccccgcacgccagcagcaccatggccagcagcaaggcgggcctgtgagtcttcgtcatgggatacaccaggggccttcgaggtgccgctcaaacgcatgccgtgcaccgccatatcgggcatgccggacaccagcggcggagtcccgagcacgaatccctccgcgcctccagcccgggaaggtggcgtcaacgaagcatcagtagttccacgcggtgcagtcggtcgtcgtgcgcgtgacgaactcggccagcgcgcgcatgttcctgacgaacgcgctcgtatcgagatgcctcaacggtgaacctcgccggaagacagcacgttattggcaacacccccgactggagagggagcccacgccccagtggaagcgcatgcgtggagacgccttcgccgagaaagctgggatatgacgcagcgtccgaaaatctccaacgcaaggcgtcagggacgggcacctattgcattgtcagaaaaaggtcgctccaggagccaccaagacttcggatgcattggcaagaatcaaatcctgtcgtagacttgtatagccggattagccggctcgatgaatgcgccccctaattggagtacacccatgcgtttgattgcatccatgctcgctgcgactgcccttctcgttggctgtggaggggaggagcaagctccggagaccctgcaggaggtgccagtggcgcccgcgcagcagaaggatggcgagggctcggtgaccgcgatggcgggcccgtactactacgcgtggtcgtcggacaacgggaagcggctcgagatctgtgccaacgacctgacggtgcaccgctccaacggctcgacctgtacgctgactcgcgggcagaccttcaccgtgtatagcggtggcagcgagtgggtttccggccacgcctggggcaactgcaacctggacggccaggtgcagaacggctggttctgctgagaccggtcgtcccggggcccgcgtgtggcgcttcgccttgcgcgggcctcggtccttatcaggatccacgcgcacgacggcggccttcaccctgtgtcccgaggagtcgcgcgcacgcgctcggaggtgctcagcgaggagctggatttcgattgcgcggagcgcgaagcggcctgtcgcttcaaggcgcgctaccggctgcgcaacggaacatccgaggcggaggtcatcgatgccgccttcctggggctccgtaggcgcgaggtgtgcgtatgagaggtgggcagcagcccggacgcatccgcgcgcacactgccggtggccgcggacaggcggcttcggcacgagggctcgcatgcggtggcggagcggcgtctcacggcggcgaccgcgcccgaatgcctcaacgtcacgctgacgaatcgcaagccgtggtgggctccgggcggtgtgcagctgggcctgggcgcgcggctgcgccgcggagccgttcaggtttcgatgaagccgacccttgcccctcccgagcacgcaggttccttggcctggttgaccgacagggcggcccatgacactcgggagtgcgccggcacggaaggcgtcgtgagcctctgcgcggctggcgatatctgcggcgcgctcggtcaatgtcgccagccacgcccagcagcgtggttcccgttcaccacgtcttcaagcacgaaccgcagcttctgcacgctgggtgcaaaggtcggacagctcgtcgcgcagggtacggccgacggcgccgagattcgaacgggcgtagagggcaagctcgagcccgtctacgacaggaaatccatccttttcgcccagcacgcgatggccggcctgcacgctactcgcaggcaacagactgacgccgagcccagcgctcaccgctgcacagaggcttgcgaggctggcactcgagtagccaatccgccacgcacgcccgcggctctccaacgcgtggatcatgtcctgccgatagagcgcccccacggggaacgccacgagcggcagagcatccgtgccaccctcgtacctcgccgtcaccggctgcgtcgcgctgtcgatccagcacagggattccgcccagcgcgcatgggaatcgctgtcggcgccccactgcttgaccagcaacagatcgagctcgccgttgcggtagaggcgcaagaggtggtggctcaacccacactcgacctccagacgcaggcgcggtcgctcggctgcgaagcgcgtaagcagcggcatcagcgcttcgcccccgagatcctcgggcacacctaatcgcaacacaccgccgctgccgccggggttcaactcaacggtcgcctcctcggctaggcgaaggatccgctgcgcatagccaagcaggcgctccccctcttctgtgggcactacatgacgctggctgcggttcagcagtcggcaacccaggctctgctcaaggcgaatgagctgctggctgacggtcgattgggtcaggtgcaggcgctcgccggcccgggtgaaatttcccgtttcgacgaccgcgacgaagcttcgcagcaagaagagatcgagcatgcgggtgtctccacgatgggctctcggtcaaactattcagaactccactatgagtcactctagtatttcgttctcgtatgaaatggcaggggattagtgcacgtcgtcaggaggtgaagtcgtgtccctggcgaacatctggagggtgatgctcacgacgctgttcacgatggcctgcgcagcttctgcgggagcggggaatggcggctttccatcgccgcccgaggcgcacttgcaggccgcgagggtttccctccaccggcagccgggtggccgatgtcgacatcgacaagcagggcttgagccgggtcgtggggtacttctcgggagccacggactttggcgatgggccggtgactcccgtgcccccatcgaccgggttcgtgctgggacttgcgcgctgaggtgaggagttcgtcagggatcgtgcgcgagcgacggaagtgagtgtctcccgcgccatggggacgagcaggctcgccgcgcctcctcgaagaacttcctcgacgccacgtggggaggtgccggtcgcgtcgggatgtcgctcactcgcattgacgcacgacttgatgcgttcgtgacgcacccaggacgcagcgaccgaattttgggtaggcacaggagcgtgcgcgggcccgaggtttgccttgcgccttgagtgagactaaagtgtctcacatgggacgaaagcgaatcagtgcggctccgcctgtcgcgtctggctcggatactcgagcgagcatcttgagcgctgcggctcgtgcgtttgcggtggacccctccgcgccactggtcgatgtggcccggtccgcgggggtcggacgggcgacacttcaccggtacttcggctcccgagaggaactcctccgcgaggcagggttggactccctggtgcagctcgaacaggcgttgaaggcgcaccgcttcgagcggctggcgcccgatgtggctctggagtccttggtgggcgcactggccccatggggtgacaggctccggtttctcctggtcgtctccgagctgagtcaggagccctcgctcaaggccatcgaagcccgggtggacgaacaaatcatgcgcatcttgttgcgcgccagggacgcaggcgtgctgcgccaggacctcccgagcgcgtggctgttcgccaccttcgaggcgcttctgtacgcggcctggacggcggtcgcccaaggtgacctcgccgcgaacgatgccgctcgaacgattcacgagacgctgcttcacggccatggcacggggcacctcactggcgccaggaaggcgcgcccacgatgaccccgaatccctcggagcggcttcatggcatcgatatcgctcgaacctgtgccacctgcgggatgttcgtggtgcacgcgttcctcgtcctggggcctcccagttcgggtctttcgggctgggagcgcatcgtgttcaacctgaccgaagggcgcgctgccgccaccttcgtcctcttggcgggcctgggagtggggcagcttctctcgcggagggaaaccaccgactcacgtcgcgtgctgtggcgtcgagccctcttcctgggggggctgggagttctcaacctcatcgtgtggcccggcgacatcttgcggctctacggcgtcgcgctcttggccgcgccgtggttgcaccgctggtcatccaaggcgctctcggggcttgtggccgctctcattctcatctttccgctcgcggccgtcttcgtggactgggatgcccgttgggactgggcaacgctcacgtaccggggcctttggactccatccggctttaccctcaacttggtggttgatggctttcgtcccttgctcccctggttggcgttcttcgtgctgggcctgcggctggcccgtctcgactggcgcgacagtgccacgccgcggcgaatgctgtgggcgggcatctgtctgttcgtcctgtcggagttcgtctcagcggggctggtgaagctcgcgattcaaagcgcgatgggcgagcacctgggagcaaacgtcgtgatggcgctcctcggcacgcactcccttccttccatgccgctgttcatgctctccgcgctgggtatcgcctgcttggtcctggggggcagctttgtcctggggaaccacctcccgcgacgcattcgggaggcgctggtgtccacggggcgtctggcgttgacctggtatctgggccatgtgctgttgttggtggggctctccgtcgcgggctacggcaaccgcctctccgcgctagccgccatgggggtggcgttcgctggattcgcgggtgtcatcgccgtgtcgtacttgcgaggcggagcacccatgctgctggagcgaatgctccggcgcttctccacatcgagcccaggccccggtcctgacaaggcggcagtcgtgctgccccaagacgtcgctcctgctgctgctcggcggagagacggcgaggctgccaatccatgagaagtgcatctcctcacgaactcaacagcctcgctcttggcctcactccctgaacctcattggctgacgcgctgttcgtggcgcggccaatgggctggggagcgggcccagccacagaattggccagttatcgtcccggctactatccctgcctgctggtgttgttgcggtgggtgggcccacatcgcctgcaacgcatacgcaggacgggggcaccacgccgcgtcagccagcgacgagcctcccgccggctgctggcctgtttcatcttcaaccgcccggcctcccctgaacgcttatctccgaagtattcgccagggacgcgggccccgtcacttgacaaccctgggtgcccccgttaccagaaggcaaaccgctgacgttcgaggttgatgcgcaggaggcctagatcaccctgaggccccgcccacacactgggcggaaatcggctgttgagacagccgaagggggcgtcgtgtgcccctctcccgcatcaaattggcaggattcctccgtgaacgtctcacgcaaggagctgcgcgtcctgaacgtgctggctcaaggcgggcgtattctgaagcacaaggatgagaacgggcgtttgacccatgtggcgtgtgtcacgccagagggctggcagttgtcgctctgcacgctggaggtcttccagcagttgaagcggcgaaagctcatctcctcggtgaagggcggcccgtacctcatcaccaggctggggcttcaagcgctctgcggaagttcaaagacacgctagtgatgaactcagaattgcctcaagaggtctcggatgcacccgagtagccgttcaggggtggtgcggagtgctggcggaggcagagcgcagcacgacgcccggtgaagtcgtggcgctcctgcgccgggaagggctgtactcctcgttggtgagtgcgtggcggttccagcgcgatgcaggggagttatcagcttgaggatgtgtgcagtcccgtgcagcaacctgcgcaccttcttgcgccccgacgtcgggcgatcagagcagcggctgggactccctttgggccactgaaatggcagccccggcacatccagtgcactggtcgcacagtgcgctagcgatggtggcaccggagcgctgtgttccgaggaaggcgcatcgtgtcagccgagcatcgcttgtcgaatgggaacgattgcttgcgaggggcaggtcaccgcatgcgtaccacccggcaattcgccagacggagctccctgtggcgcgaacgcggtgtgctcggacggagcctgcgttgcctgtaccgctggtgaggcgtgcgtctcttcgaccccttgtcgcaccgccaccatcgaatgttccaccggagcgccgccggagttcccgcgcggaaagtagatgcgcgggcgtgcttccgtgtgcataaagagcccatgcgccgtcccctctgcgccccgctcctgctcgcgctcgccctgctgctgggggcatgtgaccgccaggaccgctatgaccgccccggcacgccggtgccggagagcctgtgggcggagacgctggagggcgagcgcatcgaccgggcggcgctgctgggccgcccctgggtcatcaacgtgtgggccccaggctgacacgcctgcgctcgggagttgcccgagctcgaagccctgaggagtgagtacgaggcgcgcggcgtcggtttcctcgcgctttcgctcaaccccagcgaggcgcgcaaccgcgagactgcggctgcgctgggggtgcacatgaccgtggccacggcgaagggcgaggtgctgggcccgctgcgcatctccaccgtgcccgccaccgtcttcatcaaccgcgagggcgtggtggtggcggccgtcaacggcgagcgctcacgcgggttctacgcgcggcgcctggaggcgctgctcgctgcgccgtagttgctggatcgggcccgcaaccgtcttacctgggccgtcatgatgcgcgtcttggcgcaggcaccccgcagcgaccgaattctggctaggcacaccgggagccaggcccccctcggcgctcccacctcgggctccatcttgtccgatgcgtggcgcggggccgactctatgccgggttcttccgcctcgctgtagtaggttgacgtgaatggtacgcacttcaaggctggtgttgctcgggttcttcatcctcgcctccgccgcgtccgcccaggctggcgccgcgaggtccatcggggaggcatcgaagcgagtggagcgtgcgcgcgccgacctcgcgacggcagtgcagcggatcgaagtggagccgccgcgcaacgccgacctcgacgccgccctcgcggcggtggaggcgctgaaggtcgcgctcgacgccggagcgagcttcgagacggaggacctcgagtacgcgaagctggtcctggcagcgcgcaagcagctccggacgcagcgggagtacgtcgacgagcgccgggccaaggtccacatccacgagtaccgccgacgcatcgacggcgcgctcgcgcccctgaacgagcgcatggcgaagctcggccagggtgacccgggctccaaggcgatggacgatgcccgcgccgcggtggacgcgctcgtgaagttggcggaggagggccggcctctcaagagccaggacccgaagttctccacgtacctcaccgaggtcgaggcgaccctcgcccgtcaccagaagacgctcgacgagcggtggctgcagctgtcggcgcagaagcagcggggccttctggatgagagccgcaagaccctggcgagctcgctcaacgaggtgggcaaggcctggtcggacgagaagttcgccgccaccgacaaggcggtggccgcgctgcagaagcagcttgaggagggcaggccgctcgaggcgcaggacaaggcctatcgcgcggaggcggagaaggcccgcgccgaggtcacccaggccaggcgtcggatggatgagctcgtggcgcaggcgggtgtctcgcgggtcaaggtggagctggagcctgcccatgaagagctccgtgcgtccgccaaggcgcttcgggtgaagcggcccgcgcccgagcagctctccgaggccaagaccgcggcgttcgtcgtccggaagctggtggacaagtacgagccgcaggcggcgaggagccaggccattggccagtatctcgccgaggtgaagaacacgctcgtcgaagtggaggtggcgctccaggtccgcaccctcgacgcggcgcgcgccgaggtcgtccaggcgctgcggaacgtcgagaagcggtccgtgaccgccgagcagttcgaggaggcgaagacagcgatggtcatcctggagaagacgctcgagacggtccacgtgaagaaccccgccatcagcccggtcgccgctgacgcgcgtcagctcctcaaggacgggcgggcgacgatggagcggcgccggtacgaggtcgacctgcagcagcagcgcgcgaaggtggacgaggcccggaagaacgcggtggcgctggtctcacaggtccagaaggagacgccctcggaggcgcagctccaggcggcggagaacgcggtcaagcagattggcgtggtgctggaggcgggtaccgccctcgtcaagaaggaccgtgattacgccctgtacgccaaggagtcgaaggaacggatggctgagctgaacgaccgcatcacccggcggaagattgtcctggccgcgggggatgcccgggtccagctcgcgtcccggctggccgccacgaaggagcagctcgaggtcgacaaggcgatctcggcgaccgacgccgaggttgagaccgcctcgaagagcgtggacgagatcatgcagatgttcgagacgcacgcggcgctggagcggcaggacgcgggctacgctgcgtccgccgagcggtcgcgcgccgactggctgaagatggtcgaggcgctcgagttcgcgaagcaggtgagggcgctgcgccggctgaccggtgaggcgctggacgtcgccggcaaggcggcggcatccgccgcgtcctccacggacctgcgcaagcgcagggccctgtacacgagcgctgcggagaagctcaaggcttgccaggatgagggcgcccggatggtgaaggagaacgccggcctcgcggcggttgacgtgctcgtggacggggtccgcacccagccccaggacgtgatggcccagtgtgcccagaaggcagagaccctgcaggcgcccctgaagcgcgtcgacgtggagctccggttccaagagggccagcggaaggcctacgacgcggcgaaggcccacctctccaagggacgcaagaacgaggcgctcgcgcagctcaacgattgcatcgcggaggggcgcatcctcgagaaccgataccccgacttcaaggagcagaagttcgacatcggcggcgccagcatgagcatgttggagctggtccaggtctgcgcgaaggagcgcaaggcgctgcagccttccccttgagccaccgctccagggcccttcgttcagctccccgaatgaagccccgcgcggagcgcgagccagagtccgagtcgaaggccgcatgggccacctggatgcgcgcctctcctacgacctggagggcgcgcatcagggaccccgttgattcagtacaccaccactgaggcgtagacactggtgccgttcgtgtaggccaccagggcgccgccgttcgaggggagcgccgcgactgctggcgcggcgcccggccctactgtcctggcatccgtggccagaatcatggcggcccccacgagcatccggtccaactggatgtcgcccgtcccccgttgggacgcgatgtagccgttgccgagcgcgtccgcgtcaatcacccggaggggagcgggaccgatgtccgtggggaggcccggcacctgggtgcttgtccccggcgcggacatcgggatgacgtccacgttgtcgtccccgaaggagcccgtgacgtagatgaagccgttggagcccgtccagtccgagaagaacgcctgccccggtggggaactctgcgggccgaaggtggtcccctggtcgctgctgctgcggatgcggaaggaggggtcgtcgctcaccgagaagacatctccgctgatcttgtccacgatgacgtcgaagaaggcattgttctggtctacatccgtcacgctgaagtcattcgcgcctcgcgcgaagttctggaggacgctcactcccgtggagcctcgcgagacggagatgtagagggcgtcacccctggaatccagactgacggtagggttggccgccgggctgaggactcgcggcgcctcccagcttgctcccgcgtcgacggtccgggtgaatatcagcgtgcccgcgctggtggccgcgacgtaggcaattccggtggggccgccttcaatcgcgacttccgccgcgttggtgatgcccaggggagtgggacctacccaggtgtggccacggtccacgctcacgctgacatggacggcgccaccgcacctcatgacgacgtagaagcgccccagtgcatccaccgcggccttacggcccgggttcgagttggccgtggtgcagtccaatgccccgctgatgagcgtggggggcacatttgaaaaggcatccagttggcacgcggcgtcgcagccatccccggggatcgtgccgccatcatcgcactgttctcccgtcacgctgtcgaccaggccgtcgccgcatacctccacgccacgggagtccgctcggcagccgtctcccgcgacgcggttgccgtcgtcacacacctcacccgaatcgatgtagccgtcgccgcagacaggcggccccctgacggtgatgatgaccgtggcggtatgggaggtcagcgcgccatcgttggccgtgaaggtgaacgagtcctccccctggaagtccgcggccggcgtgtagagcaactgggcgcccgtcccggacagggttccgtgagcgggatccgtcacggtgaacgcgagcgcatccccatctacgtcggtggccgccaacgtgatgggcgtcgacgtgttgtagcccaccgtcacagtggcagaggcagccacgggcgcgtcgttgaccggagtcaccgtgaccgagacggtggccgttgcctgcttcttgccgtcggagaccgtgacctggaaggtgtcctctccggcgaagttcgcgttcggggtgtacgtcaccgacgcccccgtgtccgtgagcattccatggccgggcagggtgaaggagaagtcgagcacgtcgccatccgggtccaccgcggggatggtgatgtccaccgggatgtcctcggaggtgttcgcgtggacgtcctcgaccgtgggcgctgagttgttgtcgcaaacgcttggctgccccgtgcaggtgtagcccggctccacctcacagacactgttacagccgtctccggagagctgattgccgtcgtcacacttttcgaacctgcccagcaccccatcaccacagacggcccgtagcgacgtctccaccgcgtccaccaggtagagcgcgagcacagagcccctcagtcgcacgtagcgatagggcacgttccccgggtacgtcgccaccgccacatgcgtccccaggcccaactccaccaggtgcaacgagctggagccgatgaaggtcccgtccgccttcaggaagtccacctgcgccaccagcgccaacgacagaccctggtagtacacgcgcaggtcgccggtgccttcctctccctggcccaggtccagcaccagcgccgtgttgagcaagcccagcagtgtcgcggcctgcccgtcgggagcgcccagcgctgcgctcgcgttgagcaccgccgccgtggtgcccgatgccaccgcgtccgcatacgggtcccacgtcaacgaggcttccggacgctcacgcgtcaacgcctggccgttccctggcgacaccccattctccagaggacgtaccttctcctccagggactccacaccacatgcgcccagcgacaaggccagcgtcacgcccagcccccacgaccgcagcacagcagaacggcttcgcatcgagtgtctccccccgaggagcacgatgaagcccggaatgggccgccccctcatggaatgcacgacgccactccacgctctcgacggctcggcgcgcaagacgcggatggccaacgtcgtcccgacatccgccgccaggcacttgagtgccatggacacaaagttcctggcatgtatccgcccgcctccgcgaatcgacggggccgtgagggggaagggcagcggtatcactcacctctccaggtgagtggatcatgcccagcccatgattctgcgcctcgatgagacagggccaggtgctgcgccggggcagcacccagggcatccggctgctggccttcgagttcggcggctgggcctgggctgagagcccgcgctgtgtaagcaccaggtccaatatccatgcgctggcattcagagttgaggtggccgcgctgacgtgacccggtacctgctctggttgctggccgtctgggcgtttccccagcatgaccccagagccacttcgcacgataaatctacccctcccacttcttgccttttgaaggttgcgtcgaacccacaacccggcgcttcatgttgacagtcccatgtagggctccccacgaggaacgttcatgtcatatttgctttcaagatggctcacagcgccagccgccgcattgcgcgccggattggtgattggactggccgccagcaccctcggcgcttgtcgcgacaatgacccgccgcccaacgcaccgccggtagccagcgacatcaccctcgagacggtggaagacacgcccctcgaggtgcgcctgccggccagcggcaatggggcacttgccttcacgattgtcgatacaccggaccacggcacgttgagtgagatcagcgccaatggctccgtcacctacacccccggcgccgactacaatggcgtagatgcgctcatctttcgcgccaccaaccgcgagggccaaagtgcccaagccacggtgagcatcaccatcaccccagtgaatgacacgcccacgctctcctcggtggccgaccagagcatccctgctggcagctcgaccggcgacctggccttcaccgtgggcgacgtggagaccgccgccgacagcctcacggtcatcgccacgtcctccaataccgacctggtgcccaacgaccccagcaatctcgccctcggtggctccggctccagccgcaccctctccgtcgtccccgtcgccagcgccagcggctccaccaccatcaccctctcggtgagtgacggctccgacaccacctccaccaccttcacggtcgacgtcaccggtcttgcgagcctctactggatgactgccgccggctcgctgtggcgggttgacgtgaacggcacgaatgccattgagctcgagaccggcatcagcggggcatcttccgtcgcagccgacccggtaacccgtaccctcttctacacgcgcgacagcgcaatcgttcgagcggacagtgatggggcgaacccagtcgatatcgtggcgaacggaggttaccccagcgggctggcagtcgattcgacgaaccgcaagctgtactggtccgatttcaatggaagccgggtcatgtgcgccgagctggacggcagcaaccccacgcaggtcgtcggcggaatcggtagcccgtctgccatcgcggtcgatgtcccgaacggtagtgtgtatgtcattgcctacaacaacaccaggctcgtacggttcaatctggatggtaccaacctggagaccctcgcctcaaacctgggcggactgggcgtgggtctggcggtcgattcgagcggcgggaaggtgtactactcgacccgcggcaacagcatctatgtcgccaacctggacggctccgacgtcaccaccctggtgaccaaccagaccaccgtgcatgggattgccatcgatgtcacggccgggcggctgtattgggcggattggctggggaccgtgctccggagtgccaatctggccgacggcagcgatatccaggacgtgaactcaggcagcgccaggaacttgggcctggcctggatgcctgcgccgtagccaggagcaggtggctgtaccgcaccggattgttgagacactgggttggtggtggttcggccgcctgcctctgcatcaacgctcgccgggcttagctcggcgagcggaagtcgtgattctccagcagccagtgctcgttgtaccgggggccactccagcagggggcgccggaattcctctgcggtggcgaaggcgcgcccagcgcagtcgttggaggtgtgcccgatgagcggtgacgcacgaggccaacgttctgacgtggttggctcggaccggcaccgcgctcgttttgtcacatacacgattgtggtttctctccgcacctggatgcctcgcggcgcgtcgctcatgctcgtgccgtgatggactccgtccaccatgtgctgcctggttccggggggaaccgtgatgaatcgacacggaatgatgcggtcagtcggcatggcgcaggcgctcgtcgcttccctgtgcggctgtggcgccgaggaccgcccgggcttgcttcgccaagaggacatggcgccctactcgatggcagtgaagcagggcggcactgtctggtgaatgcgtaaccacgctttcatccacgaaccactcatagtcgaccccatggccacgggcggccaaggcgtcgccgactgccagcgctgagccagtcgatccgctgttcggatccggagcaaggtggctgccacgaggaatccccgggagcgaacgaacaatcatggaggcattgccgtcctcgagtccgtgtgaaagacaatgcgaggcgcccttcatcccccctctcacccgcagacctcagacgcgggagtcctggactcagggccctcacgcaaggacggcctggacgtgctccgggctttggccatcgtttcggtgctctgtttccacgccccggagtccgtgcggcgggccctgccggaggtgctccgtgccggctttgaagtgggctgggtgggcgtggacctgttcttcgtcctctccggctacctcattggtcggcaggtattcgcgatggaggactcagcgcctctgggacttcagctccgcacgttctggctcaaacggtggatgcgaacgcttccgctctactttgtcgtcctcgccttctatgcactgaagccatggttgttcgggacacccttcgtgggaggaggttggcactatctcgtcttcctccagaactacgttggcgtgcgcgacttcgtacagagttggtcgctttgtgtcgaagaacacttctacgtggtcctgccgctgatcgccttcggcctgcgcgcccgctccgcccccgcctgggcatggctgatgcccttgctcctgagcttgggcgcccgggcctgggaggtacacaccgccacgccgggcctgctgcccgcggaacagtgggtgcgattgcagtggcgcacccacctccacctggatggactcgcagtgggtgtctttctcgcgaagaccgcgccgcgctggcaacggtggccccaggcttggcgaggggcctgcggcgcgatgggtgccctgttgctcggggtgaccttggcagtgtgcgtgcctcacctgccggactggggaggcgtgtggatcttcgcagggctcgcggtgggatttggcgggctgctcgtggccacggaagcggttgcgctgcccgtaccgctgagaggcctcgtgtaccagaccgcggtcctctcctatggcacctatctctggttctgggtcgtggcgcgcgtgttcgagcggcgaaacctgaccttgggtgtttggggattggatctgctcgccttcatcacggtgacgcatggggtcgcatgggtgacctacgtcgcagtggagagacctgccctgcggctgcgggataggctgcttgcgtggcaggcctcgcgggcggaggcgcgtgacggggtggtggcacccggacgctaacggctcggcagtacagacatgggcgcagggccatgcggggtatcactcatttcgcccgctggtttgcggggttggcgcaggccgaaacgcagaccaccgcctccgggcgagcctgcctcgccaagcgcgccgcgggacggcggcgactcgtggaagtcggtgtctggcatggggggacgacgcgggtgctgcgcgcggtgatggacccgacggccaccgtttggataaacgcccccgcgcggttcgccgttctcgaactcactgtctcactcgcgttgacaggctccgaggcacggccgaggctcctcctcgcgtcattcgaaggccgaacgcgtgcgtcccggcaggtcattcaggcagtcatttcgatcgctgctcaagcttccgcaattctcgctccgcgtacttgcgttgagccgcggtgaccttgcgcagcaggaaggaccgataggctttgatggcctcaggtcccttccccatgtcccgaaacaggtctccccgattcaggttgagcacgttgcgctcgtggcccgtcgcggtgagcagcgccaggcattcgtcgaggacggcctcggcctgggaccactccttgtgggaccacagcgcgaagccgaggttgttgaggatctccgcccggaggtcgatggttgcctccaattgctggttcagttgttcccgcagggttgcgtcctccacagcgaactcgtccagggttcccccagccatgggccggccgttctcaagccatgttcggtacagcgtggtccacgcgctgagcgccgccttctggtctcccgttttccactgagcgagcgcatcctcgttcgcggcgagcaggccttgatgggtacgacggaggtcctccaactccttcaggttttcgaccctgttcttctccgtcagccgtccgtccttttgcatctcctcgaactccggaagggagtatgggcgacccatgtacgcctcgcacgtgacgcctgcttcacctgtctgcgcgaacgtgcaatcacacgaaggaagcgcagtgcccgcacccatcctgctcatggtgtacgctgtctggggcagccggatatacgggtcgtcggcggagacggtcccctcgagacactcgcagatctcccgtgtcatggccttgctggccgtggcgttcacctcagggttgatgctgtcgatgacccacagggcgcactcatcctgggacgcagcgagcagccagcgggagttgggctggtaggaccaattgagctcgcgagcccctccgtccctgggacccagtgccttctccagggcggcaactgcctctggaaaggcctccacgggggagtgtgcctcatccgggaagagggaagcggcccatgcctccttcgtgcgctggagccggaacagacaccgctgaggagcattgccgaagcggatcgcggcggaggtctcgctctcgggctcggggatgagccgcgccacctcgcccatcgtcggacagccattgcgcggcaggctcgttcgtaccagggccggggcaacgagttgccccgtgcgtgggtccaccacgaagaaggcgtcatggaaagggagcttgtccgcgtactggcgggtccatcggctggcgacgacgaagtagcccacgcgaagtccgacctccgggaggtcgacccagcgctcctcgaagaggaatcgtccgccgcgccagtcctggaaggcgggggtcttcttgaggttcgccgacgaaatctccggggagggcgcgggcgcgacggagagcaggagtggcaggaggagtgaacgcatgagcggtcaatgaatgtagtcctgacgcggtcttcgcgtgaagcccgcgacccagtggagttgcccacgtccattcattggcggagcgggagcctcttcagagtgggattcgaccgcccgcatgcaggtcgccgtggatgcttcgttgttgacggaggccaaccgttatccggtcagatgaatccggtagcattgggacctggcgcggaagtcggcgtaggccacgaggagccgcagcagttggagaatcaggcctgcgacaggtcatcccgcccaggtggggccctgctggcgcacgaagtgtctgtcgttgcgcagcctggaccggggttcgatgcatcggtctgatgcacgcttcgggcgcggtcacggcagaggcctgcctgccctctgcgctgtcgctcgcctcaggggctcgacctcgacgcgggagctaccgcgccaggcagcgcgacctccgacgggggcagcttcgagaagacggagcccgcggagcggagggagatgcgctgatagcgcgcataggcctccacgagtgccgtgcgcatggccttgggctccgtgggcccatggcgcgccacggtgctggccagcgcctccagcagataggcctcgggcgccatcagcgttcgcgtgagcgcgatggggctcgcgcccagcgtcttcagcaccggaccgaagtactgctcgctcatgcaggcgaggacgaccacgggcctgggcgtggctcccggcggtgcatccactcggggaggctcgcggtccatgagccggtcatgtccggcccacaccaacaggtcggcgcgactcgcgcccgccgccgcacgcaggaagtcctctagcgccgtgtctatcgcgtcgcccgcataggcgcggagccgcagccgcacgggccgctctcccttcgccgcggtccgctccaggacgagctcgcgcagcaccgcggccccttcgggtcccggctctcggctcaccatcttgaatccaggagcccgtgagaggaaccgctccgcaccgtacatcgccccccagtagaggttcgtctccagcgcgcgcggagcccctgcgggaggacggccgcactggatcaacgcgttgtcacacagcgggacgaagacctcgacctccaccggaggcacggccaacaggctcagcaacacgacggtcagcacaggggacctccagcgggtgcttacacgagacactcgtggcgaatccaccgttccgtcgcgcaagccactcgcccctcccatggcctgctcgacggctccgtgcgtgggggcgcctcgcggagccatccggctacgcgacgctcgtctcccaggagcgcgcctgccttggcccgtatgtcattcgacagcgagccgctggccgtcttggaggaggggctcaccactcctcttggagcgttcctcgactccaggtacgacgtgagccgggcatacttcccatgcgcgctaccgggcgtccgtgtcccgttggcgccgccccggctgaacaattgctgcactttcgtcgaagctctgctggtgaaggcctactttgcaaggaagccgtgcacggagcgcctcgatatctcactcgatgcgctccggcggccagggtcagcggccgaggatggcgtgccaggcatcgccgttgctgccgttcaggtagttctggacgtccgcttcggagagcacgcccgtcttcaccgcggcgtcgagggcggccttggcgccgctacggtgcgcgtccaggccgtgctggttgatgtactgcacgaagctgtccagggagccgttgtccttcatccgattgatgaactcgctggtgtacgcctcgtcgcccttgttctgctcacacaggttcgcgtacacgagcggggagtccattgtcccggcgtaatgctcgaagtcttggcccgccttgaggcgcgactccgcggtctggccgaaaaggtccggcgcgtgctgctgtgcgtaggcatatgcatccgggtagcggccctggacgtaggtgcgccacgattcgtccgtggccgtcgggtgtgtgccgtccccctgcatgttcggcatcacgcccagcaggtcccacgcgaagtccggacggcctttcgacagcgagtcaatgaagcccatcgcgtcctggcccttcatgccgcacgccttggcggcgtcgatgaccgcctggcccaggcccggcgcgtcgaacatcgtcgggtagcgcttggcgaggtcctgaatctgcgccggggacaggcccaggtccgaggccagccgctcgggctggtcatcgccgtgaccgagcgtcctcgccacgtccgggtcgaggcccatctccaggagaatgctctcggactcgttgttcagcgcctcctgtttctccttgttgacgagcaggctgccgaacgcggagaccaccagacccacgccctcgataatctgcccgacgcctgggagccccgtgcccacgagcgctcccacccacgccaccgcgtccccgaaggtctgcaaggcactgccgaccgtcgggtcgtccaccatgtccttgaagtggtccgcgaccaccaccgagttggccaccacaccgaacgcgggcgccaggcgcgagaggaacgccgccgccgcctcgcccgtctgcgcggcgatgcggcccgactcaccgagggtgcgcatcgcgaaggccgcggcctccgcgccgctgcggcccgaactggccaggtccttgatgaagtcgccccactcgccccgtatcgcgtcgttcgtcgcgctcgccaggccgtaggcggcgcccacgcccgccagcgccgcgcccagctttccgtctgacttcgagagctccagcagtggttccggagtgcccgacgcgagtgccgtcttgattgtctcaatgccagacttgacggacgcgcctccctcggagagttggacgagcggctcggtgattaccgtgagttgctgcagcgccgcctcgacatcgccgttgttctcggccaggagctggccggaagtggtggtgagcgccgtcgccaccacgtcgtcgtcaatctggtccttgaggctctcgaaggcggttcccgccgggccattcgggtccaacgccttggcagcccactcgagtgcgcccttggcctgcgaggactccccgagcgacgttgccgcctcgaggctctccttggcgacgtccgggttgttcctggcggcttcaagcaactgcgggtcgttgagcgcgtcgttgagctgcttcgctgctgcctcttcggcggcgaacgcatccgggtatttcgcccggaattgctgcacgtactgctgcctccgccgcgcgccgagcggcctccgccgccgcgctgctcgcggtggacgcaccggctgaagagacacaacctgtgacgcgcgttgccatgctcatactccaggattcacggacgtggagttggagtccggtcttggattatttgaacgcacggtccaaagttgcctggcgatgtgaaagaaacatcgtcggaccgaaccctggaccgggcagcgcgggcgtgtggggcgccctcgtccgaggaggtgaggcgcgtctcagagtgtcaggccgaccaacgaggccgaggcgacatccgggacgaggctgagccgccgtcccgggttcgtcgtctgtccagtcggcacgcacatccagcccgacgaggtgccccagacgtgggtgatggcaccgttgtggttggcgaccaactgcggccagccataggcggcgcggccggcgatgggcgtcccagtcggtagggacgccgtggtcggtatccggttccacctcccgtttgccccgaagatgtggtgcacccggctgaactccagtgacaggccttgcaggcttccatccggctgaatcacggcgaccaggtcggagccgggctgcaggtccacctgggtgtcacccttgtgccagccggaaccgtcagcccagacatggaacagccggccgttgtcgttgaacaggccatgaaggtccgttccattggccgtcatcgagaaggtgcagttgccagacaccgtcacggacgacgggaacttcttccagccattgccgtcgaaggtgtgccagagccgtccgtcttcgagggtaaagatttgggccgaggcattggccggggtccgcagcacgttgagcggcgcccccgggtccatcgccaggccactgctcatcgtggtccagccgttgctgccggcgtagaccagcatcatcacgccgtcgatgttcgccatggcgcgcggcgactgtccagggcccggcgagaacgccccgtaggtcgtgttgcccggcagcacgaggttgctgagcatgtgggcccagccccccgcggtgccgagatgcccgaggcgccggtcctccagcggcagaccgcccccggtgccgccgctgccggcgccgacgtagtcgagcgggttcacccgggtgccgccggcggtcaccagatgccagtgcagatgcggacccgtcgaggacccggagccgggtgcacccgcagcgcccccggagtacccgacgatttctccctgttggacgtagcgctcgccgccgttgaatccagacaggtggaggtactggctcctcattccgttggccatcacgatggtcgcggtgtagccgcccgtgccgttgttccagtcgatccggagctgccccgacgcgcaggccgggagcggcgtaccaacgcccatcacgtagtcgatgccgcccagggagccgcggttgacgtggtcccaccacccatccgagattgagtagccagtgaatgggttgatgattgtctctgcggcgtgggcggtgccaatcagcaggccagacctgccaaaggcggcgaaaccggccgcgacactgccggcacgcagaagggagcgccgggagaattggcgacggttgcgggactcgggagacataaaacctcgagtggggatggggagaggtcgtgaagactgcggctcgttttgtcacggtctgtggctcgcccaggcagtggaaccgccgcgagttattggcctcagggggcgcgacaatggctttatcgagtcgagatggtttagatatgcgtggaaatgtcgagtgtccgtactggcgacgctcaagcacccggtgacaggcaaggggcccgcgcatccggaagaattatctaagccgatctcgttttgtttccgcccagcatgcttgatggcgttttacctgatgatgtgcgagcgcgcgtcgagggggcgactgaccgggttggttgaatatttcagacggactgggacgagtgtccgaatcagcccccatttccgggagttgggtatcacccgcactccaatgcaatccgcaccgagggctcacgatgaagtccccccgcgagttccgcactgcgaacgctcaaccctgtgctgtccgatttggcgggggcaactccacggctttcgccccctgcccactcagggtccacacggtgcgccggttggtactgttgagcacccgtgccaggacggtgcgcgcgggctcctgggtgacagcatccagggtaatggggggctccaactggagtccgggcgtgctccccatgcatgacgccgacgcagatgaaggggttggagggagaactggagagcctcctcgcgtcgatgttctcaggcctgggccatgtagagcggcgacgagcgatggactggtacgtcaagggcctcgggcggacccgaaagcaacggcatcacgtccaccgcgtcgcacgggaacccctgagtcaggggcgttgttgcctcggccggggcgcctcgctcgctcgcgccccgtgcaccacgtccggcgtcaacctatcactgggtgatggcgccgaactccgcctcggccggctcgatcttcgcctccgggttggtccacacgaaggggatgcccggctgccggtagtgtgtggccggaatgtcctgggcgagctgcgcgtgaagctcgggcagttgagaccagtgcagcccgtgcttcgcgtggtgcgcggtgtggtagcccaggttgccggtcatcaggttgtagcccttgtgcaggatgttgtacgaggcgtgggtgtgctccgtcgcctccagccccacgtggtggaagtaggtggcccagacggtgacgtagagcgacaccgccatgggcagcaggaacacccagagggcgttgtaccagtcgtgccagaacagcacgccgagcagtgccacctggagcgcgcccatggccaggaagacgcgcatcaccttgggatatgagcggcccacgcggaaggcgcggggataggcgacgagcgtgttgaagacggagtactccgcctcgcccatggtggacccgtcgcggcgcttccatcccgattcgtcctgggtctggtccaggtagttgcggtggtggcccagcacgtggtgcaggaaccacgcatgggacgtcacgcccgtctggaagccgaagatgacctccaggagtcggttgggcagcgcatgacggaacatgggcacatgctggtggtggtggttccacgcgctgatccaccccttgggaatcactcccagggcgagccagaggatggggaaccaccagcttcgcgccgtgaagaagaccgtcaggtccagggcgaacaccagggtgaacagcaggacggggatgcggtctcggggatgtcggaacaaggtcatgcggattccactgcggggggaggaggggctcccgtgggagggtgaagggtctgtacctggcgcgggacgagcttgcccgtgacgccctggggccgcaccacgccaaagaagaagccctcctcgaagggctccgtcgagtcgacgtggatgcgcgcgcgggcggagacggtggccagggccgtgcgcaggtacacgatggcgaagtccccggccacgcaggcgcgaggaccccggccgaaggggaagaagtggtcgctgccgtgcggattccgggccgcgcccccgtcgagccagcgctccggggcgaacgtctccggggccgtccagtggctggg

SEQ ID NO: 1234 - DNA, 26492 bp, Myxococcus xanthus
cggccggcgccggtgggcgcgggcatggcgtccgcggggaagtcggtgaggcggtggaagcgggcgctgaggcccaggggctcggcgacgtggcgggagaagagcgtgtccagcggagcgcccgcggcccgcgagaggatttcgcccaggaggatgaagcccacgtcgctgtaggcggcgagcgtctggggctcggcggcgagcggcgtggcggcggcggcctggatgacctcgtcgcggacgcgtgcgcgcagggcggagggacagtccgcgtccagcagctcggggtgcgcggtgagcgcctgcgcgaagaagggcacgaagggcggcaggccggagcggtggtagagcaggtccgccacggtgacgcccgcatcgcccacgggcgtgcccgggaagtagcgggacaccagcgtctccggccccaccttcccttccgtccagaggcggaggaagagggaggtggtgctgatgaccttggtgagcgacgccaggtcgaagcgcgtgtcgccggagaccttgcccgcgacgccgccgaacacctgggcgccccggtgcagcacgacggcctgggccgaggggaagacgcccaattcacaggcgtcatcgaggaccttctgcagaatcgcgatggggtgggtaccgccactcatgcccgcacggctccttcgaggaaggtgaggcgcgcggcgtccgcgtccaggcggacctgggtgccgagcgccacggggtagttgatgtcaccgtggccgatggggaagcccgccgcgcaggggaggcccgcctcgcgcgcgagctcacggagcacgtcggcgctggagtagtccgcgcccttctcctcgcacccggtgaagtcgcccaggacgatgcctcgcacgtgggagaagacgcccgccaggcgcaggtgggtccacatgcggtcgatgcggtagggacgctcggtgacgtcctccagcagcagcaccgcgccgtcgagcggcggcatgtacgaggtgccgatgaggcgcgacagcacggacaggttgccgcccacgaggtgcccctccgccatgccgggcacgtaggtggcagagcccgtcagcgggggcggcgcctcgggggactcgaggagtcggaacaggtactcgcgcaccgcgggaggctgccggccgagctgcgtgaggacgggcccgtggaaggagacgcgccccagcgcctggagcgccccatgcacggaggtgaggtcggagaagccgatgaaggccgcgtgcgaggcgtccgcgaagggaaggtccggcaggagccgggcgctgccgtagccaccgcgggcgctgaagatggcgcgggcgtcccggtccagcagggcgcgcgacagctccccgccccggcgcgcgtcatcccccgcgaggtagcggtgggcagcgaagatgtcggggccgtggacggggctgtagcgctccgcgatgacggccaggccggcctcgaagctcgggcggtcgaagggcccggagggggcgacgacatgcacggcgtcgcgaggacggagcggaaggggcttgagccagcgcacggggcgattcatagcacccggggcccgaggggcacggtgattcgaggcccgggcgggcgaagcgttgagttcccccgtccgtcgggacacggacactgcgaccgcctgtcgcccctgcccctaccctgccgtccgctccaggaccgccgcgaagaaggcgtccgtgccatgccggtggggcgcgacgaagaggaatccgtcgcggagacacgcgtcggaaagccaccccgccccgggccgcacgaggcggaagtccgggcgcgaagccaggaaggcggcgacgacgtcctcattctccgcgcggttgacggtgcaggtggcgtaaacgagccgcccgccgggccgcaccaggcgtgccccacgctggagaatgtcctgctggagcgccggaaaccgggtgagcacctccggctggatgcggaagcgctggtcggggccccggcgcagggagcccagctccgagcacggcgcgtccacgagcacccggtccgcgtccaggctttcgggaaggctccggagcacctggactcgggtgaggtgggcccgggaggagcgctggaggagccggtcgagccgctcggggtccgggtcataggccaggagccgccccgagtccttcatgtccgcgcccagttggagcgtcttgccgcccgcgccggcacagaggtccagcaccgtctccccgggccgggcctccacgaggagccccaggagctggctgccctcgtcctggacttcgaacagcccctcctggagggaacggagcccatagaggttgggccggggaccctcgatatggagcgccagcgggctccagggccccgggcgcgtctcgacgccctcggagcgaagccgctcggcaagggcctcccgcgaggtgcgcaggacgttggcccggagggtgatgggcccggggacgttcaggtgggcgcagaagtcgtcggcctcgggaccgaactcccgggcgaaatggtcggcgagccagtccggcagggaggcgcggagcgcgagcgtggggggcggcgccgaaaccaacgggggcggcgccccatccccgagcccggcgagggcggcggactccacagccgggacgcccgcgaggccgtgcatcagggcatggagcaggaagagaggagcggcatcctcgcggcccaggaggaacccgaggcggcgccgccagagcccgacgttgaagacggcctccttgagggccaggcgctgctctcgggtcagggagcgacggtcgcggagagtacggtcgagcacccgctcagcggcggagccggcgagcacctgggcgatggcatcggccgccacggggcccaggccggcgagtgcggaccagggctggaggtgaagccgggagagcggatcaaaagggactgttgacagagcgggcaccattctctagaaagcgcctcatcacggcaacgcggttccgccgtgaggacatattccccgatagctcagccggtagagcgggtgactgttaatcactaggtccgtggttcgagtccacgtcggggagctgaacgaagggccctaccaaccggtagggccctttttttttacacgggcctcgcgatgaatatcgcggggccttcgtgcttaagcccctgaatcacaagggattctggcccgcggtgctgaagagggcgctctcggctctcgccatcgcaaagcgagatgcccctcttctccaccgccgattggggtctctgaagcgctctttcgcccgttttggggagagagaggccgagagcggttaacaggtgctgttaacttttggggaggcggttaacaacatttccatggagacccgctctttccgctctgaggtttctgggagggcgtctctctctggttttggttgcgtctcttacctgctttgctggtccccaaagaggcggcgcaaggtcgggtggagccttccccatcaacactcaaagtgaagacactttcggaagccttggatcagccgcctccgccgctgtttcacggggggctcgtccgtcacgcgaggtggacggacctcccttccaaagccatccgagagactccgagagccccaagactccgcagagccccctgccgcatcgcggaactgccaggcccttcagggagaacagcctcctccggccggatttgaatacgctgctcgatcacctactccactggcgctgagggagcgtttcacccgggacgcacgcagtgcgtcctggccctactcggacgaacctttcggcttgtccgaggcccgccccgtcgctcggtggatgtaagtccagtcctccccgtcgatgacgcgctcctcgcgaaacaacttcgtccgtcgattgaacgcggcgtcgcgggctgcgctgacctgcttctggaggtccttttcggagccaacctgcttcaggcgctccagcacgaggtcgtgagtccagatcaggcgaggcgttttttcaggagatgaataagtcaccgtgacgagctcgatgaagccttcgactgattcccgaagtttgagcatcgccacgagaaaggtactgtcgggctggacccgagccagaaccatgctgaaaagagattcgccctcgaagagtttcggcgggctccagaatcgacacagctcctccaactgatcggcgagtcgctcgctccagatggcccgctgttcgtccgaagacccttggtgccacaacgccgaccaatactcatggaagtccatgttgatggtggccgtcaggctcatgagcacctcaaagagcggctgcagatcctctggttttgtccccgcgcacagagactgccactgctgcaggagcacctcaggcgcctcgtctcccacggagtacgcggcgcgccaggcgctctcgaacgccgcgtgcgttggcagggagcggacgtgaccagccgcggcgcgccagaccgggtggatgccgccctgcaatcccagccaccacagaggttgcggattcccgaaagagacctcgaggcaacgcatgaaggtttccggtgaaacgatcttctccagctccgccggtgacaagccgagcccatccgcccgcccgcaaatcgcctccaccagagagggaggcacgaaccgactcgtcagggcgactgcgcggatccactgccgatcccctcgcgcctcgttcaccagagcaagcacggcatcacgctcggcaggcaacaggttgtcccagtgctcgatgaatgccctgacgttaatcagcgtgaacccggtgtcctcgtgctgcaacaactcggggagcaacgacccacgctcagtcgagtccgttggaacgacctcgagcaggaagtcagcgaccgcgagcgtgtccccggcggggagcgtttccctcaaacccctcttcacccaacggagccaagcccagcaaatgttacgctggacatcctgggacagatacttccgggcgttgtggaaaaacccgtagatggtgtcctcgccgagcgtcaagcgaagcggcggcgcggcgtccagaaccgttggtagcagcgcgccccacagccgccaccgctcgccctggtccttggctgatccctcttcaccttcgaactcgaagtgccacatcatccaggagatccccgcagcgccgatcgggacggatgccgcccgcgtgagtccctccaggaagaattgccgcaactccggggaataggacggccagctgaggatcgctcccttgaacgcggcagcgagcacgagcgggtggtcaccaagtatcgcgttccacgttctctccgattcctgcgaggcgagcgacatataccgcttcgcggctttcgctcggatgaagacctccgggaagcgcaggccgtgctcaaccaccgcaagggtggtgggaccttggagcgccctccacaccttttcgggtgtatcaagctcggtgggcgagagagcatcgcccccgtgcatttggtcgcggaacatctcgtcccaagacctgtgcggcgggaaccacgcctgccctccatgaaaggacaccaaggcgccacttcgtccgccgttggcgagccatctccagaccatcgcttggtcggatttgtccaaccgcgaatgttgaaacagcaggaacaggagagcttcgtccgaaaccgcaggaaaaattgagtgcaacgcgtcgagcccgatccgaagaagccgctgccggtcgtcctccgccgtgtatttctcgaacaggcgcgcaagcccccgcgtcgccgttggcgcggcgttcaccccgagccccgcagtggcccgctccagcatcgaccataggtcacgccgttgcccttggggcaacggcgccaacagactacgggcggcctcctcgtaatccggatgcgcgaagaggaggagatctccgtcgcggcggatccaacctctgcgctccaagtcatcgagaagatcggaatacggctcgggcaaccgcggcggaggcgagtaggttggaaaggggggctcgctctcggacgagaggagtccgccgacattcgacttgtcgagccccggccggtcttttcggtccgtcatgagaaaggctaggtcatccagatggattggccgcatcgcggtcgtgctgatgccgagcgcacgcacgagccgggccatctccgccgtgggacgaacctcggccgccagcgcgatagcgttgacacgcgctttgctgtccaagtcctccaggcgtgtctcgcctttgggaaagttgcgggcaaggtgccgcagttgccccggctgcacgaggaagtcaggaacgagtgcgcgcaggtgtgcggagtaccgctcgcgctccacctcagaaagtccggcgagttccgcgtgcttctgccagatccggttcgcgagcgcgggatcccgaaccgtgagatctacccaggggaacccctccatcggagtcggaataccgtctgcgtccagcatgtcgcgcagcgactcctttgacgctgtgacaatgagcaggcagtgctccggcagctcgcggatcacctgctccaccgcctcccaggtctgacggacggttcccgacgcggccgcctgctcgaatgcattttcgatgatgaacaggcgatcaaattcacccgcaagaagaaggaagcgggtggcctcctgaggatctccccgccggatttcgaacccccgattctgctgagcttgggcgagccacttggcaaggaaggtctttccgcaccgacttgggccggtgagcagaagaacgcgcttgtcccgcagcctgtcgagcagcgtcctctcttccggcctctcgatgtgctccgcctcttcgttgaagacgcgcgacccggcgctctcatacagaatcttccggagcccgggggccacgtcatcgcggtcggggaccttctcacggacgtagtccaccatccgccggaacacatggtcggcctggctcgccggcacgcgattcaggacgagcaaccgccggcattcggcctggatgcgctcgcgcgtcactccctcgaagatgtggatgcgccgtgtgagccgaaagacatcgttgtagttcaggctcagggtcgaacgatgggtgaggcgcttcttctccagatcggttcctgccggcagtccggtgacgtcagagaccttccgcaggaactcacccgcttccgctcgttcgagcccgcgctcacgctcgcctaccgtattcgtgccgtcggagaccagccgccggatggaatcggtgcaccgcccacccgcgacaattagcgcgctgctctgcggattggagagcaaccgctcaaggagcgaattggaagcctctcggtcggggaatttccacagccactccagcagaagggtaaggtccaggtcacctcgctcgctcttactctggatttccaccttccaggatttggccggaaacgtggcttccgcatcctcgccccctcgcggctcattcaccagcgccagcgcaggctcttctgcatggagcagaaagaaccaaacgcccgcttcgtattggtacgtataggcggaagtgctcgtgatggggatcgacattcgggtcttcgtccgggcagcagattaggtggcagcttcgcttgcgcgccatccggcaactgcctggcgcgcgctgggcgacagctctcaattcagggccagtaccgctccacctcatggaagaactggatgagcgagtagtgcagaagcgacaggcaggactgcatgtaccggcgggcgcggaggagaagacgaaagcggttgatgaggaggcgcctgactcatgccgggatgatgccgccttccctactcccctcgtcaagccgctactccggctcttggtgagtctctctctctgagcaccgaagactgcctcaaagaatcgcgccacgcccgcgcctctctgcctccactcgcgggcagagactctccagatggcgcttgtccacagcttcgggggccgcgcgctcgaaggcagagtgcagccgattggtccataccactcaggggttaggcccagcgtcgagttactccatgcatgcagcgcaccgagctcaagtgtgccgtccgagtccgtgcgaaaatcacgatcattcgcttgggttccagatagtcccaagcctcttcgctttcgtgctacacgcacgccccactaccaagcagccatcttgaaaagccgaccttcaggtccttcatcatggagcctgagtacaatttccccgtcggcaaacattggcccatcgctctcggctctcgccggaagctcagaatcaataagcgtgacaacaaattgaagtccaatattcgcatacttgcgcataaccgcaagcaagttggtcttcttccggtcatctagcgactcaaagaccccatcgtgatacacgaaccgaggcgcccttttatcgagaccagcgcgaagcaccgccatatcgaacgcgacgcacaagagctttctgtaggtatgccccaagtcagcactcgtcgcgttgccagactcatcaagaatctccgctcgaaactccaggtgcccttgctggttcggagcgacactgagaagcgctttacggtcgataacgtcttcgacgatttcgctaaagtaaatacggattgacgaaaacaaactattcccatccgagttctgcacctcaacgtccttttcgacctcagtttgcaaccgccccttctcatcagtaagggttcgaatctctgtacgcatctcctgcagacgatgaagatagccgcgctggcgctcaagcgacgtgatgtccgcattcaaaccgacgagttcctcggagacccgtcgatatttcgcgaagacatcagtacccgtaagaaacgccagcatctcagaccgtcgccttccaagttcagcgagctcggccgccaccctcttcagcgaggcttcaatttcaattcgttcttcttgcagatattgtcggcgctcgtcggtgatcgcccgattaaacgaaatcaactgctcgtagtccttcttcaactgtcccggaaacgtcactcccacctcagcaaagagccgctgagcgtcatccggatcaaaaaggacttgttcctcttccagtgacgcatcgattttcctcttcgcatgcgccagcgaatagcgctcagcattaagcacagcgattcgcgcatcaacatcatcagcaatagctctagttctctccttgtccgcgcctcgaaaatcaaaggcattaagcagcccttgcttcttctcggcctccttctgcttcaagaggagcatcccctcaaccttgctaacatcctcaacagagctaccgatctccgctcgaatggcctgcacggtcgattgcttttcagaaagctctgcctcttttctataaagcccctcaacaaatgcagaattaaacccaaggacatgagcaagaaacggcttccagtccacatgtttatggccgtttcgaagctgaaaaacatcacggtagtcatcctgagtcctcagcaaatagccaagcgccctcctataactccacggactaattgctcgcaaatccagaataccatcaagcaagtccttcgctcgctcgaaaggaacatcaacatggtcccattgcgcaactggcaactccgcatagttctgcgaacgagcatgatgccgtttgaaggcaactttcgtaggctcactcacaccgcgccgcaccgtcacatatgaaccgtcgagcaactctatttcgatcaagaacacaaaaccatcaaacatctgccgatgcttaaaaaggaagaatctcggatcccgaccggagagcagacaaaaatccacaagccgccccaacgtggtcttgcccagattgtgcgtatccttcgtgcgattctgcggcagtcgaatttccgcaaatacaacactcagaccaggcaagaaatcaactggcccaaaaacagccgggcgattcgaataaatcctagagagtttcattggatcctaggtattcgattgagtcgttcttgggccggtactcaataagtccgagcaagaacagcaaattgagggcaggcagaacaagaacatcgcttccagcaacgaccttgttaacgtgtttccgcaaagcatcgtactcctcaaaccgctgcgtcttcagtcgccgcagaagcaccaacgacactccgaccaccgtccgatctgggtgcgaatgtttagtcggtcgaatcatcgccacctgttgtaccaatgtcacaatgccaatacatgtaaaacagcatagctcgcgtcaatcgcttattcgaccgcagcaccggatcccgcccaaacaagagatcggtaagatattcgagcacgtcatcaaacgactgatgagattttctcttggcggtaattttgagctgaaactccatcaccacggtctcatagagtcgacgcaattgtaagttttccggggctgcaaggaacgcttgaatctgcgtggtatccttcaggtagtttcgccgttgctgtcgagcgtaatcctccgacatattgttgagcgagttcttgtccgcataggacacgcgtggcgtcggtggactgtcgacggcggcctgaatgacttgttggttacgggcgaatgcctctaccagttccgctaactcgtcggggctgactatgagtggcgaatcaacggggtcgatgttcgccagtgttgcgacctgcggaaaggtcttgagccacatctccagttgctcaacgccgcacagatagagcgacccgtgaggaaggccgcactccctagaaaggagcccacgaatcgcctcgtcggcgttcccagccaatcgacgattcgaaaagagcatatagtggtcgagtgcgttcgccgccctaaggctcttgattcgaggaatctccttaccgagcacagtttcggtcgtcgcttcgccgaagaaatccgcatccgagaatgtcttgttgactccattcgtgtgcttggcctgcacgataacagtgccgcgccaaggcgctgacctacttggaagcaattctgccgtgcctatgaacttcgcgtcccgccccccgtcgggccccttcgaaaaaccctgtacagagataccgagcaactgttgacaaagaaacactacaaggctctcaaactgctccggactcaggtcggcataggagtacttcacgattatggccctcagcgcttctcccgaatatccaacgacagccccgccccctgcagctactaggcacatttgctgtgagaccgtgcctacaaaaattcgaccactgcggcatacatacagtcaaggccgccgccaagaggcgagccacgtagggagaggccatgcgcaagacaaaccggccaaggctagagccagatgggcccagacacagccgacaccatgtaaatcctcgttgcaggactgatagcagagcccgtcggccccctggacggagaccgacgggtcctgcacatgggtatagccacacccagcaataggctcatgcccggggtgcggcgatacccatgcgtaccgctatcgccgtaaaccgcgctccggaggcctactcagcacacggtcggaccaaggcccagtcaggaccggtaccgctccgcctcatggaagaactgcgtgagcgagtagtccagcagcgcctggcgggactgcaggtagcggcgggcccggaggaagggcagccagacgcgctttcccacgcgcacctgggactcctccattttcgcccgcagcacccacgttccgcccagccgccgcaccagcggcacgacgtctgggtagttccacagacccgaagcggtgtgcccggcgatgctctcctgctacacctattcggaagtctcccgaggtgcaccgcaatgagtacccttgcgagtccaggctccacggtcactacattgagtaggggagttcgttcgaaggcaaagaaaaccgcccggtccgtaccaccacaggagggcgactgcagtccattccgagctaagatgtagccctggggagtcacacatcactcagctttgtgcgggcgccatgaagtcgctggagtggcccctcgatcacctcagctcgtggagcgtccccggcaacttcccggccttgccatgtggaccatcttttacatgctggctattcttggcggcacacgcgccaaggagggcccatgaaagacctgatcaccagcttcacctccccaattacctcggcggatgatgcggataaggcactcaaggacgcatcgaaggcactctggttcattgccggtctacagacgctcgcattgctggttttggccttcctggcgaaaggtgactccgccaagcacatcggcggtctcgtggacgccctaatacttgcggtcggggcatacttcctacctcgtcgtcggagtcgcgcccttgctgttgtggtgctgctgctcgcgtcggtcggtttggtgacgacggtgctcaaccggatgggtgcgtccctttcagggggccgcaatatctggttggggctcgcgctcgttgcgatctccgtctccggtgtgcgagcagccttcgcctaccatcgctacgttccttcgcgcgcgcaactggggaacatcgcactggtagtcgttctgacgagcgtttacgcggccattacgctggtggccacgcttattgtggcggccgtccttggactgtcggatgatcaagccagtatcgccgccgtgcttacaatggtggcagtgctgacagcgggctacgcaggcaccctgccctttgtcagacaccgcccctttgccatcccagctcttacagcacctaacgaaagtgcagaccgggctgttcagccgcaagggccatctccagcctgaggaacatggtccgcgaactcgttcccgacgccacctggcagctcgtgacaccgctgcgactcttcttcggcccaagaaaagctgggccgtcttcgggcgaatgacagcacagcgcatcggccacgtccttcactcagcgccacaagtgctccttccgcacgccctcgcccggctacttccaacaacttagctgtctagaaccggtctcgaaattgagcgagcaggcatgagggcgaatgccgggctgctaatcgacatggaagggatggccatgttcgaagctgaccggtagacctgacttatgaacagtggagtctgattgagccgcttcttcccgcgcggaagttgaagcgggaggaccggtctgggcgaacgcccaccccctcacgagcgctgtgggacggaatcctgtgcattctgcgaacccggggcgcagtggtgcgagctgccgcgggagaagtacccgccctacaagacggtccaccgctggttccagggctgggtgcgggacggtactttccgcgccgtcctgcgcgccttggccctggacctgaaggtgcgtggaggcttcgacctggaggcgggcttcgtcgacgcgtacttcgcctcggcgaaaaaggggggccctgcgtcggcaaacgaagcggggcaagaggacgaaggtcatggcagctgcagacggcgctggtcttcctctcgccattggcacggcaagcgcttctccccacgaaaccaggctcctcgaagccactctcgacgaaagcctcatcgacgagcttcccgagcggctcatcggcgacaaaccctatgacgctgacaagctcgacgagcgactgtggcatcagcggggagtgaagctgattgcctcgcaccgccgaggccgcaagacgaagacgcaggatgggcgcgagctacgtcgctaccgtcgacgctggaaggtggagcgactctttgcctggctccaaaacttccgccgtctcgtcacccgctacgaggtgaaggtggagaacttcctcggattcctccacctcggctgcatcctcatcctcttgaggcaattctgagatcacctctacgctcgaacgccccacacatatcatgcttttgttgcgcgcttcattccccgaggcaataccaagcactccccagacaccccaaaaatcattaatattcaaaattattatgataatcacctctcaacgaaactcgcttaatgaggcgttcaagctcatcggcggactgagccgcggcgaaatactccctgcagctttgctcatcataagcgacatcgagccccgcttcggcccaacgccagccgccccctagcttctcgcgcagataaccgtcgaaccgatcaagagccgcacatatctcccaaaatgaagcatgtccaataggattaaaaacaaaagaaaatccgtcgccatgccgagtcattcgagcaggaagagcagccacatccggcagatgaaagtacagagagccaactcctggctcgaatcctccatgcgccaacggatttcgcaaggcatctcgaatgcgcctaatccgttcgtacagcgaacttgcagccggatctgccttgaagtcaaagaggcgatgaatcttccttgaccacttctcagcaataaaactcatgagctgaccacctcctggctcgaaccccaagaacggcaacgaaagcaccaacacatgctcagctctactgaaataggcattcatcattgcctcagcgtagtacccgccttctcttgccgccctccacggggcacgcaactcggcagacagccatttctcattgccttgaccattggctgccggcagcgattcgggaggcccatacacctcagcagcctttgcgcgaaagaactgatacgtccgctcaaaatgatgaaacctattggcgattgtcaccctgccatcgcgcgcctgttcccgaacaaacggttcgaggtacttctcaacgatccgaaccgacttctcaattttccccaaaacctctctgactaacggcgacccctctgggtgattaacctgagtcgtcaccgtgaaaccgaacttcctgagcgacaccgaaaagaacgcctcctcgtattcaaacgaaactccccatcgagtcttctcccaagggccgagcgcctccaggccaaggacatctcgcagaacaaagagcacaagttccgggactgggaactggtcatttgccttgaactcagtgaagtgacgatccttctcatagtctttcggaagaggcttcagtttcttcagcatcaaagcaactctcttacgaagttcgtcagcaatcataactcgtggacctttgcgttccaggggacaaccagcatcctaaagtatgcatcgacctcgccacaaactctgtgcccctgatcaccgcccttcacatgtacttgagcgcctaccgctagtcagaactggtgcagttccacctcgcgaacgagtgcgtgtgcgcgtgttccggcagagcttcgcagagttgcatgtaccggtaggcgcgaaggaagggcagccagacgcgcttgccgacgcgcacctgggactcctccagcttcttgcgcggtatccactgcccgcccaggcgccggacgagcacgttgcccaggtaggcccccaccgctggcgtcacccgctcgtcgatgagctcccgctcgtgtcgctcccggactgtgctccgcagtcctgtcctgcttcgattgcttcttcacatccacctcacgagaagaggctatcagccggcgaggagcctcaagaagttccgcaacggaggacaagcctctttgtggtcaggaaatgccggattgcgcccaatttcaataaagggcgtggagcatcgcgggcaatgcgacgggattgcgcatcagagcaatggcgaatttaggggctggattttgtagggaacactgatctcgttcgccaaatggaggccgtctgtccagtttccacggtcggcgttgagcgttagaacgcccccgatgcgctgcaaaacgatgtgctctccattgaaaaggaggacaccatcgcggccgtgctcaagcaggagcaatgatgcgcgcaacatagttcggcatccggcggcatactcagggctgttgggattgagcctgaagccgaccagcatgctgggcttgaagtggaaatcctcctcaaacagggaccgactctcctcatcgagattaatggcccaaatccatagggcgggtccaatcaaatgagattcatcgccccatgaaagacaaaattggtcggcaaggaggcgaagagcctgcattggcgccatgtcggtttcaaacttaagcccattctcaagacccatgacatactcctatcggacaagcctatctatcatcaacaacagccctattgaaccccgagcacctgcttcaagggtaaatcaaggagaccttcccgtctttgatgcccaatacttccttcagcccctgaatgggatatttaagaaactgctcccgaacctcggcgactggtacaggagtgtcctccaagttcatgacaattcgatccgcctgccctgactccactttggactccctgacgtagtcccacatgtttctcactctcctcccatttggagcatagcagtccgcatactctccattgattctatagtcaggctccttgccattgggctttggagccgggttctgctcaacgtgatatccattttctgcgagaatctcggccgactcattctctcgctgaatggatttaatgttggctggatccttgtcatgcggccctggggtggtttttcgtcctgtaaggctccccttgagctttggtccaccgccacttcctgccgcctgactgaggacaacgatggttccaactcctgcccccactactgtggccatcttcccaaccggcaccgcgacacgctgaatcgccagggcgccctgggcagagagagagaggatgggcaccatggcttcggcgccgcccatggcgcttgtcagagtgcgcgtgacgccgttggcggagcccccggcaatcaacagggtggtgctcagcttggccactgccttcatctgctcgccggccgtcatgtaccggaagcgctcccagtactcgggggaagacgcaatgagggcggccacgcccgcgggcagatgtcgcaacgcgaggatgctgtccgtcggatacgtgaagaggtggcccagggcgtggtacagctcgacaaaggcgtcctccgcaccgtctaacgtacgactgacgacgtccgcgtcgtcatacacctctgcatatgccccttcgttcagctcccggaattgggcatcaaggaggcggaagatgccgccttggctgccgtagaaacggcccaactcgaagccgtgcgcgcggaaggccccgtccttccacgccacctcggccaccctctgctgggtgcgcccattgcgcacccacgccaggtagccgtccggtcgaagtactgctacgccctggaagcgcgctacccggcgcagcaactcggcccgggacacctctccgccctccagcacctcgcgtaacaggtggcccacggccattcgaggcgggaagttccctagcgtcaccggagtctccaccagcaatgccagcaggcgatccgcttcttctggggtgaaggggttgacgcgcggagggagtacgtcggtgtcgccgaggcccgccagcaccaacagcttttcgaaggcgtccacctccaacattcctgtttccaccgcgagtacggccatatcggctggagaagccgcaatgacggctgtacccatggaggcgcgccctgggcggcgacgacgaagccgcgcttcctcgtcctcatccgtcgaagcggcggcggacgaggccaccaggtacgtattgcccgcactgctgctcaacgttccggcgtgcgacacgcgcgccccctggcccagcgccactccatggccggacagaggcgtcagcgtggcacacccagacgccagcagcagggtgccccacagggacacccacttccccagagactcagcggccattgtccacccccatgccgagcgacgcgaatgcccccggacgtaacgggccttccgccgtggggtacagcagtgtaccgccctgcccgagtgcatagagtcgtcccccccaaaagcgccagcgcacctctccagaagccaggtagcgggcccacggctgacgcatgcccacggccagtcccttcaccgccacctccaggttgcggtgcagcagttgcaccgccagccgtccgtccacatccacgcggccccaactgaaggcctcggcgcccatggagaggtgcaggtggcgctgcaatacctcgcccagcaacaccgcgtcccatgccaccatggcttccgcatacacggagtacccttccgggaaggacgcctgggccaacggcaggcccgaggtgcccgccgcctgcaaccgcgccaactcgtagtccgcgccgaaataaccctgccgaaagcctccatgctgccggcgtgcctccagccgcagccgcaagtccagtgtcggtgtcaccgcgtctgcaccgacgccggccacggcgccccaggcacctcctgcaccgggacggccgccccatccggcaaatacgtgcatttccagggcgcgccgccccttgcgctgcaccagcaccaccgccgtcgcgtccaggtgcgccagcgtcacctcggccgacttcacctccccacgtccccagtcatgaatggcggagagcgagagggtgtagcgccccggctgcttcggccggccgaagaggacatgctgcacgtccaactcgagttccccacccatgagacgggctcccagcacatcagaggagaatgcctccatgtacagaggccccagcgtgccggtgaggagggcacccgcagggtggtagtctgggttcgtgcggttggagtagcgctgcaccaggtgcccggataccaggtgaaaaccctccattgcccccacccacagcgcgacgggggatgtgtccgcgcccagcttgagggcgcgcaccaactggccccagtccgacaggctgtcccagtcctcctttcgaaccaagcccgccccttctccccctccccacatgcgcagccgcactggcgcacccgcgttgaggccaaacttctctccgccgtctatcaccagcgtcggttccagttgaatgaagccctcgtcctcgccaacacctcgcctgggcagtagcgtcagcgtggtggcctccaagcgcagcaggtagccccacctcgcagccgaagggagcaggacgggcaactcgtcaggggcaggggcaggggcccggcctggcggcgtcggcgcgacctcagatggcgcacctcgctcaggtggcctgctctcgtcaggacgcggatgtagagtgccctcctgcattccggcgggcatggtcacgtcctcgccggcctgaggctccgcgaattccttcgcccaccccatcccgggcaataacaagggcagcatcagcgtcgcggcccaacatcgactcagagacatgtgcacctcctatgaaactccccgttcagtcggaaggacgaagtttccccgacaggtccgacagggcgccgagccacgggtagatgcattgcactgaggtcatcaccgacaccttgaccgcgattggtcatgggcagacgtgtcacgccacggcaccaggaagccccggcccttcccaacagcaggcacacgtgtcacgccacggcgccaggacggtccggctccgctcatgactccaaacgtgcaaatagagatgactgaggaagggctcctcagcgtccgtcaggcacgcagcccgatgacggctactcggcgcacgatgaccgtcagcacgtgcctcacatggcagtgcgggaggtcctcagcgcagcgcgagagcccaacgcctacttcgatgcggggttaggaaggtggatcaagcgcgtcgccctccggacgctctccacagccaccaaggaagcgcgcagccgcgcgcatgtacgcagcacagtggggaacacatcgccctccagggaacgccagaatggactacaccatttaaatacagtccatttgaccctggaatgacattcgcacaagctcacaaacgccggaaacccatgaaagggcttggaggcagcgctcgctgggttaagggaaggtgacgttgcccagggtgacggtgcgggggccattcgcctcccacagcttcagggtgaaggggcctcggatcgaagcgggagtaccttgcgcttcaacaaccacctgccggagcaccccgggggcggcgggttcggcctgccacacttgcagcaccgtcaactcttcgcctgacttgcctctcagcgacgccccgcttgccgtccacggctgcgcccccggcggagcctccaaccaaacctcaagcgcaactcgctcgagggagcgataactgtaggcgttgcgcaatgccaatgcgctagtgggcgtgcgaacaacagaactgctcaggtcgcgtgcctccacgccctgccgcgccatcacctgtgtggagatgaggcctgtcagccctcctggagcacctcgttcagctcggagtcgattgagttcatcgcgcagtcgctccgcctcggcccgcgcttcccgcgcctcctgctggtacgactctaccgtccgccgcctgcgagacacttccacgacaggctcagccttcgcaggatgcacattcaacaagaaggtggcgcttgccgggactgcgccatcctggaagtgcaccgtaagccggagtcgctcgttgggagaaagacgatccgacggcacgagcctcagcgtggcggtgccaatgtccacaagcgaaaaccgctcacgcccttccagatcaatgcgctcgcgcctcagctccgaatcaaagtagaggccggttgaaagcccaggactcacctcgacttcgaccgctgttcgagagtcctctggcaccaactcgacacgacgaatcacgctattcgctgcggagttcgccgattgggcatgagccaccccacccagaataagaagacacgagcagaaccccgcaaacgtagaagacacgcagttgatgctccgtagcgtgaccagccccaatgctggcaacagcagttcatgaagtgagagtcagcgcctcattcgaactcgcgcaccgcccttacttcaaggtcagaccagacgcggatcttgctggagtcgttaccaccactttccagttctaggccacgcgcaccacctgtcgacagtacctccaagcacacgggaaaggtcccttcgcgagttcgtgctcgcgtcagccgaccgtagacgcggtcgcccaggatgaggcgcccggtgaataccgttccatcaccaagcttcccccacttcccatacatgcggatctgcgttggcccctctcgcacggagatgacccttgactcccctttgatagggaatccaccaggatgggaatacccgaccttgactcccaacttcgccatggtctcgacagctccttctgggcagtcctcgggctcgggtggcggacgtacctgggcgccggtgcacgcgaacgtggcgcagagggccgtcgtcgccagggcactgctgacgctcctcgtggccttcttggcaggcactggcggggaggtcggggagtcactcttcgtcgtcgtcacggtggcagtcacctcgggaagcgtcgcagggggcgcgacggccgcaggtgttgcctccggcccggtgggagctgcggccggggcagcttgaggtttttctatatatggcgctacttcttggccggtgacagcctgcggctgcggtgagtccgtccgcagtgagaagtacgcccccgacgcgagggtcatggccagcagccccgctcccagcacacgccccagccggagtcgcgcgagaaccgagggccgccctgcctcgacgacgggggccacgagcgccgcttccagcgcgccgtccgcctccatggcggattccgcccccaccccggcctcgagcgccaagcccggcagctgcgcctccacgggccgcgtggccgcaggcaccagcggggcctcgggcggcaatgccgcgggcctaccttcgcctgggacttccggcagctccggccccggcgccttgccacggcgcatctggcgcaggggccgtttcgcccaccgcgccagcttgtccaccttgccctcgttctcggtggtggccgagttcgggccataggcgtcaaacaagggcgtgtcccacgcctccccttccgccccggacaggagcgcctccagggcagcacagacagtgctcgcgtcgggacgcgcagcagggtccttctccagcagccgcatgcacaacatgcccagccgctccgggacgaagcggttgacgtggtgagggggcacaggcgtcctgccaatgacagcctggacgtactccgcttccgaccccgagtcgaagggcagcctcgcagtgaggaggcggtagaggacggtgcccagggcccacatgtcgtccgagggggcggacacgtagcgggcgcccaccttcttgccgaagtacttcttctgcaggaagagccaagcctcggggggccggtactccatcgtccccggcggcagcatggactgggtgatgccggagggggctcccgcgtagtccccgatgccgtagtccaccagcaccgccaggccgtccgcatcgcgcaccatgacgttggcgtccttcacgtcccggtgcaccactcccgcctcgtgcgaggcctccagcgcccgcgccatgtcgagcgtcaccttcgcgattcgccgggccgaggggttctcctccttcacccacgcgctcagcttccgcccctccacgtactccatgaagatgagggcaaagtcgcgctgctcggcctgccagtaggtgaagccgcgaatgcccacgacgttcgggtgcgtcaagcgcaagaggatggagatttccttctccacccgcccctccacgcgttgccgctccacgagcttcagcgcacagggctgcccgccgttcgtcgcgaggtacacggtgccgaagccacctcggtccagttgcctcaccaccgtgtagcccatgaccgagtcccccggggacaggacggccggggggccgttgtccctcatggcgacttcctcctggagactctgtaggacagcaggactgcggccacgcgcatgcgacgccctccccggcgccggcccacgttaccagaagcccggggaaatcgcgcgaagtctcccccacctccaaccacagccccgaaaggttccgactcagctgtcaaggtgatatcaactagactatcaggtacagtttcattgatatgcacatcccccctgacgccctcaccttcgcccctccgaagagacgcgcccgccctttgcctgtcatcctcggcgaggccctgcgcgaggcccgcctccgcgcgggcttgcagcagacagaggtagcgacgctcatcaacatctcccgcaatgcctacagccggctcgagcggggactgatgcttcccagcgtcccgacgctataccgcctgtgcaccgccgtctgcaccacccccaacgagctgctgggcttctcctactcgctgccgccgggcacgagcgccatcgccaaggacgccctgcgacgccgcgtgcgccagctgaacgggcgccaggcccttgccctcattcagctcctgtcgggtgagcgctgatggattgtactccctcgacaacgcgcaactcaggtatactcccttgtacctatgaaccaacagctggcagcgcaccttggaagcatcgcccgcctcgctcgggagcagatgagtctgacgcaggtccaagtcgcggagcgcgtggggctggcctctgccgtctacagccggattgagcgcgggctgatgattcccagcgtcgagacgctgaagaagctgtgcatcgagttgatggtgagccccgaggacctgatgggactcaccgagtcccccagcagcggcagtcccacacggccggacgacgacgtcaccttgcgtcggctgatcttcctcgcgcggaagctcgacgcgtcgaagctggacgccctcgtccgcatcaccaccgagctggcccgctgaagcagcgccccgaaggccccgcccctccagcgccaggcagattgcggccggcgctccggcgtctccgagaaaggagcaggcccggcgtgcagggccccatgcctcggggccctgcaccgaaccctcgccctcaacccgagcggctccggcgatgacggagcgcctccctgtccgaaggaggaggccccccgctacgccgcgccgcgctccgccagctcttcattcacatcggcgagctgcgcctccagggctttcttcctcagttggaggcgggccacatcatccagccccgcctcctcgtcgaggcgtctctccttcggagggtcaggctccaagtcctcacgcacctccaccgtgaggacgtcgcccgcacggatatctttggcgtaacaccacttcaggtgctcgcggtactccctgcccacggagcccccaaggtggaggtccacctccgggttgtcgcgcgtctcatcatcggggcggcgcacccacgtcagaatggtggagacgacaccgaagcccgacacccccgcggttgcgacgtgccggccattgcgcagtaggcgaaagcagagcatcggcggcctactccttcttcgggagtcccagctcgtgcttctccagcccatccgggtagaggccggcctcgccgaactctacctggtcccgcagcaccccgccttcggacaccacgagggcggcctccttggcggcctccgcgcgcccatagggcgcacggagctgggcgtgggcgacaccacgcagcgcatcccgcatgtccgccgctgtcgcgaagcgctcctcggggttgaggcgcagggccgtgtgcaacaccgccttgaggtcctcactgaggtgggccaccgccttctcgacgacatccggagtgaatgtctccatgagggcctgcatctgctgcagcggcaaagtgggcggcgactccgtgacaaaccgcgtctccttcgacgccaccaccgggacgtcatgcacctcgaagaggtgcttgctcgtgaggacttccaccagcaacacccccaggctgaagacgtcggagcgcggcgtcagcccttccttgcgcaggtactccggagaggcgtaggccacgtccccccgcagcagattctccggcgactcctcccgccccaccatcagcgagtacgccgcgccgaagtccagcaccttcacctctccatgcggccccagtgcaagcctcctgggactcacgtcgcggtggacaatgcccaggggcacgccctcctccgacgtcagcgtgtgcgcgtagtgcagcgcgtccgccacctccgccccgacgtacaaggcaaatccctccgagaggggcttgcctcgcaccaacgccgcagtcaccagcgtctccagcgagggcccacccacgtactccatgactgcgaagggggcgtccgcctcctcatccacctgcatgtggaagacttgagcgatgttggggtggttgagccggaaagccaactgcacctcttcaatcagccgcgtgcgcatcatgtacgtggagggggtggcaatccggcgaaccaggcaggggccggccaggactccatccgccactcgccgctccgccttcaggagcttctcgccattcgaccgcacctcaagctcccccaccgcctcgtagcgaacgtcatccacgacgaagaggaagtgcggcgagctggggctgggcggtgtgggggggcggggcgggaactcctccgtcgacacttcatcttccgaacgcttcgtcatggctgtgaatcctcctgaaagaaggggcgcggccccaccgtcaccgacattcgccgtagcgggcaactctcccgaagcttgctaggtccagttgactcgaccgtcgaattaacatgacccttatgaagctgtgaagccctctgccacccgcagcggacaggccgccccaagtgcgcctatccggggtgaaagagaccccagcctcggcctcacacgccgggctgggcagcccgcaaaggaaacatgcatcgtgagtaaaaccattgactgggggccgattcgcacactggcgcgtcgcgtcctcaccgaaggagagcgcgtggccctcacgcgcaaggagaaggcgctgctgaggcgcacggccgcagaggtgggcatcagcgccagcgaagtcgagagcgcgctcgccacggaagagggagcgctgggcctgttgcaagaggaatctcggcgcatcagcgagggcactcgccggctcatggacgcgttgcaccgcatgtacgagcacaaggacaagggggacctcgacagcgcccgccaggagatgcggaacgtgctcgccgtggaagtcgtgcctcactaccgcgccattgcacaggggcagctcgaagccatggcggacgagcatcagcaaggagagcgagcaccgggtgcttccacccgggcagtgttcgctagacgcacccctttacgactccggggtcggtagtctgcacattcgggacggggcagatttgccccacagaagacatccgactcggacaactgccccgccgagaatcgctgctgcgtttctgcggacagcatggtggtggatgcgggtggctctttagag

SEQ ID NO: 1235 - DNA, 27903 bp, Myxococcus xanthus
cggggaaggcggcggcttcgcgctggaggtcaacgccgggacgtgggtcgtgtccgcccgccgtggggaccaactgggccgcgtgccggggccgctgtccgtcgcgccgggcgagacgctgcgcgggctcatggtgacgctgggcgcggccagtggcctgacgggcacggtgtccacggtggagggtgcgccggtgcgcggggccatcctggtggcgtctcccgcgggcggccagggcgagctgggccgggcggcgtccgaggaagatggcgagtggcggatggacgtccctcccggcgagtacgacgtgacggtgcgcgcggtgggaatgacgggccgcgtgttcgaagccgtggtggtgaacccgggcggccacacgcccctggacgtgcggctggaacccgcaacggcggcgctggaaggcctggtggtggacgcggagggacgaccgctgggaggcgcgcaggtccgcgccgaaccggcgtccttctctggcgtggcgcacacggcgctcaccgacgccgagggcgcctggaagctggaggggctggaagcgaggcccacctccgtgcgcgcgcggcgcgagggctcgcagcggtggacgtcccgcatggagacgctgaaggcgggagtcgtcacccgcgcggacttcaccctggcggactccggctccgtgtggggacaggtgacgcgcgcgtcgggcgggccgctgaccgagcccgcgctggtccacgccgtgcctcggggcggctcgggcacggcctccacggagacggatgcgcagggccagttccagttggaattgcccgcgggcgtctaccaactggtcgcgctgctccaccagacgcccgccatctacttccacatggagagcgacccgttcgtgacggtgccttcgggcggcgccgtgcggcaggacctgctgttgaaggaagactccgtgttgtccggcgtcgtgctggagccctccggggtgcccagcccgctggccatcgtggccgccatccagggcggggacttccccatgacgcgcaaggagcgcgcggacgaggcgggccagttcgccatgccgccgcgcccccagggcgcccagcccctggagctggtggcccacaacgcggggcgcgtggggcggctgcccgccgcgcatgaggaccaggcaccgctcacggtgcggctggagcccgcggccaccctgcgcgggcgcgtggtggcgggcagcggcgcggctccggatggcttcaccctggagctgctcgaggccaacggtgaggccctgccctgggccggcgcctggcccaccacgcggcgcttcgctggcagcaccttcttgcttccagacgcgcccgcccaggcgctgaaggtgacggtgcgcaccgaggacggccgcacgggcgaagcccaggtgacgctgcggcccgggggtacctcggacgtggaggtgccgctcaccggcggcgtggcgtccatctccggccgcgcggtgtggagccgggggggaggccctgcgccaggggtggcggtgttcctcgacaaggccgtgggcgggcgctcggatgccttcaccgggcaggacggacgcttccgcctgagcgacgtgcgcccgggcatccacaccgtgcggctgctaccgccggagggccgcgtggagacgcgcaccgtgaaggtggcggaggcggaggccaccgacgtgggtgacgtcacggtgtccccgcgccgggccacgccgggcacgctgggcgcgggcttcagtgaggaccggggccacgtcgccttcgcgtggctgacgccggacgggcccgcggcgcgcgcgggcgtcaacgtgggggaccggctggtggcggtggatggccaggtggtgcgcgacagcacggaggcggagtcccgcacccggggggcgcccggcacgcccgtgcggctccacgtccggcgcgcgaatggtgagcaggaggtgctcgtcacccgcgcggagtgaggcccgctacaccttctccagcacgcgcgacagcacctgcgcggtgaagttcaccaggggaatcacgcgccggtagtccatgcgcgtggggccgatgacgcccaccgtgcccagcacctgctcctggtttccgtaggggctggcgatgacggtgacgtcgccggccgcggagaagtcgctctccgcgccaatgaaaatctgcatctcgttggccacctgcacccggtccagcagcgacagcagcttgtgcttctcgtccagggccctgaagagcgcgcgcatgcgctccacgtccgcgaactccggctgctcaaagaaggaacccgtgccctggatgagcatccgctccgtggacgccaggtccgtggccgccgcgcccagcttcaacgccttggccgtcagcgcgttgtagagcgcctgctcctggtccatctccgcgcggatgcgctcgcgcgccgactccagcggcacctcccgcagcaactccgacaggtagttgctcgccttgagcagctcgtcggaggtgatggggaactccacggtaatcgccttgttgtgcacctggccgctctgccccaccaggatggcgagcacccggtcctcgcgcagccggacgaactcgatgcgccggaacaccgccgactccggccgcggcgccaccaccacgcccgcgtgacgcgtcagcgaatggaggatgcggctggcctcgcccagcatctccgccaggtcggcctcgtgcgcgagccccgcgtggatgagctccctgtcccggggcgtcgggtccttcagcttcaccagcgtgtccacgtagaagcggtagccctggtcggtgggaacacgcccggcggaggtgtggggcttctccaggaagcccagctcctccaggtccgccagcacgttgcgcatggtggcggaggacacctcgaaccccggcctgcgggtgagctgctgactgcctaccggcccgcccgtggagatgtactcctggacgaccgcccggaggacttccttctcacgctcacccagctcttcggacatccctggcgctcactccggagccacggtgcggcggcacctccgccctggctccctgggaaagtctaaggaagcggccccgggcattcaatccgggagccgccctgtccctacgggcgacccggcgcgacattcccgacgccgccattccggccagccggacggccgccccgacgcacgagtgcggtgcccgccactgtactgctccgaaaaggacccggctgtgaggtgcggcaatgcccacatggctggcgaaaatcgccagcgatacaagccgcgccgtgctcgcctcgcgtgccgcgccgctccccgtttcacagccagcccccgtcagtctgccctccggagacgtccttcccggtggcccccagcgcgggtggctcgtcgccagcatcctgtccctttatattatttggggctccacctatctggccatccggtgggcgctggaaggcggcatgccgccgttccagatgtcgggggtgcgcttcgtgctcgccggcgccctgctcttcgcggtgctgtggctgcgcggggcgcccgtgcccacggcccgtcagtggggcgccagcgcgctggtggggctgttgctgctgggcgtgggcaacggggggctcgtcttcgcgcagcagtcggtgccgtcgggcgtggccgcgctggtggtgggcagccttcccttgtggacggcgctcttcggggggctcttcggccagtggccccgacgcgcggagcgctggggactggccgtcggctttggcggcatcgtcctgctcaacctgggcggtgacgtgggcggcggcctgctgccgacgctggcgatgctggtgtcgcccatgagctgggcgctgggctcggtgtggagtcgccggctgcccatgccgcgggggctgatgtccaccgcggcgcagatgctgtgcggtggcgtcgtcatgctgggcttcagcctgctgattggggaacgccccacggccatgcccacgcccaaggccgtgctcgcgttcttctacctcgtcgtcttcggctcgctggtgggctacagcgcctatggctacctgctgcgcaacgcgcgcccgtcgctggccaccagctacgcctacgtcaatccggtgctggcggtgttcctgggcggcctgctggcgggcgaaacgatgacgcccacggcttggctggccatgggcgccatcctgggcgcggtcgtgttgctgacgcgcgggaagtgacgctcagttgacgagcagcaccttgcccacgccgccctgctccgcgagcttctgcgcttccttcacctgctccagcgggaagcgcttgctgacggggatgaccaggtcgcccttggcgacggcctgccccagttgcgtcaggcgacgcgagtccgggtgcgagaggatggcgcgcacggtgatttgccgccccttggcctcgggaggctcacccaggacgctgcccagggtgcctccgggcttcaccttctccagcacgcgggccaccacctggccgcccacggtgtccgccaccgcgtccagcatgggtagcttggagaactcatccgcgacgtcgagcgcgaagacgccgtccacgcccagcttctgcgcctccgccttctggctgccgcgcacgccggccagcaccttcgcgccccgggctttcgccgcgaagacggcggcgcggcccaccgctcccagcgcgccgatgacgagcaccgtgtcccccttcttggggttcaccgcctcttccatcagttgcacgccggtgagcgtgaccagggggagcgcggcggcgtccttcaggtccatggactcggggaccttcgcccaggactccacgggcgcgacgaccttctccgcgtagccggcgttcaccacgcccatgacgcggtcacccggcttgaagtcgctgacgcccgggcccacctccatgacctcgccggccacgtcccgtccgaggatggtggggaactgcagaggcatcatcgccttcatgtccccgcgtcgaatcttccagtccacggggttgatgcccgcggcggtgacgcggaccttcacctcgcccggtcccaccttcggctcgggcatgtcttgaacggcgagcgcatccacgtctccataggacttgagcaccacggctttcatgagcacctcccaacgcgaaagagctgacgtcgcgcgaagggtaatcacccatggaggccgcccaccgcggcgcctgcccggccctacctcccccttgctggaagggcagccggcaggcgccaggcaggcgagcttcacgaggcacggccgctcatggcgcgcgtccctcgccgagcgctgcaccgacgagcagcaagagcgtcgagcccagctcgccgacgacgagcagcgcgccccctggccccgtcacgaggttgcgctgcgtgaacatcgtgcgctcggtccgacgaataccgtggaacgcgtacaccatgagggtcactacgaaatagaagtacgccgtccagaacgctcctcggttgagcgtggcagagaacgcgctcgctgccgcgagatgaccgagcaccaacgtcgcgctcgcgtagagaagcgacgcgcgatgcaagatgtcgacgtacatcggggctcgtcgttcgggactgcgcaccatcgcgcgccacttccagacaccggaagccatccccaccgcgagcaaggcacccgcggcgaggatggaggttccctctatcctcattcgccgggaatgacttcgagcccgacgaggattcgacggagctcctcgacacgctctgcagggagcgcctgcaggggcgcgcggagcggcccgacagacgtcccctgtagctcgagcgccgccgagattgcacgcgggaggccgtgagcgacgatgaattgcaggaaaggaagctgccgatagaagctctgacgcgctgccgcgacgtcacctcgctggatggcgtcgtagagctcgatgttgagcttcgggatgatgtggggcgccgcggtgcaccagccgcgcgcaccggccacgaaggctgccaaggcgagcgggttgctcccattatagaacgccacatcctcgccgcagagctggacgaggcggtgcatgcggttcacgtcgccggtgctccccttgaccatcgtgacgttcgggatcttcagcagccgcgagatgacgtcggggctcaggtcgaggccacccgttgcggggttgttgtagaccgcgatggggatggcgatgcgcttcgccaccgtctcgtagtgggtgatgatttcggcgtcgctcagcttccagtagctcatcgggatgatcatcaccgcgctggcaccgagcttctcggcgtgcttcgcgtggtggacggtgcgctcggtggtgaggctcgaaacgccgacgagcgtggggacgcgcccggcgacccgcttgatgacgatttccgcaacctgctccctttcgtcatcggagaggtacggcagcacgccggtgctgccgagaggcgcgatggcgtggacacccgccttcaccatgtcgtcaacgatcttgccgaggagcacctcgtcgacacgtcccgtcgacgtgaagggagtgattggatacgcgacgataccgcgaagcagcgcgctcatcgtgctccccccgccgcctcgtggctcatctcgatgtctgtgtaacggttctctgtcatgttggtctccacgtgtgccgtgcgtgtcgttgcgcacggttcgttcatgtaccgggcaactggaccctgaacgacatccagaagagaaagaacgaagggtccagtgctgcatgcatgccgctcaagccagggcgtccccgtgcttcttcagcactcggcgcgcgaagtaggcgaacgtgatcgcgctgcgcgtgggccgcaagatccagtcgtgcgcctcctttcccagcttctccggtatgggcttgatgtcgccagccgcagaggcgaggagctgcaggcgagccgccctctcgaagagctcggccagcacgcacgcctgctcgatgctatcgccggccaccagttgaccgtgatgggagaggaggagcgcgcgcttggagccgagcgccttggagatgagctcaccttcctcgttgccgaccggtacccccggccaatctttcaggaaggcgcagtcatcgaagagggggcacatatccatgtgcgagacctgcagggggacctcgagcatggagagcgcgacgatgtgcgtcgggtgcgtgtggatgatgcagttgacgtcgggccgcgcctcgtagacccagctatggaagcggttcgccgggttggccatccctttgccttcgagaacctcaaggtcgctgttgacgaccaggaggttcgacgcggtgatctcatcgaacccaaggcccaactgctgcgtgtagtaggtgccgggctccgtagcgcgggcggtgatctgcccggccaaccccgagtcgtggccgccctcgaacaaaattcggcaggtcagcgccagcttctgacgcacggtccagtcaccctggccgaaggtggtgtccatctgcttcttcgcttttccgaccagctcctccttcgtctgcgtaaaggtcttcgacatctcagctcctcgttcgtgttggtgcgcgtcgctacgcaacacgggtgtaagggcatgctggaccccgtgcatcatccagaacagaaacgactacggggccagttggccgagcccaaggacgacgctcccgaggatgagcgcgaccacgaggaccgcgccgacgagggcgcgacgacgcggtgcagagcatcctcccgcttcggcccgagcaggacgtcaacccacgggacgacagcggcgccacggcgctgttcctcgccgcctggaagggactgagcgcgagcgtctcggcgctgctcggacggggagcgaacccagacctggcggacgagggcggcaacacgccgctgcacaccgcggcccgcaacgggcatgccgaggtcatcgagttgctgctgacgggtggtgccgatgcgcggctgcgcaacgcggccggtgagagcgcggcggaccgtgcccgccagcaaggccacacgaagctggcggagcggctgagctgaccctcccccctcccagccgggccctgagcgcgaaaggcgccggagcgtcacggagacagcccccgacgcccttccaccgcgcggacgccgggacacttcgcgtgggacgcgctcagttggcggagcgcgtcgccgcgtccggatgcacgccgccggtaggcgcctccgtctcgcgcggcagccagacgtggaaggtggagccttcccccgccacacccggagactccacccagatacggccgccgtgctgctccacgatgccctggctgatggtgagccccaggcccagaccgccgtacttgctgccgtgcgcgcggccgaagcgctcgaagatgagcccctgcttctccttggggattcccacgccggtgtccgtcaccgacaggtggacgccctcgtcgtgctcaccctgcacccgcacccacacgggcccgccctcgggcgagtagcgcaacgcattggacagcaggttcgtgagcacctggtccaaccggccccggtcccacgtcccctcgagctgatccgacgcctcgacgtggatttcatggccttgcgacagcaccgccatgcggtcccgcgtctcgtgcaccagatggctcaggtcgaagcgctccagctccaacgacaggcgccccgcctggagccggctgatgtccagcaggtcctccaccagcttggccatccggtcgatttgccggttgatgattttgagcgacttgcccggcccggcttctgtctcaccgcccagcttcagcagcgccaggtgcgcgtggcccttggccgcggccagcggcgtgcgcagctcgtggctggccgccgcgaggaaggaatccttcgcctcgctggccagccgcagcgccgtctccgcccgctgccgctccgtgatgtcgcgcgccacggagatgaagcgcccggggccgccgtccgccgccacgtactggagcaccacctccaccggcacctccgagccatcccgccggcggtggctggtggagtacgtctggctgggcaacgtgccgctcaccagcggcgccagcagcttgcggaagccggcctcgtcgaaggcgccctccacctccagcaccgacaggcccaccagttcatcggtgctgctggccaactgcttggcagcgcccgcgttggcgtaggtgagcgtcagcgagtccggggagaacatgaggacgcagtccagcgtcgcgtccagcgtcgccttgaagcgccccagcgcctcctccgcccggcgcttgtcgtcgatgtccgtggccacggcaatccagccggccagcaggccattctcgtcccgctccggcaccgcgcgcgccaggtgccagcggtacacgccgtcgaagcggcgcaggcggaactcgcgctccacgcgctgtcccatgcggatggcctgcacccacgcggcgcgcatggcctcgcggtccaccgggtggacgaactccaggaaggtgttgagcgacagcggctgttccgcctggatgccggtgtagtcccgcgcggcgcggttggcgtaggtgaagctgccgtccgagcgcgccgcccacatcacctccggcaaggactccgtgagccgcaggtggcgcagctcgctctgccgctccagcgcctcgcgctcgcgctgccggaggagcaccgcctgccgctgaatctgctgctccttgaggaacaggtccacgaagacgctgaccttggagcggaggatttccgggtcgaacggcttgagcaggtagtccaccgcgccgtgcgcgtagcccttgaagacgtgggccgcgtcgcggctgagcgcggtgaggaagatgatggggatggtgcgcgtgcgctcgcgctgcttgatgagcgtggccgtctggaagccgtccagccctggcatctgcacgtccatcaggatgacggcgaagtcgcgctgaagcaggaacttgagggcctcctcaccgctggtggccttcaccaactcctgcccgagcggctcgagaatggcctccagcgcgagcaggttggacggatggtcgtccaccatcaggatgctcgctcggggctgggaagccctttcctggttgcggtccgcggagatgtgttcgctaggcgtcattgaagtcggcggatgaatctgccccggtcccacctgttctcaaggtggaagaggctaggtggcccctcgaccggacccaagcccggaagagaggcgccgtacggtaaccatcactcagcgaatcaagccgtcacccacagacggatgagctccagaagcttgtcggtgtccaccggcttgggcaggtagtcgctcgcgccggccgccatgcacttctcccggtcgtccttcagcgccttcgccgtcaccgcgatgatggggaggctggagtacttgaggtccttgcggatggcccgcatggtctcatagccgtccatctccggcatcatcacgtccatgaggacgatgtcgacgtcgcggtgctgttcgagcatctcgatggccgcgcgcccgttctccgcgaacaccacctgcatgccgtggttctccagcacgctggtgagcgcgaagatgttgcgcatgtcgtcatccaccaccaggaccttcttggcggacagctccgcgtccttctcgttgcgctgagccagggcggcgcgggcgcgaggcggcaggttctggtccaaccggtggaggaacagcgccgtgtcgctgagcagttgctccggactcttcgtcccgctcttgaggatgacactgccggtgtagcggcgcagccgggcctcgtccttgggcgtcagctccttgccggtgtagatgacgatgggcaggtcgcggaagcggttctgcgtcttgacctcctccaccagccggatgccatcggtgtcgggcagcatcaggtcgatgacgacgcagtcgaactcgcccgtctccaggtgatggagcacctcctcgccggtggccacggccgtcacctcgacatcgccgccttcgctcagcagcttcaccaggctgtcgcgctggacgtcgtcgtcctccaccagcagcagccggcgctccttgcgctccaggaagctggccagttggttgaacacccgctccaggccctccttgctgacgggcttggtgaggtaaccgaaggcgccctgtgagttgccctggttcttgtccatgacgctgatgacgtgcacggggatgtggcgcgtgcgcgggttgcgcttgagccggtccagcacgctccagccgtccacgacggggagctggatgtccagggtgatggcgtgcggctggaactcgttggccatggacaggccggtgtcgccgcgcgtggccaccagggccttgaagcccttctcccgcgccatctgcaccatgatgcgggcgaacttcacgtcgtcctcgatgagtagcaggacgcggtccccttcgcggatgtggtcgcggtcatcctccacggcgacgggcgtcagcagcgactcgatgggcggcggcagcgccgcgtccagcacgtggccactgtccgccaccggcggcgcgggaggcggctccgcgcgcggcgactccggcgtcggaggaggcggcagccggggcggaggctcgtacggggacggaatggacggcaggccctcctcctccggactgatgtactcaggcggcaggtagagcgtgaaggtgctgccgcggccgggctcgctggtcacctggatttcaccgcccaacagcttggcgatttcgcggctgatggacaggcccaggcccgtgccaccgtacttgcgcgcggtggagccgtccgcctgctggaacgcctcgaagatgaggcgctgcttgtcccgggcgatgccgatgcccgtgtccgacaccgcgaagccgagcacgtaccgcgagcgccgcagaacctcgtggtcgaagtgcgtgcctacctcggccagcttcaccttcaactggacgctgccctcgtcggtgaacttgaaggcattggacagcaggttcttcagcacctgctggagccgctgcgggtcggtgcggatgtggcgcggcgcgccggggcccacctccacggtgaaggacaggcccttctgctccgcgacagggaggaagctgcgctcgatgaactgattgagctcggtgaggacgatgtcccgcggctccacctgcatcttcccggcctccaccttggacaggtcgaggatttcgttgatgaggctgagcaggtctccgccggaggcgtagatggtgttcgcgtactccacctgcttggtgctgaggttgccgtccttgttgtccgacagcagcttggccaggatgagcagcgagttgatcggcgtgcgcagctcgtggctcaccatggagacgaactcgtccttgcgctcctccagtcgcttctgctcggtgatgtcgcgcagcaccacgcacacgccacgcaacgtgttccgcgcgtccgtcaccggcgtcaccgtcgtctggacgtgccggtcgaagagcttcacctcctcgcgcagcacctgcccgcccccgtactcccaaccgcgcaccaggtggaagggctggaagcccaggcgctcctccatcagccgcgtcgtctgctcctcggggttctcccccgcgtgtagcagccgccgcgccgccgggttcatcaccacgatgtcgttcttctcgtcggtgaggaccacgccgtcggccatggactccaccatccgctccatgcggtggcgggcttcctcctccgccgagcgcagggactggatggcgtccgccgtctggttggcgagcacgtccagcaacacgccgtcgtcctcggagaaggcgtccggcttctggctgaacagcgacagcatgcccaccgggcgcccacccgcgaccaggttcaccgtgagctggctggggtacaccgacggcgccgccgcgtcctgggtggtggtgcccgccacgcgggtgatgacgcggtcctcgggcagcaggaggccgctgctcttgcggtacgcaccgagcatggactccttcacgcccagcagcgccttctcccccaccatgccctgacagcgcagccgcagcgtcgcgctgcgcgcctcgtccggtgcgatgagcgccgcgccgcagtcgtacggcagcacgcgcgccacggcaatgagcacgcggtcgatgatgttgtcgtagctggccggatcattcgcgctggcgcggctgacctcgtacaggacgaagagcgcctccacgcgctggtggagctgacggatcagccgctccttgtccttgcgcagctgcgtgtactccaccgcgttcttcacggtgatgagcaggtcgttcacatcccagggcttggtgatgtaccggtacacctgcccctggttgatggccgcgatgatgtcgtccgggtgggtgtatcccgtgagcagcagcgcggtgacgtcgaagccctccgcgcgcgcggtggccaccagctcgatgcccgtcatctcgggcatccgctggtcggtgatgaggacgtccaccggctcctttctcaggatttccagcgcggcggaaccgcttcgggccgtgaggacgcggtaccggcgctggaacatccgcgtgaggatgtccaggacgtcggcctcgtcgtcgacgaagagcagcgtgtgggggagctcggacaaagcagccgaagtgtacgtcgagttcgtccccccacctcaagaagtgagaaacaggacggaacggggcacaccgcgagtgtgcagggtgacaccggacgagttgactctacacgtctgttcagggagagtgacactgaaagcctgttgcctggggggaacgactccccggcaggacggcagacgagtgagggagcgcatggaagagctcacggaacgccagcgcgagattctcagcttcatcgtcaaggagacggagacccggggcttcccgccgacgattcgcgaaatcggggagcacatggacatccgctcgacgaacggcgtcaacgaccacctgaaggcgctggagcgcaagggttacctgaaccggggcgagcagcagagccgctccctggtggccaccaagcgcgcgcggttgctcctcggcctgggggcgcgcaaggactccggcatggtggagattcccctgctgggcaaggtcgccgccggcgcgccgctgctggcgcaggagaacatggaggactccgtcaagatcgacagcttcctgctcggaggtgtgaatggccgcgaggtcttcgccctgcgcgtgaaggggcagtcgatgattgacgacggcatccacgacggggactacctcttcgtgaagaagacgccatccgcacagccgggtgaaatcgtggtggccctcatcgaggacgaggccacggtgaagcgttactacccggaaggggaccgcatccgcttccagccggccaacgccaccatgcagcccatctacgtgagccgcgcggagttccggtccacgatgattctgggtcaggtggtgggcgtgtaccgcaagctccagggcggccgcaccccgtagtccaccccacccgtcccgggccgtttcctggcccgggcctgactcaagggcacttcttgagggtggcgtcagccgccgtcgcccgcgcgcaggcggcctgcaggatgccggtgtccttgagttcccgcgccagttgggcagtggcgacgtgcagttcggcgtccttcgcgtggtcctgctccgcgctgaggttcgcgaggatgcgcagcgcgtccggcttgcggtccatggtggccagcaggctggccagctcccgcagctcgcggatgtcctggccggacacggactccagcgccgcggacagctcctccttcgcggccgcggcgtccttcatccccaggtagatacgggccagcgccacatggacgatggcgcggtcctgcacgcgcagggactccttgtacgcgctgatggcgtccccgggcttgtccagcttcatctggatttcgccgacgagctcccagagcgtgggatcccgaggcgagcggctggcggcgtcgcggtaggcgttggcggcctcggtgaggttgccggcgcgcaccagggcgtcccccagggtggcgagcacgtccgcggtgtggatcccgtcatccacggccttctgggcagcgaccagcagctccgggtagcgctgcttcgaggacaggacgtccagcgcgcgcatgatgagcgcggacttctgctccggagagggcgccgcgttggacgcgagcgtgaagtgccgcacggccgcgtcgtggtcgcccttcttcaggtccaggtcgcccagcgactccagggcgttgaagtcctgagggaagagggacagggccttgcgcagcgaactctgggcttcgaccacctggcccaactgcgtctggatgaagcccaggcggctccagttggtggagcgcttgggctccagcttgagggcggcctcgaactcggcggcggcgtccgtcaggcggcccatggagaggtacacctcgccgcgcgcggcgggcaggcgcgggtcgtccggggcaatctgcttcatggcctcgaaggaggccagggcggcgtcgaaatggccctggaggtactcggcggtgcctttgacgtagaggccctccgcgtggtcctttggtttgacgcgaggcgtctcgtcgtcacagcccgtcagggcgagcagggcaatcagggagagggcgcgcggtcgcgggaacatgaggggctccgaggctcagaagtggtacgcgatgcctgcgttgaggtccaggttgaggccgtctcccagcttcgattccgacagccccagcaccgcctgcgcgacgttggtgcccaactcgacctggaagcccaccgagccggcgatgaggtactccaggcccgcgaagcccacgacggtgggcagcgggccggtggactggaagataccgaagtcaccgaaggacagctgcacgcccaggccgaaaccccagtagggccgcagggacttctccacgttgtggtagtggcgcgcgcccacgacgctgggcaacacgctgaggccactgcgcacgccatcctgcgtggagcgcacgtagctgaagcccacctggaggaagccgacccattcggggtggaaccagtagcccacctcgatgtcaccacctgggttcacgttggagagcttctcgatgaagttgttgttgacgcgcaggcccagcagcaggcctccaccccccgtgcgcgaagagccgcccagcagcgggcgggccgccacggactcctccggcggggcgagcgcggcgaagagctggtcggagacggccttcgcggtgcgcagcaggtcctccgcttccggggcctccgcgcgaggccgggccaggatccgcccgcccgcggcgtccaacaggttggcggtgagcaggtactggtcgccgaaacggtccaggcggccggccacgacgtagcgggcgccggtgagggccacgagttcctggaaacagtctccccggtcacacgtcttgaggccctggagttgctgctggcgctcgtcgtccagggcggcctcgacgtcccactgcgagaggactcgcagccgcggcgactccgccagccgcgaggtgatgagcgaggtgacgcccggcgccgcgtcgcggcccgcctcgttggcctccagcatcagcaccgccacgacgacgggcccggccgcatccgtcgtgctcgcctggaccgcggcggcctgtgacacaggggctggcgcctgggcatgcgccgccgaagccagcaagacgaaacaggagagccaccaggacacgaagcgcgacacgggccggcactctaccttcacctgggcccggcaccgaggcccagacgtcacacgacgtagcgccctgccccgccgactggagcaggaaggcagccgggcccgcgccgcctcgcctacgaggagggcatcggccccagaaagtcgagcgggtccacgggcttaccgtccaggcgcacctcaaagtgcagatggggcccggacgtccggcccgactcgccgacggtggcaatcacctgctcgcggcgcaccttctgcccggtgcgcacgcgcaggtcgcggttgtgcgcgtacagggtgatcagcttgttcgtgtgctcgacgatgcgatgttgccgtagccacgctgctcgcccgcgtagagcaccgtgccttcctgcgccgtcttcacgggcgtcccggagggcgcggccaggtctatgccgtcgtgcggctccttccccttcttcccgaagcggccgtacaggacgcccctcataggccagtcgagctgcccctgcgtggccacacgaggccggcccgcggcgctcgccggacgcgacagggaccggctgcgcgacgggggctcctcacggcgacccgaggtcggcacgctgcgccgccccccagccgacgtagaggtccggaccggctccgggtccgcctccgccagggcccgcacgggcacgctgcgctcgacaccggggatggagagctcctgccccaccgccaacgcccacggcgccttgatgccgttggccgcccccagctcctccaccgtgaggccgtaggtgcgggagatgcggtacatcgtctcgcccggtgccacgaggtggcgcacggccaccaactccggttcgtcgtggacgccccgcaaactgaacggaagcggcgtggtccgctccgccgcgtcggtgacttccgccgtctcgtcctcacgcgaaacggcgtccaacccggtgtccggcccggcaacggaggatgcccgggtgcccacgcagccgctcaacagcacggccaggaggaacacccggagcgccccacgcgctcggctggacacgcacggcgccaacgctaggcaccgtccggttcatgccggttgaagccatcgacctgccacccggagaggtccggaagccggccatggtccgtcagctcgaagtgcagcggagtgacggagacgcgcttgtcccgaaacacggcattgcagtcgctgcccgggatgtcctcgtgctggtagtcgctaccgccaatccagtagtacttccggccacgagggtcttcgttctccaccacctcgaagccgtacgagtgacggccctggcgggtgacgacgtagccctccggttccacgcccccagggatgttcacgttgaggagcatccgcggcgggagaggacgcgacagggcgctggacaccagcgaacgagcgaaccgggcccccggcgcgaagtcgaagttccgccgggccaccaggctgaaggcgatggcgggcacgcccaggagcgcaccctccatcgccgcggccaccgtgccggagtacatgatgtcttcggccagattcgcgccgtggttgatgccggaaaccatgagtaccgggcgatcatccttcaggagatggttgatcgccagataagcgcagtccgcgggggttccgtcgacggcgaaccaccgctcccgcacctccttgatgcgcagcggccggtgcagggagatggcgtgggaggcggcgctctgctcccggtcgggagccaccacccacacctcccccagggggctcacggcctcgaccagcgcctgaagcccctctgagaaatagccgtcgtcgttggaaaccaggatgcgcttgggcttgttgctcacgggctcacttcttctggttcaaggcgcggaacaccgacttgccagcgtagcgggccgcggcccccagctcgccttcgatgcgcagcaactggttgtacttggccacgcggtcggagcgggacgcggaacccgtcttgatctgcccgcagtccagcgccacggccaggtcggcgatggtggtgtcctccgtctcgccggagcggtggctcatgacggacgtgtaaccggcgcggtgcgccatgcgcacggcgtcgaacgtctccgtcagggtgccaatctggttcaccttcaccaggatggagttggccgtgcccgtctcgatgccgcggcccaggcgctccacgttggtgacgaagaggtcgtcacccaccaactgcatgcgcgaacccagcgcgtcggtgagcttcttccagccctcccagtcatcctccgccatgccgtcttcgatggagatgatggggtagcgctcggagaggccccggtagtactcgagcaggccggtcgagtcgtactccttgccctcgcccttcagcttgtacttcttgctgcccttgtcgaagaactcgctggccgccacgtccagggccaggaagagctgctcaccggccttgaagcccgcctggtcgatggcctccatgatgagcttcagcgcctcttcgttcgccggcaggtccggggcgtagccgccctcgtcgcccacgcccgtggccagcttgcggcccttgagaatcttcttcagcgcgtggaacacctcggcgccccagcgcaggccctccgcgaaggaggacgcaccggcgggcaccaccatgaactcctgcacgtccacgcgggtgtccgcgtgcgcgccgccgttgaggatgttcatcagcggcaccggcagggtgcgcgcctgcacgccgcccacgtagcggtacagcggcagcccgtgcgcgtccgccgcggcgcgagcggccgccatggacaccgcgaggatggcgttggcgcccagcttgcccttggtggcggtgccgtccagctccagcatccgctggtccaccgcgaactgatccgccgcgtccatgcccaccagcgcgggcgcgagcacgtcgaccacgttcttcacggccttctgcacgcccttgcccaggtagcgatgcttgtcgccgtcgcgcagctcgatggcctcatgctcaccggtggacgcaccggacggcaccgcggcgcggccacgagcgcccccggcaagctggacctccgcctccacggtcgggttgccacgggagtcgagcacttcgcgcgccagaatctgagaaatctcggtcataggctgccgtttctagaagagccctccgggtcgggcaagcgtgctcgcggcccgcgctgctacagtgtccacccgtcgaatgcctccgccccaacgccgccccgccttgaaggggcctgacccattgcttgctcaacggcgccgcggcgcgctgctcggcatggccgtgggcaatgccctgtccgtccccaccgcgcaccggcccttcatggccgttccctttcccaaacaggcggaggggccctacatgaagctgatgggcggcggtccgcatgagctgcgccgcggccaggtgacagaagaggtccagctcgcggcctgcctgagccacagcctccgggccatgaagcgttacgatgccgcggacgcactgcgtcgttaccgcgcctggcagccgcacgccttcgacgtcagcgagcccatgacggaggtcttcgaggactgccagacgtcgggattcccgcccctgggcgcgggcaggcgcgtgtggctgcgtgcgtaccggaagcccgcggacccggggagtctggcccgcgcggcgccgctgggcgtgtacctggcgggtgacgcccacgcgctcacccaggcctcgctggaggactccgccctcacccacttcgacccgcgctgccagctcgcctgcgcggccttcaacgcggccattggccatgccgtcacccatggcgcgggcctcaaggccgccgacctcatccccgccgcggagtcgggcctgctgctcgccggcgcggcgctcggacgttccgccagtgactatgtgcaggaggtgtccttcgccgcgtcgctcctgcgcgaggacctggccatcgcccagcaagaggacccgatgctgtacgggccggagctgcacctgcaccgtcccctgcacgcggtgcgcgtgcgccttccggctggccttctgggagctgctccacgcccccagcgccgaggccgcgctcctggacgtcgtccaccggggcggcgacacggaggcccacgccaccatcaccggcgcgctcctgggcgccttccatggcgagcaggccctgcccgaggagtggcgaaagcaggtcctggaggccctgagcaccgtcaaggggccgctgtgggatgtctatcacccccggcacctgctggccctgagcaacgcctgagggctcctgaatgcgcgaagcccgcggggccgtcctgggaaggaccgccaccgcgggctcggggacacactggcgcggccgtcaggccgctcgccagggtcaggacagcaggtcgatgaccactacgccccgctggggcttgtcgtcctcggtctccgtgcggcgacgcgggcggtcatccggcacggggagcggaagctccaccaccggcctgtcatgctcctcacggcggcgctcacggcgcttgatttcttcaatgatgaaggcgtcgagcatgggttttccgtctccctcagcctacgtaccccgatgtacgcccatcccgccccaataccatttccatcaatatcagatgcaaattaagaaccccggttccgcgctgggtacgttgcagccatctcgcacggttgcccgtctgccacccgacacccaggccagggcacccagggcagaaatgtcgtggaggccgaaaatccatcgggatggtgttcattttaatgccctcgaagcggcccgcaagcggaccgtcccatgggcatactcctcgtatccggcgtcgcaagccccttcgattcggcctcgtccgcccgcctgctatggcgcgcggagcatccgggtctccgaagactcctggcggccggcgggcgatggtggagtcgcccgccaagacgccgcccggaggtgtgattcagggcgcctcgaagcggcgcttgaaggcgtccagcatcttcggcaacgaggtctccaccagcgcggagacgacgctcttgggcaccagcgcgcccagagccatctccacggtgtaggtggccttcgtcttgccctcgccctcgggcaccaggacccagctgccctggttgtccttcatgaactcgcccttgatgtaggtccaggacatgcgggtgggccgctcctccgtgacgtggatggagtagttgatggtcttcaccacatccaccttgtagtggacgtccaccgtgttgcccttgcggttctcggtccggatgcccttcacctcgggaaggaactccgggtaccgctcgtactgggtgatgacgtcgaagaccttctcgatgggggcgttgacgatgatggttcgcgaggcgccaggcatgggtgtctccaggggacgtgagtcagggtgggagctgcggcctagaaagcgtaccccggcttcttgtcgaacttgtgcaccgactggatgaagcggacggtgcccgtcttgctgcgcatgacgacggagtgcgtctcgcagccgccgccgaagaagcgcacgcccttgaggaagtcgccggtggtgacgccggaggcggcgaacatgacctcgcccttggccagctcctcggcggtgtagatcttcgagatgtcggtgatgcccatcgacctggcgcggtcgatttcgccctggttgcggggaacgagccggccctgcatgtcaccgccggtggcgcggatggccgccgcggcgatgacgccctcgggcgcgccgccgatgcccatcagcagcttcacgcaggcctgcggcttggtggccaggagtttctggaaatccgcggcgcgaatctcaagggccgacacgtcggtgacggcggtggcggtgcacagccgctcacccttctgcaccagggccagctctcccaggggctcgccggagccgacctcccccagggacacatcctcacctccggcgctcttgccgctcaggcgcacggtgccctcacccacgatgaggagtgactcccccgtcttgccttcggcgaagagcacggttcccttggggaacgcacgcgtgacggcgaccccggcgaaaatctggatgccggtgtccgtgaaacccttgaacagcggacacgccttgagcgttgtggcaggcacgagagccatggatgtgctcctaacacgcccagcgtaggctcgcgagcgactcagcggtccgtgtggtactcggccgcgagcagcacgtagtgctgcgcggacatcaagaggaactcacgctccgtctcggtgatggggcgcttcacccggcccggggagcccaccaccagggagcctgggggaatcttcgtgcccggcgtcagcagggctcccgcgccgatgatgcagtcgtcccccacttccgcgtcgtccatcacggtggcgcccatgcccaccagcacccggttgccgatggtgcacccatggaggatgacgtggtgccccaccgtcacgtcgtcccccaccgtggtggcggacctgccgctggtgacatgaatcagggacaggtcctgcacgttggtgcgcttcccgatgcggatgggattcacgtccccgcgcagcacgcagttgaaccagatggaggagtcctcccccacctcgatgtcacccaccaactgggcggagtcgtccacgaagcagcccgggtggacgcggggggagacacctcggaatggcctctggggcatggggctacgcctccgcgacgacgtggaacggcgcctcggccatgggcaccggcagcggctccaccgtggggggcttgagcagggccacctgcttgcccgcgagctggttgggcgtggcgcgctccaccttcaccgtcacgaaggagcccgcgggggcgtccccatcgaagttgacggtgcggttctccggcgtgcggccgaagcgcttggtggcgtcgtagcgcgagtgcccctccaccatgacctccacttccgagcccacgagcgccgcggtgatttcgccgctgatgcgccgctgcagcttctgcagccgctccaggcgggcaatcttcacctcgtgcggcaccggaccccagtccttctcgcgcagggccgcgcccgtcttgggccgcgggctgtagacgaaggagaactggttgtcgtagcggacctgctcggtcagctgcatcgtcatctcgaactcctcctcggtctccccggggaagccgacgatgatgtccgtggtgacggcgatgcccggccgcgcctcgcgcagcttcgccaggcgctccaggtactgcaccaccgtgtagtcgcggcgcatcatcttgaggatgcggtcgctgccgcactgcaccggcaggtggaaatgcggggtgatcttcggctggacgcggaaggcttcgatcagctcgtcggacaggtcatgcgggtggctggtggtgaagcgcacgcgctcgataccggggacctccgcggtgcgcagcaatacctgcgcgaaggagatgccgcccgcgtacgagttcacgttctggccgatgagcgtcacctggcgcacgcccacctttgccaggtccgccacctcgacgagcacgtcggggaacgcccggctcaccttgcggccacgcgtgtgcggcgccatgcagaacgagcagacgttgtcgcagcccgtcatcaccgtgacgaactcggtgaccttgccgcgggacgtctccgggtcggcgcgcgggaagacgtactcctccgagttcacgaaggccgtctccaccacccgctcccgctccgcggacacccggccgatgatgtccggcaggcgcgcgatgttgtcggggccgaagacgaagtccaggtacggcaccttcttgaggagcttgtccttctcctgctgcgccacgcacccgcccacgccaatcagcgcgccacggctggccttcaccggcttgtaccgccccagggcggacagcatcttgtcctctgccttctcccggatggagcaggtgttgaggatgatgaggtcggcgttgtccggcaccggcgtcggcgcgtaggacatctggctcaacacctcgctcatgcggagcgagtcgttgacgttcatctggcagccgaaggtgtggatgaaatagcgcttcatggaagaaccctgagcaagtacgtgcccttatccgatggccggacgcggaatgcaaccagccgcccgcccgccttcatccccggctgagcaggtgcgtcaggcgggtgtgcaggtccaccagctccgcttcgcgggcccggagcagcaccagtgcgtcctcgccgtaacgccgcgccagggcattggtttcgcgctcctgcttggccagctcgtcctggatgcggccctggagctcgtccgccgcgccgccctggagctgccccagcttgtcctggagcttgcggaccgcccagcgccgcccgccgaaggctcgcagcagcgcgctgccctgctccgccgtcttggggtccagcccggacgcggccagggcctcggtgtgggccttggccagggtctccgttccctgcccggaggcctgggcaaggtaggtctgctggtagcagaccagggcgtcgagcatcgccgcgtccagcgggggggcggcccagcggagggtgcggtcgtcggcggcggtgaggtccgtggacgactcccggttggggacgtcctgaaagccgttgtcgtcgaagaggaaggaagacatggggaggtgccttgcggggggggaatgggcccgggactacgcgggcacgagctggtcggcgatccgggccaggtccgacacggaggtgacgacgacggcctggtgacagtgcttctcgtaggtgagcatctcgctgtcgccaatgccccagttgccacgctcctcggggcagatccacaagagccgcttcgccttgcggcgcaggtccttgagggcccaggcgttgttcgcgttgtagttgttccgcccgtcgccaatcaccatcacggtggtccggcgggtgatgctgcccaggtggtcccgggtgaagtcggccagggcgcggccgtagttggagttcgcgctcagggacaccgtcttgcccgcggtggccatatcgatggcggcgtcgacctccaggtccttgaagtactgcgtcacctcgcccacgtcggacacgaagacgaacgagcgcacgcggacgaagagcgactgcatcgtgtgcatgaacagcagcatcatccgtgaggcctgacggacggagtcggacacgtcgcagagcaccaccagctccgggcgctcggggcggcgactgcggaactggggcaccatgggcaccccgccccacggcaggttccggcgcagcgtgcgccgcacgttgagggcgcccttgcggtgcgagcgctgcttccggatgagccggctgcgcagcttctccgccagggtgcgcacggcggactccatctggtccacctccgcctgggtgagcaggtgcagcggcttgtccgcggcggagtcggtgcggcggcggatgcgggcctccgcctggcgcttcacttcctggcgggcggcgtcctcgatcttccgcatcgcggccgcgacatggcgcgagacaatctccaccccttccggggtgaggccgcgggctcgcagctcgtcttcgagcgacttcatgtcgttccgggccttgtccgccccagccgccgccagcatgcgccgggagaagaacccggcctggagcgggctctccatccgcgacaggtccaactgcagcgaagccatccggaagatctgcgccagccgggcccggtctcccatcagcacggcctgggccaggggggacatctccgggaggagctggtgcatctggatgaggaccatcttcagcaggtcgccctccaggtagccttcctcctccaactgctgcgccagcgacttgtcgatgtcctcgaacgtcctcgccgcgccggagaagtagaactcgaaggcccggttgaaggtgtccacgtccagctcgcgcttcaccagcgtggtgcggagcaccgaacggaacaggttccgatccttgaggcctacctcggacgtggcgcgcagcgcgtcctggacctcggacgtactgacacgcacaccgttctggcgaaggacctcggcgaactcgacgatgcgggcatccacgcaaccatcatgtccggggatggcccgcgcgcaatcgggaatgcacaaccatgaagcgagcggacgcctgcctccctggtacacgcggtgtaatcactaaaatttagtgaattaccgcttattcaagactgcggtcgcgatccacccactgcggtttcagaggggaatcgggcaagccgtagcctgagcgccgatggacgcccgaatctcgctgctcaacagagcaaatactgacagtacgtgttggtgctgttcaggccggccgctcgaaggacatcacggcctcgacgtgatgcgtctgagggaacatgtcgaccacctggagggccaggggcttgtagcccgcggcaaccaggccggcggcgtcccgagccagggatgccggatcacacgccacgtacaccacgcggcgcacccccaaggcggtcatccacttcgccaggcccggggctcccgcgcgcggcgggtccgcgaggcacacatcgaagcggcgctgctcggccaccagcccgtcgcacaccttgcgggcgtcgccctggatgaagcgcacattcgtcaccccaccctcgtgagcgctccgctgtgccaactcgacgcccacgggggaggactccacgcccagcacggacgcggcggttccggccagcgggaaggtgaagttgccgttgcccgaatacagctccagcacggtgtcggactcgcgggctcccagctcgtacacggccgaggtcaccagccccacgttggcctcggcatgggcctgagcgaaggcatccggccgcaggtacagggggacttctggccgcagcggcgagtaggagcgcagcgccggcttgccaagaagccgagccgatccttccttcggcgtcagcaccgcgccctccagccgcagggcgcgcacggccgcctcggcggcctccaggtggcgcgccgtcaccgggccgctgtagag

SEQ ID NO: 1236 - DNA, 29103 bp, Myxococcus xanthus
  unsure (1)..(29103): unsure at all n locations
agcaaggcgcagcagctcgtcgggggtgatggtgacgtccaccgtcaccacttccgtgcgcggcaccatgacgtcgcggcagcgcttgtcggacagctcgaagatggagcggatgagctgcggggcgctcttgtcgacctcgttcttcgcggcctgggcggccagcagcttctccaactcctccagcggagggggcggcggctcgaagcgcagcgtccggccgaaggtgcgcgccatcaggttgagcaccaccatggccatgcgcatgggcgggtagagcaccgtcaccagcagcgaggtgaagcccgacagccgcagggcccagcgctccgggctgccgttggccagcccgcgcatggtgacttccatgagcgtggccagcacgcccaccagcagcgcgcccgcggcgacggtggccaccggcagccacgcggattcgccgtagcggctgaagtccagcatgcgcggcgggacgaaggcgccaatggccgcggcctggaagccgctgagcaccatgcccaggcgcagcgccgtggccacgggctcgcggtccgtcttgtggcggaggacccggcgagtcgcccggcccggctgcgtgttcgccagttcctgtgctcgcaagtcggacacgccgtagagcgcggactccgaagcggcgacaagggccctgatgaaactcagcgccaggcaggcgacccagagggtccaggtaggcatagagccctgttcttatcccgtgctaagggtccataccactgcgctggagctctgatgtccgctcgcatgtacgttgttggagcactcctggcccttctcgtcccgacgctcgcacgtgcgtggccggtggacctggtcgtccccctggagcccgggaaggaacgcttccacaagctcgacaccgtggactgggtccaggtggcggacgcctccgtggcggacgcggagctgcttcccgggagcaatgaactgttgctcaccggtcagaaggcgggacggacgctgctcctgctgtacgcggggggccgcttcgccgtgtggcgtctcacggtgggctcaccgccgccggaggaccccgcgccccggctggccgccgcccgcaaggcctgtccggacctgaacgcgacgagcggcgcggagcgctccctcagtgcttcggtgaaggactccgcgtgcaggttggcgctgctggagctgctgaagacggactccttcgtggctcgggagctggagttgaccttcgagctccccgtcctccaggagcagctcacttcactgggggaggggttgaagccgctggggctggaggctcgttacagcggtgcgggcgtggtggtgtcgggcgcgggctcgccggaggtgcaccgcaaggcgttgtgggagttgttccaccgctccgtgggccgggtgccgctggacgaccagattcaggaagtgaagccgcccgagcccaccgacgccggtgtgccggacgcggtcccgcccgcggtgcaggcgccgcgtgagattccggtggaggtgctgccgccgccgaagaagtcacgcacgcgctgagggctttggcttggcgtgtcgcgggcttgcggtatgacgggaggctccctctttcgcccgcgcgcttcagccggccgcggccgcttcttcgtggaggagcccgatgcgtttggcagtccggttgaccgcgcaggcgtgggtgtcgagcctggcgctgctgatgcccctggtggcgtccgcgcagttcgatgacgtggatacttttccggcctccgagcccgagcgcggctgtccgaagcgcccggacgtggtgcccttcactgcgcgcaacctggtgggactgccgggctcgggctggctggcgcaccaggccatcatcccggagtcgaaggaccgcttcttcgtggagtccgagcgcgaccgctccggcgtgaagctggtgccggaggatgtggacgtccggaagctgggcgcgccggacccgtccgtgcccttgtgggtgttcggcaaggcggactcggcggcctgccgcgcggtgcccgtggtgtggtgggcggtgcggatggggacggacgcggaccgcaagacgtacctcatgtccgagcttcaggtggactgtgacgtgctgcccccgggccggctgtcgggtacgccggtggcgctgcgccagaaggacgcgcccacgggctgcaagctgcgccgcgccgacgacaactccaccagcgacgagggccgcggactgcccctggagctgtcggacgtgcttcccgagcgaacgtcgtgcgaggccccggagtgccagcgcaagtgggagattttcagcagccggtgggatgacggcagcgccgtgttcgacatcgcggtgtcgtggatgaagcgtggcgggaagaaggacccctgcgagtgggccacggaggaccacaccgcgctgctgctccggccggcgggggcgctggcgccgcttccgctgcgctccggcggggccttcttcggcgcgctctatgacagcaccgggcttcgcaccgtcttcagccgcaccttgggcgtgctcaacgtccatgacgccgcgaagcccaaggtggcgccgaaggcggtgcgctacggcagccccacggaggaggagctggcgcacgggaagcgcacgttgtcaccgtgcaagaagtaggggcgtcggggttgagtccctgaatcgaaccgggggatgattccctctcctgtgttctgggaaggggggcgccatggccaatacggtcggtgtcaacaagatgtccgtggtgaccaaggactccaacggcgtgtccgtcgcatttccggatgtctgcaagacgcccagtccggcgggccccattccgctgccgtacccgaacgtggcgcgctccgccgataccgcccagggcagcaagacggtggcggtggaggggaaccccttgtgcgtgaaggactccaacttcagcaccagcacgggggatgaggccggaacggcggggggcggagtggtctctggcaagacccagggcaaggccgagttcgtcaacttctccttcgacgtccaggtcgagggaaagaacgtggcgagggccctcgacttgatgctgcacaacgacaagaacacgcctccgttcccgctgatgcagccaccggtgatggcggccggccagggctcgggcaagtgcaactgcctggtctgcgaaaaagagatgtagcgcgagggggcggaatcccatggcctcacacgaacatgacgccgggcgcccaccttctcaggtggaggagcccatcctgggaaacctcatcggccgggtcgtcggacgggggcgaatgggcacggtgcaggtggacttcgagggcaaccaccatgggccgctggaggcccggctcgcggtcgcggtggatgaggccacgctgcttcgggcgatagaggcgcggcaggaggcggtgctctgtttcgagcggggcacaccgacgtgccccatcgtgctcggtttgctccagccgcgcagtgagacgcccctcctggatgccatgctcgaagcacctgatgtcgagcaccaggatggagaggtcgccatcgtcgccaacggccagcgagtccccatcgaggggcttctggacggcgcgaccgaggagctcgagcttcgctgcggcaggtccagcctggtcctgcgtcgcaatggtcagattctgcttcggggtgagcatgtgctcgtcgacgcgggccaggtgctgcgccttcgtggcggcaagacgcagatcaactagacagggggcatgacgtgatgaacccgttgccccggcacctctcgctccccatctcctgggagatgctggcgtcacacctcgacgaggcgggattcctgtggcggcagtggaagcgtgcccttgtggcgccggaccatgtcgtcgatgacgtcgctggggtggaggcgcgacttctcgcccatgtggatgcgctcgtgctcgcgggagcgcaaggccgcgacgaggctgctcgttcccgccctggccgaagcggatgagcctgggcgggtggagtgcgccgcgctcgggctgctgcttcaggaagacgccctgnatggggctgtgcggagtgacctcgatgtgctccaagcgggggaggagggcctgtgcgcgggcatccaggccgcgctgctctgtgctggcggactggggctggagtcatggctgcggaccatggtcgacgcatcgcctacacctggagggctcgcgacactgctggagattttgggggcgtggcgagtggaccctgggccggggctggaggcgtcgttcacgcatgaggccgcccaggtgcgggccgccgcgtttcgctgcctgcgctcttggacagtccggttgtccgaatccacgctggaattgggactgcgctcatcctccgccgaggctcctggcgctgctctggaggcagggctgttggcgggaagtcgactggcgtggtgggaattccgccgtcaggtcctggagggcgggccgcaccgccagagggccttgcgagcgctggccgtggcgggtgggccggacgcccagaagttgctgtctggagggtctgggagaccctgcccgagggacggagcccttgagggtggtcggcctgttggggacggtcgagactgctcgggcctgtctggaggcgatgcgcgagccgccatgggcgcgcctggcggcggagtcgttctcgctggtgacaggcatggaggttcccgcggtggctccgggcgtggagtcgggcgacgaggcggcggccgtggagttcgcgccggaagcagacctcccgctgccggatgtgccccgtgtggaggcgtggtgggccgagcacgcccctcggttcaagccgacggtgcgctacgtgcggggacggcctttgggacaggagtcgttgctcgacgcgttacgagaagggtcgatgtatcgccgccggtcgctctggtgggctgtggccctgcggacccggggcgcactggggttgggcgtgggcgcttggacacggacccagcgcgcggaagaggacgccgtgaggcgcctgccgccagcgcgttttgcccagtcgctggagggaggcttgggcgcgtggggtggggcatgaaggtgttcgtcgaggccctggggatggcctcatgcctggggccggtgattcccgcctgcgcagcgttccgggccaatctgctgcgctcctcgccgtctcccgacgtggacgtcgcccacgccggtgatgaggcacctcggcccgtgacaatctgtgcgctcccggtggcgacgttcgggttctcgggcgtcggtcggctggtggcgttggcgtgcgaggtgctcaaggatgtgggcactcgcgtggacctgcggggccttgggccggagaccggcgtctatctggcgctgccggacccgtgggagcgaggccttgacctgggcgagccggacgcgacggaggcgctgcgagtggaggcgctggggcgtcgtgtgttggaggcgagcctgcggaacatgggcctggaatggcccgggcccaggcgcttctttggcggtgggcacgtggccttcgcgagggcgctgcatgcggcccaggcggcgctgcagaacggcgggcttcgctcgtgcctggtgatgggggtggactgcctggtcgaagagccgacgctccatgcgctggcggatggacgacggttgaagacgccggagcagcccgtgggcttgacgcctggggaagcgggtgcggccttgttgctgaccaccgaggggcccgcgcaacgttcgacgggcgcgccccaggtgatgctgcacgcggtgcggctcggagaagagccgcacccgagaggctctgacaagccatcggatgggcgggccctggcggcatgtgccgaggcggtgctcgcagccgcaggggcccttcgtgcccggccgctcctggtgagcgaccacaacggagaagagggaaaggcgcgggagtggggggatggtgttgctgcatctgcgggcgttggacgcctcgctgggggacttccgcggtatcctcctcgcttgggactggggcccgatggccggacagccttggtccggtcagggactgcaacgcggcgatgcgccttcctccgtgagccttgtcttcgccagcgcggacgattccggccgaggcgccgtcttgataggaaccactgctgcgcatccgtccagaggagctctgccatgacaaccggtgacgcccggcacaatcccaatacggaaatggcccgcaggctcaatggcatctacaagcgcaacctggctcggaaggaatctgcccgggccgcggccaaggaggaggcgaagaagagcaagccgaagaagaaggcggagcccgctcctgacggacatctggaccccaacgcgccgttgaatggggtgctggccaagggcgataactatgcccgccgcggctacacctacctcaaggcccaggacggccggggggtgtaccgcaacttcgaccatgtgcacctgagcgaagtccgggacatggtgaaggagcgggcggagtttccaggggggccgaaggagaacttcaaccccacgtacacccagcagtatccgtacgcctgggaagctcaccacatgctgccgggctcggccttctattacatgatgaaggacggcaagccggccttcacgtacaagcagattcggctgttgctgatgtccgagtacaacatcaaccacgggcacaacatcatcaatcttcccgccgaggactgggccgtcccggtccattccctcatctgccatccgagcgaccacgagtcctacacgatgcgggtcatggatgagatgcggaaggtggccaacgatttacagaagctgattgatagtgggaaaccgcacggaaatttgccagaactcatctttgaagagctcaaaaagctggagaatcggttctggatatttattgtcaaactcagcggaaagctcgttgaagcaaaagtcgctggtgtccgatatgtcggccctggttcagagcacgttaggtacgccaataaagatggcggaacgcactatgagtggggcagcctttggtaggagcaatcatggctaattactgggtgttgcgggcggagtctgcagatggggctatcattgatgctttgcccaaggacagtccgaccaattggaagttcagtacgggcgagcctcttgcgcggagtttccctgcaggggggaaggtgtcgttctcggaccacttcccggaccggcgtaaactctatgatttcgtgcgaaataccattggtgtcgtactcgcgtcgtcgcgagtgagacatgttttggagagcttgaaggtcgaaaatgcagaatttcttcccgttaccatgtgtgatcaccagtggggtccggtggctgatggttatggcatcctgaatgttctgggctcccaagatgcgatcgatatggaaaagtcgacctatgacatcagtgctctctctcgtgaaattagtcatgtcagtaacctggtgctgacggtagggaaaattgagccgcaggccgacatcttccgagcccgcaacatgatggagctcatcctcatctcggaccgggccaagaatgccttcgaacaggctggcttgacgggcttcaagctccatcccgctgaaggcttcgacgacatgttcgcttgagagttctctgtgatggactattgggttctcaaagccgagtcggcggatggtgcaatcattgatgcactgcccgagggtagccctaccaactggaagttcagtcggggggagccgctcgcgcgacagttcccagccggagggaaggtgtcgttttcggaccacttcccggaccgacgcaagctctatgacttcgtgcgaaacaccgtgggtgtcttgctggtgtcatcacgtgtgaaacaggtgctggaggacttgcaagtcgataatgcggagttccttccggttgccatgtgtgatcatcagtggagtccagttgccgaggggtacggaatcctcaatgtgttgggctctcaggacgtcattgacttggaaaagtcagattgtgacattgacccaataacgaagaaggaagtgacccgggtcggcaaccttgtcttgaatcaagggaagatcgaccccaaggccgatatcttccgcgcccggaacatgatggagctcatcctgatttcggaccggaccaagcaggccttcgaacaggcggggctgacgggcttcagggcccatcccgccgaaggcttcgacgacatgttcgcctgagcctggaggaggcagcgtggcaaagcttgcggcactgcgggaggactccgggagggcgattctccagttgatgcgtcaggtcgatcccaccgcgagccgagatgtcctcgtgcggaccgtggatgagctctgtgtccacttccacgtcgtggccgtggccaccctgctcgtggatggcaacccgcagggcttcttcctgaacctgtgccgagccgccgagaactggaggcgattgctcacgcactgccgcctcaagcagtgggcgctccctgcttcgcgacacatggatcctctgctcggtgccgtcgcggcgggacattggaatctggcgcgacaggtcgcggagctctccgagacgcggtggcttccggacgaggagtaccgctccgagcacgcacgcgcccagctcttcctggcgctggtctcgcccggtaccagggacgtcgtcatcccgagggtggaggcgttggagggactggggctcgagacagagacggaccgggttgcctgtgcccgagccctgctcgatggtgacgcagacaccttctccgaggcgttcaagcacgcggtgctcgtgcatggagaggacatcgagaagcgcgcgaagctcttcacgacccccgtgacacgcttcgcgcccaagcgagccatctggttggaggggctcgcctggctcaggctctccgagcgcgcggacatcgcgagcttcgatgagcacttccaatactgcccgccgctggcccgcacgcccatgacgtcccagtacgccggggactgggtcgtttcgctcggtccttgagcgccgcggtgcgtccccgcccgtggcgcctccagagtggagcggctacagctcccgcgactgctccgccttgcgctgctggtcgcggacggccagctccttggataggtagggcttgagcctctggctcgtgtacgtgagcgtcaggctgcgcgctccgggctcctggctgccggtgagccgcagctccgtttcggtttcggtccaggtgctccgcagcaggtattcgtgaaccgcgagggcggcgtccgtcctcgcgttggcctccatctgccggccgaagttgtccacggcggggccactgggctgcacgccggagcgccacgcgtggtagttcgccgaggcctcggagaggttgttggccatctgcgccagcgccaggcggccctccgcgtcgcgcgccgagtcctccctggtcgcgggcttgccgtacttcatggtgagcagctccgccaccgcgttgaagttgtcgcggacggcgcctggcgcgtggaagtggagggtgacctcggccaactgcccctgggcgaacacgtagtaggcgtccgctcggcggcccgccacgacgtcggcgacgtgcacgtccccccaggcgttgatgacccgggcgtggaaggggagcgcggtcatggcctcgtccttcgtcatcccccagcgcgtgtcttggaagccggagttgctgcggtaccgctcccgggcgccctcctcgcgctcgacgtccgccagccggatggcgtcgcggcgttcgagcagcgcctggtgcttcgcggacgtgccgcaggcggtggtggcgagacacagcggcagcaacagggcggaactccatcgcatgggcggctcctctggcggtggcgtagggccgtgacggcccgccgcttccgatattcaaaggggctcgcgccatttcgaaagcgccgggcgctcaggggtcggccgccgcgccttccgtccacttcccgcgccgggtgggctccttcatcgctcgggcaagcgccgagaggaagcgcctgcggggccagttctccgcgccgaagcgggccaggtgttcggtctccacctggcagtcgatgagctggaagccccagccctggaagcgctccgccgcggtgacgaaggccaccttcgaggcgtccggggccagcgcgaacatgctctctccaaagaaggccgcgcccagggacaccccgtacaggccgcccttcagctcaccctccgcccacgcctccaccgagtgtgcgaagcccgcctcgtggagcgtgacgtaggcctccatcatctcctcggtaatccaggtgcccgtctgtccgggccgaggcacctggctgcattcggtgatgacgcgccggaaggcggtgtcgtagcgcacctcgtagatgccgcgggccatcgtcttgcgcagcgagcggcccacgtggagcttgtccggcgacagcacgaagcgcgggtccggcgagtgccagaggatggggtctccctcgctgtaccaggggaagatgccgcgggcgtaggcggccagcagccgctccggacgcaagtcaccgccaacggcgacgacgccgctcttgtcggcgcgctccgggggcgggaagagctccgggtgctcgtcactcaacaggtagatgggcacggcgtgccactctaccgggagacgttcagcttcaccttgcccgtgagcgaatacggcacgcgcagcagcgggcccgtcacctcacccgtcaccccgtagggcagcagccccttggagatgagcgccttcacctccgggccccaggtgtccttcgtcaccgtcagttccaccgggtacacgcccgtggcggacgcgtccacggtgtccgcctgcgccagcgtgccgctgtccagcgtctttccggccaccgacgccgtccacgtcaggccttccagccgcagcgggaaggggttggggttgcggacgcccaggcggaggttgagctggacctcctcatccgagtagcgcgccccgtccaactcctccaccaccaccgtgggcagccggggcacccgcgccgcgcggctggcggcgaagggaatcgtctgctcctggtctcccgagcgcacgacgagagtgccgcgcagggcgagcagcagcgtgcctccctgggcgctcagccgcgccaggtcgtccgcgttcttcacatagggtgcgcgctcctcgaaggagaggtccgtgggctcgccgggcgtcagcgccacgtccagcttcgcggtgtccgtcttcaccacctggccgtcggcgacgagctcgtagtcggcgcgcaccagcaccccctccccggggctggtcacctgggcctcgaagcgcagggtggcgtcggtgaggccctgggacgcgacgacggtccgttgggcggtgaggacggcgggactggagggccgggtgggggcggaagcacaccccgcacagaggaaaagcaccactgccagtcggaacatgggcgagggcaagcgcatgacgctagacaatgtggccaccccctggagtcctctcaagggcttttccgctagactgtccaccacccgtggcccaacgccgccccaacttcaacaagacgctccgctctctcatccgggacatctcggcgaagatgccggagttcgggcatgtgaaggcgggccgcatcctcgtggtggccggtgaggcccgccgcgcctcccggggcaccgtgaagcccctgtgcttccggggtgggaagagcacggaccgtaccggacgccgcaagcccatcatccgcatcgggggcaagcggatgctgtactgcgtcacgctccggccgctcttcttccgggggtccaccgcgcaggctcgcgtggagacggtgattcacgagctcttccacctgtcgcgccgcttcgacgggacgctgcactccggccggcgccatgccgtgctggggcgcaacttctctcgcaagctcaagccgctggtgcgccgctacctcaagctgtgccccccggagctgctggccgccatggcccactccggcgaggtacgcatcctccagtggctggagcggcccggtcccgcctaccaccccggcagccatcgccgggtgcggaaggtctacaccgaggaacagctctactccggtgtcgctcgcatggtgacgcccaaggtgcgtctggctcgcgacacctccgcgcgctccaaggttcactgagcggcgcgctcccgcacacccggattcgcacaggggcgggtttttcgccaatcgtttgactttgaaaatcagtatcaatatcgtcgccgtcgtttcgagtcaggagcggtgatgcgcgacggttgccacggtgaaggcggggcggaggagctgcgctgcatgtgcggcagcctgctggcgcggttggtaccggagggcgtggagctcaagtgccgccgctgccaccggacgcaggtggtgcccctggagcgaacgccgccgggaggcggtggtggtggtgcccaagtgagcggctcaggccgctgacgtgtgagtcgttcccgggccgcgcaggcccggtgcagtgaggtcttttcctgaggcccgaggccattgagcccagcgccctacagggccttccgcgaaaggcccccggccttgcgccggaggacgcagcatggcgtggcgtgggtgtttgctcttcgtggcctgttccatgccgtggacggcgtggggcggtggcagtgaagcgcctgccaccgaggtggcttccagcgaggcttccaccgcggaggctccgcccgatgcgcaggtggcccaggccgatgcggggccggagcccgcgttagacgcggaggcgctgccggaagcgcgcacggtggtgacggcgtcgcgttcgccggagcggctcgaggattcggcggtggccacggaggtcattacccgctcggacatcctggccagcggggcgcgggacgcgtcggagttgcttgccgcgcaccctgggctccaggtggtgcagacgttcgcgggcgccacggtgcagttgcagggcctgtcgccggagtacgtcctggtgctggtggacggtgagcgcgtggccggccgggtggccggaagcgtggacctgtcccgcctgtccaccgaggacatcgaacaggtggaagtcgtgaagggcccctcgtcggtcctctacggcagtgacgcggtggcgggcgtggtgaacctcatcacccgccgtgcccgccgtccgctgggcgccgagctgcgcgcctcctacggctccatgcagcggctggagctggacgccaccggcgaggcgaagggcgagaactgggggctgcgtctgagcggcggtctggcgcggcgggacgcgtacctcctggacccgacgagcatcggcaccacgggcagcagcctggatggcatcgacgcgtccgcgggcggtgacttgcgcatcagtgagggcacggcgttgcaggccaacgccacctatgcgcgtcgggtgcagcggggcgtggacgtgggcgtgacaggcgccatcttcgaccgcgccagccgggatgactcgctctccgttcgcctgtctccacagtggaggctgtccaacaacgcctcgctgcgcgtggatggcgcctatgcgtggttcaaccggcgctacctgagggaccagcgccgctccaacgcgttggacaccatcgaggacacgcgcgagcagcagggccggctgggcgcgcaactggacgcgaagctgggagacacccacgccttcgtggtgggcgcggagctgctcggcgaatggttgcaggcggaccggctgggcgaagacggcaccggccagcgcgcccgcgcgtccatctacgtgcaggacaactggaccctggtgccgcgcttgaagctgacgctggtgccgggtgcgcgagtggacacggacacgcagttcggtacggcggtgacgccccggctggcggcgcgcatggacccgacgtcctggctcacgctgcgcggcagctacggctgggcgttccgggcgccgggcttccaggagatgctgctcgacttcgaaaaccccagcgtgggctaccgggtgcacggcaatccggacctgcgtccggagcgctcgcgcagcttcaatctgtcggtggaggtgaagcccgcggagtcctcgctcctgtgggtgagcgccttccagcacaaccttcaggacatgattggcgtctccacggaggtggtcggtccgcagcagctcttcacctacgtgaacatcgcgcgtgcgcgcgtgcgcggcggcgagatgggcgtgcgtcagcagttgcccggccgcatctccgcggagctgggctacacgctcaccgacggtcgttcggaggagacggggctggcgctggaagggcaggcgcgccatcgcctcaccgcgcaggctacctggcgtcaccggacgtcgggcctggaggcctgggtgcgcggcgcgctcgtggggccgcgtcccttctacccggacacggacggtgacggcgtcgccaacccgtacgacgcgaagacctacgtcaccgtggatgcccggctgggttggcgcatgcgcgaggagctccagttcttcgtgctgggcaccaacctcgcgaacgcgggcaaccccaccgaccttccgattccccctcgcgccatccaggccggcatctccgcccggctctgacgctcccttccacctctcactcaaggagtcccgatgtcccgcttctcttcccattcctccttcctgggccgcgccgccgccgccctgctgctggccggttccctgtccgcgtgcggcgatgacctcgagctgccatcagagaaccctccgacggatggctcccacgtgaatcacgtggccaacgatgacggctcgtacaccaccaccgtgaacgcgacgagcagcgcggactggattggcctggacctggacaagggcgcgcaggtgagtgcttctgatgacactgtctgggacctggccttcaaccgcttcaacgtccgcacccggggcggcgtgagtggtaccggcaacgtggcggtggcggtgctcctcgagacggacttcgcggcggtgacgcgggctcctgcggacggctacgtcgcggattccgaggacggcccggatcggggcgaggacccggacagcgccttccagcagggcgacgggtggtacgtctatgacatgacgacgcacgccctcacggcgcgtcgcaatgtgtacgtcgtccgctccgacgctggtgactacttcaaggtcgccatgcagtcctattacgacgatgcgggcacgccggggatgttgtcgttccgctgggcgaaggtgcctggccccgcctccagcggcagcgcggtgacgcagccgtcctcgtactgagcctccttccacttccaggtgtccaacatgaatcagaccgcgaactctgatgtcgtttccgagtcctcccgtctgcgccagcgctggcagaccctccgcgaggagcagcctcgcacccgtatccgtgacgccgccgagcagttgggtgtgagtgaagcgcagttgctcgccacgggacttggggagagcgtcgtccggctggacctccggctggatgcgctcctgcctcgtttcgagtcgctggggcgggtgatgtcgctcacgcgcaacgcgcatgccgtgcacgagaagcgtggcacctggcgcaacatcgagctgcacggcaagcaggggctggtgctggacgaggaaatcgacctgcgcctgttcttcacgcgctggagcttcggcttcgccatccgcgagccgcacggcgatggcatccgccgcagcctccagttcttcgacgcgtcggggacggccgtccacaagctctacatggaggaggcagggcgcgaggagacgttcgacaccctggtgaaggaattcacccacgcggaccagtcgccggtgctcagcatcgtcccggccacgctcgcggtggagcccaagcccgacagtgagattgacgcggaggggctgcgctccggctggcgcgcgctccaggacacgcatgagttcttcatgctgctcaaccgcttcagtgtggcgcgcacccaggcgctccgcctggccgagccggagctcaccaccccggtggcgacgtcctcgctgacgtgggtgctggagaaggcgtccgcgacggagctgcccatcatgattttcgtgggcaaccccggctgcatccagattcacaccggcccggtgaagaacgtgaagccgatgggaccgtggatgaacgtgttggacgcgggcttcaacctccacgtccgcgcggaccacgtccactcggcgtgggtcgtgcgcaagcccacgcgggacggcgtcgtcacgtccctggagctgttcaacgaggcgggggagaacatcgcgctcatcttcggcaagcggaagccggggcagcccgagtcgcccgagtggcgcgcgctggccgaagagctggccacggcgctgcccgcgagcgaggtgtcgcgatgagccgcgcgttcgggctgtcgtgggtcttcatggcggtggcctcgctcgcgcacgcggcggcgccggcgcccgcgaagcctccggcggcggccgcggccaaggccccggtcaacgcggcgaagctggtcaccgtcggccccgccatcaccgaaaccgtcttcgcgctgggcgcgggcgggcaggtggtgggcgtggacgacaccagcctggcgttggaggtcgcccggaagtcgccgaaggtgggctaccagcgggcgctgtcatcggaggccatcgtcgcgctggggacgtcgcagttgctggcgtccgaggaggcgggccctccgggcgtgctcgagcagctcaagacggtgggcgtggacgtggtggtgctgccgaacaagcacaccgtcgaagccacgcgcgagcgcatccggacgctcgcgcagcgcctgggcaaggccgagcagggtgaggccctggtcaagcaattggactcggacctgcgcaaggcgcaggagcgcacggcggcgcgcaaggacgcgaagccgccgcgggtcctcgcgctgtacgcgcgcggggccaacgtcctcatggtggcgggcgccgggacggcggcgggcgagctcgtcacgctgtcgggcggcgtgaatgccatcgccggctatgcgggccacaagccgctgacggcggaggcggtggtcgaagcggcgccggacttcatcctcatgccagccagctccctggagccggtgggcggtgaggagggcctgtcgcgcacgcccggcctgtcgcaggtgcgcggctggcgcctcatcaccgtggacgacgtccacttcatggggctggggcctcacctgggcaaggccgtgagccgcttgcaggatgggtacacgtccccggctcggggccgcaaatgagtgcgtcggagattgcgcccgtctccgccacctaccgcacccaggagcccatccagccagcagccccgcgtccgtggctgttgctgacggcgctgctgctgggcgtggtgctcctgtcgctcgccgtgggcgcggtgccggtgcctctgctggcactggcgggcagtctgctggaacgggtgggcctggacatcggccacaagctggagtccgtgcagcaggcggtgctgctgtccatccgcctgccgcgcgtgacgctcggcatcatggtgggcgccgtactggccacctgtggtgccgcgctgcaggcgttgttccgcaacccgctggtggagcccggcctgctgggcacctccagcggcgcggcgctgggggcggtggcggccatcgtcatggatgtggccctcagcgcccacctgggctcgctgcggatgctcgcggtgccgggcgcggccttcctgggcgcgctgggcgccacgttgctcgcgcaccggctgggtgggggcggcggtcgcacggagacggcgcgcatcctcctggcgggcgtggctgtcagcgcgggggcgggcgcgggcatcggtctgctcacgcagatggccaccgacgcgcagctccgctccatcaccttctggacctggggcagcctgggcggtgcgtcctgggacgtggtgggggcagccacgccgccgctgctcatcgccctgggcctgctgctgcgtgaagcgcgcaccctcaaccttctgctgctgggggagcgcgaggcgtggcacctgggcgtggatgtcgagcgcctcaagcgccggctcatcctcgccgcggccctgggggtgggggccgcggtgtccgtcaccggcgtcatcgccttcgtgggcttgctggtgcccgcgctgctgcggttggcgctgggacctgaccaccggcggctgctcagtgcgtccgccttgctgggggcctcgctgctggtgggcgcggacctgctggctcgcacggcggccattcccgccgagttgccagtgggcgcgctcacgtccgtgctgggcgttcccgtcttcatcgggctgctgtcgcgcaagggggccgcatgagcctggaggttcgtggcatcgaggtgtggcgtggccgtgggcggacgctgggacccatggatttgacgctggagcccggtgaggtgctggccgtcgtggggcccaacggcgcgggcaagtccacgctgctgtccgccatgtcgggcgagctgcggtgctcgacgggcgaggtgcttctggacggcactcccttgttgcagtggaagccgcgggagcgggccatgcggctgggcgtgcttccccaggagtcgtcgctgggcttcggcttcacggcgctggaggtggcgctgctgggacggagtccccattcgagccgcgctgagggcagcgcggacctggcggcggcggtggcggcgctcgatgccaccgacacgcggcacctggcttcacgttcgtatctcacgctgtcggggggcgagcggcagcgtgtgcagctgtcgcgggtgctggctcagctctccgaaccgttggcatccggacaccgttacctgctgctggacgagccgacggcgagtctggacctggcccaccagcacctcgtgctggaggcggcggcgcgcttcgcccaggcgggtggcgcggtgctggcggtgctgcatgacctcaatctggccgcgcgttacgcgcaccggatggccgtgctcgccgagggccgggtggttgaactgggcgcaccggcgcaggtgctttcccaggagttggtggcccgcgtcttcggtctgcgcgtgcaggtcgtcgaatggccgggctcgcccggtcccctggtcatcccggagggccgcgcgccgctgactccctgagcacggatggagccgtgcccgctggattcagctccccgcgggaaacgccttgggcgcccggtgcccctccacaccgcgcgtgatggcccagggcctttcccgcgggggggcgccgtttccccacgctgacagcagacgggtagggaggccgtggcctgcccggtgcccccacgccgcgcatcgggcgtgctgtcgtgcctcctcgccccgtccccgttcggcgggcgcggaggtgccacgcattgcgtttcgaagcggcggcggtttcagccggtcatcgcaacgctttgagcgaatacctcggcgggggtgcgccagtcgagcgtctggcgggggcgggtgttgagttggagggcgacggtgtcgagctgggcgcgcgacaggccgctcaaatccatgcccttggggaagtactggcgcagcaggccgttggtgttctcgttgctaccgcgttgccaggggctgtgggggtcgcagaagtagacttggacgtcggtgtcgatggtgaagcgcacgtgctcggccatctccttgccttggtcccaggtgagggtgcggcgcaaggcgtcaggcagttggccaagttggtgggtgagggcctcacgcacgtggggcgcggtgcgcccctcgggcaggtgcaacagcatgacgtaccggctgcggcgctccaccagcgtgccgatggcgctcttgccctgcttgcctaccagcaagtcgccctcccagtggcccgggacggcgcggctttcggcttccggcgggcgctcactgagcatcacccggcccggcaactggccggacaggacgctggcgcggccacggggccgacgctgggggcggcccgtgcgcaggtacgcggcgagttccttgcgcaggctgccccgcgtctgcacgtagaggctgcggtaaatggtttcgtgggacacgtgcatctggggctggtgggcgaagtcgcgcttgagcgtggcggcaatctgctggggactccagcaccgcagcagacgtcgctccacctcctggcgcaactggggctgggccaacagcttcgtttgcttgggccggcgcgacgccctcgcggccgccgcttcacccagccacgcccggtagccttcgcgtcccttgccggcacgccccacttcgcggctgatggtggacgcagcacgccccagtcgccgcgcgatggcccgcaaggactcgccggcctgcacaccgcgagacacctcctcgcgctcggccacgctcaaacgcaaggtagagcgcacgagcgcaggccgccggatgccgcccgcacggcgcaaaaggcgctgcagcgtgcgctcattcacccctgccgcccgcgctgcctcctcctgcgtctgtccggcggccaccgcgcgccgcacctccagccaatcctctccactcatcctgccgagcttgcctcgactctccaccgggcacctctcccggatgcgctcccttccgcgcatcctgactggtgcgttcaccgattgagaccgccggcaaatgtcccgacatttccgaacagcgagctcgcgaacggcctccaagggggcgctgcgcccaagcggggattggagtagtcacgggcgtgggtcgtcgtcgaggagccgcattggagactgctgcgttggtgctggtgttgtcgtccgcgttcctgcacgcggcttggaacgcgctgctcaagcgtcatcccaatccggaagtgggcgtggtgagcgtcatgtccgtggtcatcctggccagtggcatctgggcgctggggatgcgtggccccgcgttctccagttcggaggggctcgtttgggcgctgtgggcgggcgtgtgtgagagcgtttacctcgcggggctcgcgcggtcgctgcgtcaggcgccactcgggctcgcgtacacggtgtctcgtggcggcgcgatgctactcgtttggcccgtgtccgtgctgtggctgggggaggcggtgtcctcgtggacggtgtcgggcgtggcgatgctctgcgttgggctggcggtgatgaacctgtcccgtccatcgggggccgcaggggcgggcgtggcgtgggcggccctgtcggcggtgggaatcgcgggctaccacttgagctacaagatggcgctggggacgggcgcgcagcctcctgcgttgttcgccaccggcctgctcgtcgcgctgcccgtgctcatcctggagcggggccgtcagcaggggtgggctgccttccgccgggaggctttgctcgcaccggggcttgttctgacggcggggctcatctccgcgctgtcgttcggcctgttgttgacggcgctggcggggggaggcgcaggcgtggtgctgacgcttcgaaacacctccatcgccttcgcgttggtgctcgcggcgctccagggtgagcgcctgggccgacggcaactgtcgggcgctgcgctcgttgccgtgggcgcgttgttgctcggcgtgccggcataggtgggctcaacgcaggactgcgcggacgcgatgcccatgcgctcatctgtccacgctgctgtgggctcgcgcgcggtcagttcatctcgcgcgcaggccttgccgtgagacgtcccgcgagacgcctagggcgtgggcgtgcacaccctccgcccatctcgccgcatgcattgcggcgagacgttccgcgagcggcctacggcgtgggcgcggacgccgtcagccgcttcagtgcgtccttcgcatccgggtggtccggctgcaactgcacggccatcttgtaggcgtcctttgcctcgtcgatgcgcttcgtcgcttccagcagttgcccgagtgcgttgtgcggctcggcgaagttcgggtctgcctgcacggcgttgcggaaggacttctccgcgcccttcgtgttgccctgctggtacagcgtgtggcccatgtacagcaggcccagcgagtggcgcgggtccaccgacagcacggacgtcagcaccttcctcgccttcgcgccgtcgccgccacgcaggtagatgaagcccagctccgcgcgagcctccaactgcgcaggatccttcgccaccaccgcctcgagctccgacacggccaagtccggccgaccacgccgcgagtggacgatgcccagccgcgccagcgccgcggtgtcggcctcttcgccgtccttgggcttgagcagcccctccgccgccacatagtcgcccatggccagcagcaggtccgcgagcgccagcttcgcggcgcgattggcggggtcctcgtccaggagggccttgtagagcggttgtgctttcgcgcccacccgcttctgcgcgtacacatccgcgagcgccagccggttctccggcgtgggggcgagcttcacaccctcttcgtactcggcgatggcgccatccaagtcacccttggcgcgcagggcctcgccataggcggcgcgggcgctcgcgtccttcgggaaggcgcccacggccgtcttcagggtggccaccgcttcgtccgccttgcccaggctgagccacgcgcgagcaaggccctggtacgcctccgtcgtcttcttcccgtcctcggcgctcttcgcgatggccgtcttgaaggcctcgacggcctgcttcttcttgccctgcgtcaggtacaggtggcccagctgcgtgtacggcccgctggaccgctgcggctccagcaccacggccctttcgaacgccttcgtggcccgggcgaagtcaccgagctggtagtacgccaaccccaggttgaagtgcgcctcggcgaacttcgggtccgcggcgatggccttgaggaaggcgtcggtggccttgcgcgggtcacccttctcgttgaacgccacgcccatgttgttgtgcgcgctggcgtgcttgggggcggcggcgagcgtgcgctggtactcggcgatggcgccgtccaggtcgttctcccgcatgaggagcacgccgaggttgtagtgcgcctcggtgtcacccagcttctgccgggtggcctcgcgcagcgtctccttggcctcgccgttgaggcccttctccgccagggccttgcccagattcacgcgggccacgttgagcttcgcgtccagcttcagcgcctcacggtaggcctcgatggcatcgtccgtgcggttggcgcgctgcagggcctcgcccaggttgaagcgcagctccgcgtcctggggggccagctccaccgccaccgcgtactggctgatggccacgtcgcgctcgtccagcacgcgcgccagcaggccgcgctcggcccggagcgtggactcctcagggaaggcggcgatggccgtgtccagcaccgtgcgcgcctgctccggctcaccggacagccgcagcgcgcgggccagggccagcttcggtggaatgaggtccggctcctgggccaccagcttcttcaggggcgccacggccttcttcggcgtgttgagcgcgaggaaggcggtgcccaggcggtacagggcatccgcgtcgtcgggggactcggccaaccgcgcgctctccacggcggcggtgcgctcgagcgtggccgagtcgggctcggcggcctgcgcggtgaggagctggagcaccaggaagctggcagtcttcattataggttctccacgtagggactcgcgcgcgcgtcgaaggtcttcttcgcgagcgccgccttcttcgcctcccacgcctcccgcgccgtcttctcttccttctcgtctccagcgagctcggcgcgttcctccttcacctccgccttgcactcggagacctgctcctcgaattccttcgggtccagccgctcgctgccctcgaccttcgccttccgggcggcctgcagccgggccagctcgaactcggcgaaggcgcagcgcagcgccagccgctccacgtcccgcaggcccacgctgagccgctgccgggcgcgcaggtactccacgcgggcctcggcctcggcgatggccagcttcgccacctcgcgagacacctcgtccgacgcgcggtccacttcatcctccgcggcttccttgcgggagcgggcgcggcggatgttgtcgcgggcgcggccaatctcgttgtcggcctcgtccaccctgtcgatggcgagcgcgaggttgttctctgcctccagcagctcgatgcgcgcctcgtacgggagcttcttctccatcgagtcgggcacgcgcatgttgtagctggcgccgcacgcggagagcagggggagggtgagcaggacaaagcgcttcatggaaccgtcgcctcgaagcttccgaagatggtgcgcccggaataggtgtgggtgccgttgacgaacgtgacgtggaactcgccggagatgcgctggccctgctgactggggagggccttcaccttcagcccacccacccgcagctccgggaaggtccgcgccggctcatccagcacgttgcggccaatggcgccgcgctgggcgccgttggccaggacttccgccaggttgacgtccagcgagccggtgtagccctccgggagcatgtcctgcacccgggcgctgaccttcagcaccgtgttggtgcccgtgccctgctgggtgacgaagctcaccgccagctcaccttcggccaactgcgcctccgcgcggtcgtagcgcaggtcgagcagcgacgtcacgctgccctccagccgcccgccctcgtcgccacaagcgcagaggatggcggtgagcaggacgccgagccacgatgcacgcgagggcctcacttgcatgccttccacccgccatccacgtcgttgccgcccagcgaggccacgtccttgagcacggccagctcgcggcgtgcgccgtcgacgtcaccgaagcggcagcgcagcgcggccaggttgaggcgcgccttgccgaaggtggggtcggagtccatggcgcggccgtaggcctcgcgtgcgcccatggcgtcacccatgtggagcagcgccaggcccagcgcggagtgcgccgaggcccgcgtgtcctgcagctccgtgacgcggcccagggtgagctgcgccatgccgtactggcgcgcgtccaggtaggccagacccagtgcctccagcgcctccgcgttgagcgtgcgctcggccttcttgcgcagctcctccagcgacgccggctgcgtgggcgtgcccggctgcggcaccggcagcgccgccgtctccgtgcgagcgcggcagcccaccaccgcggcgctgaagacctccagggattcggcgcgggacaagcaggccttgaacgcttcgtcggagcgcgccttcagcggcgtcacctgctccttcacggcggcccggaactgctgcgcctccgcggcggagaggcccgcgggaacggccgtgccctccaccacgtccgcgatgtggccgtatgcgagcgccagcttccacagcgaggccaccgcccactcggcgtagcccagcgacgcggcctgcgtgtagatgccctccatgctctggagcgcggcgaccttctcctccacctggtccgccggcaaatccctgtagccgcggtagaggatttcgcccaggtaccacaggcccttcgccgcctcctcggtgccgccgttggggccttgtaccgcggtggtgagggtggcgatgagcgcgtcggcgggcgcggtgggcgccgtggtggcctgcacctcggccagtaccgccgccgcggcggcgctgtggcggtccagcttcagcgcggcctcggccgccgtcttcgcgcgggcgtagtccttctgcttcagccgggtctccgccagcatcaccaggatgtccgccttgcgcgcgccagcgatgtcggcggcggcctccaggtcacgcgccgcctccttgtgctcgcccagcgccatgcgcagccgcgcgccggccagccagccgtccacggcggcgaagtcgccacccagcttctggcccacctgttcgaaccagcccgccgcctcgccgaacgccgcggcctccgccgcgtgccggcccagcgtcagcagcacgtccgacaggtactggctcttcgggtagtcctgcaccagcttcgtgcccagctcgcgctgggcctgcatgtcacgcttctcgcgcgccgcggtgaacgcgccgtagagcgccttctcgccgatgtcggagttcttgttctcgtcggcgaccttcaccaggccctggatgacgtcgcccgtctcctgggcgctctgcagggccaactcatccagcgcctcggcgcggctctgcgtgagaatcttctgcacgtccgcgcggaagctggccggcagcggcgcgcccagcagcttcttgcccgtctcatccaggcccttgaagtcgttgagctgccgcaggctgtccagcgccaggttgcccgcgatgggggcttccttgtgctgcgggtggctcagcgcgaaggcggtgaacagctccgcggccttcgggtactcgccgtcctcgtagtaggcgcgggcgatgttgaacttcaccaccagggcattctcactgcgggggtagcgcgacacgaagtcggcgcccagcagcttcatggcctgacgcgcgtccgccacctcgaaggcgttgcgcgtctgcgcctcctctggcttgagcgtggagaagtgcgccagcagcgcggcgttgagcgcttcctcctcacccttcgcgtccttggccttcacctggtagcgggccagctcctcgaactggcgcgcggcctcggggtacgcgttggcggagaacagcgcgtccgcgcggttcttcatcatcgtgcgcacgtgctgctcgggccggaagaggcccaggtacgcctgataggcctccgccgcgctcacgtagagcgccttgtcgttcttcttctgcgcctccacgtggagcagggtggagaggtctcgcgccatctcctccagctccaccaggtgcttcttgcgctcggcctccgccagctcggggtccgtcttgctctgcaccgcggcgcgcacgaggattcgcaggtcctcggggtccggcagcaccttgcccttggaggccttgatggcgtcgtagagcttctggccgcgctccaggtccagctccgggtcgtgctggatttccatcagcttgcgcagcgcggggatggcccactcgtactgctgcttgatgaagtagcggttgcccagcttgtccagcgcgagcgcgtacgtggcgcggctgtcgctgagcttctcgaagtagttgagcgcgcccttggggggcttggcctcggtgtagctgtacacgaggtccagcagggcctcgcgcttgacgttgagcgccttcttcacgtccacgccgggcagcggcgcgctggcggccgcggcctcgaagaaggtgacagcctccgcgtgcttggcctgattcacgcgaatccagcccatcttgtagcgggccaggtcgtgcacgggagaaggcggggcctccaggatggcctggtagtgcttctccgcctcgcccaggtcggccttgtcgaagaagtggtcgcccagaatctgctccgcctccaggcgcagcgggctgccagggaacttgcgcgtcaggtcgccgagcgtcttgagcatctcgtcgaactgacccagttcgcgctgctcgtgcgccaggtagaacgtcacctggtcgccgtccttgaagtccggatactcgcgcagcagccggtagtacatctgcacggccttctgcttcagcagccgcgtctcaggggagacgatggcgccgctggccccctccggccgcgactcggcctggaggtagtacacgtagcggctcttctccacgtagagctcggacagccggaactggaggtccggcaggtagggcgcgttgcggctcttggagatgaggcgctccgtctcgccgatggcgcggtccaccttgaagatgtcgcgcttgagcttggcgatgagctcgtcgcgctccttggccttggagacaatcgggttgatgcccgggccgggacgtccagcgccacccggggcggccgcgagcatcgcggcggcaatcaggcccgtcaggtggccggtcatggcgtctcctcgatgcagcggctgtcgatgcggacccggtaggagcgcagctcgtcgttccagtattcgccgtcgaaacggtaggccgtttgcgtgggcgacagaatctgctcgtcctccggcgcgacaatccgcgcgcccttcttcacgcgctcgtacagcttcaggcccacttcgtactccatcaggcgcacctgctcggcggcgcgcagcagcgtgtccgcttcctggcggacggcctcggccagccgcgcgtcatggacgcggaccgcctcggcgcgggacaagtcatagagcttcgtcaggtgcgagaagagccggtcgccgaagctgccggcgtagcggcccagccgctcgccctccagctccaacgtctccaggaagcgcgcggcgcgctgggtgcttccacgggcgttggcggcgcggcgcaggcgcacatcctgggtgaggtcctcgcggttgcgcaccgcctccagcgagtccgcgaagcgccgcgtcagctccttggcggcgcgcttggccggcaggtagtggcacaagtcgcggtagatgagcgcgcgcagcaggtacttgtccggcaggaattcgtcgcggaaggacggcgcgtccatcgtggtgaggatgcccagcgacgcgcgcggctcgcccagcttgtaccgggtccacgcttcctccaggtatagcctggctcggtccgggtccagctggggcagcttcacgcggtcatacgcctcctcagcgtcttggaagtccctgccctcgtaatgcaggagtgcccgcaccagcgccggctcttttcgtgcatcgagatataagattttggtcttcgagcagccccacaaagtcaccatagaagtgtttagagcac

SEQ ID NO: 1237 - DNA, 26659 bp, Myxococcus xanthus
catcccgctccctccgctgaaggcccaccgtctcgcgcagtccctccacctcaccgagcagccgtccggactcctcacccgccttgcgccgctcgccctgcgccccctcgtagcgttccagctcgcgatgccagcgcggccactcgctcgtgagcgcgacccagtgcgccttctccgtcagccagtgcctcgcggcctcccccttgtcccgtgcctcggcctcgcgcacgagcacggcatccagctccgccttcgcctccgacagcgccgcctgggacttctccgcccgcgcccgcgcctcccccgcctcccgggagacaccgtccagccgcgcatccagtcgcgccgcctcctccagcgcgggacgcgtcgccacctcccgctcctgcgccgcggcgcgcgcggtctccgcctccagttgccccacccgccgcgccgagacctccgacagcgccgcctccacctccgacgcccgcgccacctgcgccgcctccgcctccgcccaccggcgctccgcggcatccgccgccgccaccggcccccggaaggcctctgcctcgcggaccgcctccagccgtgccgcgcgcggcgccgcctcctccagggccgtcgtggccgccttcgcctttgcctccgccgcgagctccgcctcccgcagccccgcccgcgcgacatgccacgccgccgcgccctccgcgtccttgagcagcgcctccaccgcctgacgcgcccgggactcctcaccgagcgcagccgcagccgccgcgcgctccgcctctggcatcagggcaatcgccgccaatccctgcgcccgcttcgccagcgactcctgctccgccttgttcttctcgtgcgcggccatggacaagcggctgtacacctccgtgcccgtcatccgctccagcagctccgcgcgctcgctggcatccgccttgaggaaggccgcgaactcgccctgcgccagcagcgccgagcgacggaactggtcgaacgacaaccccagccgctcctggatggcggccagcacctcgcccttggtgcggcccgtgagctgcccggtgaccacgtccatcaactgcatttcctggggccggaagcgcccctcggcgcggtttcgcgcgcgccacacggaccagcgcgcccggtagcgccgcccgtccttgcccaggaagtccacctccgcatagccctcgcccgcgccccggcgcagcatgccgcgcacgtcgtaggcggacagtcgcgcgtcctcgtcctcgtccgcgcggcccaccggcgcgccgccgcgtccccccagccggggcgtgcggtcgaacagcgccagacacagggcatccagcaacgtactcttgcccgcgcccgtggcgccggtaatcgcgaacaagcccagccggtccaacggcggctggtccagctccagcgcgaagtcccccgcgaagctcgtcaggttggaaccgcgaatcgcgagcaccttcacggcgactcctcctgcacgtcggtcagcaacgtatgaaaggcctccagcagcgccagtgcgggtggctcctcgaagtcacgggcgtaacgcgcgcggaagacatcctcgggcgtgcgttccttcagggagaggcccggctgcacctccgccaacgcgcctcccgtcccggtataggcgggcgtcagcttcaccagccgcgccgccttcccctccagcaccttctccaccttctgccgcagcgcgggctccggccggggcaacgacacgcacacctccaggtagggccgccgccactccagcgtgtccgcgtcgtgcgccggcaagccctccagttgcgtcagcaccgcgtccaagggagcagcgtcccgcgaaggcacgcgcaccatgtccgtggtccggggcacgggcagggattgcacctcgcgcagcgcgtcgccttccagctccaccagcagcacctgatgccggtagcccgcctccgacagcgacaggggcaacggcgagccgctgtaacgcaccccctcgcgtccgcccacccgctgggccttgtgcagatgccccagcgccgcgtaggccacgtcgtccgggaacaggtccacgggcagcgcgtgctggttgccgccgagaatcttccgctcgctcaacgcggacagctccgtgcccgtcatgtagcaatgccccatggccaccagcgcctgtcccgcctgacgcctgcgccgcgccgcggccagcacctccgcgtacaccgagcgcacaccctccaccagccggtctcccatgtccccgggcacgggcggcaggtccgcgggacgcaggtacggcaccgccgccacccacgcacccacccgtcccttcgcgtcgtgcagcggcaccagcagccgctcctggtccatggcgcctcgggcccgcggcagtccgcccaccacgtgcacgcccagcgccgcgaacagcgggtccggcgcgtccagccgcgccgcggagtcgtggttgccgccaatcaccaccacgtccagccggggcatccgccgccgcgccttcgcgacgaactggtaccaggccgcctgcgcctccgcgctggggttcgccgtgtcgaagatgtctccggccaccagcagcgcatccacggactgcgcttccagggtctccagcagccagtccaggaaggccgcgtgctccgcatcccgcgagacgtcgtacagcgtgtgtcccaggtgccagtccgacgtgtgcagcaggcgcatcaggcgtccaccctccctctttcccgtggcgctctggccagcgggcagcctccaacagaggggctgctcgctccaagcggcgggcgcctgctcccttactccctcactctgacatgtgcgcaagttcctgtaattccaggccgttctggagaagacgccccgccacgtcccctctggaggccctcacgcacggagggggttggccaagacgctccgagcagagatgctcgcgggaatgaccgggctacaaattggcatcttcgccggcatcctcggggcgggcgtcggcgtctcgagcatcgttggctacttccgctggcgccgctggaagaagcaaatccaggcctggcaggacttcgcgaccacccgtggctggtccttcatgccgacgcctggcaggttcatgtactccgcggggaccttgaagatggagggcagctacgccgggcgtccgctcaccctggagaccgagtaccgccaccaggagaaggcgtaccgcatcgccaccatcatccggcacgagctcggcgacgactttccgcgcgaggtggtcatccgccccgaggggctgggcgacaagttcctcaagctgttcggcgtacaggacgagcaaattggcgatgccggcctcgacgccatgctggacctgaagaacgtcacccctcaggcccgcgccatcctcctcagcgcgggcatgcggcgccccctgctgaacctggcccgcgccttcgagagcttctccatcgagaacggcgtcctgtcggcggaggtgacagacgaagtcccatgcacccccatcgagttgtacggcttcctgacgcccgtgcgtgagctggccgacgccgtgcagggcacgcgcggccatacccagtggcggtcggagggcactggacaggaaggcacccagtcctgaggctggagaccctgctgacacgctgcgggtcccgcgcgtgcggcatccgcgcatgatgcgttgccgccacttcgggaacgtcaccctcggggacgagcggcgcaaggccgtgaagctcggcatgcccgacagcgacgaagcgctggagtccatggtgactccagcgcttctgctcaaagatgccctgcgcgaggtgaaacagggcggcgggcgcaagagcggccaggcgcgctcaactgcgacgcgaccgtcgccgctggagcacgagccacgcaagcgagccccaggccaacggcgccagcggcatcgtgttgcagttgcagccgcccggctcgttgggaggcggaagctcggtgcccgcgtcggttccggcgtccgtccccgcatccaacagcggcgactcacagggggcatcgcccatgcacaccgtcgcctcggcggagccctgctgccccgtcgagtccaccacgacgaagcggacgcggtgccagcccggcgtcaggcccgtggtgtcccagcggctgggctcgccgccgtagtagtaggggctttcggtccgctcgtcggtgtagcgcagcacgtcgtccacgtataactccgcgtgcgtgcagcccacatcgtcctggcagtcgccgtagaactccgccgtggtgccggacacgtgctcaccatcttcggggcgcgtgaggatgccggtgggcggcgcgtccgggctcaccgtgatggtgaagtcctgcacggcgtccggcgcggcgccgttgctcacgcgcacggagacctccaccgtgcccgtctcggtgggctcccaggtgatgacaccggtggcggcatcgatgctcatgcccggcaccgtgctcaccagcgcatacgtgggcgcaggccgtgccgtcgcctgcacttcataccggtacggactgcccaccacggctcgggtcaccggcgcggagaggatggcgggcggcaggagagtcgtgtcctgctcgaaggcctccacctcacgtgcgtccacgcccggggcggacacggtgatgatggccgtgccgtcctcggcgtccgcgtccggcgcggcggccagggtgacgtccttgggcgtgttccagtcggaggtggtgaaggtcagcgtcgccccggactggacggtgaggtcctcgtccccgcgggtgcgcaccacggtcaccgtgacgttgcgcaggggccgctgtgagagcgacacgccgaaggtcgccgtcccgccctccacgaccgtcacctgcgactcggtcagcaccaggcgcggcgagttgttgtcgatggtggtggccaccaccgccacctcctgcagcccgtccgccaccaccatgaaggtagcgacctccggcgtctcgtcctcgtccaccgccgcgctgagcgtcaccacctggggcacgttccagttggatgcggtgaaggtgagtgccgcgccgctgacgatgctcaggtcctcggagccgcccagcgcgcgggagacccgcacggagacatcgaaggccggcgcttcggccaggcgcacggtgaaggcagcgcgtccgccctcctcgacgcgcggctgcagcccggacaccaccagtttctgtcccggcgtctcgggcgtgatgcgccgcaggacgccgcccgacgcgccgatggtgtagagcgcgccgtccgggcccaccgacatgtccacctgcgaggtgaagccggtggcccattcatccaccgtagccaccgagttgtcctcttccagggtgactcgcgtcaactgaccggtgttgaagtccccgaagaagaagttgtcctggtacgcctcgtcgaacagggtcgcgtcgtagaaggtgccaccggtgatggagccaccgagctcctgcgtcgtggccgttcccccgctgctcgccgcgtccggcagtgaaggctgcgacacggtgaaggtcgtgggggaaggaacgctggccaccagcaacaggccattgaagctcgcatcctccacaccgctgagcgtgagccgctcacccttgcggaagccatggttcccggcggtggtgaaggtggccaccccgctgctgcgtacggcgccacccgcggagaggccgcgggtatcggaaccgttggttctgtacttgacgacgggagtgatgaagtcgttggtgctgggttggttgttctcgtagtcgctgtagccggcatggcttcggcgggtgacgacgaagacctgctcgtagtcggtgcccacgctgttcacccacaaccggcccgtggtgggctggaaggtgaaggtgaagggattgcggaagccgcgcgcccagatgtactcgttgttgggccccacgccgtcgttgaaggggttgtcgctgtcgggcgtgccatccgggttcgcgcggctcaccttggccgccatcgacgtcaggtccgcattcacgcccgtgccgttgcccaggtcgccaatggcccagtacagctttccgtccgggccgaagccaatggcaccgccgacattgttcgcgccccgcgtgggcagccgactgacgacgacggtgcgcgccctgcccgtcccttccacatccgtgtagcggacaatctgctgctccgacgcggagacggtgacgaagaaataaacgtagcggttgaccacgtagttcgggtcgaaagcgataccgaggaggccgcactcgctgccggtgtagacggaatcctccgtcgcgaacacctgcgtcaccagcgtgctgttccctggctgtgtttcaggctggccgtccttcagcgacaccacccggatttcgcccgtcttgagggtgatgaacaagcggcctgaaccgtccggcgcccatgccatccccgtggcctgcgtgagggtattggagatgaagggcatctccacgaagccggagggcaccgcggcccaggcgggcgaagacagccctaacaacccaagtaacatcaaagtagagcgcatgtatgttgaggatagcgcaatgtccccctcagcacgcatgagacgtacgcgaggactcacccatcctgtattggattgtgtcagtgtttcagccccccattatttgcaccagggtgggcttgaccgtggccaggcgcgagcgcgggggcactcagcccgtcttcgccaacgtctgctcgaacagcgcgcgaacctgcgtggccaacgcctgtgagtccggactgaaggactcgggcggcagcgcgggaagcacgcgcacgcggatggaggcggtgggactcatccaggggccgtctccatccagcagccctggcgtgccctccaccaccacgggcaccaccggcacatgctcctccagcgcgagctggaaggcgccccgcttgaagggcagcaactgcccgcccttggagtacgtcccctccgggaagatgagcaccggcatgccacgacgaagccagcgccggcacggatccaggagctggttcatggcggtggacgagccccggacaatgggcacgtaggccagcagcgtcatcatccaccccaccaggggcagcgagaacagcgacgccttcgccacgaacttgtagggacggaacaggcccatgacggcgaggatgtccgccgcggactggtggttgaccaccatcacacagggcccgggcggaatgagctcacggccttcgattcgcgtgcgccagcctggggacgcgtgcagccacaggccatagcaccaacgacagaccaatgagtgcaagagccgccggtcccggtcgaacgggtacgtgacgatgagcagcagcgcgcccagggtgaacagcaccggggcggtgagcaggaagacgacccagaaccagagcgtgacggcgtacttcatggcgaggccccaggcataccaccttcgggcccatcccacgctcccctcctgacggccccgcactcccacggccgcgcccctcccatccagccgaccggcctgggggcgtcatggagattggccccaagggcaatccgccgttccttgtccgtggacctgccgctgccataaagacgggagcgcccccatgcgccccatcacccccgcgctccgagccgcccgactcgcccacacattcctcctcttcagccagctgcgcacggcgcggttgctgctggagctgaacggtcagcaaccgctcgaggtccagcgcaggctgtttggctatgacctgacattgaaggcccaccgcagcacgacgcacatgctgctgtacctgcagggcgacgacttcctgtcggacctcccgctcatcgccccccatctgcggccgggcatggtggccttcgacgtgggagccaacatcggctacctgtccatgtacctgcgcagccgcatcggcccgctgggacagctcttcagcttcgagcccgagccggagaactacgcggagctggacgccaacttccggaacaaccacctgcgcaactgccaggccatccagacggcggtgggctcgcaggaaggcgtcatcaccttcgccacgggcctcaacggacacgttcccgtagagggcgcggagggaatcagcgtcccggttgtcaccgtggacggcttcgtccagaagcagggcctgtcacacgtggacttcgtgaaggtcgacgtggagggcttcgagctggacgtgctggctggcatgcgggccacgctcgaacgtccggacaagcccatcctctacatcaaggtccacggacggggtgagtatgcgcgagccgaccctcgccgcgtctgcgaggtgctcgaaggtcactacaagaacatccgcgcctacctgccccccgacgacttcaaggcgaagcggagccacctgcgccggctgtggggtcgggtgtcgcctttcgatgacattgaacaggcgtgccgtgtcgacctgcgcgaagtgaagcagcacgacacccaacggtaccagttgctctgcctgccttgaagggcgcggagcaggcacgctccgcaacgtcggaccggcgtcactgcccgcactctcccttgcccggtggttgctcggaaggcgtaaggtgcctgccggaccgaacccggagggaggcagcgaatggacgcgcatcagggcctgcacatcgagacccatccccgagaaggagacccgctggttcgcgcccggcggcccgacccgtgcgcgctggtgttgttcggcgccaccggagacctggcccagcgcaagctgttcccggccctcttcgagttggcgcgagcccacctgctgccgaagaacttcgccgtcgtcgccttcagccgctccgaaggagacagcgaggccttccgcgagcatgtgaaggcgtccctgctgaagttcgcccgcacccagcccctggacgaggccgtctggaacgacttcgccccgcgcctggagctcatctccggcggctatgacgacccgaagtccttcgtgcgcctgcgcgaggagctcgaccgggtcgcccagaagttcggcacccagggcaaccagttctattacctggccactccggcctccaccttcccccaaatcctccagggcctgtcggagtcggggctgctgaagcgccaggaacaggccgacccgcgcccgtggcagcggctcatcatcgagaagcccttcggccacgatttggagagcgcccgcgcgctcaaccgtgagctggcggcggtgctggacgagcggcagatattccgcatcgaccactacctgggcaaggagacggtccagaacatcctcgtcttccgcttcgccaatgccatcttcgagccgctgtggaaccggcagcacatcgaccacgtggaaatcaccgcggcggagacgctgggggtggaggggcgcggcggcttctacgacgagacgggcgtcatccgggacatggtgcagaaccacctgctccaggtgctcgcgctgtgtgcaatggaaccgcccgtgtccttcggcgccgaggacatccgcgacgaaaagaccaaggtcttccgcgcgctgcgcccgctggagggccgcgaggtgtcccgcgcggtggtggccggccagtacgagggttacctccaggagaagggcgtgaaggccggctcgcgcacgccgacctatgtcgccatgaagatgaacatcgacaactggcgctgggcgggcgtgcccttctatctgcgcgcgggcaagaagctgaagcggcgcgtgacggaggtgtccatccacttcaaatcggtgcccatcagcctcttctccggggaaggcgccacctgccagcggctgcagcccaacgtgctcacgctgcgcatccagccccaggaaggcatcgcgctctccttcgaatccaaggtgccgggcgaggatgtcaacatcgcgggcgtcaccatggacttcaactatcaggagaccttccagcggccggtccccgaggcctacgagcgcctgctgctggactgcatgcgcggcaacgccaccctctacgcgcggcaggacagcgtggagcaggcgtggaccttcgtgacgcccatcctccaagccctggagtccggcgagggcggaccggcgcacggctaccccggtggcagcgcgggcccggatgccgcggccgcgctgctggcccgcgatggccgccggtggaccggcctatgagcgccacgcgcacgcacgtcgtgcccaccgagtccctgccccgggaagccgcgacgtggatggcgcgcgcgctccaggacacgctcgccacccagcgtcgcgtcagcctggccctgtcgggcggcagcacgccggggcccgcgtaccgggcgctggcggcgcaggtacttccctgggagcgcgtggacgtctacttcgtggacgagcgcttcgtgccgcccgaccacgcggacagcaactaccggatggtggaggacacactgctgcgtcctcttcggctgtcgccgtcgcaggtgttccgcatggagggtgagcgcgaggaccgggacgccgccgcgaaggactacgcggcgaagctgcctgcttccctggacgtggtgctgctgggcatgggggaggacgggcacacggccagcctcttccccggccaccccgcgctggaggaatccgagcagcgcgtcctggcggtggtggggcccaagccgccgccctggcggatgacgttgacgctgccggtattgcggtccgcgcggcacgtgctgaccctcgtatcgggggcgggcaagcaggacacggtgcgccgggcgctggcgggggacctgagcctccccgccgcccgggtgacgaattcggagtggatgctggaccccgccgccgccgggcggtgagggctcccagtcgcgaaccttccaggaggaaccaacgatgagtgagtcagcgggcgcgcagttcggcgtggcgggaatgggcgtcatgggggcgagcctcgccctcaacatcgcggaccacggcttccgggtggccgtgtgggacaggcatgcggagcgcatcgatgagatgcaccgcaaacacggacaccccgaggtctggggcaccgagtcgctggaggccttcgttcagcgactggagcgcccgcgcaaggtgctgctgatggtgacggcgggcgcggcggtggactccatgctggagcgcctgctgccgctgatggcggaaggcgacgtcatcatggacgccggcaactcgtggttcctggacacgcgccgccgcgaggagcagtgcaaggccaagggcatccacttcctgggcgtcggcgtgtccggcggcgaggagggcgcgcgcaacggcccctccatcatgccgggcggtgctccctcggcgtacgagctggtgcgtccggtattcgaagccatcgccgcgaatacggacatggggccgtgtgtcacctacgtgggggcggacggtgccgggcacttcgtgaagatggtgcacaacggcatcgagtacgcggacatgcagttgctcgcggaaacgtacgacgtgctgcgccgcgggctcgggctggacgcggacgcgttggcggacctgctgtcccagtgggaccacggcatcgccggctcgttcctgctggagaccaccatcaaggtgctgcgccagaaggacccggagacgggcaagccgctggtggacctggtgttggacaaggcgggccagaagggcaccggcaagtggacggtgcaggtggcgctggatttgggcgtcccgattccctccatcgccgcgtcactggacgcacgcatcctgtcctccatgaaggacgaacgcgtggccgccgcgccgaagctgaacggcccggtggggcagctcagcaaggaggagcgagcgcaactggcggcgtggacgcacgacgcgctctacgcggcacgggtggtgacgtatgcgcagggcatgcggctcatccaggcggcgtcccaggagtatcagtggaacatcagcctggcggagctggcgcgcatctggcgggggggctgcatcatccgcgcgaagctgctcacgccgctgcgtgaggccttccagcagcagccgacgctgcccaacctgatggtgtccgacgccttcgcgccggtgctggagcgcatggcccccgcgtggcggcaggtggtgggcgtggccacgcgcgtgggcatccccgtgccggtgttcagctcctcgctggcgtacctggacagctaccgcaccgcggagctgccgcagaacctcacccaggcacagcgtgacgccttcggcgcgcacacgtatcagcgcaaggacagaccggaagcgggcttcgtccacacggagtggggcaagtagcacggggcctgcttgacccgggcgttcacccgaacgcccgggccgcgaacacggcaattcctgctcatcgaatgccctggcgcgcaggacctgaaagcattagcgcactgcacctttcacagacatcgagcatcaggcatctttgaggctctctttccggagcctcgaccatgacgctggatgccggagcgaacctgctacatgcggtacgtgagttggcccctgccctctccgctcgcagtggggagattgagcaggcacggcagctccccttggacctcatcgccacgctgaaggacatcggcgtctaccggatgcttgtccctcgcagccatggcgggctggagctgaatcttgtcaccgggctggacgtcctctccgagctggcccgcgcggacgcctccaccgcctggacgatgatgatagccacggagagcccccaactcttcgccctcctcctccgcgaggagttcgatgccgtctacgccgccgggcccaatgccaccgtgggcggcgccttcaatgcccagggcaaggccgtgcaggtggacggcggctaccgcgtcaccggccactggaacttcgccaccggctgccgccagagtgaatggctgttcggcaactgtgtcgtccttggcccagacggcacgccccgcgctggccccgccgagggcatgcccgagacgcgcgccatgctgctccccgccagcgaggtccgcatcatcgagcactgggacgtgctcggcctgcgcggcaccggcagccacgacatcgccatcgacgccttcgtcccccagcaacgcaccttcgacatcttcaccggccagccctccgtgccgggcgccaacttcgtggtgccggtgctgcactacgccatgcacatcggcgcggtggcggtgggcatcgcccagggcgcggtggacgacctgctcaccctggcccgctcgggcaagcgccggctgtatgcgcgcacctcgctcgtggactcccctgtgttccgcaaccggctgggccgcgcggagacgggcgcccgcgccgctcacgacgccctccgccgcatgggcgaggtgttctgggacgcctgccagcagtccccgatgaaggccttcgccctcgcgccgcaggtgtccgccaccctgacgtgggccgtggagacagccgccgaggtcgtgacggcctgctaccacgcgggcggcgccacgtccgtgcgcgatggcgcatcactccagcgccgtttccgcgacatccacaccctcacccagcacgcggccgtggcggagggctggttcacccaggaaggcagcgcgctcctgggcttccccgtcctcttcgaagcctgacggcgcgcccgctacgtccgcgtggtgcgcagctccgcgcggcgaatcttcccgctcaccgtcttgggcagctcggtgacgaactcgatttcgcgcgggtacttgtagggcgccgtcgtccgcttcacgtgctcctgcaacgcctgcgcgagcaccggggatgccgtatgccccggcgccagcaccacgaaggccttcacccgctggccaatcttctcgtccggcacaccgatgacggccgactccgccactgcgtcgtgctccagcagcgcggactccacctcgaagggccccacgcggtagcccgacgtcttgatgacgtcatccgcgcgtcccacgaaccagaagtagccgtccgcgtcgcgcacggcccggtctcccgtcacgtaccagtcaccacgccggcacgccgcgttggccgcgtcgtccccgagatagccctggaacaaccccacgggccgctcgggcgccacgcgcaccgcgatgtccccctcttgcccgtccgccacctcctggccctggtcgtcgatgacgctcaccgtgaagcccggggacggcttgcccatggaacccacgcgcggcgccatggaggggaacatgcccacaatcatcaccgtctccgtctgcccgtagccctcatggatgtgcagcccggtggcatccttccacgtgtcgatgacttccggattgagcggctcgcccgcgctcaccgtgtgccgcagcgaggacaggtcgaaggccttcaagtcctggagcaccagcgcccgccacgcggtgggcggcgcgcagaaggtggtgaccttctgcgtctccagcaccttcagcagcttcgcgggctcgaagcggccacggaagtcatagacgacgttgcacgcgccctgactccacgggccgaagagcttgccccacgcgcacttggcccagccggtgtcgctgagcgtcaggtgccggtcctccggcgtcaggtccagccagtagcggccggtaatcacgtgcccctgcccgtagctggcctgcgtgtgcagcaccatcttcggcatgcccgtggtgccggacgtgaagtagatgagcagcggcgcatccgcgcgcgtgggctcgaaggccgcgcccgcgttcgcctccgcgacgccggacacgtagcgcccccacggagacggcgcgccctcgcccaccgacacccaggtgcggaccttgccggccgtccccaccaggccgtcgaagcgctccaggcagctcacgtccgcaatcaccgcctgggcctccgccacctccaaccggtaacggatgtccttcggcgtgagcatgggcgtgcccggcatgaagacgatgcccacgcgaatgcagcccagcaccaggaaccaccactccggcacgcgcggcatcataatgaagacccggtccccccggcgaagcccctgctccgtcaggaagcgggccgcgtgcagcgagcgccgccgcaagtcctcccacgtgaagcgccgcgcctgcccggcttcgtcggaccacagcagggccagcgcctccgggcgctcggcggcgtgccggtcgatgacgtcggccgcgaagttgaagtgctcgggccgctcccagcgaaagtcccggcgggtggcctcgtagtccttcatgttccgagggggtgacaggggcatggtggccgactcctgggcggaagaaaccaaccgtcagagcctgccacgacacgccagggacgtccttcacgagtcccgcgttcgcccggtcccggacacgcgcctgcacgaagcccacaaaagcaagaggccggccctgtcacaggccggcctccgcgtgacgtcattcgaagcgagcgctcagttgatttcagcgcacgggaagagcgtgttgtacgcaccacacgtgcggagcgtggccagcagcaggtgctcggcgttggcggcgcggccggacgcctcctcgctccgggcccgctcacgctcggccagcaggttgagccacgggtccctggagccatgggcgtagcgctgcagggccttgagcgactccgcatcccgggcggcctcgcccgtgtggagcagcgcgccgacgtacaggtccgtctcctgggagacgcgcagtcgctccagcagtccgggaaccagcgccccctccttcaccagctgcgcatagtcctccgccagcggagcacgcaccttgaagtcgcgggatgccgcatcccggacgtagtcctggagcaccgtgccttcacccagccgatccaacgccgaggcgagcggcaacagtgcggccaccgcgtccaccgaagtggccgtacgcaccgcttcatagagggccgcacgcgtcaccgcgggatgctgccgcaccaggtacgccgcatccgccgtcttctcggtgagctgcgtccacgtctcccgcacctggcgcttccacctcgcggcctctgcgtcacgcagcgcacgcatctcgtccgcgcgcttctccgcggccaccgtccagcccgccgcctggcccggcagcgaggcgacgtcgcggaacgatgtctccgcctgcttcagcaggcccagtccccgcagcgccagcccccggttccacagcgcctgcgcatgccgcggctcctggcgcagcgctccgccgagcaggttcagcgcttcctcccaccgctgaccgctgagggccaccaccgcgcggtcattgtcccggtccgccgaggccggtgcccgtgccaggaaggactccgcctgctgccagtccccgcgcagcgcataggcggcggcgatgcctcggaagtcctgctgctcctccagctccgccaggggccgcagcggcagcgggttcgcggcgccggacgtgccgcgcatcggctcgtagggccggaagcggtccgccatcgggtggctgagccgcgcctccaaggtccgcacgtccgcgcccgccagccacacgtcggtgggggcctctggctgcgtctggagacggaacacacccaccgccgccaaacccgccgccaacgccaccggcaccaccgtgcgagacatccgctgcatccacggccgcagcggcgtcaccttcgcgggcggcggctcggcgacgctggcactcccctccagggcgcgggaggccagcagctccaactgaagcagctccctcagccccgcctcgcattcagggcagcgccccaggtgctggcggaagacctccgcgtcgggagcggacagctctccgtccacgaagaggttcagattggtgcatggcgtcgtcatgagctcgtggccccctgctcccgggctaccgccacctggggcagcagcagttccttcaaatccctacgggccagggtgagccaactgcccacggtgcccacgggaacattgaaatgctcggcgatggcgttgtagcgcttgccctccgcgtgcaggcggtaggcgtcacgcaggtgcggcttcaaccgctcgatggccttctggaaggcgtcggtgctcaccagcgcccagttctcctgggtctcctccggcgacaccgccaaatcctggaccagcgccaggtgtggcatcccccgggactccgtccgctggcggcggcagtagtccaggaagcggttcgtcatcgtcgtacacagccacgcagccgccgcggagtccgtccggtccttcagatgctcgaactccggcatcgcccgctcgaaggtctcctggacgaggtcgtccggctccaggctggagcgggcacacaaccggcgggccagccccagaaggctgggccgatgctgacggatgaacgcttcgaagcgcctccggtcccggttgaagaggttggacatgcagccccactcacatgcgcgcctgcgcgttacccagtcaaagacgcgcagcggtccaatccttgagaagaaaaaaaagaaggacccggacagaaaaatgcccgggagggtgaaaaaccctgcccgggcctggagatcagcggacctggctggcgttcggatgctccggcccgaccaggggaggaaccgccggcgacggcagcgggagccgcttgcgcggggcgacgctggccgtgtcgcagttgacgtaggtgttcttgacatgggcttcaccggactcggaatccaagctaccggccataagggattcgacgggcgtcatgagcgctcgcacctcgcgattggggatggtctgaaagctagacatggatgatacggcaacacgtacagtccttatcatgacacgcgccaaccccgcgcatctgacggggcaactcgcgacatggaattcacggagttctgaatgagcagggaagactcgcgcctggcattggagtggcacacctggctggcggaaaacctcgccctgggcgtgagcgcggaggacgcgcagcgggtgctcgtggatgcgggcgtggaggcttcgctggcgcagcgggagattgccacggcacaggcgcacccctacgtggtggcggcgcggcggattggccggcgctacgagtggctggaggcgctggcggacctctacgcggagctgcaccgccagtccggcgcggtgacgctggagaagcgccgaggggtgagcccggaggagttcttcacccgctactacttcggtcaccggccggtggtgctgcaaggcttcatggaggactggccggcgatgcgccgctggtcgctcgcggacttccgggagcgcttcggagacgtggaggtggaaatcatgtccgggcgcgacgccaacccggaccatgcctcgcagcccgacaaacaccgccaggtggtgaagctgcgcgactacgtccagcgggtggagacgggcggcgagtcgaatgacttctacatggtgccgcgcaacgagaactggaagcgcgacggactggcccggctgcgcgaggacatccgcgcgcccgccggcatcatcgacccggagctgcgtccggacatgacgacgctgctgctgggaccgccgggcaccgtcaccccgctccaccacgacaacatgaacgtgctgctgggccaggtgatgggccgcaagcatgtgcggctggtgccgtccttccagcgccacctcgtctacccgcgccatggcaccttcagctccgtggacgcggcgagcccggacgcggcgcgcttcccgctctacggcgaggccaccgtcctggagggcgtggtggagccgggcgagctgctcttcctgcccgtgggggtggtggcactgggtgcgcgcactggacgtgagcgccactgtcacgttccatcatttccagctcccgggaggcaacacgcacctgaggactccgcagtagacggccgcaccgcgcggccgcttgcgctcaatatgactccacgaggatgacgtgccgggtccacccggcacggctgtcccgctccaaccagcgctgacgctcgtcccgcagcgccaccgccggcgcggccccttcgcgaatgcggcgccggaccccatcgaagaagcggccggcggcatccgggatgtccaccgtggaggccagcaccgcccgtgcgcccgcatcgatgaacgccgcgggcaggctgaagggctcgtggctggtggtggtgctcgccgcgcgtccggcgctgcacgccgccaggaacaccatgggcgcccccgtgagcgtctgctgccgcaccacgtccgcggtgagcgcgtagcggccgctcgtctccggggacagcaccaccagcgacgcatccgagagcgccgggtccatgatgccgtgggcgtggatttcgatttcggtggcgtcccgcatgtccgccagcacgcgcgcgggcgtggcgtccgagccggacagcacctgcagcggcaccgcctccggctcctgcgagggcaaccactgcggcagccgcggcagttggagcagcgcgggcgcatccacgctggagacgacgagccgccgggccgtgggcgtggtgcgcggctgggccgtgcggccgagccggaagctccagggcacctccggcggcaacaggtccgtgtggccgaagacgggcggccaggcaagcacgtccacgcgctcgcagccacgcaacacctcacgcagccgatccggcaccagccgcgaggtgtccgcgcggatgaatggcccctgccggtccgtctcgtagtggcccagcacctggccttgcgtcccgcgcgccaccagcaccgtgcgctcgccatgcaccgccgccgcaagggcgcagcgctggggcacgggcgtgccaagctgcgcggccatcaactccaacgcctgggtgtactcgcccgccttgcccgcgtccgtgacgagcgacgaatagctcagcgcccaggcctcgcgcgccagtgaatctccccgaggcaatgcctccgcctcggtgatggtctgccgcagcagcgccagcccccgggctctgtcggaatccagcaggaagcggccctccacgtaacgggcatacaccgcgtcgctgggcatggggttgctgtggttggcccacgtgagggcctgccgcagcaacgcctcgtcccctggcttcggccgggtgcgcgacagctccgcgaggttgacggcgaacagcaggctcagcggctcgttcttgcaggcggcgttcgcgtccacctcgcggcgcgcgtcgtccatgcggttgtccaggtagtacgtgtgggccaggttctcccggggccagacgcagttgacgtgcccgcgggcggaccactcctccacataggcacgcgagctggcgaagtccccgcgtgagcgggtgatggcggccagcgcctccagggcggtgaactccatgtcccattcccggagctggcgcgcccaggcccaggcggtgcgggcatgctgctcgccctcggtgaggcgctggaggtcggcgtagaggatgctcaggcgcagctccaggtccacgcagcgcgtggacagaccgccctcgcggcagcgctggagcgcgttgaagatgcgctgctcggccttccaccactggccctcggccgtctcgcggatggcctcctcacgctcgatgtagaggttgaaccaggggtcgttctggcgcttcgcccgctccaccacctgcgaaaacatgcggcgcgtggcccgcgtgtgctgggccgtgcccaggaagaggtcgtcctctcccgacgccagcacccgctccagcagcttgtccggctggttcagcttgccgcgcaccagcgacgcgtactcgcgcgacagcacgccgcggcgcgtgaagttccggccgctcacccgcttgacgtagtccgtcagcgcggagcctccgtggccgcggtccaactcctgcgccaggggcagcagggccaggacgcgctccttcgacggcgccgcgcggaccacttcatagaaggcctgccggacgatgcccgggtccttgcgggccgcctccagcggaagaggcgcctgagggtcatccaccagcgccagcgtggcctcgcgcgcttccttccaccggcgggcgcgctccatcgtggcgtcgcgttgctcgcgagcgttggccttcgcctcgcggctccagcccggctcccccatcagcgccacctgttcgaaggtgtccgccgccttcatcgtgagccccatcgcctggagcaccagcgcgcggttccacatggcctgcgcatgcttcggctgcgccttcagcacgccgtccagcaaccgcaaggcctgctcatgtgagccgcgggcgaggtacaccgcggccaaatcactgtcgcggtccggagaggcgggcatgcgctccaggaacgaggccgcctggttccactcgccctgaagggcatacgcggaggcgataccggacaggtcgcccgcttcctccagccgggcgaggtctcgcagtgggatgggttcgggagcgacggggcagccgcccgccgacatacgtggccggtagcggtccgcttcggggtgcgtgagccgagcctcgatgcgtgacgcggagcggcgctccgcccagaactgcgcggatacaggtgccccgcttcccttggagggcgtgcgggcaagaaggacggtcaacaccaagacgggcgtggccagcgccaggaccaggactttgtcgtacgccggcttcaacatactgccccctcgggcgccatcccccaagcagccgcccatctaccgcgttgtacaccatccaccgttccccaccgacttccggggaggctgggcaacctgaaacagacgcctggctcatcgccacccgcggcatttctcccgctttttccaacccacctccccgactgcccgcccacgattcgccaggtggtcaggccgtgaaccaggcggcctgacctggagacggcttgcgccgaaaaccttgagtgcaggtcctccgcgcatcccttcggaatcactgtctccttggaggaaaaagccggcatgacgccaggggcccgcccgtcaggcagccctccacatgagacggcggacccacctccgcccgagggttctacgagagggcacgagcgggaagtagcacgtccgcctgagtgtcccactgcgccaacctggaacgaaaggacctcgcttgacgcagctgcttcgactcgccgccctggtgtctctgattccctcgttcgcctccgcggacgtggtgtggaaaggcgacttcgagacgggcaatacctcgcaatggacgcgcagtcagagcgtctccaacagccgtctccaggtggtgacggatgtggtccgcgaaggccgctatgcgctgaaggccacggtgcgccagggcgatgaccccatcaacgccagcggcaaccgcaatgaactgctctacatcagccaggagaagccggactccacctggtactacaagtggagcaccctcttccccaccaactacccgctcaatgacagctggcaggtcttcgcgcagtggcaccaggagggatgctgcggctcaccgccgctggagttctacgtgcgcggcgaagcgatgcacatgcgcgtgggcggcgtgaagggcaaggtgctgtggacggccccgctcaagcgcggtgactggagcgacttcgtgttgcaggtgaagtggtcgcccaacgcgaagacgggcttcgtccagctctggcacaacaacgaggtcgtcgtgccgaagacctacgtcgcgacgcagttcggcaaggagatgaactacctgaagctgggcctgtaccgcgacgacaccatccgtcccgaggccagcgtgtaccacgacggtttcaccatggcctcgacgctggaggaggtcatgccgccgccgacaccggagcccacccccgagccccccgcgccggagcccgagcccaccactcccgcgccggagcagccgggtgaggacgcgccgtccgaggagccccccgacgagcccatcgtccggacgcccgacacgcagccgcggacccgctggggcgtcacccctcccgaggacatcctctccggggagagtccgctgggcgccgacggggcgcggggctgcaatgcctccggcggcggaacggcgggtgtgcccatcaccgccgcggtgggcctgctctccttcgccgcgctgttcgcccgccgccgcaagccagcacaggctcgcgcccacgcgaagcgctgagcggcctcctcatcgcggggtgtgtcggtgatacggcaggccccgcgtgggaaggtcgtgagtcagggctccttgagcagggggagccctgaggtgaccttggccagcaacgtccgcagcgtggtgcgctcctcttcactcaagggcgccatcagcgcggcaatccgccggtagtggtccggcaacacgctctcgatgagttgccgggccttgggcgtgaggcgcaccgtgtacatgcggcggtcctccggatggtcctcgcgggagatgagggcatccttctccaacgtgtccagcaaccccgtcatcgtggcccggctgacgccagagctctccgcgaggtccgcgggcgtgagcccacgaacgcgctccacgtcgtcgtcctcggtggtgaacagtcggaccagcaccatgaaacgccccatcgacagcccgtgacggcccaggtgcgcctcgtaggcccccgacaagtcgtgcgaagcccgcagcaaggtgatgcacgtctcgatggcgctggcgtcgagctcggggaagcgcagcgccaggcgccggagccgctcgtagcgcggcatcgccgcgggcgtcggggaagtgggaggtcgagtaggcacggcacaggcctcgtaaggcccctaatgattttaggcaatgagaaagggcgcgctccgcaccgggggctggcgcctgctggcccgggcgttatgaacaggccgtgatggatgtgaaggacgcggccgtgcagacggccctgcgccgcgcgtgcgaggaggtcggcttgccggactcgctgcggggctgcgtatatcccctccttcgcgacccggagggtgactggccgggctgctgcggtggaggctgccacccgtgtgcctcctccctggtggacgtggcgatgcgcacgctggagctgctgggcaccccccggcgcgcgcccgtggtcgggtgaagtgaggccgggcagcggcataggctgcgggcatgaatcccattgtccatgccgaactggcctggctcgcggcacagggcctcaaggagcgcagggaccgcatcctcgtcacctgcgcgggactggcgccggacctggacggactcacgctgctcgcgggcgaggcgtattacgtccgctatcaccacgtcatcttccatggctacgtgggtgccatcgtcacggcggtggcctgcgcggcgctggcgcggcagcggctgcgggtggcggccctgtccctgtgcacctttcacctgcacctgctctgcgacctcgcgggcagcgggccgggctggcccatctactactactggcccacgagcatgcgggagtggttctgggaggggcagtggaacctcgcctcctggcagaacgcggtcatcgggctggccaccacgctgctgtgtctggcgtgcgcgctgcgcttccgccggaccttcgtggaggtgttctccgcccggtgggacgcggaagtcacgcgcactctccgtcgccggttcctccgtgaggatttcgtgcgggaaccatgacgtgattgtccatgcgtccgtcgccagcatggacgcatgctcatcctcggactcgggttgatggcagtgggcgtgctgggggcgtcgctcgaagcccccgtcacgtcagtcacggtctacagcaaccaggcgcaggtggcgcgctccggcagcctcacggtttccggctcgcggcgggtgacgtttccccggctgcccaagaacgtggatacggattccatccgcgtcgaagccgagggcgcggaagtgtcccacgtcgacgtgcgcaccgtgaaggaggaggccttctcccacgacgaagcccggaagctcatcgcgcgcatggaggaaattgacgcggcgctcgctcgcatcacggctgaacgaaacgtccaccatgcgcaaattgaagcgctccggcgggttcgtccctcggcgcagtccgacagcgaggccgcgcgcgcccagactccgcccaccacctgggacgccgcggtgtccttcctcgtggacaacgtggcccggatggaggcccggctgcgagaactggaggcgcaatccgcgacgctccagaaggaacagcagcagcacaaggagcgcgccacgacgttgggcaagacgttcggtgagcccggtgtcgaagtgactgccacgctcacgggcaaaggcgccacgaaggtgacgttgacgtacctcaccaccggggcccgctggtatccccactatgagctgcagttccaacccgaaacgcagcggatgcagatggccttctacggccgcgtgagccaggagacaggcgaggattgggagagcgcacggctcacgctcagcaccgccctgcctgccaacgccacggagttgcccaaactgagcacctggaagctgggcatccgggagcgattcattcccacgccgcgtcctcatgaagagtccattcaacccgtgccggacgcttcgaacaccccgtcccagcccacgacctcagccgaggaaatgctgcgcgcgcagttgctgcgacttgccggagagcggggcctgacacagcccgcagcctcgaagccgcaggtcaccgcgcaacgcgaacaaggagggatgggggccatccggggtaccgtcatcgacacccagtcccggcagacgctctccgatgtggtcgtcaccgcgatcccctcatcaagggaggcggagcacgtgacggtgacggacgccaagggtgagtacctcctccccaggctcccctccgaagcctacaccgtgcggtacgagcgtgagggctacaagccccatgcccgccgccccatccagatccgttcgaaccgcacactccgagtcaatgcggagctgcttcccgactctctgaacgagtccgtcgaaatcgttggccacccgcccaccatcgacgtcgggtcctcgaccatgggcgtcaacatcgatcaggagttcatcaagcggatcccaggctccattcagcggtcgatgtcactgaccccaccgcctggctggcgcccccccacatttgccccggattcgccagtcgccgtcgcgggaggctacaacctcaccttcacctcacagcacccggaaaccctcctcagtaacaagggggaacgcagcctcccgctggtctccgagtcctggcccgtgcaagtggagcgcaagattttccctgcgctctcgccgaacacgtacctcgtcgcaacgcttcagggcccatcccggaacgtgtttccagggggggatgcatcgctcttcgtgggcgccgacccggccggcaccgcgatgctgacaaccatcgttcccggggagtccttcaccctgccactgggcatcgaccgcgcggtacgcagcgcccgggacgtacggctcgtcgagtcggagaaaggcttcatctccaaggatgaggtgggcacgtacgtagtcaccaggaggttcccaatccctacccctgccccc

SEQ ID NO: 1238 - DNA, 21758 bp, Myxococcus xanthus
cttgtgcttcgtgaggaagtcggtgtccacccacgtgaagcgcgcgtcgctgcccagggtcgtcttgttcgcctccaggaagtcccgcatcagcaggtcctgactggggccggtggcgttgaagatgccggtggtgcgggcctccccggagcggatgatgaacgccgccaggtcccgcgcgtcgatgaactgcagcgggtccacgccgtcgccgggcgccaacacctcaccgccacgcgccacacgcagcggccagtaggtgaagcggtcggacgggtcgtccggcccgacaatgaggcccggcctcacgttgaagacgcgacccggcatggcggcctcggcggcctgctcgcacagcgccttcagcgcgccgtagtgctcctccacgtcttccgtcgtcgcgtcctccaccgtggccacggtggccgtctcgtcgagcccctgccgtgacaaatccttgtagacggagatggaggacacgaaggtgtagtgctggacgtgaggggccagcagctccgcggaggcgcgcacgacgcgcggcacgtagccggaggtgtccaccaccgcgtcccacttgcggccctccagcgccttcaggccctcgcccttgttcgggtcgcggtcgcccgtcagcttctccacgtccgggaagaggcccggcttcgtcttcccccggttgaagagcgtgacggtgtggccgcgcgagcgcgcgaactccaccagcgccggccccaggaacgcggtgccgcccaggatgaggatgcgcagcggcgcggcgggcgcggaggactgctccccttgcccctgggtggaagacgcggtggtgccggacgtgcccgtggtggcgcaccccatggcccagagcgagccgaccgcggccgctccctgaatcacactcctgcgagacagcgtcatgcgggattcctcctgcgtgtgtggactgactgcgtgtggatgaccgctagcgggccgcgacttcttcggacaccggcgcctcgggcgcggcggccggcaccggctccgcctgcctccgctggtggcgcgcgagatacagcgacacgcccagccacagccctgccaggggcaccgccgccagcgacaggcccgtcatgcccaggcccagcttcgcgaggcccccctggagccaggcgctcaccgtgtcgctgccgcggtacaccaccgtgtcgatgaagctcttcgacttgtagcgcgcctcgcggtccacggtggtgaagagcacctcgcgcgagggccgctccagcgcatagtggcttgcgccgcgcaccgccttgaacaggatgagcacggtcagcaccggcatggcggccatccccaggaagcccaggcccgtcaccaccggcgccacggcgagccccgcccccagccccagccaggagatgacacgccccgtgacgagcgtctgcaaccccagcgtcgccagttgcacgtagaagtcgatgtcaccgaagagggcggtgcggctggccgcgtcgctgccaagcgcggcgacgagccgcacctcctggaagtagaggaacgtggaggtcgccgcgtagagcagcacctggagccccagcgccagcaggaatggcgacgtcacgatgagccgcaaccccgcgagcacgccgccgcccaccgggccctgcgccgccgcgggctgctgctggacgtcctgggcccagccgctcagccggcgcacacactgtgcgctcacctccagcaacaccaccgagatgaggatgagattcaccgggcccaccggctcagcgagccgccccaccaggaagggccccaccagcatgcccgtggtgccgcccgcggcgatgaagccgaagagccgcttgctctgtccgctggcgaagacgtccgccatgaagctccagaagatggagacgacgaacaggttgtagacgctcaaccagacatagaagacgcgcgccaccgtctcccgcgccaccccgagcttcaagagcacgaagaagcccagcaggttgagcaggaagaagcggtagatgcgaggaatcaccacccgccggggccaacgcgacaccagggcggaaaaggcaggcaccgccgcgagcatcaccaggaaggtggcggtgaagagccagtccaaccccttcacgctgcccgccgtgcccatctcgttgcggatgggccggaggatggcatagccacacatcagcgtgaagaaatacaggaacgaccagcggacggcgccgacttcctcgtcccgaacgtccacgaatcgcctgagtatggaggaattcacgtgagcggcccaacgaggccccgggcaacgtattcccaggacctccatgatggaacgagcgcggcgggaagatgtcgcaaggattacgcgccggaagagaggacctcacggagcgccgcctccacccggggcagcgcctcctcgatttccttcaccgacgtggcccccaccgacaggcggaaccagcccgtgtccgcgtccagtccgaaggcctggaagggcaccacgcccaggttcgccttctccagcaggagcttgcggatgtcattgttggagcgcaggccccccttgcccaccaggtcgaagcgcaccgacaggtagatggcgccctggggcgcgatgtgctgcaccggcagccccgcctcgcgcatgcgcgtgaaccccttgtgcaaggcctccagccgcgcttccacggacttgcgcatcccctccaggaaggtctccgtcgccgccgtgtcgtcgaggtagcgcgccaccgcgacctgctccgccttgggggcccaggcgcccacgtggccgagcacgtcccgcatacgagcgatgatggtcggcggccccacgccccagcccacgcgcacgcccgtggcggcgaaggccttggagatgccatccacgaacaccgtgtacggcgccacctccggcaccagcgacaccggcgtgacgtgtctggccgcgccgaagctcagcacccagtaaatctggtcgtacatgaggatgagcggcttgcggccctgcttctcgcgctcgcggttctccgcgacgacgcgctcgcagatggcgcccagcgcatccggctcaatcatggtgccggtggggttgagcgggctgcacaggcacaagagacgcgcggcgcccaggtgcggcgccaattgctccacggtgggcatgaagccccgcgcggcgtccgtcaccaccaccgcgctcttcgcgtccatcatgtgcgcgtagtggttgttgttccacgaaggcaccgggtagacgaccgtctcccctgcatccagcacgctgcggtacgtgccgtagatgatgggccgcgcgcctcccgcgatgacgatgccctccagcgggtacttcagacccagcgagcgctcatagaagcgctgcacggcctgacgaagctccagcacgccatccgccggcgggtagttcgtctcgcccgcctggagcgcggcggtgatgtgctcccgcagcgggtcggggatggggaactcgcgcgggttgaagtcgcccacggtgaggttgcacaccttctggcccttggcgatccgctcgcgaatctccgccgcgatgcggaggatttcgctgccgacgatgccacgcgccatcgttcccacggtggcgtcgtccttggaggggcggggaagagaggtcaggtcgaggggggccatgggagcatgctctccggttcgtgcgcgttcgggggccgcgcggacgacttgcggcgcggacgatagtcgcggccccaccgtcctgtgtcatccattcgtggtgacggtggccctccggggcaaccggtcctccgtggaaatttccagcgctcccggggccgtccacgggtgttatctttgcccgctttcccttcgtgacactggcccccgggccgccgcccgtgcgagacgaggggccgcagtcccgaactcgcaggccctggcaggaggggaatgatgacgcggtccggacgcaggatgacgtcgctgtggttggccgggtgtctggcgttcgccgggtgctccaagaaggaggaacccaccgcggcgcccaccggcgcgcagccccagcccgaggtccaagcgccgcccacctcgccgcccctgggcaccattccccgcgaaggcgaggccgccgccaagccacccgtgcacacggcctccatgggtgatgaggaagtggccggcgcgcctccaagtgagacagagccgccttcggacgcccccacgggagacgctcccgccgaggacccgaagaaccgcgagtggaccaccacccccggtgtcgatgaagcggcgcccggcccagtcggtgacgctgcgctcggtgcgcgctggcacacatgccgacttcgaccgcgtggtgttcgagttcgacgggccgcaggtccccggctaccagctccagtacgtggacaagcccatcatccagtgtggctccggggacgagacgccgctggccggcaagggcttcctccaagtcatgctgacacccgcgcgtggccatgacgaccagggccgggccaccgtggccgcgctggagatgaagcccaagctgcccaccttgctggagctggtgcgcacgtgtgacttcgaggccgaggtgacgtgggtgctgggaaacaaggcccccaccgacttccgcgtcatggagctgcgcgaccccactcgcctcgtggtggacgtgaagcactgagggcccacgcgtcacccggcccgcagctcgcgggccagcgtgtccagtccttccagcaagcgctggtgccgcgcgcgcgccggagcaccctgcgcccgcagcgccatggcgagcgccgcgggcaggttcaccgcggcgtctcccttcaaccgctcgcggtactcccgcgcccagtcctggggcacgcgcagggaccagttgcgctcatccaccgtgccaggtgcgttgtacgtctccggcatcccgagcaggtcggtgaagaacatcatcacgttgcgcgcgcggctggcgaacaggtccgccaccttcgcctgcgccaaccgtcccgggctcgtggacagctcgcgcgcgaaggcctcgcgctccgagggctcggggcacaagcgcgcggccaggtactccgcctgagcgtgcagcgtgcccttccattgccagtccgccaccaggcgccacagggacttcgtgtcgtggttgcccaccatcacccagtcctccaggcccacgttctcactgcggtacacgtccgacgggttgtgcaggtccgccttctgcgtcacgcggaagcggcccaggccgtactgcgccagcacgcgctccaacgggtacggcagcgtgctgagcacctccgcgagcaagtcacccacttgccgcccgttgcgccgggacgcctccaccaccgtgtcgaagaggacgctgtagcggcgcacctgttcgggcgtgaggtccttcacccagcggtccgcgtagcgcggcacggcgcggtccacctgctccgggcgcacgagcgcgaagtgcgccagctccgggtggtccggcaggtccggtgacgagaagagccgcgcgccatgttgtacggaccacagcgcgtccggcaggtccgcgcggtacacccacgggcacaccagcccgtgcggatggtccagccgcagcccgtcgtattcaccgagcatcttgtccatgcgcgcgttcatgaagcgcagcacgggcccattgcggctcccggcgttcgtcccggcgtcgtccggttcgaagtactgctccgggtccatcaccggatagttccacggctggccgtccgggttcgtcctgctgggcggcgcgcccatgaggtaggtgcgcaggaagaggccctgccatgcccacgcgtcgcgcggcgacaggccaatctggaggtcgccgtacagcttcaaccgccatgcgcccacgcgctcgcgcaggccgtggtgctgcgcatgaaccaggaactgacagaaggcgtagcgctccagcgtgtccgcgtagcgcagctccagttgcgtcaggcgcgcgacggccgccgcttcctcctctggacgggggttccacaatcgcccgtccagcgagtccgcccagcgccgccagtccggttcgcgcttctcctcgcacagcacgtcgaagagggcatcccgcaccagccaggcccggtgctgctgacgaaaggtgtcgaagcgcgaagccagtgcccgaatggacggagcggcgtccggcgccgcacgcttcttttggaaggtgcgccacgcttcgttcagcagggtggtctgcacgcggaaggcgtgacggaagcgctccccggggggcagcgccgaagggcggctggcggcgagctgcgccacccggcccggtggcaacagcgcgccccagggctcgggggcctccagcggcgcgagcgccacgttgaggaggtttcgcgagaagagcgtgccgtcatacggcgaggcgttgaactccgtcacctgcccctgcggccccagttggatgccgttgaagcccagctcccgggcgaacgcgaggaagcgcgccgccccttccgagtacggcgagccccagcccgtgtcctcatctggaaggctggggaaactcgggtcgtggatgctgagcacccagttgcggacgtcgagcgcggccagggcttcggtgacgagtcggtggtgattttcaggcagcaaggcgcgagacatggcggaaggggctgaccctacggcccctggtgcgatgcgccaaccgtcctgtcgtcccgaacccgcccgttcgttgccgagccctcaatcgtgccgcgcctgaggggcgggccggggctctccacggccgccgcctccgcccggaacgtgaggccgctgttcgggaggcttcatccggaagagcttgcgcagcatgcgcgtggaccatgtccggccgtccaccaggatttcgtacaccgtgggaatcaccagcagtgtcagcagcgtggacgtcagcgtgccgccaatcaccgcgcgtcccagcggcgcgcggaagtcgccgccctcacccgcgccgatggccaccggcaccatgcccgccaccagcgcgaaggtcgtcatgatgatggggcgcagacggatgcggcccgcttcgatgagcgcctcgcgcagaggcatgcccttctcgtgcgaccacttggcgaagtcgatgaggaggatggcgttcttcgcgacgattcccatcagcagcatgatgccgatgaggctcatgaggttgagcgtgtcaccggtgatgagcagcgccagcaccacgccgatgagcgacagcggcagcgagatgaggatggccagcgggtccaggaaggagccgaactggatgaccaggatgaggtacatcagcatcagcgccatgccgagcgcgatgaacacgcgcatgaacacctcggcctggtccgcggactcgccgcccgtcgtcagcatgtagcccggcggcagcttcacgccgtccagccgcttctcgatgtccgcgcccacctccgacaacgagcgcccctgcacgttcgcctggacgttgatgacgcgctcacggttcaagtgcgttacctgcgccggacccaacgtttgacggatgtccgccacctgccccagcggcaccagccggggcggcccgctcgccgcgcctacggagatgggcaactgcgacaagtcattggggttgtcacgcgcacccggagccagccgcaccatgacgtctcgcgtctccccgatggggtccacccagtcccccacgtccaggcccgcgaaggccggccgcagcacctgggccacctgccccaccgtcacgcccaactgtccggcgagcccgcggtttagctccacctccagctccggcttctgccctcgcgtggacaggcccacgtccaccgcgccggctacctgctccacttccttctggacctgctgcgctagctgcgtgagcacccgctggtccggaccgcgcagctcgtactggagctgcttgaaggccccaccgaagcccgaggtgaagacggagacggtggcaccgccgatgcgcttcatctcctcgcggaactggacgcccaatgcgtcctggctcatgtcgcgctccgccttcggcttgagccgcacgtacaccagggcctggtccacgccgggcgcgctgagcgccaggggcacgccgatggtcgcgtaggtgtagtccacctccgggtgggcgcgcagggtacgcgtcacctcgtccaccttgcgccgcgtgtactccaggctggagcctgggggcgtctccaccaacagctccacctccgcgcggtcgctcaccggcacgaagccggcgccgcccacggtgccctggagcaccagcgcgcccaccagcgagcccaccgccaccagcaccatcaccagccggtggtccagcgcccaggcgatgacgtgcttgtagcgctccgcctgccggtcgaaccaggcgttgaagcgattcagcgtccgggtgatgaagcccgggttctgcttcctgggcggctccggccagtacgcgctcagcatcgggtccagcgagaaggacacgaacagcgacaccagcaccgcgcaggcgatggtgagggcgaagggcttgaaccactggccggccacgccgtacatgaaggccacaggcacgaatacggcgacgatggagaaggtggtcgccgaaaccgcgagaccgatttccgaggtgccctcgcgcgacgccgtgtagtggtccttccccatctccacgtggcggacgatgttctctcgcacgacgatggcgtcgtcgatgagaatgccgatggccagcgtcaggcccaagagcgacatggtgttgagcgtgaagccgaaggcccacacgctgatgaaggacgccagcacgctcaccggcaacgccaggccggtgatgacggtggagcgccacgagttgagaaagacgaagacgaccagcaccgtgagcagcgcgccttccaccagcgcggactgcacgttgtgcacggcgttctccacgcggacgccggcgtcgcgcacgatttcgagcttcacgcccgcggggagccgctgctggagcgcgtgcacccgctcacgcaccgcgtccgcgacctcggtggtgctgtagccacgggccttgagcacgtcgatgcccaccgcctgggcgccgttgaagagtgccagtgtgcgcggctcctcggcgccgacgaagacatccgccacctgctccaggcggatggcccgaccgttgcgcgaggccaccaccatggtccggaagtcctccaccttctccagtcggcccttgaggcggatggactcctccgtcagcggcgcgttgatgcggcccaccggcgccgccaggttctgcgcctggagcgccgccaccacctccgccaccgacaagcccgcggcctggagcgcctccggcttgagctgcaccgtcatctcccgcgccacgtcaccgacgacttccgcctgggcgacgccgggcaccgagcgcagctcgcccaccaccgtcgggtccgccaccagcgacagcgccgcgacgtccagtccttccgaggtgagcgttagcgacacgatgggctggtccgccgggtcgaagcgcgtgaggatgggctcctccatctcctgtggcaggtccgcgcgcttgctggagatggcgtcccggatgtcttgcgtcgcttcctggatgtccttctcgaagtcgaagaacaccgtgaaggacgccaggccgtcggtggcgatggacgtcgtctccttcgggtccacgccgctgatggcgaagatggcgtcctcgatgggctcgaggatttcccgctccaccgtctcgggtgaagcgcctggatagacgatggtgacgctcaccaccgggggctggacgtcggggaactcgtcggtctccaggagtcccagcgacacaaggccaaagaccaccagcgccagcatcgaattgatggtgatgatgggccgcttgatggcgaagtatgagatgaacacggacgtgactccaggcttggagcattagtgggacggcgcagcgtcctccgccgggggttgcgtggacgcgggccgcggagtgggctgcctcgctcccgacgacgggggcggcggcgcctccgagccgccaacaccgggccccgcctcctccacgggcttcgagtccggccgtggggacgacaccttcacgcgcccgccctccgccacctcgctccgcgcggcgcccagcagcaccacgtcgccgtcctccagaccggagcggacctcgacctgccgcgccacctcgtcgcgcaggcccaatctgacgttcacccgctgcgcgcgcccttcctggatgcgcagcacggcgggctcggtccccgtgtcgtcgatggcgtcgatgggaatcgcgaccgcctgcgtacccttcgaggccacgcgcccctccgcgaagaggccggccagcaattggaggtccgtgttgggaatggccacgtagatgcggacctggccggtggccgggtccaccaccgggttgatgcgctccaccgtgccgcggaaggcgcggtccccatagcccgtcacgtggaactccaccggcgtgtccaccttcacctgttcgagctgcgcggcgggcacggaggcctccaggcgcaacgtgcgcgggtccaccaccgtgaagagcggcgcgctgggctggacgacgtcacccgcgctggcctgccgctcgctcaccacgcccgcgaagggcgccacgacgcgcgcgcggttgagctgctcctgcgccagggcatgccgggagcgcgcctccgcgagctgccccttggcctgctccacggagagctccgcccgttcgaagtcgcgctgggtgatgacgcccgccttggacagcctcgtggcgcgctcctgctcggcctcggctacctggagcgcgcttcgggccgtgcggaccgccgccgacgccgcgatgagctggtccttcagcgtgacgtcctcgatgcgcgccagctcctcgcccttcttcaccacctggccctgctgggccttgatgtcgaggatggtgccgcccacttccgcgcgcaccgccgccgccgtgcgcgcctgcaggttgccggagatgccaggaccggagcgcaactgccgcacctcggcgcgggccacgttctcctggcccagcgtcatctccagctcctcttgtcgaggcgcgggcgctgcgtcctcacccttccggcaaccggacagggcgcagagccccatcagaatccccgccgaggttccgccgaagacctgtcgtattcgagcccgtctcacagcgcgtctcccatccccgccccccacggcgagccggctaaccatggtgtcggccccctgcccccggtagccgagggcaacaaggcccaccgccagcaagcaggccgggctgacgggctggcgagccttctcaggcacgccaggcggacggcgcctactgcgcgggagggacctcgctcatgatgagcgtgccggcctggaagtgggcccacttgccgcattgggtgagctgcgtctgccccgggcagctcacggcctgtgccgcgcgcgtcgtctgcgtgaagcagcgcgcaccgtcggcgtcccactcggcttcgtgtagccacgcctccgtatccgtctgcacgttcacgccgtcatgaaggttcacccactggccatccgtggtgtgcgacgtgccgtcgccgcagaagtccgcgcgcaccatgcgcgtgcacgcctggtggtggtccgccagactcaagccgtccgccgtggtgccccaaggccggtagccgaagcgcacgcatttggcgatggccgccccctcacaggcgaaggtgaagcgcgcggcgtcatccaccttcgcgccgccgcccgccacgccctggcggtagtcccaccggcccgccacgggaatggcgctcagcgcggagccgtccgccgccgcgcacgcgggcttccagagggcatccgccgcgtcgtagtaggagacgaggtacgcccagacgtccgcgtccgcgcccgctccaggctcgatgccgtcaacgcgcagctccacggtgtcaccactgctcaggttgccgatgaagcgcgcgcccaggaaggactggccggacaccgggccgctggaggcgacgccgtggaagacgctgccctccagccgcacctcgccgagaacctcctccgcgatgcgggcgcccgccaggtccacggacacgagcagctgtcccagctcgggggtgttcaggttgcggccattcaggttgcggccattcaggttccgtccgttcggcgccaccagctccgccacgcccgagcgaagcgccaccggctccgcctccatcacgttccccgcacagcccaccatgctcaccgcgctgaccagcgccgccaccgtctgcttccaagcacccatcacccaccaccttcccggcccgaccacggaatcaatgtccgcagcggccgcccgcccagcaactcgcctggggacccgcaggcacttgcttcgtccactgcgcatcaccagccccagacgccagggcggacacagggttcctccgtccggtagcgcgcggagtggatgtagggcaggcaggcgagctcaggggtgcgcgttggctgccacgtccgcgcacacccgcatgcccaccgtcacgtcgcgcagggacggctccggcagctcgcggttggaggcgcgcgccgaggtcgccgcgaaggcgaagctgcccccgcgcgccacggccttgcccggctccagccaggagcgggtccactcccacacgttgccggacatgtcgtccacgccgaagggactgcgcgatgcggggtggctgcccacctcgtcggggccgaagcctccgggctgcttgccgtaggtggtgtcgatgttggcgtcgtccgggcctagggtgtcgccatgcgggtactcacgcccgtccacgccgcgcgccgcgcgctcccactccagctccgagcagagccgtgcgccggggacgcggccgctctccgacagccacgcggcataggcatccgcgtccgcgaaggtgatgccgctgacggggaagcgcagccagtcctgctccgcgcgcgacgtgcggtgggcgtagcgcagcggcgctccggcccgcgccatgtagggctcgttccccggctggaagcgcagccgccagacgccgtccacctgccccagcgtgagcaggcccgcgtagccgcccgttcccacgcgcggcagccgctgtgcgcgttgcgcgggcggcagcgactccacgtaggccagccactcggcatacgtcacctcgtgccgggccatcaggaaggcggggacttccacggggtgcaggggcacggcgttgaagaactcgcgcacgctggcctcggccgcgctgccgaacttcacctcgcccggcggcacgaagacgaagccctccggcacgctgcccatgcgcggcagcggcacgccgagccgccgcgactcgcctcgccgcagcagcacccactgcaccaccggctcgtagccgagcgagcgcgcggaaatctggtacgtgcccggcgccaccgctgcgtccagccagcgccccgggtccgcttgcaggggctctcccagctgaaacctgccctgcgcatcgcgcgtcagtggacgcagctccacctccgcccctgagacaggtgtctccagtgtgaggctggccgcggcgttccagcgccgccagcgcgtgcccgccgtgtcatagagccgcagacgctggagcaacgcgggcagcgccgcggtgtcttcgtcctgctcggcccacagggcgcgctcgtagaggaagtccgccagggcctcgcgcacgtctgcgcggccgggcgccaacgccagcgcgcgctccagccgtccggccacttcgtcgaaacggccgcgcagctgtcccgcttgcgcaccggcccggttccagtgccggtccgcgtcggcgcggcggccggtgccgtagaggcggaaggcctcgtcgcgctcggcgcgcagcgtgccccagtcctgacgcacggcgctcaaggcctgggccgcctggcccagctcctcgcgcacctgccggtccaggctccaacgctccctcagcttgagcccgccgtagacgagccccagggacacgacgaaccccaccaccagcgcatgccgcgtccgccggctgcgcaccatggtgcgacgcgaggccttcaggaagtcgcgctcgcgacgggtgagctctcccgtgtcgagcacctgcgtctcctccagctgacgcgggccccagagggactcgctcgggaagcccagcttctcccagtgcgcggcggcggcctccagtcgggattggacctcgcgtcgctcggaggcctcggccaaccagcgcgccagcgtgccccagccggagagcagcgcctcgtgggcgagttcgtaggacgtgccctcctgggcctcgcgcgccacgagtagccgcgcgtgcaccagcgcctccagggcggcgcggtagcgggcgtcgtcccccaccagctcgcggtccgtcttccgcgcgcgggtgccgtccacggtgacgagccgcaggagcacgccccgggccgccacccgctggtccggtagcaaccgggccaccgccgcatccgcgtgccgcgcgagcgcgccctccacgccgcccagcgagtcgagcaccgcctgcgtcatgacacccgccgccgcgtctcgcgcatcccacatctcggccagcgcgaactggagcaccgggaggccgccctccgctgcggacagggtggaggtgacgagcgcatccaccagcgcgtcggattcaaagcgcacgcccttcacgcgggcggggcccgtcacggcgtcccgtgtctcctcgggcgacaaggcgcgcagcagatacagcgcgcgtggcacctccgcgcccagtccgggaacggcggacagccgggtgaggaagtcacttcgccccgtggcgagcaggcgcacgccactggcgccctccgcgagcgcccccagggcctgtcccgccagctccgcctcggccggcggcgccagcgtcaccagctcctcgagctgatccacgtagacgagcagcccctcctgggcccccagcttcacgcggagccggcgcaccagggacgtgggctcggcgcgcagggtttcggccagggtctcctcttccgtctccagcacgggcgcgagcgccgcgaccagggccgccaggggcctgcggcccggcaccagccgcacgctgcgccagcgacgcccgtcctccaggcccccttcggtgacagcggggagcagcccggcgaggcacagggaggatttccccacgcccgaatcaccggtgatgagcaggaagggctccgagcgcatccgctccagcaccgcgcgctgttcgcggcggcggccgaagaagacggcgcggtgctccgcctcgaaggcctggaggccgcggtagggattgccctccggcaccgcctggacggtgtcgtcacgcgtcagtgcgtccaaggcatcgagcagctgtgaggcggtggcgtaacgctcggacggctcgcgacgcagacacttgtcgatgacggcggcgagcccggcatccacgccggacaccacctgggccagggggctggcatcccggtggcgcacctgagccggaagttcgcgccagggaacatcccggaaggggcccttgcccgcgcacaactcgtacaggacgacgcccagtgagtacacgtcactgcgcgccgtcagcgcctctcccgcccaggcctccggggacatgtaatacggcgtccccaccagcgagccgcgcggcagcgatggaaggaagactccgtccagcgagcgcgcgcccaggttcgggctggcctccgggtccaggtcaggaggcaactccggtggcggagtcccgcaagcgggcggcgcggaatcccccgcccccgcggcccggtccaggagcttcgcgaggccgaagtcgagcaacttcacctcgccagcctcggtgagcacggcgttgccgggcttgatgtcccggtgcaacaccccgcgccggtgcgcggcgctcaggccccgtgccaaatcccgccccatggacagcacgcgctcccagggttggggcttgggcagccggtccaggctcatcccccgaatgaactcggagacgaggtagggctgctcctccaattgtcccacccggtagagggtgacgacattggggtgctggatgcgcgcggccgcccgggcctccacgagaaaccgcgccagggcgttgggccccagggcggggatgaacttcacggcgacggggcgctcgagcaacgtgtcatgggccaggaacacccgccccgtgcgcccacgcccgatggcccgcacaaggcggtactcgtcgaactcctggggaggagtccacgcatcaggagacggcgaggcggccggagagcccacacccggtgcctatgcatccgtccggcaggggtcaactgaacgggccgcgagggaggagactccaggacgccagggccgcaggagtgtccgttgccgagcagtggtgttgtccttgggcctcagccgccccggaccttccccttgctcggcttgagcatgtttcggatcttgttctccaaatcctgcggcagacagggcttggcgacgaactcgtccgcgccagcgtcccgggcatgctccgcgttccccgcgagcacatggccggtgagcgccatgacggggatgtcccgggtgcgggagtcctgcttgatgcgccgcgtcgcctcccagccgtccatgacggggagggacaggtccatcaggatgatgtcgggctcgccctcgctggccttctccaccgcttccacgccgttgcgggcggtgtccacctcgaagccgacgaactccaggtactccgcgtacatctcccgggcatcgtcgaagtcgtccaccacgagcacgcgcttcttgttcccgcccggcgcgggctccttggcggttggcatgtcttctgccgggactgtcatcgccgtgctcttcatgggacagacgcctctcgggttggaacgggcgttgaacaatctatacacgcccctcccgacgtgcccaccccacccggctcttcaacgaatgcggaccagagtgccagtacgtgttcagtggaggacaggtgggctggatggagaaacgttgactgtgtatcagttgttgggacggtagacgtagaggtggcgacggctgggggtgcctgcggactcctcgatgcgggccagcacccattgctcggggcccgtcatgaagaactgggcggggcccaccggcgtagcgcctgggcgcgggagcagcggagtccccatgggcgcccatgaactttcgtcccagcggcgaacgtagtggttcaccgggccaccggcgatctcaggttcggagatgagcgcgaccaactggccatcatggtcgagctcaaggacctccgccgtagcgttggtttcgccggggtacatgccttcgataacagggccgaggagctgccatcctcctcccgggacaaaacgtccgacgatgggtctgaagcccgcgcctgccactacatcttgtgatgagccagcaagtacgagccgatccgctccatccaatgcggacgcaatcggaatcccgcctcccgatggtatccagtcggactccacccaatgtgtctcggcccatctcctggaatgcagctccattcccccccctctgctggaatgaagggcccaaaaaagagcaggacgatcagccgaatccaccatcaagttcagactagccatctccagatgatgattcaccgtcagaacatgcttcaccctctcccaagattctccatcccagagccaagtcgaaatggaagaagagttcccttcgatgaactcgtgaacaaccagccaacgccctccgcgagagtccactacaaaatcgaatgaaccgaacctcgcttcaagataagttgctgtaacaggcgcaccaacggctgaccaaccgcctccgctccagcgccggacgtgtacgcttggcgtaccgtcggacgtctccacactccatgcaacgaggaactcgcctcccggtgatatctgaagggagcaagccataatgatggattcggcagcgctcgctccaagcacctcacccaactgctcccatgccgcgccggtccaccgcatgacgtagacaccatgttcggaaggcgaatcgccatcaacgaaagcaacaacagggtttccattcccatccagcacaaacgagaacttcgagacgttcgaagcctcgacagtgccggcagaaagggcccctccgtaatggagatgcctggggatggcccactcccaatccagtgccgttacatccaacgcgttgcctgccacgtctgtcaccgaaggcgcgatggtcacagatacatttgagtccacgggaatttgcgtagcaggcgtcagcgtcaccgtcatgccatcggccgacaggcgcacccctgcagtaatatccgattgattgaccaagagcctgatggactccgcgttcacggtggacggctcgacagcctcggagaagacagcctgaatgggagcatgcacggaaacgtcccggtccccagaccgagggctctgcgtcaccacccacggtgctgtccggtcgacgaacagcgtgttcgccgcactcacgtaaacacggtcgccgattgatgcccttgcggtgatgatgtactggccctcgtcgaggtcacgggtgctccaccgcaactcgtaagaaggctggggcaacgtcgctgtggggacgccatcaaccagcaactcgaccgactccggcgccaactccgcgaccgaaactcgcacatcgacatcaccattcgtcgccgcacgcgacagcgttagcgtcacatcctggcttggcggccccgcgtccggcgactcgggcacaatttcgattccaggcacgttgatgcatgcccagaacaaggaactgagacacactgcccaaaccctgatggagttcatatgtcctaatcgggcatgcagcagccattcccaggaagggcgggctttgctgcccaaaaggtttgagtattcggtgacttacagggaaggagtagtccgagccgacccgaggcacaccacgacttggaccgtgggtccgaatatgtggactccccgcccgagcgacacacttcgacttcccaaaagacaacacccccgcgggaaaatgccccacgggggtgtctgttcaagcccaagcgtctatcaaagcagacttgcccgtgagctcacggcagcgggggcgccggatgcaccccaatccccgtaatagcaatgtcgctcgtaagaggctggccccagatgttctcgtaggttccgatggccccacgactccccagcttagagaagcccaccgaaatctcagtcccgagcagattggggttgtccggcccaggataactgaaatagaaccgggagctgtatcccgacttgatgattgggaacacagcggtttcggcaggcgtggtggtatgcagcgggagcgtcggctcgtcatcaatgaggtcgaatcccatcaggttgcccttttcgccctgcgcatcgccgagcttgccactgttgttaaggtcaatattgaaaaagacctgaacgcggtacccattcgcgattttgttcgcaatcggatgcgcgaagtacacgtaaaccctttcaccgaaattcaactgccccgaagccggaagtgccagtgacgtttcgtggtaccgcgcctctacgatagccgtcggattctgcggcccacgcggctcacccgcgaagaagaagccctgggagttgaagagcgagccaccctcggcggacaccgcgcgcacatccaggttgtactccttgccctcgacggtgctcccggggttgacggtcgcgctgtatccaccgttgttcacggtcgccgtcacgcccagcgactcccgcgcatcctcgttggtcatacgcacgagcaacgagccctgctggatcggctggttgaagtacaggtggatgagctcgcccgggcggaccaggttacgcagcgggtgcatgtcaacagcggcgccccggaggctggccacgttgctgctctcgatgctcagcggcacgttctgcggccgcgagtacggcaggctgatgagccgcgtggtgctgttggccaccacctcggccccatagtacgtgttgacgtagccaccggtctccgggacgccgtcaccgttggcgtcgatgggcgacacccacagcctgtactcgccgttgccgttgcgcaggcgcgccagctcagaagcgctcgggatgcccgtgaaggtgagcaggccctgctcgttcgcggtcgcctccaccaccacggagctcaccatcgacgaggactcatcgccgttggagatggcacccgccggcgtggcctccagcgtcgcccgagcacccgccgcgggacggccctgcggcgtcaccaccaggaagttcagcgtgccgtccagccgcgccagggtgatggggccgaagctcgcgttgccgttgttgatggggacgttgcccgcggacgacggaacctgcgccgtcgcgcgcagcgtggcatagcccgccttggagaacgtcagcagcacgtgcgaaccggccgggacgttcttgtaggtgaagttgcccttcgcatccgagacggtcgacaccggctccgccgagctgccgatggtcatctccaccgtgacctcggtcagcggccgcaggtccgtgctcagcacctggccggacaccgtgcccttgggattggctggcgtcaccaccgtcacagtgtccggttcgcgcacgccgtccgcgattccgtctccgtccgcgtcaaccaggtcgtctccacaaccgaacgccaggaacggaaccacggccattaccagatgcttcttcatcatccccgccttgaaagaaaagtccccaagtatcgccgcctcaacacttcatgaggcgtcagccggacactctccgacacttgcccgttccgtcaagaagcccccctgattcaaggcgggttctcatcggccgagacgcccgtaaccgggtgtgtcacggatcactcggagaaccccgtatgccctcatggacatgagtcaccgttgacccgatggcgtgacccacccgggctatccccggactgctagcgtgagtccatgccggatgttttggatgtgaatgacccatgtctcggctgcgccatcgtgcgcggtgaaacacgacccgtgggaggcgtcatcgcgcgcgcgccgggactggtgctgcatggcgtggcgggccccagccccgtgcccggctgggtcgtcatctccagcgcccggcacgtgcgcgcctggtatgacctggaaccggacgcggcgagcgagctcggccccttcgccgcccgggtcatgcgcgcccagcgcgaggtgctgggcgccgaacacgcctacgccttcgccattggcgatgtgctgcgccacttccacctccacctcgtccctcgctattcgcagacgccgcagcggctctggggccgggccgccttcgacgctcccgcctccgaccacctccccgcgcaggaactggaggccgcggcgcaggcgctcgccgccgcgctggcgggctgaagcccgggcccagggccaccctcacgtgatagagacagcggcctcccctcccgtcgagaggtgccgccttgtcgcccgagccccgcaaccgcgtcctggaaaagatgcttgagcggctctacgccgcgctcgcatccggccccagcctcaacagccggccgcacaacagccgccagcgcgtggacctccccacgctgaaccggctggatgggaccgcgccccacacct

SEQ ID NO: 1239 - DNA, 25048 bp, Myxococcus xanthus
cgcgtggggcgctgggctcaacggctgcgacgcggccgaagccgcccgctgtatcgctgaagccacgcgcgcctgagccgcctcactttcaggggcgacttcgggggcgacgcgaggcctacgagcccgtccgcgggtcgcgttgaacgcgggggcctcagcggctgaacatggccttgacactcaggtcgttctgccggcggacctcggcgaccttcgtcgcgtcggcagcggccagggcctttgggagcttctcggcgtcgaggtcggtgcagtacaccgccgtgcccggttgctgccgccaggactccgacaaggggcccgcgtcgatggcatcgaagcccagtgcatcaacgagctgaagaatctgctgtcgcgcccgcgggtcatcgcccgaaaccggaagcgcgatgcgccccggtgccccacggggaagacccttcgtgtccaggctgccagcctggatgttgttgaaggctttcacgaccggacgcttcagttgcgctgagacccactcgctgtcggtctgccccgcatcgatggcgccgatgtggccgtcgcggaactccgggtagtagttgcccgtgtcgaccaccacgacgtccgcgggcacgtcgtcgaacaggccgggcggcaaatccgtgatggccttctggggaatggtcacgatgacgatggggcccgcgtgcgccgcgtggcgaacggtgacgggctttgcacccacgctcgccgcgatggtcgtgacgccctcgacgccgcgtgagtttgctagtgaaatctcatgccccagggcattgaggtgccgcgccagggtcgcgccaatgctccctgcgccgatgattccgatgttcatgggacgagcaacctaatgaggcgttccgcggctcgctcgtcattccatcgcgcgcccctgcacctgtgtgagcagtgcgcccgtggccaggtcgacgcgcccgagcgcccccggcatggcccggtgcatcaatcacacatgcgccatgaacaattacagcaacacatcaagaggttgtctctgtcgcgcgggctggcaaggctgtgccccatgacacacaagcggctgaagaggattggcatggtgggcgggggcgccatggggtgcggtatcgcgctcgagctcgccatcgccggcaggcaggtggtgctctacaacacgcgcgccgacagcagcgagcgggcacgcgcgaagctggagcgagacgcatcgctgctggtggagacgggcctgctcgccccggagcaggctcccgccgcgatcggacgcatccgccgcaccacagtgctcgccgaggccgccgtggagcaggacctggtcatcgagtccatccccgaggacctcgccctcaagcagcagctcttccgcgagctggaccagctcgcggcccccgacacactgctcgccaccaacaccaccgcgctgagcgtgacggccatcgctcgggactgcacgcggccggagcgcgtcctctctgcccactactatctgcccgcgcacctcatcccgctggtggacatcattcccggcgagaagacgtcccccgacgcggtggagacggtgcggcggttcattgaggagcttggcaagtcgccggtggtgttctccagggacgtgccgggctcggtgggtccgcgcctgcagcaggccctcatcggcgaggccatccggctggtgcacgagggcgtggccacgccggagatggtggaccgcgtgctcacccagggcgtcggacggcgcctgggcgcttcgggtgtcttcgaccggctggacctggtggggttggacttcatgacggccctcctccgcggcaccggccgccccgtgccgcccgtgctcgcgcagaaggtggagcggggcgagctgggccagaagacgggccagggcttctactcctggacgcccgagtccaccgctgcctacgaggagcgcatggcccgccacctcgccacccagcttcgtgaggatcgggcagcgggccgcctccgcactcccatggcggagctggcggaatgaggacggagaccgtcctgctggattcggcggtgctgtcagacttcctggtggacgccatccgcgagtacaccacgtgcaccccggagctcccgccccggagctgggccgtgctgctggggcgcgtcgccagcgacgccatgcgcgtggagcgtgttcgcttcgccaccaacgtccgcgagacggatgagcgcgtactccaggagttcgacaccaccatcatcccccgcttcggcgcctgctacgccaacgggcgtcgtggcttctggtgcgagccacgagagttgctgcgcatcaccacagaggctgaggcccagggactggaagtgctcggctccatccacctgcacccggactggcaccgcatcggcccaccccacgagcgcggcctgcgcgtcagccaggaacccacgcccatggaccgacacctcttccagggcagcggctggccgctcaacatgattctctacctggagagacgcgagggcagactctatcactcggtcggagcgtgggctccgcccgatggccaggaggtcggcgcgggctgtcgcgcgctggccatccgcatggagactccggagcggtgaaccataaccgtccggccagtgatgtggcgtaaggggttgcaagcggacgaggggcgtggtcggcgaggagcgagttgtacagagacagggctggagacgtgagcccggcgggtcggcggtgcgccgccggatacaaaaagcccagcaacccggtgggattgctgggcttcacagtggaggcggcgggaatcgaacccgctccggacggtgcgaaaatcccagcagaatcgcgcccttacctcgtaaccgcccggaacgactcagcttcgatgtcccgccgtgtcccctggtgtcccacccagttccggtccgttccgcagtgtcgtgcgacatacgtgcaacatggaaacggcccaaatgccgcccccgccagtcggtcaggacgtcgtcacgtcatccggattgcgcgttccccgcccacggcgctggggcgataccgtgccccgtgctgcctcttcggcctgagccgcccgcgctcgcacttccgctgcggcatcggccttcgtgaaagtgccaccaaaccaggccgccaggtcggcagccaactcccccgctgactggtagcgctcacgaggggcaacccgaagtagccgattcagcgtcacgcgcagcccctggggaagcccctcagtcatcgcgtctacgtccgcagccgtcagtgtcgccgcgcgccaaatcgcgtcggccaccaacggcggcgcccctgcgagcgtggcccgcttgattgcccgagcgacccgacgacgcttcttcgtgggcaacgagcccatgactttcccccgctgactggtagcgctcacgaggggcaacccgaagtagccgattcagcgtcacgcgcagcccctggggaagcccctcagtcatcgcgtctacgtccgcagccgtcagtgtcgccgcgcgccaaatcgcgtcggccaccaacggcggcgcccctgcgagcgtggcccgcttgattgcccgagcgacccgacgacgcttcttcgtgggcaacgagcccatgacttcgggcgtgatgtcgtccgggcaaaagagcaggttcttccccgttgccagttcgagcagcacgacgcccagcatgaagaggtcggagcgcgcatcgacgctcccccctagaagcatctccggtgacgagtagaagtggtccccgtaagggccccgcgccgaagaggccactcggcccggcaagtcagacagcgcgaggccgaagtcggcgagctgaaccgtcccgtcccagttgacgaagacgtgctcaacgtcgacggcccgatgaacgatgttgagtggccgtccctgctcgtccttcgcggcgtgcgcgtgctcaagggccgctgcgacctgagcgccgacgtagagaacgaagagcggcgggaaccatcgctgactctcaccaacgagcgtcagcagctcattcagggagtgaccatccgggtgctccgtactgacgtaccaatagccctcgaccttgtgcagcccatgcaccttgaggatggacgggtgattgaggaaggtagcaaggcgaacctgctcatcgagcttcgcccgagcacgcatgacccgagccccttccgtttccgatggagccggaaccgccttgagcagcaccttcccgcgcggtgccccggacgcggttcgcagccgagctacgaacagggccatcccgtggtgagtcggccctaagtcctcgcggtactcgtagccgaccccgcccgccgagaagaggatcgccccccgtgggatcttgaactcgattgccttcgacatgccgttgcccctcgtgtgcgaactcgcaaccaacgcgacgaggaaaacgctacctgcggcatccggttgagggaacgccctcacgggtcatggggtcaaaacggcgtattcggcccgaatttgacctcctacctattacgtcccccctgcggtcagggccagcggtccacgacgtagccgccccctgagttaaacgccttcacccggccgtcactgtacccttcagaggggggcctcgacgacgaagcacacggggcgctcatcctgccccggcagcttcactcggtcgtagcggatgaccagcgcgggtccctccgagcggcccattcggtcagataggtaatacgccttgccgtagaaatgcgtcccaggcggagcaaacgccattctggaccgaaagaacccccttcggaaccacccccaccacatctgccccagcagtgacccaaccaacgtcttcagggccatgacgggcattgagggtgaggttgaacaattgatttaccttccagcggaagatcctcccgcatcgactcttccgcaccagccgggcaagtgaacgcctcaggccgaatctgggcactggggcaacccgccgcgagtgccgcaacgagcgtcatcgtcgcgcagtcggcagcaacggcggccttcgtcctcccgcgtaactggcgtccttggggtgggacctcgggtgacggagtcgtcttcacggttgaaccttccttcggagcggcagttacttgccccgtcagcagcacaggcggggggctaggaggtgacatagcaggggcagacgacgtgcgcggagccgaataaggagggctctgcgggctcggcgcaccagcgacggtcggcgccccgggctccgtgggttcccctcgggtgagcaagaagcccccagccacgaccaacgagatgagggttgccacgcccgccaagaggcccattccagtccgcacagggccacgctcaagggcatctggcgagttcggcacctctacggcagggcgcaccggcccaggtgcctccggcttccgttgctcggacggcggatgcaccgggcgtaggaactccgcactcgaataggccaggagttcgcccagctcacgacgtagagcctctgagtcgacggggcgcttggccgggtcacgcgacaggatgcaatcaacgaggtcgttcagagcttctggaacacgcacgttcaacgcacgcgcaggaggcggcttcatgacggtgctgttgagcgtaactcgcgcttgaacctccgtgggtcgggggtcggtcagcaactcatagagcatggcgccgaccgcgaaaatctcgtccgcgacgcggaaggcgtacttcgcgcgctgttcggccttgtgctcccgaagccatgcgaactgctccggcgcgcgaaagcggtccgtccccggaggcaagccccaatccgtcagctcttcagccaacgagtagctggcacagctaaagtcgataatgaccggctctccatcgctcttccgaatcagaacgttggacagcttcaaatcccgatgtaggacgccacggccgtgcatgtacgaaagcgcggcggaaatcttgtcgaagacctgcaagacctcttgaaccgtggggtgtttacgctccgcccattcagcaagggtccacccctctacgtactcgagcgcgagatagacatttccctgctcggagtatccatacccacggtgcttgacgatgttcggatggtccagaaggaggagtgccgaaagctctcgaagcgtccgcgcgtgagtctgcttgtcgtccccactcgaatcccggtggcgagctaacttgagcgcgcatcgacggccatgcttttcgacgagatagaggattgcaaacccccggtttccattttttttgacgacactccacccatcgatgttggtaccagggggtggaaacatcgaaatcacgttcatggagttcccccggaagcagcctttggcaacctcacattggggatcgtgagcgtgcggccgtcccccaccacctccagagtaaagacagggcttgcactcaactgtgctgtctcggcaaccacgagaattcggccgtatccgcctgaaggcattgcgcccggagcaactgttacgatgcgcccctttagcggcagcccgacgcgtccagtcagcgtggctactcgtggcacccaaggtggttgcccgaggttgttccgtatcccaagatccacaagcacccacccctgtgcgcgataggccaccccggacactacagcgaagccttgtgccgcatctctatgtgccttgatgagcgttgccgttacgccctccttgtcgacatacccgagcagcacgaagtcttcaggtctgggcattcgcggttcgtcaaccgggcatccctcgactgtcatctcggggcgctgaacattgatctgaatgtccacttcggccgggtctgtgaccagtgagaaggcagctcgcgcaggagcccggccatccgcgaagaagaccccaacttcgtagcgctcaccttcggcaaggtcggccaccggctgaacgatgaccgaccgctcaccggcatccaggacgcgaatccgcgactcgtcgaaggtcagggtcttccggttgatgggagccggaaacaggaagagcgtcggcgtgtcgcgagccactcggacgacaggaagtggatcggtagggctgtttgcaacggacaccgcgcggtcccgcttcgcgcgttccgcttgttccgccatggctggcgtcgcagcccccccacgcgagaaccagcacaagggccaatctgaccggttggatcaaaggcgcatgacctcccagagcaggaagctaccatcgcggatactcgcgcagtgggcctatttcctacaggccagcacgccccgtgtggtgcgcggtcccccgtgcctcgcacttggcttgttggtcccgcctaggtatgaaggcagccgggcggctgtggtgagtacgtagttcacggcgtcgcgaggtcccagaccaaccgcgccgattccgcagccgcccgctatcgctccacaagcttcgcaacggcgaacccggccccaagcccggcaagcagcgccacaatggcgaccgtgaaggacacgtccccagcctgctggcgtaacgactcgttctcggcgcgcagccgcgcaatctccgaggcggttcgaatgcagcggctttccgacagccagcagccgccctccacctccacggctgccgaacctccatccggaaagagctgagcgcgctcgacgctgatgacctccgagcccgacgcgggaagcgcgagcagaacaaccagcacgagcgcgccgagcttcacttgtcgccccgggtgtcgagctgctccagcacagcaatcgctgcggctttctccgcgacctgccccgcggcaatcgcgcccgccagctcggcgcgggcaatggcggcgctcccgaacagaatccgcctgatgatggtgaagccaccagcggccgtcagggccacttgcagcgccgtcagcatcagcgccagcgagaacggagcccccgcagcgagcgcgttcgctaccgcgccagcgagggagacgccaagcacgagaacggcgccgcctctgtcggtattgaagaacgggacgaacccgccaccgaacctccgcagcaggtagacgagcaccaccaccaccagggcggcgagcagcgcgtagttcctgctcgtcacggcatcgagaagaaggcgcgcgaactcctcgaactgctcggggttcggcccgactacaccagcgtcaatcatgttgcctccgggttagaagcccagccgttccagttcggccgcgagcttcgggtttgctgcacgccacttcggcgacaggcgctcggcatcgaggcgagcccacacgtcggcgagggaactctgttggaccagggtgcgaagcggcgtgagctgaagcgcgctcacgtagcccggccactgcacatggggggagtcaccgaacctgccgccccagacaaggcccgccttcgtggattcgtcacccagcacgcggtaagccgactcacgccaatccggctgcacgccaggtcgcgggctcgcgtcacaaacgaagtcgaaggcgaggccgtagttgtgcgcggacaatcctgcgggcgatgccttgccgcccttgcccgccgcgtacaaccgacgcagctctgcctgctccggcaggtcacggaagccatgcgtcgcgacgtagcgaacgccgtgggctgcactacgcgcgatgacctcaagggagaccgcaacgaacggcagataaacgcggtcaaggtcgacccgctcgaagttcgcatgggtcatcacgagccccgcccgcccgactgggacatgcgaagcagctccagttcaacgacctgctgaacctgagccgggagccctcgggtgaactcgtcgcgccaccgacgcagcgcgcccagttccacggccagggcgttgatgcgctcgtcctgccgcgcgaccttctcaacgagggcgcgaatctccccaaccagggacttcgcggcccaggtgaggacaccgacgccggccgttccaagcagggagccgactacgagctgtagggacttggtctcttctgcggtcacgacgtcaccaggggcttgaggttgcccctggtaaatgcgtgtgactcttcgatgtggttcagggcacgcaaccaagtggttccaaataagccaccatggtgatcagacgcccacagcatttaccggagtcggcggcttcccaagtcccagatcttccctgctggcagcgaacaatggtaacttcatgccgctgggagttccctagacatctggcattggcgctacttcggccaacgacgtatctcgtatctcctctaccaggaagcagccatgagcacttcaggtctcttcgccgtccagagcgcttccggaagcgaactggatgcccacttctcgctggagctgttgcagggcgaaactacactgctcttcgaatcgaagggaggtggaaaagactctccccttggcaagagaagaaatcaagactacgacccgggactccgacttatattggagcgactagcgcaaagaggcgctaaaattcgggatgcctctgttgattccgacaatgtactggacgctggattgcctatcgaacagcgccgtctgaatgtgcgagctcccttcaaacttcctgtagacctatccctcatcgatgactttgacaagctgagaaaagccctaagtgctgcgcaaaagccgattggacaacgtgctaacgcgaagggcggaaacgggcagaagaagattcgtctctacctcgatctcaacactcaagggacagatctacacagtctagggagatcgctcgccacgcccacgcgatcaatagtcatgtccgcaggtgacattgccaatactgccgagacgattagtgcgagcggtcattttgatccccacagcattgaagatgccagagcccgcacgcttagtgcaatcgtccagcgacaggggcagtcggcatttcgaaagagcttgcttgaggcatacggcaacaggtgcgccatcacagagtgtgatctcgaggaggttctcgaggctgcacatatccttccgtttaaaggacctgcgaccaataccctcgagaatgggctgcttttaagggcggacattcacactctttttgatcgaggattgattgcggtcgacaccgccaactggaccattctgactcacgcgagaattacatccactcaatacgccagcctaaacaaacaacatctccgactaccttctcgccctgaactgcacccaagcacggtcgcacttaacaagcacagggtcgaatctggactctgacgccgcggatctcattcacgtcgactctccacatgacccttcgataaaccggcgcccgtcactagggcatcaaccattgttctcatgacttaaatcacccaccacaaggaagccaaccatgcccaatcggcgactcagcgtatcgctaaaacgaggggaggcccttcacgtcacccgagtggcggccgggcgcgatcggctagtctacataataacagccaaccaaaagctcaagtacaagctcggcagaagccgcatcgcctatatcgggacaacaaagaatggcattgatcgagtggctcaaagcgccgcagattggacggacgatgttcttggacagagaggcgtagactcattcgacgttcgaatagtcacctgccgtccacggcaaaaagtaaagacatgggtcaagcttgagcgcgcgttcctattggtttttcgcgaacagtatggacaggctcccaagtgcaacactcaaggcaagaacataatcgagcgtgacgagttctactatttcgcaaaatccagactcctgagggtcctcgaagacctgagctaggctgctcaacacagcaaacatcctggaatctttagtctcgtggcttgaggttgtgcgcaaggagcccctgcacaatgtaagtcatcgcgaagcgaacggtgattctcatcacgtcgccaaagtccattggctcaacacgagccactcgtcccggagcgactccatcaatcgtctctccggggcgaagcgcgtccgtgcgtgtccacccgcgctcgaacgtccgccagcgatggtccggcgtcacgacgagcacacgcccatccgtcatggtgagcgtgcaacgcgctgcctgatgccttctgacgtgcgtcacctcgaagatgccgccatctcgctcgtgctcgtgcatggtgagcactcgcatcccaggccggagcatttcggcaggtacttccgaaccatcgccgagcaacaccagttcccacggcgcgacgcaggttccgtgcgtgcccccgccacctccaccgctgccggttggcgttgacgcgggccccgtcgcgctccgaagcatgttgacgttgtagctgctcggcgggaagaaccaccgctcggcgctgtagccgctcgcgttgtggagccgcaccttcaggtaaagcagcctgttcgccatggcgtcccgcagccggttgaacctgtcgccatacatgaaggtgaagcccgcgcgcgtcgcgttgctggcgtcaccgtctacagcgccgttctgatacttgcggtcggccagcggcaccgatgtcccatagagccactggggcgcgttgctatcgctatatgcccagtagaatcccacctccatgaagcgcagcgcatcgaggttgtcgctcaccacctggggctggatgacggcatggtagtgagcccaggtgaagctcgccgcgccaccagccgccccggcaatggcgtaaccctcaagcacctggatgttgagtcggtcgatgttcggaacgccctcgttgttgccccggtagtagatgcggcttcccgtgtccgcgagggcctgcacggaacggaagaagccgtcgctcaggtagtagcgccccacctggacgttgttagaggccaccttgagcgtcgttccgacgttgtcgagcttcgccccggccgtagggataccgctgccgtcctcggcgtagttggacgtcttgagggtgttcgccgcgagcaagtcgaaggtgaccatcttccgcatggagacggcatcgaagtagagccgcttgcccacgtccgccgccgccacctgggtttcccagaagagctgaacccccgtgcacccggccgggcacatccccttcacggtgacgcgccgatacgtcgttcccacctgtcccagaaagacgctcgtgccctggcccgcgtaggcgccgcttccgtcctcccacagcaaatgcagggttcccatgcccccgacggtgacggacgacgccttgacgtagacctcggcgaagaactcgtccccaggcgagcacttgagccgcccgcctggaaccgccgagccatacccgcccgtccagctcagccccggccatgcccccgtgttcgtcagctccacccggcgcacccagcggcccacccgggcattcacagggtcctcgacgagcctgtcaccgtcgggtgacttccccacggcgcgaatgcccgcttcgttgtagccattcggaatgagattatcggtgggcgggtacagcagatgctggaagccgaccgcggcatcgcttagcgacgcgccttcgagctgcttcggcgtgacggagagctgaggcgacgcgttgcctcgattgccgaagctgtctcggggaaccacgcgcacgaagtatgtcgctcccggcatcaggtcggacacaccgaatgccgtcgtgtcgaacgtcccgcgcagagtggagctgctcggcgtgaagccgctcgacgtcgaaacgtgcagctcgtaccccgaagcaactgggccactcgcagccggggcgagggacagtgagaagccattcacgacggccgtcacgttgatgttcagcgggacaagcggcggggacgtgtgcgcgggctcgcccagtccgggacgcgtgtccatctccagccacatggagacgccgaaggagggcttcccgcgcgttgtaggcgtggtgcgtgcgtctccctctgccgtgaagacgtggcgaaacccggtgactgccaggttctgcgcgtccgagtagtgaacgccgttggggtgaaaccgaaagaggtcgcccagctccaccggaaggaagaagtcgaggtcgatttcctggtcggcgagcggctcgcacaagtcggacagggccgcttccgccatcctccgcgcttcaacctcgctgttgatgttgctcgaagccccctcggcaatctgcatgtagcgcacgccgtaggcggcctgactcgcggcgtcctcaacgacgacactcttcgtctttgcgtgccccgcgacgtccaagtcgccagtgtccgagaagacgacctccaccctgttgcggacgtccgtcctgctgacggcgagcttcgtgacgtcgcggtagtcatcagggccgaaggtccacgcgagcggcggattcgtccggttgggctcggtgaacgtcaaagcgaatgtcccgctcgactcgcgccagcggtagcgcacctcccagccaatctgttgagccaagtcccgcacggcatcgaggacgctcgccttcttctgcgcgtactgacgaagcctccaccctggcgacaccggggtatggagcaccacgcccgtcccgttgtcagtcaggagggcctgcatcaccgcttcgacggcaacgccctgggcgtcgtccccgtaggcccgctcagcctcgatgaaggtatcctggagccgtccgcccaagtcgcgcccacggaagacgagctgctcgccagcgaagtcgacttcgtcgatgtcgccatgaaaaagcgtgcgccacgccccttcgctcggcgccatgccgaggggcgaaaccgccgcctcgacggtgaactcgcgccccggccggatgagctgcccgctggcggcattcagcttcgagtcggcccggagcgggaccacgctgaagagttcaatctgccgcttgagcgtcaccgtcgcggccgacaccggctggtcaacgtcctcgtccacctcgacagcatcgagaaagtcgcggccttcaagctggctcaagttccgccacatccccgcgccgtcgagcaccttcacccggacatgggatgcgtgcccggccgcactcgtgagcgccgccaaccctgcgtattccggtcatggtgagcactcgttccggctcaagccgagcagcgattccggctgatggcgagcggtcggagcgtcagcgacgctgggtggttcatcccttggcctgcttgcggcccttcgtcaaatttgtctccacgtaccggatggactctccgcccagcttgatgcgatgggcgttgtggaccagacggtcgaggatggcgtcggcgagcgtcgcgtcgccgatgacggcgtgccagtctttcggctcaagctgggatgtcaccacggtgctcgcgagctggtagcggtcctccaggacttcgagcaactccttgcgctccggagcgccgagcggctcaaggccgaagtcatcgaggatgagcacctgggccttggccagtcgcttgagcacgtgcgcgtaggttccatcggcgcgcgcctgggcgagctcatcgaagagacgtgaggcccggcggtacaccaccgagtagccatcccgacacgccttctggcccagggcgcatgcgaggaaggatttgccgacgcccgtgggcccggtgaggaggacattctgcttgtccgccgcccacttcgaggtggacagctccatcacctgagtctttgcgagcccgcgcgcgtgcccgtagtcgatgtcttccaaggccgcggcctggcgcaggcgcgcggcgctcagccgagaggagagtttcttgttctctcggtgcatccactccgcgtcggccagcaggcccaccaggtcggctgggccaacatctcgctcccctggcctcgccaaccagtcgcgcaggtacgaggccatcccgtgcagcttcatcccgttgagtttctccagcgtctgttccaccagcattggcttcgttcctcatgtcggtcatgggggcttgcccgcgcgcgccagcttctcagggcgcgcgcgggccccttccgggtgcgggtgaccgaggactcgcaccagacgggaagtgtccgcgcacccaaggggctccaccgcggcaggtggcggcggtgcacctcgcggagcgcgagaggtacgtcagtggtagtagtgggggccgcgcacattctcatgggcgggcaggggcggcttctcctcgcgctcctcccgcgcgtcctccaggtggtgctggaggatggcggccacggacttgtagctgtaggcccggtgacgcactgccctggcgcacgccttctccagccgcgcctctccgtacttgtccttcaatcgcatgacacccaaggccccgcggaagccctgctccggatggggttttcgctccatgaggccttgcaccaacgcggccgtggaagggcccgtcttctccgcccatgtcagcagccgcgtgggcgtccactccgcgtgggcccggtggctggcgggcatgtgctccttcagcgtggtgtagcccttggcgtgcttgcgcacgtggctggcgacccgacggcccccgaggaacacctcgacgctcccctccgtgtagcgggcctccacctgcttgtgcgccagcgagtacggcacgctgtagaggtgcccctccacctcgacgtggtagtcagggtggacgcgcgccttcttccagaaggccagctcgtaggcgtgtaccggcagggccttcagcacaggcttctcgagctcctcgtacagctggcgacgcgagcgccccacatgccgcatcgggcggccattcagcttctcgagcaacggccgtacggcctcacgtacctcgtgcaggccaccgaagcggtggttgcgcaggacggccagaatccaccgctgagccaccagcaccgcggcctccaccttcgccttgtcgcgcgggcggcgaggacgcgccggcagaatggcgaagccgtagtgccgggccaggtcggcgtacgtgggattctcctccggctcgtagcggtgcacgtgggtgacgccggacttcaagttgtccggcaccaccaacgccggagtaccgccaaagaaggccatggcgcgcacgtggcagcccacccaggtggccaaatcctcggagtaaacgggctcgacgtacgtgtaactgctggcccccagcgtggcgacgaagagcttcgctacccgcacttctccggtgtcgcgctccaccacctcgactccatccccgctgaagtccacgaagagcttctcgcccgcgcggtgctcctgtctcatggtgacaccgaggacggactgccagcgcccataccgctcgcaaaactggctgtactggtacccacccgggttggccgccaggtactcctcccacaacagcagcttggtaaccccctttcgcttgagctctcgatgcacctgcgcccagtccggctccggccggtgcgcaacccccttgccctcggcagggaagagaagcgcggtgagcgccgcgtcgtcgtccagctccggcggcagcggccagtctcccacccctgctacccgcgctcgccccaggtactcgcacaccgtcccattccctatgcccagactcgtggcgatgttcctcgtcgacagcttcgacgcgaaccgcaaccgcaacacctctctcaacttgcgcaccgccagcctctcttgggccatctccacctcctcgaaggaggtggaggcgagaccctgctgcccagtgccgtcaacgctccgtaccgttcccgactgtgctcaccatgtccggaacgggtgctcaccatgcccggaacgggtgctcacctcgggccggaatcggtgctcaccatgcccggaacgggtgctcaccatgcccggaacgggtgctcacctcgggccggaatcggtgctcaccatggtccggtacacgcaggtgggaggatgattggcctcgaggtacgcgcccggattcgccagttgcactacgcggaaggctggccggtgggcaccatcgccacgcagctggggctgcaccacgacaccgtggaggcggccctggaggacgcgccggtagccagtgctgacagaagcacggcgaagcccacggtgctgggcccgtacacggacttcattgacgtcaccctcaaggcccacccgcgcctgagggccacgcgcctcttccacatggtgaaggcccgtggctacctgggcggctatgagcaggtgaagcgctatgtgcgacgggtgcgcccaggcccccaggccgaggccttcttgcgccgcaataccctgccgggcgaagaggcccaggtggactggggcagcttcggcaaggtgcgggtggggcgggccacccggacgctctcctgcttcgtcctggtgctgggccactcgcgcgccatgtacgcgcgcttcttcctgggccaaaccatggagtgcttcctccagggccacgtccaagccttcgaagcgctgggcggcgtgcctcgcaacctcctctacgacaacctgaagtccgtcgtgctgcagagggccggagacgtcattcacttccacccgcgcatattggaagccgccggccactaccacttcgtccccaagccctgcgccccctaccgcggcaatgagaagggaaaggtggagcgcaccatccgctacctgcgcgactccttcttctccgcgcgcaccttccacagcctcgacgacgtcaaccgccaactgcagcgctgggtggaggaggtggcccaccagcgccgggtgcccggcgacgcctcgggccgcacggtggcgcaggccctggaagccgagcgctccctgctgctgccgctgcccgcgcacccgctgcccaccgacgtggtgcgccccgccgcctccggcaagacgccctacgtgcgcttcgacggcaacgactactccattcccgagggcctggtgcgccggcccctcacgctggttgcctcgtccaccacggtgcgcctcctcgacggcgccgtggaagccgcctcgcacgtgcgcagctgggacaagggcgccgtcgtcgaggatgccagccacctggctgccctggccaggcgcaaggcccacgcccacgagctgcgtggcagggacttgctgcgcgcacgctgcccgcacgccgagcaactcctccaggcgctcaccagccgcggcgacaacctcggcaaccacaccgtgaagctgctggcgctggccgacaggtacggctccgccgaaaccgacgccgccatcgccgagacgctcgctcgcggcgcactcggccccgccgccgtcgcccacgtccttgaccaacgcagccgcaaaaggggcgcccctccgccgctgcccctcgtgctgccggatgacccgcgcgtgcgcgagcaacgcgtcccccagcactccctcaacccctacgacgccctcctcgggcgcgacacggagcaagtgccatgagccccttgaaggaacgcctcaacaccctgggcctgcatcacaccagtgccgcgctcgatgacctcattgccctggccaccaaacgcaggtggggccccaccgagttgctggaagccatcaccgaggaagagacgaaggacagagcccggcgcagcgtggagcggcgcctgtcgcgcagcaagctgggcgcgctcaggacgatggccgacttcgactggggctggcccaagcgcatcgacaggacagccgtcgagggcgccctggcgctggacttcatggcccgccccgccaacgtcgtcctcgtcgcgccccaaggactgggcaagacgatgattgctcagaatatcgcctacaacgccgtgcaggctgggcaccccgtcctcttcaccaccgcctcccagttgctgctcgacttgggaagccaggactccgctcgcgctctcgacaggcgcctgaagcactactgcactcaggcggggttgctcgtcatcgacgagattggctacctctcctacgacgccaggaacgccgacctcctcttccaggtggtgtcgcgcaggtatgagaagaagccgattgtcctgacgaccaacctcccattctccgagtggaccaccatcttccccaacgccgcgtgcgccatcgccctcattgaccgcgtcatccaccacgcgagcatcatcagcatcgagggcgacagctaccgcaggcgtatggccgaggaatcacgcgcggagcgcaaggcaaggaagagctgagcgtccccgcgactcaccgatgcccaccagcctcgctctgcgccccgcaatcggagcgcagcgcggggccgtcttgcgttgcctcgactcgatacctgcgctcgccgatgacccgatttccgcgctccgcgatgaccgcggcgatgaccagaatcccgcgctctttgatgaccgccaacaatcgggccaccgttgtccgaatgcagcacaagcccctcggagcagccagcttcctgccagcagcggcggatgagggccgcggcctgctcggacgactcttcctcgtgcacctcgaagcccatgatgcggcggctgaagacgtccaccaccaagtacaggtagaggaaagcccccttcaccgggcccttcaggtaggtgatgtcccaactccacacctgattcggcccggtagcgagatgctcggcccggggcgtgggcgcctagcactactgcgtcaggggtaggcagaagggagagtgggcgacggagggctgggcgggcaggccctcattgcattggccgccatccgccccactcatgaagcaggtatggactccttcatgaacgccgccgcggtgcagcggcttgagaggtatttccagcaaatcggcgaggtactcggcgaggagagccgacgcggctcgttcgccctctacgccatgggtctgctgggagagggggagcgaaagagcgtggagcccatcgccgctcgcgcgtgtccggaccccgagcgagtggatgccatgcaccagcggttgttgcacttcgccgtggactcgaggtggagcgaccgggacgtgcggcgccaggcggcgaggtatgcgctggaggcgatgacgcggcgggagccggtggaagcatggattgtggacgacacgggcttcctcaagcagggcaagcactcggtgggcgtgcagcggcagtacaccggctcggcgggaaaagtggccaactgccagattggcgtcagcctcagtgtcgccacccgcaccgagcacctgcccctcgacttcgagttgtacctgcccgagtgctggaccaacgacgcggctcgccgccgcgaggctcgcatccccgacgatgtccccttcaagacgaagcctcaactggcgctgcaaatgattgagcgggccgtgcaggacggtgcccctccgggcgtcatcctgggggacactgcctatggcacttccagtcagtttcgtgcgcacctgcgcgcgttggggttgcactacgcagtcgcagtggaccctcaaacgactgtcagcgtgctggatgcccagggacggccccgcggcaatgtgcgcagcgtttcagccctggccttgcacattcacgagcgagggggatttcgtcggtgcacctggcggcagggcccccagagggacttgtcggcgcgcttcgccctgcgccgagtcgtcgccgcgggtgtaccccagcgcgagcaagagccgctgtggctactcattgagtggagggacggtgaggccgagcccgccaattccttcctggtttcccttccaggtttcaggacgaagaagcaactcatccgcttggtgatgcaacgctggagaaccgagcgcgtctacgaggaactcaagggcgaactgggtttggaccattatgaaggccgccgcttccctggctggcaccaccatgtttcggtagcactgtgctgctacgcgttcatcgtggctgaacgcgtgcggcgttttcccccctcggcccgaggggcggctgaagcctacgcgcagccactctcggcctgagcgccatttccgcgacagcttcatcaccgctcggctcgccatggcccgggggattgccacctggctgccgcgctgccccacctgccaccgctccaaccacccacgctcctcgcgcagcccacccgatctccccgtccacccgtcggggccctgacgcagtagtgataccgggccacccatcagtaggaatgatacatagaacctgttaggtagggtctaccaatgggcctctcccgttccgaacagatgtcgcggatccgcggccgagacacctctcccgagcgtctgctccggtcggcgctctggcgggccggactgcgcttccgcctgcacacgcgaactactcatggaaggcccgatgtggtcttccccaggcacaaggttgctgtcttcatcgatggctgcttctggcatgggtgccccaagcactatgtgcgcccgcgaacgcgtgacgagttctggtcctccaagcttcgagaaaacgtcgagcgggaccgccgacaaacgctcctcctcgaagaaggtggctggcgcgtctgccgcttctgggagcaccagatcttcgagtccctcgcggaagtagtcgagtgggtccgccaagcactccaggacggagaatggactccatccgcatcgtggagggtcgtccaggtcatcccacaggtcggcgagggcgacatggagcagcgctggatggaggaacttcgagacgccaccgagactcgaaccgtggtcggacgacggagcacgaagaagtggaagaggccatgaactccgggccgaagcagcagatcaagaagtgggatggccggagaccctacggtataagtccggacggcatggctccaggcatcagggcgaagctggataggatcgggagaggagagccgctgcggctgctggacctcttttccgggtgtgggggcctcacgctcggcttcgtcagcgcgggctgcgtcagcgttggaggagtcgagatcgacgcgcatgccgccgagtcacacgcgttgaacttccacccgctgaaagatcgatcagcggctccctggcacgcgatgtccaaggacatcctgcagctcaagcccagctcgctgaaccatctgctgaagcgtcccccaaatgagggggtcgacgtgatcgtcggcggtccgccctgccctgccttcacacgcgtcggccgggcgaagctccgggaagtgttccagcatcccgaggccttcaagcaggacccccgggcaacgctctatgtgcagtacctgcagtatgtccaggcgctcaagcccctggcgctcgtcatggaaaatgtccccgacatcctcaactggggtgggcacaacctcggggatgaaatctgcgagtcgctcaaggccatggactaccgctgcgcatatacactcctgaatgcggcgagctacgacgttccgcaaatgcgcgaacggttctttctcgtcgcagtccacaaggagaccaggagcgaccccagctttcccgtgccgacgcggaaggtggattttccacggggctattccagcagccgcaatgtagccctcaagaacgtcctggcgcagtcctcggacaaagggtcctggtatgtcgcaccgcctgccgccccagcgaacgcacctcccgcggtgacagtcgccgaggccctcgcggatttgcccgaattgacggatcatctccacaacagggatcgtcgtggcgcgcgtcacctcaacggtcgtgtgccccataccacggccccgcacagcgccttcgcacgactgatgcgggagtggccaggattcgagtccgacggttttctcagggatcacgtcacccgctgcctgaccaagcgcgactaccggctcttcgaagccatggagcccggggaggactatccgaaggcacatgtgcgagccacgcagttcttcgcacaggaattggagaagcgacggagatcgggtgctcgcctcacagagggctcacttgagtacgaggagctcaaagccgcattcgttccgccgtacaaccccggaaagttccccaacaagtggcgcaagatggccgccgatgagcccgccagaacgctgatggctcacctgggcaaggatacctacagccacatccactacgactcaggtcagcagcgagtgatttcggtgcgtgaggctgcgcgcctccagtcctttcccgatgggttccgcttcgccggaaccatgaaccccgctttccgacagatcggcaacagcgtcccaccactcctggcctggcacatcgcggacgaactactccgtagcctgggcatcaccccgaaagcgcggccgaagctctcggaggatccccgaaagacacaggccaaaacccgcgtggcgtaatgacgccgtaaagaactgcaggagcggctccagcgcgcccctatgaactggcatcgacgggagcgcggccgtcgctagcgtgcgcggcgttgctgggcacttagaaggatggacgccgagcaccgcagacgtcctctggcgtatcgaccagccagtggtcctggtggcctcgatgttgcgcatccggatccagctatcaccccgtggctccatgagcgactcgccgcagagaaactgcgcgaggaccataacctgcctgcgcgaggaccataacctgcctgcgctcggggccacaggcctgggcaccgctgagctgctgcttggtgccaacacagtgccagtcgcgcgtacggcagttcgcgtcctcccggaagcacaaaaaacaaaggccctggaatcctcagctttcgccaagaactccagggccttcgatggtcggggcgacaggatttgaacctgcgaccacttgcaccccaagcaagtgcgctaccaggctgcgctacgccccggcactgctgctgccgtgaaagggtgcgcccttatgcccccacatgacgttcaggtcaagcaagagcagcagggcaccgtccaaaaaactcacccttccatgtcctccattccctcttcgtcgaagtcctcgccacgggcctcggccgcgtcggcggcggcttcctcccgggcgtcgatctccgcgtgatcctccggcggcgcctcaccgttcagggcgctcttcagcacctggctcggccggaaggtcagcacccggcgcgccgagatctcgatctccttgcccgtctgcgggttgcggcccacgcgcgccttcttctggcgcacctggaagttgccgaacccggagatcttgatcttgtccccgcgctccagggtctccttgagcgtgtcgaacacgagctccacgatttcggccgactccttcttcgagaagccgaccttctcgtagacaccctcgatgatgtccgccttcgtcatgcgaatcctcgggaagccctcggggctgaacgccgggcactgttgcagccttcccaaagacgtgtcaaccctctgacttcattcaggaattcaggcgcgcaaggcagcccccagccgctgcttcacctcatccacgatgcgctgatgcgcctcgttgacctccacatcggtcagcgtccgctcggccgagcggtagcgcagcgcgtacgccaagttcttccgaccctggggaatctgctcaccggtgtacacgtcgaacacctgagcgtcctccaccagcggcttgcccacctccaggatcacccgacgcacctcgtcgttgggcaactccagcggcaccaccaccgccaggtcccgcagcaccgccgggaaacgcggcagcgaccggtacgccggcaccagcttcgaggccgcgtacagcggctccgtgtccaactcgaagacgaacaccccgtccggcaggcccagcgccttcgccacccgggggtgcacctcgcccacgtggcccagcaccgtgccgtccgccgccttcacctgcgccacggccttcgggtggtacgccgctggccccgcgggcacgtacgtcacgccctccacgcggagtgcgcccagtagcccctccaccgccgccttcgcgtcgtagaagtccgcgcgggcatccttgtgcgtccagctccggccaccaccgcgcaggccccacaccagacccgccacgcgaggcacctcgcgcgccgccggacgctgcccctgcccgccttaagagtactggaagtaggcccggcccgtctcgtagatggccaccgcctccacctg

SEQ ID NO: 1240 - DNA, 28509 bp, Myxococcus xanthus
  unsure (1)..(28509): unsure at all n locations
gggcttcacgttcgggggttaccgtacaacctggagtccaaacgaggttgcacatgcacccgattcgttcagcgaagatggcggtggtgggttgtggtctcatgggaagcgcactggcgcgagccttcgcctcggcgggccacgacgtcgcggtctggaacaggactcccggcaaggcttccgctgtcggtggtggcacccgtgccttcgacagcctcgtcgaggccgtatcgggacgcgagctcgtcgtcgtctccctctccaactacgctgccgccgccgaggtgctctcggagaggggcgtcgcggcggcactgactggaacgacgctcgttcagctcaccagtggctcacccgcggacgcgcgcgaggggctggcgtgggcccaggcccacggcgtggactacctggatgccgcgatcctcgcctacccgagtttcgtcgccaccgagtacgcgaccgtctattacgcaggggcgcgcggcatcttcgaccggcacgtcgagaccctccaggcgattgccaagaactccgtgtacgtcgacgagaagattggcgctgccgcgacgctcgactgcgcgattctcgaggcctattacggcggctccctggcgttcctgcacgcggcggccatgtgcaaggcggaaggcctggacccgaaggctctcttcgcccagaagaactccttcctcggcctgatttccgtcaccgccgacgccgcgcaggacatgattgagaagaatggcttctcaggcgaccagtgcagtctcaacacccacgtcgccgcaatcgaacacatcgtccggctgagccaggacgcccgcatcagcgcacgcttccctaaggagctgctcgacaactacaagcgagccgtcagtgcgggactgggggaccaggaactgccggccgtgttccggaccctgactcaagactgacgctcgcgactccgtgcaggccgctgcttcaacagcctgcgagttgcctccggtctcatcgagcgcggggggcgagctcgaacaggaagaggtcgaagcgggaggaagtgcccgcgtccggggtgcgcacacctcccgtctgccctgccaggcatgccgcccagcgcccattgggagacacccgcgggtgtgccggcgcgggttctgcgcgggttcccggtcacctccgcgacttgaggccatgacgtcctgggcgcggacgcgccacccgcgccaccgttgctcacacctatccttggaatccaaccctgacggacagcggcgcgcacggcgcctcacgtttcggatgaacaccagggcccatgtgtcagggacgttgcctcctctgaagccctcctccgctcttgcgctccagtccgccacctctcaacaggccttccatccttcctatgctccaggtctgccggatacccgacttccgcaaggggctcttcggccagcaggtcgcgttgctacgtgagacgttcctgcagctcaccgaggggggcgggaagcgggatgccgtctggctgaacaagcaggtggcgccgttcggcgacgtgtgacgttcttccagatgccgttggggatcaggggattgaggtgacgcgcacgagctgcttgcccacgttgcggccttcgaagagtcctcgcagggcagagggggcctgctccaagccttccgcgatggactccgcgcaatggagcgcgccctgggcgtcccaagccgccagctcgcgaaaagcctcaggaaagcgcgagacgtagtcgaggaagatgaagccctccatccgcgctcgcttgaagccgagctgcatgtagttgcgcggcgcggtgccgtagtcaccgtccttgtatcccgaggccacgctgccggagagcaccacccgcgcgcctcgggcgaggtggtccagcgcggcttccaggacgtggccccccacgttgtcgaagacgacgtccacgccttgaggcgccagggcgcgaagccgcgcccggatgtcttcagacttgtagtcgatgcaggcatcgaagcgcgcggtgcgggtgacccattcggccttgtgcggccctcccgcgatgccaatgacacggcagccccggagccgggccacctgccccgcgatggagcccacgctgcccgcggcggcggacaccagaactgtctctcccggcgcaacgcggcccacctcggtgatgccgaagtacgccgtcagcccgctcgcgccatagaggttcagcatcgccttcggagcgacgccgtccggtaccttgttgaggccgaagagccccgcgtcgccggtcagtacatagtcctgccaaccggtgagcccggccacccagtcacccaccgccagccgctcggttcgggacgcgatgaccaggcccacgcctgcgccccgcatcacctcaccgagcgcgacgggctggatgtacgtcgcatttgcattgagccaggtgcgctgggtgggctcgatggcgagccaggtgacgcggaccagcgcctcacccgggcctggcgtcggcacgggcccctcgcgccactcgaagcagtcttcggacaccgcttcccggggacgggtcttcagcacccactgacgattggacgtcgtgctcatggcgtcacctttccgaacgcgggcgcggccagccggcgcgcgtgattcctgaggtcgtccggccagcttcgggtccactgattgaaccgggcgcggtgcccagcgtagagcgcgcgggcggccttctcgtagccgggcaggttgccggccatcgtggtcatgaagcggtccgccgcgacttgggcctgacggtgccggtcggtgtcgccgctgctcgcgcgcgcggcctccaccaacttgcgcagcgcgacggaggcaccgcccggttgcgaggccaaccactcccagtgccgtggaagcagggtcacctcgcgcgccaccacgcccagtttcggcctgccggggctccgaggcccggtgtcttcttccgtgggggcaggcgcgggctgaaggcgggccagtagctcctcgcgcgagccacgaaggtggaagtccacggtccggcccgtggtgtcgtcgaagagcaacagcggcgcggactccccggtgtccagcgcgcggcgggccgcgaggatgacgtcagccggagggccggaggcaatcaggcgctgtcccgcgaaggcggtccaggtggtcgaagtcgtgggcatcccaggtgtcggaggttcgagcatggccgaatattacccgggtgaaaacccgggtcaattctacccggatgaaatcatccactggcgcgtgttgccggggagtcttgcttctgagtctcccgtcgcggcggtcttggtgctccgtccatccgctcgcgcgcctcttcctgcttccccatctccacgaggcgcgtggtcagaagcgacaggccttcgaggccgtcctcccgggccagcgaagccagtgaatggcttgttcctgaagtgccgcggtgtttgtctagcgccgcgcggacactagcaacttcatggggcgctcccgcgcctcggccagtttcggctggcggcgggcagcgcctcggtcggtccccattcgttcacctggcgcaggcccaagccggtgtgaatcagtgcgttcagcaagggacccagcgtgctggtggtacagtgagatgcatcacggaccggcagaggcccttgcgagcctcgccggtcctacgagccctcccggaaagtccggcggagcccctgattagaacaggtcgtgcgcgggccaggcgctgacgccattcacgacgttccacatgaggctgtcgaggttgatgtcgggcgtgcccgaaccggagctgttgttggagttggtcatgacggaccaggtgaactcctcggagcggctgggcccatagcggtcatcggtgcgcaccaacagggcccgggtgcccgggatgtagccaccgtgccaccagttgggaaggctgttcaccgaccagcccttggcgtagttgacggagttgcccaaggtgtcgagcgccgtcgtgcgtgtggtcatcgtggtgagagagctcgcgctcagcagatccgggacggtggagaacccatccgcgcgcacggggacgcgcagcaaatcgatgggcgtgacgacccagccgccgtgcgcatccatgcgacgcaccggcatgccgtacgggctgaaggctccagtgccaagctggtagtagacgggctcgttcggcagacgcgcgctcaacgtatcgccccccactgcgaagctggtggcgccgctgggcgtgaacacgttggcgcgcatataggcgtcataggtcatgcccgtgacccgctcgatgatgcggccaaggacgctgtagccgaagttcgaatactggtacgtcgtcccaggcgcgaactcgagcggcacgttctgcaacacccattggatgagctgggcgtgcgtcatgcccgtgttcatgaacatggggtcgcccgtgccgtctgcgccgtcgttgtcccatgcgcccgcggtgtgctcgagcaggtgctggaccgtgatgttcaggacgcggctgtccgcgtaggtgccctgcgcgccgaacgtctcaccaagcaatccgcccctgccgaagacgcggtccgtcagacggatctggccgctttcaatcagccgcatgatgccaatggatgtcatcggcttggacacactggcgacgcggaagcggtgggaggtgttgaccggcgtgttgctggttcggtcggccagtccataccccttggcgaacacgaggcgcccgtggcgggtgatggccagcgacagtccgacggtgttcgtgctggtcatcgcctgctggacggtgtcgtcaatgtgctgcaggtcggccgcgctgaacgtcaggttctgccaaatcagggcgaactcgggctggctcccattgttgtgcgccgccaccaggacggggcgatacccctggttcttgaggtccgtcacggcctgttgatacgcggcggaggagagcccatgacgcgcggcggtcggaatccccgatgaaacctggaagatggccgcgtaccggtccgtgccgcccacgttgtagctgctgaccttcgcgagctggtaaccctgggccgcgttggtattgaacgtggactggtactgggccgcggtcagcccgtggtaggcccgccaggccgggccgctcgtctgctcccagatggccgcgtagcgctccgcgccaccggacgtgtagccactcacgtgcacgagccggtagccctgccccgcccaggtgttgaactccgtctggtactgggacgcgctcaggtcatggcgggccacccacgcggcaccactgtccacgtggaagatgaccgcgaagtaggcgacgcctccgacgctgtacccgttgaccaccaccgggcggtatccctgcgcgtcttgattgacgacggtggtctgatactgcgcggaagtcagcccgtggaaggcgcgccaggcggggccgctcgtctgctcccagatggccgcgtaacgggcactgcccccctcttcgtaaccgctgacataggagagacgatagccttgccccacccacgtattgaactccgtctgatattgggcgttggtgagcccgtggcgggcaacccaggcatcatatggaccggccagtgcctgggactcggcgctggaagagtcgcgggactcttcctctggcaccccgcatcccacgagggatacgaccagcactgacaggaccgccagtagcggcctcatgctgaaaggtttcatgctcgagaactcctgcttgacgttggtaccgccaacaggaaacgactccagcgcgcatttcccctcagccgcggccagcaaaatgagagccccctcgcgcgtggcgccaaatccacatgcatgtcagcaggctggcccacatcgcggaaagtcccttcggtaaggccttcaagcgaagcgtgggcgtgacgcctggtgcgttccgacagcgagagggtgagtgactcggcccatgtcgtcgtcaagccgaagggcatcgagatgcgctccacccatgaggtgctcgacgagcggtatccaccgtccggcgctggacggccccccatgcgtgatgagcgccctgcccgtgcgtcaggtcagcgccgccgtccgccgccgcccggtcgtcttccattccggggtgccttgccgtgatgcccccggtactccccaggcctgggggcgccgcgctcccggtcctgtcgcgggagtgaacgctcacgggtggcctcggcgatctcgtccggcatccagggccggtcgagcagctcctggagctcgaggagcgagcgagcctcgagcacgcccctccggcccctggccacgctgaagcgcaggggacggtcgagcagcggcagctcctcctccaccagcgtgcgcgcgagcttctccggcaggtgcagccgcaccacgcctcgcggggctccgtccgacagtctctccacgtcgtattcgagcggcaccgcctgctcgcgcacctccacggtgtccgggagcgccaggagcgcctgacgcatctcgggcggcacgagcgcgtccagttcgagccgcagcgggcgctccttgaagtcgtcgagcgtgtccaccccatccaactgcgcctcgtagagcgcggtcagctccgacaaccccagcggcgcggtggtccctcccgagcgtcgccacagctcgcgcacctcggcgatggcgacccggtgccggtccaccgcgggatggggtgcttcgccctgcgccagcgcctcggcgagcgcgtgccgggccgccttggcgagctccggcccccaggcgcgcagcacctccacttcccgttcgagctcgaagccgaaatagtccacccgcttttcgagcacgaccgagcggaagcgcacgtcgtacaccggcgccgccgcatggcggcgggcgtagcggcgcagcagtgactggggaagctgggtcccctcgatgccggcctgcgagtcgccgttgcggtcggcgaagtagcgcagcgtgcccgccaccgcgcccaggttgccacacacgctcgtcttcgacacgcgcgcgacctcgccccaggcggtgcgctcgtcgatgaccaggtcgaagggcatgaagcgtgcgagcaggtcgcagaaacgccggtgggcgcgcgggtccgcaaagggcatgcgcgcgggcagcgccagccccacgctccggtacacgctcgccatcgcgagcgccgcgtcctccagggccttcaccagcaccccacgcacctccgcccaggccgcgagcttctccgcatggaagacgtggcgcggcagcccctgcacctcccccaccgtgcccgcttcacggaaggcctcggcgtagaggttgtacgcggtcaggtggtcgctgccgggcacgagcagcccgtccaggttccgctcctcgcgcgtcatcctgtgcagcgactccaccgagctgcacaccgcgagcaacggcagcagcgcctcctccgcgttgacgatgagctccgcccacggacgctccacgggcagggcctccaccgcgcggccgtagtcggacagccggccttccgcgtccacgatgccgcgcgcctgcaacttcgcgagcgcccggcgataggcattgcggtccagtggcacgggcaaatccaactcatccgcccgcacgcccagggccgcggcggtgagcgccacccgctccggctcgcccgcgagttggaactcgggctcggtgggcctcaatgaggcgaagtgtagcggccggtcgctcaggatgaagacgcgcccgccctccacccgcccgtgcacgcgccccgccatctgcaagagttcgttgttgcccaggtgcacgcgggtcaggacgttgcggccgcgctccaccaggttcgtgaagcgcatgtcgtcgatgacgaccgtgtccagccccggcacgttgagcgcgctctgccccgccgccgtcatcgcgaggacgaagggccggggcgccgtgccctccaggaagggacggatggcacgcagcggttcgccgccgtggtagtgcgccgcatggagctccggcgcgttcgcgcgcacgtgggccgccgcctcctccacgcccgcgcgcgtggccaggaacacgcccacgccgcgcccctgctgctgcacctcccgcaggaagtcctcgtcgaggaaggacagcggctgacggcgctccacctccacccgggccgccttcctcggttcgaaggaggacacctggagcacgtccgcgctgtccaggtagcgcgcgtagaaggccgggtccacggtggcggacagccagatgaagcggcagcccgcgcgcttgcccaaggccaggcacagctccagttcggcggaggtctggtggatttcatccacgatgagcgtgtcctcgcgccggatggcgccgccctggaaccagcgccgcgcgatgccggtggtgacgatggccacatccgcgagcggcgtctgcgcggtggcctcccgctcgcggttgaccaccgccacccgcaggggccgccggcccacgagctcctccgcgatggagcggatggcgagcgtcttgcccgtgccagtacccgcgacgatgccaaacccctgaccgctccgggccagctcgaggaggcgctcgccgtggtgctcctccaggtacgtgcgcagctccagcccaagcgccagctcgatggtttcgcacgcggcgcgcgtgggcgcgatgaccaccacccgcccgcgctgggacgtgacggcggaggaagcgtcggggcgcggcggcaggtatcggtcggtgggcgtacgcacgaaggccagtgatacgcatgggcggtgtccaggggaagcgattcgcccgcgcaagcccggccctggggaggcaggcaaccgtgtgcgccagggaatgacgtactcgggcatcgggctagcgagtccagcgccgcccggtgagcgtggcctgcggcgcgaggaagcccaactccacgacgcggtagtccaagccgagagcaccgctccgtccaaaggacgcatgctagagggagccgtcgcccgcatgcgggagcctgcgtcgcgttctcatccatcaacgaagcatcacgaggcgatggaagtgagcgcgactggacctgctgaagatttgcgaccaggaacccggcgctccccctggccgcggcgctgctccggacttatcgccatcggggctgtcgcccacccgagaacgaggggaaatcatgcgtgcatggtggcaagtggcatgggtctgtctggcaaccgcgggatgcggtgggcctcttccagaagcatcgctctccgaggaacacgcccccgaggaggtcaccgcgcattgggatgccccactcccgaagttggggcccgccacgctgttgaaggacatctacccgcctcccccggggccattcccggatcccctgggtggcccgtcgccaacggatctggtgtccttccgcggcaagctcttcttctctgccttcgacttcgaggcggaccggggcgcgctgtggcggagcgcgggcacgacagcgagcaccgtccccgtcaagcacctggacgattctcccggacggctgaccgtcgtcggcaagcagctcttcttcaccgaaggcttcctagaacacggcgcggacctgtgggtgagtgatggcaccactgcgggaacgcgtcaggtgaaggacctcgccccggagggcggcaccgcctccctggcggacttcatcgcggtgggcaacaagctctacttcttccggtcggtccggcccaccctcgtcgccgccgagaacctggagctgtggcgcagtgatggcacctcggccggcacggtgcgcgtgaaggacctggggccgagggacaccgtgaacgggccctttgacctggcgagcgtgggcaaccgcctcttcatgggcctcgggatgcccgacaccggagtggaactctgggtgagtgacggcagcgcctccggaacccgcctcgtcaaggacatcaacccgggtgccgcctcttcgttccctcggagcctgacgcaagcggagggggtgctctacttctccgcggacgacgccgtgcacggccgtgaactctggcgcagcgatggcacggccaagggcacggagctggtcgaggacaccgttcccggcccccagggctcggaagcgcaaatcttcgccctgttcaaggagcgcctctacttcgccaccttcacaccgggattcacggtgacggagattcgcaagctcgacccggacccctcctgccacccgcgctcgaatctcgtcgcgagcatccccaacccctacgccgaccttcccttcgatttcttcatcttcgtcgccacgtccacggcgaccgagagaaagctctacttcacgctcttctacgacatcggcagccccgcccccttcgacgtccagttgtggcggaccgatgccaccgcccagggaacgaagctgctgtaccagccactcatcgtctctccggacctccgaccgcccacgccggtccccaccgatgacggccgcgtcgtcttctacgccttcgatgaagcgcacggccacgagctttgggtgagcaacggacagccgagcggcaccaagctcctgcaggacatcgtcccgggccccgcctcttcctatccgcaggacctgctgcgcgcgggcgacttcatctacttcacggcactggatgggcaactcggccgggagatctgggtattgcccgtgccaaagcctcaggtcgcgagtcactgacgcctcgccaacccatcgcgctggcggcctgccgtttctcggaggctgcccccgccccgtgcgactgcctcagacgacacacttcatgacgccgcattcaagacacaccaccgctaccggcaggtgatgcaatcgcgtgaggggaatctcctatatggggcgcctaccccaaggagccttgcaatggcaaacccggttcgtttcgcgttcacgcagaccgcccagcccaacctggagttcatcgtcgagttgtctgacgagaagacgatttcacacgcacggaagattctctctggcgaggagaagaacgaagtccacgtccacggacgcatcatcaagcgggccgcggcctacaacccgaggttctccttccacctggacccgaacaccatccgcttcttcgcgatggccatcgaggtctgcgatgccaacatgacgtatgtggaagaccacctcgacgaggcgggcggcgcattcctcccgggcggacactggtgcccgtgggactccaagctgacgcgcgaaatcacctgatccccttcagataggtccgcgagcagagcgccctgcgtggccgaagtggccacgcagggccgcaaccatctgacctttccctttgcgcgcggcttcgacgagccaggcccctgccgcgcaccgcacgggagagcggacagggccggcctgtccacccaccggtagcatcactccggcgtccccgagaagggcgtcctcaagcgggagaccagaccgccgcgctccctgcattcagggccggatgccggtgagcgcgaggcgcagcacccggctcgcggtgagcggatcgtcttcgttggcgacggcaatcgcgttcgccagcatcagcaggtcctccgtcgtggcaagggcatgaatcgcgcctgccgatgacgcccgcgccaccagaacgctcaacacctcgagcagcttgtcggtggagcagacctcctcagccgtaaggccatccggaccggtcaacagcgctgcggcaagcccgcggtgggtcgccgtgtagaccgtcaaatcctcgagccaggcggccaactcggcggcgggatcctctcccggttgcgaggatgcccgcgcacagagttgcgcgacgccatcgcggaataccgcctccaacagagactgccgcgagggaaagtgccggtgcagggtcgccgagcctacccccgcccgccgcgcgatctcctcgagcgacaccttcgcaccatccctgccgaccagttccgcggcgaccgcgacaatccgctcccggttgcgccgcccgtccgctcgcaacggcttcacatgctccaccgcgaccgcctcctcacgagaacccgcgttgacaaatggggtgcccctccatatttaaccacgagaataagcggtggggtcccccacttacaaaggagcggtccatgagcagcaacgaatccgttctcgtcaccgctgccacggggcgtcagggcggcgccaccgcccgggcgctgctggccgaaggcggcacccgggtgcgtgtgatggtgcgcaatcccaaggcgccaaacgcgaaggccctcgcggcggctggcgccgaggtggtcgtcggggacttcgacgagcccgcgtcgttgcgcgcggcctgcgctggggcgcgggcggtcttctcgatgcagtcccccctcatctccacgaccggcgtcgactacagcaaggaactccagcaagggaggaacctcgtcgaggccttgcttgccgaatgtgtctaaacgttcgtgcacacctggacctccggtgtctgctaccaccgcaacgtgtagggctgggcggaggggcgctggaagtcgcacgagacgtactgggagaacaagcttgccacctgctacctcgtccgcagcgcgggattcaagcactggaccctcatcctccccgccaccttcatggatcatccgatgttggatccggctggcttcgtcgacgggcgccggttgctcaccgtgatcaggaccgatcaaaccatcgcgttggtcgcgccagaggacatcggcacggcggccgcggcggcgctcaacaatcccgcgacgttcaacggagtgacgctgcagctcgcgagtgacctgctcacgcttcctcagatcgccgaggtcctctcgcgcctcgacggcaaggagtacatcgtccagttcagcacggtcgaggaggctgtcgcggccggcctgcatcccggcgtggcgcaaggcctgacgtacatgaacgtcgccccggtgctggcgcggcccgagatcgcgcggtcctatggcctttcgcccatgagcttcgagacctgggcgcgccagcgtcgcgagatggcctgacctgccgcccagtcgccgcagctccgatgccgtgtccagggcaagcggccccgtcatgaccaaccggcggcgcataggatgcgccgacatggacttccaggcgcgactcgaagcgctcacgcaccaactccggccctggtccccgctctggtcccgctccatcctccagggctggcccgggtccggcgccgcctatccccaggactggctggcctatgcccggtcgctcgatgaagcgggcgagcagcggctggaccagggggcgctcgcgggcgtcccgcctccggccctgtgcgcactcctgggcgcgctccaggaactgacggcgctgccctggcacgagggcattcacgcgctgactgtcgcggagacgcagggcctcagcgccaagaagacccacgagctcgagcgggtgctcgccctgctcgcgccgagaacgcgcttcatccaccaggcggtcgatattggcggcggcatgggacatctcgcccgcctctgtgcgcggacgttcgggtggaccttccacagcatcgatcgggacgccgcgctgcaggacaagggccgacggtggctgacgagaacccatccccgaggcggggacaccgtgtgtttcatccaggcctccgtcgaggacgggctccaaccacagctcgatccactcttctccggccgggaccgggcctcgatcggtctgcacacctgcgggccgctcgccctcacgcagctccgcaagagccagggggcgggcttcgtcgtgaacatcggctgctgctacgacaagctggaggtcccgcgggattaccccgtctcccgcttcgggagcgagcatccgctccccttcaccccgcatgccctggcgttgacgacgcggggacggcatcacaagaccgaggtggaattcgcgcggatgaagcgggtgtatgcgtggcgcttcgctttcgatctcctatcgaggcggcactttcccgagcgcggcttcgtgagagcaggggacgcgccccgggcgctttacgccgaacgcttcgccgtctacgcgcgcgaccgcctggagcgcctgggcctcgatcccggcatgacggacgccgagctgaatgccttcgaggtgtccgttcgcgccgagacacgggaccttttgctctgccatctgctgagggaccgcttcgcgagggcgttggaggtcgtgctcctgcttgatcgcgcgctcctccttgaggaatcgggcttccaggtcgaactcctccagctcttcgatccgcgcctgtctccgcgcaacctcgcactcatcgcgtcgcggagcgcttgagcacgtctcgggccggtccatcgattcagtgggctccgccaatacagataggttttgcttcttccgtagcgactcaccggtccgagcgaggaggtggcagccgacgtggcacatgatggagacggaaacttcttcatcgccgcggccttcgagggcaagttgtcggatgcgaaggggacactggggaagtccgcaacgcgggcctccgtccttgcgaagtaccgacccaatggtcagcgggtgtgggctcggagcgtgcccgcgcaagtgagggcgctcgcgacgaaccgagcgcggcacgtgcttgtcaccggcaccttcgaaggaagcatcgacctgggcgggggcccgctcaccgttggtgaattcctggcgggcgtgttcctggccgcgttcgacgcgagtggtcgccacgtctggtctctcgcctatccgctggagttcttcagcttcttcggcgcgcgaaagatgctcacggacagccatggcaacatcgcgatcaccggtgtgctgcgaggcgccatctacttcggcaccgggtacgttgttgcggacagcgcgcccgtcctcctccggttctcgccaacgggcagctaccagtggagctacgtcgaatcgccgtacttcggtgagtcaggcggcgtcgccacggacgaggacgacaacctctacatggccggaaccatcatcacggacctgtatccgccgctggatgtgattccattcgtgaacaagttctccccggaggggacgcggctgtggcagcggcagttggacaccacccttggctacgcacagagcgtgggagtgcacggaaatcgcgtggtcctcaccggcaccttcatgtcgccgctctccttcggtggtcagacgttcttcccccagcactcgcaggatggcttcgtcgtagcgatcacccgtgcgaacgaggagcgctgggcgaagcaactcggttgcgaggtgctggatatttcgatggaccaccgcgacgacctggtgattgttggnaggtatgaggacggagatgacctcggcctcgggccgctttgcggcgtgcctggaagtgataccaacctcttcgccgcgaagtacgaccgggtcgacggacatccccgctggacgaggggctttcccatggcccacccgccggatgtgtcgaccgccattgaccgttatcgcgtgtcggtggacgaagcgggggcgtcggtgtttctgggaggcctcatcgcccccctcgacgttgggcccaagacgctcgtgccctctggcgtccgcgacctgttcctgctggggctgaagccctgacggagcctgccccgccctggcttgttgtgacaccgggtgtgggaagggctgcccgacgcgctccgggctgacctgcccccgttcctccagggccgcgtgcccgccgcggaacaccgaccctccaggagggaaggcccgctcgccgggcgtcttggagccgtgcagctccagcgccaccattccggggacctcacgcactggaaggtgatggtgtctcctcctcccttgcctgcatccatggggtttgcgcccaccaatgcggtggccagacccgggagaggatgcgtgaacgagcaggagaagcagcggcggcttttgacatacgcgaagcggatcgccccctcggccgagacaatcgagtcgctcgcgacggaaagcagcgccccgctcgagccaggtgccgaggccctggaacatgccatcaaggcggcccacgcggtgacccgaggtctcgagtccaccctacggccagaggagctgtgggcgctcgaggccatcgtcctgcctcggaacagaccggtcatcgacatcatcaacggcagctacctgcgccccggggccccctggagcgccctggatgacgcgaacttccgcaagcccatcgaggcggccattcccgccatcggacgcgtggaggtttccgagcacccaacgctgccgtacgttggaacgggtttcgtggtcgggcgcgggctgctgatgaccaatcgccacgttgccgagctgttcacgctggggctggggatgcggggactgcggttccagccggggctcgacaacgtgcaggtagacttcaagcgggagcgcggctcgagcgcgtccgcgcccttccgcgtgcggcgtgtcctgatgattcatccctactgggacatggcgctgatggaggtagagggggttgatggactgcggcccctcaccctggattcgcgccacgtggacgaggtgcgcgagcaggacgtcgtcgtcatcgggtatcccgcgcaggacccgcgcaacgatgccgcgctccagcaccgcatcttccggggcgtctaccaggtcaagcgcctgcagccgggtaagatcatgggcgcacggcgcacctcgagcttcggccggatggtggaggcgctcgcgcacgacagctcgacgctcggaggcaactctggctcggccatcttggatgcgcgctcgggcaaggtgctcgggctccacttcgggggccggtacctcgaagcgaactacgcggtgtccgcccatgacctcagccgggactcccgcgtggtcgatgccggggtgctcttcacgaagacgaacgtcggaggacagctcccatgggcgaacgcgtggaaggacaacgagggccccccggcgatgccgccttcgcctcttccgccgtctcccgtcctcttcgtcccggcgccgagcggcgagtccctggcgctcaccattccgctccacatcaccctccgcctgggggttcccgccctggcggggaatggccagaccgcgctcgtccccgggccggcagtgcccccgccagtgccaagccaactctggggaggcgtgggggctggggcaccgggcctgacacaggtcgacgtcgcggcggctgtcgcggaagcccagcggacgcgggacctcccctattacgacgccgaggcggacgcgctggaccgggagcgctactacgcaggtgtgcagccggactccgaccaggacgcgttctatgacggcctgcacggcctcctcgagcggacgcatacggtccgcccatcttacgatccgagccgctggctctatccatgggtggaccgccagaaggacctcctcctccgctcgctgtactcggcggcgggccactccttcacgctccaggagatccttcagaaggacctggaggtggagagggagcgtgcgctacggctcctggagcggccactgacagagagtctcgacgagggcttcctggagcagcttgagtccgccctgccgtacaactgcgagcacgtcgtgccccagtcctggttcaaggccagggagccgatgcgcggagacctgcaccacctgttcgcctgcgagatgcgctgcaacagcttccgcagcaacaatgcctacttcgagttccccagcaccgaggccttccaagaagactgcgggcgggccgagcagaaccggttcgagccgggcgccgggaagggagccgccgcgcgcgccacgctctacttcctcgtccgctatcccaacgccatcaacagcccggcggagctcgccgaggagcggctggagacgctgctgcgctggcaccagcaagaactcccctccgagtgggagctgcatcggaaccaggccatcttctccatccagaagaaccgcaaccccttcatcgacttcccggagtgggcggcgcgggtacgcttcgcccgcggactggggcgctgatctggcccggccccttccgcgcgcagcaggcggggaagggcctcagcatcgcacattgaacagagtggcccgctcgtcaggacaccgcaggtaggcatcacatctggaatgtgtgggcgctgcgttgcgaattttcgcgggcttcttgcgatgcgcgcatccttggggtcgacctcggccacgacaggccgtgtcccatgcgaatcgcgccccgggtgctggcgggcagcacccgggcggcggcgccgatccgcacgcccgagtcgatggcggagcgctttgtggaggccgagccggagcacctcgccggcaggagctccagagccgctcttttcagctcttctgctggcgcacgccccagcagtcgaggacgtacgagaagaccaacggcgccacgatcgtcgcatcggactcgatcacgaagcgaggcgtgtcgacgtcgaccttgtgccaggtgatcttctcgttgggcggtgcgccgctgtaagagccgaacgagggcgtgctgtcggagatctggcagaagtaggaccagtaggggacctcctcctccaaatcgaggcgcagcatcggcacgacgcaaatcgggaagtcgccagcgatccccccgccgatctggaagaagccgaccttcgcggacgaggaggtctcccggtaccagtccgcgagggccgccatgtactcggcgccgccgcggattggactccaggtttccagctccttgcgcatcacgctggcgacgaacacgttgcccagcgtggagtcctcccatcccggtacgaagatcggaaggcgcttctccgcagccgccaggagccacgaatgacggggatccacctggtacgagccggccagcgcgccggagaggagcagctcgtagaggtactcatggggaaagtggcggcgcccgtcccgctccgccctctgccagagctcgaggagggggcgttccaccttgcgcatcgcctcctcttccgggatgcaggtatctgccacgcgattgagccccttgtcgcgcaactcggcctcctgctccgccgtgaggctgcggggatcgggcacccgcacgtagtgctcctgggccaccaggttgaagacgtcctcctccagattcgcacccgtggtcgtgatcgcgtggaccttgtcgcggcggatcatctcggcgagcgagatccccagctccgccgtgctcatggcaccggcgagcgtcaccatcatcttgccaccgtcatcggcgtgcgccgcccaggcgtccgctgcatccacgagggtccgggcgttgaagtgccggaagtggtgccgcagcacgcatcgaacggaaatggtcatgtcatgtcctcgaatggagaagacgtccgcatcgcccccggggggacggcacggacgaacgaagtgaagggaacgccgcgccttgcagcacgagcgagcccgccagcttttccgaacattcggatggagcaccggcagcggaggcgacaatcacgcgccacaccgtctggaaccggcaggatttcgcgtatcaaacgaacacccatggtgcaagcctcccctgcggcccctgccaggttgcggtgtgatgcaggggctcctcgcttgaaaaagccgagaaatgcgaagctgaagcggcgtcggcacgacgcctgcccttcgccgagtcacctctctgaccgggagcacagacgagccgcggcgcttgaggaccacggaatcggctctccgaatccctttgatgcggcgcggtacgtcgcctggctctcgcaccaagccccccctcatgtcggagggactcgcgttcgcgcttcgcgacgatgtgttcgccggtcaactcggggtgagcgcgaggccggacgtaagcggatacgcgcgccctctacgacctcgtgccatcgcagcgggggcgtggcctcagtgcacagttatttcacgaggcctggaggtttcacgcccccagggagtccggcacgacagggcacggtgaacgcttacgtggactggacagagctgcggaggaggacgtccgatgttgacgtgttcgcctgcgtgagatgtggaggcaggcttaaggatcttggcgtacgtgaagggggcccccggggagcgggcgattctggagcaccggggcttgcccacggcctgtgcgaggttggccccggcacgagggccaccccaggtcgcgtggtgttgaggcgcaagacagccaacaggcccaggcccctgccacgcacctcatgggagcgcggcttgggcaggcgtgtaccccaaggggggttcaagcggtctgcccaccggccgggagcatcgctcgggcggccccgtcagcggccctcctcggcccctccgctccagccctcaccctcaacagcgcctctatcccgccgatacgtctgaaccgaggtgcgagaaggcccgcccgagggcaacagtaggctctgcggtatagaccggtacgcccgccgcctcttcggcggtctccttcagtagaaagcacggccatgaaaccgccctctcagctccgctgcacctgcggaaaggtccacctccaggtggagggagcacccatcgtcagcgtcgaatgctgttgcaacagttgccgtatggctggcgccaggctggaaaccctcccctcggccccccgaatcctggagccccatggcgccacgcgtttcgtgctctaccgcaaggaccgcgtccacttccaggaaggcaccagccacctccaggagcttcgcctcacgcccgaggcgaagacccgccgggtcgtcgccacctgctgcaacacgccggtcttcctcgagttcgagaacggccactggctcagcctctacggcggcctctggcccgagggaaccctgccccggctcgagatgcgaaccatggccagcgacctcccgcccggcgtggtgcttcccgaggatgtcccgaatgggaagactcaaccgttcccattcttcgtcaagctcctcggtgcgtggatcatgatgggattccgcagcccgaagctcaccttcatccacggaacgctccacttctgacgcgaacggcgtgcttgagactgagggcacagcctcgtgccgctccgcgagtccagagagccccggccgcggtcctcctgattctccgcgagggccctctgctgaggaacaccggctcccgatccatctccagggcatcgcgccggtactgggccaccggctgccatgacgttgctgcactgctcgatggcggccacattaaaaacatcgagtccgctgcgattttcacgaagggaatcttcacgggttcactccgttggatgaaccagcggcatggcaacagccgtgcgcttcggattgagcatgttcgttcactgggattcgcggaacgaagtgcatgccgagcttgagcactgacgcgtcagccatagaaaccgacacgtcatgaacgcggcgcggcccacggacttcacacgagctgactgcgccgccgcgcgctcgacgagctacgcgaacgggtggggacggagggacttcccggtcgtgaccacggcgagccggggagcccccatcaatcaggcgcaagaagcgggctgccttcatgcaggcgctcttctatccgtaacagggcgatggggagcacaccccatcaccacagatggagagcaccccatgtcgacgcgaatcatcgattccttggcgaagtaccacctgctcggccagacgggccttcgggtgagcccgctggcattgggcaccatgaacttcggtaccgactggggctggggcatcaccagtgaggacgcacaccgcttgctgacacgctatctggaagcgggcggtaacttcattgatacagcggatgcgtacacctccggctccagcgagcggatcatcggcgactacttcgcgaagcatggcgggagggaacgggcggtcatcgccaccaagttctccgccaacctgtctccgggggatccgaatgcgggcggaaacagccgcaagcacatctacgccgccctcgaaggctcgctgcgccgcctcaagatgagctacgtggacgtgtactggctgcacgtatgggacggcctgacacccgtggaggaagtgatggggacgctgaccggcctcgtgcgcgagggcaaggtgcgctacatcggcttctccgacgtgcctgcctggtacttcgcgcgcgcacagacattggcggagcgcaaccactgggaaaaggtcgccgcgctgcaactggagtactcgctcgctgaacgcaatgtcgagcgcgagcacctccccgccgcgctggccatgggggccgccctcactccgtggagccccctggccgggggcctcctcaccgggaggtacacccgcgacggaaaccagccgaagggtgacgggcgcgcccatgcactgctcgccagcggaaaccccgtggcggacaagttcctgcaagagcgcccctgggccattgtcgaggagctcgtcgctgtggcgaaagaggtggagcgctcgcccgcccaggtggcgctcaactgggtggcgacgcgtccggccgtcgtgtccaccatcatcggcgcgagcaggctggagcagttggaggacaacctccatgcgctggacttcaagctaccgcacgaactctccgcgagactggacgccgcgagtcgccccgagctcttcaatccgtacgtgttcttcgaaaaccccttcttcacgaagggaatgctcgcgggcaataccacggtgagcgcggagccgagcgggttccggggaccgctccagccccggtagaccatgcaacggtttgaggcaacccatagctgtttgggctgccaatccctttgcattgaaaaagtgtgggcgtcgccagcgcggcgcccggctcacgaggtccccttgaacatgcgaacgaccctatcgattgtcgcaatggcagtgctgacaacgctttcgcacgcgagtttcgccgctgcgcccaacgaggtccgtgtgtgtacagcgcaaggcgccccgccgcacggactcccgatctgcgtgtggtcgctcccggcgacgagcggagaggtgctgcacgatacggcgggcagtgccagcgcttcggaggtccgccgggcaatctcggtgaggcgcaagccgaagctctcgcctcacgccgtgaccgatgcggaaggcgcgctcgcggccaacgccgtgcggcactcgacgatcgagttcagcggtgtgctcggcaacgctctaccacgctacgcgccagtgacggtgatgagcggcaagttcgagagcggcttcgacggaattcacatggcgatccacgtgcacgacagcggaggcatcacgttcgtgtatgagttcccaacggctgcggcctgttccacgacagcgagcacggttggtgcacactgacataagtggctcccgcggcggtccaactgctgcgtccggtcgcctcgcctgtccgtggaaggacaggcatgtgcgaccgtgggcggctcagacgtcgccgctataggtgcccacgagttggatgtggcccttccccatctccgagcatgtcgcgttgacgctgacgctccaggctggaacctcggaatgctacgtgatggtgcccgaccagtcagcggccaggaaggagcggatgaaggagaggacaccgcgagtagactgggccgatttgctcaggaggacgttcgacttcgacgtgttcggctgcgtgaggtgtggaggcaggcttaagggtcttggcgtacgtgaagggggcccccggggtgcgggcgattctggagcacctgggtttgcccacggcatctacgaggttggccccggcacgagggccaccccagccgcgtggtgtggcggttcaagacagcaacaggtccagaaccctgccacgcacctgatgggagcgcggcctggacaggcgtgcacaaaaagggggctcaagcggcctgtccaccggtcgggagcatcgctcgggcggccccgtcagcggccctcctcggcccctccgctccagccctcaccctcaaaaagggaaattcaccacaattatttacagcacagagggagcaatgttctcgtgagcatacccgtgacccatacccgtccgggcatgaggagctcccatgcgcggtttcttgcaatccatcacattggttgctgtcttccttgtaggcctgttcacgagccgccccgccgccgcacatggttcgctccgcgagcggatcgacaccttcgtccgcgcggagcagaaacgacagaatgtgcccggcctcgccgtgggcgtcgtgagccacggaagggtcgtgctggcaaaggggtatggctttgccaatctggagcatcgggttcctgtcagcaaggacaccctcttccaatctggctccctgggcaaacaattcaccgcaatggcggtgatgcaccaggtggaggcaggcaggatttcgctctccgacagcatcacgaagttcttccccgacgcgcccaccaagtggcaccccatcacagtgcgccacctgctgacgcacacctccggcatccaggacctcgagggactgctcgacgtgcgcaaggactacacggacgaggaattcgcgcacttcatctacgagttgcccttggagtttcccgccggtctgcggtggaactacagcaactccggctacgtcctcctgggcatcatcgtgaaccgcgtcgcgggcaccgactacaccaacgtcctcggtgagcacgtcttccggcccgccggaatgaagacggcgcgcggaatcagcgaggcggacatcattcccaaccgctcggccggctaccgcgtggtccgcggcgaggtgaagaaccaggagtgggtttcgccttccctcaacaccaccggggacggtgcgctctatttctccgtgaaggacttgctggcctgggatgccgccgtggcgcagcgctccatcctgagcccggagagctggcaggaaatcctgtcccccgtgaagctcaacagcggagccacccagccctatggctttggatgggaaatcctcgagcgcaatggcaagcccctgcaccagcataccggtgggtggcagggcttccggaccgcctactcccgcttcatcggggactctctctccatcgtcgtgctggccaactcgagtgggtcaaaccccatgaccttcgtggaaggcattgctgccatcgtcaaccccgcgctcgccgtgcccccgttgacccccatcccggacctcgagccgcaggtcaccgcccggctcaccacgctgctcgagcaggcacgggccgggacgatggagccagtcgagttcgcgtacgccccctggtggttctggggccaagccgtgccgttctatcagcaactgctgcaaagcctggcgccggcggggccgctcgtcctggtcaagcgggaagtggtgggtgacgaccgcctctacacgtacctggtgcagttcgggcccaagaccctccgctacagagtgtcgctcatcccggatggccgggtgtccgccttccgcctgaacgagcacatcccctaaggcctcggactacgacctcggactgtacgacgacgactcccttgacgccgtcgccctggcccacctccgccgcctcgccgtggagctcgctgcctccgcgaggatacccaccttgcggatggcccgggtgggagtgagcgacagcacccacaggacggcggcctcgacctgagcaccgacgctggggtactggcgattggccgagatgtgcagcttcaactccctccagacgtggtccatggcgttgagctcgggacgctgcttgggcaaccagagcaggcggatgtccagctgcgcagcaagggcctgcgaccgctggacggtgtgaaagctggcctggtccagcagtagcagcaccggtcggcccgtattcgctgcacgaaccccgtctggcgtcgctgagccggcgcgcgcaaggtggcgcgcatggcagacgcggagccgtggaagaagcgagtcaggccctgccacgcacctgatatgtcagagttggctggtcacgatggcgatgcgacacacgttgcacctgaactgaggggatggcggatgcccgcccagcgtcatgagtccgaagtcgggaaccaccggcttctccttcccgcactccgggcacttgagcagcaccttcgtccagtcggtcctttcggcgctgtcgttgttgtcggccatggctgtgttcccccgtgctcgtgggcgctccagcccacggccacattctaccggagccttccgtgacgtgcctgcgcgacgcggacatccgccagcccctggcccaactcgccgcgggcacgtagcccggcgcccgggtgctccacgaggtggggctgaagtgcgggctggtgcgggtggacgtggccaccatcggctccgggtgcctccacgcctgggaggtcaaggcggacgcggacacgctgcgccgcctgctggtccaggagttgtcctacagcgcggtgttcgaccgctgcaccctcgtcgcaggtgagcgacacctggagcgcggccgcgcgctggtgccgtcctggtggggcgtggtgctggcccgcgccgagggcggcggtgtcgtcctcgaggaggtgcgcccggcgcgggacaacccgagcccgagcccgagcccaggcgctaccgcgcgcctgctgtggcgcccagagatgctggctctgctggagtccgctggcgcggcgcgaggcgtccgctccgccagcaagtggcgcctcctgccccgtctgcttgaggtgctgcccccggcggagctgcgcgcccgggtgcgtcaggttgtgtccccgcgccgagatgcgcctcgtgctgccgtacccgctcagcgccaacgatgactggcgcccggccaagggccgcgggctggtgccgtccgacaaggccatggcgtacaaggcccgcgtcgcgcaggtggcagcactggcccgcatccagcccctgcacgggcccgtccgtctcgtgctgacggggttccgcccgcggaggaggcagccgcccacgccgcagcccgggcggagagagcgcgcaaggcacgggagacgcggaaccggaaccgggcagagaagaagctggcccaggcgctggagcgtcgccggctccccctcgctgcgcgggccacctctgccagttatcgcagcaccaacccgaggaagacgtgatgcgctactacctggacaccgaattcaacggcttcggcggcgagctgatgtccctcgccctcgtgccatcccaccccgctcgtccgccgccccgaagccgcccgacaccagcgacaggcacagcccgttgcgcgtggggaaggcggagtccacgtacttcgccccccctggccctcgggagcgatgaccgcgtgcgggagcgtgccggcggccgttccgtcactgacgtagagcgtgatgccaccccacggcagggagacgacgaagtacagccgctccttccacaccgtgagctgggaggggtctgtgcccccagggccccgggatgatgtcgcgcacgagggtggtgccctggggcgtaccatccgtgcgccacagctcctggcccacgcccgtcccggtggccgagaagtagacggagccccccatgcgggtgaactggtccgagagggagagctggcgtgccagggacgtgacgttgaggtccgtcacgagcgtcaccgggccggtggcgggcgccaattccgcggactgtgtgcggagaggggcggagtcagatggagcggcgtcacagccgtggagcgtgagcagggtgagcggggccaggaatgacaatcgagcggacaagggcgggcttcctccggacttccggcgtcagggaatgacgccgataaaggcccatctggccggccggagcatcatggttggatcatgattggagcatttcctgatgctccggggtctccctcgcgacccaggctgctcaggcggagagcaccgcgctgcgcagcaggtccacgagtgtggcgagcgccggggcgagtgggctgtgacgcttgtgcaccgcgctccactgtcgccagtagcccttgcgaccgaggccgcgggtgacgagccccccttgtgccaggtgcggcccgagtgaccagcgcgcgatgagggacaccccgtgcccgctccgcaccagctccaccatggcctcggtgagtggaagcgtgcggacgcgcagtgcatcgggcctccgtggcaggagctctcggcggaagcgctcctcgtcctccgcggggagcgggtagaagtagacggcctgctctgtcaggtccggtccgctgacgtaggggcgcgcggccagcgggtggcccgcgggcagcacggccacgagctcatcgcggaagaggggcgtggagacgagcccgggagtgctcacggggtagcaacagagggccacgtccagccggtcttcgagcagggccgcttccgccgagcgcgt

SEQ ID NO: 1241 - DNA, 28493 bp, Myxococcus xanthus
  unsure (1)..(28493): unsure at all n locations
gctctacgggctgtccacgccgacgatgagcgcccgctggacctggccggaagcgatggcctcgcctgcttcagccatggccgcgagcacggacacgtgcccacgagccaagaccttctgaagcctcggaaagaaggcaaggccgcagcgacggctgaccgccggaaggagccgctcttgaagctgctccaccaacaggtcctgctcgggcgctcgagggcccgagaggcccaggaagaaggcggtgtcctgccagaagcgagaatccgctcccgtgagccccgcatagatgcacaggtccttgatggcctcttgcacgagcagcgcatggaggcccagccccacgaacccatccgtgagtccctggatgggaaatcccaccacggactcgacgccgggctcatctccggaagagacgacctgcaacctcagtgggacgggccgcgccattccgcagcgaatcgccgcacacccggagaccacgtcatggcccagacaggacaccaaccccaatccggtaagggccagggacatgcccgtactctattcgttgcccgggcagggccaagcgcccatgcgcggttcccctgatgccggtccccttcgttcaagggaagacatctctcttctcaggccgtcttctccgcagccagcgacaccaggagctgcttcgccttcacctggctgcccacggacacgttgagctccgcgacggtgcccctaacgtccgccaccacctggaactccatcttcatggcctccagcaccaccaggacgtccccgggcttcaccgccgcgcccacctgcgtgtccacgcgcaggatgcgcccatccatgggcgccgccagccgtccgctgcccacgccgtccgacttcgacggcggacggaacgttacgtccgtcacggcgtgcgcgcccgagcccaggtccagccacagcgtgtccccgtcccgcaggtagcgtgcgcggccccgtgtcccggcgctggagaagtcgagcacgcccgcggacagccccaacacggacacgtcgaacgacgaatcccccacgtccacctcgtacccttccccggacacgggctggacggtgacggacgcttccgcgccacggctcacgagcttcatccgcacggggtggcggtgggacgtgttccaattcagcagggacacatccagacccgccgtgtccgccagcttcaggccttcgtcgtggaagagcagcgccgccgccagcgcccgcgccttcgcgtctgcctgatacagcccttccacctccgacgccgccgcgtgcctcgcgatgaacgccgtgtcgtactcccctgaacggaacgccgcgtgctccagcacgtacaacaacaggttcttgttggtggtgacgccgaacaccgtcagctcgcgcagcgcctccaccagccgccggcgcgccgtctcccggtccgggccgtgcgcaatcaccttcgcctgcatggagtcatagaagggcggaatctcctgcccctcccgcacgccgtggtcgatgcgcacgccctcacgcagcggcagcctccacgccagcagccgcccggcctggggcgcgtagcccttcgccgggtcctccgcgcagaggcgaacctcgatggcatgccccgacgcggaaatcgcctcctgcgtccggggcagcgtctcccccgccgccacgcggagctgccactccaccaaatccaacccggtaatcagctccgtcaccgggtgctccacctggagacgtgtgttcatctccatgaagtagaagtcaccgctcggagcgaggaggaactcgatggtccccgctccccggtagccaatcgcccgagccgccgccaccgccacctcacccatgcgcgcgcgcagcgccgggctcaccgccggtgacggactctcctccacgattttctggtgccggcgctgcaccgagcagtcccgctcgcccaggtgcaccacgttgccgtgcgtgtccgcgaagacctggacctccacgtgccgcgcgtcgatgacggccttctccaggatgagctccccgctcccgaaggcattcgtcgcctccgagcgcgccgcgcgcagggccgcgcgaagctgcgatgcctcgtgcaccagccgcatgccgcgcccgccgccacccgccgccgccttgaccatcagcgggaagccgatgcgctcgccctccaccgccagcgcctcatcatccaggtcggacgcctcgtagccaggaatgcagggcacgcccgccgcaatcatgcgcagcttcgcctgacgcttgttgcccatcagggtgatggcctcggcctccgggccgatgaacaccaggcccgcgtcgcggcaagcgcgcgcgaagtccgcgttctccgacaagaaaccgtagcccgggtggatggcctccgcgccggacgtcttcgccgcttccagaatcttcccgatgacgaggtaggactccttcgccggagacggaccaatggccaccgcctcgtccgccgccagcacgtgcggcgcgccgcggtccgcctcggagaaccccgccccggtgctgtaacccagccgatggcaggtgcgaatcacccggacggcaatctcgccgcggttcgcgatgaggaccttcttgaagcgctccattgtgtccgctcctctcacagccgcgcgacgccgaacgtgttgggatggacctgccgccgcttcgcttcacggcacaccgacagcgcgaacccgagcacccgccgcgtgtcccgcgggtcgatgagcccgtcgtcgaacatccgcgcgctgcagttgaacggatgcgactccttgtcgaactggtcgatgatgggctggcagaacgccttgagctgctcctcgtccaccacctgcccctgccgggccagcttctccccgaagacgatggacatcaccttcgccgcctgctcgccgcccatgacggcggtgcgcgagttgggccacccgaagatgaagcgcggatggaacggacggccgcacatgccgtagttgcccgcgccaaacgcaccgccaatcagcaccgtgagctgtggcaccgtcgcgttggccacggcctgaatcatcttcgcgccgtgcttcacgatgcccccctgctccggctgcgtgcccacgaggtagcccgtggtgttctgcaggtagaggatgggcgtgtccttctggcagcacaactggatgaactgcgccgccttcgtcgcgccctggggcgaaatcggcccgttgtttccgatgatgcccagcgggtggccgtacaggttcgcccagccgcaaacggtgtgcgcgtcgtactcgtccttgaagccggtgaactccgagccatccacgatgcgcgcgatgacctcgcggcaatcgtagggtttgcggtagtccacgggcacggcgccgcagagttcgtcgggcgagtacacgggctcggcataggcggggcgctcggtgggcggaagctgcgcgttccacccgagcttcgccacgatttcgcgggccatgcggatggcgtccgcgtcgtcctccgccaggtagtccgcggtgcccgccaccgtggcgtgcatctgggcgccgcccagctcctcatccgtggcgacttcccccgtggccgccttgagcagcggcgggcccgcgaggaacaccttcgccttcttcttcaccatcaccacgtagtcggacaggcccggcaggtacgcgccgcccgccgtgctggagccgtgcaccaccgtcacctgggggatgcccgccgccgacagccgtgcctggttgtagaaggtctccccacccgggatgaagatttcctgctggtacatcaggttggcgccgccgctctccaccagcgacaccatgggcagcttgttctccagcgccaatgcctgcgcgcgcagcgccttctgcacgccccacggcgacgcggtgccgcccttgatggcggagttgttcacgaagacgatgcaccgcacgccggacacgtagccaatgccgatgatgctgttgccgcccgccagcgagccgtcactgtcgtcgtggtagccatagccacacagcgtggacagctccaggaagggcgagccccggtcgagcagcagcatcagccgctcccgaggcaggagctgcccgcgcttgtggaacttctccttcgcctggttctccgtgttgcggaccttcgcctcgatggcgcgcaactccgaaacgcgggccagcatgtccgcgcggttcaccttgaaggattcggagcccgggtcgattcgcgaggtgatgcgtggcatcggtctactcctgtccttcgcgcagcagcgcctcgggaatgtccatgtgccgcgagcgcagccactcgcccagggccttgccctgcgggtcgaaccgggtggacgaggagacgccctcccccagcagaccctccacgacgaagttcagcccccgcaggttggggaagacgtgccgctcgatgcgcagcggcgcggcctccgggagcagctcgcgcagcttctcttccgtgagcgcatgcgccagccaccgccaggccgcgtccgtgcgcgcccagacgccgatgttcgccgtgccgcccttgtcaccactgcgcgcggcgacgatgcgtcccagcggaacccggcgcgtgggaccgcccggcactggcggcggcagcggaggtggctccacgggctccagcgagcgcgtctccccgggaggcgtgatggcggtgcacgttccatcctcgaggacggcgacatgctccacgcgccccgcttcgacataggcaggcgtgtagacgccatacggcgcgccgtcggagggcggcgccgtcatcgtgaagcccgggtagctgcccagcgccagctccacggccgcgccgctgaaggcccggcccaccaccttcgcgtcggcgtccttcaccaccacgcgaaggaaggcggcggcctgctcctcggtggccgcgtcctcgcggtccgtccgcgtcagcatccactggagttccttcggcttgcgcgtcagcgccgcctccagttgctcgcgcaccagtctcgccttctcctcgatgtccaaccccaccaggatgaacgtcgcctcgttccggtacccccccaggttgttgaggcacaccttcatcgtgggcggtggcggctcgccgcgcacgcctgagacgcggacgcggtccttgccgtgtgacgccagggaaatggtgtcgaagcgcgccgtggcgtccgggcccgcgtaccgcgccccggtgatttcatagacgagctgcgccagcaccgtatccaccgtcaccgcgccgcccgagcccgcgtgcttggtgatgacgctgctgccgtcctcgtacagctccgccagtgggaagccggggcgccgcgcgtccagctccgtgaagaaggagaagttgccgcccgtggcctgcgtgccgcactccaggacgtggccggcgaccatggcccccgccaaccggtcccagtcatccaccttccagccgaagtgcgccgccgccgggcccaccaccagcgaggcatccgtcacccgtcccgtgacgacgatgtccgcccccgcgcgcaggcacgcagcgatgccccacccgcccaggtacgcgttcgcggtgagcggcgagcccaggcccagcgcatccgcctgcgcggagaggtcatctccctccacgtgcgccacgcgcaccttcacgcccagcttcgcggcgacctcgcgcagggcggcggccaaccccgaggggttcaaccctcccgcgttggtgacgaccttgaccttcttctccaccaccaacgccaggcactgctccatctgcttcaggaacgtcttggcatagccggtggacgggtccttcatccggtcccggcccagtatcagcatcgtcagctcggccaggtagtcgccagtcaggacgtcgagctggccgccttcgagcatctcccggaccgccgagaagcggtctccatagaagcccgaggcattgccgacacgcaggggggatgcaggcatgagctctccactcggcagcaacgaaagacgcgtgagtctgggcaggcgactctaaaaaagcaagcgtgcttgcttttttaacccttggctcgcatcctggccgggtgagtgaggcatccggtacgcccggcaggcaggagcaggagcgcagccgcgtcacgcgccagcgtctgatggaggcggccattggcgcgctctccgagctggggtgggcgggcgcgaccatgactgtgattgccgagcgcgcgggtgtgtcccggggcgcctgtcagcaccacttccccacccgcgccgacctggtggccgccgccgtggagtacgtggggcaccagcaggtggaggccgtgctccgcaaggccgcccagttgccggccgatgctcgccgcacggaggccatcctccacatgctggccggcatctacctcagccctgtcttcaccgccgcggtgcagctctgggtggccgccgtggcggacgcggagctgcgcgcgcagttggccccgctggaggcccgcgtggggcgggagttccaccggctgacggtgcagttgctcggcgtggatgacagcgtcgcggaggtgcgcgagctgattcagggcacgctcgacctcatccggggactcgcgctggccaatctgctgagagacgacagcgcgcgcaggaagaaggtcctccaccgctgggcgctcaccctggacgaggccctgagcgcccggcgcacccgcagaggctgaggaccgcaggtttcatgaacgacctccacatcaggagctgaccatgggctaccgctctctcttcgcaccgggctgtttcagcaaccgcaccatcgtcgtcaccggcggcggcagtggcattggccgctgcaccgcgcacgagctggccgcgctgggcgccaacgtcgtcctggtgggccgcaagcccgacaagctggaggccgtcgcgcgggaaatccaggaggacggcggcaaggtgtccttcgaggtgctcgacatccgcgacgaggagggcgtgaaggccaccgtggcgcgcatcatcgccgcgcacggccccatccacggcctggtcaacaacgcgggcgggcagttcccctcgccgctgtcggccatctccaagaagggctttgacgcggtggtgtccaccaacctcaccggcggcttcctgatggcgcgggaagtctatctccaatccatgagcagccacgggggctccatcgtcaacatgctcgcggactcgtggggcggcatgccgggcatggggcactccggcgcggcgcgcatgggcatgctcaacctgacgcagacggccgccgtggagtgggccgcgtctggcgtgcgcgtgaatgccgtggcgcccggctgggtggcctccagcggcatggacagctacaaggacgagggcgtgcgggcgatgattcccctcctcaagaaggaggtgccgctccagcggctcgccaccgaatccgaggtgagcgccgccatcgtcttcctgctcaccgacgctgcggccttcatcaccggcgacgtcatcaagattgatggtggcgcgtcgtgcaacaccaagattttcccgctggaggagaccaccgcctccaagccctacgagggattccaccgcgcgtcggcgccgcgcatcctcgggggtgagtcgaaggagtaggaacgacaccccgcttccgccaacgtcgcgcggaagcggggcgccgccagctcagaggccgtccgggtagcagaagccgtaggtgcggtcgtagccgccacccgcgagcgggtaggacacgtagcccagctcctcaccagggccgcagtccgagcgagcacgggtgtaggggaagcaggtgccgcggcccgtgccgttcaggtcgagacacacgccgcgcgcgccctcggcgccgcagaactccgcgtagcccagggtgcactcctcgccgatgagggccgggtcgaagtcgaagccactggccacctgcacggcctgctcctggcacagaccctggacgccgcacacggtgcccgtggggcaacccggttcggcggccatgaagtcacacgtggccatgcacgtgctcgacgaaccccaggccgtcgtacaggcgtagccctccgcgcagtccgtggccgccagttcgtactcgctggtgggcgccgtgtacgtgcacgcctcgccgtgcgtcttggtgccgagcgaccgctccagcgtgccgtcatccgcggcgcggttggtggccacgcaggtgtggccggggatgttcgccgtcagcgagccctcgcgagggtcacacccgccgttgcgggcggtgttccacgtcgcgaagcgaatccaccggcactcgccgcccgccaccggctcggtgccggtgtagggcgcgtacagcggcggcgcggccacggactggcgcagcgtcacgttggccagcgcgccaatcgtctgctgcggcgtcagcttgagcgcgagcagcagcgtgcccgactccgccacgaaggtcttcgccgtggaggtaccggcgtcctggacaccccagacgcattgttcacacgtgaagaggttggtacctccagtcgccaggtcatagacgcccggcgccgtattcacatccagccggatacgggcgacatccgccagcgccgggtcgccctggtcggagaacgagccgacgtaggtcggctgcgagccatactgcaccggcgtccgctcgacaccgttcgtcagctcgcccatcgtgatttcggtacacccggcgggcggcgacagcagcgccgcctgctcctccgctgcgcgcagcgtctcctgctcagcggcaggaggcgggggtccgccggcatctccggcgcaccacagcccaccaccgcggtcagcaatgccacacgccaacgccacccacctgtaaatgcaactccagaacgtcgattcgccatgaggtcccgtccagttgccatcccggccattcggcttgcctcgattgattcaaggcaaagcgagaattagtcgcagggtctgacatcgaacaactgctgctcccgtgttccggggccctgcattcacctgacgagacctatggccggaagcgcacgacgctcacgtcgagggcgccagcttccacatccaggacctggcgcatcagctccagcgcgcgtgcttcatcaaagcttccggagcccgcgccaatgacggggaaggcgacggagcgaaatccctgctcgcgggccttcgccagggcattgcggaccgagtcctggatggagcgctccgaggcgcgccacagcatgtcgatgcccgccacgtggatgatggctttgaatggcaaccgcccggcggaggtcaccaccgccgagcccaggggcatggggcctgccctcgccacctcgcggaagggcccgaccccgccccggcgcttgatggcgccggacactccctgcggcagcagcagccaccaggggatgatgttccggttccaggcattgacgatggcctccaccggctggtccagcaaatccccttcgacgacagagacgggcatggcgcggactctagcgccagcccgcctcggatgggggtgcctgggggctcagtcgcacgcgtgcgtgtgcgtgtgctccgtggccttggggctccagccttcgttcccgtccttctcgaagaagaacttcgcgcgcgtgcgctggcgcgtccccacctcgttgagcgtggccgcgtcgtacaggcgcccgttcaccatggtgtagcgcaccgagcggctgtgcttgaggtcctgcaagggattgccatccagcacgatgaggtccgccagcttgccctcttccagcgagccaatctccccgtccaggcccaggtagcgcgccccactcagcgtcgccgagcgcagcgcctggagcggcttcatcccgccatggccgaacatccagacctcccagtgcgccgccaggccttctcgctggccgtgcgcgcccaactgcacgctcacgcccgcgtcactcagctcgcgcgccacggtggcggcggcgaagtggttgaactcgtcgtccggcacgtgcatggacggccgacggctgcgcgcatccaccacccggcgcgggacgaaggacaacaggcgctcgtcctcccacacgttcgtcttctggtaccagtaattctcaccccagacgccgccgtaggccacgcccagcgtcggcgtgtagccggtgccgctcttgccccacagctgcttcacgtccgcgtagatgcgcgccaccggaatcgcgtgctccacgcccgtgtgcccgtccaccaccatcgtcaggttgtgctggagcagtgagccgccctccggcaccaccagcatgtccagctcgcgcgccgcctggagcaccttctgccgctggtctctgcgcggctggttgtagctcttcacgctgaaggctcccatggccttcatccgccgcaggtgcgagcgcgcgtcgtccaccgtttcaatgggcgcgcggtagcccgcgccggacgcgccgtagaggatggtgcccgtggagaagatgcgcggngccaccacgccgcccgctcgggccagctcactggcggcgaacacctcttccgacgtgttcgacgggtcgtgcagcgtcgtcacaccgaaggccagggacgacgcatgcacccagctctgctcgggcatcagcccgtccatgcccatggccccatgccagtgcacgtcgatgaggccgggcatcaacgtcttgcccttcacatccaccaccttcgccccggacggcacctgcaccttgcccaccggacccacggcgacgatgcggttgtttcgcaccaccaccacgccctgctcgatgacctcgtcacccttcatggtgatgacgcggccccccaccagggccagcgtgccctccggcacgtccgccttcaccgggaaggagaggtccacgcccttctccggcgcctccggcagcttctccggcgcaccgtcgatgaaggcgaagctctccttcagcgcgcgcgtgaagagctcgggccccagcgcccaatgcaggcgctggctgtcgccggaccagtgcaggtactcgcccgcgtcccggctcaccttcgccagcggcagcgccttcgcgccgggccccaccgtggccgacttcgcgcccagtgcgaaggggacgacgaaggcgttgaagttctcccggaacgccacccaccgctcgtccggggagacgcgcagctcggtggcctccgcgctggtcaggtgcgtgcgctcctcgctcccgctcagcccgatgctcttcagggagcggacgtcctccttctccttgtgttccacgtgcaggaagtacacgcggtccgagcgcgcgccgaagtgcggctgctcaccgtcacgcgccaggcgcttcggcgcgccgccacctgcgggcatggcgaacaggcccgtgttccggctccacagcccgggcatcaagtagccgtccccggacgcgcggtacaccagcgtcttgccgtccgggctgagcgcgggctccacgtagtagcccggctgctgcgtcagcaccttgccctcgccgccggtggtgggcaccacgcggatggtgcccagcttctcgtcgtcccatgtcgtgtagacgatggaacgcccgtcccgggagaacgacggatagaactccaggtggtcatcctgcttcgtcaggcgccggggcgtgcccgccggcagctgcttcacgtacagcttacccagcgcctggtacaccacgcggtctcccttgggggacacctgcacccagcgcagcatcttcgtggagaagcgctcgggggccaccgcctgcgggctgcgcaccgcctcgaaaatcgtgcgcgtgccccgcactcggaaggcgatgggcgtcaccttcttcgtggccacgtcgatgcggtgcagcttgccgcccgcccagaagacaatcgccttgttgtccggcgtccacgccatgcccggatacacgccgtggatggcccacgtctcctgcatgtcccggtcgagcccgtcgtacagcgggcgctccgcgccggacgccacgtcggtgacgtagagcacgctcttggcgcgcacccggcggacgaaggccagctgcttgccgtcacgtgacggcgtggggcggatggcgccgccggggcccgtgatgaagggctcgatttccttcgtctccaaatccaaccgctggatggcgtagatctgtccgttggggtccttgttgtattcgaagctcttccccggcgagacgtcctggctgaagtaaacgtggcgcccgtcgggtgagaaggcgggctcgcccaaatccttctggtcgttggtgcgctcggtgagctgcacgccctcgccgccggcgcggtggtacattcacacctcgcccgcgcccagcgaacgccgcgcggtgaagtgcttgcgcgccacgatgaactgcccgtccgggctccacgcggggctgttgagcaggcggaacttctcctccgtcaccgcccgtgcattcgagccgtcccggtccaccacccagatgttgtctccgccgccccggtcactggtgaagacgatgcgcttgccgtccgggctgaagcgcggctgcatgtcccatgcgacgccggacgtcagtgccttcgcttcgccgccgcccatgggcagcacgtagatgtcccccagcaggtcgaagacgatttcgtctccgcgcgggctgacgtccacgttcatccacgtgccctcggtgacgtcgatgttcacttggcgggcggggaagcccggcgcgtccaccttccaggtgtctcccccttccttctccgccttctgcgcggcctcaccggacggcggacgcggggcgtctacctcggcggcgcgggccgcgtcgcgcgcggcgtccttcgtgtcgggtgccggccgtggcgggtcctgccggaccgcgggaggcttcgccggagcctgctgcgcggccatgggcgcggcgggcagcagcaggacggcgaggagggaggaggtcagtcgtttcaccagaagtcctcttgagggagaagccgtgtgtcgggtggcggagactatccggccccgaggggctgttggatgccggccgagaacaggcgaacaggcgagcctcttccggggcgtgtaggctcacgctcgccgagcagcactgattccggggggagtctccatgcagacgcgtcagaagctcgccgtgctcgtcatccacggcattgaagtggatgatccgggtctctatgacaccgccgtacgcctgctgcgccagcacttcgcgcagcacgcgggggccgggccggacacactcgccgtcgaaacggtgaactgggcctccgtgctggaaggtgcggagaaggacctgctcgcccgctacgccccggccgacgcggacacgtactggaaatccctctatgacagcgtgcgcacggtgaaccagggtcacgagtccgcgctcgtgccgatgatgctccgcttgatgcggccgtccctgcgcggcatggacctgcgctaccccggcctgcggtggatgctggtgcacttcgtgggcgacatcatcgcctaccagacgaaccccgccgacccggacgtctacacgggcatccaccgcaaggtcgccgaggccctgggccgcctgcgccagcaggccggtgacaccgctccgctctgcgtcatcgcgcacagcctgggcagcgtcatcgccagcaactacttctacgacttgcaggctcagcgactggccgggcgggacatcatcgaggagacggtgcgcgcggcccagggcagctcgcccctggagcgcggcgagacgctcagccacttctacacgctgggcagtcccatggccctgtggagcctgcgctatccccacgcggagctcgaccagcccgtgcaggtccccgcgccggagctggcacgccaccatccggggcttcgcggacggtggctcaacttccacgacgaggacgacgtgttcgcctggccgctccaggccctcagcgccgcctatcacgccgcggtcgaggaccgcgccgtgagcgtggcgggcccgctcttctcgtggacacccctggtccaccccttctactggtcggatgacgcggtgatgcgggacatcggcacgtcgcttgccggcgcgtgggtgcagctctccagcgccgcggccgtggcctcctagcgtggcgttgcgggcccccgtcaaaacacagtgcgcccaggcggccctgaatctggtatcgcgcccctcatgtcggacgacttcacgcttcctgaagacaaggccgagcggatggagcgctgcgcgatcttctacaccgacgtcgtgccccacaatcacgcgctggggctgcggctggtggacatccgcgccgccgaggccaccgtcgagctgccctacgcggagaacctcgtcggaaacccggaaaccggcgtcatcgccggcggcgcggtgacgacgctcatcgacgccacctgcggcaccgccgttttcctcaggctgggccgcttcgccccgctcgtcacgctggacctgcgcatcgactacctgcgccccgcgcggcccggcatcgttctcacctgcgtggccgagtgctaccggctcacccgccaggtggccttcgtccgcgcgttcgtccaccagggcgacccgggccaccccgtggcttccgcccagggcaccttcatgcggacagaggaatgacgaccatgtccgagtccacgacgcctcccctcgccgagttggtgcgccaggtacgcaagacgcgcgagtacaagcgcctcaccgacgccatcccctacacgcgtttcatgggcatcggcgtggagaacctcgccggcgagatgctctgccgcatggccttcaacccgaggaacatcggcaacagcctgattcccgcccttcacggcggcacgctcggcgcgctgctggaatccgccgccgtcttcgagctgctgctgcagacgaacaccgagcgcgtgccgaaggtcatctcgctcacggtggacttccttcgctccggcaagccgcaggacaccttcgccaaggcgttcgtcacccgccagggccgacgcgtggccaacgtccgggtggatgcgtggcaggacgaccgcacgcggcccatcgccagcgcgcacgcgttgttcctgctgtcagagccgtaagccttccgggagtggagccgctgacggcgggatgccctcgaaaccccggaggcactgagacaggagccctcgccccgctgcccgccccccttgctccgcgacatcctccgcctccaccttcagtttgatgtctcgctcgggacatgggaggcaggcgatgaagcgatggatgggtggcgtggtggcgggcgcgctcgcactgggcggcggcgccctggcgcagcagaacggcacggacgacacggagagcatggtccgcatgggccgtccggaggccatcgaccaggggcaggccccggagccgttcgaggaaggcacagggggcgccggttcccagggcactccgcctgatgcgcgcggcgtggcgctgctgcggcaaggcctgctgcccatccccaccgacgaaaaggccttcctcgacgagctccaccaggccaaccagcaggaggtgaagctgggccggctcgcacagcggcaaggcagctcccaaggcgtgaaggactacggcgcgcggctggtgaaggaccacgggcaagcagaccaacgcctcatggcctacgcccggaagcagaacctgacgctggccgagccccaggcggacaccgacttcgccaggacgatggagcgcgcggaagaagcgtcgatggcgaaactccagtccctccagggccccgcgttcgaccgcgccttcctggccgccatggtgggcgaccatgacgcggacatcgccaaggtgatggcgggtcagcagcagttctccggcaacgccgggctgcaagcgctgctcggcgacacgctgcccacgctgcgcgaacaccggcagcaggcgtaccggctgctgggacaggaaactccccgccaggcacgcagggctcccggcggacgctgacgtcagcgcgcggtgacgtccaggactcgggacttcatctccccggcgtgactccacgtaatcaggtccgtgctgccctcctccttccccttcagacgcaccacgccctgacgcggcacggtgacttcgacgaggctcggttcgcccaccgcgatgcgctggagtccaggaacggccagttcgtgcacgtcgccgacgcgcaggacaatcagcgatgcggccatacgcccgaggctctcggctcgcggcgtggcggcgtcggactggaacagaaaagacggcttccacaggagcacgcccaggaccaccagggaacccgctcccgccagggccaggatgccccggcggccccatgccggcgaaggcagggagagcgccgccatcagcgcctccatgctggggaagcggtcctcgggcgcgttcgcgagcccccgcgccagcgcggtgcggagatgcctcggcacgctcgacgttcgcggtgcggcggaggcagcaaggtggccgggacgctcaccgtggagcgcttcgtggagcgcgacgcaaaagctgtactggtcgccgcgggcgtccacggcccttcccgcgcgctgctcgggagacatgtacgccggcgttcccgcggcctgcccccactccgtgagcatggaggccttcgatgcaccctcgctcacaccggccggcgcctcgggagactcgcccgtgccgcgcctcgcgagcccgaagtccgtgacgcgtacccggccgtcccgccccaccagcacgttggacggcttgaagtcacggtgcaccacccccgcgcgatgggcagcggccagccccgctcccgctgccaggaagacatccaacacgtcccgccatggacgctcgcgttcccgaagccagtccgcgagcgtcgtgccgtccacccactccatggccaggaagtcgtgcccctccgccgtccccagctcgaagagtggcagcacgttgggatgcgagagccgcgccatggcctgggcctcgcgaagcagccgctcacgaccctggtcctgcgcgcccgcgagcagcggcctcaacagcttgagcgccacccgccgccccagccgcaggtcatccgccgcgtacaccacgcccatccctcccatgcccaacacgccctgcagcagataggcccccagccgcgtccctggcggcaggaccggctcctcccgcgcgtccggcaacgtcgccgcgcccgtgtcccaccgcgtgggcgcctccgcctcacgctcaacgacgactgcgcccggcagagaggaactggccgccaccgccgccaccaacgcccggcagtccgcgcaaccgtcgaggtgcgcttccaccaccgccaccttccccacgggagccgagccactgacgaaggccgcgagcaggttctcatccggacatgcggacatcggaggacggtgcagcgagttcatggcgcgcctcgaatcatcgcagcccgagtccgcgccgaacagcccacccgagtgttcccaccctcgaaggcagctccgctggcgcgccgacccgacctcccaccttgtgtcagcccctccctgtagacaggtcgtcgtggagggaacgttccttccacgcgacggccgcgaaggcagggggacgggcggatgtacacgttggcggagatgcgcgctttcaggctgcgtgacgcggcggagttgctggcacagcgggggttcgacaacgtccgggccgcggaactggcccgggccacgcggctctcggtgggctcgctgtatcgttactacggcagcaagcagggcatcgcgagggcgatacggaccctcaccgagcgcgagctgtcctacacgggtttcgtcgcctaccagatggcggatggcgacccgctgcggcagggctttcgcgacgtcttcatcgccttctggcgcgagttcgcgacctgggcgctgttgcagccccacctcgtgggcttcaccttccttcacaaccatccggacacggactcaccgggcgagcatgacggacggacgcgcgcgcaggtgctggaggtcctcgagcatggcgagcgcgagaaggtgtttcccaagggccgcacctggctccatgagtgcatggtgtggggcatgctgtcggaactcgtgcgccggacgggccggggcgaggtggtgagcgaagaagacgtcgagactgccgcggaggtcctctggaaggcgctctctttagatgagccctccaagcctcgaggtggtggcaatccgcctccgggaggtgaccacgcgcatccagcgctcacggcggacacgtcagctcggacaagtggggcgatggtccccaccgcatccgctgaaccccctccaactgcgacgcgccttcgtgcggcggcaggtgacgcaccgctctcgcatgcaccttgcccccggccggtccagacggcgcgaagccctggtccagcggcgtccacgcccctcatccctgcgcggaggagcgcggcttccattcatgccacatggcggcaccatggccaccgatgccctgcatcaatcggtgacgacgatgcggtagctgctgcgcttgttctcgggccccacccacacgagcagcgctgtctcaccggcctgcttaccgatgatgcgcagcacccctttgccgagcgccttgatgtccgcaatctccggttcgtcaatcgcgatgcggaccattcccggaatttgaaggtcgcgatggctgcccttcttcacgaccaccgtttcctcggtggtggccgaggccccagaagacggggccggcttcgactcctccgccagcgcaggcgctcccatcaacgccagcgcaaccagggcaaggcccattctgtgatgcatggtgtgtgtcctccaagagggggttgttccaccttcacccggatgacaccggccaggtcggagcgttgcacgcggccgcgaaaaaagtccgcggaccctcaggaagccccagggctgctcagcagggacggcaggctcaggtccagctctccctgtaccacccgcatcaggctgtgcagttcgccggaggtgagccgaagccgctccgccagccgctgacgtgtgccctccagcgccgcttcccgggcacgggccacccagcgcgacacggtggacttgtgcgtctggtacatggtgccgatgcgctccaggctcagcccctccaccacgtgcaagcgcagcacggtgcgctcccgcgtgggcagggcattcagtgcctcggagagcgccgcctggaaatgctcgcggtggttcttgcgcaggtagtccaactcgacgtccgccatgcccgcatgggttggcagcgggagcgcctccgcctcctcttcggcgtgggccctccggcgctccgagcgctggaggttgagggcggtgcgcaccgctgccgcgcgcaaccaagccgcgagcggaccactgcccaggtattccgccatgcgtgcgggccggtcaccttctgggacgagcagccgctcgcgcaggtgttgaaccacctcggaggggtccacacccgtgtcccgcatccgagccaaggacgccgccgccttgggaagaacgtggcgctccagcgcgacatgcgccgcggcgttcccccgcacacaggcgcacgccagatagaggtccgcggcatgcacggaggccagcacccgtgaggggtcctcgtcccgtggcaggcacgaagcaaggtggcgtaggaagtcttcctccgccagcgtcacgcccggccaggcctgccgcgccgcggcgcagagcgcgaccagcgtgtcctccagtccggacagggcctcgtagccctcgcgtgtcccggagccgagctgctggaggaagacgagcgagcggctctgctgcgttcgcatgcgcacctcggcaccgcgcgtgcctggaacggcacggctcacccgccttgttaccccgttccctccccccgtttccacccggccagcacgacggctcggcgagcaaccgcgccaggaagtcgccaagggcctttaacttgggcggcgtggggcgcgcgggcggccacacccgccacaaggctccccgctcccccctgtgctcgcacacgaaggaccggacgcggcgctcgcgcggacgctgggccacgcccacctgggcatcctgcccggacagggccacgtggcccacgtcaccgcgcctgaattgctggcgcgcgaggtctccgcgttcctccgcgaatcgcccgcgcgcctggggcctacatggacacggacttgcttgggtcgagctgcatcttctcgggctcgcgcgtccgggcctgcgtgtccgccttcttcgaggcgtcccggctcttgcgcggggcctcgacctccgccttcaccggcgcctcgcagtggtcacccttccgattcgggtggcagtgccggatgccatacacatggtgacacccacaggggtccacccgtttcttcgcgcacgcggagggattgaacaccggggctgccacctccaccggtgtctgtgcctgctccttctccacgggtcccgcctgcaacgccaccgccaggaaaatcccaccaaggaaacccatcgcccaccccctacctggatgctgcggaatggatgggaatggaatccggacgtgacaagtcccggggcgttcggagcctcgccgtccgctctcgggctgactttcgcccggccgggcacgtcccggccgcggccgcgtgcggctccgaattcgctcgccttcccgcctgtgcccccagcatcctctgctcctgttttcgggtttcggctcctggcgtcagcttccctggacgctcccgtcgctgccgcgtgttcatcccatctggggaataagagtcatgagttggaagcagcggctggagaaggtctcagagggccattacgtcctggcgaagaccaagagcatgaaggtcgatgcggacctgttcctgtccgacaagttgctgtggggggagggccccgagcaacctggactggaggactctgtctttgaccaggtggtgaatgcggcatccttccccggggtcacccgcgtggctgtcacacccgactgtcacctgggctacggcgtccccattggcacggtggtggaaacggacggcatcctcctgcccaccgccgccggctacgacatcggctgcgggatggtgcagttgcagacgacgctcaccgccgaggacgtcgccgacgccacgaagcgccgccgctggattgaagaggtgacgaagcgcatcgccgtgggcgtgggcgccagccgcgtgcagaagcagcgcagggtgacggaccgcaccttcgcggacgtggtgcgccacggcgccaaggccctgggccggggttcgtccgtcaccgagcgcgactacatccccgtcgaggatgatcgggtagacatccccgagcgcgccttcggcaagcgtgagcaactgggcagcctgggcggcggcaaccacttcaccgagatgcaggtggaccaggacggccgcgtgtgggtgatgctgcacaccggcagccgcggcttcgggtggaacatcgccaagcacttcttcgtggagggcgccgcgcagctgggcctcaagagccgcagcgaggaccatgtctggctggacgcggagagcccgctgggccgcgactactggaacctccacaacatggcggccaacttcgcggtggccaaccggctcatcatcggtgaggcggtgtgcgcggcgctggaggacgtcttcggcggcacggccagcgtgtattacgaaatctcccacaacctcatccagaaggaggcggggaagttcgtcgcccgaaagggcgccacgcgcgcgttccccggaggacaccccgcgctgaagggcacgccctgggagaagacgggccaccccatcctcatcccgggctccatggagacgggcagcgccatcctcttcgccgagccgggcgcacagaagtccatctattcggtgaaccacggctctggccgccgcatgtcgcgcggcgaggcgcggcgcgtgctgaagcaggacgtcaccgacaagcgcatggccgaggcgggcatcctcctcaatacccgccagacgccgctggacgagtccggcccctgctacaagaacctggacgacgtcctggagacggtggagatggcggggctggcccgggtggcctaccggctcaagccggtggcctgcatcaagggcgcggactgaggcggcccgggaggcgcatggccgtctgcctgccgccaatccctgggaggcgggcggccccgggtcatttccggctcggcgcgtagggctcgtggggccgtccgggggacgctacagtgggcgcccctggagtctttcgcccatgagctcgccgtcccctgctgcccgcatgcccccagctgcttcccgtgaagcggagctggctcgcgccgagagcgagctgtccacgctggagggccggctccatgaacaactcgcccaggccacggcggaggcgtccgcgctggccacccggctggagcagacgcggcaggcgctgacgcgggcccaccaggcccccggtgccgaccccatgttgggggaacaggcctcccggttgcagttggccgtggcgcccgcgctggacgtggaggcgccgcgcatccgggcactggaggcccgtcaagccgcgctcctggctcggcggcaagcaggttcggagatgcagtcactgctgcgagcccaccaggagcaggccgcgcaggtggcccgcgcggtgaccgaggcggaagcggtgctcaagcgtcaggccgaggcggccaaggcccgccaggaagccgcgtcgcgggcacaacacgaagccgccaaggcccgccaggccgagctggcgcgggcggccgccgcggcgagggcccaggggcacgcacctctcccggcagccgcggcccggcccgccaccccgccggagaacgacgcgcggcgcaacggacgggtgcggatgcacacgtccatcgacatgcgcagcgactccaacttcttcacgggtttctcactggacctcagcgagggcggcgtcttcatcgccaccgtggacgcggtgccgcgcggcacgcaggtggagctggacttcacgctgccgggcggccggcccatgaaggtgacgggcgtggtgcgctgggtgcgcgaggccaattcccgcacgccggagctgatgccaggcgtgggtgtacagttcaccgggcttccggcggaagtggccagcgccatctcctcattcatcaccacgcgcgacccgatgttcttcccggactgagcttgagacagacgccttcgtgacacgcgggcgcgatgtttcacgtcatccgtcgggtagtcgacctcgcggccactcccgcgcgctgacaggcgggattatcctccgcagaagacagacactccgacgacgaactcatggcgcaagccaatgcagcggcgccgcggaaggagatgacacccgcatgagcgcgcctcatcgcagccccacggtcctcgccggacgtcgtccgcgctgggactcccgccgacacgccgacactgcccgtgccttggaaggcacgggcaccccgcccgcacgcgacgccctggagacgccggcccccgaggtggacaaggtcaacctcgcgcagaagctggccctcttctccgagcactggtccccgaaggtggtgggcgagctgaacggccaacacgtccggctggcccggctccacggccccttcgtctggcaccagcacgacgccgaggatgagctgttcctcgtgctccacggccagctgcgcatggagctgcgcgagcgcacggtggacgtgggcccaggcgagttcatcatcattcctcgcggcgtggagcaccggcccgtggcggaggaggaggtccacgtcctgctcttcgagcccgccaccacgctcaacaccggcaacgtccgcgaggagcggacggccgagcatctgcagcagctctgaagcggacgtccaggcacccccgccgggcgggcgggcctcccgccaccccgctcgcgcggattcctccgtggcgtcgcgcggcgcacctttagctccggacccgggccgcccgagcggctccctgccgaggagcggaagcgatgcgcatccaccacctgaactgcaccaccatgtgcccgccgggcggccggctggtggacgggcgaaagggcttcacggggcccgcggcgctgacgtgtcactgcctcctggtggaaggccggcagggactcatcctggtggacaccggcttcggcctggaggacgtgaagcacccccgggcgcggctgcacccgctgctcctcaagggaatccggccccggctcaacgagggccccacggccatccgacagattgagcgcatgggcttccatgccgaggacgtgcgcgacatcgtcctcacccacctggactgcgaccacgctggcggcctgagcgacttccctcacgcgaagatccatctcttgtgggatgagtaccagcaggccctggcccaggcgacggcgagggaccggagacgctaccggccacagcagtggcctccggagacgcagtgggtgacgtatccctccctgggggacggtgagcgctggttcggcttcgagtgcgtgagggatttgacgggcctgccgccggaaatcctgctggtgccgctgccgggccacaccctgggccacgctggcgtcgccatccagaatggaagcggttggctgctgcacgccggagacgcgtacttctaccatggggagatggccccggaccggtaccagtgcaccctgggcctgcgcatcgcccagaaactgaatcagacggatggctatctgcgctggcacaacatgcgcaggctgcgcgagctggtgcatcggcacggacgggacgtcacggtgttctgcgcgcatgactcgctggagttcgagctgctggaggagcaggagaaagcgcctgagcggtcgcccctgcggaccttcgtggacacccggccgccgctgcacgcgtgacgggcgggctcacgagtgcaggggaatatcgggtggctcacgcagctccgagcccagcagcatcagcggcaactccacgatgaaggtggcgccctcgctgggggcactctccacgcggatggtgccgccgtgcgcctccaccaactgccggacgatgtagagcccgagcccgaagcccgcatgctggccgccggagggctctctttcgaagcgctcgaagatgcgccgctgcgcctccggggcaatgcccacgccgtggtctctcacgcacagccgcgcccgcgccacgcccgcgtgctccacccggacctccaccggccgccccctcccgaacttcagcgcgttggacaagaggttcgtcaccacccggtccaaccgcagccggtcccaccggcccaccagccccaattccgcgccgaactccagcttgcagcccgcctccgcagcctgttcggcgaagcgctccaccacctcgtgcaccaggtccgacaggtccaccggcgccacgtccagcatcagctttcccgatgacagccgcgacaggtccagcaagttgtgcagcagctgccccagccgctgcgtctgcttcagcgccgccgccagcccgtcgcgcgccttctgctcctccgcgagttccatccgctgaagccttcgcaggagcaactgcagcgtgttcaacggattgcccaagtcgtgcgcggccacgccgatgagctccaccgcgtcctgcgcctcgctccagagccgggcgttgtccagcgcgagcgcggcacgtcccgccacctcctccacgaagacctggtccgtcaccgtcagccggcgctccggcgcggacgtcagcagcacaaacaccccgcgagtctgccgccccacccgcagcggcacgccgaggtaggagcgcacgcccaccttctccatcaacgagaggtgctcggggcccaccagcccccgggccagggtctccggagacacgtcgctcttgagctcggagcgccccgtgcgcatcacctgccagatgccccatggagactctggtggcggcggaaagcgccgcgccgcgtcccatagccacgcctccttctccggcatcgcgtgcgccaccgcgcgaggccagaggtcaccactggccgacagcaggtagagcaggcaggcgtccgccacctccggcaccatgatgcgcgtcagctcggccaccgtctggtctgggtcctggaactggtggaagaggcctcccgcctccgccagcagttgctgcgtgcgctcggcccggcgccgctcggtgatgtcgcgcgtcaccttggcgaagccgcgcggcagcccgcgcgcgtcctggagcacggtgacgttgacgtccgccagatagcgcgagccgtccttcctcactcgccagccctccgtgtgcagccgcccatccttccgggcccgcaccaggtccttgtccggaatccccgccgcaaccgcatccggcgggtagaagacgctggagggctggcccaggatttccgcctcccggtagcccatgatgcgctccgcgcccgggttccagctctccacccggccccgcgcatccagcaggaacaaggcgtagtcgcgcaccccctccacgaggagctgaaagcgctcggcgctggcctcggcctcctgttggatgggccgcagcttgcgcgtcagcgtccacgccagcatcgtggcgcccgcgaggcccaggctccccgcgagcagggacagcccaagcgcgctgcggtccgtggccaggctctcatgaatgccctcggacagccgggtctccgtctgctggtggagcatccggaggctgtccatgacacggcggcgcgtgtccgccacgtggccgtcgaaaatctgctccagccgctggcggggcacgccgtcctcgcgctccatgatgagcgcctgcatggcctcctcgtgctccagctccgcgtgggagacggcctccaattgagtggccaggggctcctgggtgagccggcgcttcagggcttcgtaggtggcgatgaagcgctcgcgcgcgacggacatgtcctgggcgaagaaggtatctcccgacaaagcgaagccccggccactgacgaccttgtcgttgaaggtccgctccagttgtttgatgtccagcacgtcccgggacagctccaggatgcgcgccttgtgattggcccgcacggagagcagcgccaccacggacgttcccgccagcacgagcgccaccaccaacgagatgatgaagccggcgcccgcgcgctgcgcgaacgtccacggacgtgccacctcccctcctccccagacggtccaccgcccatgccctcgggcagggtgaagcgctccgcaccctgaatccagggggctcgccgggtgacgcgaacgttggaaaccaggcgcccgagcagacggcgcccgtgcccgcgcgtcgcggtgtgtgcaccgtccaaccccgcattacaccctggctgggcacgcgcgcagcccagccccaggttgggcgcgggtggtggcctgggcgggacgggagcgcatgcgcggagcggggcggcggggagcgtggttctgggcgtgtgggctggtgctgtgggtggcgtgcagccagacgcaaccgtacgaggacgcggacacccgccggccggtgtccgcctgcgagcccatgacgtgcgcctcccagggcatggactgcggcatcgccattgacggctgcggcggcacgctcggctgcggcgcctgtggccccggtgaggtgtgcggagggggtggccggcacaacgtgtgcggaccggcgccctgcgagcccaccacctgtgaggccctggggaaggattgcggaccagtctcggatggctgtgaagacgtgctcgactgcggcacctgcacggcgcccgagtcctgcggcggcgggggcacacccaacgtatgcggcgagcccacctgcacgccggacacctgtgagtcgctggcgcgcgactgcggcgccgtcccggacggctgtggcggcatgctcgactgtggcgtctgcgcggacggactgacgtgcgggggcggcggcgcgcccaatgtgtgtggccacggcatctgcaagcgggccacctgcgacgtgctggggaaggactgcgggccggtgtccgacggctgcggcggcatgctcgactgtggggcctgcgcaggcggcctgacgtgtggcggcgacggcgtgcccaatgtctgcggcaactcgccgtgtacgccggggacgtgtgagacgctggggaagaactgcgggccggtggcggacgggtgcggcgacatgctcgactgcggcgtctgcgcggacggccagacgtgcggcggcgccgagcccaacgtgtgcggcggcggcgtgtgcaccccgctcacctgcgagtcccaggggaagaactgcggcaccgtgcccgatggctgcggccgactccttcactgtggcctctgcccggcgggcgagacatgcggcggggggcgcgtggaccacgtctgtggccatcccctctgcacaccggccacctgcgagtcgctgggcaaggact

SEQ ID NO: 1242 - DNA, 28783 bp, Myxococcus xanthus
  unsure (1)..(28783): unsure at all n locations
aacgccgcctacgcatggcggcagatggtgttcttcctgtcgctcctctcccaatctgagcaggaggactttggacattgggctcagcagcacctcgcctcgcaaccgcgccgaatcgcggaaccgttcgcaccagcgctcacgcggcttctcgcggcgatcgaggaacaggtttcgccactgcccggccgggtgttccttggctgggccgttggctcacactggctcctgggcgccccgcgacctgagcgcggatcggtataggccaccgcgccgcggtacctgggatggatgagagcgcgcacgcagcgccacgacgcgcgtgtgcaccccgtcgtcttgaattgcagggggactacagcaggtcgaccggaggcgccttctgcgtcatctgctgtgcgtagtccgacgcgtggtcgcgcatgtacccaatgggatccgggagcacgcccaggccgttcgtccgcgaacgcccggtgtagatgagctctccgctctcgttgatgtagtggacgtagaggcccgccgtgccgtcagcgccgaagcgctcggtctccacgctcccgatctgcgtcccatccggggccaggatctccttcatgatgggggagcggtacatgtgcgcgaccgggatgatgacccccttggcgccgaactgtttcacgtactcggccagctccttcttcattcgcggagggacgacgaactggtcggctgcgatgttcgggaacgcgtcgcaccactcgctgtcccccttcaacttcttcaccttcacctcggaggcgtccttgctatacgcgctccagagcgctggcgcgaggtagtcctcgatgttgcggtacaccttgtcgttgccctccgccggataggcgcaggcgagcatgggggtgagcgcgtaggggccgtccaactggttccattttccgccggtgaagtagcgcgggttggacgtcgcgaggccaccgcagccagacagcaaggccatcgcgacagcggcgctcaatgagatgtggaagaaggatgcacggcgagcggtcatggaaactcctcgagcaggtggatgtggctcacggaaaattcgtgagccacttggacgttccgccccgcaccgggggtcccatctttttacgaagtttccacagacagaagcccagcactcttgacggggtgctgggctttttcgttgcccctacttccgcatgcgcctgtcaacgcttctcccgtgtgagctgggcagcgctgccgagcgacgtggttccggcctcgttcgaagtagagtagggggatgcaccgttgcctcctgtccctttcttcgttggtgctgctcgcggcgggctgccgtcatgcgaatctgccggacctgcccgcaagccatggcgccctctccatggcgatggaccgctacgcgaacgaccgcgagtcttccttcgacaactacacgccagcgccagccagcatcttccaggaagagccccaggttctcgtggagccggagcaggcgctggccgtctatggggaagcctccgcgacgctgagtgggacgcccacggcacagcaggtccgtgatgccgtggatgacctcaaaggcgcgtgtctgtctggcctgctggatgcctgtgtcttcctgcgcgagcgcttcgagttaccccgaaggcgcaacgaagcgacgccccactttcccgaagaagtggtcatgaagcagctcttcaccgtgggcgtacttcgctgtcgactggccttggatggagttctccgggactgcacggtccttgaacgcggcgcgaaaggtgtcgaggagtcgctgctcgaatacgcaatgaagatgcggtatcaccccgcgacgctggcggggcatcccatcgaattgccttacatcatctccctccaattcaatccagcgaggagggatgcgcccatggcgaaggtgcttgagcctcggttgcggcttgaatgggcgcgggcccgggcggtgggctctcctgcgagcccgttggcttggggaaacctcgccgtcctgctcgcgaaggaagggcccgaggacggcttgtaccgagaagcgttgcgccgctttcaatcgcttgcacccgcgtcctggtgggccgccaacgaagtggcctggtttcatatccaggagggccagtacgcggacgccgcgccgctggtgaagcgggctcgcgccttcgcattcgacaacccctatgtcctggagacgtccgcggcggtgatggccgggacaaatcagtgcgcgcaggccgtgcaggaacagcgccgcgcggtggagaagctgccagccgagtggcccgctccagagcgcgagcgcttcattcgggcgctggagcattaccagcgcgggtgcatggcgccgaacgccgactccgcatcagcgccgactctgggaatttgatgtcgctgagggacgcggcgtcgctggaaagcccgcccgcgtcggccctccggcgcgcttgcgtggtctgagttaccccgcatgaagcgcgtcaccaccgtgttcttccagatggctgccccagcgggctgggtctgacagcgtttaggatttcacaatgtcaggcggtgtagggggtcccacgagtccacccaccgaatgtctgccctagaatgcctccaactcgtatgcattgggggggcgccgtggctatcacgacccggcagcctgtctttcatgcaatgcgaagtctgctgggcatgggctcatcctccaatgcaaagagtgccgcgccgagctcgacgaccgcgacgaaggcgtatgccgcagccccggattggagggcgacgtcggcgaacctcatggaggccatcgcccgcttccagcgtcaggccaatgggcagctcggtaggtgcgtccaactccaagagcggatgggcttccgaccggtgcgcccaggcccctgtgccaggggcctgggcaggtccgactcaccgtgaggtgagccgaaccgcggttacttcctgcgcttgaaggagtcgagcgaggggcagtaggtggcgtacccgtggccggtgatggcgccattggcgtagaggccattcaagtcgaaggccacgaagtgcgattcgggaggggtaccgctcaggacgcaggtggggcagagcgaggccgccacaggtgtgaaggtgaggctcgtgctgtgcaggaagtacgcagtagtgagcacaccctcgaagtcgacgagcgtcgctgtcggctcgcccggcatggatcctacctgcggcgttgcgtccaccggcatcctcaccttgtgaacgttgaccaactgcggcgggagcggcgaatcctcggaggggcactcacccggcgcgctgttgttgagctcgatccaaagctcccaaggggcctccgggttgtccgtctcttcatatccgaagtaggcgctggtcaagacacgctggttctcgcccaatcgaatcgtggtcgcggtttcctggcactcgccctcgcaaacggtgaacggatccggctcggtgccagcgtcgggggcagtgcctccgtccgagtcggtgccagcgtcggggtcagtgcccccgtccgggtcggtgccagcgtcggggtcggtgccagcgtcggggtcagtgcccccgtccgagtcggtgccagcgtcgggagcagtgcccccgtccgagtcggtgccagcgtcggggtcagtgcccccgtccgagtcggtacccgcgtccggctcggtgccagcgtcgggctctgtgccagcgtcgggctctgtgccagcgtcgggctctgtgccagcgtcgggctcggtacctgcgtcgggctcagtgcctgcgtccggctcagtgcctgcgtccggctcagtgcctgcgtcgggctcgggctcgggctcagtgccagcgtccggctcagtacccgcgtccggctcaatgcccgcgtccggctcaatgcccgcgtccggctcaatgcccgcgtcgggctgaacacccgcatcaaatcccgcgtccggcgtcggatcgacgtcatcggaaccacagccggagagtgcgggagcgactgtgagggagagtatcaacagggagcgtatcgagagtcgcaggttcatttcgttgattgtcacgggtttctcgcggagatgcgagggggcccggccttctgtgtcacagcttcgttgcatcaaggcggacgtgtccacatgccgcgaacactgttccgggccgtctccagcgtttcacgccgagctttcacgatgtttccgggactggcctggatgcccagccgcatccaggcgtcaagacggacgagcatgccggaacacatgaaacgccgcaccgaggagtccctcagcggaagcgtcgctgacgtgcagactcaaatcgtcccatcccaacccgcaccacaccgacggcacgcgtcgcggatggcttccacgaagtccgagggcagaggtccttcctcgctccagtccagccccgcgagtcgagcgccaggggccgcatccggtgccagtactcgctgaggtcatgcgcactgccgcgtactccatggcggcattgtcaccggagtaggcggccgcgcggacctttccttcctcgactgcacgaaccagcgcttccaccagcccggggcgctggagcacctccagcgggcacgagtggaaatgtaccacgtcgagcacgtcggtgcataagcgcatgaggacctggtccacgccgcgggtgatgcactcggacgccacctacgtgtccggcgccagagccgagcacggacacctgcagtcccgtccgtcccaggtggcgatgctccatggaaccttctcgcatggcctgacggagcctcgcatcggctcgagttcactgaatgtcacagggtcgttgacgcggcggcgcgatgcaccacggcctccagagaaggtcgcctgcgggcgaacccgctcgcctgcttttccctcgcgtccggcaccgtctgcctggctcgatgtcggttcatcacgagtgttcggtgccatcggaaacagttctcaacttgtgctggggtcgtggctcgctccgcacctgcagcggttggtgcgtgcactcgctcccgggagcaattagagcccgatgcacgccatgaactcgctccccgtgcatcgcgtctcaggcctgcttcttgtgttcgcgctcgtctcaggaggcgacgcaggcgcggcgcccgcggatgcccccctggcgtcgaaggagtgcgtcgaggccgttcccgcggagccccggcttctcgtgccggagctcgtgcacccgcctcgccgcgccatctggaacgcgccggacggaggagggcgcaatttcgttgtgcccatcgtggagatgggcgccttccacgccatcttctgggggacggcgaagctcctcggaaagccctacgcggacatctcgctggagaccatgcgccgcaacgtcgccgatggctgggagtgggacgaggatgcgttcgcgaccaatgcgctcgggcacccctaccagggctcgttggcctacaccgcggcgcgctcgagcggcttcggcttctggggctcggtcccgttcacggtcgcgtcaagcgtgttgtgggagctgttcatggagtctgagactccatccacgaacgacctcattacaacgtccatcgggggcgtcgtgctgggcgaggtcctgcatcgcaccgcgctcgcgattctcgacgaaggcgaacccacggtggcgcgctcggtgctctcgctgcttgtcgaacccgtgggcggcatcaaccgttacctcttcggccgccgtaagaacgacttcctcccggtgcaggggaacttcctccagttgatggccggcttcacgagcaacgtcgacaactacaacgacatcgacggcacgcgcttcgatgttcccaacaagatggaggggcaccttggcgtcgaaatggtctacggccccccgctgctcaccacgggcgactatgaccagcccttcgactacttcacgctcaccgcgcgcatgggcttctcgcgtgacacgctgacggtggggttcttcagccgggggcttctctacggcgaccgcttcaagttccgctccatatcggggctctggggcttgatggcgggctacgacttcgccaatccgaacacgctgcgcgtttccacggtcagcctcggcatcggcggcgtggcgcaggttcccctcacgtcgcagctcaccctggacgtcaccgcgaacatggccggtgtgccgtttggccatggcggcggtctcacctcgccggagtccgctcgtgactaccacttcgggcctggggcgcagtcggccttcgagctgggcttggtgcggcggggtgtcgggcgcgtcggcgtgtccgtgcgcaactatctcatctcgggcgccttcctcggtgagggcgtggagctcatcacctatgccaccgcgcgagccgagctcctgctcgccggccaacacggcgtggcgctcgaagccttcgtcgccaaccgcgcgggtgagttcggcagcgattccgacgccatccgccagcgtgcaacgcaaatccgtctgctgtggacggtctcgaagggcacgggcttcggaacgcgctgaggatccgcgggagcgaaatccagcccgagcgcaggtggagtgcccatcaggtctgctcctcggtgacgcgggcggctgtactcgcagcgagccgacagcccttggcccgctcctgttcctgccagagcgctgcgtagacgccgcgcttcgctagcaattcgacgtgcgtgcctgactccgcgacgcgccccttgtcgagcacgatgatgcggtgcgcccgccgcacggtgcgcagccgatgtgcgatcacgacgacggtcttcttcctgaccagttcgtcgatggcgcgctggatttcagcctccgccgacgcgtcgacggaggcagtggcctcgtcgagaagcacaatgggggcgtccttgaggatggcacgggcgatggacaagcgctgacgctcaccccccgagagggttcctcctccttccccaagcagggtgtcgtagccgttcggcaaggcggtgatgaagtcgtgggcgcgcgctgcccgcgctgcccgctggacttcctcgagcgaggcgtcgggccgtccaacgcgcaggttgtcgaggatggtcccggagaagaggacgacgtcctggaacaccatcgcgaggtgctggtgcagttcctcgaacggaatgtcccggatatcgacaccgccgatgcggatggcaccctggcgcggaatgtcccacagccgcgccacgaggtggaccagcgtcgacttgcctgagcccgaggcaccgacgagcgcggtcagcgagcgctcggggaacgtcaccgagacgccgtcgagcacggtcgcgtcttcgtacgcgaaggacactgtgtcgacctccacgtcgaacttctggatcgacgccgctcttacggacggttccgggagcggcttctccgcgagtagccgatcaacgcgaccgagcgcgcgctgagacgctcgaagcatgagcagagccactccgagatccgcgacctggcgaacgaccccaaccgtcacgatgaggaagacgagcagcaccccgggctgaatcgaaccgcgcaacgccagggtgcttcctgcgtacgccaccgcgacaaagctcatctcgacgacgaagccgaacacggcgagcagcggggagggcaagacatcggcgcgaatgagggcgtcgcgcaggcgctccattgctttcacgaagcgctggtagacctcgccgtgccggccgaacgcccgaagcacggcgatgccctgcacgtattcgacgacgcgggcgttgacatccgccgaggcctcgagcacggcttcgaactcacgcacgaagaggggcgtggtcgcggccagcacgaggagcgccaccggtagggcggcgaggatgacgagccccaggcgccaatcgaggaaacagaggccgagaccgacgagcatcggcagtgcgaagctcgccgtgaagatgccgatggtgtgcgaccacacgtcttcgacaagcgcgacatcggtggtgagcacgcctgccagttcaccgctccttcgctgcgtgaagaaccccatgggcaggcgccgcaggtggtcggcggtgcggatgcgcgcttgccccatgagcgcgtgcgcggcgacgaagatgttggacatcgctctgatcgagaacgccaggcgcagcagcaccgagagcgcgatgccgccggtgagccaccacgtcaggtgcatcgagagccggtgctcgagcgcttcacgaacgaagaagaggaccagtgtgtagggcgcggcgcccgcgagtgcctcggcaaaggcgaagagaaggccgcgccggacccgtgcgtcctttcggcccgcgagccgctcgccgagcatgaagagttccctgagcatcacaccacctccttctgaacgtcaggagtgcccggatcgcccagtgaccagtcgagcgcttcggtgtggctgcgccagagttgctggtacaacgcgcagcgcgcgagcaattcgtcgtgcgtcccctggtcattcacgcgcccgccgtcgaggacgacgatgtggtccgcggtggcgatggtcgaaagccggtgcgcgacgacgagcaccgtccgccccgcgcatagcgcggacagcgcttcttggatgcgcgcctcgttctcggggtcggcgaaagccgtcgcctcgtcgagcagcagcaccggggcgtccttgaggagcgcccgcgcgatggacaggcgttgcttctcgcccccggagaggcgggcgccgcgctcaccgagcagcgtgtcgtacttcccgggaagcgcctggatgaagtcgtacgcacgcgcggcgcgacacgcggcatcgacttgcgcatcggtggcatcgggccgagcgagacgcaggttctcgcgaacggtgccgtggaagaggaagacgtcctggaacaccatcgagaggtgggagagcagctggtcgagcgggagcgcgcgcacgtcgacgccaccgagttccaccgcgccgttcgtcgcctcccagagccgaggcacgagcctcacgagcgtcgtcttgcctgcgcccgaaggtccgaccagtgccgtgaccttgcccgcgggcgcttcgaaggagacgtcgcggagaacctccggaccgccgtcctcgtaacggaaactgacgccacggaacgcgacgccatcgtgcgagggccgcgcggcgctcgtgggagtctcgaggtcgggcgccgcgaggatggcctggatgcgcgcgttgcccgcttggatgcggtcagcgttgccccacgcgaacatcagccgcatcatcgacatgaggagctgtggcccgagtacgaggaagagcacgagcgactcgagcgaaagcgtgccgcgcgtgtagagccaaccccccatggggacgaggacgacgaggctcgagccgatgagcgcgccgaacgcaccgtagccacggccgttggtgcgcatgaaaccctccatccacgagagcccttcctcgatggagcttgagaggtcgctgaagcgccgcgcggacaggccgaaggtcttgatgacgtggatgccccgcaggtattcgagcagcgagcggttcatccggctctggagcgcgttccactgttgatgggccttgccgacctcgcgcatggcgacggccatcgccatgacggcgagcggcgccatcacgaggctggcaagggccatgcgccagtcaatccacaggagggagatggccgtcgcgagcgggacgacgagcgcggtgaccgcatccgggaagtgatgagcgacgaacgcctcgagctggttcacgtcgtccatcagtgtcttcttcagttctcccgcgccacgacggctgaaaaacgaaagtggaacggcgccgagcttcttcgcgagccgcacgcgcaggtcatggaggatgcggaacgcggcgacgtgcgccagcatgttcgcggcggcgacgaggatgtaacgcaacgcgagcgcacccgcggcgaggagggcgagcgctcgaaccgcgtcgaggtccggcggcgtcgcgtaaatcgaggtcgccatgcgtgcgacgacgaagaacggcaccaatgcgagggccgccgccaacgtcgacgcgagcgcggccccagcgacgagcggcccctgcggtccgagaagtgcaccaaggccccggagagggcgttcctgggcccgcgtggcgggggagtcggcgctcatgctcgcctccctttgtgggggcccctgcggctggggtgcgaccgttccgtccatgccgggcctgccggcacgcgctgtgggaggcgttcactcggttccatgacgcctaggaaacgccgggacagctgccgcggattggatctttttacccggagaccgccacgtggtcggtgccctcgacccgcgttgccaggtactcgcgggggcttgagccggcgagcgaccggaactcgcgaaggaagtgggcctggtcgaagtacccgtgctcggcggccaccgcggcgccacgcaaggcgccctgttcgacgtcgaggagcgccgctcgaaaccgtcgaacgcgccagtacgtcttcggactcaagccgacttcctcgcggaacagggccaacaggcgcttgggagagagccccgtgcggcgattgacttcagcgaccgacgtgaggtcgggttcctcgaacgcggccagcgccgcacgaagcgcgggcgctggttcgacgggccggcgcagtcggtgcaggaggtgttcttccagcagcaggaatcgctcgcgcggcgaggatgcctccattatccgttcgcgcagtgagtgcgccgacgcgccccatatcgcatccagcgaaatggcttgttccgcgaattcgttgcagggcacgtcgaagaagacgcgcgcgccgccgggcttgaagtggataccggcggtcgggccagccacggccgcgatggtcagcgggctgcttctcgcgccggtgacgatcgcgccccggatttcagcggcctcgtctgtctggtcactggagtagacgcgcagtgggagggcgccgagagggacgataagggactgcgagcccgacggcagcacacgttctcgtggcgcccgtgcgacgtagccggcggacacccagaagaagtccacgaacttgtcgagaggtgcgtggggccgatagatcgtgtgcatcatggcgcgtgctgtgagcgaatcatgcgagttgttcgcatgattctcaaggcccaagtccagtgaccatgacagagatttctgactacggccccgtgccgatgtcccccgtgtcgacgcacatccaggggcattccgcgagacaggctgcaaaggcctgttggtgcgtatggattccgacggcgcaggtcgccggccaggcgtagggatactggtgcccgcgatagccacactcgaaataagcatacacgcaggattgctcgaggccctcggctgccacgtccgtgcccggcgcatcctgcgtctggccaccacagcccaccatggacacgagaccggccacgaagcccactgcgatgtgtcccatcttcatttgtgcctccttggagagggggaaaggatgactgaattggtggctttcagtctattctggatgagggcgccccggggcctgctggcgcgaacgcggcgactgtccaggccctccagcgcatcgcttggaacttcgtgagcgcctattacgcgcagcctgacgcgggtgagcggacgatgacggactgccgcacccgaattcctcgggacgtctgtcctggcttctgggaactgttggggcgcccggagaacgtcgcgggttgccagcgttacttcggtaacgcggccctgggttcaggtgggaaccccttcgtctggcccgacccgaactggcagccgctgcctcctccgtagtcatgggcttccaggcgcaggagggaatccatccccctgcgccggagtctcaagagcgcctggacgggtcctgcccgtcggatgaacgtgcgagcttcgggtgtccatctggcgggacttgccgtgaggggagcgcagtcgtggcatctggctcatcgcgtgcgagcacctgtgcgatgagcgccgcccgcgactggactccgaagcggcggtagagggttttcgtgtactgattcacggtgaaacgactgatgccgagccgagccgcgatctgcttgtctccgagtccctgaagcagcaactccaacgtttgtcgttcgcgaggcgccagccagcctgacggcgttcccaccttcgaggaccctggtgggtcgaacatggctccgcactcggcgtggaacagatgcagcagctctcggtccgcggcgtcgaaggggcggccgccccgctcacggtagattccgataccccgcaccacccccgggagcccggaccactggcttgaatacaccgagtcatcgagccccgtggggcgcagatgatgctcgacataaggggcgccataccagctccagtcctccaccagttcccggcgcatcgcggtgacgatggtgccgggctccgagccgcgctccatcaatgagcgtatggcggggttgcaggcacttcccatcctccggagcgcctcgagcgcggacaccgcgctcccgctccacccttccaggacgatctccgtgaatccgtcatgtcctcccggtctgaagtcgcgctccaagacgcatgctccggcctctgcgcccagaatgcgacacagcccgacgaggagatgccgggaccgtgtcgccactcgcgctggcagctcatgtgcctcgttgatgagtctcacgagcgcatgaacctgtgggcttcgaagggtgccgccgctcatgggacctcccggttcgcgccggaccgatcatctccctaattttagtgaattacaataaatgcatgttcaggtcagggtttgcgcggcatttcgcggcacatcgtttgggaaccggagtcaaggaggatacatcatgaagagcaagtgcacgattcggctggggattctgctgatggccggcctggtgtcagcagggtgcggtgacggactcggggaggcccaagcgccaatcgatctcagcccgtcctcgctgaatgcagcgcgactgtcgttccagcacatcgaccgactctatgagtccgatccggcggccgcgatggaggcctcgcggcgactgcggccgaagctcgatgagctcaatcagctgcttgctcgtgtcgaggtgtcgcgggagcacttcatcgaattctacgatttgcagcccggcggcatcctcgtcgtggagcgtggccccgtagcggatggacgtgtcttgcgtgacggtgatgttgccaggcactccgccgtcgaactctatcgccagttgacgcaaggcgccacgccgcccacggcgttggtcagcgccgaatcgcgccgtgctgtccctgatgatgcccaagtcatcgtgcgggatgaagcggctccccatctggagtcatcagggggattcgcaccggaccttggggagcaggggagagacggcttctcgtccgtgactcaacccctgacgagcgcggacggccccttctggagagacagcgtctgctacaagggcggggacttcttcgactgctggtccaatgtgaccggcaacggttgggcggccgcggatgccaagacatccttcacccaactcgcgccctatcgggggactgtcgggctttgggtgtcctacgagtcttctgtgaaagctgcctggaacgttgccgccggagaatggttttcgttccaccaatacagcggaacctactggacgtgtcctccactcgttgcctgcggcagcaccgattactacatccgcaatcatcgatgggacgtcacggacgcggtcggcgacggatatcacttcacttatgcgttcaggcggaactgcagcggcggcttgtgtacgtacagcccctgatgtccgcgtagatggggcccgtcaatgcctgcttggagcaggcacaggcacgaagccgaccctcgtggtgtcgagggccggcttcgttaccgaccgttcagcgaacttcgaactcgtagattcgcgtcgctgggtcgctgttctgagtcggcgtcgtcacgttgagccggatgtaacgcgccggcgtcgccgtgattgcatgggtcgaagtgctgccagtgttgttgctcaccgtgacgggcgtgctccaagtggagccgttgctcgacgtctggatggtgaatgccctgctgttccaggccgtcgattcaccgcccgcccccgcgtgctggagcgtgaagctgctgactgtctgcgccgtaccgaggtcgacctgtatccacgccggcgaggtcagtgagcagaacttgtcggtggtgccgcccgagacgctgccgttgaccgccttggcggccgattcggtgctgttgcagggggctgaactggtggtgggcctgttcaacgccagattggcgtagcccgaaccgacggacaccgcctgggacttcgtatgactggcgccgccattgtcggtgacggtcagggtgacgttgtagttgccggcgcttgcataggtgcgtgaagggttggtcgcggtggaggtgctgccgtcgccgaaattccaactgcgcgaggcgatggttccgtccgcgtcggtggacgcatcactgaaggtcgcggtgaggccgctgacggtgacaccgaagttcgccaccggcggggtgttgccgctgacggcggtgttgattgccgccgcatactgcgcgctcgtcccctgcgcgctgcactgctggatgtcgtcgtacaaccacatgaagccgccgctgatgccggcgctggtcttccagttgctcatccgggtctgcaccgtggccgggctgtcgcccgacgcgcagccgctgccattcctggaccacaagccgggggcgacagtcatgcccatggcggtgttccaactcgctgggttgttgccggcgccgccggcgtacacttgcaggtagattctatcgacggcgctgccgaggttgttcctgaggttccgccagaacgtctgctgcgtgtacggtgcgaaggtgatcttgtaacccatcccgatgagcatctggctgaaggtcgtggttggggccaggtcataggcgctttcgtcgtcgaagttcacggcgtcggcgccggtggcggccttcagcgcctggaagttcctgtacaggatgctgttgcttccggtcccgcagacgatggtggtgccgcagccgggcgcggtgccgttgaccagtcgaatcatgcgttcgaagtccggaacaccccaggcaccgatcgacacctcgatgcgattgaccgaggtcggcgcggtcttcagtgtggccagtcgggtcggccaggcagggtcgcccatgtaggcgccgttcttgaccactggaatgtcgttgtagatcaggtcaccgttctcctcgatgtggaagctccacaggatgaccgtggtgaaacccgagccgcgcaggtcgttcatcaccgcggtcccgccggaatagaacgggccgccgccgtagatcgccgagtacgcgctggcatccggcgcggcgacagccagggcgagcgcggcgagtgttggtaacaggctgcggcgagaaagggtcggcgcggactgattcgatttcgacatgaaatgctccttggcattgcgcgtcgtggacgatgcgatggccggcgatccgcgtctgttcgcgatccattgcgctcgttcatgcccagacgcactccgggtcgccaatgacagcgacgggccgagattgcgagtggcgactccagtctgtcaatctttggggcgattcaagtcaggcaagaacgtttgatcgcgaatgtctgcccggaacgtgaacccgttgggtggaccggtcgattccgctgcagcccttccgattggggcagctgctatcgcaaaggcgtgaaggggaagtagctcaagatgtgagttgtgtgtgtcgccatctggcggcgcataccgggacgcgcacccaagatgtcgacgtgatgtgtgccgagcctcgtttgggcgaggcacaggaccgtgcgccgccggttgagtgatggcgtgtgtgcgttgaacgtgaggcgagcagtctcagatgggactcacccccagcgcgctgttggagggctcgtgcgcggggtgatcgacgacgccctctccgcatacgcccgaccggcccttgtccaccgtgtaccggcgtgcacaggtgtgctgtgaccgcgccacccattgcacgcccggggcttctaggaagggcgcaacggcgctggcattctcggtgcattgccgacgacactcgtgagaccgggggcatgtcgccgcggactctcgaaagggttggccatggctgcagtgactgtgattctcgttgtcctcctgttcgtgggggctttcgtggggggactcatcctcatgctccagaagcaccagccccgggtcatgagggtcctcggaggcatcatggcactcggcaccgctgtgacggtgggaggtctggcttggctcgtccacctgatcagctccaccaacttttcgaaggggagggtccttcgcttgcgtggacgaacgcgcgtagctcgcccgnnggcgctgggggcgggccttggggcccgggnattgaaacccggcccccgtcggagttcgggctacccctgcacgaacggtgctcggggaggtatggatgtactcagcgggcctggagcatgcgtccgttcccgccttctcgaagttgtcgctcaagctctccgcgttgggggcgccctcggagctcctggaggactgtcacctggcggcgctggatgagattcgtcatgccaggcggtgcttcgcgctcgccagcgcctactcgggggtaggctggacggcgggaacgattccggagcttggacagggaagtacgcagcctgccccgatggattcgggagatacctgggcccggctggtgcgcggttcgctactggatggatgtctggccgaggggatggcctccctggtcgcgggcgaaggcgcgaggcgggcctcagaccctgtcgtgcgggagaccttgtcggtcatctccgaggatgaggggcggcacgcggacctggcctgggacgtcatcgctttcgccctgaagcggggcggccggaatgcgaaggacgcgttgcgccaggccctcttggcgctggagtcgcagcagacgcccgcgctccctcgcatcccaggcgtcgacgaggacttcctcgcgcgaaacggcgtcctgcctcaggtggaactggggcgactgatggcggtgtgcatcgagcggacgcgcgcccgggcggaggcgctgctggcgccgtcgaacctctcgatgcggcaccgccccagtgacttccagggggcgcccgcttcgtcttcgcgggacgcggtgcccatggaggccgcgccgcgctactgaccggtgtgcggcgtgggaggtggtgcccctctcaccttcaactggccagttcctgggattgaactggggggctcttgggctcaccgaaggacatcagccgacggtgtagcggcgtgagcagtccgaggaggatcaccagcacgccggtgacctgcaggagccgctcgatggagaccacttctgccaggggcccgaagaacagcatggacatcggcatcagcgcggtggagagcatggtcatcacgctgaagactcggcccaggtaggccggctccacgcgctcctggagcatcaccatggcgggcgtgttgtagagcggtagcgccacgccgaagatccccatggccgccaggtacaccccgaagtgaggcaccacgccgagggccacggtgcacgcacccatgatgaggttggatgtgaccatcgtccgcatgcggctgctgaagccgccccacgccgcgagcgcggcgccccccaacatcatgcccaccgagaagaccatttcgatggccgtcaacctccacacctcttccccgaagcttcgcgccgtctgcagcggcgtgaggaatgcggccggagtgatgaggaccatgatgaatcccaggtagccgaagaacggcaccaggtgcgcgtggccgcggatgtagcggaagccgtcttggatctccgtcagctgcgaggccccctcctgctccggcgcgcggggacgcggcttgacctggacgaagagcgtcaccagggcgatggccagggccgctgtcaccacgtcgatgtagaagagcacctgcaggggggccacggacatgaggaagccggcgagcgcgggcgcccccaacatgttgaccgagtggagggtgccctggatgctgttgacccgcatcaactggtcttcgggcaccaactgcggcagcagcgcgcccaccgccggctgttgaacggccgtccccacggagcggatcgccgcggccaggaagaagagccacagctccgtgccgcgcaaggtgaacaccacggccagcgccagggtcaccagcgcaatcatcgcatcggcgaggacgatgagcttgcggcggtcgtaccggtccgcccagacgcccgcgaaaggcgagaggatgaacgtgggcaggaagccggccacgatgtagagcgtcatcatgacgctcgagcgtgtctgcagcgtcacctgccacaggagcgcgtactgcaccagggaggagccgagtaaagagagggcctggctgcccaggaaaagggctgtgttgcgcttccaggaagcgtgcatggcgcgcactgtaaccgctggccgggtatcaacaaccgcaccggtctggatgactccatactggacgtatccttctcttcggctgcgagtgaagttcgctcaatcgccagacacctcaggaaagacttcccaggcgcggagggaagtgggccctcctggattcgaaccagggacccatcggtcatgagccggggtggggcgggttggcaggggctcgcaggccctgtcattggctcgcaacctgcggaaaagactggtactgcgcaggggacggggggcggtctggatgagggatgtggcggcacggcgcgcgctgccttcgagcggagtgcagcaggtagccgtggacggcaggagtctacgggggcacctacgacgggcgcgtcgagcgtgccgatgtgccttgttcacacctatctggtcgagggactcgacagcctcctggtggggctggcgcccgcgccaggtggtgcctcgagtgaggcagcgggcagcgtccttgtgcgattcacgcacggacagcggggaggaagcaggccatggccggcaagagcaacggcgtggctgggccttcgacgtgaagcacttcccctgcgtgcagcactccacaagggcccaggcgctcagaacctcgccgtggtacgccgagccgctctcgccgtcctgaaggctgacacctcgttcaaggcaagtctgccgtcggcggggatgggaattggctgacgcagtattgccagggctcgacttcgacctgggccagggttccgtagggcgctcgcctgattcgccgcgaagccgcccttgggtcgtccgggcggcttcgcgtcattcctggagcgggtgcatcaggctccgggcagcacgagaattcgcacgagcccggagttgtcgttgacaggcgagtccgcgaagcgcacctgcaggggcgcgtcctctcccgtcaggtcgtaggtgtacttgtgctcggccgcgttgaagtccgccgtggaggccgggtgcttccaggtctttcctccgtcgaggctgacctggacggcgctcatcctgaggggagcggccgccgggggcttcacgcccgcgaaggcgaactcaggatcgaagccgacgttgcgattggtgacgcccgggctcgggaacatcggcgcgggctcgggctggcctgactgcgggcccgggacgatgttgttcccccacacgttgaaggtgccctgcatcgtgacacggtagggcttgcccttctggagcacctgcttgctgggaacgggggcggcgctccgggtgttcagccacagctcctcggcgggcaccacgacaatcttcaagcgcccggagttgtcggtgacgggcttgtcggcgatgcgcacctgtagcgcggactccccgcccgtcacctcatagccatacttgtgctcggccgcgttgaagtccgccgtggaggccggatgcgcccaggtctttcctccgtcgaggctgagctggatgaagctcgccctgagcggagcgaccgccgggggcttcacgcccgcgaagacgaactcagggtcgaagccgacgttgcggttggtgacgcccgggcttgggaacatcggcgcgggctcgggctggcctgactgtgggcccgggacgatgttgttcccccacacgttgaaggtgccctgcatcgtgacgagatgcggccatccctgcttcagcaccatctggctcatcacaggagcggcgctccgggtgtcgagccagacctcttcctgctgctgcgcccacgcgggggcggcggccaacacccacaacccagcacaacgcgcggtcaattgcgaaagacctctcatgctcactctctccattgtctcgaacggggactgcggatgcttgggggcttctccgcgagtcgtgggagtgcaagtgagggaccaggaggagagagtcttcactgctcagggcgtctgctctggaatcggatggaatggggctcgaggcgctgtcaccagcgcgggcctgacacgtcaggaggcatgggctggcacgggggttgacgcgtcagagagggctttgggcccgtaggcaggccagggcatcaacccgttttcggggtgacttggtaacgagcaggtacggaggggaatgccggccaggtccaagccctgaccgtccgtctgccgccgtcttcgcgcctgtgtccgttctcactccgtccgtcgtgacgtgatgctcttggaggccattcgtgtcgcatggacccttgcttcgtcgtgtctttgttccttcgatgagtaccgtccccatgggggcgctggtggcgtgcggcgctcccgaggaggcgtcaccctccacggagcccgtgggccaggggctcccccaagcaggaggtgaggaggggagggggccccaggcagcggccaggaaggagccgatgagtgagaggacggcgcgtgtgggcgtcagcgggcggctggggttctccagcctcccccacgaggcgctggccccggacatggtcaaagcggtaaaggtgctcagaggcacatccggggccgcgaggtgactacttcgcttcgaggttcagttcgaggtcgaacgccacgtcgctcgactccgcgttggcctgcttcaccatcaccgcgatgatgttctcccccacgacgaaggcagagccgtcgaacctggccgtgctgatgacggcgtccttcaacacgcggctggcgaaggtgccatggccgagaccgttgtcggcgtaccgcgagtagacgagcttcccgttcacccagatggccacgccgtcgtcatgcagcacgcggagcttggcggtgcggatggcctcgccgagcgtgagcttcttgcggaagtagacgctcggctggaggggtgtcgtcttgttgagcacggtgtgctcgtccccgtccccatagccgagcttcgcggggcccgagcgccatgcgtcgtcgtcgaagttgaccgacgtccactgcatgtccgggttcacgttgctgtcatcgaacttccagtactcgccgaaggcgatggcctggaattggggcgtccgggagatggtgaagggcaggtccgtgcggtcgtcgatgtccggacgcgaggcgtccgagattcgcagcacgcccttggacgtcacggtgttcggcaccgtccactcatagaagtcgatgttggggacaccctggtcgaccagggtccagttggccccgtcgtcgggcgagaactccacccggacgttgtcgacgcccgcgccgtgggtcatccactggagcatctggacgttgcccgggcgcagcgtctcgccgccgttggggctctccatgaagagggcatcgtgctgcatgccgtcggtggtcaccttcagctcaaggtcgaaggacaggtcactggaggtggcgttcgcctgcttcaccatgacggccagcgtgttctcccccatcacgaagcgggcgccggagacggtcgtttggctcaaggtgttgtcggaagctgtgccggaggcataggccgagtgcgcggtagagccgacatacttggagaacacctgggtgccattgaggaacaccgccacgccatcgtcgtgaatcacctggagcgtggcctgctccaccatgccgtggacggtgaacttgcggcggaagtagacggtgggctgcgccggcgtcgtcttcttcagcaccgtcgcctcgtccgtctcgccatagccgagctgggccgggcccttcttccaggacgcgtcgctgaagcccgaagacgtccaggcggagcccgggtcgacgttgcggtcgtcgtacttccactcggagccgaaggccaccgcggtgaagccggggttgggaggagggtccgtcgggggcggcgtcgtgcctcctccgccgatgcggatgatcttcgcgaccgacggcaccttcttcgcgttgagcaggaacagcatgtagtggccaggcggcgccacgttcgggttgggcggcgcgacgacgttgagccccccgccgctggcggtgaagcgcagcttcatgaatcgctggttctcgtcgaaggcgtgggtgacggagcccaggcgaacccaggacgccatggtgatgctggccgcctcgggggtgttgacgcggaaggtctctccataggcgatggacgcgggcgcggaggtgatggtggggcgcgggccattgaagagatacggcggggagaagacctgcatcgtcttgacgtagcggctgcccgcggacagcacgcgtccgtccggcaacagcacggtggtggagtgatagccgcgataggccgacgcgggcgccagcaccgaccactgctcggtgacggggttccacagctccgtctccaggcgggggaagttggggttgtcggtgccggggccgctgtggccgccggtgacgagcaccgtgccgtccgggagcacggtgctgttgtgctggcggcgcacgtagcgcatgggccgcacggtgcgccaggcgggcttcgcggcgttgaggtcgagaacctccacgttgttggtggggggattgtcgccaccggtgatcagcaccttgccgtcgtcatacatcaccgcgctgcccgcgttgcggctgcgggcgtagttggtgcgaggcccggaggtccaggcgccggtgccattcgtgtcgaggtaccgcgcgggcttccagtaccccgccatgagcgtctttcccgtgctcgtcacgaacatccacgggtagtacatgagctccaagctcgcacccgtcaggttgcgccaggagttcttcgacgtctgccagacttggggaatcaggttcttggtcgtgtcttccttggcgccgccaatcaccagcatgtccccattggggagcgtggtgacggtggggtaccagcggccggcgttcatgttcggcagccgcgtccaggtgagcttgaaggggtcgaagatggcggcgtagggcaggccagagtcattcgtgatgtggccaccggccacgagcagccggccatccggcatgaaggcatggcccgcgcagaagatgttgaagcccgccttgggcagcgtggtgaggacgttggtctgcgggtcccagagcgtgggggtgtcgccgtccccgaactcggagaagaacatcactttcccggtggggagcacgtgggtgtggaccgcggagtacggccacttctggacgggggtccattgtcccacggaggctggttgtgcctgggcgatcgataacgaggcccaggcagcgagaaaggcaagacgccacggatggaacatcaggctgcccctttgttggttgaaaggtcgcgcaacggtaggcgcacggcccttgcgagccacatcgttccggcgtgcgtggacaatgacgcggggtggaccgaaccccagcgccttcgtcggggcccggaccgtccgtgaggcacgcgtgtcggatttcccagcggactcgaatcggtggctgctgtcgtgagtcgtggtagacgctctgccagtcgggcaggtcgtgaggaagggagcgccactgcgggcagcgccccaacatccgcagcgacccgaatggctacaccgctgactcgctgggcaccttccccaagacgtgccccgtgaagcacgacacccggcgtgcctgagcacccaatggagccggggccgggcgcgtcctgtccccccggcctccgctccaagcagaggccggggcttcacgcccgtgggcaccacggccggctccgggccgccgcgtcaggcaggctcgaacgcgagctggcagcaacccgtgagcgctccctcctccacctggagcgtgatgtgctcgatgccgaactcgtcatggagccgccgcttcacgtcgtcgaggaaggcgtcgtccagccgcggctcccgcatgacgaggtgcgcggtgagcgcggcctcggtggtgctcatggcccagacgtgcaggtcatggacctcggacacccctggagtctgaacgagccgctcgcgcacctgacgcacgtcgatgtgtcccggcaccgcctggagcgcgaggttgacggagtccttgagcagcccccacgtccccacgaagatgaggcccgcgatgaccagcgtcaccaccgggtccagccacgcccaacccgtgtagtagatgaggagacccgccaggacgacgcccagcgacacggccgcgtcagcggccaggtggaggaaggcgcctcggatgttgaggtcgcgctcgcggcccttccagaagagcagcgccgtggccgcgttgacaacgatgcccatgcccgccaccgacatgatggtgaagctggacacggtggcgggctgccccagccgccgcaccgcctcccagcccatgccccccaccgcgaccagcagcaacagggcgttgagcagcgcggccaggatggtggcgctccggaagccgtaggtatggcgctccgtcgccttgcgccggcccaggacgctggccccccaggcgaggacgagccccagcacgtcactcaggttgtgccccgcatccgccagcagggcgagcgagccggacaggatgccatacgtggcttcgacgccgacgaaggccaggttgagaccgatgccgagcatgaaggcccggctgtgcgaatcgggcgcggcgtgcgcgtgcccgtgtccgtgagagtgcgagtgggagtgcgagtgggagtgcgagtgtcccgccatggagaacggctccttcgttccagttctccctcctgacgacgcgcctgggccccggttacagtccgcccgcctcctcgcaggggcagtccacgcagcccttgcggcagcaagtggttccgcacgcctgctccagcctccggcccagcgcctgccgggcccggtggaggcgcaccttcgcgttggtgtgggtgatgccggctgcctccgcgaactccgccagggtctgcccgtccaggtccacccgctggagcgcgtcggagtactccggcttcagggtggtggtgagcgtggagacacaggcgcagacggtccgctccagttccgccgcgtcctcggtggacagggggctctcctcggcgaaggcccgcagggcgcgcccctggcgctgctcgtgccggtagcggtcgatgagcgcgttgcgaagcaggcggtagaaccaggccaccgcccgctcctcctcacgcagggtgctcccgcgttccacgctcttgagcagcgcggcctggagcacctcctccgccgcctcgacgctcccgacgtgtggggtcaggaaggcgaggaagcgctggcggttctggagcaggagcgcgaggacctccggggacatggccccagcctcgcacatcgcggtgcatcagcgggcgtggacttcctgcgtgggacaggccacggtggcgggcatggcccacagcgcgttgcctcgcgtgtcagagcgggcccggaagaagagggtgctgcccacccgggtgaaggactgtgggttggagccccccaacggagagaggtccgcgaccagccccgtccgtccgggcgtgccgtccgtcacccagggctccaaccccgtctcgccgccgtccgcgctgaagagcagcgtcccggcaccggtgtcgaagagcggcgagtagttctcgtcgccggtgaagagcccccggctgagctcccgtgtccccgcttccgtgccatccgtcacccagaggcccacttcgcgcggcgcgggccccgaggtgccaatggccatggacacgtagagcttcccgcccgcgaccgccgagtactcgacgtagggccgcgcgtcgggctggcccgcgtagcggttgggcagccacgtcgccgtcgccttgccaccgcccgcgagcgacaggcgggagagcttcaacgcggagccgcccgcggtgccagaggccacgtagacatacccacccagcgcgcccagcaacctcacgtagccgccgaaggagtccaggcgcaccgtgccgcccggcgtgccatccgtccgccacacctccgtgatggggccttcatcgtagaaggaaaacacgctcaggcccgtcgcagtgacggccgtgccctgcgtccagaccagatctgcgtccagccgcttgacgaccgtggtccccgccgccgtgccatccgtccgccacaggtaggtgccattcgccgcgtcgtgcagggtgaacagcagcgctcccgcgaccgggggcacccccgactcaaacgagtcctgcgcgccgaaggtcaccaagcggaacgttcccacctcagtcccgtccgagcgccacagctccagcggccccctcgaggccggtcggcggaagaaggtcagcacatcccccaccgaagcgaagagcatcaggtcgtcactggcggggcctggcgcgaagtcccgcacgagccgcgtgcccgcctcagtgccatcgctgacccacagttcccgtccgaccacggggtccttcaccagaaagaagacgcgagtccccaccgcgacgagcggcgagaagtcgcggtaggtccccgcaatcacggggaactccttcacaggcacggtgcccacggaggtgccgtcactgcgccacaggacgccggggccgtcgaagaggtcgaccacgaagaagagcgtgccctccgcgttcgtcagccagtcggggaccggcaaggcgttggaaggcaccggcacacccggcggcaggacgtccttcaccttgtagacggcgcccggcggcgcgcaggccagggcctgcactggcacctccgaggtctccttcaccgcatccactgccgccgcatccacggactcaccgcaccccagacccgccaaccccaggccagccaggacccaccagaacccgacgcgcatgtgcacactccctcgcctgcccgaaacccggtgacggtgagacccccggtggcggacgccaactgccctggagggcagccccccggaggaaatccgacgcttcggcgcccaccgctggggtgacacctcccgcgcgacacctgggcctggaggacacctcggaacaccggatggggccgccctggcgcgccacacctggtgcgtgcttcagcgcgaggaaggggtgattcatcatctcgggcttccccatccgaaaggagccttgcatgaatgcctcccgcctcgccgcttcatgggccgccgcgctttccctctcgctcatcgcctgcggaggcggagacgcctccctggacgtccccgagggtgaggctcccgccaccgtcgagcagggcctgggcgttccgccgcaatgcccgaacggagacctcatctactgggtcgagaacgtgcaggcctgtacgatgaagtgcggtaccacgcgcaagcccgggaagccttcgacccagtacgccgcctgtcagtccaacatgacgggcacgcgcacgctcatcaacgtccagtactgcctccctggctgcgaaatcgtcatcgactaggtctcccaccgggaaggcacgcgtcagactctcgccatgaaatgcccgctctgacgccacctggcgcgggagaagggcctctcctctcccgggcgccggcgtccttcacctcgcggcccgatccttcggcgcggcgagacgacggcgagcggtccggttcgaggcgccggaccgcatcgacgggcgtcgtcggtgtgctcgctacttcgagcagaccgtcaccttgaactcatcttcgatccccgaggagtaggagagcggggcataggcccctccacccttgtaggtccccgagaagcccacgtcgtcgtagagccggcagaacccgccgtcgctcgcgacgcgcacgagcgccgcgccacgggtcgactgcgcgagcgggatgccgaggtcgttcttctcgaccatcgtcgtgccggaggtgcggagcttcaccagcgtgccgccgaaggacttgacctgcccggagaccgagccgttgagcttcgcgtcgttcgtcgaccagaccttggggaagcgatcaacccggaccgcggcggccagtacctccttgaacttcttcgcctggacctcgagcggcttgaagtgatcggcgccgatggtcacgctcgccgaggcagtgagctcggcgaactcgctggcgacctgcttggcgtgcgcggcgggattcttgaagcgcgcgagccagacgttggagaacgcgccatcctgctcgagcgcggtgagcgcctcctggtcgac

SEQ ID NO: 1243 - DNA, 30780 bp, Myxococcus xanthus
  unsure (1)..(30780): unsure at all n locations
cgctcgatttccatgggcctgttcgcgtactccacccacgtccaatggctgccgtggttgttcgcgtcacgggtgctcgcgggagccaccgcgggaaacctggcggcgtgtcaggcggcggtggcggacgtcacggacgagagtgggcgggcagcgggcatggggctcgtcggcgcgggcattggcctgggcatggtgctggggcccgtcattggcagcctcctccatgtgcatggcgcctgggcgccaccgctggcgggcgcggtgatggcggcggcggcgatgctcggcgtgctcttcttctttccggagacacaccgcccgcaggcggagcggcaccaggagccaggccgtccccgggtgcggctgtccgacgtcctggcccggcccgggctgggcgcggtgctggctttgacgttcctggtgttcatcgggatgacgaacctccaggtgtcgctggggctgctggcccaggcgcgcttcggctggggcgaacaggagatcgggcggctcttcgcgttgatgggcctggtcaccttcgtgcttcaggccttcgtcatcggctggctgacgagccgggtccgggacacgacattggtgctggtgggcgccgcgtgcatgggggccgggctcacgtgcatcgccgctgcgggccacggtgccatgttggtgctggccatggtgctggtgggctcggggacgggcctgttgcagccgctgatggccagcctggcctccgggttcgcggggcgcgagctgcgtggcggggtgctgggcgtggtgcagtcggcgggcgggctcgcgcgcgtggtggggccggtgtggagcggcttcctctactcacggctggggcctggtgcgcccttcaccagtggggcggtggcggcgggcgtcgcgctgttggtgggggcttcgctcatgnggnggtgcgttcagnacgcgccgccgcagtcgaccttgaaagtctgagcgcggggccgcttacagacagtactgcgcgaacgtcgggctgctgcacaggctctggaaggccgccaggttgcaggtgtcggcgccgggaccgacgttgcacggattgccatgcgggctgccgtagtcgctgcagatgaactcgacgcgttcgccgaacaggtaggtgacggccacggtgttgttcgcgtattggccgttgacgacgcagcggtccaggtcgcccgagtggtccacggtgtagacgccgtgggacaggacgcgagggcactccaccgtgcagctcgtcggcgactccggcgggcggaagccatacatgaaggtgttcggctggccggtggtcgcgccgaacgtccccgcaggtgcaccggtggggctcagcgggtctccggtgccgttccaatttcccttggccagcgagtacgtgctcgcgcccacggccgacagggcgttgagcgcgtcagcctggttgcccgcggcgccgtagaacgtccggaaggagcggacctgtccgacggcgagcgagcccagccggaagtcgaactgcgcgcccaggtcaccagggcccacgttggtgaagtcacccgtgccgcccatgagggagtagttgatggccagcgggtccagcgacacgaagttgttgtcgaccgcgctcaccacccaggggttgcccgcggtgcccgcgacggtgacgtattcggagaaggtgttcggcaggatgtcgtagtcgatgccgcgcgtgtagcgcaggtcggcgatgaaggccgtgccgatgttctcgatgaggacgtccacctggtacagatggttcgtcaccggcgacggcgtgtagatgtgcgtcacccggaacgtgttccccacgcgcaccaccgacatggtggagatgggcgatggcgcgttgatctccgccgtgaggttggaggacgcgccgcagtccgcggagctgtagccggagatgcccaggtcggcgctcgcgacgccccagccctcacacgcgctcccgggcgcggcggcctcgccgttggtgggcaggtagcgcaagccaatcgtgcgggtgccgaaggtgccgctggagaccgtgttggtggggcaggggaggttcaggtgccccgcgggcgcgacgccgagccggacgacgccgtggtcgatcatcccaggacagtcaggcaacggcggagggaggaagtggggctcggacgcgaggaggcgctccgcgcgcaacagggccctcgcgttctggggatggatccgtgccttcgcgtcggtgggggcaagctcctccgcgccggaggccatcgcctggccgctccaggacagggcgcagaggagtgctgcgtgcagaaagcgctggggattcttcgatgtgagcatccaggttctcctgtacccggcgaggccgggcagtgagagggccatgaccggcccgccgtgccgccgcggggcctgacctggatgcgctgccactggcggcggcgcccggcgggcccgaggcgctcgcagcctagccagttacggagcgtgtgtgtgcgctgtgctcgctgtgacacagactgcgtgtgtggtgacgtcgatgtggccgtggggggcttcctcggaggaggcgccctgtgtgtgggtgctgggcctgttctgtcggaatgggttatggacagtgtggaatcctccattgagggcatcctcaacggcccacctgacccgagaacccttcaagccgaccttcgtccacatgaatcgcagacccgagctcgacagcctgcgcggaatcctgctcgtgttgatgacgctgacgcacctgccgacgcgactgaacacgatcagcaaccagccattcggattcgtctccgcggccgagggtttcgtcttcctgtccgcgttcctcgtgggcgtggtgtacgccaacaagattgaagcggcggatccgaacgtgctgtggcgcagcctctggcagcgggcgctcaaggtctacggctaccacgtggcgctgctggccttcgcgttcgcggtcatcgggacgttgggcatggcgacgcaccgtcccgccatccacaacctgttgggcttcttccacgaggaccctttcaccgcgctgtggagcagcttgttcctgctctactgtccaccgctgctcgacatcctcccgctctacgtcgtgctgctgttgctgacgcccttcatcctgctgggcgcgcgcaaggcggggtggacgcgcatcctgtgtctgagcgggttggtgtggttgtcggcgcaactgggcttgaagcgcgcgctctacgatttgctggtgttcatcccggtgctgccgtggccaccgctgcgcatcgagctgtcgggggccttcgacctgttcgcctggcagttcctgtgggtgctgggcgtgtggctgggcgtgggccgtgccacggcgccggagaagcgcgaggtcgtttcgcccgtgctgctcagcggggcgctggtggtgagcgtggcgctgctgctgatgcgctaccaggtgggcatcttcagcatcgacctggacctgtatggcgccctcatcgacaagtggaccctggcgcccgtgaggctggtgaacttcctggccgtggccctgctggcgagctggctgagccccaaggtgttccgctggctgcgcccccgcgtgctggaggcgctgggccgtgcgtccctgcccgtgttctccgtgcatctggtgctgtgcctgctcagcctggcgctgctcaatgagaacgaggacccgctggccgactgggaagaggtcgtcgtgttggtggccacgttcaccgtgatgctgctggtggcgtgcagacaggcggccgcgctgcgcagcagtcggaccccatagggcttctctgagaattctctcaggatgccctcaaacggcatgcgcgcgccctccctagggtgcgcggcatgtgggtcctgctcgtcacactcctcgccgcggctccggcgcgagagtcccctccactcaccttcgccgagtcccagtcgctggccgcgaaagccgcgctgcccgcgagcctggcgcgcgccgtggaaacgcggcgtgtgtgggacgcgcggctgccgtggctcgccgccaaccccacgctcagcgtggtgccggggcggcgcgcccagcccgaggggccaggcttcgagctgacggtgtcggtggagcaaccgctcttcctgtcgaacctggcgggggcccagcgcgacgcggcgagcgcggagacccgggcgctggagcgggaggccgtggccgcgctgctgaaccgccggctggaggtggcgcgggcctggctgacgctctggtcggcccagcaggccgcggcgacggccgagcaggaagcgacgttggcgggtgccctgcgcacctccgtcgcggatgcgctggcgctgggcggcgccacccggttggagctggccgaagcggaagggttcgaggccgaggcccaggtcgcgctcctggctcgcgaggcggaggtgacccacgcgcggctgtcgttggcggtactggtgggccgtcagcccgacgcgcacctggtggtcgcggaggcactgccggaagtggcattgccgccgtcttccgaagaagcgcggtggctggcgcgcgcctccgagcttccagatgcggaggcccggcgcctgctgggtgtggcggagcgggcccgcgcggcggaggtccgggcagcgcggggctggcaggtgacggtgggcgcgcagggcgtgcgtgagtactacggcgggctcagtggcctgctgatggtgggcgtgacgccgccgatgttcgacgcgggtcagcgcgagcgtggcgcgctcctcgccgccgctgaacgtctggagggcgaggcccaggaagccgcgctgcgcgccgccgcggagctggccctggcgttccgtgagcgcgagcagaccgcagcgcagctctccgtcgtcgagaagtccctggcgcccaaggccgaagaggccgcgcggctggccgacgtgttgctgcgcgcgggccagagcacgctgcctgacgtcctgcgcgcccgccgcgcccgggccgccgccaacatccggctcgcgctcgctcgtggcgaagcctcgctcgccgccgcgcggctccacctcctgctctccgctctgccatgacgcccttcgtccgccgtttcgtcgctgtgccgatgctcgccctgtccggggcgtgcacgtccggttcttccaccgcggaggttcctcccgcgccgccccccgcgcgcgcctccgcgccttcggcgtgggtgcccgtgcgcgcggcgtctcgcgtggccctggcggaggcccccgcgctggtgctgtccagcccggacgccgtcgccgcgctctccgcgccgttccgcgcccgagtgcagcaggtgcgcgcgcggccgggtcagcaagtcaaggcgggagacccgctggtggaggtgctgatgccgaaggtggtggagccggcggggnccgccagcgccgcctcgctgaggctggaggcctattcgcggcaggtggagcgcctggaggcgcttcatgcccaggggctggcgaagctgcccgacctggccgacgcccagacgcaacaggccgaggcccgcgccgccctggtcgcggcgcacgcggtgttgcgcgtggcgggcatcgctcccggggaagcccggggcgtggcggagcgtggcaccgtctggctcaagagccccatcggaggaatcgtcaccgaggtgcgcgcggtgctgggggagatgcagcccgaggccagtgccgccttggtgcgggtggccgctgacggccccgcgcgcctggaggcccgcctgtccgtgcgtcctcccgaggacgccagcttcgccttcgtgtcgtcccagggcatcgctgttccggtgcggtgggtgggccagtccccggtcgtggacgccgcggatggaacgtggcgcgcatggttcgagccagaggacaccgccgccgtgctgcgcgcggggcaggggggccggttgcgcatccaggccgcggcgggcgaggacacggtgctggtcccggcgcgcgccctggccttcgacagtgcgcgcacggtcgtcttcacgcgcggcggcgaggggcagcccgtgcgccgggaggtggaggtgctggccacttccggcgcggaggccttggtgaaagggccgctgtctgcccgggacacggtcgccgctgacggcgcggcgctgctgttggagtctcaggccggtgacgccgatgaggtgacgccgtgattgaagccctcgtgcgctggtcggtgcgtcaccgggtctgggtcctggtcctcacgggcgtgctcgcgctggcgggcgtcgcggtgtcgctccgcctggagctggacgcgatgccggacatcaccaccaaccaggtgctcgttcttacgcgtgcgcccggcctgacgcccgaggaggtggagcggctggtgacgcggccggtggaggtggcgctgggcggcatgcccggactcgaggagcagcgcagcctgtcccgctatggcctttcctccgtcaccgccgtgttcgaggacggcgtggacccgtaccgggctcggcagcaggtgcaggagcgcctcaacgtgctcggctccacgctgcccccgggcgtggatccaccggagctggggccgctcaccggtgggttgggcgaagtcttccacttcacgctgtcctcgccggagcgcacgggcgcgcagttgctcgagctgacgcagtttcgcgtggcgccccgcctgcgtaccgtgccgggcgtggtggaggtcaacagttggggaggccaccagcgcacgctggaggtgcgcgcggacgcggtgcggctggcccagcggggcgtgacgctcgcgcagttgcgtgacgcgctggagcgagccaccggcagcgctccgggcgcgagccttccggtgggagagcgccacgtcctgattcgcgccgtggcgcggcctcgggtgccggccgacctggcggaggcgttgattccccggccaggggccatggccgtgcgcctgggcgacgtggccgaggtcaccgaaggcgcgctgcctcgcattggcagcgccacctccaatgggcgcggcgagacggtctacgtcatggtgcagatgcttcgggatgccaatgcgctcgccgtgacgggcgccatctccgacgcgctccccgatgtgcgagcgctgctgcccgaggacgtgcggttggacgtcgtctatgaccgcgccacgttggtgcgcggcacggtgcgcaccgtgggcaagaacctgctggaaggagggctgctcgtcgtgggcgtcctcttcctgttgctcggcagcgtgcgcgcgggtctgctggtcgcttcggccattccgttgtccatgctgggcgcgaccaccgccatggtggcgctggacatccccggcaatctgatgagcctgggagccatcgacttcggcctgctggtggatggcgcggtggtgatggtggagggcctgttccaccggttggcgcatctgtcgccggaggagaaacagcgttcgccccgtgagcacgtcgaggagacggccgtgtccctggcccgtcccgtcttcttctccgtgctcatcatcctgctcgtgtacctgcccatcttgtccctgcgaggcgtggacgggaagatgttccggcccatggcgatgaccgtcgtcttcgcgctggccaccgcgctgctgttgtcaatgaccttcatccccgacgccgcgagttggctcattgcgccccgagcacgtccccgcgcgtgagccactgctggtccgctggttcagagcgtctctacgccccggcgttgcgtcagagcgtgcgccggcgcgtgcccgtggccgccgtggccgtgttcctgtgggccgtgggtggggggatcttcgctcacgcaggcacggagtttacgccggggctggacgaaggcgacatggtgattcaaaccacgcgtgtgcccgacatcagcctggacgcggcggtgagcgaagcgggccggatggagcgaggcctgctccaagcgattccggaggtccgacaggtggtgtcgcgcgtgggcagccccgcggtggccacggacatcatgggctgggagatggccgacgtcttcgtgtcgttggccccgagggatgcctggcggcccgggctcacccgtgagtcgctcatcgaggagatggggcaggtgctggaagcccgtgtcccaggtggagacccggccttcacgcagcccatccagatgcgcttcaacgagctgctcgggggcgcggtgacggacgtggcgctcagcatctacggcgaggacctgaccgaactcgggctcctggctcgccgggccgcggcgctgttgagccaggaaccgggtgcggtggacgtgcgtgtgctcgctccgccggaggtgccgctcttcgaggtgacgcctcgcccactcgattcggcccgcgcgggcctgggcgcggtcgatgtgctggaggcggtgagcgcggtgcgcagtggcgtggaggtgggcgccacctgggatggggcggtgcgcgtgcccatcgtcctgcggttgacgggcgcgtccgatgccttctccctggccgagctgccccttcccacggagacgggaggcctggttccgctctcccgcgtggcggacgtgcggttgacttcctcgcctgggctggtgagccgggaagggggccagcgccggctggtggtgggcttcaacgtgcgaggcgtggacctggggacggtggtggagcgggctcggagccgcgtggagcagtcgctcgctccgcctgatggctatcggctcgagtggggcggtcagtacgagaccttgacggaggcacggcaaaggctttcgctggtgcttcccgccgtggccctcctcatcttcgccgtgctgctgttcgctttccgtcgcatgcgtcctgctttggccatcttcgccaacgtgcccttcgcgtgcgtgggcgggatgatggcgctggcggcccgggacttgcccgtgtccatctccgcggcggtgggcttcatcgcgctgtccggcatcgcggttctcaacggcgtcgtgctgatgtcgcgcgaacagcggctcgaagcggacggccatgctcccggtgaggcggtggtgatggcggcccgcgagcgggcccggcccgtgctgatgacggcgctggtggcggcgctgggcttcatcccgatgatgctcgctcgcggggtgggcgccgaggtgcagcggcccctggccacggtggtggtgggcgggctcgtcacctccacgctgctgaccctggtcatcctccccacactctacccatggttcgcgggtaggacgcgcacgcaggcgcgtgcatgatggggtgaaggaggccggtgccgtgaggctgctgctggtggaagacgaggagcggatggcgaacctgctccggcgggggctcggggaagagggccacctcgtggacacctgccgcacggcggaagacgcgctcgaccaggcaggcgaggttgcctacgacgccatcatcctcgactgggccctgcctggcatggatggcgtcgcgctgctgcggcgctggcgcgaacgcggcttgatgacgccggtgctgatgctcaccgcccgcggcacggtgggggagcgggtgacgggcctgcgcgctggcgcggatgactacctggtgaagccctttgccttcgaggaactgctcgcgcgcctggaggcgctgcaccgccgctccgagggccagacgcagtcctggggcggaggggccatccacatcgatgcccggcggcggatgttgacgtgtggcgaccgtgaggtggccttgacgggccgcgagttcgccctgctgggtgagctggcttcgcgcgcgggcgaagtccacacccgctccagcctgctggcgaaggtgtggggccccagcttcgatgggcctcccaacatcgtggacgtctacgtgggctacgtgcgcacgaagctgaccgaggtgggcgcggaaggggtgaccatccaggcggtgcgtggcgtgggcttccggttggtgattgagggcgctcggtgaggttggtccggcggatgtggctgtggggcgcggtggtgcccgtggtggcggtggtcgccgcgctgggcgtggctgtccaggtgttccgcgtggtgctcgaacggacgttggacgaagccttgctgtcgcaagccgccgcggagagcgtgagcctcttcgacgcgccggatgggcgcccgcatctgcacgtggagccctccccgttggcgggagaggtgcgcgccttcgtccccgcgacgcggctctatggcccggatgggacgctgctctccgtcttcccgcccgagtcacccaccgtctacgaacgggtgctacccgaggacgggcccacgtcgcggctggagacgcagcgtctgggctcgggcctgcggcttcgcgtgctgacggtgcaggtgcgctcgccgaagggcgtgccccatgtcctgcagttggtggcgtccctggggacggtggaccaggcggtgggcaccttcacctccgtcgccaccgtgctggcgttgctcctgggcggggtgctgattggcatccagggctggcaggcgagggggctcgcgcgacggcttcatggcatcgcggaccaggtggctcgctcgcgcgacggaggcatggtggccccggtgcccgtggatgagccccgggacgaaatcatggaggtgcgcctggcgctgaccgaggccgcggtgcgcgtgcgcgccgcgcgtgaagcgcaagaacgcctcatcgcgcgcgccgcgcacgagctgcgcacgccgctggccctcatgcgcaccggcttggacctggcgctgcggcgcgagcgtggcgcggaggagttgcgcaccgtgctggaggagaaccggcgcgaggtagaccggttggccagcgtcgccggtgcgctgctggagctgtcggcggcgggcggcgccctcgattttcagcagggggatttgcgcgggctgctcgacgaagccgccgcgggggcctgggcggaggcggaccgtcgcggtgtgtcgctgcgcgtggtaggccccgacgaggccgactgccggatggatgcgatggcggttcgtcgagcggtggacaacctgctggccaacgccctccgctacgcgcctcgtgggtccgaggtgcggctggagctggcgcaccgggacgcgcattgggaagtcgctgtccaggacgaggggcgcggcatcccggagacgcaccgtgaggacgtcttcacgcctttccaccgcctggagcgggacgcggggggcgtggggttgggactcagtctcgtgcgcgaggtggcgcggggccatggtggcgacgcgcgcgtggtggaaagcccgggcccgggcgcgcgggtgctgctgacgctgcctggccggtgagcccgggagcgttcgtcgagcccgggggcagtggcccgtgttcgcgcgtgtctcccacatctgcctccggtacaacgccgccggaattcatcccttccgacaactcagcgtggggcgtatggccagggctcgtcgttcgaagcagcaatcagactcgtcaggtaccaccgagcaaggcttcgtggaggtgcgcggcgcccgccagcacaacctgaagaacgtcgacgtccgaattccccgcgacgcgttcgttgtgttcaccggcgtgtcgggctcgggcaagtcgtcgctggccttcggcacgctctacgcggaagcgcagcggcggtacttcgaatccgtggccccctatgcgcgccgtctcatcgaccaggcgggtgtgccggaggtcgacgccatcgacgggctgccccctgccgtggcgctccagcagcaccggggcgcgcccaccacgcgttcgtccgtggggagcgtgacgacgttggcgaactcgttgcggttgctgtactcgcgcgcgggcacgtatccgcgagggcagccgcacctggattcggatgccttttcccccaacacccccgcgggcgcgtgccccaagtgccacgggctgggccgcatctacgacgccaccgagaagtcgatggtgccggatgactcgctcaccatccgggagcgggcgattgccgcctggccgcccgcgtggcacggccagaacctgcgcgacatcctggtgacgctcggctacgacgtcgaccggccgtggcgcgagctgccgaagaaggaccgggactggattctcttcacggaggagcagcccacggtgcccgtctacgcgggcttcactccggccgagacgcagcgggccctcaagcgcaaggcggcgcccagctacatgggcaccttcacgggcgcccggcgctacgtgctccagaccttcgccaccacgcagagcgcgctgatgaagaggcgcgtctcgcagtacatggtgagcggcgactgccccgaatgccacggcaagcgcctgcgccgcgagtccctgtccgtcaccttcgcggggctcgacatcggcgagctgtcgcgtctgccgctcagtgaactcacggacctgctcgcgcccgtggcggatgggacggccaaggacgtggcggcgcttgcccgtgtgcatccggagaaggcgctggtggcccagcgcatcgcccacgacgtgttggcgcgcgtcaacgtcctgacggagctgggcctgggctacctgtcgctcgagcgcggaacgccgacgctgtctcctggcgagctccagcgcttgcggctggccacgcaggtgcgctccaacctgttcggcgtggtgtacgtgctcgatgagccgtccgctgggctgcaccccgcggacaccgcggcgctgctgaaggcgctggaccagctcaagggctcaggcaactcgctgttcgtggtggagcacgaggtggatgtcatccgccacgcggactggattgtcgacgtggggcccgacgcgggcgagcagggcgggcagattctatacagcggtccgctcgaaggcctgaaggcggtgaaggcgtcccggacgcggcgctatctcttcggcgacgcggagaagcaccgcggcacgcggcgttcgcccaagggctggctgcgcctgcagggcgtgtcgcgcaacaacctgaaggaagtggacgtcgacttcccgctgggcgtcctcaccacggtgacgggggtctccggctccgggaagtcgagcctcgtgagccaggtcctggtggagctggtggccggacacctgggccacgcggtgccggagaacgaggacgagggagaggagctggagcgcacggtcatccacaccaccggcggcaggattgcctccggcatggagggcatcaagcgcctggtgcaggtagaccagaagcccattggacgcacgccgcgctccaacctggcgacgtacacggggctgttcgacaacgtccgcaagctcttcgccgcgacgcccgccgcacgctcccggcgttatgacgtgggacgcttctccttcaacgtggccaagggccgctgcgagacgtgcgaaggtgagggcttcgtcagcgtggagctgctcttcctgcccagcgtctacgcgccgtgccccacgtgtcagggggcccgctacaacgccaagacgctggagattcagtaccggggcaagaacatcgccgaggtgctgggcatgacggtggacgcggcccacgacttcttcagcgaggacccgctggtgcagcggccgctcgccgtcctgcgggaggtggggttgggatacctgcggctggggcagcccgcgacggagttgtccggcggcgaggcccaacgcatcaagctggccacggagcttcagcgggcccagcgcggcagctcgctgtacgtgctggacgaacccaccacgggcctgcacccctccgacgtggacaagctgatgacgcagttggaggggctggtggcctccggcaacaccgtcatcctcgtcgagcacgacatgcgcgtggtggccgcgagcgactgggtcatcgacatgggcccgggcgctggggacaagggcgggcgggtggtggtggcgggcccaccggaggaggtggtgggcctgccctacagccagaccgcgcccttcctggaggaggcgctgggctgagcttccagcgcccgtcggagcctccgagccgtggccgtgagggccgccgggctcggaggtggaggccgcggaatcagcgcgcctgcgcctgtgccgcgggcacggacaggccttccgccttgagcgtatggctggccatgccggacatgctctccgcgagcgactgcacggagcgggcggcttcctgcgtctcctgcaccgtattcagcgtgcgctgcatctgcccggacagctcctggatggcctgcgccatctggtgggtgcccgcatcctgcgcgctgacggcggcggtgatctgccgcacgctggagctggtgtcgccgatgatgtcggccaactgctggaactgtgcgctggaggtccgcacggcgtcgaggctcagccgcacgcgctcgtcgcccttctcactggagcgggcggcctcacgcatgctgttgctgacgccgtcgagcacctcgcggatgcggtgcgtggcctggatggactggtccgccaggccgcgcatctcccgggccaccacgccgaagccacggccgctctctccactgcgcgccgcctcgatggcggcgttgatggccagcatgttggactggtccgccaggtccttcacggagtccacgatgccggagacctcgcgggtgcgctcgtcgagcgcgaagatgcgccgggccatgtcggagacctcggtgcggatggccgccaggtccgacagcgtgcgctccaatgcggccgttccctcgcggcccacctgttcagcgctctccgcggaagccgcgagcgcgctggccttctccgccgtcatctgcgagctgcggcggatctccttcaccgtctgctccgcctcctggagcgccacggcctgacggctgacgccctcggtctgctcgtcgctggacgagcggagctgctgcaccaccgtggcgagctcgccggcgccgttgcccatgcgctcggccaggttgcgcacttcctgcgcgcgcgcctccaactggtgggtgtgcgcttcgagcgtgcgcaccaccatgatggagcggcgggtgacgatgcccagcagcgacagcgtcaacgcgacgtagccccagtgcgtgacgttgcccagcgaccagcccaccaggccgatgacggggaggatggtgaggacgatggagaggacgagccccgcgaagccaccgacgaagaggcgcgcgtccgggttgcccaaccacgcctgggtgatggccactgagagcaccaccagcagcaccaccatcgccatggggaggaagggcacgaggatgcgctgcccgatgcccaggtcaaggagcgtcgccagggcgcacacgcccgccacgggcgagaacaccatggccgccttctggaaccagccgcgccggttgtcgagcagcgcgtccgagacgaactccatcagaccggcgacgagcaggaagatgcccatcgtggtgcccagcgtggcggcggcggacgagccccacagcgccgtgggcatgccgctcaggcccaggaggatcaggccgccgctggccgcggagaccgccaggcccgccagcatccggcgccgccagtggagcgcgaaggcgccacccgcgccgagcgccaccgccagcagcaggcagcagatgacgaagggcgcctggccctggcgcgtcacgtagaccagcaggtcatacttcgagcccacctgcgcggcctgcgccacgccgatgttgggattgctggactggatgcgcagcagcacgcgcttgccctgcgcatcgcgcggcaggggcacgatgtgccaggacaggttctcgccaatctcgtagctgtccggccggatcttgccgctcgtgtagatgtgctggccgtccgcgtacacctcgagcgcgtgggtgatttcgcccaggtacagcgcggggtccgtccagccgccgtcggggatggggatgctgagccacatgaacttgtggtcgccgcgaccctccggcgccgcgagcgcgggcgtggtccgccactccttcgaatcccccgtttccttcgcccacaggggcgtgccatccgaacccacgggggagtcaccccatcggaagcgccacccgtcgagcacgttgacaggaggtcccgcctcggccgcgtgggccgaggacgtgagggcaaacatcagcaagagtgcggaacagaagcggaagccagccatggagtgcgtatggtcttccgcccgggcaccgaatgtaaatgggtcttcccgacctctcccgagaatcgattggcgttgcttggaattgacgtccacagagagcgtggcaggcaatgaatgccgcgaattttatacttccggtgaattcctcgctccggcagcccgtgggggaagcggcccaccggcaaggttgttcctggaaagccggatgatcctcaacgtccggaccatgttccgatcgggtttgaacggcgacccggtgcgtcatgttgagtccgaggcgggcgggggcatcagccgggggacccacccttcccttggggtgggccaagcggcgacactggggccatggcgcatctggagttgatccccaagcgggacctgtcgagctttcgcaagcttgcgattggaagttggaagacggcgtacgaccccaccgtctacggaacgctgaccgtccgcatggacaaggcgatggcctacatcgaggccttccgtcagcgcacgggcgtgcggctcacggtgacgcacctggtggccaaggccatgggcgaggcgctgcgtcgctgcccggacgcgaacgccatcctccgcttcaaccgcatctacctgcgccagcgcgtgacgttgtccacgctcgtcgtccagacggacggcggaaaggtggacctcacgtcggcccgcatcgaggacgcggacaagaagaacctgaaggagatcgccaacgacctggaggaggcggtgcgccgcgtccgcgagcgtcgggacgtggccctggagaagggcaagggcaccatccagaagatcccctacctgttcctcaacacgttcacctggttgctgtccttcttcatgtacacgctgaacctggacatgagccggttcggcatgccgaaggacgccttcgggtccgccatcatcaccaacgtgggctcgctggggctggacacggcctacgttccgctggcgccgtacacgcgcgtgcccatcttcgtcgcgcccggcgcggtgaaggaggtgcccgtggtggaggacggcaaggtggtgccgggcaaggtgatgaacatcaacgcgacgttcgaccaccgcttcatcgacgggttccacgcgggcgtgctcgccaacacgctccgggagatgctggagaacccgttcgagagcttcgacgcgcttccggagaccgccgacgcggctccggtcgccgccgtggggtagggcggctcacaagccgctggtctcacctccgtgagggaacccggaccaggcggaagccgatgttgggcgccgccccggtgtcgctcgcggagcggaagctgacccgcagcgcgtccgcgcagtccgcccacgagccgccgcgcaggacgtgggtgcgcttggggatgtcctcgcccagcacgcagacgggggacgtcttcggcgagtgccggtagtactcggcgtcgtagtggtcctggcaccactggctcacgccgcccgccatgccgaagaggccgtagtcgttgggcgggaaggcgcgcatggggcggagcgagaagtcgttgaagcggtcgaagtccgcgcggctcgcgtctggaggttcgttcccccatgggtacgccgcgccacggaagcagccccgcgccgcgcgctcccattcggcttcggtgggcaggcgataggtgacggaaggcgtgctcaagcgccgcgcgaactgttccgcgagcgaaggggcgaccgcgaccatgggcttctggtcatagcgcagcgggccctcgcccgcgcgcgctggcgtgccgaacaattcctgtgaggtcttgatgacgccgtcgccggtttcccatcgcgtgtggatggcgtgggcgtgccagtcactggcctgcagggtgtcgttctcgcagtactgcaggcgaatcttcgagtcgttgaagtacgcgaagctgtcggtgaatccgtcgagttgttcgtccgtggggaactcgggcggttcgggccaatccaggaggcgagcgaaggcgctccatgacagcgatgtgtcgctcatccagaacgcggacaacgtcaccgcgtgggcggggcgctcgtcgggttcgccgtcgtcgctgcccatgatgaatgtgcccgcggggacatagcggaacacgaagccgttctcgatgacggtgagctgctccaacacgtcctggagcatcggcaggacgtcctcgcgtgcctgccaggccaccgcatccagcgtcgcggcggcgccttccaggtccccactggcacgctggacccgggctttccccagcgcggcttggattaccgacatgcgcccccctgtccccgctccgcgccgagcacgggcagtggatgtgactccgtggcagctcccagggactgggcttgccaagggtcctccgcgaacgcggagccattgtagaactgcgcacgcgcgcggcagcccccggtgaagcggtctcccgtctgcttcgcccggaggcgctggaaggactgcccgtcacgccagatgtcctcgaaggggcgcgttcggatgttgccggactcgaaggcccggcccaggaagctgcacggattcacgttgccctggacggagacggaggccaccgtgttcgcggctccgcagcccgggccctccgtcacgacgccgcgcagctcctcgcgcgccgaaggactgaaggggtccaacgcgaagaggtccgagtcggcttcgacgcgctccagccgcgcgagtgcgtccacgtagccgtcgaacgtgggcatcagctctgggtgccgggtggcggtgccgacggggtacagcgggcggaagacggcggtgtgcgcgcccacccgccgggccagttcgacgcaggcctcgacttccgccacgttgtcgcgcgtcagcgtgaaggcgagggtgaagcgcgcatgctggccgagtagcgcgagcttctccatcacccggtcgaagacgccagcgccccgcacggcatcgttcgtccccgcctgggcgccttccagcgacacgttcagccacaccagctcgcgcttgccgagctcacgcgcccaccgttcgtcgatgagcagcgcgttggtggtgatgcagggatggaggccgtggcccgtcgccgcgtcgaggatgtccagcaggtccttgcgcatcagcggctcaccgccggtgagtcccagccggaagctgcccaatccggcgagctgcgcgaagagcgcgtccatctccttcacggagagcggggactgattgcgcggcagctcccccgcgaagcagtgcgtgcacgtgaggttgcacgcgccaatgacctccaggtggacggcgagcgggcccagcaggtggtcgggtgggggcgcccggtcgatgcgggccgccgcgagccggccatccatccggaggtagcccttcgtcgacaggtgctggatgagcccgatgacggcgtcccggtcgccagcctccgcatcaccgatgacgtcgtccgcggtgtgctcggtgagccgggtgagcacggccgccgcgggggcatcgaacggcatgtagcgagaggagcgccggtcgaagaggagggcgccgaagtgctgaggaatgaggaccagggaagggcggctcatttgaagccctcgtcgtccacgtggaaggaccaccgcacccaggccttcgtggcgctcgaggccaggcccaggcccgtggcgtcgtccttgagcatctgccaccgccagcgctcgttcgtcttcggttcgggaacgggccgttgcaccaacggcgcgaagcccgcgtcggcgaagtccggtaggcgccagccttcgggaggtggccgtgtcgtggccttccatcggccatccggagcggatgccagtttcgggtggaccgcgctggcgatctccggatccagccgggcctccatcaggacgaagcccctgtctccgggacggttcacttcaaatgacaggatgtgcgcacccggggtgacgagcacccgttgctccacgaggggattcccatcgaggaacaggccgccgtccgggacgccattcaggtaggaggacagcgacagaccgatggacgcaccgggccttcgccagcgaagcaccacaccgccacagcccgcgggcacctcgcaatggctgtggatctccagcgcgagctggctcgacctcttgcggtagcgcgccaacgcattgaggcggaagtcgtccgagttcgacatgccggcgttgtaccgcgcgccacgcacctccgcgaaccgcgtaggagccgagcattcacggtattcctggagcgtatcgggtcaaatgtcggacatcggaggaaaattgcgccacgtatggcagggctgctccggtgacttcggcaacgcccagtgcttcgacgtgggcggccggtggaacgccaaggacggcatgccggccagcggcgcgctgaataccttggggccgtagcgcgtgctcattctctccaaggacctgtgatgaagctcgaaggctcctgccactgtcgcggcgtgcggttcagcgtggagacgcaccacccgtctcccttcatgcggtgctactgctccgtgtgccgcaagacgcaaggaggcggaggcttcgccatcaacctgtcgggggacgcgcgctcgctcaaggtgcgcggccggcagcacgtcaaggtgtaccgggcgcgcatccagaacccggaggacgcgaaggcgcaccagagcaagggtcagcgccacttctgtggccgctgcggctccgcgctgtggctgtatgacccgaggtggccagagctcatccatccgttcgcgtcggccatcgacacgccgcttcccgaggcgcccgagctggtccacatcatgctcgagttcaagcctgactgggtgcccgtccatgcgggcaagaaggacaagaagttccagcgctacccgaaggagtccatcgcggagtggcatcagcgccacgacgcggaagtgggctgaggcggctcggggggccgcctgctgtccggacgggcggcacgacgttgcccggagcgcgggttgtggcgggtgcctcgggggcccagcgtgtctctcatacgcggaggcaatcgatggcacagggcagctcgcggcgaatccggtatgcggtggtgggggcggggaatatcgcgcaggtggctgtacttccggccttccagcacgcccttgagaactcggagttggtggcgctcttttcctccgacgcggagaagcgcgacgtgctggggaagatgtacggcgtgcgccacaccgcgagctacgacgaccttgagcaggtgctgcgcgacgcggacgtggacgcggtgtacatcgcgctgcccaacacccagcatcgcgccttcaccgagcgggccgctcgcgcgggtgtgcacgtcctctgcgagaagcccatggcgacctcggtggaggactgtgaggcgatgattcgcgtcacggacgagaatcacgtcaagctgatgatcgcctaccggctccacttcgaggaggcgaacctgcgggccattgacctgctgcgttcggggcgcctgggtgagccgctgatgatgtcggcgctgctgacgcagcaggtgcggaccggggacatccggacgcgcgtggacgtgggcggaggcgcgctgctcgacgaagggccgtaccccatcaacgcggcgcgctacctcttgcgtgacgagcccaccgaggtgttctgctacaccaacgaggagcaggaccctcgcttcaagggcgtggacgccacggccttcgcgttgatgcgcttctcgaatgggcgcatcgcgcagttcggcatcagccacgccgcatcggcggtctccagctaccgggtggtgggggagaagggcgacctgctcgncgagngcgngnggggctacgagaaggagcgcaagcatgtcctcacgctggagggcaagacggaggagcgcgtcttcgcgacgcacgaccagttcgcgccggagctgctctacttctcgaagtgcgtgctggaggaccaggagcccgggccgtccggccgggaagggctcgcggacgtgcgcgtcatcaccgcgatgcaggagtccgcgaggacggggcgcccggtgaagctggaagcattcccgatgaagcggcggccgtccctggaccagctcatcgtccgccccgcggccaggccgccagcgccagtgaacgcgcccgcgccagtgcaaggatgaacttgcgtccactggaaatatttcccgcgcgcgagcttcttcgtgcgctgaatgtgcggcgacatccgcctccgcaagtcgtgtcagacccttgatgcattcattgccgcgaaccgggaaaccaggggtcggcaatgacaacgcacgcatctcatcagggcacctacgcggtcgagcacgttctccagcggattcgccgttgtgccgctgacgtcacgcggtaccccgtggacatcctgacggcggacgcgcagctcgaggacgagctcggcattgactccgtcaagctggcggagatcgccgccgtggtcgggcgcgagttcaacattccgtccgagcggctgccacggggcgctcaggcgcgtacgttgggtgcgatggcggacgtggtggcgcggctgctcgcggacacgcagcccgccgccgtcgcgacgcctccaccggcgcctgtcgcggctcccgtactccaggtgtcgtcagcgggctcaccggtgaaggacctggaggcgcgggtccgtgccgtcttcgctcgggtgacgcgctatccggaagagctcttgacgccggaggcggacctggaggacgagctgggcatcgactcggtcaagcaggccgaggtgatggccgtgctcatcaaggagctgggcctgaccgatgctccgcagccttcgcagcggctgcggacgatttcctctatctgtgagatggcgcgcgctcggctggcggtcgcggcgcccgtgcgcgaggaccgagcgccgcgtcagtcgccgccgccagccgtgctgcccttcgcggggaaggtcgcgttcgttacgggctctgggaaggggattggcaaggtcatcgcggctcgcctggccggctcgggggcgacggtggtggtgaactcgttccactcccgtgacgaaggagagcggacggttcaggagattgttgacgcaggagggaaggcgttccacgcctggggctcagtcgcgcaggaagagcacctggaccggatgttcgccagcatcgaggcgcagttcggcgggttggacttcctggtgtgcaacgcgtccaacggcctcatcggaccgttcgaccggattactccgcgcgactgggacaaggcgttccgcacctgcatcacggggacctatgagtgcgccatgcgcgcgcggcccctgatggcccggcgtggcggcggaagcatcgtgacgatgtccacctccatgtcccagcggtacatgcacgacctcggctgtcagggcgtggtgaaggccggggtggagtccttgacacgctacctggccgcggagctggcaccggatggcatccggaccaactgcgtgtccgcgggaccggtgcatggcgagctgctgcgcatgttccccgacgccgcgagccgggtcgcgcgctgggagtcggcgacgccgggcggggaaatctgcactgccgaggatgtcgccgacgtcaccgagctcctcctggggcccaagacgcgccgggtaaacggcgccatctgggtggtggatgcggggctctccggcacggtggacgggctgctgccgggcgcgtcggaggcacggcgttccgaggcgcagcgcgggtctcaccgcagtgagcacgacctgcgagcgctcctcgcgctcgattcctgaacgtcgtaccggagccaattgccatgggttacttcgcggtcccgtacgacattcatttcgatgacacgatggcctacgggagccatcacttcctcacgaacttcaagttccagtgtgctggacgggagcacctgctcttcagcccggacgtgttcgacgtgccggagttccggcgcgacttcgaccaggtgctgctgctcacctacgagggctactcgcgcaacctggcaccggccagcctgggagaccggttggtggtgctgacgacactggaggaggggggagcggtctccatccgcttctgctttaggaccctcaagagcgatgggacgccagtggcgtgcggcttccagacggttctctgtgcggaccggacgtcgggtgccctgtgttcgtttcccgattcgttcctgcggtgcttcgattcgttgtccggcatcttcgagcgcgcaggggcacggagcttccgggactgtgtccagcagggaggttccgcactcaaggaggtgtttccagagtccatccgggcgctggcgaagtcgctgctcgcggacccggcgtcgctggggacgtcccgcgtcgtttcgttggagggggcgcccgcggcgagtactgccgagagtcccggcgcgctggtgctgccgccgggggcgacggcatttctgttcgccgggcagggttcgtttgatccagggctctatctccaattgaaggcgctcgaccctgacctcggagacgagcttcagggggtcgccgccgcatgtcgtgcggtcggagtggaggcggagccgttgctcgccgcgcgtgatgtctcgggcgtccagcgtgcgctggaagagctgcctcagctcgaccaactgggcatctacctgtccggagtcctgggcgcccggtggatgcagcgccagggggcgagcccggacgtgttcgtggggcacagcttcggggagattgccgcgatgacggcggcgggtgcgctcgacttgcgcgctggcgcgcaggtcgtctgccaccgcatccgagcgcttcaggtccttcccgacgacttcggaacgctggcggcggtggcgctcggggagtccgaggccgttcgcgccatcgcggagtgcggcgcttcgagattgcacatcgcgggacgcaaccacgcgcggcagacggtggtagcgggagcgcgcggtgagctcgcgcggctccgcgcgctgctggaaggccgggggcagggattcaccttcgtttcgagccggtaccccttccaccatccgggcatggccccggccgcgaaggccttccgcgagatgctggaccgtgtgcccatgcaggcgccacggcgccgtatctattcgcccattgaacggcgcgcttatgtgggcgggcggccagagctggcggatgcgctcgcatcgcacctggtgcgctcgttcgacttcctggggacggtggagacgctctcccgcgcgggatgcgcgcgcttcgtcgactgcggaaccacgggcgtcctggcgcgcatcgtccagaaaatcatccccgaggagacggccgccgaggtgagcgtcatcagcaagctgcttccggcggagcggtctgccccgtcggctggcatcgagccgaagtccgtggatgccgccgaggtcgacgaaagcggcattgccgtggtgtcgctgggctgcatcctgccggggggagcgaaggacccggaaacgtactggcagaacatccggaagggcatcagcggcatcgtcgaccagggcctgttgcagcccgagttggtgacggacttcgcgggtcccgcgggaactccagaccggacgtacaccctgctcacggggtatgtgcgggatgaggacctggttccgccgccgggcttcgacccgacgcgtttccagcagtacgtccgcgagcagaagctgctggccatcgccctttcgcaggccatgcagggactgaagccggtggcatcgaagacgccggggcgcatccagtgcctgctcggttcgacggcggaagggtcggccgagtacgacgccgcgctgagcgtggaggctggagaggcgctgctgagtgcccggggggagcgggttcatgacatcgcggcgctggcgtgcgcggcgcgtgaggcacttggggtggaggccatctccagtgacctggcgccgcatcccaccctgcaggccgtggtgacggacgtggtggggcagggtgtcgccaccacgctgctcgacgctgcttgtgcgtcgtcgctctatgccatggcgctgggcatgaaggcgctggagcgaggggactcggacctgattcttgctggcggcgtgttctcgccggggcctggcaacagttgtctgttctcacagttcaacggcctgtccgccacggggagccggccctttgacgcgcgcgcggacggcgtcatcttcggtgaaggcgcgggtgtcgttgggctgatgcgcctgaaggacgcagtcgcggcggggcaccgggtccatgccgtcattcgaggcgcggggctctccagtgatggtcggagcagctcagcgaacgtgcctcggtcggacgggcaggtggcggcgatggaggcgtgctactcgggggcccaggttgacccggcgagcgtgcagtacatcgaggcgcacggaacggcgactcccgcgggggacgccaccgagctcaggtcgattgcccgcgtctttggtggcaagcgcagtggcgttcagctcgccagcgtcaaggcactgattggccacgttggctgggccgcgggtgctgcttcggtcatcaagctgtgcaaggcgatggcgcaccggatcttcccggtgcagtccaacttcgatgcgcccggtgccgcgctgcgcgccatggggcccggcttcgaggtgaacacgcgcgagcagccttggccggagaatggcgaattgcctcgtcgtgccgccaccaatggctttggctttggcggaaccaatgcccacctggtgctggaggagtaccgggggccttcatcggcgccgaagtcccgtgagggcatcccatcggaggccgaactcgtggtcgtggccacggagggcttgttcccggatggacgcggacggcccgaagcgggggttcctgtcgaggtgggagcgcgcttcgatctgcaggcactgcgcctgccgcccacggtgcgcctgctgcccgacatctccgaggacatggatgcgacgcagcacctcgggctcgtggtcgggagtgcgctcgcccagaagctgggggcgttcgacgcgcttcgttcagggacggccatcgtgctggggctggagggcaagacgcgccgtggtgtcgaggcggtccagcgtgtcctggcgttcacgctgcaacggcgcttgagtgagaaggctcgtcgcgagccagcatccgccgcggtgctgcccctggcggagcgtctttactcggcggtgatggggagcctccgtccctcggggccgtacacgcttcaggggatgatgccgaacgtcacgcccggccgtgtcgcgggagcgctcgacgtcaaggggcccaatttcgtggtggatgcgggggctgcgtcgtcctcggcggcgctccaggctgcgcgggggcttctggagagcggcttcgagctggtcctcgtgggcagtacgcacattggcaggccgggtgaagtcagaggggcgcagcagcccgaggaaggcgcggcgctcttcgcggtgacgacggcggagaaggcccgaaggctcggcttgaagcccatgtgccagcttcagctttccacccgtggcacgaaggggacaggtgcgggtatcgacctgccaccgcactcggcggcggagagcctggcattgctgcgcgccgtacacgcggcggcggatggccgtgctggcacgctgcggttccaccccgatgccgcgacaggtgtccggctcgaagtgcggctccagccgatggcggacgggctgcccgtggaatcaatgcagtcgtcgtcgcgagcccactcccatgccgcaacggaaggccggcttggcgtgtcatctcgggcagcggagcagggagggcggattgacgcctccacgtcacctcttcggacgcatcctgatgccgtgacggacggccgaagcgaactgccgtcccgaccgtcagagggagtgcggcttgcttcttcccgttctgttgaatccgcgtcgtcacccgccgacggcgcatcgggagccgagttgcaagccgcagcgggaggcttcgaccacgccgcgcccattcagtacctgtcgcccgtgctggtggagcggccggttcggaagacacggccctcgtatctcagaggccgtcgggtgctgttcatcgcggaggacgtggcgctcgcgcgcgagcttgcagctcgggcgcaggccctgtgcggggcggagcacctgattctctgtccgggaacaggttcggattcgggacgcgtccggtacgtcgacctcacgaccgacacctccgcggaggccgggctggccgcccttggcttcgagcccgaggtcatccttgcggtcagccgcatcgaggcaggggcgctcgaggccgcggtggtcgcggacacggcgatgaagcacggggccctggagctgctcttcctgaccgcccgtcgcgcgtatgagcgcctgtctcgtggcgaggtggagctggtgagtctgtgcattggcgctgtgggcccacggcggtgcctgcatccaatgtcgggactgttcgcggggatgctcaagtccatcgggcgggaagtgcctgcccggaacgttcgtgccgtctccaccacggccatgctgctccaggaggcgctcgagctggccgaggctgagctgggctcggaggtggaggggaatcactccatcgaggtgtgcttcgaaggtccggtgcgctgtgtccgcgtgttgcgggtgacggacgtcacggcggacctggcggcgacgctcgattcgcgctcggtggtcctgctcacgggcgggggccggggcgtcacggcagtcctcgcgggagccctgctcaagcggtttggatgcaaggtggtcctcgtagggcggagcgatccggatgaggcacccctgcgcgtgctccaggcccgtgaggaagacctgccggcgatggagcgggagttctacgcctcggagctggcccgcaatcggggcgtgcgcatgccagagctgcgcaagcgcttcgagcgcttcctggccgctcgcgagctgaaggccacgctggagggcctgggccggcttccgggcgaggtgctctaccgggccgcggacgtcacgcgagcggcggacgtggaccgcgtggtccaggaaatcgtcgacacgcatggacgactggacctggtggtgcatggggcgggcacgcagacgtccaagaagctgaatcgcaggcagctcggggagttgcgtacgaacctgggcaccaagctgctggggctcaggaacctgcgggaagcctgcgtgagtcggctcgctcggccggtgccgttccacatccttacctccgcgttcagctacatcgggaatgacgggcaggcggattacggcgcggcgaacgaggcgctggaccggctctgcgcctgggtcagcgacgcgagccaggaggtccgctggtgcagcgtgggctggttggcctgggacggaatcggcatgacgcggggttcggagtaccgcgtgctcggtgccagccggcatctgcgaggaatccgagcggaggaaggcgaagcgctcttcctccaactcgtggatgggcggcctcgacaggccatcaacgtccagctcactgagagcgagcgttcctactacgcactggaggtcttgcccgcggaggagacgcgttctctgtcggccgggcccgtgcagcgcgagctggtcgtggattcggcgagtgtgccgtgcctggaggaccacctcgtgcgtggcacgcccacgttgcctggggcctgggcgttggacctgatgctgcaagccgcggtgggcaacgggcggccagagctgcgcaccgtcaccatcgaggacgtccggttctcacgcttcatccgagtcaagcagggaggccgccagcacctgcgcgccgaatgctcgcccctcatcgatgagcccggatgtcatggcgtgcgggtccggctgatgggggacatcgtccatgcgtcgggtgtcgtgctggagaaggacctcgtctatgcggaggcgcggttcacgctgacggcggagccgccgcggggcacgccggagctggatgcggcggcgccgtcgggacaggcactgcgggtccacgacccacactgcgccgccggtgcacccatcgaactgcggaagatgttcgactgcctggaggaaattcgcatcgagccgtcggcccggttcgcgcggttggggctgccggccgagcctcgtcaggcgggcagcaccgtgcccgcgctcgtcctggatgccgccttgcggctgagcgcgatgcatgtggatggggagtcgagcgcggtgttcgcgcccatccagttccagcgggccacgttcgatcgcggcctggtggacgtccggggtggagcgccgcttcacctctcgttgaaggcacttcctccgcgagtggatggcgacctgctggagtgcggcaccgtcgctgcgctcgacgaggcggggcggcttcggatgttgctcgagggcggccttgcgcggcccatggcttgagacctccttccttcgggtgaacgcatgaattcttccaatccccaggcgggacccattcccgccgatgacccccggtggctgcggtcggagctgcgccgggtgatgccgccggagtccttccagccgca

SEQ ID NO: 1244 - DNA, 27219 bp, Myxococcus xanthus
gctgaccccagtcgatttcacccaccaggacgggctggagccaatccggggccgccagcgcgggcgtgctcgccagcgtggccactgcgatgaggacccggcgcattcagtccaccgggacaatctggaggaagtgcgtggtgccgttggactcgtccccgtcgtggtcggcgaggaagaggcggcggttgacggcgtcgtaggcgatgccgcgcacgttctggaagccgctggcgatgactcgctgcgcgccggtgctgggattgatgctgaccacggtgccctgacgggtgcccgtgagcagcgcgccgcccggcccgagcgacagcaggtccggctcggtgagggtggcgatggtggtcagctccgcgggacgcgccagcggcgagcggtacaccttcccggcaatctggtccgcgatgtagagcgagtcacccacggccagcacgcccacgggcttctccagcgcacccaccacctcctgctccgtgccgtccaggttgagcagggcgatggagcccacattcacgttgctgttgcggacgaagtaggagttgtagagccgcccgtcctccgtcaccgtcaggccgatgcggcggcggttggtgggcagtcccggcaccttgccggtggtgccgtccggccgcgcgaagagcaccgcgcccgccgtcccgaagccgaagcgcaccgtcacaagcgtgccgtccggcatccgcaccacctcacccaggttggtgctgttgggcggcgcgtccggcagcgcgacggccagggacacgccttcaccgtcccggtacttgaggatgcggtggttctggtcgtcggcgatgtagagcgtttcgttctcggcgtcccagaacatcccgttggggtcgccgtccaatgggatggccttggggccccggtccacgggcgcatccacccccggaccgtcggagggggtgtcagagcagcccacgagggtgagcagggcaagaagggacaacaggggcgcgcgcatggcgggcttctaacctagaaggcctcgcccacgttcaaatagaagctgggttcacttccgtaggcgatatcgagccggagattgacgggaacgtctgtcatgggggcgaagcgcagccctgcgccagccgccggtttgatgtcacgcatgtcgaagtcgcgtgggctgcgtgccaccgtcgccgcggagacgaaggccacggggcccagtcgccagaagaggggcgcgcggtactcaacctgcgcgcccaggtgctggcgctcgcggaagcgcccctccaggtagcctcggctcaactccatcccgcccaacctccccgtgtcatagaagggcggttcaccgtcgcgcaggtcgacgagtccctgcatcgcgagaacgtgtcgctgtccccacggaagtgtgaggtagcgccggacatccagtcgcagcacatcgaagacgtagtcggagctccacgcgtcccgggcccggcgcaggttgagccgcgccaccaggcctgtcaccggattgagcgtgttgtcccgtgagtcataaagggcggtgagcccgaattgaaccgtcgaaccgccctcggcgcccgtcatgcgccgcaccgccccgtcctccgcgacataggtgaagcgcgcgtgctgatagcgcacggtagggccgacatagaggcgcggggcgatgcgccacttcggactcaattcaagctcgaagaagatgggggtgaagtcctcctcgtcctccgcccgcgtgcgtgcgcccatgccgaagaagcggtccggtaagcgcgccgcgctggcggtggccgtgaggttcagccggtcgtcgagcagattcacgtccggctggaggaggagggtgaactggccacgggtgctcgcggcggcggccagcatcacctgggactccctgccgcctcgcgacgccgggggctgatagatgagcgatgccgcgccgcccaggaggaagctcgtctccggctggtaggcgggcagcacgaaggggacgacgctgaagcgcccctccggtgcttcctcgggagtggccacgagcaggacgccgaggacggccgtgaggagcggtgtcatggcggggcctcagacgttttcgtcgagccagtcgaacaggcgcgcttcggccagcgcagtggacgccgcctggcagtgcaggggcgcggcctcttcgtgggtgaacatcatcaggtgcttggggccccggagcgcgtcgtagagcttctgggattggcccggcgaggcatcctccgcctcgccctccatgatgagcaccgggcagcggatgcggtcgacgatggcctcgttggtgaactcctccagcttgcggaagagctccgacggcgaccgggcgccatgcttccagtacacgtcacgcagccagtactgggcggtgggccaccggtccgcgagcgcggtaatggcctggtcgaactgctccgggtgtgacttcagcagtgccagcgagcccgggaggaagcggttgaagtgcgagctggtggactcccaccaactgaggacgccggggttggcgatgcacagggcgatgcgaggttcgaacgccgccgcccgaggcgccagtgcgccgccgaacgacaggcccatgaggagaatgcggcgagggtccaccccgctgatgcgctcggccgcgtccaccacggggctgacggccttctcccaatccggccggaagctcagccggtgttcccgcagcgagcggccctggcccgggccgtggaacatgagcacgtggtagccgcgccgggccgcgccttcccagacccacttcgtctcctccggccaggcatgcagcccctggtggaggaggatgacgggcgcgctgggcttcgcgtgcggcgagcgcacgaagtacgccgccagcgtggtgccctcgtaagggatggccagcggctgcacgtcgtagccgagcagcccgttcgacttctcgaacgtggtggccgcctgccgcgtcacctcgagcgtccgcgggtcctccaggtccgtgtagtgcatcgtcgccgcgcggtagtagttcgccgcgcgcgcgtaggcctggccggcgctcagccggtgacccttggactcggcgttctgggcgtggccgtggacccgccgcgccgtctgggtccacgcctcgaaccaactgcgctcgtccccgggctggatgcggctggccgtctccagcacgtcccccacgtcgctctggccgtgggttgcatggctgaggaaccagagcacctggttgtccatcagcccgtcccccgtgaggcggatgtcgtaccaggcgtcgcttcgggggttgatgccctgcacgtccttggacaccggtgccagcgcgctccgcagccccagcgccgccgccgcgccgcccgcaaacagccccgctcccatcagcacgcctcgtcgagagggtcttcctgcggtaggttcgccttcgggcttgaccatgggattcaatctcctggattaatcggttgattgaatcagtagatttaaggctgcccgcgcctgtcaagcgtcggcgcggagtcacgtcgtttcaggggtttgcagggatggggaccaaggagcaggaggcccgggagcgcattctccgggcgaccatcgtgtgcatcggccgggacggactggatgcgacgggcatccgggagattgcccgcgaggcgcaggtgaacagcgcggccatcagctactacttccggagcaaggagaagctggtcgccctggcgctggagcagacgctggaccaggccttcgggaacgtcctggaggacttcgatcggctccggttggagggcctgggcattcgcgaggcgttcgagacgctgctcgaggatttgatgagcaactcgctgcgctacccgtacatcgcgcacgcgcacttccacgacgcgctggcccatcagcgctacgacagttccgccatccagcgcttcaatgcgttcctcgccgaactggccgggcggctggcaccgggggcgccgcacctgccggagaaccggctgcggatggcgctcacccaggtgtgggcctccctgagcctgctgtcgatgatgccccggctgttcgaccagttcatcctgctcgacttcggcacgctcgacacgcggcgcgcctgggtgcagcaggcgtcacggctgctcttcgttccttgagggccgtgtcacacgtgtctcgtcagaacgccgcgccgtccgcgcgcagccctggagagctggcgacccccggcgtcagcgtgtcatgcgcgacgaagctcgcatccggcgtggcgtccggcgagcggttggcggaaaccccgggcacggtggacgtgtagtcgtactggtccaccagggtggagtcctgccgccggacgcgcacggagtcactgccgttccccaggcccagcagaccactggacgcggccagcgcattcgcctgtcccgcaggcaccgccgcggcgccaccgaagacgaccacggccttgccaccacccagctgcgtcccctgcgcgaagacatgccgcgcggaaccgttggtggcgtcccacagcgtccagccggagatgtccacggggaagggactggcgttgaccagctccacgaactcgtgcgcggaggcctgggtgccttcattggccaacacctcgttgatgaacacgcgcgcggcgccactggcgatggtcaccgcagcgtcactcatgtccgcgtgcgccggttcgtagacatccaccacgcgcacccacacgttcgaggccgcctcgtccggaacgctccaggcgaagcgccccagggccgccgggacggacgcggccaggacgctccaatccgttccaccattggtggagacctcgacgcggacctcgcccacgccccaggacgtccaggtgatgggcagcgtgctcccgccctggtacgtcccgccgtggggcgacttcaggcggaggagggggccggttgccgcgctgaaggcgtagctgctgacgacggggcggtggtcgctgaccacgttgaggaagtcggggaaccactcgtccacgtagagcacgcgggccgattccgcgacgtagcggtccgccgcctcgttggtggccagggtgtggtcgacgacgttctcgaagccaatggaggtgtcatcccccgccagcgacagctctcgggtgatgaaggtgaagtgagccgagtcggagacgaagttctggtagggcgtggccagcggcgcgccggaggtggggtcgagcgagatggactcgtccacgtcgtcattccagtcgccaatcacgaagacgtgctgcgtgggcaactgctcgtcgaggtacgccttgagcgccgcggacgcgcgctcccgggcttcgcgcggcgccgtcgggtcggcgctgttggcgcgcatgtggacgacgatgacggtgagcggcgtctccgccccgttgatttcggtggtgaagtccacgcggagcggcgggcggtccgcgaagtcggagatgttgccaatccggaccagggtcgcgctctggaaggtgagggagctgtcgtacagcacgcccagcttctggctgctcgtgccgtagggggacgttccgccagagacgaaggccgcgtcgttggagaggaagccgtcgaagccggggagctgggccttgagcaggtcgaagtcggcggtatccaccatctccaccatggcccacaggttggcgcccgccgcgagcatgatgtcgcgcgcaccggcaatctgcaggtcatcggacgcgccgccatccgacgaggagttcgacgggccgcgcgaatccgagccgaagtaggtgaggttccactggcccgcggtgaacacgggggcgcccggcgcgctcacggagagcgtcagctcccgggtgcccgtctggccattcgcatcctccaccgtgacggtgaaggtgccgcgggccacctgggcgggcgtgccgctgagcgtgcccgtggcggacagtgtgaggcccgccggcgccgtccccgccgtgatgcgccaggtcaggggcgcggtgccacccgcggcggccagcgtcgtcgtgtacgcccggcccacggtgccttccggcagggcctcggtggtgatgccaggcggcgcatcctgtccggcgtccgcccccgcatcggaatcggtgcctgcatcggagtccgtcccagcgtcgggattgtttccggcgtcgacgacgacgccactgtccgcgggcgtgggcgtggggtcgtccccgcaggcggtcaataggagcaggacgagaagaggcgcgagtgtgcgggggggcgacatgaacgactccagggcagggaacgaagctcgaaggacagcgacggtagtcgatggggcggacatgctcccgctgccacggcaggaccgccgcgtcctcaggtcgcgccttcgtcaatgactgactggattgcggccgccagccaacgctgggtggacgtgtcgagcccttctgagagccgttggatgggcagcagccgcccgctgacgagcaggccattccagaggatgttgagccgggccgcgcgcccctcgccatccggagcgcccagccagcgggccaggggggcgatgacctgcttctggagcagttcgacgctggtcgcatgggcttcggggtcggacgccgacaggatgagcatcgccaacggccccgaggcgtcgtgtgcacccaggaagagggacaccaccgtctctccaaactggcgcctgtctatctggagcaacgggccgatatcgagcacctgcgccagcgtctcccggtacagcccctgcttggagccgaagtagcggcccacgagcgaggagttgactccggccagcgccgcgatgtcccgcacccccgtgttggcgaagccctgtgtggagaagagggcccgcgcggcggtcatcagggcggtgcgtgtgcgttcggagtctctttgccgaacggctggctttgcagtgggcggtcgggtcgagggcatctgggtttacttataattccgcttgagttatgtctatgtaagtaaacgactgtgtacgtcgtgcgtggcttccaactcgaaaggacatgtgcggatgactgcgacaaagcaggaggggcgcgctttctctccggaagccttgaaggagaagtaccgcctcgagcgtgagaagcggctgcggcccgacggcaatacgcagtacatccccgtgaagggcgtcttcgcggacttcgacaaggacccttatgtcgagcctggcttcatgcgtccggcgctggcggaacagctcgacgtcttgattgtcggaggtgggtttggcggcatgttgtcggcagcgcggctgcgtcaggcgggcgtggacgccatccgcattgtcgagaagggcggcgacttcggtggcacctggtactggaaccgctatccaggcgccgcttgcgatgtggagtcctacatctatctgccgctgctcgaagagactggctacatgcccacggagaaatatgcgcgggcgcccgaaatcttcgcccattgccagcgcatcggcaggcacttccagctctatgagaaggcgctgttccagaccctggtccagtccatggactgggacgaggacgcccggcgctggaacgtcacgacggaccgaggggaccggctggcggcgcggttcgtcatcatcgcgggcggcatcctccacaaggccaagctgcccggcattccaggcatcgagacgttcaaggggcattgcttccataccagccgctgggactacgcctataccggtggcagccccaccagccgcatgacccggctgggcgacaagcgcgtgggcatcatcggcacgggcgccacggcggtccaagccattccccaactaggggcagtgtctcagcagctgtatgtctttcagcgcaccccctcgagtgttggcgtgcgcggcaaccggcccacggatgaggcctgggcgaagtcgctccaggccggctggcagcaagaccgcatccgcaacttctccgcgattgtctctggccgcgcgctgccggtcgacatggtccaggacggctggacgtacatcttccaggacggcgcgacccagcaggcccggacgcccgaggaagccgtcgaactccgccagttggctgactaccggaagatggaggagatccgcgcacgggtggatgccattgtctcggatgcggcgacggccgaggcgctcaagccttattacaacccgatgtgcaagcggccctgcttccacgacgagtacctggagacgttcaaccggcccaacgtccagctcgtggacaccgaaggcaagggcgtggaacggatgacgccgaggggtgtggtggtgaagggggaggaatacccggtcgactgcctcatctacgcctcgggcttcgaagtctcgggtgattacacccggatgctgggcttcgacatccggggccgcgatggcacatcgctccgggaaagctgggccgacggtcccgcgacgctgcatggcatgcacagccgcggcttcccgaatctgttgatgttcaccacgacccagagcggctgggccatcaacttcgtgcacatcctcgacgagcagtcccagcacgccgcctacatcatcgggcggtgcctgaagcagggcgtggaagtcatcgagccctcggcgcaggcgcagcagcagtggtgggatgtgattctctcccgcctcaggatggggatttccttcggcggggcggattgcacgcccggctactacaacaacgagggcgtcagcccggggccgaacgccatccgctacgcgaccttcggaggcgatacgctcgcgttcatcgatgtcctgcgtgcttggcgtcagggcgatggactcgtgggcctggagctctcgcagggcaaggtggcttcgaagccatgagtgcctccatgttccgatgcgtctccaagtccctggccgccggtctgctgttgatggcggccccggccctggcgacccctcccaagtcctaccgtcaggagacggtggtggccggctcccacttccagggtgtccacgggctcgccgtggatggaaagggaaacctgctggccagcaacctgctgggccagtcggtccacgccgtcaacctgagtacgggcgcggtgagcacgctcgtggggcctccgctgggcggcgcggatgacgtcgcgctggggcctgacggctccatctactggacgggttacttctccggccagttgatgcggcgcactccggacgggaagacgcgcgtcatcgccaggaacctgccgggcctcaactcgctggcctttcgcggcgatggccggttctacgtgacgcaactcgggcgaggcgatgcgctgtgggaggtggacccgaccgggcgcaagccgccccggaaggtcatcgacgcgcccggttatctcaatggcttcgagttcggccccgatgaccggctgtatggcccgctcatcctcaaggggcagattgcccgcgtggacgtggacacgggcctcatcgagaaggtggcggaaggcttcacggtgccggtcgccgtcaacttcgacgcgcgccgggagaacctctacgtcgtcgacgcggcgacaggtgaactggtgcgggtccgcctgccgtcgggtgccaaggaggtcgtcgcgaagctgcccactgggctcgacaatctggccgtgggtccggatgaccaggtgtacgtgtccaacatggtcgacaacgacatccgcgtggtgaatcccgcggatggctccgttcgcctcctggtcgaatctcgcttgtccgtgccctccggtatcgccgttgtgccagatgaccccgaggagacgctgtacgtggcggatgtgtacgccctgcgccgggtgggcgggcgtgagggcttggtgacccagacgacgcgggtcctctcgtcgcagttgaacttccccatgaacgtgagcgtgactgcccggcatgtcgtgctgagcacggcctatctgggcagccacagcaccctccaggtgttggaccgcggcacgggagcgctcctgcggaccatccccagcccgaatggcgcgcagggcgtggtggagctggaggacggcacgctgctcgtcgccgaggccgccacgggccggctcgttcgtgtggatacctccgagcccgctgtcaccacggtgctggcggaagggctgggtgggcccgtgggactcgcggccgacacgaaggcgaaggagcctggggtgtacgtgacggaggtgcgttcggggaaggtgacccgcgtgcgcctgtcgcatggggcgcggcgcacggtgccctcggtcctcaaggcgccccaaggcatcgcgctgcatcccgatggtgggttgattgtcgcggaggtgggccgcaagcggatggtgcgcatcgacgcggccacgggccgggtgacggtgctcgccagtggcctgcgcatcggtctgcctgagagcgagggactgcctccgggctacatccccacgggcgtggcagtgggcgcgtcgggcaccctctatgtgacgtccgacatcgagagcgcgctctaccgcttcgtccccgtgccttgagcctgcacggccaaccgtcacacggggacttcgaggttcatcgacagacccgcttcgaactcgggcgcttgccggagccgctccaggacgatgcgggtgcagtggagcgtgacgaggggaatcgttcccggttcgctgatccaccggaccgcgtccatcaagtggtgggctttcaggaacgcgagcacggcatcccagaagcggcgtccttcgtcgagcgcggcctggtaggcgggccggcggtccggggctgatgccgggatggcatcggctccacgcttcttgcgcggcgcgggccggtacggcgtggcgctctgccggggcatgatgatggcttcaatccacatcgcgtcaccctccacactcccggtcctcgggtgggtctggggattatcggacatggcgcgtgcaggttgcgcccccttcggctcgcactcaagggtggggcacgctcgcccccatggcatgcgttgcctgcttcagggcttgaggctcgctcgcgcctcaggcgtggcggtgggcgcacgcctgcttgcctgctgcgcctgcgctacgccaactgcctgaagttgcaggagcgcctgtcaggtgacgcggtggtgtgctccgggccgcctaccgtccgtgcgaccacatcctaccttgtgaggcatgaaggcatctcgtcggcagctccccgtctatgtgccgccgcggacggtctggattgtcggaacgcaggtcctgctgctcatcctgtgctgggccgcgctccgggcggtgtaccccgtgctcacgctgctggccgtcgtgctgctgctctccatcgcgctgagccccctggtgcgaaggctgacgcagtgggggcttcctcgcggcgcgggtgtggccatcgtggcgctggcgctcctggggatgatgggcgtcctggtgggctcgctggtgcccatgctcatccaccagctccagggcctggtccagtcgatgcccgccatgcttgagcggctcgcgcagtcccgctgggtggaggagctgagcacgcgttatggcgtagaggtccaggcggaggacctcatccgcttcgagccgacggacgtcgcgggccgcctcatcaacgtcctgtcgtcgacgctgggcctggtggcgggcggcatcaccgtggtggtcctcacggtgttcagcctgctgttcggtgaagacctctacgagagcaccatccagtgggtgtcgccacgccgccggccacgcgtgcggttgctcatgtcccggatgcgaaaggccgtggccaactacctggcggggaccctgctggtgatgaccattggcggaacggtcgccgccaccattgcgctcatccagggcgtgccgtacttcctgccgctgggattgatggtgatgatgatgggcgtcattccctatctgggcagcatcatcagcgcggtgctggtgggcgtcatcaccctggccgcggtgggcctcaaggatgcgctcatcgcggtggtcgtgttcatcgtgtaccagcagattgagtccaacgtgctgggccccatgattcagcggcgggccatcaagatgaacccgctgctcatctccatcgtggtgctctgcggcggcgcgctggcggggctgcccggcgtcgtcctggcggtgccgctggccgcggccgcgcaggtgctggtgcaggaagtgctggggcttcgccaggaagcgtggcagcgcagccatcggatggaggactcgaagcgggagcccggccggggcgcggtggaggaagggttgctcttcgcgggccccatggcagggccacgtccgtcagcgccgccgagccgagagccaccgccgccggacacgccctcggagcactgagcgcgaaagcagaagggcctccggacgtcgacccggaggcccttcgcgttcattccgccgtcacgccgggtgacggggttcgttcatcaacgggccgcctgcgtcgagcgtccctgcacgctgcgcgtcttctccggcgccgcggaggccaccgcggccgccacgccgaagacgaggtcgtcgcggtcgttgtagctgccggaggtgcacgaactcgcggtgccgccgtatcggaattgcgcgcggatggcgtggttgcccgcggtggcgcccaggttgaaggtgtgcgtgaaggtccgcgcaccgctgcccgtacaggccacgtccgtggtcagcgccgtccacgacggcgcggaggtgttggtcgtgtagtacaggtcgaagcggtccgtggtgccccagcaccacaccgtcacctcggccgtcacctgcttgccgacggagaaggcgctgtggtccaccgtgcggaggaccacacggtcgatgctctcatcgctgtggtaggtgccggagcttccgtccgcgcaggaggcgttgagggtgttgggctggttgggctcggcgccgccggacagggtgccgcggccgttgacgagcaccgtcccggtgtcacacccgcacacgttgccgcaggacggtgtccgcagcgtggcgttgtaggtggcggccaccggcgtgcagatgttggtggtggtgaagctcctcgccgtgctgtaggcgctggtgccgcaggagtcggccgcccgtgcgcgccagtagtacggggtgctgctgctcagcgctggcgtcaccgtccacgcgctggccgtcagggcggtggccgagcggaccacattggtgaaggccgagtccgtggccacctggacctcgtaggtggcggcgctgggcacgtcgctccagtcgagcgccgcggacgtgccgacaccggtggcgccgtcagcggggctgctcagcgtgggcgttgccagggcgacgcagccgcgcgtggtgaaggtggacgccgcggtccaggcgcccacgccaccgcacgagttgctcgcgcgcacgcgccagtagaacgaggtgctggtggccagggctggcgacaccgtccaggtgctggccgtcagcgcggtggcgctggccaccacgttggtgaaggccgcgtcggtggcgacctgcacctcgtatgtggaggcgccggagacgtcgttccagtccagcaccgcggacagctccacgccggtggcgccgccggagggcgcggcgagcacgtccgtgccgggcgcggcgcagacgggcgtggtgcacgtgcacgcgctggcggcgccgtagcacgcgttggaggacgccgggacgatggagtagcagtactgccggccgttggcgacctcgccgtccgtgtaggtggtgcccgtgacggtggcgaccttcgccttgccgaagtcgcagcccgcgaagccctccgtcttcatcacccagtactgggtggcgcccgcggacgcgttccagctcaggctgacctgtccgtcacccggggtggcggtggtgttggcgggcgccgtggtggggccggcggcgcagccgctgttcgtcaccgtcggggtggagcacgcgatgcggtgccggttgtatgccgcgtagatggcggacatgtgcggcgtgccgttggccaggttgccgtcgtcgtcgtccgccgccagccactgcatgtagccgttggtggcgccacagccgtcggacgtgcccgccgtgcagttacaggcgtgccacgtgcccacgttgccgctgccctggtagaacgtcttgttgcccacgatgaaggcggtgttggagtcgtagttgaacggcggcgccgtcaagtcgcgcgtgacgaagtcccaggccgcctgacgcacgggcgaggccgcgcagtggacctggcggctgcacgggccggagccggagctgcacatggggcacacgaagttctgcggcgtggcggggatgttgggcacgctggcggcccagtccgcgtcacgcacgccagagcacttggtgttgcaccacgactggccggagacctgcgcctcctgctggttgtagcccgtgccgtccggcgtcaggccgcagccggtgttgaccgtctcgaagaagccgtagcccacgcaggacgtctgcaggcggtagatggccgcgatgtccgcgtagccttccgacgagttgctgagcgagccgttggcgtcgaagtcgtcgatgccgtggccccactcgtggtcgaacacggcgccaatctcaccggtgttccggcagccgccgccgctccggtagaagttcaccgagctgccgttccagaaggcgttgcaggtgctgttgatgttgacgttggagagcaactggccctggagccaggtgttggtgggcagccaccctcgggcctgctcggccagcttgttcagctcgtagaagctggagcgggacgcggcggtgttgcccggcgacgtgcccggaggcacggtgcagttgtggtcgccgttcaccccgcccaggttgaggttgcccgtggtggagctgacgttgatggcgccgcacgagtcgctgatgcgcacgtacttgcccgccaacgtggtggtgacggtgccggaactgtagttgacgatgcccgcgccgtccgtgaagttgttgggcgccggcaggcccgtgttggcccagggcatgggcgagttgggctgcatggtgccgcacgtctcgttggaggtgcaggattcgatgttggtggacggatagatgccgcccttaatctgcgcgtcgaagtagtggttgtcgtcctccacggcgagcacctcgcccgtctgggcgtccaccgtcgtcttccagcgctcgttgccgccggcctcggagaagccgtaggtgtacacgagccggtgctcgtagccggtgccgacggcgccgttgaaggactcacccgagagcgccacgggggcgatctccagcgtgggctgctgccacagcgtctggggactggtgttcagccccacgaagccgttgccggacaccagcgcgtcctgcggggccagccgggggcgggtgtcgatgcgcacgttggcccaggcctcggtgccgatgaggatgaggttgccgtggctgatggtggccgcgatgcgcccgtggcgcacggggacgccgttgacctgctgggagatgtggacctggatgaggtcgtcgttgatgcgcgtcacccgggggttgcccatctgcatcaggtcgacgttgaacgcggcctggttgtccgcgatgaacttgaagatgaggtcaccgacggcggcctcgtccacgttcgcgatggagcggccaatggactcacggacctcgtccatggtgaccttgttgttgaagccgtcacccgggatgaggggaatggtgccttgcaccgcggtgggcgttcccgtgcgcgggtcgatgtagacgttgaactcgcgcccattgcgcttgaagaagtcgtcccacgcgtcggcgccgagcgagttcatctgctggcgggcctgctgcaactgcatgttctggatgggcaggtacagctctggtttgaagaaagccttgtcggcgacggcgctctgtcccttgtcaggtggcttgaaggcccaggcggaggtggataggagcaggacaagacatgctgctgacacccgtgtgtggcgcatgcgtttctcctctgcggacccgcggaggcacatgccctcgcggtggctcctgcacggagcacgtcaacggccataccgggtgtgaaattaaatctgaatacgtgggattccgttcgctattcccgaagaaagttttgtaagaataacgggacttagaagtgttcactggtggtgtgcctggcattcgaactgccgcgcacgaaccgggctgtcatcccacggggttgtagtttttccacgagggcgcgaatcgccttcagtccggccagatgcgcacccagtcatcctggatgagcttgccgctggcgcggtcggtgctcccgctggccatgaagcgccggggcgcggtcagcgcgagcacaccggcctccacccagaagaagagcaacgcggcggcggcgacggcgggcagccgcgtggcccaccgctgtgtggaggcgcgtgtggcgagcaccacgagcggaagcaacagcaatgggatgagcgcgggaaagacagcgagcaggccgcgcgtgtagccgaagaaggcgacggtgatgagggcccggtgcagcagcaccgcggtgaagagcgcgaagccgcgccacgcgggccgcaaggacagcgcggcgcccgcgagcagcagcagggtgagcggccacttcagccacgcgctctccggcacgaagacgtccacgggggcccgggcgccgttcagtcccgcgggcaggttggaggcccccaaacccagccggaagccgtccagccagcggtccagcttggccagccacagacgcgccgcgtccgccgggtaatcccgcatccacgcgagcccctccgcgtacccgtgcagcaacaggtggcgctgggcggagttggccacgtccaggaagccctcctggcccatctggttgacgctgtcgggcgtgaagcccccggtggccgtggcgtggttggccatggcgaagttgatggggccgtacacggtgacgggggccagcacgggcagcggctccaggtgcggcgtccgggcgttgagttcgcgcagcacgcgcgcgttgtggattgcccagggggccagcacgacggcggtgacgagcagggccgcgccccaacgtagggccagtgtccgcgggggcatgccgcctcggtagagccaggcccaggcgaggaggaagggccagaggtacaggtgttcggcgcgggtgagcgagcccaggcccatgacggcgcccagcagcacggcgcccatccacgtggggcccgcgcggtgctggagcatcagcgcgcaggtggccgagaggaagaggacatagagcacttcgttgctgtacgtggtggacagcaccagccagccgaagctgcacgcgaagagggcggcgcccagcaggctccagccggtgcccagcaccttgcgccaccaccaccccgtgaaggcgaccgtgcccgcgttcagcagtgccagcgcgagcttgtacggataggcgctgccctgcggcgggcccagcacgcggtagagcagccccaggagccaggggaacaggggcgggtggtagggcagggttgcgggcccggtgtgcccccgcgcgaggtcggcggcgtaggcgtggaagaagcgcgcgtcgccgtagaagaagatggagaagggccaggtccggtcaggcgacgcctgcaggtagagccagcgcagcagcaggctgaggctgaaggtcgcggcggcgcccagggccaccgggtgccgccgacacagctcgctcacagcggtgaagcgcctgcgcatgccaccccccggacgcgttgcccgccaccttagccaggcgcgagcgcggcggccaggcggcgctcagctccgcaggggcggcttgccctggtgtgccaccagcaggtcatgcatgtcgttggcgtgctcctcctccttggcgaggatgtcctccatcatccggcgcgtcgtcgggtcatggttggcgaagtagcgcaccatctcctggtacgtctggatggcgatgcgctcggcgatgaggttctccttgatcatgtccaccaggttctgcccttcggcgtattggctggcgctgcgggacagcagtccttcggggttgaagtccgccttgccaccgagctggttgatgcgctcggcgatgcgaagcgcgtgctgctgctcctcgcgggcgtgcgttccaaactcgtccttcacggactcgctctggatgcccaccgcggcgacgtagtggtaggtgtagcgcagcacgcagacgatttccgtcgccagtgcgtcgttgagcagcttgatggtggcgttgacgtcgccctcgtagtcttcggtgatggcgccttcctccaggtgctcccgggctcggcggcgaatctcggtgatatccgtgaggaagggctgctggacttcggccatggtggtccccctgttctgggcctcgcgcaaaggtaggacgggcggggcgcgtggaatccacccacgggaggaacggtccgccaccacgccccgggggcggacgagggcgcggggacttcttccgagctttcagaaaaacgacgaactttcacgcgtcggtggcaggctgcacgcattcgtttcctagactcggccgccgcggcaatcgcccgcccggtctgtcttgacgcccggcatggagggaagtgtgtcccacgcaggtgagcaggccatcctggccattgacctcgggacgtccgccgtcaaggtggcggccgtcacgctgaggggacggattctgggcggtgacgtggagccgctggagctggccctgctcccggatgggggcgccgagcagcagccggaggcgtggtggcgcgccatcgtcctggcgacgcggcgcctgctggcctctggggccgtgcgcgcggaggacgtcatcggcgtcaactgcagctcgcagtggtccggcaccgtcgcggtggacgcgtccggcacgcccgtgtgccccgcgctcatctggatggactcacgcggcgcgccggacgtgaagcgcgcggtgggcggcttcctctccgtggagggctacgacgtccgccgcctgatgacgtggattcgcctgtcgggcggagtgcccagcctgtcgggcaaggacccggtgggccacatcctctacctgcggcgcgagcgcccggacgtgtaccggcggacgtacaagttcctggagccgaaggactggctcaacctgaagctgagtggccgctgcgccgcctcgtatgactccatcaccctgcactgggtgacggacaaccgcgcgctgggccgcatcgcctatgacgaccggctgctgaagatggcggggctcgagcgggagaagctcccggacctggtccccgcctccacggtgctggggccgctccaggcgcaggccgcgagcgagctgggcctgcgcgaggacgttcaggtggtgacgggcgcgccggacatcctcgccgccgccgtggggtctggcgcggtgggagacttcgagccccacctgtgcgtagggacctcgtcgtggctgtgctgccacgtgccctacaagaagacggacctcttccaccagatggcgtccgtgccgtccgccctgcccgggcgctacctgctggccaacgaacaggagtccgccggcatctgcctcaccttcctcaaggacaacatcctgtatggccgggatgcgggggcgggcacggacggtgacgcgccggacctctaccgggtgatggaggcgcaggcgggcaacgtccccgcgggcagcgaccagctcatcttcctgccctggctcaacggcgagcgcagcccggtggacgacaagtcactgcgcggcggcttcttcaaccagtccctgaagacgacgcgggcgcatatggtccgggcggtgatggagggcgtggcctacaactcgcgctggctcttcacctatgtggagcagttcgtgggccggcggttggactcgctgcgaatcatcggcggcggggcacgctccgcgctgtggtgccagattcacgcggacgtgctgggccgcgcggtgcagcaggtggatgagccggtgctcgccaacgcacgaggcgccgcgttccaggccgcggtggcgctggggcggctgacggtggaggagattccctcgctcgtgccggtcgcccgcacctttcatccggattcgaagaacgcggcgctctacgacgagctgtttcgcgagttcgtcaacatctacaaacacaacaaggccatcttcgcgcggctcaatcgagcgcgaagcgcctgaacccccaggagttcgccatggcacttccagacctgaaggcgctgagcctgctcaaccacgtcccgccgaggctgctatccgcggcggagcgctacctcaaggctgttccgggtgtgaagggcctgctcaaccgggagacgggctcgctgctgtccgaactggagagcggcctcaagccctaccgcgggaagatgcagtcgttcgaccacctgccgccgacggggcgctcgcgcgaggacgtgctgcgtgagctccaggccctggagtcgcaggaggagtaccgctggcgggagggccgcgtgtccggaggcgtgtacaacggcgacgcggagcacatcgcgttcctcaaccgcgtctatgcgctgcattcgcagagcaacccgctgcacgccgacctgtggcccagcgccaccaagttcgaggcggaggtggtggcgatgacggccagcatgctcggcgcggacgtggcgaacgcgggccagccggaggaggcgcgcatctgcggggccatgtcgtccggtggcaccgagagcatcatgctggcgatgaagacgtaccgggactgggcccgggagaccaagggcatcaccaggccggagatggtggcgcccgccagcgcgcacccggccttcgacaaggcggcgcactacttcggcatcaagatggtgcgggtgccggtgggcccggactaccgtgcggacgtggccgccatgcgcaaggccatcaaccgcaacaccatcgtcctcatcggctcggcgcccggctttccgcacggtgtcatcgaccccatcgaggcgctgtccgagatcgcgcgcaagaagcgcatcggcttccacaccgacgcgtgcctgggcggcttcgtgctgcccttcgccatgaagctgggctacgacgtgccgcccttcgacttccggctgccgggcgtgacgtccatgtccgtggacacgcacaagttcggctatgcggccaagggctcctcggtggtgttgtaccggggcacggagctgcgctcgcaccagtacttcacggcgacggactggccgggtggcatctacttctcgcccaccttctccggcagccggcccggggcgctcatcgcctcggcgtgggccgcgctggtgagcacgggggagcagggctacctggacgccacccggagcatcctggagacggcggcggccatcaagaagggcatccgggacatcccggagctgcacgtgctgggggacccgctgttcgtcatcgccttcggttcggagtccgtggacatcttccaggtgatggagcggatgagcgagcacgggtggaacctcaacggcctgcacaaaccgtccgccgtccacctgtgcgtcacgctgcgccacacgcagcccggcgtcgcggagcagttcctggtcgacctgcgcgacgccgtggactacgtgaagtcccaccccagcgcgaaggggacgatggcgcccgtgtacggcatggcggcctccgtgcccttccgcggtctggtgagcgacctgctcaagaagtacatggacctgctctacaaggtgtaacggcgcgggtcctacagcgaccggctggcgatttccgccagctctgcgtcggtgagcaccagggggttggccttcatgctgctggcctccttggccttcgccaccagcgctggtacctgggcctccgtcagcccgtagcgtcccagccccggtacgcccagcgccgcgcgaagttcgtccacccacgtgacggcgtcctcggcccttgcatccacccgccccgtcagcagcgccgccaactcctgcacccggggcagtgatggatgcgttggcgcacgggcccgcagcgcgcgcaggttgacgtccaacaccgctggcagcaatgccgcgcacaccgcgccgtggggcgcgtcgaacatgccacccaggggcgcggcgaagccgtgcaccgcgcccaggcccgcattggccagacacagaccgccgaagagactggccagggccaggtcctcgcgggcgggcgcatccggaccgtccagcaccgcgcgccgcagcgagcgggccgaccttcgcaggccctcgcgtgccagcgcgtccgtcagcgggttggcgcgcgcggagaggtagggctcgatgagctgcgacagcgcgtccatgccactggatgcaagcacggcggccggtgcccccgtgagcaggtccgggtccaccagcgccacgcgcggcagcatgtgtggactgcgcaggctggccttcgccttcgcgtccttcgagcccagcaccgcgttgcgcgtcacctcggagcccgtgccggccgtggtggggatggccatgaagggcagggacgggcgggtgagcggctggccccggccaatgacttccaggtagtccagcgggtcgcccccgttggcggcgagcgctgcaatggccttgcccgcgtccaacgcgctgcctccgcccagggccaccaccacatcacagcccgcttccgcgacgcgcgcggtgccttcacgagcacgctccacggtgggctcgccgtccacggagaagacagtcacccccaggcccaggcgctccaatgcgtcgtggaggggccgtgcgcgggagggattcgcgccggtgacgagcagcacccgggagcccccgaggccgcgaatgatttcgggtgcctcggccaggcggcccgggccgaagacgacgcgggtggcggtggcgaactcgaacgaggaagaagcgctcacgtccgtcaccacccggcgtcttcagggaagcggttgacgaacttccggctggtgcggggctctgacatcatcggagccacggtgtcgcgccatgtgaggtagtgcgccgtctccttgtgcgcggcgggggcctgcggcgtccggtacgcctccaccagcacgaagcgcgtggggtcctcggcgtcctgcaggacgtcgaaacgggcaatgccaggctccttcacgctttctcgcgcattggcgagcgtggcctggtggaaggcgtccacgtgctcctgcttgacgtggacctggacgtgaacgacgaggagactgtgggacatgccccggaaactactccgggccggggccgcgtggggacgcgacctccggcccgggagggggcaggggtgttggctgcccgtcagtcgctacggggccttgaggaccgccgtcgggctgatgacgtcttccagcttgcgggccatggtccacccgtcgtggtagacgatgcccacggggctgatggtgtcattccggtacaggccgaccttcaggtagttgagctgacccttgtactgcgtggcgatgtagcgcttgggcagcaccaccttgccgttcaggtacagctccacgaagcccaccttggagtccggcgaccacttcacgtggaagatgaagtccagccagcggccgcgaaccagcggcgtgcgccagacgatggtgcccgggttgccgccgatgttgaggcgaatctcctcgccgtagacgtagaactccaccgggggcgaaccggagttgccctcgtggtgccactgggtgaagagttgccacgtcttcgcgctggggaagctcgagtcgaacatggtgctgaagcggtagtagtactcggagcccgtggcctcgcgcgtcatgcgcaccagctcgttgcggttgccgctggagttgatggggtcgtcgcccttgcgcacggtggccttgagggcgtagcggccctgccgcgcgggggagctcaccagcgccagccggtccgcgctcaccatctgcgtgtggctccactgggagcggctgttggtctcgaagtcaccgacccacaccacgctggcgccggtgcccgggggcggctgctccggcgtgggatccggattcggggtggggtcggtgggagtcgacgtcgtggacgagcaggcacgcgcctcggcgatgctggcccattcattgacgttgttgctctggaaggtgatgcgaacccggcgggtgttgacggccttgaagctgtacgtctccgcggcggcggtggtgccgctgctcttgcccgaatagacctgtgtataggtatagccatccggtgaaacagagacgaggaactcattcgtgcgggtattgccctggtgccacgcgacggagaccccggcgacctgctggatggagcccaggtcatagtcaacccaagagccccggccgctccggctccagcgcgtgcccaggttgtcgtccatggtattggctgcgacgttcccgtcgtcgccgttggaaatcaccgaccgggccgtcagtgcggtgcacccgggggtggtcaacgccgcggcgctgaccgcggagttgtcgagggcatcgaattcgatgggggacgcaccggcttcagatgaaacatcatcttcaggggcaccgcagccagtgctgctcataccgagcagcgttccaaccagcaggagggtcttcttcatgtggggggatctctgggaactaaagacagacgagggggagtccgcgccgtggagggacgggcggggagggtgcttggctttgctaggtgggcttctccaaggtcacggcgggtcgctgccgtgtcgagctctcaacgagcatccatcaaaagtatttcgtattcaacatgcgattcacgcctgcttgctctccaggcgccagtcggggcgtaccttgtttctgtttcatttggtgtgattggaattgtttgtcattgtgcgatgcgggcgctgaaaacgcgctgcgcgtgaggctttcgatgcactgcgggcctgggctggcgccggagtgcactgcgacgcgagtcgggggtgtgcggtggggagcgaacagtcccacatccctggcggccggaggcgcgaggtgcatgccggcgctacaacacccccggtcgtaccggcgacgcgaaggaccggcgctcgactcacacagcgtcatccttcagggaggtgaccatgaacccggcttcgggctcgtgcgttgcgtgtggggcgcgtttcctgggaggcgtactggcgtgtccgcggagcgcggcgggggtaccccgggacgcgccggtccgccgatgggcgccagggctgtgccacccgccgctggtgggccggatcgcggtgctgaagcggctgatggggctggcggaggatgtgcggcgcgggctgggacgggcggtgtggttgatgggggaggcggggatgggcaagacgcgcatcaaggacgccttcgtggagcgcctggcctcggatggcttcgaagtctgggagggcagtggcctggcgctgccgggcgcaccggcgggcatcttccgggagctgctggacgccacgcgggcgctcagcccgccggccgggacgggccgcgtgtccagcgcggacgcggagcgaatccagcgcttcctggaaggccgcgagcgccagggcattccggcgagcctcgcctccgagcgcaccgccctcttcgactccctgtgccacgcgctgatgccccaccgccgtccgcgcctgttggtgctggaggactggcagcatggggacgcgctcagccatgcgctggtggaggagctggtgtcgcggctgtcgcacacgccgctgctgttgctggcgctccagcgccccagtggcacggcgcccgcgcctcttacggcggaagtcctgacggtggggcggctggggcccgccgagtccgcggcgctgctggagggccggctgcggaaccgggggacactgacgcccgcggcccgggtggcgctgctgcgcggcagtgccggacacccgctgcacctgctgcacgcggtgaccctgcacgaggagcagccggagcgggaggtgccactcacgggcgaggcggcacatgcgggcgcggcaggccttgctgcccccggcacagcgggaggtgctccgggcggcgtcggtgctgggcccgtcgtttccccgggcggtgctggtggcgttggcgggtggggtagggccgctggcgctgctggagacggggggctggctgcgctccgtcgcgggaggccggtacacgtgggcggtggagcccgccccgggcgtcgacgaactgccggaggcggagttgcccgcggcgcaccggcgggcagcggaagcctatgaggcccttccggagccgctgcgtcaacgcgcctgtatggagttgacaaggcaatggctgtcagcagaggagtcctcccgggcactgccttatctggtatcactggcaggctggaacctggcggcattggagccggggcccgccatggctgtgtatcgcttcgcgttgggactggcggatgctctcaagccagacgccgcgcgggagtggcagcgccgcctctgggaatacatgggcgacgcgcaccggctggcgggcgagcccgcggaagcggacgccgcgtggcatacggcgcggacgttggatgatgaggggttggcgtctcccgcgggggaccgggcccggcgtctgttcaagcgggcgtcggtggtgctcgcgctcggcaggtacgaggaggtgctggggctcgacagggaggggcgccgggattgtctgtccgcggcgccgctgttgtccgtgtcgctggacgcgctctccgcgttggcgctgtccgcgctggggcggttcgaggaggcgcgcgcgaggattgtcctggcccgcgagcagttgcagcgggcggtccgggatgacggccccgcgtgggcgggcgtggaggcgctgctccaccgggccatgggcagcgcgcagctcgggctgggattcccggaggccgcggcgtccgaatacgcccaggtcctgcgctggagcgagcgcgcgggggatacgtgggagcactccaccgcgctgctgaacctgggcgatgcgtattcgcgggcaggagacagggagcgcgcggcgcacttcttccagctcgcgctcgagctggactcccgcacgggagaccgccggggcatggcctacacgcaccatggcctggcgctgctgcatacgcgcgcgggcgcgcccgagctggc

SEQ ID NO: 1245 - DNA, 23951 bp, Myxococcus xanthus
ctgcccgttcagctcttcaccctgcaggctttcggctacagcagcgtggtgcacctggaggtcagcgaggcgcgcgaggagtccggcctggtgctgatgccggtgccccgggagctcgttcgttaccgccaccgctggctgcggcgcgcgccgccgagccgtgcctgcacgctgtccttcgaccatccgctgtggccgcaggtgcacgtgcggcgtcaggtgttggacctgtcctatgagggcatcgccttcctgacggagcccggcgaggacctgctgtacccgggcctgcgccagccggtgctggaggtcgcgacggaaggaatggcgccggtgcggctgcgcgccgaggtgcgcaacatctccagcaccgcggcgggccgccgctgcggcatgtccgtgcgtcccctggatgcggcgggcgcgcaggcctggcgcgcgctggtggaggcgcagatgcacccggccacccaggtggagggtgactggggtgatgccacctggaagctcttcgacggctcgggttacttccggctgccgggcaagtcgccggaggacttcgaggacgcgcaccccagcttcgacgccacgctggcgcggctggagggccggacgcggctgggctaccgggtcgtgcacccggaggggcagtccgtgggcgccacgctgtcggtggtgaagccgtacgaaggcagctggatggcgcaccaactggcgcgtcagccggtgaagggcagccgcacgtcggcgcgcgaggcgctgcgtgacatctacctgcgcggctacgagcccacgcaggtggacccggaggtgaagtggttcttcgccttctgcgaggcgcgcgtgcgctgggtgcgcttcaccaagttcgacttcgccacctggtacgagcacacgggccagacgtgcctggtgcccttccagctgatggaggcggaggtggacggggcctgggaaatccccgcgggcatcgaggtgggcacgcccaccgaggccgagcgcgcggccttcttccagcaggtggagcgcacgcgcccgctggcctaccgcgaggcgctggacctggtgccggagcgcttcgacctcaagcgcgccaaggagcgctggggcgaggcggggatggggcgcgagcgcgagctggtggtcgcgcggcacgagggccgccccgtcgtcctggcggtgctggagacggcgcagccgggcctcaacctcttcaacgtgctggacggcgtgcggctggtgccgctggtggacgacgcgacgaaggaggcccaggacgccatggtggcgctgctggcccacgcggcggactggtaccgcgcgcgcgagcgcaaggtgttcatccactacgtggaagcggcctgcgtggagtacgtggagcgcgcgtcgctcgcggacctgggcgaaggcaagctgtgggtcatctccgccagcctgctgcccgagtttctcgagcacctccacgaggccaccacgcccccggcgggggcgtagtcgcggggacgggggctcagccctcgtcttcgtccgggtccgggtaggactccagctcgtcgtcttcctcggcggcgtgcgcggggccgcgcttcttgcccttggtgtcgcccccgccgacgtcgaagtccgccgccaccacgtaccactggcggccctgctggatgcggcgcagcagcccttgctgctccagcgcggccagcagccgggcgaaggtggagaagccgtgctcgcgctcgtcgaagtcgggctccttgcggacgatggcttccttgatgagcgacgggttcaccggcccggtggcgcgcgccagcatgctctgcaccacctcgcgggcgatgtccggcacctccgtcttcggctgggacttgccgccaccctgcggtgtcttctccttgtctccccggcccttctcgtcgcgcccctggcggccgccacgcttgccgtgtcccgcctcctcggcggacacgctctgccggcccttctccttgtcgcccttgtcggagcgtgactggcgcgggcgcaggtagatgaattcgtcgcaggccttcacgaagagcggcgacgtggactccttcactgcgagcccgatgacggtgcgcccgttctcacgcagcttgtaggccagcgggcagaagtcgctgtccccggagccgatgacgaaggtatcgatgctctcgcgcgcgtagcacagctccagcgcgtcgatgaccaggcgcatgtccgcgccattcttgccggcgcgcgtggagggcggcacgtcgatgagctccacgccgaactcgtgcagccggattttggcctcggcgaagcgggaccagtcgcagtaggcgcggcggaagacgaccttgcccttctccagcagccggtcgagcgagggctgcaggtcgaagctcgcggagctgatgcccgtgttggtgacgaggttctcgaaatcgatgaagagggcgatgcggtgctcagcgttgcgaccgttcacgtgcggcctctgcgtgttgccgccatgagggcggcgggaaaggggtccgtgcaggacggcgcaccctaacctgaatcgctccaggagagaggatgcacccggtgaggaccggctgaatattggacggtcctccctggaggaccgggcccctcccgcgcggaccacgacggcgcaagggatgccgatgtgtcattgaatgttactcagggataaagcttgacgcaatgatagtgaattgggcagggttgaaaccaggcgcttgtatggaccagggggaagccgcgtcgtcaacgtcacttcaggcttcaaagacacaccatgctcgatacgaaaaacgtgatgcgcatcacctgtctggtgttgctgggtgcactggggggctgcacgcaagcctcctctggggacgcgacgtccacggtccgttgggggaatggaggcaggtgggcggcgggcgccatgacggacgccgtcgtcggagctcccgtgggcgccacggtcagcgccgtggtggggacgacgaccctggctgccggtgcctactgcgaggcgtctcctgccgcctgctccgaagtcccccggtcagtcctgtccctgagccccacgatgctgccgggggcccgttggatgctggccgcggagcacacgaaggggaagcggtcgtccacctgggacaagcacacgaagacgcgctcgggcggcaaggagaagaaggacgaccgcatgcgcttcagccacggcgcggacgacagcaacaaggagaagaaggaagaagcgaagcggaagaaggaggaagagaagcgacagaaagaagaagcgcggctgaagaaggaggaggagcggatcaagagggaagaggaccggcggaagaaagagtccgcgaagaaatgagtcaggggggcctcgtgaagaaaagacaagacacgctcagtgacgctgaaaaacgccgtatcagcaagcgaatcgacgcgctcttctccgcgcagcagtggagtgagttggatcaactcatctccgagtccctgcaaggcacttccgacgaccactggctgcacgtccgtcaggcggatgcctggtacgagcagaggaagtactccaaggcgtcacgcctctacctgaaagtgctcgaaagcgtgccgcgttgcccgctggggcggtgggggctggcgaacgcgctcatggcgcgcgggaacgcggacgacgcccggaagctcttcctgtccctggcccggcagaagccggaggtgatgggcactcgcgagtgtggtgaaggcgtccggtgggcacggggcctcatcgcggatgcgaacttccggttgggccagctggaggaacgggcgggcgcgagggccgcggcccggcgccgctaccaggtctacctgcgaatcctgcagcgcccggcgctctcccttgagagccggcgggaggcgaacacccgccttcgcgccttgagtctcaaggggcgggccgacggttgagggcctggcccgtccgcctgcctggaacccgcgcgtcggcttcggacctggccagcaggtccgctcgtgggcccggcgcgccgcatggcgcacggcccttggtgcaacggaacgttcagtccacagggctggggcctcgggtcagggcctagcttgtcggcaacggggggctcacggcccctccaggaggaggacccatgaaacgaatgcacgctgggaactggagggccgccgccgtggcggcgctgatggtaccggtggctgtcctggcccgtgaacccgtcaacatcccgaatgacggctccggcgctggcaatgtgcccagacaggagggccgggaccggaacttcaccaacttcggcgcgaccatgtccattgatcgctccagcagtggcagtcagcgcaacctgcgcgtgggccctcaggccaatggcgtgggcatgcccatccgcgaggtgacgccggaccaggaggagatgaagcgcctgtccggcaaggtgctgaagctcaacgggcagatgctctacctggagacggagcccggcgccgtggtgcccctggacctgagcgcgctgcgcatccgcaagcagccggagaagggccagcatgtggtggccgtctaccaggtggagaacaccacggagaacgtggcgctggcgctcgccggcgaggtgcagccgaaggactgacgcgcttcagtcctccgggtggagttggacgagcgagggcagttccgctgccctcgcccggagccgcggcttgggccggatggctaccggcacgcgggaggccgccagcaactccaggtcgaacacgttgtccccgaaggcggcgtagagcggctgggacgtgcgcgagcgcaggcaatgcaccttcccggccgcgtagggaatgggctcgatgatgccggccagcaccgtcccatcctccgtgcgcggcgtgcaggccagcacattcaaggggtccagccccacttcatgaacggcggcctccacgacggcgagcggcgaggcgctgaccacgtagcaggggatgccctggccgcgggcccactcgacgacgcggcggctctccgggtggatgcgctgtttgactgcgtggcgggccaccacgtccttcgcgaaggcgcgcaccgcgtccacgcgccaaccggcgaagagccacgccaccatctcgtagatgtccttctccggaatccgccccgcctcgaaggcggcgaagagctggtgtgccagctcgcgcgcgggcaggcttttctcgaagccatgtgcggtggccagccgctccagggcggcgtgcgcttccgggcggatgtcgccgtgctccagcagggccaggaacaggtcgtctccgacgtctccgctccacagcgtgccatcgccgtcgaaggccagcaccccgccgggggcacgctcggcctccaaccggatgcgctccagcgtctcctctacacgctccatcttcatgggtgcgcatcctcccccggcctcgagcccacgtcacccgagctgtgttccatcgtcatcacttcgcggcgcccgcctgtgcctcgtccaggaggctcaggtccaccagcccgtcgatgttggcgtcggtgatgaagcccagcgtcttcgcgtgctcggccgcggtggcgagcgcctgcggcaccgggtccaggctgggctccagccgggagaaggcctgctggaggatgccggcgggcaggggcttgctcgtgaggcggccgaaggcgacgttggccgcggtggtgaagccggccgggtcctcctgccagcgctcggtgagtcgcacgtgcgcgcgcagcagggcgaccacgcgcgggcgctgcgtctccagcacctgtcgtgtcgtcaccagcaccgtggtgggaaagcgcccaccgggccacaagtccttctcattcaccaggatgcggcccttgccctcggccaccaggcgcgcgccccagggctccggcacccaggcgccctcaatgccgccgcgcaggaactggcccaggatgtccgggttgctcagcgggaagatctgcacgtccccggtgccgtccaggtgcgtcgtcagcccttgctgcttgagccagtagcgcagggcgatgtcctgcgtgttgcccagctgcggcgacgccagcttcttgcccttgagctccgcgggcgtcttcaccgtgcgcaccaccagcaccgcgccgttgttcaccgcgcctgcgatgacgcgcagctcgcgcccggccttgaggaacgtgttgatggccggaccgctgcccacgtaggacacgtccagtgaaccggccaccagcgcctccatggcggcggggcccgcgttgaactgcatcacctccaggcggcccacacccggctgcgaggcgaacgtgccctccgcgttgcccaccagggcctgggcgtgggtgatgttggggaagaagcccaggcgcagcggcgcgtccgggccgcgcgcggcggactcgcgcttgcagcccgcgccgagcaccgccagtccagcgaccacgacaggcaacagggagtggaagacacgcatggccgctgaaggtgtgacgcggcggcgggatttcaacgcccgccgaatccaagcgtcaggcgccacacggccgtgggcctcacgtcgtcgccgtcagcccccaccgccgccgcagccgcacctccaccgtctggaagaggacacggtccaccgcggtgccgatgatgacgatggccaccatgacggccatgacctggggcacgtccatcaactcgcggcccaccgtgagcaactgccccaggccgccggagacgaagagcagctcaccggccagcagcgcgcgccaggcgaagctccatcccagcttcaggccggtgacgatgccgggcagggccgcgggtagcagcacgccgaactggaagcgcaggcctcgcacgcccagggtgctggccacgcgggtgagctgcgggtccacgccgttgacgctgtcctcggtggcgatggcgatacccagcacgctgcccatgacgacgacgaagaggatggcgccgtccgtcagcccgaaccacagcagcgccagcggcagccagcagatggacggcagcgcctggagccccatcaccaccggcttcaccgcgttgcggaagaaggggatgcgggaaatcagcaggcccagggggacacccagggccactgacatcaggtaggcgcgcagcagccgccccagggagcgccccgccgcgcccaccagtcgcccgtcggtgaccatggccaccaggctctgggccaccgtcaggggccggggcaggaggtggggagaccagatgcccatccgggccaccagctcccagaggccaatcagcaacgcaatcaccagcagcttctgggcatggtgtttcatgacgcacctctacgggccgggaatcacctgcggacggagcacgggctgggcgggggcccgggtgggcgctggctggagcgagcgtgtgtgggcgcggccctccacctcacgcagcaggccgccgacgtgccgcaccatttcattgagcgccgcgtcctccggctggcgcggcatgggcaggtggacttccaaatcccgcaccacgcgtcccggccggggcgccatcagcaccacgcgggtgcccagcatcagcgcttcatggacgtcatgggtgacgaacaccaccgtcttgcctgtgcgcacccagatggactggaggagctcctgcatgtggatgcgcgtctgcgcgtccagcgaaccgaagggctcgtccatcagcagcacggccgggtccaccgccagcgcccgggcgagcgaggcccgcatcttcatgccgccggagagttggtggggcagcgcgtcctcgaagccgcccaactgcacgcgccggatataggtgtccgcccgctcgcggcgctcggcgcggggcacgccccgggcggccagcgcgaaggtgatgttgccgcgcacggtgagccacgggaacagggcggcctcctggaacatcagcagccggtccggcccgggcccgtggatgggatgccggtcgatggacaccgagccccccgtgggcaccacgtgccccgccagcgcgtagagcagcgtggacttgccgcagccggacgggcccagcaggcacacgaattcgcccgagcggacgttgaggtccacgttctgcaaggcgaccaccttgttggcgtactcgtggtccaaccgggcaacactgattttcgcgcgctccgcaccgacatgcgccggctggagcaggcgcagggaacttctccatcggcctaggagggcgcgcagcatccaccacaaactaggcacgtaggtgcaagtgggaagggggagcaggcaaagggcccgttgagggcttcatggcctgctcgcctgctttgcgcgcggagaggggctcgtggcccgcggcctttgtcccacccagtagaacctggtgacgcttcagacgcgtgttttcatcgcctgcccgtctgtcttagacatgggggcatgctggaggacgacgggattatcaagctgatgcggggcgttctggcgacctactcggacaagagccgcttcggcgccgccgggctgatgctcctgctgggcctgggcgtgctgctgggggcgggcagcctggccctctccgccgagcccctcatcgacgacgagtggctggcgtggcccgtgggattgctggcccccttcgtcgtgggcgccgtcgtggccggcttccagaaggtgaagctgtgggactggaagttccggttcgacctggagcgcttcggcgcggccttctgcgtcacgacgggcttcgtgctggcccgcttcgtcggcgtcccgctgctcgccgggggctgaggcgaaggcccttcgtcccggggggctcaggcggcgcggctcgccccttcggtgcgcaggtgcgtccgggttcgcaagcccagccacgtagcgaagacgagcagcagcatgcccacgccgctgaaggcgccgcccacgcgcagggaggcgttgcggtcatcccggacgaactccaccgtctttccgccggggttcgcgaaggccgcctccaactgcgccttcacgcgcgtggcttccgcttcctcggtggcccactggaagaagagggggtactcgccgtgcaccgtcaccagcgtgggccggaagatgggcacgcggttgcggcgggcggcgcgggtccggtccaccttgacgccctgcacatccttcatcgcgaagctggccacttcgtcgcgggtgagccagctggaatggaacagcaggcacacgccgccgggctggcaccgcagctccacgcgggcctgggcgttgagcaggtaggggcccagcacgaggaagggcagggcgagcagcacgcacgccgccgcggcaatggccgtggtgcggctgcggcgcggctcgccattggagtaggaggactggggctcgctcacacctctcctcatagacccgggcgggccgggtgggcagcggtttcgtgcatgcacagcgttgacccctgggcaacgtgggagcgggcgctgttcaccagcgggcccgtgccgccacgggtccgtgtctgagcgggcagccgtacctggcaggcatcaccgtgtcctggtccgcgtctggccgcatgccgggacgtgtatcgcaaggagcccgtatgaaggccgtggccgtcttcccccagaagcgcgaggtgcgtgtcatcaccgacgcccccgagccccgcatccagtcccccacgcaggtgaaggtgcggacgcgggaaatcggggtgtgtggcacggacaaggaaatcatcgagttcgtctacggctccccgccgccgggctcggaccacctcatcctgggccacgagtgtctgggcgaggtggtggaggtgggcgaggccgtccggggtctgagccgcggggactgggtggtgccccgcgtgcgccggccgtgcccgcatgccacctgtccgccgtgccgcgggggccatccggacttctgcatcaccggcgattacaccgagcggggaatcaagggcgcccacggcttcggcgccgagtccttcgtggaggacgtggcctacctgcaccgggtgcccgcggagctgcgcgaggtggcggtgctcaccgagccgctcaccatcgcggagaaggccctccgccaactggagcgcttccaggaccggctgccctggagggcgggcccgggccgcgcggtggtgctgggtgcggggccggtggggttgctgggcgccatggcgctggcccgccggggttatgccaccacggtgtattcgcgcagccccaagcccaacgtgaaggccgaggcatcggaggcgatgggggtgccctacatctcctcgaaggaggtgcggccagaggagctggtccgcagggtcggcgccgcggacgtcatctacgaggccgcgggcgtggcgaaggcggcgctggagacgctgaaggcgctgggccccaacggcgtctgcatcctcacgggtgtgccgtcgaaggaggagcccttcgacgtgtcaccggtgctcaaggacgtggtgctgggcaaccaggtgctggtgggcacggtgaacgcggcggatgtcgacttcgacatggcgctggaggacttgcggcacttccaggcccgctggcccggggggctggagcggctcatctgcgccaggcactcgcccgaggacttctgcgacgtcgtcactggcaagaagtccggcggcatcaaggacgtcatccgcttcatctgacccttcgaaaaggagtgacgcatggcaacgggaagcggcggtgcctcggtgacgggacagccggtggccatcgaggaccacggcgtcatcggcgacctgcggacggtggcgctggtgggccatgagggcaccatcgactggttttgttttccgcacttcgacagtcccagtgtcttcgccgcgctgttggaccgtgagaagggaggccactggggcgtcgcgccggaacccgacggggtgatgaagcggcagttctactggccggagaccaacgtcctggtgacgcgcttctacacgccggatggcgtgggcgagctggtcgacttcatgcccatgtcgggcaggaaggggatgaaggaggagcgggaaatcctccggcgcgtgcgggtggtgcgcggacagatggtcttccgcatggagtgcttcccggccttcaactacgcgcgggatacgcacgagacgaagctcatccacagcggggccaccttctcctccgacacgctccagctcacgctgtcctcgtcggtgtcgctgaagaagacggagcggggcgtcaccgcgtccttcaccctgcatgagaaccagtccgccgtcttctccctgcacccgggcgcgcgcacgtcctgcgaggcggtggtgcacaaccatgagtcctccgaggagctcttccgggagacggtggagtactggcgccactggctgtcgggctgccagtacacgggccggtggcgggagacggtgcagcgctcggcgctggcgctcaagctgatgaccttcgcgcccacgggcgccatcgtcgcggcgcccacttgcagcctgccggagtcaccgggcggaacgcgcaactgggactatcgcttctgctggctgcgcgacgcggccttcaccgtgtacgcgtttctccgcatcggcttcaagcaggaggcggcggccttcatgcgctgggtggaggcgcgctgcgcggagtacgacgaagggccgctgcccctgatgttcggcatcgacggcaagcgcgtgcccgaggagcaggaactcctgcacctgtcgggctatggcggcgcgcgcccggtgcgcatcggcaacgcggcggcggaccagttgcagctcgacatctacggcgagctgatggattcggtgtacctgtccaacaagtacgcggcccctatctcctatgacttctggcggcacctgcggcggctggtggactgggtgtgtgacaactgggagctgccagacgagggcatctgggaggtgaggggcgggcagcggcagttcgtgtactcgaagctgatgtgctgggtggcggtggaccgggccatccggctggcggacaagcgcagcttcccggcggaccgggcccgctggcacaaggtgcgggacgccatcttcgaggacatcatggacaagggctggaacccggagcggggcgccttcgtccagtactacggcggccacgcgctggacgcggcgaatctgctgatgccgctggtgttcttcctgtccccggtggacccgcgcatgctccagacgttggacgtcatgcgcaagccgccgtcccaaggcgggctcgcgtcggacgggctggtgttccgctacgacgtggaggccacgttggatgggattgccggcagcgagggcaccttcaacctctgcagcttctggctggtggaggcgatgacacgcgccagcgtggcccggcccgacttgctggaggaggcgcggctcatcttcgagcggatgctgggctacgccaaccacgtgggcctgtacgcggagcagacgggcatgtccggcgaggccctgggcaacttcccgcaggcgctcacccacctggcgctcatcagctccgcctacaacctggaccgcacactgggccggcgcgactgaggccgcgtcattcgtcctacacgcccacgaattcggaccaggcgcctggcgtcaccacgccggccaggcggacgctgaggtcatccggccgctggacgatgtccagggcgtcgagcagccgggggtcgtccgcgaagtggcgccgcttgcgctccaccagcagctcgaaatcgtggagcatcatctcccggacgtctcggggcatccgtttcagcgtggcgcgcgcccgctccacccagcccttctccggctcccaggtgtcttgcaccacggcgttccacgcgctcagggccagcgccaggcaggtgaagagctcggcctgcggatcctccgagtcctccacgtcctccaggatgggtttggcgaactcgagcagtgtttcggagaccttcttcgtggggagcgagcgcgtgggcgcgtgggtcgccttgggccgccgggtggccagcgacagcaggtcgagctgtcccacgtagcttcccgtcagcagcggcagggggatttccagccgcacccgaacgtggaggtctccaaccttcagctccacgttcacctcgcgctcctcgggacgtgccagagcgagcgcctgggccaccgccgccgccagcaccagctcctcggcgttgcccaggcgcggtgtgttgtgctggacgcgcatcacgtcggggacgaagggcaggccggtgacgtccttgaccgtcttcaccacccagtccggcgcgtcctccagcgtcacgcccagcgagtccgggatgagcacgtcgacgttgccgcccggcagaccggacatgctcatccgctccacggagccggcccggtcgaagagggcgaagccgaactcgctgcccccactccccatgacggacagctcccgggtgccccgcacggtgccctccagatgcacggtgaagacctcttcgttcgtccagctctcccaaggctccgcgcggatgagcgccgccgtggcgtcaaggagcgcctccgtcacctctggcatcaccatcaagcccggctccaccgaggcccagtgcatctggagggccagcgccgcccggaaccgggtgacggagtcaggaatgggccgcgacgcgaagccgtggccggctccagcacgcgccagccggctttcgcagtaacgcttgagtccggggttgtccctcgccaggccttccaggccctccgcgtcgcgacgcccgaacacgggtggcagcgcctcaccttcggacgtcaccgcgacgtagacggaggtgcgtccgtccacgccgacgtcgatgggacccagcttgaaggcatagagggcccctggctccaactcgggtgctgggggcttccgtcgaggcttccgccgggcggcatcctggaaggcccggcggcgaggaagaggttcaagagagaggtcctcgggaagctcggtggtggtgagctccgcgcggacgggctcgaggcgtgggacctccttcgagctgtacacctgggtcagcgggatgcgttcgtcacgcgacagacccagctccgcgtagaggtcatcccagagcaggtccgcggcgtcggagaggtgagacacctgcgactcccagtccttcagccattcgagcacctgggcgcggccctcggtggagcgcatcaggtcgctggcgctccttccaccccaggcggggattccccgggacagctcctcccgggcccgttgtgcgagcatcaacgcgaatgcgtccgccaactgagggggcgcgtcgtctggcagggcgcgcgcgggctctcctcggacggactgcaccggccccaccgtgtcctcttcgtgctcggcctccgcgcccagcaactcctccagcagggccttgcccttctccagacgctgcgcggagtgggtggtgaggaccagcaccttgccctccaccgtgagggagccccacaccgccgcccgaggaccttcccagttgtagtgaccctcgccctcgcgggtgaagccgtcgtgccggcgcaggtgctcttcgaccttcgccgggtggcggatgcggaagcgcgcggtgcagaggcgcagcggctcgtcctcgaagttgaggagtggccgctcggtggtgagcagctccagcacgcgcgtgaaaagaaagggcgccagccgccgtgcctgcctgcggcggccgggcgcgtcgtcggctggaggctgatgggtggcgaacgcgtgacgcgcggcgacgacgacgtgctcacgcagggggcggggaatcgcgacgatgcctcccaccagctccaggtggtcctcggtgggtatcacccagctcgcaatcaagtcgtagcgggccacctgcgtggtgaggctgcgctccttcacctccagcacctcgtcgagcacgaggtccctcaagcgcagtccttggccgagccgcacctcctccacctcgaacaccgagcaccaggacgcggccagggctgacagcaagccgcgctcggcgcgcgacaggcgttgcccgtccctgaggagctgacggtccgccgcggtgcggccctcggcgtcttcccgtccatggagggtccacgccatcagggtggcgctcatccagggaaaccgctcgtcggcccacgtcgttggaaagtcggcacgagcgctcgcggacagctccggctcggcgttggcgaaggcgcgcagcgacgcgagtccgcgggcgaaggcagtggggctccaggttgccatggatgcaccctatccaccgaggtggcatgcctctaccccatcaggcgggagtgtcgcctcggcggccctgcggccagctccctgcccgggcgagccattccgggcgctgcccccgcaggggaagcgcctgctcgcgctgcacccgcgtccactgccgggactccatctggggcgtgcctccgccgcgcagggccgcctcccaggcgagcgaggggcgccgtctcatgggctcggtctccagggccctgaccagcacctccacggtgagaggtatgcccctcaggaaacgcgcgccttccgtgaagccgccgcgccgccgcgtccaccaggcctccacggcctgggcgtccacctcgccgggaagcacccgggggctggggagccacgcctggaggtcctcggcctcgggttcggcctcctccgcgtcctcctcctcgtcagcgggtgcctccacgaggaaaggaggcaccatggggagtccggtgatggcggcgaaggaggccgcggccagcgggccctgggcctcatcgcgcagcagcggcagcaacgcctcggccgccaggagcctgccactgaagcccaccgcccagatgacctccgccggtgcggagccatccttcaggcgcgcgaggaggcccgtgaggtccttcgactcacccgccacggcgagcgcgaggagcccgccgcgcgacgcggaacctcgggcgtgctcccaggcttcacgcgagcccagcagcaacccggtctccagggcggcggtgctcacggtgggatgggcgtggctcagggcgcgtgacagccgagcatcccctgtctgcatcctgggagcgaagggaagggcacgaagcgcctcggcatgcagcgccgggtcggcctcccagtcgagcttctcgagcgcggcgctcgtgtcgaggtgacggacgcgcgcgacccggagcgctcccgcctggagcgttggctgcaacgtcggcagcttcttcaggagcagggcgtggaggtccggccggtcgagcagctccagcgcgcggaggaggcccggatgcgtctcttcggacccctgctccaactgttggaacacaggctcgcgccagtcggcgtcctcggcggagagcagggcccacgccgcgctggccacacgcgcggggtcctcggaggtcagcgcggggagcagcaagcgggtggcggcggcgctgcctcccaacacgagtgcatccaggtgggcccgcagacgcccttcatcgccctcggccagcgaggacagggtgagctccgggctccagaggccgtgctcccactgcgtccacaggaactcggcttcctcgaggtggcgctccagcagctcccagcgaaccgttggacggggcggcgacaagggcctcacagctccttttcacagacgaggcacttggccttcgtgtcgctcttgccgagcgcgatgaccggcccctggagcagcggtgcgggcggggtgttcttgtcgttgtggagcatgaggtcgaaggtccgcgccacgctcttgccctcgaacttcacgtcgaaggagtagttgacgaactcggccttgcccttcgtcttgccggagacgacgccaccgcccgcggtgcccgcctcgtcgccggtgctggtgctgaagttcgagtcctcgacgcacaccggcttgccatccaccgaaaccttcgtcgtgcccttcgccgtgtccgaggacatggcgacgttggggtagggaatgggcacgggaccggcggggctgggcgtcttgcagacgtccgggaaggcgatggtggtccctccggtgtccttgtggacgacggacaacttgttgacgccaacggtcgcgctcatgcggatggctcctcgtcccgggagtgtatcgctcctggcctcatggcacgagccagggtggtggctcgttgtatcgtgccgtggaaggctgtccctccggtgtaggaggctgtgtcgcgcatgttgggatgggtccaggcgatgggaatggcgtcgtcgctgggtgggctggtgcctgcctcggcggcgttccgtgcgggcatgtcctggccctcggcggcgccggacttcgaggtcttcctgaagggcgacgaggcgccgagccccgtcaccgtgcacgcggcgggagaagccacgctggggttctcgggcgtggggcggctggtggcgctgttggcggaagcgctggtggacctggggacgtgggtggacgtcgcggcgctggggcccggcgtagggctctacctggtgctacccgacccggaggcacggggcttcacgacggggaaggacccctacgaggaagacccggacgacgcacgcgagcgcatcgcgcggctggtggaccggctggtgaaggggacgtggcaggcgctgggatggcctgcgtggaaggggctggtgcgcgcgttccccatggggaacgtggccttcgcccaggcgctggccgcggcgggagaggacctgcgggcgtccaaggtggagcgtgcgctcgtctgcgcggtggacagcttcatctccccggagacgttgacgttgctgcaccagcagcagcgcctgaagaccccgggccggcccacggggttgatggcgggcgaggccgcggtggccttgctgctcacgcgcgaggaaaccgcggagtcctccatggccgtggtgcgggtggcgcagggacgcgacgcggcgccgctggatggggagcagccaccggacgggcaggaactggcgcggcaggtcctcgcggctttggggcccttgggacaggacgcgtccgcgccgttgatggtgtcggaccacgacgggcaatacgcgcgcgccttcgagtgggggatgctccaggtccggctcagggagacggacgcccgcttcgagcaaggcgcggtgtggatgccggccaagagcttcggacacacaggagtggcctcgggagcggtggccacggcgttggtcttccgagggctggcgcgaggctacgcgcccacgtcgtcggtgctggtgctctcctccgcggaagcaggggagcgcgccgtgattcacctcacagctccaggccgttccaaccctcggctacgtagaccttgaagccggtgaggcccgcctggacgaaggcagcgtgcacgtcctcgcggatgaggatgaggcggcgctccatggtgcagcggaacagcttcgcctgcggggagatggcgtcgtacttcagggccagcttcttcacgcggccaatctggtccttggcgatggcgttcatcctgtaaaccgaccgctccatatcgatggcgtcttcggcaccctggagattgaggaaggcgtaatcgggacccacaacggcgccttgatggtttttgaccacgacaggaagccattccgcgttggtgacctccagggattcgatgagcttgcgcgcgcggcctgagacaagcaggtcgctcatcaagttcggttgaaaatcgtagacagtccggtcgtctggatagttcttggagaaggagacctcaccacccacaggaaactgtttgatgaggctgatgcctttgtcgaactgccagtctgccgggcttccccggggatattcatcgatgaagcctgcatcgatgccttggaccttgaagacgaagtatttcatggggtatcggtctccttgggcccgaaaggatctcagagttccacgccgtcccatccctcggcgtcgtaggttctgaaacctgtcagtcccgcgcgttggaatgccgcgagggtgtcttcgcgaacgaggatgagccgacgatacgtcctgcatcggaacatcttggcatcagggctgattctgtcggggctgagagccagttgttcgataagcccgatttggtccttggagatgtgattcatctcgtagaccgaacgggccatgtcgatggcgtcttcggcaccgaggaggttgaggaaggcgtagtcgggaccgaccactgcaccttcatggtccttgaccacgaccggaagccattcggcgttggtgatgccgagcgattcgatgaactgacgcgcacgtcccgagatgagcaggtcactcatcaagttcggctggaagtcatagaggttccggtcgtccgggtagttatcggaaaaggcaacctcgccaccctttggaaaatccttggcgagactgatgcctttttcgaacttccagtctgctgggcttccaggtggataggcatcaatgaatccatcttcttccgccatgaccttgaagacgaagtacttcacggacgaaccccatcctgagtgagatgccggacccgccggtggcgacggcgcttcatgattcctcgtcgacctcgccgtcctcttcaagccaacgtaggaaacgcatggcgccgatcaaggcgagcactggctctccctcttcgtccgtgaagcggatggcatccttttcatcagacaggctgacctggacgcagtacatggccatgtccttgcctgggcggaccaggtccttcatccgggcattgatgacgcgcggatgcgcctccagcacctccgtgtagacctcatccaggggtaccagtaccccccggacgccctcacgtgcggtgacgaagcacggagactgttgctcgaggacccgggcgacgatgtcggcgggctgctcttctatgcaattggcttcgaacatgatgggtcagagctccagtccgtcccagccttcagcttcgtagaccttgaagccggtcaggcccgcttgctcgaaagcagcgtggacgtcttcacggatgagaatgagacggcgttccttcgtgcagcggaacatcttcgcgtcaggacggatggcgctggtgtccagagccaacgcatcaatattcccgatttggtctttctcaagggagtccatctcgtactccgagcgttccatgtcgatggcgtcttcggcacccaggagattgaggaaagcgtagtccggacccacgaccttgccctgatggtccttgatggcgaccggaagccattcggcattggtgacaccgagcgactcgatgagcttgcgtgcccgtcccgagacgagcaggttgctcatgatattgggttgaaaatcatagagattccgattgtcgggatagttttttgaaaacgaaacttccccgcctactggaaaatctttggcaaggctgatgccttcgtggaacttccaatcagtagggctgccatttggaagcttctcgatgtagcccgcctcttcggccatgaccttgaagacaaaatatttcacgaaaaatctcgaatgactggttcaattaatagagagagccccactcataacgactcttggccttcttgtccttcggggcatagcgcacaagggcgtgcttgtactcttttcctgcggtgaccgaggccacaactgctcggctcagtgcaacgaggagtttccagtacttgttctccagcttgtgcagctggtcaaaaacatcctcgatcaacgccttgtgttctttttgagagtcgatcgccttttgaagcttttgggcgatggttttcatgtcccgcatcacctgctgcgtgtagttgggatggtcgcccgggtgctgcagcagcgcgtggacaggcacggcccaagcctggtccggcagcatgatgatgttgtggccgtggttcagattgtagtcggactggaggatgaggcggagctgccggtatgtgaagaccgggccgtcctccaattcgtagtagaacgccgagcccgggaggatgtggtgtgcctcccacgcgtacgggtacttctggagcgcgggcttcttgtccttgtccttggccctcgggttgaaattctccggtggccccccggggaactcagcggtctgcttcaccaggtcccggatttcatccaggtaggagtggtcgaagacgcggtacacgccacgcccgtccagggacgcgatgtagtcagagccgttctgcgcgtagtcgctgtctttgccgagcacgccccggggcggggcgctgtcgtccacgtggtcggcgtcgtccgcggcgctggctgcgggcttcggcttcttcttctttgccgccttggccgccgtgtacttccggtccctgcttcgctcgaagatggacaggagccgctgcgccagcaccgtgttcatctcgctcgcactcaggttgctcatgcgcgtacccacctctcacgttgtatggtgcctgaacgccccgttccaggctacgctcacccgcacctcccatcatggcccgtctcatctccctccgtgcagatgccgctgactccctgggagaaaggctgagccggttcgacccgggcgcggaccgctccagcattctcgcgcggttggacgccatcacgctcgacctgcacctcatcgccgtggccacgctgctggtcgatggtcatcctcaggggttcttcctcaacctctgccggatggcggagaacggccgccgggtgcagcgcctcctcgcggaccggggccttccgccaccgcccgcgcggcgcaacacgcctctgctcggcgcgctcgccgccggtcacttctccctcgcggaggccgtggccgcgagctccgccacccagtggcagcagggcgccgaatacgaggatgagtttctctgggccgccgccctccagcacctcacccgcacgccgtccgcgccgctggagtccatcctcgccccgttggagaaggtgggccaggagccctacgccagccgggtggccatggcccgggccctggtgtccagggacgcggccgccttcgccgaggccttcgccgccgcctgcctggaccacggcatcgtcacggagaagcgcgcccgctcgctggccacacccgtgacgtccttcgcgccgcaccggttcgtctggctcgaaggattggccctcctgcgcctcgccgagcgcgccagcatcgcacccgaggacaccagcttccgctactgcccgcccctggcccgcgtcccaatgacgacgacgtactcgggcgactgggccgtcgacacggcgccgacccgataaccccgtcagtccgttccgacgggttgccccggctccagcgtctccgcgccctcgcacgttacctggatggagcgcagctccgtgggctcgcgctgcaacgcgaaggtgccgcgccacacgaggaacagcttcatcgcgtccgtgtccaggaccacggtgtccagccgcagcgctccttccaggtcatccagcccccgggccctgggcgcgaggacctcaggagacggcagcgcgggcaatctgaacgtcagcggcgcacccggcgccatgtgcttcagcagcacggcctcgccccctcgcaggtagcccgggacgagctggtcctgcggcgcgccgttgaggaagcgccggtcgaagtccttcggcagcaacgggctgcgcgacttcttccacgcgtcatcgtaggtgcccgcgtagccggcccggggctgccagtgtggttcgatgaacccgaagcccgtgggcggaggacgctggccccaggacctcagcggctcggtgggagactccaggttcggcagccgcaggttctcctcgaagcggctgcccttctcgcgaaagcccatgcccagcgggttgcgcgactcgaaggcgctgccgtccttcccgccgaaggcgcgctcatagcgcacggggacgcgctcgaaggggaggggctgcgtcaccccgatgccgcccatgctcttgaaccacgtgcggtcccccagcacacggacctgtttgtgcacgggcccgacatgcaactcggcgaggagctcgcgggtccccgccgcgggcgcatgggcatgtcccaccagcaccacgtccgtggcggccttgaagaaggcgccttcgggttccaggcggaggctggccacatccccgccgtcccagcgctcacccccggtcagcagcggcgcctgctccgcggacagcgtcggcgcgccccgaggccgcaggtcgaacgtggccttcaacacgggcacgaacaggggccgcagcgcctcgtcggtgaggaacagcggctcgaaggtgaagggcgtgaggttctcggtggaggggtgccccatgaaacatgtctaccagtcctcacccgtttgggacacggacagccggagcccggctgtcagcccgcgctccacctcccgtccacgccgtgccctcacacaaggacacggccatgggagacccacgcaatccgaagcgagcgcacgagcgctggaacctggagcgcctgcgcgcctgcgaggcggaggtgcgcgccctggcgccctgggtgacggtgtccggcggctgggcctggcacttcatggccccgccgcacgaggagttgaagcgcttccacgaccacaaggacgtggacctcttcgtggagcccgcgcgcttcccggagctcatcgccgtgctcaccgctcgcggctaccaccgcatctggacgcgcttcgacgccacctccacgcacttctaccgctacgcccggcacgatgagggcggcaaggtcctgctcgacgtcttcgtccggcgcgtgccgtccgtggacgccggggggattcgcgtggtggacccggccacgctgctcaccttctacggcgacatccacagcacggatgactgcgtgtcggtgctggcggcgcggcggctgctggcgaagggccacagccccctgggccgggtggagctcgtcacgcaggcccactgaaagcccccgtggcgcgga

SEQ ID NO: 1246 - DNA, 25686 bp, Myxococcus xanthus
agctctcagcgcggcctgcatgtcccgggcggagaccatcctgaacacggagaagggcgcgctggagcagcggctgagcgaggtggcgcgggagcgggacacgctgaaggcgagcatcgagaaggagcgcaaccagcatcaagccgccctcacggagcagctcacgcgtcacgacgccagcatggagcgggcacgcaaccagatgcatgagagcaacaacctgctcgcggaggcgctgggtgaagcagcgaagaagcccgcgccctcggcggtggcgacggccacctccacgtccagcagcgagggactggcgaacacgcagaccgactccacgcagcgcagcgacgcggcgctccggggtgacgtgtcgtcctctgcacgacggagctcgtcgtcgcagggcccccagaccgcgccaccgcccagggtggtgaagcccatcatcgacaccacggacgacacaccgctcatgtgcgaactgccgtcggcgacgaagacgaaggcgaatcagtcacgcgcgtcctcaaagaagaagcggccgggtgtccgatacgcgtctgagtgcacgcagatgaagcctgaaccatcctttcagcccgccgagccggaggaggccatcctggcaacgcccgcgcagcagacggcgaaggcgcccatccctctggtgccccaggacgctgacgccgtgaagtagcgccgaggcacaccaccgcggggccgccccttcacacgaagtgggcggcctccagtgcatacccctgcgcacgcatcgcctgcagtgcgtcacggaggcgcggggagatgagcaagcgcggctcgggcctcagttctccacgccggtccccgaacaacgtatctgaagcgattgccgcggaaaccgagaaggggcctatgcccgaagcggtgccggaagctccgagcgcaacgcattcagcgagttgcgcgacatggcggtcgcggagaagaacgtgcttgaggacaagttccccgtcactggcgtcagggcgcttacttctgccccagcacactgggtgacatcgccactggcgatgactgccaacctaccggaggtgcagcgctttctgctgggtgaaacagcgccacagcgcctcctgcagtcaagggaggcaacgttagccaaactcctccgaaccccctacgaggcagaggcgagggcgctacttccacagagtgaacgcccagcgctcgcgaccgaagaacagaaacaccagcacgcgctggcggaggtgctgggacgacctattcagtaacaacgggctcagggtcaacaaggtccattaccgccgggcggacgcgcgccgggcgatgctgcggaggattggcttttaggtagtcattgcaaaagtcatccaacattggctggagcccttcacgaatcaggctcccgacatcatgccttggcacgacgccatagccgccgctggttgtccatgtgattgcgcgagcaaggctttttgtcgacaggagtctaacgaactgacgaagcgtgatgtcgacagagtaaatcaccgcttcttttggtttcccgatgtcgatgttcacatgaaggacgggataccccgagaccgaaatagcttcgtcgtcagtgaaaatgcggatgccggaacgtctcagggcgagttcggtcattgtcctcacctgagcagttgtaatgctggcatgtggcggcaagctttggacgacaattgcgacaccaggcaaatagcgaagcgattcgtcgacgtcgtctgaagcggaagccgtcgccccaaaagacatcaaaaccaacatcaatatataggacagttggcgcatgccaccagcctcccgcagcccaggaggctgcatcaatctgctccgtcgcccatcgcggcggcccgttcctcgttcgcgaggtctgccccggagagaatgcggtatccaagggtcaaggcggcgcctgctttggccgcgtccacttggactcggtgcccctctggcgtgatggccgtcaccttcccgtcccgcacaagcgcgagacgcttggacgtgtgaatctgttcaccaacggcatctccgggcgcgttggccaccttacccgtggaaacatcgacgacttgcacgaggatggacacggacgtcttagagcggtgccgatctgtacgactcaaagtggcgtcgggttgtgcctccacacaggcgatgacgcccgacacccagcccttggtcggcgcaggttgctgatagacgtggagggtgttcccgtagcggttcgcaacgatgctgcttggccccctcgtagttccggagtcaagacgccagtcgtagttgcggggccgacagatagcgacggcgcgctgatggaagtagtcctcaagggtgtccacgcttgtgaaggcattccccttcacctcgatgcgaacaatgcctggggcaacctcggtgtctcggtagcccccgcggatacccattcgctggtacggagtggcgcatccagcaaccgtcaaaacaactatcacagcccccacaagcctcttcatgttccccagcctcccgcacggcctgaacgcccgtcaacgcccagccctaccaccctggggtgagggtgccccagagtggggaggctgaaggggccttgcaggaatccgtcctcccggtcaaagctggtcttcgggagggtgaatggcgaaggtgccgcgaccagcgcacgcagcgacgctttggggcgaccgaatcaagcgggttccaagcgtcgttccggtggcggaagtgctcgtccccaatgcgtgcgatgccacctacgcaatggatggggaccggcattgggtgcacaagcgcctactgggcgccgatgggcttcttgcggaagcgcttggtctcctgcttggtcaagcgcttggcgcgcccgtcccggagggagccgtaacaggcccgcctgacgacaccacctggctcagcgaagtcatcccggacatccagcattgggaccgtcagcttgcgaacttcatcgtcaactatcccgatgtcggacggctgctggcactcgacgccattctcctcaacgatgaccgccatgaggggaacctcgtcttgcaggcgacggcggagcatgagtactcgcgccgtgcctggggcatcgacatggccaatgccctggctggtaggcccaccgacttcgctgcggcgggcatgaatacgccgagcatcgcaaagctcgtcgacgggattccggtcacgctcatccaagagggggcaatgctggccgctgtccaggcccagtccctcagcacctacctcgtgaagtcgatggtgatggaggcctgctcgctctctcgtgaaccccgtgaaacagaggatgtgctcctgggtgcgctcctcagtcgaatggcgcgtgcgccggagctcgtagcagagtatcttgagaaagtaggttcgcgcccatgactgcccgatttcgactcgttcacttcatgcctgaccccttctcgggcatgcgtgtgccagtcgcagcgctcgtgcagcaagggagtggcgtacgggttgttcgggcgccacatgctgctggtcccggctgcgtcggcggccttgctacgtggcacaacatgcagggactccttcgtggcctagagtccgtcgagagattcgaccagttgccaatgagcctgggaccgcatgccgtccttggtgggcagctcgccgttccagcacaggtgaacgacccgctgtcctgggtggcgaagttcatcctccctcagcgccccctcgctgccggcgatgcgcgggagtccgccttcccatcccctcgacgagactcagtggggaatctcttctttcagacatggcgcgtagagcagttcgtggagcgccgcttcaaaggggagacactgggcctcgaagatgagtacgccggcaacatcacgcatgctgtcataggtgcggaagaacttatgttgatggagcccgtcctcggactccggcatgacgtgcaaaaccagcttgaggaaatcagtaagagctttcttgcatgggagaaactcctagagcgaaagcaggctcgacgtaagccgcgattcgtcgctttcatgttctcaagtccgcgagcgaccgtgcgcgaggcaaagtcgttccttggcatcgcagaggccgaagtcatcgacgtagaggtcccgactgagcgggaccgttttgttagcgacatccgccgagtcggactcaccaatcctgtacacgcccatcttagaagttaaggggtgtccatcgcatgtgcggatgatggcaggcgcctccgtcacggagtgaaggctaccgacgaggggcgcactcctgtccccggtatccaggaaatgggtacagcgtttccattcccagggtgtattcgctgagctgtctgattgccgcgcctgcctgctgccccgaggggaaccacccgaagtacgggagagccgatttcgtgaacaggttcgttaagctgccgcacttcgggttgaggcgttccgctcgtactcctcgggtctgacatagccgcgagttcgggtgctcagaaatccgccccgatcaggtcttctatttctaccggttgtcattggatggggagaagatcccaccggacgcgaagctcttcaggcccaggggaaaagcaatctcgttgtcatccgggaagatcttgccaatgacatcctccgcgcgggttgcgatggaatgatcttccaggagatggacgactacggccgtgaatggggaaagctgcgagaatgaataccccgaacatgcgtgccgtcgaggcagccgcgagcgccaaggccgcgttgctggaggaagagctggagcagggccaacgtccgccggacgaggtcgagcgcatcctcttccatctctcgcggcacacgcgcgccgccgccatcgcccagttgctcgcgtatgcggatggagccaccttccgcgatcggctggttcgctccgggcagccccaccgccggcggctccaatgggcgacgggcgagctgcggcccttcaaccgcttcaccgcgacgggccattacgggccgctctgcgactcactggccccggggtgggcgagttggcccacgacattgcccgcctgtcggcggacacgcccgtgaagggccacgagttcgaggaggacttcctctaggcgcgcctgctcggcctcctcatcgccaccgaagaagacgcggtacccggtcgcgcggagccactgctggacgccttggagcggggcatggacggtcaggacttcccccggctgcccacatggtgccgggccctcctggtgcgaggacaggagggcattgacgccaccttccaagcgctcctgaaggaacgagagcaccactgccacacgcaggcgaaatccttcatgcccagggatgaagagtcggagacggagcccttcatcttcgtgggggcatggcgctcctgcatctggccgagcgtcgcgggctctcggcgcagtccgactatctcttcctgcccagcctcgcccgtgcgggctgaaacgctggtttgccatcatgcgcacgggcaaccaggccactcgcggattccatcctgtcagacgccacgccgcgtcccgtcgctcgacctcggcggaatccagaggcgtcacggggctgtccccgggctcccaactccgggcaggggcgcactgcgcccaggtgtcggcgagggtgttcccgggtccatcgctcgcagtggtttcctcatgtcggaccgcccggccggacccccgtcgggtccaacaggaagcaggcgccagatgcgcctggctccgaactagctcactggtagagcacaggtccaaatcctgcggagaaggttcgattccttcgttcaatccagagggttccgccgcgagctgacgtgagcgcgggtccaccgcttcccactcctcccacctcgatgcccggcgattcgccagggcgacaaggccccttccgagctgtcagcggaagcccctgccgccgtccgcggaggtgcccggcgcgcaggcgcgagcagccaggaagcggccaggacaggcggtccgcgctccacgtccgtgaacggtggggccctcacttttcagcagtacccgggacacacgcggcaacgcgcactgaaacgtcccggttcttcaagctccccggagggggaaaggaggtgcgcgatgagcatcatgcgtgtggatatcgggcagaatgagcgggcgttcgtgctggtggacgagaagccggagcgctacctcgttcccggccggtactggctgctccaccccttccgaaaggtgcggctggtgcgcgtgagcaccgagcagccgctcgtccagctcgacccggcgttcctgcccctcgtgccggagacggacctgcaggtcgtggagctgagtgccgacgagcgcgccatcctcttccacaagggccgccccgtgcggtggctcggccggggcctgcaccaggtgtggacggtggagcgccttcccagccgtcagctgacgcccggcgcgcccaccgtgcgcgtggagcgcgtggacacctcgggtgtcaccacggcgccgctgcgtgacgacgtgcgtgccctggtccccaccagcgactacacagaggccaccgccactgagggcaccgtcgtgctccgctacgtggatggcgtgctggacgccgaacttcctccgggccgtcacgccgcgtggaccgtcgcccgcaaggtgcagctggccgtcatcgacctgcgtgagcgcctgctccacgtcaccggccaggaggtgatgacgaaggaccgcgtcacgctgcgcctcaacctgtcagcggccttccgcgtctcggacgcgcgccggctcgccgtcgtgtcccgcgctccggatgacgtcctctacctggccatgcaactggccgcgcgcgaggccgtgtcggagcggacgctggatgagctgctcgcctcgcgagaagccgtggccgaaagcctcttcacccaggtgaaggaccgcgcccacacggtgggcctggacctgctgcgcttcggcatcaaggacgtcgtcctcccgggtgagatgaaggagctgctcaaccgcgtcatccaggcgcagaaggaagcggaggccaacgtcatcctgcgacgcgaggagacggccgccacccgctccatggcgcagacggccaaggtgctggcggagaacccgctgctggtgcgcctcaaggaactggaagcctacaaggacctcgcgtccaaggtggggcaggtgcacctcgtcctcggcgagggcgcggtgcccaccctgcaactcaagagtcactgactcgcaaatcaatctcgggttaccctcgcggccccacacccgcgaggagcccgagatgtcgtcttcgaaccactacgtccccaacctgcgcgatatcgaattcaacctcttcgagttcctcgatatcggccaagcctcgctgggccacgcaccctttggcgacctggacgagacggccgcacgccagatgctccagatgttcgcccagctcagcaccaacgagctggcccagagcttcgaagagccggagcacaacccgccgaagctcgagaatggcgaggtgacgctgccgcccggactgaagaaggcgatgaacgccttcttcgacgcgggcatgcacctgctggagcagccgccacacctgggcggcctgggcgcgccgccctccctgggctgggccgcgttcgagctgctggtgggcgccaatgcctcgctggccttctacacgctgggcaacctgctggcgcgcatcatcgaccggctgggcacggacgcgcagaagcagcgcttcctgccgcacatgctggaccgccgctggggtggctccatggtgctcaccgagcccgacgccggcagtgacgtgggcgccgcccgcaccaaggcccgccgcgtctccgacgacgtctgggaaatcgaaggggtgaagcgcttcatcaccaacggcgactcggacatgtccgagaacatcatccacatggtgctcgcgcgtccggagggcgcggcgcctggcaccaagggcctgtcgctgttcgtcgtgcccaagtactgggtgaatgaggacggcagcctgggtgaagccaacggcgtggtgtgcaccaagctggagaagaagatggggctcaagggctccgtcacctgtgagatgaccttcggcgacgggaagccctgtcgcggcctgctgctgggcgaggtccacgacggcatccggcagatgttctacatcatcgagcaggcccgcatggcggtgggcgtgaagtccatggccacgctgtccgccggctacggccgcgcgctggccttctccaaggaccgcctccagggcgcggacctgatgcaggcccgggacaagacggcgccccgcgtgcccatcttccgtcaccccgacgtgcgccgcatgctgatggcgcagaaggcccacgcggagggcatgcgcgcgctgtgcctctacaccgcgttcatccaggacggcgtggagcgcaagggcggccaccgcgccaccgaggcgggcgagctggacacgctcaacgacatgctgctgccgctggtgaagggctactgctcggagaaggcctacgagctgctggcgctgtcgctccaggtccacggcggctccggctacctgcaggactacccggtggagcagtacatccgggaccagaaaatcgacacgctctacgagggcaccacgcacatccaggcgctcgacttgctcatgcgcaaggtggcgcgtgacggcggcgcgacgctccagggcctgctgtcccagattcgcgagacggccgagcgcaccggagagggcaaggagttggaggccgagcgcgccgcgctgggccgcgcgctgggcgacttggagacgatgctcggcacgctgatgggcaagctgggcgagtccatctatcacgtgggcctgcagggcaaccgcgtgctggccgccgtcgcggaggtcgtcatcggctggctgctggtgcgccacgcggaggtcgcgctggagcgcatgaagagcaaccccggggaccgcgccttctacgtgggcaagctcgccagcgcccgctggttctgccacgaggtgctacccggcgtcgcccacgccgcccgcatggtggagcacggcaacctggacctgatggaggtgccggaagagtcgttctgacgcggagacacccaggcgagcctggccaccggtgccaggcccgccgtcgcggccgggaggcgctcgctacttcctcagcgcgtcccccggcaccggcagcccgcgcgccgccaggtcacgctccacgtacagccgcaggacatgcatgaagtcctgcgcgttcgtcaccacgccaaaggcctggtgcgtgccgcggtccttcagcttgctcaccacgaactcggacgagtccacgcagatggtgggcagctcccgcaatgagccgtccttctccgtgacgaacgccggcagcatgttgccggtggcgatggcatgcagcgccgtggcgatcatcaccgccatggtggacttcaccgcgtgctcgcgcatggccacctgcgcctccaggttgtccgtcaccacgtccggcagcggcccgtcgtcacggatggagcccgtcagcacgaagggcaccttgtgcaccacgcacgcgtgcatgatgccgctggtaatcaccccggcctccactgccttggcgatggagcccgccgcccgcaccttgttgatggcgcgcatgtgcaagccgtggccgcccgaggtggcctcgcccgagccgctcatccccagcgtggtcccgaagatggaggcttcgatgtcatgcaccgccaccgcgttgcccgccagcagcgcgcccacgaagccattggcgacaaaccacgtcatgtccgcgcgcgcccgcgaatgcaccagcgccggccccgtcacccagatggggtagcccccgcgctctcgctcgtccaccagcacccgggccatgtgcgcgtagtcgatgggcttctcgcgggacaccgcgctcgtcatgaacttgaactccccctcgccctcatccgcgaggtaggcggagttcacgaacacgccttcgctgccatcctccgcgaagcctaccaccacgtgctcgcccgcacgcacgcgacggccttcgcgaatccacagctcgccttgggcatccagcaccagcgccccgtccatgcgcggctcgcgcggcatgcgccacgcgccgcccacgcgcacgtaggtgggtagattcgtcgtggtgaagaagccctccggcaacacgccgtccgcaggcgcaggctggaagcgcgcgtccggacaggaggagaaacgcgcggccgtgaagtcaggatgaggaatggagctcacaccagcaccatgcgcggagccctcgcccgcttcaagcgcctcggcatccgcggaccaccagatgtcaggggacgacagtaaagccgggattgcgcgtcactacatccgcgcgtccacacccactccgcccagccgtggacggctgctggccgaggccagctcacgacgcagcaactccgcatagcgagccgcggcatgccgcagccgggccgcctcgtctggagcgtgggcgtcgtaggatgcggcggccagcgcctccgcgtccagcgacggttccaccgccgcgcccgccaaatcccaggacaggtcctggcagcccaccaggtcgtgcgcccggttcgcggatgctctccggacaccagtagcgcggcgctccctcagtcctcattcccgcgggaagcgggtggcggctgggtcaggtggctgtgcgcaatcgcggccagctcctccaacctgggcacacgccacgtcgccgcgttccgctgacgccaggcatccgcccacgccatgaaggtgcgcagttgctccgtgctgggtgacacctgccagcgccgccgcttcgccagggacagcgcctccaacggtggatgccccagcgccaccaggacgcacaaggcgagcagcgcgctgcgccccaccccatgctcacagtggatgtagaccttgtggccccgagccagttggtccgtcacccacgcgacgccgtcatccagccggtcgccacggatggcccggaggtcctcggtgggcaggtgcaacaaggtgatgccgtgctcgcgcaggacgtgctcgtcgtcacagtcctccacccgcacgtccaccacatagcggatgccaagcgcccccgcgaggtgctccgccgtatcgatggggaagcggccccccaccgccagcgagggcagcacccagtccaggttcaatctccgggacagcgcgctcatgccgcccaaggtagggcagctcgctcgcgctggcagcctccgcggacgccaggacgcattttgaagtgtttttcgacccaccttccggaaaattcgctggaatcacggggggttccgggcgctggccttgaaaatcaagaagcacgcaactccgggtctcaagctccgagaataggtgcaagacgtacatgcggcgccctcgcgccgctccagacccctacggagccccccatgagcagcagctaccgcatcaagtcgggcgacaccctctcccacctggcgcagcgctacaacaccagtgtcagcgcgctgatgaaggcgaatccgcagatcaagaacgcggacctcatctacgccggcaagtcgctgaacatccccggttcgaaggactccttcgagagcggctctgcgggccgcgcgggtggcgccacgggcggcggcggcagcagcggcggtgcgcaggacgtgcagggccccagcagctccggccccggcgtccgcggccccaagggcagccccttcgaaatcgcgtcgcagcacctgggcaagaacgcgggctcgctgaagctggagaagaacggcgtgggcgcggacatggaggactgggtccccaacaacgtcaactgcgccaacttcgtgtccgccgtgctggagcagtccggccagatttccgactcgcagcacgacaacagcgtgatgggcctgatggccaagctggacagggaccccaagttcaagcgcatcgacctgaaggacgcgaagccgggtgacgtggtctccatgaagaccaacggcggccagcacgtggtgatgttcgcgggctggaaggacggcaagccgacgttcatcggctccaacaacgtcaactcggatggctcgcagcgcgtcaccatctccagcatgaactaccccatcatggcggtgcaccagtaccagggctgagcgcccgcacagacatgagcgagcacccacggggctccgcgtccgaccttccaggcgggcccggggccccgctggcgtccaggcacccgcaacggctcagaggcagggcgccagcgacggcgcggcctggatgaggcgcgcgtgtcccggctcctctccgagcatgacccgctcgccccgcccaagctgtgagcgctcagggcgcgccgcggcccgagtgcaggcagaccacggcctcatccagcaggtcgagcgccgcgtcggaccagccccgaagcttcatgcgcggggacacagacgtggtgaaggggatgaggccggcaacggcggcgtcctcgatgagctgagcctgttgctcggggttgagctgggcccaacgcttctcgcggctcacgcccttgcgccagtcgtatccatcgccggaccactgcgcggccagcgcggcgctcaggtaggccgtgccaccgtgctggtgctgccacacgtgcgtcagctcatgaacgagcaggccgaagtccacgcccccgctccgaggcgggacgaagacggtgttgccgtgcgcgaaggcccgcccgggaaggcccagcaggcccagccgaccgaccttcacccgcaccaccgcgtagttcaggctgtctccaaagatgggccgcaggcgggcgatttcctccgccgagaggcggcggcccggcggctccagaccgaccagcacctgcaccgagctgagcacgcgcccgcccaccatcaacacggcatccgcgggaagctgcgccacgcgcgtcaggccctggcccagttggggcagtccctcgcgaggccggccgcgcacgcactgcgccacgcctccgcccatcgccttcagcaccacccccacgctgcgagccactcccaccgacgcgctcgagacaccggtgagcagaccccggcccgcatccaccagccgctctgagaaggtggccgcgtggctcatgccatgttcctcagcgccccgccgtcatggcgcgcagcccggagagccccatcacggactccaccagcgtgcgcagcgcacccgggcgccacgggcgggacagcgcgaagtgcgtgaggctggaggcgctgtaggccgccgccacctcgggacggaagtaggacgacacgaggatgcgtggccccgccaggtcgcgctccaccagccgagccaggaaggtcggcacggccgctcgctccacggagtccaggtccacgatcacggcctcgggcaccacacccaggtccatccgacgatccgccgacgcgatgcccaacgtggggaccagttcgaagtctgacgccagctcgcggcccatcgccagccggaagagcggctcctccgagacgagcatcacccgaggccccttgggcacgctccggtgacgccgtgcgggcgcgggagtgggctcgatgggaagacgcagtgcgccagcctccaccagatggcgggcatcgaggagggactgcgcacggcgaatcaggggggcgggggcgctggacacaacgcgacaataaccagcaatagcggaaatatcaatctttgcttcaattactgagcacaattcctggttttcaggacctccaaacccatggaggtgggcgtcttggcacgcccgttcagtgagtcagaagcaacacctattcaagcgtatcgggtctggaatgaccctactgtttccacagggggattgccgcgtacccgcggccttcgcgggctcacccagggcaacagccgcgccgctcactcgaactcgagcgcgcgctggaagtcggccgggttggaggccgcgctctgcgccgtctccagggtgatgatcccctcccgatagagctgcgtcaggtgctggtcgaaggactgcatgccgaacatgtctcggcccttctcgatgacgtccttcagctcgttggcgcggtcgtcgcggatgtactgctccaccgtcttcgtctgcaccatgatttccaacgccacggtgcggcccttgccgctggcccggggcagcaggcgctgcgacaccgtggccttgaggcagtccgccaggcgcatgcgcaccattgtctgctcttcggcggggaacaccgacaccaggcggttgatggtgcgtgacgcatccgtcgtgtgcaccgtggagagcaccaggtggcccgtctccgacgccttgagcgcgatgtcgatggtctccgtgtcgcgcatctcgcctaccaggatgacgtccgggtcctggcgcagcgccgcgcgcagcgcaatcgcgaagctctgcgtgtccgggccaatctcccgctgggagatggaggacttgatgttcttgtagatgaactcgatggggtcctcgatggtgaggacgtgcaggttctccgtgcgattgatgtggtcaatcatcgccgccagcgtggagctcttccccgagcccgtcgcgcccgtcaccagcaccaacccgcgctcgttgccggcaatcttcttcaacacctgcggcaatcccagtccgtcaatggttgggatttcatccgggatgatgcgcaggatgcacgccagcgagccccgctgccggtagatattcacccggaagcgcgccacacctgggaggctgtaggacgcgtcgcactcctgaagcgtgtcaatctgcttcttcacctcggggtccgacacgacatggactgccacctgtcgcgtgtggtccgcgtgaagcttttccatcttcaagggccggagcgcgccattgacccggtagatgggcggatcccccggccggaagtggatgtccgatgcaccgttctgcacaccgaccgcgagcagcttgttgagcgttgccagatccaggggagtgaccctcgtcagcaaggaaggccccggactctaggcggatactcaacagttgcacatggtgcgcaattaccccggggcagacaccagggtcagttccgcaatctcaggcgagggccccaaccgcagcggcggcccccaatagcctgtccccctgtgggtatagacgcgcaccccggcaatggttgccagaccacgcaccaccggctgctgcaatttgacgaggaacatgaagggaaacacctgtccgccgtgcgtgtgcccggaaagctgcaggtccaccatcacgccagcctccgccacgcgcagggcggaccggggctggtgggccaacaacagacgcggcacgccctgcggcgccccgcgcagcgccagctccggacggctggcatgcgagggaatgatgtggcccgcgtcatggtccgtcacccccgcgatggtgagccgcgctccgtcgcgctccaccacccggtgctcgttctgaaggacggtgagccccaggcgcgccacctccgccgcccaggccggtcccccgtggtagtactcgtgattgccggtgacgtagaagacgcccagtgacgcgcgcagctccgacaggggcttcacctcgtcccgtagcgcgtccacggcgccgtccaccaggtcgcccgtcaccgccaccacgtccggctggagcgcgttcacctgctccaccacgcgccgcagccagcggccgtccaacgtgggccccacgtggatgtccgaaatctgcaccaccttcaggccgctgagcccgggtgccaaacccgccaccggcaccgtcacccgctccaccgtcgcccggccacgcgccgtgatgaaggcgtacaccaccgccggcaccgtcacccccaccgccaccagggccttgcctcgggccagggccaacgcgtccgtcaccacgcccgaccacgacaggcccagccccaccaggtccacgaccaccaccgcgctcagcaggatgccgaaggcgcccagccacacgtaggacgtccactggagcacctgcgcccagagagtcggttcgcggcgcgacgccaccattcctacgggcagcgacaggaagagcagcgccaccaggacgggccccagccatgcccacggcagcggtagctgcgggctcacgaacaggcgcaccgcgatgtacgcgtgcagcccgcccatcaacgtgaggatgccacccagcgacatcaaccaccgcaatgccagcgacagggacactctgggccgtcgggcctcctgctccacaccaggggtcagctccgccacgaacgacgtcctccttctcaccggtgccagccatgaccgcgtccggaacgcggggacataacgacaacagattgccgatgcccggcaacccgcccgtacgccaggcgagccaacgcctcttctcgtgcaccacgcctaagacacgggtgacgggttggcgagccaactacgttcaaagcatgagaacttcacgtatcttcacagccgcactgctcgcagcggcaggctcggcctgggcccagcccgtccagtacctggacctgcgaacgcctcgggtcgcgctcaatgcgcgtgtcaccgaccgcgacctcaccagccctgacctgcaggtcggcttcagcgacggctcccttcgaggccgcgccttcggcaggcccctcaacctcacgctggacgccgcgcggatccgcggcatctatggaagcggccccgtggacctgcggatgacgcaggaagaaggagccctgcacgccaagggcacgttcggtgggcagctcaccgacttccaggtgacgccgcagacgctcaagggcgacgtgggccggtgcagctaccagctcaaggcctccgaggaaggccgctatcaaggctggcgttcgtgtctcgccggattggagaacccggtatcgctgtcgattccgcctgccattggcggcgacgacgcccggctcgtggccaccctggctttgattctgtcgcggtagccccaccgcgggcggctatggtgcgcgccgtttccctcacgacggagcgcatccatggcacgcatgcacgaagtggacttccacatctacggcgaggacctgcagttcgtcgaggtggagttggacccaggagaagccgcggtcgccgaagccggcacgctcatgtacatggaggacggcatcgagatggagaccatcttcggtgacggctcggagaagacgagcggcttcttcggctcgctgctcggcgcaggcaagcgcctgctgacgggtgagtccctcttcaccactgtcttcctcaacaagagcggtagcggcaagcgcaaggtgtccttcgccgcgccctacccgggaaaaatcatcccggtgaacctgagtgagctcggcggcgagctcattgcgcagaaggacagcttcctcgccgcggccaagggcgtctcgctgggcatcgccttccagaagaagctgggcaccggcctgttcggcggcgagggcttcatcatgcagcggctccagggtgacgggctcgccttcatccacgccggcggcacgctgcacgagcgcacgctgggcccgggtgaaatgctgcgcgtggacaccggctgcatcgtcgcgttccagcccaccgtggactacgacatccagatggtgagcggcatcaagacggccttcttcggcggcgagggcctcttcttcgccacgctgcgcggccccggcaaggtgtggctccagtcgctcccgttcagccggctcgcgggccgcattctctccgcctcgcgcccgggtggcgctcgcgacgagggcagcgtgctgggtggcgtcggcctgggcagcctgctcggagacgactagcgcaccgggcaggccggccgttcgcggaccgctatccgcgccgccgccgcgacaggccggccagtcccgccagcagcacccaggagcccaccacgcccacgggcgatgcgccgcagccacaccccacgtcgagcgccgcgggcccccgcacctcgaagcccgtggtccgcgagcgcgccggcacgcggctggaggtgacgaggcgctcctgcgccgcgacgctgtgcgagcctacggacagcgcgctctcgcggggcacctggtaacggaaggccccggtgtcatcggccgtcaccgtggcgacttcaatgccgtccacctcgatgaccaccgtggcgccagccgtcgccgcgcccgcgaagagcggcgtggagtccaccacctcgccatcagcgggaaccaccagcaccggccaaccgtcctctgggaactgggtgccgccatctccctgggacgtgcccgcatcctgcccggacgtccctccgtccccctcgccgctcaccacctgggactcgaatcggatgggctgcgagtagggcccgctgattcccgcctcgttgtgcgaatgaacggtgacgaaatgagggcccggcgccagcggcgattcagcaggccactggtagcggaagcggcccgcgccatccacggggatgatgacctcggggccattgtccacctcgatgcccaccgtctgcccgttgggcgcgacgcccgcgaacagcggcgtggttcccaccgtctccccgtcctggggaatcaccaggatgggctccaccaccacgccaccatcctccagcgtggtcgcgacagagaacgacacaggcgcggagggcgcgctgtacgcccccatcgcctccgccaccacgtggaccgtgcgcgtgccgacatcgagcggcgcctgatgcggagggatgccagcggtgaacacgccatccgcgccagagctcacctgaagcagctccacgccatcgacgaacacgaggactcgaacgccagggtccgcccggccttcgaagcgaggacggtgaggaacgcccaccgctccggacacgggagcgctgacagacggcgtcccgggcgtgcggtaggccacgtggtattcctcggtgaagccttcgctccccgtacccgcgccattcgttccgccatccgacggggtgagggtcccggcagcgccgcccgacacgctcatgggacacgacgccgtcgccccctgcagcagcacgccgccgccaccgccaccaccgcccgggccgagcacccagcccgggtagctgacgttgccgccgttgccgcccgcggctcgggcgctcccgcaggacagtgagtcctgcgcgcgaaggatgaggacaccgcccgcgccaccaccgcccgcgccatcgtctcccggcgtgtggctggcggcgagcccatccgcggagaagcgcccggcgcccgagaacgccctggcccggatgaacacaacaccgccgcccgcgccgccattcgagcccaggtcatcgttgccctcgcccgcgcctccgccactcccgaagacaaacttgtcgatgagcgagtacttcacgggcgcgccaccgaaaccgcccacgtcccgcatcatgtccgcctccgacgtgcggcccccgacaccgccccggcccccattcccgcctccgccaccacccgcgttgtggcagttgccaccgccaccctcacccgccacggagccacgccccgaggccgtgccgaagtggcccatccgcaggccctcccctttgtaggccccccctgcctcgggagggatgtccaggtcggagcagccaaggaggtccgcgtgattgacgaagagcccgccccggaagcccattccttccgcgctgatgaggccctggttcgtcacgctccccgtggcgaggaaggccaggatgccgccgctgcgcccatcccatggatgggctacgaccgaggcacccgcggacacgaggacgtccgtgtactcgggcacggtgaccacctgcgcgcccggcgcggtgtaggcatgcaccaggggctcggagaagcgcagcccgggcggcgactccgataccgccttcacgcgcgccagctcccagtggcccatcttccgaagcgccagggtgccgccatcgctggagaccacggcctcctccgccccgccgctctggtggaggagcaccagcgtgcccgcggtgaagcccgaaacgcgctgcaccggaacgtcgtgggctccgaccaccacgaggtccgtcagcggcgtggcggcgttgaggacgcgccccaccgtcgtgacggacagcgcgccatcacggcccgagcccaggccgaaggaatccagctccgccagcgcgggggacgcagggagcaacactagcaggcaggacaggacgaagcgcatgccccctcatgctgcctcagaagccgggtctaccgcgagtgcaggccccctgaagactcactcgcccgaggggttcatcagcgcccgggcgttgcgcggtgcgaagaagggctggcgcgcgagcctcggcagggcgcgcttgtccacgcaccagagctggagcgcatcctcccactcgcccagctcgaccaccgcgcgcacgtccggcgcatcgcggtagaggctgttgaggttgtgcaccaacgcggacaggtcctccacctcccagcgctctgtcacgtcaccccccatgacgtggagctccagcacggggcgctcgcgcacgtccaccaccttgaagcggcgggccgcgccgcccatggcggtggtgagcggccccaccagctcgtcggcgcgcacgccgtaccccacggacaagccgccttcgagcaggcccgcgtcacacaggcgcagcatggacacatggggaggctcgccacgcggcagcagcgccgcggcggcagcgcggtccttgaggagccgctcccgggtgagcacgtcgagcaatggggccatctcggcccacagcctatcgctcctcgccgctccagtagtccacctccgcggagaggggcagcgtggtgaacagggtccgagcggccttgtcgcccccgggagcactgcccgcggagatgaccaccttccctgagtccgggtacaccatgacgtccggctccaccatggtggagaaggccaggtagcgcagcgcctcggccccgtcgttgaggagctggtgcgcgcccccgggccccaccggcagcgccacatagtcgcccgccgtgacggcgagggtgtcgtcccccagccgcagccggcccgtgcccgcgaggatgaaataggcctcttcgttggccaggtggtagtgccgcggccacgcgtgtttaccgggtggcagctccatcaagctgcaccccagcttgcggcccttggcggcggagcccagttgcttgcggcggtactccacccggggaccttgcgtgacttcggtccagggaagctcgggctcgtggacgacgtgaggatgcgaggacatggacaggtgctcctgttcagggtcgcgtcgcgagcagcgcgaagacgcggtggggaatgtcgagcgagtccgccggaaagctcccggcgagcaggtccgcgagcgcggcatcgaagccactcaccgcgctcgcaggcatggacgcgcccaccttcgcgctggcgcggatgcgcccccgccacgcgcgggggctgtacgacacggacacgtcgaaggagaacgaggtgagctgggtgaagcctgcctcggcggcgtctcggaaccacggaggatagacaccggaagactggctcaaggatacgaagggcgcgggagcgcccgggttgaagcgctcgatgagccgctcggtggcctccaccacgttgccgggcaggggcagccagtcgaagtgggcgatgaccagacggcccccgggaacgagcaaccgcgcggcctcacgcgctgcggcgggccggtcgaaccagtgccagcactgccccgcgaccaccagctcgaacgcctgtgacggcaggcccgtgttctccgcgggtgcctgtcggaagtcgatgcccagccccattccagaggcgagcccacgggcggcatccagcatgtccgcggacacatccagccccgtcaccacggcgccgcgctgggccaaccctcgggccaccgtgcccgtgcccgtccccaggtcgacggcgcggaggcccgaacgaaggaggccctccctgtcgagccgttcgaagaaggcctccggaaagcccgcccggtgcctcacgtagtccgacgacgtgcgtccgaagtccacctgcatgacaggctcctctcctcgcgggcacacgcgggccccgccgacctggggacgtatcgacacgtcatccagtcgagtcgacaatggccttcgcggaggtgcgcgagacatgagtaggcccaagggcggacgctctcaatctcgattcgaccatcgacctgaggaggagctcgtgaccgcggcacaggccgccgcgctcctgggcgtgaagcgagccacgctctacacctacgtgagccgaggcctcgtgcgctgcgtgccggagcgaggcaccaaggagaaccgctatgtgcgctccgacctggagcgcctgaaagcgcggcacgacgcgagagcgggacacgcggccgtcgcctcgggcgccttgcgctggggcgagcccgtcatcgactcgtcggtgtcccgcgtgggcgcggaggggctcgcataccgaggccattcggcggtgacgctcgcggtggagggacgcgcgttcgaggacgtggccgagctgttgtggacaggcacgctgcccgaagaagcgtcacggtggccctcacccgagccggcgtttccaccgtccgagctggcgaagctgttgccccgtggaacacctcccgttgccgcgctgtctgcgttggtgccgctcctaggcgcaagggactcggcgcgctttgcctctcctcccgagcaggagcgggcccgcgcccggaggctgctgcgccacctgtccgcctgggtctgcgtggcgaacgcgccggggcgagtgacgcatgccttgaacgagcccacggtggcgcaatccctggcgcgcgcttggaacacccgcgtgaagcgcgcacctgagctgctcaaccgcgcgctggtgctgtgcgcggaccatgagctgaacgtgtccacgttcaccgcgcgcgtggcggcctcctccagcgcggacctgtacgcctgcttgagcgccgcgctggccgcgctctccggtcccaagcacggaggggcctgcgaccgcgtggaggcgttgctcgtggaagtgggccggccggagcgcgcggcggaggtcatccgggagcggctgcggcgaggcgaagcggtccccggcttcggtcatcagctctatccagacggagacccacggacaccaccgctggtggaagccgcgcggagcgtcaggcccgagacgcccaatgtccgtatcgccagcgccgtgctggaagccatgcgcgcggcgggacatccgcccccgtccgtggacttcgggctggtgatgctcaccggagcgctggggcttccttcaggcgcgggcgccacgctgttcgccgtcgggcgtgccgcgggctgggtggcccatgtgctggagcagcgggaacagggccacctgctgcgccctcgggcacgctacgtggagccggcacaccccgccggtggcagggcgccatgaacacgctccgcgcatccggacgcctcacgcacgtcacgtgagcactcagcccactgtcgcatgccacgcaccggtcgaagtccgtcgttggaggtccgcgctcgcgaggcgagactcccgcgccgtggacactcgacgcgtatatccccgtttcgccatcgcctccctgctcggcaacgtcgccttcctcgcctcctggggcgtggtgctgatgcgtccctcgggctggcaggtggtcggcccgctcctgctcctcatgttcctcgtcctgcgggtgggcggcatgtggctcttcgcctcgcgccacccggaggaggaacgcccacgcatgcggcgcacggcgaccctcaccaccgtgctggcgctcatcgccgtgggcatctgggtctacaccgtgctgcaaggcccgcgcggcttctgagccgccaggccctgaaacggctcgcgggcgccgcctccagactgaaccgtccggaagcacagcgcccgcgatgactgccgtgtgctgaccgctacacgttgaagcggaagtgcatgcagtcgccgtcctggacgacgtactccttgccttccacgcgcagcatgcccttctccttcacggcggactcgctgcccagcttcaccaggtcctcccagcgcatcacctcggccttgatgaagccgcgctcgaagtcggagtggatgacgccggccgcctgcggggccttgtagccctggtggatggtccacgcgcggcactcctgctcgcccacggtgaagtacgtccacaggcccagcagcttgtagccggcgcgcaccaccttgtgcaggcccggctcggacaggcccgcgctctccaggaagcccggacgctccgactccgggagctgctggatttcggactccagcgcggcggcgagcaccaccacctcgaagccctccttcgcggccatctcccgaacggccttcacgtggggattcgcgtcctccttgcccagctccgactcgccgatgttcgccacgtacagcacgggcttgtcggtgagcaggaacaggtcatggatgacggcgctctcctcctcggtgagcttctgggcgcgcacggtgatgccgttgtccagactcgccttgatgcggtccagcaacgccacctcggccttggcctcctcgccagccttgccgcccaccttcgtgttcttcaaggagcgctcgcggcgcttctccaccgtctccaggtccttgaggcacagttccgtgtcgaccacgtcccggtcccgcaccggattcaccccgccctcgacgtgggtgacgttgtcgtcctcgaagcagcgcagcacgtggagcacggcgttgacctggcggatgttgcccaggaactggttgcccaggccttcgcccttggacgcgccgcgcaccaagccggcgatgtccacgaactccagcgaggtgggcaccttcttcagcggcttgatgagcgcggacagcttgtccaggcggtcatccggcacgggcaccacgcccacgttgggctcgatggtgcagaagggatagttggccgcctgcgcgcccgcggccgacagcgcgttgaacagggtggacttgccgacgttgggcagcccgacgattccgatggatagacccatggtgattccctggaacacgcgcgccggggggcgcgcttccccaagaaggggattaggcagtgcggcgcacggcgccggtggcgctggtgctgttcagcggcaggccctggacgaactgctcggccagcgcgcgctgcttgctgtcgtccatgcgctcgctgatgagcttgccggcgacttccatggccaggtcgaccgccatggagcggacctcggcgatggccttcgccttctgctcgtcaatctcgcgacgcgcgctcagcttgagctcctcggcctccttgcggctcttggccatgagctcctcgcggaacttctccatctcctgcgtgttgcggcgcatcatctccgcggcctcgcgacgggcctcggcgatggccgtcttctggtcggccagcagcttctccgcctcggcgcgctcacgcttggcgctctcgatggagctggcgatctgcttctcgcgctcctcgaccagcgaaaggatggggccccacgccttccacttcaggacgacg

SEQ ID NO: 1247 - DNA, 32241 bp, Myxococcus xanthus
  unsure (1)..(32241): unsure at all n locations
gacgcgcgccgagcccgacggcagcggctggtacgactcgtccgcgcacatgctgtggattggcgagcgcacccgccagctcgacggcggccacgtggagttcatgcgcggcatccagaaccccattggcatcaagtgtggccccaccatggagcccgacgaagtgctccggctgatggacctcctcaatccccagggcatcccgggccgcatcaccctcatcgggcggtttggcgcggacctggtcgcggaacggctgccccggctcatggccgccacccgccgggacgggcgcccggtcatctggtccatcgacccgatgcacggcaacacccacaaggccggcaatggctacaagacgcgctccttcgaccgcatcctcacggaggtgtgtggcttcatggacgcggccgccgcggaaggcgtccaccccgggggcctgcacctggagatgacggggcagaacgtcaccgaatgcctgggcggcccacagcccgtgacggaagacgacctctccagccgctaccacacccactgcgatccgcgcctcaacgcggaccaggcccttcagttggccttcctcgtcgccgaatccatgccgtcccttcgcacgcacgaagcccgtgcggcctgaatcgcaggagcctttcgtgaccgcctcgttctcaccgcgacaggagcgtctgctcatcctgctgctggcgggcgtgcagttcacccacttgctggacttcatgatcgtcctgccgctggggcccgagttcatgcggctgttcagtctgtcagccgcgcagttcggaacgttggtgtcctcctacacgttggcctccgccgccatgggcgtgctggggctcgcgtgggtcgacaggtttggccgcagaagcacgttgctggtcatcctgggagggttcatcacagccacgctggcctgcggcgcggcgcagagccacgcgtggctgctggtggcccgaagcatcgcgggaggatgtgcgggcctcatgggcgcggtcatcatgtccatcatcgcggacaccatccccggtgaacgccggggccaggccattggcacggtgatgtcatcgctcgggttgtctgcggtggcgggtgttcccctgagcctgggcatggccaacatgctcggctggcgcgcgcccttctgggccattggcgtccttggggcgctcctgtggttcgggctgctcgccgtgcttccgcgactggatgcgcatgtcaccacggactcggatcgtcaggcgccttccgtcacggcgctcttcacgccgggcttcgcgctgggctggctgctgacgttcagcgtcgccttctccagcttcttgctgattccgtacctgagcgcgttcatggtcggaaacctcggactgaagcagaccgacctgccctgggtgtacctggctggcggcgccgccacgctgctcgcggcgcgtcaggtgggccgctgggtggaccggtttggccccgcccgggtgctcgggctgctgctggtgggcactatggtgccgcacctgggcttcacgcaccttcccgccgctccgctgccggtggtgatggtcgccttcgtcctcttcatgtccctgacgtccacgcggcccatccccaccatcgcgttgatctccgcgaaggtgccgccgccgctgcgcgggcggtacatggccatgaacatggccgccagcgacggtgcctccgggctcgcggcgtgggccagcggcctgatgctggccaccacgcctggcggtgcgctggtgggcttcgggctggccggatggctcgccgtgggcgtcaccaccgtttcgctcttcatcctctggacctttggccgtagcgccgtcccgctcaacgcggcgcccacgcctcggtgaatcgcagtctccgtctcgacccacagaaggaaacgtccatggacactcccgtcaagaagcacccttccctgcctcgtcccatccagggcgagctgaagctcgaccgctccaaccagctcctcgccgaggcgcggcggctggtccccggcgtcacgcagtccatgatgaagcgcccggagatgttcgcgctcggcgccttccccgtgttcctggccaagggcaagggcgcgctggtggaggacgtggacggccaggagtacatcgacttcatcggcggcctgggcgccaacatgctgggccacaatgacccagccgtggtgaacgccatccgggagcacctggaggaaggggtcctccactcgctgcccacgcccgtggaggtctccgccgcccagacgctggtggacctcatccccggcgcggagatggcgcgcttcttcaagacgggcgcggatgccacgtccgccgccgtgcgcctggcgcgccacatcaccggcaagcagaagatcatcaccgtcggctacaacggctggcacgaccacttcatgttcgacacgccgggcgtcccggccgcgctggcggcgctgacccttcggatgccgctcttcacgcccccggacgaaccggccctgctggccagcatcgagaagaacgccagcgagctcgccctggtgctgttgtcggtgccctacaaccggcccctcaccccggccttcctgcaacaggtgcgcgccacgtgcaccgcgaacaacgtcctgttcgccctggacgaagtcgtcaccggcttccggctcgccgtgggcggcgcccaggagttcttcgacgtccgcgcggacttcgtcacgctgtccaagagcatcgctggcggcatgccgctgtcggccatcgccggtccggcgaagcacctgagccgcctgagcgagctccaggtgtccaccaccttcggcggtgagctgctgtcgctgtacgtgtgcgacgcggtgctgaagggctaccgggatggcgcctacatccagcacctggcccacctgggccgcaagctgcgcgagggcgtcaacgcccaggcggaggccgcgggctcatcgttgcgcgtgattggctacgacgcgattcccttcttcctgttcgccaaggacccgacggagcacgcgaagcagatgcagcccttccaggcgggcatggcccgccggggcatcctgctgcgccgcgacgtcaccttcctcagcacggcgcacacggaggagcagattgactacgccatcgagatgacgggcgaagtcctccgctccctcgcgcagccggcggcggcctagcccttcgcgtcgtggtggtccgaggtgccgcgcttccaatagcccgtcacccggacccagctcttgttggcgccacgctcgttgatgaggtggtccttgatggggcgcacggtgtgcgcctcacccgccacccaggcgaagtagtcccccgcggggaactccagcccgcggatggcctgctgcaacacgtccgagtgccccgcctccacgccgttgcggtgcagccacgtcactgtcgcgttggcgcgggtggtgaagtgctgctcctcggacgcgtccgggacttcgcagaacacgatggcgcgcgtcccctccggcagctcctccaggatgcggccaatggccggcagcgctgactgatcgcccgcgagcaggtaccaactgaaatcctgcgccacgaacgtggagccgcgcggcccacccacggccagcaggtcacccacctgcgccttgctcgcccacgtcgtcgcgggccccgtgccgtgcaccacgaagtcgatgtccagctcgcctgccgcggcgtcatagcggcgcggcgtgtagtcacgcgcgtccggcttgcgctcgccttccttcagcaccaaccccgtgggcgtcaccgtggggatgacaggcatgcgcttgccctcctccgggaacagcagcttcacgtggtcgtccgcgccggggctgtagaagccctccaggtcctcgcccgcaagggtgatgcggaccatctgcggcgtcacccgcgtcacccgcttcacctccaagaggcggaacttcacggggaacggtccccgccgatagacacgctcagtcgtcgtcgtcacgaatgctccaggtatcgatattgaatatcattttcgataccatgaagccccccaggcgggcaacgaatgaaggagccccgcggtggccgccgctcagcgaacggccagccgcggggaggtctggcatgtgggttgacacggcttgctcacatgccagctagcgacctcagccgcaggtcagggtccaccggcagttgttggacagacactcccgcgcgctgccgcagatggcgcccttggccttcttgttctgacacttgccggcgttgagcccccagccgcagtactgggtgctggcgcagtcgctgtcgttggtgcaggtggagctggtcggatactgggccgcgcgggtctccttcggcacgtaggccgccacaccgctggtgtcgatgttcgccgcgctgtccgccatgccggtgcgcgttccggtggcccgctcccacatccggatgaacgtctcggacgagccctccaggcccgtggtgttgacgccgagctgcttcaggtcacgcaccacgtccggcagcaggcccacgtgggccaggccgtagttgtcgaagtccgtgcccagcggcggcgggccagcggtgagctgctgctgcgcctggaacgccgcctccgcggcgaagccggccgagcaggcgccgtgggggccgaaccgcgggcgggtctgctggatgaagccgttgaggtccgcgccaaagcccatgttcaccttgaggcccaggcggccgaactcataggcctgcgccagcgagcgcgtggagccctggcagttgttggcgaccggcgtgcgggtgtagtcgcgcgtgtcatcgtgcgcggtgcgcaggccgaacatgccgcccgtctgacgcacgttgcggatgatggacgcgggcgtcgtcttctcgttggcggcgagccccgggtgcatcacctcacggaaatgaccgtgggagatgtacatggggtagtagttgcggctctgggcgatggcgaacgtgtcgtccacggagcgctcggacatgtgcgccacgtcgacgagcatgcccttgttcatcatctcggcgaccagcgcccggccctcggacgtcaggcccttggtgttcttgcagttggcgtccacatcgaagcctagcgtgaagccgttgcccgtgaggccgcagtcggtgtccacgtggcagttctccaagaactgcgagacctggaagatggcgttgtggggcgccgcgccgccgaaacggttgtccagttggtgcaccggctggatggagcgcacgcccagcgagtagacgcggttgagctcggactgccagttcttggtgccgaacagcttgctcgactcgatggagagcaccatggccagcttgccggaggcgatgatctgccgcgcgtgcgccggcgacagcgcgatctccgcccacggcgtgcgagcgtcgaagtcacgcgccatctgcaactgcacgtccacgtccaccatctcgtcacatggacgcttgatgttctggtacggcagcgccctgcagaggaactcgttgctcaccagggagatggtgaccagggacatgccaccctgatgcgcctgctgcagccagccctcccaggcctgctgatgcgcgatggtgtcccatcgcggccactgcgtgggcacgctcatccgccccaggtggagaccggtgtcgccctccgttccttcgacctcgccgatgatttccgacgccaccgcgccgcccaccccgaacatctgcgacagcaccggcacgccgctcaggttgattccgcctgcgttggggcacacgttgagcatggagcccaggtccatgcgaacgcgcgcgtggtcgctctccggaaagccaccgtcacagctcaccagggagccgttgtgcttgccgtggaaccaaccaccgccgaacgcctcctcggcgaacatgtggtggtgcatctccgcgaagccaggaaccgagacgggctgtgcgacttcgcccgtcgcggactcctcgacagacaagtcttcatccgtgggttggcacccctggctcagcgccatgacggacaggagggagagggacaggaaacgccgtggggctgctccgatacatcgctgcatacagtgcacctttccggtaccgcggggaggtgcactcgaagtaccaggagcgtgtcctgtttttcaattggttcaacttattcttagaaagtgaaacagacaggcgtcacacngtgagtcggtgtgaagcgtcacgttacaaacggcgttcaggacccatgggcaggtggggcaagcccccaccatccacagattgacgctccaagatgctctcgacctcacggagctgctgatgacgaagtcctggcgtgcgaccccgtgctgttgacccttctggctgcctgtgagccgccaccggtggacgactcgcttccgtcatctaatgaagcgcccgcgcggcggcccgcggaccaccgaatgtgggagccctgtgggaccagcgtgcgcaggctcgcggacatccaccccggcccccaggaggcagccatccaggaaggcctccacggggatggcttgctcttcttcaccgcggatgacggtcaacacggcgccgagctgtggacgagcagcggcacgcagggcgaaggaacccggctgctccgggacatcgcgccgggaccggagggctccaaccccaccgacctcacacgcgtgggagaccggctcttcttcatcgcggacgatggggtgaatggccgcgccctgtggaccagcgacggcacgtccgaaggtacgtccctggtgaagcgcgtgcttcccattggcgccggccagggagagggacagacgctggtcgcgtacaagggccggctctacttctccgccgccgcgccgggtggcgcgcacggcaacgagctgtggaccagcgatggcacggacgcgggcacccatgaggtcgcggacctcgtcccaggcgaggacagttccttccctcgtcgcttcaccgttcacgacggctcgctctacttcgtcatcagcgtgggcgaagagaactggctcgtgcgaagcgaaggcggcgcggccttcacgcccctcctcaaggtcttcgaggacacggtcatcttccgcatgaagtccgtgggcggaaggctcttcttcctcgtggaccccgacgaaggcgaggccacgctctacgtcacggacggcacggcggcgggcacacgtcgcctgcgcttctttccgggccggtacccgcacgacctggtgccgttccagggccggctctatttcagtgcgggctcggacgcgccggagggcgaggaactgtgggtcagcgacggcacggtgtccggcacgcggcgggtgaaggacatccggcccggagcggagggctcggcgccggcgttcctggccgtgcttggagatcacctctacttcgcggcggatgacggccagcacggccgcgagctgtgggtgagcgatggcacgtcgaaaggaacgaagctcttcgcggacctggtgcccgggacggagggcgcatcccccaccgaggtgactgccatccagggctggctcttcttcggcgcgacgacggggcatggcgcggagccctgggtgagcaacggcactgtgtccagcacccggaagctcgacgcggggaccgcgcgagccccacgcgccttcatccgctccggctgggacgtgttcttcaccgccgaggacgaagccagcgggcgcgagctctacgccctgcccttccgtcccgccaacgagtgcactcagacgaaaccctgagcccgcccggagatggcgttcggctccgtctagctcagcgccatcgtctccgcgatcacgtcaaccgctggtgccctgaggatggagtggtgatcaccggagagttcgtgcacctccacccctcctgccgccagcgcaccccagccgccatccgtgcccgtgggtacgcgcgtctcgctcgcgcgcagcagagtgacgcggccaccgtatcgtccgggttgataatcccagagggcgcggaggttgctctcgtaaacacggtacagcgcgtggagttgttcggatccaacgccctgagccagaacgccggtgcgccgccccagctccaacaggcggtccagcagcgaagcctcgtccgcgggatgcgcatccgcgatcaactccgagaggggcaggcccaggagctgacccgtgaactccacgaaccgggcggcaatccactccgcgcccacgggttccactggccgctgatcgaaggcgtaggcgtcgatgagcgtcagctgctccacctgctccccctgctgctccaactgccgcgccatttcgaaggccaccacacctcccaaggaccaccccgccagccggtatggcccgctggcctggacgccgcgcatggcctccacataggtggaggccatcgcctccacggtccccagcggagcccgctcgccttcgaggcccggggcctggaacgcgtagaacggttggtccggccccaggcgccgcgacagttccaaatacggcaggacgttgccgctgacagggtggacgcagaagacgggccgctgcgaaccaccactctggatgggcaccagcgaggacacgtgtccgggtgcgtgccggagccgagaggccagctccgccagcgtccccgcctggaacagtgaaaccacgggcaggctgcgtcccaggcgctcgcggatgagcgacaccatccgcatggccaggagtgagtgccctcccagctcgaagaaatcggagtggatgccaatggggccggtgcccagcaactcctcccagatgcgcgtgagctggagctccagcgcatcccgaggcgccacataggcccgcgtcgactccggacggagtgcgtccggcgccgggagcgccttgcggtccaccttgccgttgggcgtcagcggcagcgaggccagcaccatcaccaccgagggcaccatgaagtccggcagcccttccttcacgaagcgccggagcgccgtggcatcgggcaccctgtccgactgcggcacgatgtacgccaccagccgccgaccttcgctccggtcgtcgcgcacaaccaccacggcctcgcgcacgtatggatgccttcgcaacaccgcctcgatttcgcccagctcgatgcggaagccacgcaccttcacctgctggtcgattcggcccaggtactgcagcacgccatccggcaaccaccgcgcgctatctccggtgcggtacagccgcgctccgggctgcggactgaacgcgtcgggaacgaagcgctcggcggtcaactcgggccggtcgacataccctcgggcaagcccagccccgcccaggtacagctcgcccgccacgccctgaggcacgggttgaccgagcgcatccagcacgtacgcacgagtcccctcaatcggccgccccacggtgggctcccgcgtggcgccgcgaggggccacggtccaggtcgagtacgtcgtgtcctcggtggggccgtagaggttgagcacgcgctgcacaccgggtgcggactggtggatggattccaccagggattgggccagcggttctcccgccaggttcaccgtgcgcaccgagtccggcacggtttgggcacgcaccaactccgccatcgcggagggcaccgtgttgatgagcgtcacccgccgtgcccccgggagcgacggcaactccaaggcattactagcgatgaccacggacccgccacggatgagcggcgcgaacatctcgaacacggacaggtcgaagttgagcgacgtggaggcgaggacccccgccagttcgtccgacgagaaggcccgcgtcgtccagcgcaggaaggccacagcgctgcgatgcgccagggccacgcccttcggccggcccgtgctgcccgacgtgaacagcacgtaggccagatggtccggagcggacctgagcaccggcgccgcctcggcttccgccacgagcccattcgcatcgtcgagcgccaaccgtgccacgtccccgtgaggtagcgcgtcgagcagcgcgcgctggcccaccaggacgcgaggctgggagtcctcgatcatgaaggccagccgctggctcgggtatgccgggtccaacgggacgtacgcgccacccgccttgaggatgccgagcaccgcgatcagcaggtccgaattgcgctccgcacagaggcccacgcggacctccggcccgacgcccagagtgcggagcttccgcgccagccggtccgaccgctgcatgagctcgcggtacgtgagcacttcttcaccagccaccaccgccacggcgtcgggagtggccgccgcctgccgttcgaccaaggcgtggatgctcgtctccgcgacgtcgccggagccggtgtcattccactccaccagcaaccgccgctgttcatccgcgtccagcaagggcagcgcgaacacggaccggtccggctccgtcacggcaccttcaagaagcgtcttcaggtgggccagaagtcgtgctgcagtctcgggctcgaagaggacggtgctgtactccagtccaccggagaagccgtccttgccttccacgaagccgagcgagaggtcgaaccgcgacacccgatgctccacggcgacgtgcttcatccccatgccggcctgtgcgtcgcctccagcatctggcgtgctgtcgaaggtgagcatgacctggaacagcggcgaatgactgaggctgcgctccggacgcagcgcctcgacgagcttttcgaaaggcacgtcctggtgcgcgtaggcgccaagcgtgacctcccggacccgagccagcagctcacggaaggacgggctcccctccagccgggttctgagcaccagcgtgttcacgaagaagccgatgagcccctccgtctccgcgcgagtgcgtccggcgatgggcgaaccgacgctcacgtcgtcctgccctgagtaacgcgccagcacggcctggaacgccgccagcagcaccatgaacggcgtgacgccttcacggcgggcgagtgcatgcaccgcctcggacagctcacggcccaacgagaagggcacgtacgccccttccagggactggaccgccggacgcggcctgtccgtgggcagctccagcaaccggggcgcgccgtccaggcgttgcttccagtagccgagctgcgcgtccaggacgtccccctggagccactcgcgctgccagaccgcgtagtccgcgtactgaagcggcagctccggcaggtgcgacggctgtccctgggagaaggacgcatagaactcggtcagctcgcgaaccaggagccccatggaccaaccgtccgagacgatgtggtgcatcaccagcaccaacacatggtcctgctccgacagcgcgagcaaggcgagtcgcagcagcggaccgctttccaggtcgaacgggcgctgtgacgcctcttgcgcgatccgctgcgcctcctcttccctctgcgcggctggcagtgagcgcaggtccacgatgtcgagccgcgcgccgccccgtgggtcgatgacctgtaccggcgaaccgccctcggtccggaacgtggtgcgcagcgcctcgtgacgatggaccagtgcgtcgaagctctgcttcagcgcgggaacgttcaaggcgcccgacaaccgcaccgacgccgggacgttgtagacggtgctgtcaggctccaactgcgcgaggaaccacaagcgctgctgggcgaatgacaggggaagcgccctgtcgcgagaaacccgtaccaacggtggtggctgcgcgccgccatctgttttcgaagtgtggtccagccgctgggcgagcttctccaccgtgggacactcgaagatgtctcgaagggggagctctgcttggagctcctcccgcacacgcgacaccaactgcgttgccagcaaagagtgtccgcccagttcgaagaagtctccgtcgagcccgacccgctcgaccttcaggacgtcgacgaagattgcggccaacgtcttttcggtcgctgttcgaggcgccacatatttctcgctcgccgtgcccgctgtgtccggcgcgggcagtgccttgcggtccacctttccgttcggcgtcagcggcagcgcctccagcaccacatacgccgacggcaccatgtactccggtagccgctgcttcatgtggcttcgcagtgcacccgcgtccagtgtggccccttcctgcgccgtcacataggccaccaaacgcttgccttcgcctccatcctcccgcgccaccaccacggcttcgctgacgccactgtgctgggccagcgccgcttccacatcacccagctcgatgcgatagccacgcaccttcacctgcgtgtccgctcggcccaggaactccagcgtcccgttcctcaaccaccgcaccacgtcccccgtgcggtacagccgctctccgtcgccgtacggattcggtacgaagcgttccgccgtcagctccgggcgccccacgtaccccatagccaggccgtctccgcccacgtacagctcacccggcacgcccaccggcaccgggcgcatccccgcgtccagcacgtagaccaccgtgttcttcaccggccggccaatggacaccgaggcacctacttcttccggactctccatccggtacgtgctggagaacgttgtgttctccgtcgggccatacccattgatgagcacaccgcccgctgccaaccgctccttcacgcgggacacaggcagcgcgtcgccacccgccagcagctggcggacactggccagcgccttcggctgcctcgcctgcatctgctcgaagagcgccgctgtcagccacagcgacgtcacgcctgacgattccagattccggcccagctcctccagcgacggcgtccccgccgggtacaccaccaaccgcgagccgtgcagcagtgcgccccacacttccagcgtcgatgcgtcgaaggagatgggcgccagttgcagccacacctcttcgggcccgaagtgcgcgaagtccgtccccagcaccaagcgagacaccgcacgatgcggtacgcccacgcccttcggcttccccgtgctccctgacgtgaacatcacgtacgccaggtttccgccgcccacgttggcactcggcgtggtttgcggatgatgggcaatctgcgtgtcccactccgtgtccacgcacaccaccagctcgctacccgtggctacctcgtccgcgagcttctcttgcgccaccagcaccgcgacgcccgcctcttgcttcatccacgccagacgctctagcgggtagctggcatccagcggcacgtatacgcctcccgccttcaggatgcccagcacgctcaccaccagctccagtgagcgctccacgcacagccccacccgcacctccggcccaacgcccattctcctcaggtggtgcgccagctggttcgcacgccggttcaactccgcgtacgtcagtcgctggtcctcgtactccaccgccactgcgtccggcgtccgctgtgcctgctgctcgaagaggacactcaggctggcatcgcgtgggtacgtggaagccgtcccgctccactccttcaccagtcgctgccgctcctcactgcccatcagcggcagctcggccagccgcgtctccggcgcggcgacggcggcctccaacagcaccctcagatgccctagcagccgctccatcgtctcggcttcgaacaggtcgctgttgaactccaacgcccccgtcagtccgtctgtgctcgacgcccccaagccgagcgtcaagtcgaacttcgacgtcttccccgtcgactccgctgcctccagcttcagccccggcaggcttaccgcgcctcccggagtgttctgcagcaccaacatcacctggaacagcgggctgcggctcaggtcccgctcgggctgcagctcctccaccagcctctcgaaaggcacttcctggtgcgcgtacgcacccagcgtcacttcgcgcacctgcgccagcaactcacggaagctgggattgccatccagccgtgtccgtagcacgagcgagttcacgaagaagccaatcaactcctccgtctcggctcgtgtgcgattggcgatgggagagcccacagagacgtcgtcctggcgcgcatagcgcgacagcaccacctggaaggctgccagcagcaccatgaagggcgtcgcgttctcccgctgccccagccccttcactccctcccacagctccttcggccactccagccctcgcgtgtcccctcggtacgtctggaccgccggcctcgccttgtccgtcggcaactccagtgccgctggcgcacccgctagctgcttcctccagtaccccagctgctcttccagcacctcacccttcagccaccctcgctgccacaccgcgtagtccgcgtactgcacctccagctccgccagcggtgactcgcgcccctgcgagtacgcctcgtacagcgccaccaactccctcaccagcacgcccatcgaccagccgtccgacacgatgtggtgcatcaccagcaccagcacgtgcgcttcttccccctccttcagcaacgtcgccctcagcaacgggcccgtctccagattgaacggacgaagggtttgaagttccgttcgacgctggacctccagggtcttctccgagccctggagtgcactcaggtccacaaactccaacgcgccccttcccgcgggagagatgacctgagtgggaacgcctgcctcggaacggaaggtcgtgcgcagcgcctcatgacggagaaccagtgaatggaagctccgctccagcgccgcaacatcaagggcccccgagagcttcaccgccacgggcacgttgtagaaggcactgtcggggtcaagctggtggaggaaccacagccgttgctgcgcgaatgacagaggaagcgcgccatcgcgtgaagctcgaaccagcggaggggctctcagcccagcagcgactcccgaggcactgtccagccacctcgccagtgtctcaacagaccgagactcgaagactgtccggagtggcagttcaacccggaaggcctcacgtacgcgtgacaccaactgcgttgccagcagcgagtggccacccagctcgaagaagtcttcgtcgacgctgacgcgctcgacgttcagcacctcggcgaagatggatgccagcttctcctcagtcgccgtgcgaggcgccttgaagtgcgccgtcttcggcccctgggcatccggggcgggcagcgccttgcggtccaccttgccgttcggcgtcagtggcagcgactccagcaccacgtacgccgacggcaccatgtactccggtagccgctgcttcatgtggcttctcagcgcgctggactccaggctcgtacccgtgcgcgctgtcacatacgccaccagtcgcttgccttcgcctccatcctcccgcgccaccaccacggcttcgctgacaccactgtgctgggccagcgccgcttccacttcacccagctcgatgcggtaaccccgcaccttcacctgcgtgtccgctcggcccaggaactccaacgtcccgttgctcagccaccgcaccacgtcccccgtgcggtacagccgctctccttcgccgtacggattcggtacgaagcgctccgccgtcagctctggacgccccacgtaccccactgccagcccgtctccacccacgtacagctcacccggcacccccaccggcaccggccgcatccccatgtccagcacgtaagccaccgtgttcttcaccggtcggccgatggacaccgaggcacctacttcttccggcctctccatccggtacgtgctggagaatgtcgtgttctccgtcgggccatacccgttgatgagcacaccgcccgctgccaaccgctccttcacccgcaacaccggcaaggcgtcgccacccgccagcaactggcggacactggccagcgccttcggctgccgcgcctgcatctgctcgaagagcgccgccgtcagccacagcgacgtcacgcctgacgactccagcttccggcccagctcctccagcgacggcgtccccgccgggtacaccaccagcttcgctccgtgcaggagcgcgccccacacttccagcgtcgatgcatcgaaggagatgggcgccaattgcagccacacctcctccggcccgaagtgcgcgaagtccgttcccagcaccaagcgagacactgctcggtggggcacgcccacacccttcggattaccagtacttcccgacgtgaacatcacatacgccaggttgccaccgcccacgttggcgctgggcgtggtttgcagctgatgggcaatccgcgtctcccactccgtgtccacgcacaccctggactcggtgtcattgagccccatggactcgagcagcttctgctgccccaccagcagcgtgacgcctgcttcttgcttcatccatgccaggcgctccagcgggtagctggcatccagcgggacgtacacgcctcccgccttcaggatgcccagcacgctcaccaccagctccagcgagcgctccacgcacaagcccacccgcacctcgggccccacccccatgcttctcaggtggtgtgccagctggttgccacgtcggttcagctccgcgtacgtcagccgccgatcctcatactcgaccgccaccgcgtccggcgtccgctgcgcctgtgcgtcgaacaactgcgccaacgacgcttctcgtgggtaatgcgcagtcgccccgctccacgccttcatcaaccgctgctgctcttcactgcccatcagcggcagttcggccagccgcgtctcaggccgagtgacggctgcatccaacaacacccgcagatgctccagcagccgcgccatcgtctcggcttcaaacaggtcgctgttgaactcgaggcctccagaaaggccctcatccgtctcactcaagccgagcgtcaaatcgaacttcgacgtcttcgcagacgactccgccgcctccagttgcagccccggcaggctcaccgctcctcccggcgcgttctgcagcaccaacatcacctggaacagcggactgcggctcaagtcccgctctggctgcagctcctccaccaaccgctcgaagggcacttcctggtgcgcgtacgcacccagcgtcacttcacgcacctgcgctagcaactcacggaagcttgatgccgcagacacctgcgtccgcagcaccagcgtgttgacgaagaagccaatcagcccctccgtctctgccctcgtccggttcgctatcgccgtcccgacgcacacgtcttcctgcctcgcgtacctcgacagcaccacctggaaggccgccagcagcaccatgaagggcgtcgcgctctcccgctgcgccagccccttcactccctcccacagccccttcggccactccagccctctcgtgtcccctcggtacgtctggaccgccggcctcgccttgtccgtcggcaactccagcgccgctggcgcacccgctagctgcttcctccagtacccaagctgctcttccagcacctcacccttcaaccaccctcgctgccacaccgcatagtccgcgtactgcacctccagctccgccagcggtgactcgcgcccctgcgagtacgcctcgtacagcgccaccaactccctcaccagcacgcccatcgaccagccgtccgacacgatgtggtgcatcaccagcaccaacacgtgcgcttcctccccctccttcagcagcgtcgccctcagcagcggccctgtctccaggttgaacgggcgaagcgcctcttgctccgcgaggcgttttgtctccagccctccttcaccatcgtccggagttccgcgcgccaagacttccaaccggttcgatgcagtgtcggagacaatctggacgggcatcccgtcctgagcacggaaggtggttcgcaacgattcgtgtcggcgaaccaactcatcgaagctacggcgcaacgctgcaacgtcgaggacgccggtgagcctcactgcgaccggcacgttgtagaaggcgctgccaggctccagttggtcgaggaaccacagtcgctgctgagcgaacgatagcggcaatgccccctggcgcagagcccgcttcagtggtggcgcctggggcatcaagccccccacctgttcgtggcccagcttgagggccagttgctccaccgtcggagattcgaagacgtccctcagggggagttccacctgtaaggactcgcggacgcgtgacaccaactgcgttgccagcaacgagtggccacccagctcgaagaagtcttcgtcgacgctgacgcgctcgacgttcagcacctcggcgaagatggatgccagcttctcctcagtcgccgtgcgaggcgcctcgaagtgagctgtcttcgggccctgggcatccggggcaggaagcgccttgcggtccaccttgccgtttggcgtcagcggcagcgactccagcaccacgtacgctgacggcaccatgtactccggcagccgctgcttcacgtggttccgcaatgcacccgtgtccagcgaggcaccttcctgcgccgtcacgtaggccaccaaccgcttgccttcgttcccgtcctcgcgtgccaccaccacggcttcgttgacgccaccgtgctgggccagcgccgcttccacttcgcccagctcgatgcgatagccacgcaccttcacctgcgtgtccgcgcggcccaggaactccagcgtcccgttcctcaaccaccgcaccacgtcccccgtgcggtacagccgctctccctcaccgaatgggcttggtacgaagcgttccgccgtcagcgccggacgccccacgtaccccactgccaggccgtctccgcccacgtacagctcacccggcacgcccaccggcaccggccgcatccccgcgtccagcacgtaagccacggtgttcttcaccggccggccgatggacaccgacaccccgacttcctcgggcttttccatccggtacgtgctggagaacgtcgtgttctccgtcgggccatacccgttgatgagcaggccacctgccgccaaccgctcctccacccgcaacaccggcaaggcgtcgccacccgccagcaactggcggacattggccagggccttcggctgccgggcctgcatctgctcgaagagcgccgccgtcagccacaacgacgtcacgcctgaagactccagattccggcccagctcctccagcgacggcgtccccgccgggtacaccaccaaccgcgagccgtgcagcagtgcgccccacacttccagcgtcgatgcgtcgaaggaaatcggtgctagttgcagccacacttcctccggcccgaagtgcacgaagtccgttcccagcaccaggcgtgacaccgcgcgatgcggtacgcccacgcccttcggcttccccgtgctccctgacgtgaacatcacgtacgccaggtttccgccgcccacgttggcactcggcgtgatttgcggatgatgggcaatctgcgtgtcccactccgtgtccacgcacaccaccagctcgccacccgtggctacctcgtccgcgagcttctcctgcgccaccaacaccgcgacgccggcctcgtgcttcatccacgccagtcgctccagcggatagctggcatccagcggcacgtacacgcctcccgccttcaggatgcccagcacgctcaccaccagctccagcgagcgctccacgcacaagcccactcgcacctcgggcccaacgcccatccccctcaggtggtgcgccagctggttggcacggcgattcaactccgcgtacgtcagtcgctggtcctcgtactccaccgccaccgcgtccggcgtccgctgaacctgcgcctcgaagagggcactcaggtcggcatcgcgcggatacgtcgaagccgccccgctccactccttcaccaaccgctgctgctcttcacggcccatcagcggcagctcggccagccgctgctccggcgcggcgacggcggcctccaacagcaccctcaagtgtccgagcatccggtccatcgtcccggcctcgaacaagtcgctgttgtagttgaccatcgccatgacgccgtccttcacctcctccatcaccagagataggtcgaacttcgacgtccgcccctccgactccacaccggagagcctcaagccatctccgagcttcacctccgtcacgggcgtgttctgcagcgtcagcgtcacctggaacagcggactgcgactcaggtcacgctcgggctgaagctcctccaccagcttctcgaacggcacgtcctggtgcgcatacgcacccaatgtcacctcccgcacctgagcgagcagctcacggaaagttgatgccggggccaccttcgtccgcagcaccagcatgttcgtgaagaagccgatcagcccttccgtctcgccttgcgtgcgccctgcgatgggcgaccccacgcacacgtcgtcctgtctcgcgtagcgggccagcaccacctggaaggccgccagcagcaccatgaacggcgttgctccttcacgctgtgccagggccttcacccgctcccacaaggccaggggccaggactggtcgagatgtcctcctcggaagctctgcgccgcgggccgcggtttatccgtcggcagctccagcgattggggtgcccccttcagctgccgcttccagtatgcgagttgcgactccagcacctcgcccttcagccattcccgctgccacaccgcgtagtccgggtactgcactggcagttccggtagcagtgaggggcgcccctgcaagaacgcctcgtagagtgcggttacatcccgcacgaggacgcccatggaccacccatcagacacgatgtggtgtgtcaccaggatcagcacgtgctcctgctctgccagcttcaggagcgtcacgcgcagcaaagggccacgttcgagatcgaaccgctggtgtgcctcctgttcgaccagacgcgcgacttccgccgtgcgcacggcctccgccgatgactccagccccatgcttcggaaggccagcaccggctcggctgcgatgatttgaacgggttttccatcccgagtgctgaacgtcgtccgcagcgactcgtggcgccgcacgagctccacgaagctccgctcgagcacctcggcctggagcggcccctctacccgaaggacggccggcacattgtaggaggcgctcccttgctccatctgatccaggagccatagccgctgctgcgcgaacgacggaggcaatacccagctcccatccgctcgtggcgtcaagggcggagcggtgatcgacgcccccgtgcgaatggcatggtccacccgctcggacaggaccgacagcgtgggagcctcgaacaagtcgcggagcgggagctcgattcggaaggtgctccgaatccgcgacaccatctgcgttgccaacagtgagtggccgcccagttcgaagaaattgtccttcgaaccgacccgctccacgcccagcacctgcgagaagatcccagcgatcagttcctctgtaggagtacgcggcgccagataatcggaacctggcgtgcccagcatcgtcaccggagcaggcagcgccttgcggtccaccttgccgtttggggtcagcggcagcgcctccagcaccacatacgccgacggcaccatgtactccggtagccgctgcttcatgtggcttctcagcgcgctggactccaggctcgtgcccgtgcgcgctgtcacatacgccaccagtcgcttgccttcaccgccgtcctcgcgtgtcaccgcgactgcttcgttgacaccaccgtgctgggccagcgccgcttccacttcacccagctcgatgcggtaaccccgcaccttcacctgcgtgtccgcgcggcctaggaactccagcgtcccgttccccagccaccgcaccacatcccccgtccggtacagccgctctccttcgccgtacggattcggtacgaagcgttccgccgtcagctccgggcgccccacgtaccccatagccaggccgtctccgcccacgtacagctcacccggcacgcccaccggcaccggccgcatccccgcgtccagcacgtagaccaccgtgttcttcaccggccggccaatggacaccgaggcacctacttcttccggcctctccatccggtacgtgctggagaacgtcgtgttctccgtcgggccatacccgttgatgagcaggccacctgccgccagccgctccttcacccgcaacaccggcaaggcgtcgccacccgccagcagctgacggacactggccagcgccttcggctgccgtgcctgcatctgctcgaagagcgccgccgtcagccacagcgacgtcacacctgaagactccagcttccggcctagttcctctagtgacggcgtccccgccgggtacaccaccagcttcgcgccgtgcagcagtgcgccccacacttccagtgtcgatgcgtcgaaggaagtcggtgccagttgcagccacacctcctccggcccgaagtgcgcgaagtccgtccccagcaccaggcgtgacaccgctcggtggggcacgcccacgcctatcggcttccccgtgcttcctgacgtgaacatcacgtacgccagatgcccaccggccacactggaacgcaggttgctttctggctgatgcacaatctgagcgtcccactccgtgtccacacacacactggactcggtgtcggagagcatcatggactcgagcaacttctgctgccccaccagcagcgtgacgctcgcctcctgcttcatccaagtcagccgcttcagcgggtagctggcatccagcgggacgtacacgcctcccgccttcaggatgcccagcacgctcaccaccagctccagtgagcgctccacgcacaaccccacccgtacctcgggccccacgcccatgcttctcaggtggtgtgccaactggttggagcgtcggttcaactccgcgtacgtcagtcgctggtcctcgtactccaccgccactgcgtccggcgtccgctgaacctgcgcctcgaagagggcgctcaggctggcatcgcgcggatacgtcgaagccgtcccgctccactccttcaccaaccgctgctgctcttcatggcccatcagcggcagctcagccagcggcagctctggggcgctcacagcagtctccaggagcacccgcaagtgccccaaaagccgctccatcgtctcggcttcaaacaggtcgctgttgaactcgagcgcgcccgatagccctcccgcgctcgactctcccaagcccagcgtcacgtcgaacttcgacgtcttccccgtcgactccgccgcctccagcttcagccccggcaggctcaccgctcctcccggcgcgttctgcagcaccaacatcacctggaacagcggactgcggctcaagtccctctccggctgcagctcctccaccaaccgctcgaagggcacttcctggtgcgcgtacgcacccagcgtcacttcacgcacctgcgccagcaactcacggaagcttgatgccgcagacacctgcgtccgcagcaccagcgtgttgacgaagaagccaatcagcccctccgtctctgccctcgtccggttcgctatcgccgtcccgacgcacacgtcttcctgcctcgcgtacctcgacagcaccacctggaaggccgccagcagcaccatgaagggcgtcgcgctctcccgctgcgccagccccttcactccctcccacagccccttcggccactccagccctcgcgtgtctcctcggtacgtctggaccgccggcctcgccttgtccgtcggcaactccagcgccgctggcgcacccgctagctgcttcctccagtaccccagctgctcttccagcacctcacccttcagccaccctcgctgccacaccgcgtagtccgcgtactgcacctccagctccgccagcggtgactcgcgcccctgcgagtacgcctcgtacagcgccaccaactccctcaccaacacgcccatcgaccagccatccgacacgatgtggtgcatcaccagcaccagcacgtgcgcttcttccccctccttcagcagcgtcgccctcaacagcgggcccgtctccaggttgaacgggcgctgaatctcctcttcgatccagatccgcaccctggattcgcgctccgtttccagttcactgaagtcgagctgctggaaaggctgaagcggatccgttgcgatgacctgcacgggttcaccgccactgacacggaacgtcgtgcgcaatgactcgtgccgccgcacgagttcactgaagctggcctccaacgcggtcgtttgcagacgcccagtcaacttcaccacggaggggacgttgtagaacggactgcctggctccaactggtcgaggaaccacagccgctgctgcgcgaatgacagcggtagcgcatcgctccgagaagcgcgcgtcaggggtggtgctcgaacctcggccgctgccgtcccgcgggatgcgtcaatccgttcggccagcttccccactgtggaggattcgaagatgtctcgcagcgggagctctacctggagttcttccctcactcgcgacaccaactgcgttgccagcagcgagtgtccgcccaactcgaagaagtccccctccagtccgacgcgctcgacgttcagcacctcggcgaagatggacgccagcctctgctcagtcgccgttcgaggcgcctcgaagtgcgctgccttcgggccctgggcatccggggcgggcagcgccttgcggtccaccttgccgttcggcgtcagcggcaacgactccagcaccacgtacgctgacggcaccatgtactccggtagccgctgcttcatgtggctccgcaatgcacccgtttccagcgagacaccttcctgcgccgtcacataggccaccaaccgcttgccttcgctcccgtcctcgcgtgtcaccgcgactgcttcgttgacaccaccgtgctgggccaatgccgcttccacttcgcccagctcaatccgatagccacgcaccttcacctgcgtgtccgctcggcccaggaactccagcgtcccgttccccagccaccgcaccacgtccccagtgcggtacagccgcgctccctcaccgaatgggcttggtacgaagcgttccgccgtcagctccgggcgtcccacgtaccccactgccaggccgtctccgcccacgtacagctcgcccggcacccccaccggcaccgggcgcatccccatgtccagcacgtaggccaccgtgttcttcaccggccggccaatggacaccgaggcacctacttcttccggcctctccatccggtacgtgctggagaacgtcgtgttctccgtcgggccatacccgttgatgagcaggccacctgctgccagccgctccttcacccgcaacaccggcagcgcgtcgccacccgccagcaactggcggacgctggccagggccttcggctgcctcgcctgcatctgctcgaagagcgcagccgtcagccacagcgacgtcacgccggacgactccagcttgcggctcagttcctccaacgtcggcgtccccgccgggtacaccaccagcttcgcgccgtgcagcagcgcgccccacacttccagcgtcgatgcatcgaaggaaatgggcgccagttgcagccacacttcctccggcccgaagtgagcgaagtccgttcccagcaccaagcgtgacactgctcggtgaggcacgcctacgccctttggcttccctgtgcttcccgacgtgaacatcacgtacgccaggttgccccctcccacatgcgtgctcggtgcgacctccggttgcagggcaatctgcgtgtcccactccgtgtccacgcacaccaccagctcgccacccgtggctacctcgtccgccagcttctcctgcgccaccagcaccgcgacgcccgcctcttgcttcatccacgccagtcgctccagcggatagctggcatccagcggcacgtacacgccccctgccttcaggatgcccagcacgctcaccaccagctccagcgagcgctccacgcacaaccccacccgaacctcgggcccaacgcccatgcccttcagatgatgcgctagctggttggcacggcgattcaactccgcgtacgtcagtcgccggtcctcgtactccaccgctaccgcgtccggcgtccgctgcacctgctgctagaagaggacactcaggctggcatcgcgcgggtactccgacgccatcccgctccattccttcaccagtcgatgctgctcctcactgcccatcaacggcagctcggccagccgcttcgccggctctgcgatggccgcctccagcagggtccgcagatggtggagcagccggcgcaccgtctctgcttcgaacagctcggtgttgtagttcgccgccaccaccacgccgccctgcacttcctccaccaccagggagaagtcgaacttcgacgtccgcccctccgactccacgccagacagcgtgaggccgtccccaagcttcacctccgtcacgggcgtgttctgcagtgtcagcgtcacctggaacagcggactgcgactcaggtcacgctcgggctgaagctcctccaccagcttctcgaacggcacgtcctggtgcgcatacgcacccagcgtcacctcccgcacctgagcgagcagctcacggaaggttgatgccggggacaccttcgtccgcagcaccagcatgttcgcgaagaagccgatcagcccctccgtctcgccttgcgcgcgccccgcgatgggagcccccacgcacacgtcctcctgccccgcgtacttggacagcacccactggtacgcagccagcaacaccatgaacggcgtcgcaccttcacgacggccgagcgcctccatgtcgcgccagagcgccttcggccacacctcgtgccgcaaaacgccgccatacgtctgaacggcgggcctcgccttgtcggtcggcagctccagtgccgcgggcgccccttccaaacgttgcttccagtacccgagctgcgcctccagcacctcgcccttcagccactcccgctgccacaccgcatagtccgggtactgcaccgccagttcaggcaagggtgatggacggccctgggagaacgcttcgtacagcgccgcgacctctcgcacgaggacacccatggaccagccgtcggacacgatgtggtgcatcatcagcaccaacaggtgctcgcgctccccgaggcgaagcagcatggtccgcagcaagggtcccttggccagatcgaacggccgaagcgcctcgacgtccgctcggcgctgtgcctcctgctccgcatcagggagcccgctcaggtcctcgaccgtgaacaccacctgccccacaggcgcgatgacctgcacgggcgtcccaccgtcggcgtggaaagtcgtccgcaaggattcatggcgacgaaccagcgcgtcgaagctgcgttccagtgcggccacgtcaagcggccccgacaccttcaccaccgccggcacgttgtagaagacactccccggcgcgagctgctccaggaaccacaagcgctgctgcgcgaacgacagcggcaggacgctcgtcagtcccgcccggggcttcaacggaggcgcagcgaagcccgctccggcgcgcacccaacggtccacccgctcggcgagcgcagccaccgtgggtgcctcgaagaggtctctcaggggcagctcgacaccgaaggcgccacgaatgcgggagatggcctgcgtcgccagcaacgagtgccctcccagctcgaagaagccactgtggatccccacacggtcgagccccagcacctcggagaacagccccgccaccagttcttccgtggccgtgcgtggcgcgacaaaagcctcggcatccacggactggaagtccggcgctggcagcgcattgcggtccaccttgccgttgggcgtcagcggcagcgcctccagcaccaccagggcctgcggaaccatgtagtcaggcagcgtctggcccaggaagtcacgaagcgcatcgacctccagtgtgtggcccggcttcggcacggcgtagcccaccaggcgcttgccatctgtcccgctctcgtgagccaccacgaccgactcacgcaccgaggggtgccgctccagcgccgcttccacctcgcccatctccacgcggtagccgcgaaccttgagctggtcatccgttcggcccaggaactccacccgcccatccgcgagcagccgtgcccggtctcccgtccggtacatccgcgcacccggatcctccgcgtacgcgtccggcacgaagcgctcggccgtcaggtccacccggcccagatagccgcggcccacggtccttccaccaatgcacagctctcccggaacgcccacgggcaccgggcgcaggtacgcatccagcacgtagacgcgcgcgttgggaatgggccgccccagcggcaccgacgccgacacacgcccctgaggcccacgctccacctggagcgtgagcacacccacggtcgtctcggagggcccgtagtgattgaacacctccaggtccggcgacagttcgtgcacccggtccatcagtgcccaatccgagacatcaccgcccagcaccagacgctgacgcggcaacacccgctcgggattcccagaggccaggagcgcctgcaagtgagcggggacgatcttcaggcagtccacggcctcgcgctcgaagagctcggccagggcggacgggtccgacgcgcattcacgagacacgagatgcagcgcgccgccttggcagagcgtggggaagacagcggtgtggcccaggtccgccgccagcgtggacacggaagcaaacgaagcgctttccggcaggtccagccggcacgagacgccctttacgtaatgaaccagttgccggtgctcgatggccacgcccttcggccgccccgtggagccagaggtgaagatgacgtaggcaaggttctccggcgccgccgagggctccgggttgcgctcgctccgttccaatagagaagacgcgtccgcatccagacggaccaccccgcccgcgccccagcgcaggacctccgccagggccgcctgcgtgaccagcacctgggcacccgcgtccgagagcacacttcggatgcgctcgacggggaatgtgacgtccagcggcacataggcaccacccgccttgagaatgccccacaggcccaccaccgcactggcggagcggtccaggtacaagcccaccggaacatccggaccgacgcccagcgaacgcagctgatgcgccagttgattggcccgctggttcagcgcctcgtaggtcagccgtgagtcttcggcgacgaccgcgagcgcttcaggcgtcttcgcggcctgagcctcgaagagggcctggatggtgttgggaacgaagtcgctgcgggtgtcgttccactccacgagcaaccggcgctgctccactgcgcccagcaacggcagttcgcccaaccgagcatccggcgtctggaccgcggcctccagcaacacgcgcagatggcccatcagccggtccatcgtcacgggctcgaagaggtcgctgttgtatacggcgctgaccgacaacccctgcggcgtctcggtcagctccagggtgaggtcgaacttcgacgtgcgcgagtcaccatccattcccgccagcgtcaggcccggcaggtgcagctccacggtgggcgtgttctgcaggatgaacatcacctggaagagcgggctgcggctcaagtcgcggtccggcttgagttcctccaccagtcgctcgaacgggatgtcctgatgcgcatacgcgccgagcgtccgttcgcgaacctgagccagcaactcccgaaacgtggggttcccatcgagtcgagcacgaagaacgagcgtgttgacgaagaagccaatcagcccctccgtctcggcccgggtgcggttggcgatgggcgagcccacgcagaggtcatcctgccctgagtagcgcgacagcaccgtctggaacgccgcgagcagcaccatgaacggcgtggcgccttcacgatgcgcgagcaccttgaccgactcccacaggtcgcgcgggcactgcacatcccggctggcgccatggaaggtctgcaccgcgggacgcggcttgtccgtgggcagttccagtgcctgcgaggccccctgaagctgccccttccaccaggcgagctgtgactccagaacctctccctggagccactcgcgctgccacaccgcgtagtccgcgtactggagcggaagctccggcagcggtgacgacaggccctgcgagcactcgtcatacaacgaggtgacctcgcgcacgagcacgcccatgcaccagccgtccgacacgatgtggtgcatcaccagcaccagcacgtgctcctgctcggacagcttcagcaataccgttcgcagcatcgggccgcgcgccaggttcaaaggatgcgctgcctcttgggagatcaggcgttggacttccggggcccggtcagcctcggacaggtcgcgcaggtccaccactcgcagctggacctctgactcctcggcgatgacctgagccggctcaccaccgctgctctggaaggtcgtgcgcagcgactcatgccgaagcaccagcgccttgaaggcttgctccagcgcgtccacctgcaccgtccccgtcagcgtcactgcgatagggatgttgtaggacgaactacccggctccagttggtcgaggaaccacagccgctgttgcgcgaacgacaggggcagcgacccggttcgttcaactcgcgtcggcggcggcacatgaagcacctgcgtgccgttcggttccgtctcgagccgctgggcgagcttctctaccgtgggcgcctcaaagacgtcccgtagaggcaactcgacgtggaaggcttcgcggacgcgcgagaccagctgcgtggccaggagcgagtggccacccagctcgaagaagtcttcgtcgacgctgacgcgctcgacgttcagtacctcagcgaagatggacgctagcttctcttcagtcgccgtgcgaggcgcctcgaagtgcgctgccttcgggccctgggcatccgggacaggaagcgccttgcggtccaccttgccgttcggcgtcagcggcagcgcctccagcaccacatacgccgacggcaccatgtactccggtagtcgctgcttcatgtggctccgcagcgcacctgtgtccagcgaggccccttcctgcgccgtcacataggccaccaaccgcttgccttcacctccatcctcccgtgccaccactacggcttcgttgacgccaccatgctgggccagcgccgcttccacttcgcccagctcgatgcggtaaccccgcaccttcacctgcgtgtccgctcggcccaggaactccagcgtcccgttccccagccaccgcaccacatcccccgtgcggtacagccgctctccttcgccgaatgggcttggtacgaaacgctccgccgtcagttccgggcgccccacgtaccccactgccagcccgtctccgcccacgtacagctcacccggcacgcccaccggcaccgggcgcatccccgcgtccagcacgtaagccacggtgttcttcaccggccggccgatggacaccgacaccccgacttcctcgggcttttccatccggtacgtgctggagaacgtcgtgttctccgtcgggccatacccgttgaagagcaggccacctgccgccagtcgttccttcacacgagacacaggcaaggcgtcgccacccgccagcaactggcggacattggccagcgccttcggctgccgggcctgcatctgctcgaagagcgccgccgtcagccacaacgacgtcacgcctgaagactccagcttccggcctagttcctctagtgacggcgtccctgccgggtacaccaccagcttcgcgccgtgcagcagtgcgccccatacttccagcgtcgatgcgtcaaaggaaatcggtgccagttgcagccacacttcctctggcccgaagtgcgcgaagtccgtccccagcaccaggcgtgacaccgctcggtgcggaacgcctacgcccttcggctttcccgtgctccctgacgtgaacatacgtacgcaaggtttccgccgcccacgttggcacttcggcgtggttgcgggtgatgggcaatctgcgagtcccactcgtgtccacgcacaccacca

SEQ ID NO: 1248 - DNA, 28054 bp, Myxococcus xanthus
cggcgggcggggagctgcgcgaactccggaaagggcacctccacgagcaccggctgagccgcccgctccgcgcgccacatgcccaggcctccgagcaccgccgccatggcactcaggccaatgccccagcgaaacccgtgcatcattgaacggcccccagctccagcagtggaaccgggaggctatcactctccgtccgggtggcacatcccggcccggctactcgctgccgtagcccgcgctctgcacgtcgatgaggcggccgttctcgaacgtcaccacctgcatgaagcggcgcggcccgaagttgtaggtccactcctcgtactcccgggtgacggaccgccgctccgtcgtgacgccccccgtgttcctgtccggcgtcaccgagcccgccgagtccgtcaccgtgcggaagttcttcgccgctggctccccacacttggcgagcacctcggtcttgagcgccccatccgccaccagcgcctggccacaacggagcgaagccgcctccgccgccaccggcaccccggccattgaaagcacgaccgccaatccaagagctcgcatggggtgtctcctctccattcaggtcaacggcgcaggatgtccgtgtgggcggagcacgctacgcgtaggggttgtagaacttcgcgaacgtcgccttggcgaaatcgccgaaagtcattccaggctggaaggcgcccaccttctgctcggcggggtccacgccctccggcggacgcaggtgcatgtcattgtccggctgcatgaacaccgcgaaggtggcgcgggagatgttgcggctggccggatgggccagcgcctgcaccgcgtgcggcgtggaccgcagcagcccgccggtgacaatctgggagctttcgccaatctggaaggccaggctgtcctttcgggatgacgaccttgcgctcctcgccggaccgcgtgcgcacgtacaggcccgcctccgggtccggcaccgggatgtccttgcgcgccggctccgccgcgcccggctcggcctcgaagtacatggccgggcacagcgccgtgagcgagccgtggtcgctgtgccagccgcaccacgagtcgcgcgtgcgcggcgtcgcgtcctcgttgatggcgaagtagtagagcagccgcgccttgcacgtgcgcgaatcacgaatcgtcttcgccagcgccgcgtccggtgccaggcggctgcccagtttggcctgcacgtacttgtcgcactgcccggcgaccagcacgcccacgtccaccatccgctggcccagcgccatgaaggcgggccgcagctccgggaagtccgcgtccggccacacgttggggtggtagttctccgggtgcttctcgatgagctccgcgtcggtgtgcggcacgtcgtactgcgggttgttgtagtacgagcccttgaactcgtcgaactggccggggcgcagcagctccttcccgtggctccagccgaacgagtagctgctgcgcgcgtggacgtagcggtccttcacctcggtgggcagcgcggcgaagcggaagcccaggggcagcaggttgtcgcgcagctcggccagcccggggatgccccgaacgacgagcaggccaatgccgtcatgcccgtaggcgcgctcgatggcggcgctcaggtccgcgcccgccacgagctgcgcatagtcgagaagaaccactccgtctttcgtttccgccacgtcgctgctcatcccaggtgcctcgtgtcttctccccacggtgccacaccggcatccgcgccgggcagggtgtgcacaggccacccgtgacaagggagacgggcgccatactgcccggtttgggcgcatgcgtgccacctgcgtctctcggtggtgggcggaaacccctgctcccctccccgctctcgtgccaggccccgctccctcgtcccgcagggcagtcgcgcgcggcggcaaccaggactcacatggggggtcgtatttcctctcacaaggagaaccccgcgatggaaagcccactgtataccggagaggtccgtaccgtcggagagagcatggcgcgcagcatcaccgacgcgggcgccttcaagatattcatggacgagcccatggagttgggtggccgcaatggcgcccccagtccgctcgacttcatcctggccgcacacgcgggctgcctgaccttgaaggccgctacttcggaggcgtgacggacaccggcgccaccaggggcgcggcgcggccgggccgggggacgaggaagagcagccgccccttctgcttcatcatccccgccgccagctccgcctgcgggcccgcgccccagaagacgtccacccgacccgcgccccggatggccccgcccgtgtcctggttgagcacgaagcgcgacagcggcttccactgcacggagccgtccgccatgcgcaccgggcgctcggtgtggatgaaggccaggccgcccttgggaaacagccgcgcgtccgtcgcgatggagcgccccgccgtcaccggccgcccgagcgaccccaccgacgcggtgtgaggaagcggaagagcacgtaggactcgttctggtccaccacccggtggctttgctgctgattcgcggccagccacgcgcgcagcgcctgcatcgacatctcctccttggggatggcgccctcctggatgagcagcgagccgatgctgcggtacggcttcccattcgacgcggcgtagccgatgcggcgccggctcccatccggcaggagcaacgaaccgctgccctgcacctccaggaagaagagcgccaccgggtccttggcccacgccagctccagcttccgtccgctgagccgccccccacggatgtccccgcgcgaccagtacggcaccaccttccgcccgtcgagccggccgaagacgcgctctgacttgaagcgctccgcgaaggattccagcgggacctcaatcaagtcggacggaggcccgtggatgggcacgttgtacacgtccgtgcgcgtcaggctcgcctcgatggtcggctcgtagtagccggtgaagagcacctggccgtcctcgcctccggcggcctccagcggctcgaagtcctccagaaccagggcccacagcgcctccggcgtgaggtcctcgcgaagccgcgcgtgcaggcgctccagggcggtccgcagctcggcgatggagacctgccgcgcgccgtagatgaagcgttggtcggacggacggctccgcagccacacgaggctctcggcgacggcggtccgcagggacgcgacgtcaccgtcgtcccggggctccatcttgcgagacaggcggatgagcgcgtcctcgggcctggtgacgggggcgcgggtggggctcggacaggccgaggcgagaagccccagcgccgacagcaggaggattcggaggtgccgcatgtccatgtggctcctctacctatcgcacctgccccgatgggcgaatgggaacggcgtgcgccgggatgggcgagcaggcaggcgttgacggcggatgcctgggccccggcgccgccctcgcgggctcccatgcggtgagcgcggaggcctcaaggtggcgccgggccacggggagctacttggacttggaaggtaccttgagcgaaaaggcctgctcccgtggcgggaagatggcctgtgcggcgccagagaccaacggcgaggcgtcctgctggagccgcgccagccggcccagccgctcgggcgtccatccgcgccccggcgccgcgtcgtgcaccaggcaccagacagccacgcgccgagcctccgcgctcgcgctcgcgctcaaccgggcctccatcgcctccagctcacccttgggcaacatgctcacgacgagacggcacgcctccagggcatccgcatggaggaggcctgcctcccccatctggaccagcgtttcagccaactccagcggtgaccgtgccgccatcacacattggatgtacagcggcgccagacgactgtcccgggagaggacccgctctgccgcgcgcgccgcctgcatgtagctggcgcgggacttcacctccaccgccagcaactgcgtcaccgcggtgttcagtgcgcgtcggtccaaagccaccgcctccaacatgccctccagccgctccaggtcgcgttcgttggagcgatggagcagggccctcatcgcccagctcacctcttcatcgtatggcgacgtcagccgagccccacaggcatcaaggaaggcgcgctccacatccctgacggggagatacgccgcgcgcgaaagcaggccaatgcgcgcctccggctcggggcgagccagcacccgcccgagcagcgcggacagcttgcggtcggaggtctcggtgaggcggttcgcggggatgtctcccagccgtgaagccaccacccaatcagggtcctccgcagcgcgggcgaagacggcccaggtgggctcgcgctccaggtggtcccagagcgcgcgcagcagggcgatgcgcacgtcccgatgcaggctcattccgcccaactccaggagccgctcgtaggcggcctccacgcgcagctcccccagcaggcgcacgacctccttggccacggtgactttggtgagggggacgcccgccagcagggacagcacgcgcgcgggaggcatgccgttgaaggcacggcgcaggccatagatggcgatgcgcgcacgggcatcctccaggcagcgcagcagcgtggtcacgccttgcccctggtcgcaccggcccagcacccggatggccctctcccgcaccacgggccgcgcgtcgtccacccgggtgcatagtccctccatcgtcccccaggtcaacgccgcgagtgtcgagacaccccagagcaacgtcggcgtgtctcgctccgggtcctcgaccagccggcagaccgcgtgcgagtagagggcgctctgccgcgcggtccaccggaagaaaccgcggtcatcgaacgccagcaaccaacccgtcttctccgtcgagaaacgaccggtgatgacgggcgcgctcaggtagggcgtcagcagctcctgcctgcgccgatgcaggtacgtgttcacgaccgggaagcagatgacgctggcatcggccttgagcagctcgggcaggaagccgtcgaaggcggcccacgcctgtcgccggagcaccaccagggcggagtgcgcctcctttcccaggcgaagcgcgacccgcttcagtccggagctcagctcgggatgcagcggtcgcgccgcatcctccgagtgggccaacgcgatgacttcggagaaccaccccaggtcgaggaaccgccggaccgtggcgcccacggtggcttcgaagcccgcgcggtcgtgcttggactgccactgggccatccccagcgccagcaagggccagggcgtctcctcccgcatggacacaatgagttcctgcagtcccgcgaccagactcacacgagcgcccaggctgttcaccaactcgagcagcggcccgccccgctcgcgctgagcccatccccgggcaatgtccaggagctggggcgcggcggcgcgcacctcgtcatcggtgaggtactcgcccacgcgagcgttgaagagccgaccacgctccttgaggagggtggccagccacgtcgccccccattcgggggccctggcgaaggtgcgcagcagcaacgtctccgcgaactccgccgtctgataggacaggtcggccgcgtccagcgcgtcgcgcaacatccggcccaccgcctcggtgtgctcgcggcgccacacgcggcgaggccaccgcacgaacgcgcccagcatcagcatccgcacggggtcctgctcgttcttgcgcgccaacgccagcggcagggcacggtccaccaaggcgggctcgtccggacgcagcccggggatggccaacagcgacgccaacgccatgcctcgcacgctggcatccgggtgaccgatgtatcccttgagcgccgcctccgcttcatcccacggcagcaggcatgcgtacctcatgcgttgctcgggccgggagcccagggccaccacctcgtggagatgccggcgcgcctcgcgctcacgcaaatcgatgggcagcgcggtcaccgtctccagtgcgatgacgccatcgctgttcctcgcggcgacgctccagcgggcatggacgcgctcccgttcgcggacatcggaaatggagcggagcagctccgtcccccagaccggcgccacatccaccgtggcgcaccacgcctcgacgacgacgcggcgcgcggtctcggagagccgggggagcagcgtcttcgcatcccccagtgagctgggagcatgacgaacgagccacacgagcgagtccatgctcaaccgcgcggcggcgcgggcaaactgcccctcgaaggggaacgcgtgctcgtgccgctggagcagcgacacggcggcctcgggccgatggagcaccaggcaatgccagtcataggcatcgggatggatgcggcgggagagcagcagctcgaacaactccaaggccgcgtcgggggcctggtcagcgatgcgatgcaggtacgcgttgaggtacatgcgcgtcaccggatcgggttcgcccgtcacggccctcaaacgtgcggcgaagacctccgcgaggatgccgggggcgttgtgcgccatccgactccagaagcgcacactggggcgcgccagtgcgctggggaggtgacggcgaatgccctcggacgtcgccaaggggacggcatcagcgaagtcaggcacgcccgtgcaggtggccagccagtcgagatacgcatcgatgacggcctgccgccgcgtcttcatgaacccccagaggagtccctcctggcggcgaacggcgcacgccatcttcagggtctccagcgcctgggcgtcgtcacaggccaggggcaccagtcggaaggccagagaacgaacacgagcggacgcatcggtggtggcggagagcacctgccccccatcgcgccaggtgaactgggcacacagggcgaggtaccgctcgaaggcatccccttgagacagcaccccaagcaactcgcggacgccagggttcgtcggcgccaggcgccccagctccaccatcctgcggacgcgggcatcgtggtggataccggacagctcgtcgcgcaactcggagaggcgaggctcgtgcatggccgcgggagactgcccgacgttcccgcgcctgacaaacagcgggccacgcccgcgcgcgggctccagcaactccgcgcgcgaggatgggctggggcgacacagactcagatgaagtagtccgggagcagctccgccccgggcaccagctggtacttgtcgaagtccgtcacgcccacgccgcggaggacctcctcgtcgatgcagaagttgccagtgaactcgcggctcggcttggtgaggatggcgtaggccgcgtccgccatgatttccggcgtccggcagccgcggatggtctcctccccgcccagcaggttctgcaccgccgcggtggcgatgacggtgcgcggccagatggcgttcaccgcgatgccgtccgagcgcagctcctccgccatgcccagcacgcacatgctcatgccgaacttcgccatggtgtacgcgacgtggggcgcgaaccagcgcgcctccatgttgagcggcggcgagttgttgaggatgtgcggattgctggccttcttcaggtacgggatacacgcctgcgaacacgcaaacgtgccgcgcgtgttgatgccgtgcatcaggtcgaagcgcttcattggcgtctcgagcgtgcccgtgaggctgatggcgctggcgttgttcaccaggatgtcgatgccgccgaaggtctccaccgccttggccacggcggcggcaatctgctgctcgtcgcggatgtccacgacacagggcagcgccttgccaccggccttctcgatttcctccgccgccgtgtagatggtgccggggagcttggggtgcggctccgtcgtcttggcggcgatgatgatgttggcgccatcccgggcagcgcggagggcaatggccttgccgatgccacggctggcaccggtgatgaacagcgtctttccctggagattggacatggggtgtcctcctatcacgaacgggcggatggcttccgatgcgccaccttggcgacgggctccatcacttcgcgccctcggagaaggcgcgctcgatgagcatctgcatgggagcgtgggccggtagcgtgccaaacgtctgtccatgcgctccgcccaggcgggactcgcagaaggcatccgacacggcggtgttgcccgcgcgaatcagcagcgacgcctggagcgccagcgccagcccttccacgatggtgcgcgagcgcacctccagcgagtccgtgttggccaactccttgcccagccgcgcggtggcctcgtcgtaggcggggtgcccgccctgcgcggccaggagctcagcgaagagggcctcccggctggccggctcgcgcgacgccgcgcgcagcacgtccaggcactggatgttgccgctgccctcccagatggagttgagcggggcctgccggtacaggcgcggcaggttcgtctcctccacgtagcccgcgccgcccaggcactcctgcgcctcgttgacgaaggacggcgtgcgcttgcacacccagtacttccccaccgccgtggcgatgcggcagaacgcggcctccttctcgtcccgaggcgtggcgtccaccgcgcgggagacgcgcccggtgagcgcgacatgggcctccagttccagcgccaggtccgccagcacgttgcgcatcagcggctggtcgatgagccgcttgccaaacgccacgcggtggcgcgtgtggtggatggcctgcaccagcgcctgacgcatctgcccgctggagccaatcatgcagtcctgccgcgtcagcgcgaccatctccaggatggtggggacaccgcggccctccgcgcccaccatcaccgcgtaggcaccgtgcagctccgcctccgagctggcgttgctccagtcgcccagcttgtccttcagccgctggacgcggatggcattgagcgcgccgtccggcgtgaagcgcggcatcaggaagcacgacaggcccccctccgcgtgcgccagcaccaggaaggcgtcgctcatgggcgcggagaagaaccacttgtggcccaccagcgcgtagggctgaccgggcccgcggccttcacccaagcggtgcgccttggtggtgttggtgcgcacgtcggagccaccctgcttctccgtcatgcccatgccaatggtggcgcctgacttctgcgcggcggggatgaagcggctgtcgtaggacgccgagctcacgcgcggcagccactccatcgccacctccggctggtggcgcagcgcgggcaccgacgcgtacgtcatcgtgagcgggcagctcgtcccgttgtccgcctggttgtgcagatagaagagggccatgcgcgccacgtgggcgccgggcttgtcctcgttgcgccaggcgaaacccgacacgccgtgggccatgcccagctccatcagccggtggtacgcgggatgaaactccacctcgtcgcggcggttgccatagcggtcgaagggccgaaacttgggcttgttctcgttggcgaggaacgccaactgctgcatctccccgcccaccacggggccgtacttcgccaggtcggcctccgcccagccgccgccctcccgggccaccacctcgcggagcacggtgtccgtcgtccacgcgtcgtactcgagcggcggaggctggttcgtgacttcgtgcgtgaggaaaccggcggcaatggcgttgcgttcagtcatggtgaaggtcctcctggggacgatgcccggtgccccctggattaccgtgaacacgcgcgacaggccatcgcaacccgaggggcggatgcggcgggtcaccgcttcttcgcctgctccagctcctcgaccagcagctccgaaaccttccgcacacgcggtatgtcgagcgcggacttcgcgcagaccaggtgcagctcgctggtggcatagggccccaggtccaggtcgagcggcacgaggctccgctcccgcacgaagcggtgccgcaggtcgcccagcaccatggcccccacgcccgcttcggcggcggccagcatcaccaggtagttgtcggcggtgaacacgggcgagaagccggggatgatggactccaactggggattgggcggcgtcgcatcgaacggcggcgcccaggccacccacggaatctgctggagcgtgggccgcttgggcagcttcgccttgagcgacttcgccacgaagacagcgttgcgaatctgcaccccatacacgcgcttcaagtccgcgttcggcgggcaccgggcccgcagcgcgaggtccgcctcgccgcgccccaggtccaggtactgaatcccggagagcacctccaagcgcagccccgggtgcttcttcgccaccgcgcccgagaagggcgcgaggaagtcgaagcacatgtacggcgccgccgtcacccgcaccaggccgcgaggcgacgtgtccgacgactccgccgcgcggtgcagctctccggcccactccgccatcttcttggccggtagcaccagccgctcgcctgcggccgtcagcaccgcgccgtccacgccccggcggaacaaggaggcgcccaccgcgtactccagcgccgccagccgccggctcaccgtgggctgaccgatgcggagctgccgcgccgccccgctgaagctgcccgtctccgcgatggcgaggaacagccgcgcgtcatcccaggagatatccatgaatgcatgacctcatgcctgaatcgccattttccatccattctcgcatcgctaccttgcgcctgtctcgacgtgcaggagccccaccatgcggaaccgttcccttgccctctcgttcgccaccatgctcgccaccgccgccctcacgggctgcgccgtcacctcacatggcgtgcagccctccgcgctcggcaaggcacgcccttcgtcggagctgctaccaatgctgacgcaacccggccccgtggagctggagacggtcgtctcctgcgactgggccgtggagcgcggcggcctcatcaacctggaccaccccaccgcgaagcgcgcgggcctggaggacggggatgagccggtccaggtcttcttccacgccctccgccacccggagaaagggctcttcatcgtcgacaccggcgtggagacggcgctgcgagacgcgccggagaaggccgccatgcgcgggctcgtcgccagcgcgatgaacatggagaagatgacggtgcacgccccactgggggagtggctggcgaagcagcaacagccgctggcgggcgtgttcctcacgcacctgcatctggaccacatcaccggcatggcggacgtgcccgccgggacacccgtctacaccgggccgggtgaggcctccgaccgcgccttcgtgaacctcgtcgtccagggcaacagcgaccgggccctggccggcaagccgccgctgtcggagtggacctacgcgcgggaggacgccggcctgttcgacggcgcggtggacatcttcggggacggctccgtgtgggcgctctggctgcccggccacacgcccggcaccaccgcgtacctggtgcgctccacgaagggcccggtgctgctcgcgggggacgtcagccacacccgctggggctgggagcacgacgtggagcccggctcgttcaacaacgacgcggaccgggccacggtgagcttcaagaagctgcgcgcgttcgcccaggcacaccccgaggtcgaggtgcgcatgggccaccaacactgacgcgcgcgggcctcagttccgggtgtgctgccggaagaagtcccacatgatggaggtgccgtccggcccggacgggtcggcgaagggatagcgcgaatccccgccgggccaggcgtggtccatcccctggatttcgatgtgccgcgccaccagcgagccgccgtagacgtagtcctccaccgtgtacgcgcgcccgccgggcaccgtcgcgcgcgtcacctgcgtggccaccggacggatgctgtcgttggccacgccgtcatcgccgtagtcgctggtctggaggaactgccgcgtcgcctgccggccgttgacgatgtcgacgacgctgtccttcgtcccgtgcacgacgagcaccggcaccgtgtgacgcggacggcccgagcacacccacgcgtcccggccccggtcatccgggtggtagatgctgccgaagagcatcgcgaagcccgtgcccgaaatcgtggtggccgccttgtacatggcgcccgcgccaatcatccccgcggcgaacacgtccgagtagcaggccagcagcgtccccgtgagcaccgcgccggagctgacgccgcccacgtagatgcggcgcgcatccaccgcgtagtgccgcttcacctgctccaccatgcccacaacgagcgcgggctcaccgtggcctcgcgtctggttgagcaccagcatgaagttccagcactgcgtggggttcgcgaacgtcgcctggttcgggtacagcaccaggaacttctcggcgtccgccttctcgttgaggcgcgagaggccggcgaactggctcgggttctgaaagcagccgtgcagcgccaccaccaggggcagcggcgtgtccgcctggtaacccgtgggcacccagagctggaagccccgggtcccttcgatgccatggacccaggtgccggcgcgcgcgggggccgcggcggtgagcgtgaggacggcgagcagcaacaaccccgtgcgtgagcacgtgacagcgttccgcttcattggctgactccttcggggtgggggaaccgcgctcagcccggctgccgcgcatccgccgcggcgtcctcgactccggccaggaaggcctccactgcgtcggcgaccttgtcgggctggtcatgcggtgacgcatggccggaatcactcaacacctggagccgcgcgttcggcagcaggtccacataggcctgcttcgtggacacgggcgtgtagtccctgtcggacgcgagcaccagcaccgggcaggtgatgccgcccaggtgccgcatgacgctccaccccaccaaccccttcgtcgcgcgcaggtacgcgtccgggtcgttggcgctgaatatctccagcgcgcgctgacgaagtgcttcctgctcgggcttggggaagagcttgggcgccaggaccttcgccagcaccgagggccccagcagcttcagcagcgtcaggcgcaggccgaactcgaacttgcggcgcagcgtgcgcgccaccagctccggcccgctgttgacgatgaccaggctgcgcaccagctccggccggtccaccgcgagctggaaccccatcatcccgcccatggacaggcccaccacgtggacgccggtgagccccaacgcgtcacacagcccggcgatgtcccgggcgaagcgcggcacgccataggcgcccggcggctttccgctgcggccatgcccccgcgcatctggaacgatgacgcgatggcggcccgtcagtctgggtgccacggactcccagtcccggccagaggagccaagcccgtgaagaaacagcacgggggtgccctcacccgattcctcgaagtagagggagagctcctcgagctggagcaacggcatgttcggaccccagattcaggtaggaagcgtgtcgaaccgcaggtccgaagctacatgaacgaacgttcgtttttcaagagtaccccatgagcacctccccccgctctcgcctgcgcgccacggccgcccgtctcccccccacgggggcggccccccccgaaggcacgcgccgacgcatcctggagacggccctgcagctcttcgcgagccgcggctatcacgacacgtccattcgggacctggcgtcggccctggagctgcggcccagcgcgctgtacgcccacttcgcggccaaggaccacgtcctcgcggagctggtgcgcattggccacgaggcccacttcgaggcgctggagaccgcgttccagggcgcgaagcccacgccggcggaccaggtgcgcgcgctggttcatgcgcacacgcgcgtccacgcggagcatccgcagctcgcgctggtggtgaacgaggagttctacgcgctgagcctggagctggcggcgcccgcgcaagcgctgcgggacaaggccaacgccatgttgatagacgccatccaacgcggcatggcccaggggcagttctccccgctccatccccaaatcaccgccgcggcgattgtgggcatgggctctcgcatcccccactggttcgaacccggcggccccatcgcggtggagaccctggcgaagacccacgccgagctggcgctgcggatgctgggaagtgtctccggcgcgtgaggccgggcggctaactgcgtatctgcctgcggcccgacgccacctggaacgcgtacactcccagcgtggcgatacccacgaggaggacgccccgcgcgctcgacaggactctgcgacactgccggttgctgaccgttgaattttcccaacacgctcgcgtcagcaggcgcatccaccgcaacggcggatccttcctcacgctggataccctcacatgaccactccccgcacgctctggaagctcacgaccctctccctcatgttgtccgctcccgccttcgctgccgacgaggtcgaacaggcccaggaggaccgaggcttcgcgctgggactgcgcgcgggctacggcgtcccactggggcacgccgcgggctccgatctcggcgaaacccccaagatgagcgaggtgttcaagagcgccatccccttgcaggtggaggcgggatacttcttcaactcgaatgtctacctgggggcctactttcagtacgcgcccgtgctgatcgccgaggactgcgactcggacgtcagttgctccgccaaccagatgcgcttcggcatcaacgcgtcctaccacttccgggcgggagagaagctcatgccctggatgggcctgggcatcggctacgagatgctcaagttgaatgtgtcctcgagcgaggacggcgtggaggccaccattggcacgggcgtccgcggcatcgagttcgccgccctccaggccggcgccgactatcgcatcaacgacacgttctccatcgggccctacctgtcgctggcggccggcgtctaccagtcgtcgacctccagcattgagatgaagaacgtgcccatcattggtgatgtctccgagtcggagtcggagagcatcgacaacaagacggtccacgcctggctgtccggcggcgtgcggatgcagttccgcttctaggccactcccgcggcgctgacggagcctcgtcagcgccgcgcggtccacctcagtccagcaggtgcgggttgcgcaggatgagcaaccccgcctgcacggtggcggcgtagtcgttgaggtgcccggcgccgatgagcgccgtcacgtcacggctgccccccgcggtgagcgcggcatccaccctcttggtgccctggttgtacgcggcgagcgccagccgccagtcgccgtaacgcgcgtgcaggtccgacagcagcgcggcggcggcctgggactcgcgcgccacgtccagccgctcgtcgcgcgcctcactcacctccagcccgtagcgccgcgccgtctccgggatgaacatccacacgcccgcgccacgcatgcccggcgccagcgagggccggccatccgtctccggcatgttcgtcgccgcggattcgacgacggccacggccagcagtccctcgggcagccccttgtcacgtagcggtgcggagagcgcctcccgctgcgtcaccaggttcgccagcgcgcgcttcatgaacgcgcggcccttctccgaaccggtgagcgcgttgagccgcgccagcacgtgcgcgtccaccaccaccggcaagtccccctcccgctggctggatgtcgcgagcgcctgcgcctccgcgagcgtcaccgcgcggccctgcgccacgccttgcgacaacgcggcgagcggaaccaggacgagacacagcgcggccaggagcgcggaaacaccctgggcacgggcgggacggggctggaagagcatctggattctccgggtggtgggatgggacatgccggtgacaccggcgggaaggggggactcgagccgcaccgacaaggccgcctggagcaggcaccgcgcataggcctgcgcctgggcccggccagtggccaccagcgcttcgtcacacgccagctcctggagcgaggccatccaccgggacagggcatatgcgcccggatgccagaagaaggcacccgtgaggacgagccgcgcgaaggcccggtgcgtgtcgcgctgacggtggtgctgaagctcgtgaagcaccgtcagccggaaggactccgcatcctccagcagcgcgggcggcaccaccacccacgcggagggctgacgcccggcgcgaggaaaccacgcggagaaggccggcatgcccgccacgccgagcaccacggcgacacgccccacgccgcgcacgcggggcagcgactccaactgacgcagcaggcgcgcatgacgcaccagcgcccgtgtgatgaaggcgcctcctcccaccaagagcgccagcgccgccgcgggcagcacgggcggcagcgcgggcgcggactcccgagcccgagccggctccgccaccggacgcggctcccacaagggcgcgggcagccgtcccgcgtggcgcgccacggaacgctcgaaggtgaagcggggcccggtgggcaccagcgcgtgcacggccgcggccaacaacggcagcaccagcgtgagcagcagcacgccacgcgccaccctcaaggactgccgcgccgacaagggacggcccagccgcgacagcagcgtcagcgccagccaggccagcggcggcgccacggcgagcaacagcgcctgcgtcagatagagcgacgcgagctcacgcagcacggcgctcacggcttgcgccccttcgcgtcgagcagcttgcggagctggtccacgtccgaggcggacaggggcaccgcctccaccagccgcgccaccagcgcggagggcgcgccgtcgaacaccgtctccaccaggtggcgcacgctctgcgcctcataggcgtcgcgcggcaacaccgccgagtacaggtggccacggccctgcttgcggctgtgcaccacgcccttctgctccaggatgcgcagcaccgtggagacggacgtgtacgccagcgcgcgctccggcggcagcgcggcgagcacgtccgccacactcacctcaccgaggcgccagacgatgtgcatcaactccagctccaccggcgtcaacggccgtggggccacttcgggctcaggcttgcgagtcacgagcgaacctccgtgacgcgcaaactactaagggcttagttttaaatcaactaatcacttagttactcactgacggagctcctggccctacacaccgagcgcctcccgcagctccggcaggcgccgcgaccgcaccgcgccgtagacgaaccggtccggccgcagcaccaccacgtccgcggcgtgcttggagaaccagtccgccagctttccggtgacgtccaccaccgcgggtgcatcctcggaggcatcgtccaccgcctccgccggaggatggaacgtcatcatgcggccccccagcgactcagccagctcgcgcgccgcctccagctccgccgacggcgcgttgccccggcacagcaccgtgaattcattgcccagggtgtcgtccagcaggacctcctcacccgacggcagcttcacgcgcggctggatgaagtactcgcccttgtcgccgaagtagtagccgctcgcgtgcgccggggcctccttgaactcgaagccctcgatgaacttgcgcacccgcgggatgcgctgaagggtgcgcagcagcgcgtcacgcgccgaggccaccagggggttgcgcgccaggaacaggtgccccacccgcacacacagcttctgcaccgcctccacgtgcggccggcgctcctgctcataggtatccagcagcgacgcggaggactgcccgtgcagcacgcgcttcagcttccacgccaggttggacgcatcccgcatccccgacaccaggccctggcccatgaagggcggcatggtgtgcgccgcgtcgcccagcaggaagacgttgccgtggcgccaacgcgccgcgttgaggcagtggaacgtgtagaccgaggcacgctcgatgcgcacgcgcttggggtccacgtacggcgcgatgagctcggagatggtctccgacttctccaggtgctcgcgcgtctcgccgggcatcatcatgaactcccagcgaatctggttcaccgcgccggtggccacgaaggccggacgcttcgggtcgcacacgaagcggcagatttccggcacctccccttccaccacggtgccggacaccgccagccagggctcgccataggcccgtcccgacatcgggatgcccagcgccttgcgcacggtgctgcgcgcgccgtcacacgccagcaggtacttcgcgcggatggagcgctgctcgcccgtgaacgagtcgtggtagcgaaccgtcaccccgtcggagtcctgcaccacggcctccacgctcacgcccttgcgcaactccacgtgctcgaagcggttgagcccgtcgcgcagcgcgccctccagcagcggctggtggaagaaccacagcggcgtgtggccgaagccgaagtccgtctcgccggtgtgaatctccgcgaagcgcttgcccgtgccgcccacgtactccgcgaaacggctttcccgcatgtcgctttgcaataaatccaacagtccggtggactggtagatgcgcaggccttcgtcgtcgcacgaaaaggcccggggctcgccgtgcggcgccacgtcccgctccagcagcaaggtgcgtacacccatgagacccagcaggttgcccgtcaacgcgcccaccggaccacatccgctgatgatgacgtccacctgcgtgtccgtctgctgactgtcacaacccatggatgcctcccggggcaatgtctggcttttttaataacgaatcaggtgtgaccacggtgtgacgggtccggaagcctggatcagcatccgcccagagcggcgagctgccgtgtgatggaaaaaccacacgcaaaaattgtcactgctggggcaatccctacccgttacggaggttttcggcggacgtgttaccttagagccccgcccatgcgaggaatcccggaggacatggcagccgacggcctggtaaatacacaacgctttcacctggaactcttgggcgaagcccggctccgggtcggcgacacacgcatcccgctggagcggcggaccgcggcggtgctcgcatggttggcattggaaggccctcacccgaagtaccgtctggccggcctcctgtgggcagagtccggggaggcgaccgcgcgcaacaacatgcgacagttgctgcgccggctgcggctcgcctgcggcgcggagctggtacagggcaccgatgtcctctcgctgtgtgagggtgttgtctcagacgccgccgaactccaggcccacgtgctcgaggggcgacacgcggaagccctcgcgctggaaggcgttctcctgggtgtcctggaatacgaagattgctcagaattccaaacatggctggagggcgcgcgtgagcggttggacaagcttcgccgccgggccgccgtggcggagtcggagtcgcgggagaagcggggggacctgacgggtgcactggcgctcgcggagcagctcctcaccatggacccgtattcggaagaagcgtggcgccggctgatgcggctgcactacgtggcgggcgaccgcatggccgcgctcaacgccttcgagcggtgccgccgcctgctgcgcgaggagttggacaccacgccgctgccgcagacggtggccctggcgcgcgaaatcgagcggggcccgcccgcccccaagcaggtgcccccacccacgagccggctgcccctctccgtgctccggccacccgtcctcgtgggccgcgagaccgagtgggcgcggatggaggccgcgtgggaggcggggcagaccatcttcatctccggcgagccgggcgtgggcaagacgcgcctggcccatgacttcgcggcgtcgcggggcaactacctgctgctggaggcgcggcccggcgaacagagcgtgccgtactcctcgcacgtgcggctggtgcggcagatgctggcccgggtgcctgatccaaacctgccgcgctgggttcggcgcgagctggcgcgcctgctgccggaccaggccgggcaggaaggcctgcccccgcccatggcggacgaggccgaccgcagccgcttcctggaagcgcagtgccagctcgtctaccagctcgcggccagcatggacgccatggtggccgacgacctccagttcatggacagcgccaccgcggagttcgcggtgctgatgctgtcgcgccgccacgcgcccgagcccggcggccgtttcccgcgcttcatcgacacctaccggacggatgagctgtcgccccaggccaccgtcttcgtccagcagttggtgaccgcggggctggccatcctggtggagttgcagcccctgggctccgcggcggtgggcgcgctgctccaaagcctggagcttcccggcgcggagaagctggtgcaggacgtgacgcggcacaccggcggcaacccgctcttcatcaccgagacactgaagtacctgctggagaccggcggcctggaacgcggctggcccgaacacgtccccgcctccggccggggccagcagctcatccagcagcggctggagcggctgtccccgtccgcgctgctggtggcccggctggcggcgctggcgaagacggacttcacactggagctggccagcgaggtgctggagatgaacccgctggcgctcgtcacgcatgtggcggagctggaaggcgcgcagattctgagaggcgagcgcttcaccaatgatttgctcttcgaggtggtgcgccagggcgttcccggcgcgctgggcacgctgctccaccgccggctcgccgtggccctggagcagcgcggcgccgcgcccgtcgtcgtggcccagcactggctggacggccacgagccacgccgcgcggcccccttcctcgtctccgccgccaacgcggaagccgccgccctgcgccacctggaggccgccctgctctatcaccgcgccgccgcgctgctggacgagacgggccacgccgacgaagcggcgctcgtgcggggccgcgtgcgcaacatcccgaccgcgtagccggctcggctcagcgaggcgccgccgtcacctcgcgcgccacgtccaggaaggcgcggaaggcgggcgacacctgcgcgcggctggggaagtagagaaagaaaccctccacacgcgccgcgtagggctccaacaccagacgcaaggtgccgcgcgccagctccgccgccacggacggctcgaacacgtaggcgagccccaggccggcttccgccagctccacgtgcgccttccaatgcgcgctgacgaacggcccgcgcaccggcacgcgccagctgcgctgcccacgctccagctcccactggtagatggagcccgtcgtctcggagcggatgcagagacagtcatgcgtcagcaaatccgtgggccgctcgggcgtaccccgccggtcgaggtaggcgggcgcacccaccacgacgaagcggaagctgctcgacaggcgcacctgcaccatgtcgcgctccagcgcctccgacatgcggatgccggcatccagcccctccgccaccacatccacgagccggtcctccacgcgcaagtccacctccacgcgcgggtggagccggaggaagcgcgtcaggatgggcgtcaccacgggcgtgacggcgacggtgggcacggtgagacgcaccgaaccagacacctcgcccggccgggcagtggcagtcttcagggcatcgagcgcctgctccacaggcggccccgcggactccagcaggcggcggcccgcgtccgtgagagacacgcttcgcgtggtgcgggtgagcaacaccacgcccagccgcgtctccaactggcggacggactggctcagcgcggacgcggacacacccagctccgaggcggccgcggcgaagctgcgcttgcgccccaccaccaggaaggcattcagggcattgagcggcgtgaaggccattgtaaagatttcctaagcagcgcgtcccgatttcgcctgttacgcgcgcgcgagcgcggacgcatattccgttccgccgagcagtgacaacaccccaaggccaggagagcacccctcatgattcccgttcgcggctatgccgcccaggacgccaagtcccccctcgccccgttccagttcgagcgccgcgagcccggccccagcgacgtgcagattgaaatcctctactgcggcgtctgccactccgacctgcaccaggtgcgcgacgaatggggcggctcccggttccccatggtcccaggccacgaaatcatcggccgcgtggtccgcgtgggggaccaggtgaagaaggtcaaggtcggggacatggccggcgtcggctgcatggtcgactcctgccgcacctgccccagttgccaggagggcctggagcagtactgcgagaagggcaacgtccagacgtacaacggcaaggagaaggacgggcagacagcgacccagggcggctacagcgaggccatcgtcgtggacgaggccttcacgctgaagattccggagaacctggacccggccgccgccgcgccgctgctgtgcgccggcatcaccacatactcgccgctgcggcactggaaggtgcagccgggtcagcgcgtgggcgtggtgggcctgggcggactgggccacatgggcgtgaagctggccaaggccatgggcgcccacgtcaccgtcttcagccacaccgacagcaagaagcaggacgccacgcgcctgggcgccgacgccgtcgtggtctcctcgaacaaggaggagatggccgcgcagacgggtgggttcgacttcatcctcgacaccgtctccgcgcagcacgacatcaacgcgtacctgcggctgctgcgacgggacgggcacctggtcctcgtcggcgccccggagaagcctctcgacgtccgccccttctccctcatccccacgcggcggagcttctcgggctcgatgattgggggtatccaggaaacgcaggaaatgctagacttctgcggcaagcacaacatcgtctccgacatcgagctgatttccatccagcaggtgaacgacgcctacgagcggctgctgaagggagacgtgaagtaccggttcgtcatcgacctcgcgagtctgcggaagtagccgcccgggagctccggctcccacctcgcgggacaacagccgataggcaacgactgccccggctcgaagtcgcgcccctcccaccggccctggagggcaggacagtgcacgcctttgcacatcgtcctgccccactggtcaggtgcttgctcgccgttcggtgcgaattctcagagcatgactacgacgattgcgcaggccggtttcgtgcaggtgacgtccccgtaccccgaggaacaggagttgttggatccggcgctcgccgcccccacgccccagaaggcagcccagcttcgccagaaggcgagccattggctcagccgcgcacagaaggagctgcacgacgccatcttcgcgcgggacggctcggaggccggactggaccgttatgccagcgcccgcgcggagctcgactcggcggagacgtgggccctgcgcgtcgcggaagccttcgccattcgccgtgattgacgacgcgccggggccccggcgctggacggcggcgccgggcactccagcggacgtcacgccacccgggcggaagcctcggtccgttcggcctgggcgccctccggcaccggagcggggcgctggccgtaggggaagtagtccttgagcttcagcatgtgcttctcgaagaggttccagctcaccagcgcgagccccagcgagagccccgcggccaccacgtagaacaccaactgcatgggcatgtccgagcccgccaccgtcttcagcggcgtcttcagcaccgtgcggcgcaggatggcgtccagcggcgagtggatgaggtagatggcgtagctgtacttgccgaaggtgaggagcagccgcatcgtgaggaagcggtacaggacgtggcccttggagacggccaccgccttgtacacgcacacggcgtagagcacggcgatggcggtgtagccgcccgtgcgcttcaccagctcgaacgtggggcccaccggcagcaccaccagcgcgagcaccaccggcaccgaggcccagaccgcccagcgcatccacgggaacgccttcaggcccagcccttccgggtggcgcagcgccatcgcgagcaggccgcccatcgccagcgagtccacgcggcagaacgtcaccacgtaggtgctctcgatgctggccccgtacagcgtgagccccacgcgcaccaggatggccatggcgatggtgcccaggcacaaccggatggcgccccggtacgacaccgcggcgatgaggaagggccagacgatgtagaactgctcttcgatggccagcgaccacaccacgccgaggatggggtgcgtggtgtccacccacagctggtagaagttggagaagtacagcaggtaccagacggcgccgtcggtggtgatgcgctcgtccaggcccagtcggcccgccagcgatggcagcaccaggaacgacaccgccaacgccaggtagtagagcgggaagatgcgcaggaagcggcgcatgtagaagttgcggaagaagtacggctgccccttcgcctcccagaggataccggtgatgaggaagccggagaggacgaagaacaggtccacgcccgtccatccggcgccagccagccaccacgtcacgcgtcccgccacgctctggtcgctcaggtgggtcgtgtggaagaacaccaccagcaggacggcgaggccccgcacaccgtccagcacgggcaggtgaccctgcaggcgcggagcgtgcgccgtgggtgcatccacacggccagagttcaaggacatgaaagttctcttaccaacaacgactgttattcaacaagaccaccacccggcgtgcgtgggattgcggtgtggggtgtcagtcctgccaccaggcagtcgggcgcgggaaaaacgcacgcgcgcgtgaaactcccgggccgcccgtgacaccttggtgccgtggccctcctttccgcgatgaaaatggtgctggcaggtgcgcccccgtccgacacggaccgggagcggacgttgctgcgccgggcgcgcacgggtgaccccgcggccttccgctggctgtttgaacggcacgccgcgggggtgtggcgcttcttgaaggacttgctgcgcgatgaggccgcggcggacgaagccacgcaggagacgttcgtccgcgcccatgcgcggctgggcgcgcttcgcgacgaagaccggctgggggcgtggctgctgggcatcgcccggcacgtgtacctggagtcgctgcggcaccggggcgcccacgtggacatggacgatgaagtccatggcagccaggtggaggcgatgctgcccacgcccacgccggaggacctgctcctggaccgggaactggaaggattgctggcgggcgcgctggggacgctgcgcgaggaccggcgcgcggcgctgctgctgcgcatcgaccacggcctgccctacgaggagatttcagcggtgatgggctggtcgctccagaaggtgaagaacgaaatccaccgcgcacggctccaactgcgcgagcacctggccgcacacgttggaggccactcatgagcgcttgtcgcgaaaccgaactggacgcgctgctggccgacgaactctcccccgaggacgccacgcgggtccgcgctcacgcccaggcctgccccgcctgtcagcacgcgctgagctggctgcgcgcggagcgtgggtggatggcgcagcgagcgcggcgcatgccggcgcggcccgccctggacttcgccgcgttggagtcccggctgcgaaagcccgtggtacccgacgccccgaaggtcaactggatgcactgggggaagatgctgaccgcggccctggcgtcggtggccttcgtgggcatcaccacgctccaggtgacgcgcctcccaagcgccgacgagccctggccccggaacgacgcgctcaccaccgccacccgggccgtcgactggtgtgacgacccttcacgggaagccgtggcggcgctggaagcccgcgtgggggcgtgcctggtggcctcccccttgataaccctgcgctgacgccggccgcggtgacctacggcgccggggccagctggcgctctgcgtgctcgacggcctccaccgcatccaccaggcccttgccgtagttcagatccggcccagccggccccaaatcccgggccgtctcgagcagggcattgcggaccttctccgcatcgagctgctggggactcacgctccacaccagggccgccaccccggccacgtgcggcgtcgccatggaggtgcccgtctgcagcgtgtagtccagaccggtgacgtccaacgtcacgtcctgccccatgagctcgcggagcacgttggccgactccaaggacacggagacagtgggcacccacagcttggacggcccgttgagcgtgaagttgcccgtgccctcctcggcggtgtggttgccgatgatgacggccttcgctccggcgcggacggcgttgcgcaccttctcctcgaagaggatgccgccgccgcggtcaacataggcgacgaagccatctacaggtggcggcctctctctcacagtcggagatgctgctgctcaggccgcagttcaccatccgccccgaataggcgcccacggccgagaactacagggggttggacgcgaactgctggccgctcgcggccacctctccatacggcgccccgccgatgatggtggcgctcaacacgcccacgccgggggccaccaggttgatgccctggccgtactgggagaagctagcccactcccccgagaaggtcaccgcgcccacgcccaccacggagtcgtacccggccgggaaggacacctcgcccgcgccggagttgcccgtcgccgcgatggccagcacgccattcgccttggcctggctgaaggccagctcctcggcctcgttcttcgacacggcgcccagcgacagcgacacgatgttcgccccctgctcctggcaccactggagcgcggcgatgacattcagggtgtcgcccgtgccgcgctcgttcagcacgcgggcgatcagcagcgacgcggtgggggccacgcccaccgttccgttggggtcctcgcccagccgcacccggccacccccgcccagctgcgcggcgatggtggccgcggtgtgcgtgccgtgtccgccgccccacagcagcacgttgcccttcgagtccaccttcgcgtccagcgccagcgagttggcggacccgctgatgaagtccttgcctccgatgaaggcggcctgcagctccgggtggcggttgtcccagccactgtcgatgacgcacaccttgatgcccgtgcccgaaggccggccctcgtcgaggacaccgtcgtcgttgaaatcccagaccttgttggcgcgcaccatcttcaggccgtcggtgtactcccccacggagcccacggtgttggggggcggccgcggctccgcgcccagccacgcctgcgcgggcagcggtggccgcgacatgccgagcgcgtacaccggacggttgggcgacacagacacctcgtccgaattcctggcgagcgccgcgcgcgcctcgggagacaccctgagggacatcatgttcagggtctggacgacct

SEQ ID NO: 1249 - DNA, 30135 bp, Myxococcus xanthus
aagcgcaggttgcggtgcgtgtcgagcgtcgcgtaccccagctccgcgaagggcaggtccttcaacttgcccaccgcgtcgtccacggagacgcggccggacttcacactgcccaggagctgtttcagcgccttctcatccatgggcgcccgtctagctcgaaacgggctacacgcccagccgcgccagcaggtcgcggatgctgtcgcgcgccagcaccaacagcaactgcccacccaccgggggtgccgcggtcgcgaggaagcgggcctccaacaccaccacgctgctggcgtcgccctccacctgccccaccgcgtcggacaccacgtcccgcgcgcggcctcgccgcaccgtgggcaccgtgggcaccagcttccagcccgtcagccggcccatggcggacaggcaggcactggcgacgatgttcgccgtctccgccatcacgctgtcccgttcggtctgatgaatcgcgggctgaccctccaggagcagcgcttccagcgcggctccgtcctgctggggcagcaccagcaacagggcaccccgcagcccgccctggatgcccagccaccccgacaccaccggcgcggctccgcccagaagctcggcggcgtcggaggggcctgtcagcaacacgcggggaatggagaggtccaccttgcgtccccccatcagccgggagagcgcattggccgcgtggccacaaccaatgttggccacctcgcgcagtgcgtcgagttgcgcgtcgctgtgcaggggctggctcacgcggacagtaacctcggcacgtccaggatgaacaccggacgcccacttcccaggatggtgacgccggacaggccgggcagcaagtccaggggccgcgacagcggcttgagcaccacttcctcctgtcccaacaggcggtccaccgccagggccacccggccggaatccccgtccatcaccacgaaaggccgggctcccagtctccggggggcaggtacgcccaccagcgcatccaacgaatggaccggcagcagcgaattaccatggggcagcagggccgtctcgcggctccggctgagtgactccccgtccgcctccgtcgcacccaccaccttggcgatgggcaggccgaagacctcctcgcccacctccaccagcagcaggtgcaccaccgcgaccgtcagtggaagtcgcagggtgaagcgggtgcctcggcctcgctcgctgtcgatttcgagcgtgcctccgacgttctccaccacgcgcttcaccgcgtccatgcccacaccgcggccggagatgtcggtgatgtccttggcggtggagacgcccggaaggcacgacagcatgaaggcctcgcggtccgtcaggcgcaccgcggcctccgccgagagcaggcctcgcgacaccgcggcgttcttcagcttcgcggggtccatgccgcggccgtcatcctccaactcgatgatgacgcggtccctggcgcgctttaccgccaccagcacccggcctcgtgggcccttcttcgcggcggcgcgatcctcgggcgcctccaggccgtggtcgatgcagttgcgcagcaggtggagcagcgggtctgacagctcctcgaggatggcccggtcgagttcgatttccgcgccggtgatgaccaggtcgacctcgcgctccttgcggcgggcgatgtctcgcgccgcccggggcagccggtcggtgatgagggacagcggcgtcatgcgcgccgtcatcaccttgtcgtgtaggtccttcaccaacgtgtgcagccggtagacgccctcttccagcgcggggcgcgtgttctccggcagcaccttgcccacctcgcgcaggcgggccgtggcaagcatcagctcacccacggtgtcgaggaagtagtcgaggagctccgtgcgcacgcgcaccgtgcgcgacgccgtgtccgaggacgctcgggcgccgtcggggacaggcaccagggtgggctgcaccacgggcgcggccaccgcgggcttcaccgagaggacctccacttcggccacgttcttcagcgccgcgtggatgcccgcttcgcccgccggggtctccagctccagttggatgttgccgtctgggatgcggccggctttcagttcctccagcgcgggccggagttccaccagcgtgcccaggttggtgaggcgcttgtggacgaggaaggcgcgcacgccgggcacctgacaggtgggcgcgatgcgcagccgcaccgcccagcgctgggccagcgtttccgggagcggcgcgctggccgcggccttcagggagttggccaggtcgggcgttggagccgcggatccggcgtcggtgccaggcacgtccgaggcccggcgcgtggacagcggcaccaccacgcctccggtggctccgtccggggataatggggcgctggtaccatgcgctccattcggcgcgctggaggtggcggaggtaccgggtccgccgttcatcagattggggctggccgggccgggccccgcaccgtcaacaccagtgccgctggctacgccggggctggcactgccacccgcggcgcccgagcctccgtcgacgcagctccgggtgccgctgccagcagctccgccaccgtgcgttgaggcagggctggcaccggcgcctgtagggcccgagccgccagctccgcccgcagtgcccgagcctccaccagctccgcccgtagtgcccgagcttccaccagctccgcccgcagtgcccgaaccatccgggcctccgcccgtcgtgcccgagccatccgagcctcctcccgtagtgcccgagccgcccgctccgcccgtagtgcccgagccgcccgcagtgcccgagccgcccgcagtgcccgagccatccgagcctccgcccgtgccatccgagccgccgccctctggcttcagcgccgtcaccttcgcgacgcgcgtggcggccggggcttgacccgtcatggtggtgacgcgctggctgagctgcgtcaggagcgccgcggaatcatccggctgcttgccctccgccaccgcgcgcacctgcgcgagcatggtgtcggcggcggtgagcagcaggtccaccaggtcgcggtccaggcggccgcggtcctgacggacggcgtccacgaggtcctctacgcggtgcgccacgatggcgatgggctcgaagcccatggacgacgccatgcccttgaccgagtgggcatggcggaacatcgaatccaccgcgctggacgagccctcgcgctcgagctccacgaggtcacgcccgagcgcctccaagtggtcggtcgcctcggagatgaagagcccgaggtagcgggacatgtccatcgtcatggacccggcctcgtgtcaggaagggtggacagcccgcgccagggcgcagccgctcacgtctcgcccaggaccttcttcaccacggccagcacgtcctcggcccggaacggcttgacgatgaagtccgaggcgcccgcctcgatggcctccatcaccaggctctcctgcccgagcgcggagcacatgatgaccaccgcgctgctgtccgccttgatgatctctcgcgtggcctcgatgccgctcttgaagggcatgacgatgtccatcgtcgtgaggtcgggcttgagctccttgtacttctccacggcctccaggccgttggccgcctcaccgacgacctcgaaccccccagacgcaaagatgtccttgatcatgttgcgcatgaagatggcatcgtcgacgaccaggacccgcttagccatgtgaagaactccgcctccgaatcacctagaggagcgcggacactagcatccgcgctttccagggggctactcacttggaatgggtgaacaaggcaaccaccgcggcgtccaacccttctgggtccaggacagtcactcccaggccacccagcctggcgacgccccggatggcaggcgtcatctttcctggcgccgtgctcacccgctccaccgcttcgatgccatctacgtccgttaccaacagtcccaggtctctccgcccgcggtccagtagaaccacccgtccgggcggggtaggaccctcgggaagactcagaagctgccgcagctctaccactgtcacgaccctgccgcgcagattcattacgcctgtaatggccagtggcgcacgcggcacacgggtgaagcgctcgggaggcacgacgacctcccgcaccgccgagagcggcaacccgtaacgctccttctccacccggaagatgacgtgccgcacaggagtaacgttctatccactctggaatgaccggcccgattcgctaccgcttcgaccgggacgaacccgccgcgccccgcttcgccgtggacgtctgcttcgcgccggcccgcctggtgggaccttcgcgcgccgaggccggcttcgccacggatttcttcccgcccaccgccgccttgcccgatgcgggcttctttccggccgctgacgtccgtgccacggcccgccccgccgccacaccccgcttcgccgccccgcccttcccagcaccggcccccggcttcgccgccgccgacgtccttgcaggggccgcgggcttcgccgccggcttcgccttccgtgctgccgacttcgccttccgtgccgccggcttcgccttcggagcctgcgccgcgcccggagccatcagcgccttgagcaccttctgcggtgccacggcgcggaagctctcgtgaatccactgggccagcagcccgatggggacctcgctgcccggcttgaagtgggaggacacccagccgctcttgcccaggccgtagccggtgggcgcggtgaagggcagcgtgagcgcggcctcgttggactccgggagcttggtggtgacccccagcccgtcgttgtccagcacgaggatggcgaacatcttccccttcaccttggccgtgcggtggccccaggggaactcctcggtgacctcggggagcgcgagcatcacctcgcgcaggtggtcctccgcggccttcagcttcgcgtcgacgttgtccgagggcgtctggctcatgggcccaggcggaagctgcgcacgacgctctgcagctcgacggagaggttggtcagctcactggccagcgacgtcatgcgggacacggcggcggtctgctcctggatgacggcctggatggcctccgtggaggaggcgttgttgcgcgccaccagcttgatttcctcgatggccgtcaccatctcctcgctgcccttgagctgctcgcgggcgctctcggagatgaggtgcaccttctcggagcccttgcggatggtgtcggtgatggcgcccatggagcgcacgatgttggtcaggtcctcacggccctcggccagctccgcgatgccttccttcatggcgctcacgacggaggtggactgtccggagatgtcgcgcgccagcttggagatctgctcggcggagcggcccgcgctctcggccaacttgcgcacttcatcggccaccaccgcgaagccgcggccgtactcacccgcgcgcgccgcctcgatggtcgcgttgagcgccagcaggttcgtctgctgcgccacctgcgtaatcgcgtcgacgatcttcgagatttcctgcgtcttctcgccgaaggcgaacacctgctggctggcggactcgatgcggttgaagaccttcttcaccttgtcgccggccaaccgcgccgccttggagccgtcctcggccgcgctgctcgtctccgccgtcgtccgcgccgcgtcctcggcgctggccgtggtgcgctggatgctgccggccatctcggtgatgaccttggacgccttcgacaccaactgcgactgggactcggcgccgccagcaatcttctccatcgacgagcccacctcctcggtggagccgttgacgttctccgcggagcgctggaggtcgatggccgtgtcggccacgctcttggccgtctcttgaatcttgcccaccagctcgcgcaggttctcctgcatgcgggtgatggcgcccgtcagctcgtcaatctcgtcgcgcttgctgccgccctcggcggccaccggcttggacaggtcgccctgcgagatttcgtatgcggagcggctgagcaccttcacgcgggtgacgcgcgcgagccacgaaggcagcagcgcggcggcggccccggtgatgatgatggcgacgccgatgcgcacggcgtccttccctcccgcgctgagggcagggaagacgaagttgatgaggccgtccgacgcgtacatccaacccgtcagcgccagccccatcaagacgtagccgttgagaatcttccggtgaagggagacctcgcgggtcgcgcgaggtccgtccacggcgcgcagcagtcgctgcaggggctcgcggcggggagtgtgtccggggactgtgtcgtcgcggaggggacggcgcacgggttgctttcgggggatgagaagcgtctcgggtttagccttgctgctccgcagggtcaatccatcgcccgaggtcggaagtggtcgaacccctctggcggtgggagaacgcggcctgtcctgtcccggcccacccacccgcgcccctctgtgaagtggccgatgcgggtgatggcgtgcccgcctgtagcgcacgcgcgctcgaatgcccggctgcgtcccggaggaacggccagcagcaactcatagtcctcgccccccgccagcgcgccttcgggccccagggccttgcgcaccgccgccgacagtggcagccgctccacctccagctccgcgcggacacccgaggcggtgcagagatgacccaggtcttgtgcaagtccgtcggaaacatccaacgcggcagatgcatggcgcgaggcgagcaggcccagcgccacgcgaggctcggggcggcgctgacggcgcacggcggcaccccggcgcagccccgcacgaaggtgctccaggcccaggcgcgcatcacccagcgtgccggagacatagaggaggtccccgggccgggcccccgcgcgggtaaggggcgcgcgtgacagctcgcccgctgcggtgatggtgacggacagctcgcgcgcggaggtgaagttgccacccaccagcgcaatgcggtgcgcggtggccagcgcggccatgcctcgcgccaggcccgtgagctcccgcaagggatagtccttcggcagcgcgagcgcgcagacgaaccagcgcggcgtggcccccatggacgccaggtccgacaggttcaccgccagcgccttgtggccgatgtccgcgggggagaacgcggcgcgcgtgaagtgcacgtcctccaccaccgcgtccgtggtgacgcactgcgccccacgtgaggggggcagcaccgcgcagtcgtcgccgggccccacgggcacacgcgcggccgggaagtgcgcgaggaaccggcggatgaaatcgaactcaccagacatggacgcacacgtaagaccagacggcgtgtcagggcaacgacactttttggtaccttgggcagacgcaactttttcccaccaatccaagacaacataaagattgggacttccatctcctgggggaatttcatgtcgaagattggcgagcggctgcctttcgtttccacgtccaaaacccagacgagccccacgggccaaaaggacgtcagcacccagcagtgggtggacctgctcggctccgtgcttccaacgcagagcgtgacgaaagcagcccccgcgagcaccttcgccacgcaggccccggggacttcgggcaccccgcagccccccttcggcaaggagattctcccctccgccctgggcccgctcagggatgagcgcctggcggcctgcattgacaaggctttccgagaggtcttccaaggcgagcgctggccgagcgggcccgagcgctccaagtggatggacttcgcacgggagctccgcaacaagaaccccgaaatcaccgccgaggaggtccgcttcgccatccaagacaagctgcgattggagcgggacggactggacgcccattcgccggcgaacactgacaggttcatctccgaggccatcgcgtgggtcaaccagtgctacgacgaaaaggcgccccctcccacggaggcggacatgcagcactggcgcgccttcgccgccgacctgatgagcaagaatccaaagacgaccccggaggagctcaagtacgccatcatcgacgccgtccgggcgaaggtgacgggaacggacgcggtgacgccggagaacatcgacaagttcatccaggacgccgtcaagtgggtcacccagtgctacgaggacaaggagcgcgaggccacgcccgcggagctgaaggagtggcgcgccttcgcccaggagcagttgaagaaggacccggaaatctcgccggagcacctcaagtacgccatcaccgacgccattcgcgcgaagatgacggggaccggtgaggcgacgccgctgaacatcgacaggttcatcgaggacggcgtcaagtgggtcacccagtgctacgagggccaggagcgcaagcccaccgccggggaactggcgcactggcgcgacttcgcccggaagcaccagaaggcgaacccggacatcacgccggaggcgctcaagttcgccatccaggacgccatccgcgtgaaggcgacgggcatggacggcacgggcagcaccaacatcgaccagttcatccaggacgccgtcaagtgggtgtccttctgctacgaggggcaggagcgcgacgccacgcccgaggagatgcagcgctggcgcgccttcgccaacgagaagaagaaggagaacaaggacatctccccggaggagctcaagttcgccatccaggacgcgatgcgcgacgagaagatggggacggacgctcccgccagcaatcgcatcgaagaccacatccgggcggcctacggctggctcatctacctcaaccaggccgggccctcgcagccgtcgagcgagccgacgcccaacgagctgcacgaatggaagaagttcgccgaaaagaagttgaaggagacgcctgagatgacgagcgaggagctccggtactacatcctggacagcctccgcaccgccatggccaacagttgacggcggcgcccctgcgctcgcgttcagagcgagcgcaggaaggccaccaatgcctcacgctccgccttgctcaaggccttgaagcgctcgcgggcacgagcgccttcgcccccgtgccacaggatggcctcctcgaagctgcgcgcgcgcccgtcgtggagcatccgcacctgacggttcaccgtctccagcaaccccagtccccacaagggcggcgtcctccactcggtgccggtcgcttctccgtcagggcggccgtccgccagctccggccccatgtcgtgaagcagcaggtccgtgtacggacggatgcgttggttggacagctccgggacatcctcgaccgtgcccgtgatgaactcccgctggtggcacgccgcgcagcccgtcttctggaagagggtctgtcccttcatcacggtgggctccaacacgtcgcgccgcgcgggcacgccgatgagccgcaggtacagcgtcgtccgctccaggacgtggcgcgacaacgcggggcccttggcggccactcgcgtcatgcagccttcctgcttcgccgtgcagttgctctccggatagagcggtgacgtcagtcccaggtcctcggagaaggcgctggcgacctgttgctccagcgtgggctgattggccttccacccgaagcggcccagctccaccttgccggagtggacgctgaccacgcggttcggacggccggagacgccgtccccatcacggtcatccgcgtccgccagggcgtggatggcttcatccgggatggccgccagcagccccaggccgaagagctgggaggggatgcgcggcgagagcatcacttcgggagccagcttcccatagcccagttgattgatgcggtagcgcggctgacgcagcgtgtacggcgtcccgtccgcgtacgtccccttcacgtccgtataggtgacctggaccgtgccctcggccgggacatccgcggtcccacggtcattgagctgcacgccgtagacgggttcgtgatgccccgcgggcgcgtccttcgcgggcacgctcaaccggacgagcagcggcgcctccggccccatctcgggcagcgggcggccccggccatccttgaagtgacacgaaccacacccggcggcgttcgtcagcgggcccgccagcccttcttcatgcgcggcccagtcccgcatgaacaacaccttgccttcgcgcatctggtaccagcgcgtgggcgccaggtttcccagcgcgcggccataggcattgtgcgagacgtcaaacaccgtggtgccgccccccgccagagcctcgtcgtccgggcgcccgggcacctccgagacggccgcgcccggcgcgggtgcgccgctctcctgcctgggagctcccgccgtgagcagcagggccgtcaaccaccacgatgccttcatgggacgctcttcggagagaggatttgaaacgggaaagacaacggcccggagcgggcttccccccctgagcccgctccaggccgaaacgacgcgatgactacttgccggcggggatgagggactcgccggtgatgaccgtcgagcgcgcggtggtctgcacgtcgatgcggttgaagttgaggtacgggtagttggacgggcccgaggtctcctcctgcaacacgatctggtcagcccgaacaatctggccgttcggcagccggacccccggctccgcgacgttgtactgccacaggcaggcgctgctgagctgagcgctcgcgaagcccacggtgagggagcacagcgtgttgcagtagttgcagttggagtagccgttcgcgtagcaggccgactcacactgggcatacgtctgggtgcgcgggcggcagttcggcgtccagcccggggtggggagcatgatgcccacggcgcccgtgtcaccgctttggataccacccacggcggcctggagccggccattgtagtacgcgagcacggagtaggtggtcgcgtcaccggagccggtgaacgtcgcggagtacgaggtggactcccgcgacgagtcgacggtggacgtgctgaccggcacatcctcggcgtaggcggtgaagaagttgcgctgcgcgccttccgactgggtctccgccgtccaggccgccgcgggcggcgtgtggatggcgacgccgcccttaccggacggctccttctcctggctgtcgatgcgaacgcccttcctcaaatcactcaccttgacggcgccaaggccacagtgctggagcccctggaactccacacagttctcagcggcgtgggcctggctgagcggaagagcgagcgagaagacggcggcccagagggcggttccaacgcgacgagacgaacgcatgaaggctcctgatgacccagggggaatccctgagctcgggagaagccagttcaagcgtcatgccatgttttaccgcactctcagaatacaccgggctgtgacaggaatcaccacagcccaggcgggtcatgtgactgcctttgctacaagaacagccccgggtcgaactcgtccacgttgacagggagcatgcgcggcaggggccggttgaacaccttggcgttcaactccaagtccagaatcttgagcccggaggggacgagctcccggaagcgctggctgacgtattcacgcaggccgagcacggccacctggcgtttctcctccagcatgggcttgagcgcgtccgcgaagtccgcgccgtcatggctggcgagcaccaccgccgcgccggggcgctgggtgcggatgttctccagcagcttcaggatgcccaggtccaccaccttctggtcggggcggccgtagagcagggccacgtcgcagccggcggacttgagcgcgcgcacgaagccaatcatgacgtccggcagctgctctccgcgggcgttgagcaccaccacgcagcgcacgggcgccgggaagttcgtctcacagaaggacacgagccggtcgaactggacgcggtcctgggactcgggcttgcgccccaccacgttggacacagcccagtcgatgttctcggcgtcgatgagtacgtaggaggaggcgggggggcgtccggagagcatgcgcgcgaggatacgcgggagcccttccggccggggaactcagttcagtccccggtgcgtcaggtcgcgtcagaagcggtcgtgtccgctgggcgacggcgtgggcgccagcgcggagaagccgccgtgctccgacagcggcggctggagcggcagcaccacggtgaagcgagagccccggccgaactcgctctccacggacacgcggccgccgtggccttccaccaggctcttcacgatggccagtcccagccccgcgccgccgtgctcgcgcgtggagctgccgtccacctgatagaagctctggaagatgttctcgaactggtcctcgcggatgcccatgccggtgtcttccacacacacacggtagcccggcgcggccagctcatgctgcgcggtggcctccgacatcaccaccgacacccggcccccggacgaggtgaatttcaccgcgttggcgagcaggttcaccaccacctggcgcagcttgtccgcgtccgcggccaggcgcggctgaggcaacggcggcaggcgcacctccagctccacgcccttgcgctgcgcctggggcgccacgctggacaccgccgtctggatgacgctgcccaggtccaccgggcccatcaccaggcgcagccgtccggcctcaatctggctcaggtccaggatggaggagatgaggttgagcagcgactcgcccttctccacgatggtgcgcacgtagagcagttgctccgggttgagcgcgccggccaggccctcagccagcatctccgagtagccgatgatggaagccagcggcgtgcgcagttcgtggctcaccgtgcccaggaaggtggacttcagccggtccagctccttcaggcggatgttggcctgcgccaaccgggcgttgttcgcctccaaatcccggtgcgtctccagcatcgcctcgatgtggagctgcgtcgccaggaaggcgcgctgcccgctggccaccagggcggcgagcacctgcccgaagtgcaccagcacctgcgcggcggtgcgctcgggcacgcgccgcacgcgggccaccagttcatgcgcgcgcgacaggtccaccccggagatgtccgtcagcgacggcgggaagtccgccagctcctccggcgtgaaggggcccaggatgacgcggcccaacgtgtcgccctcccagcacaccggcatcaccaggtagcgcaggccggtgaagcacggcagcgcgatgatgcccgccgcctccgcgccatcaccgcgcgcgggccgggcgccctgcaccagggccaccggtccgtccttcacgcgggccaccgtggcggtgcagcgcgagcggccctccgggaagccgaacacgtacgagcagaagtcgccgtggcccaccttcacgtcggccagcttgtcgcccgcggtgtccatcaccttgatgcccacgcggtacaactcactgaagctccgcaccacctccacgaaggagggcaggtccagcatgtccgccagcgacagcctccgctggagcacggactcacggcgcgatgcgcccacgccgtccgacgccccgttgcccgacgcgccgttcatcgcccttctccgctgcgcgcttcacccgccgcgcgcccgtacatggaggccaacgccgtgcccgtgaggtccatgcgccggaaaatctgccccaggaactccgcctccgtcaggcccaggttgcgcgccaggtgggcgcgcatgtcgagccgccggtaggctgcctgcgccaccgcgtggaaggtctccagtacgccttcgccccgcagcgccaccgcgcccaccaccgcctcgccgcctcgccggcgcgactcctcgatttcggcatccgtgcgcgcgtccggcaggtccttcttgttgaactggatgaccaccgggacctggctggggtccaggttgttctccttcatgttctcctggaggttgcgccaataggcgttgttgtccgccgtggcgctgcggcggctgtccgcgatgaagaccaccgcgtccgcgccctgcaggacgatgcgccgggtggcgttgtggatgacctggcccggcacggtgaagagcttcaccttcaccttgaagccggaggacgtggagaagaagacgggcagcaggtcgaagaagagcgtgcggtcgtcgtgggtctccacggtcagcaaccgcccccgcacctccggagacgccttcgcgtggagatgacgcagattggtcgtcttcccgctgaggccgggcccgtagtagacgatcttgagcgtcagctctcgctgggcatggttgagttgcaaggtggggctctggctgacggtcgagcggaggagtttgacgccttcgcgcccgactacgggttttatagtgggaagcggcccgacacggaaggccggcagggtgccaggcgtggaggcgatgctcatccttggaatggcctgaacgcatgaccggttcgacgaaatccggctcctcaccagcggagaggagggcctctcctcacttcatgggacaatgtgcgcggaatcaccgcgtgcaccggtgccgccggagcggttaggatcgcaactcgacggaggagcaaggcgatgacgatgaagcaggtggacgcaggcgtggaggtggccccagcaccgatactggatgtggctggcctccccaacgacctgatggcggcggtgaagttcggcctgcccaccgacgaagacatgacggcggtggcggacctgcgcgccggctctgagccctggaagagccggggtgagacgcaggaggacagcctcaaggccctgacgcagctcaagcccttcatccatgtggcgaagctgcaaagccagcttgtcggctatgtcacggtggagcgggacggcccggttccgggcgcggcatacctgcgcaacatcgtggtgaagcccgagctgcgccgcaagggcctgggcaacatcctgctggagcaggcgctgaaggcggcccgggacatgtaccggaagaccatcgccctgcgggtggatccgtccaactcgcccgcggtgagcttctaccggaaggaaggcttcaccacggtggccacggtggtctccaagaagtccgggaagcttcgcctcctgatgtcccgcgagctctagagcccacggaacgtaatgccgccgggcggggggccctcctcccgcctgctgctccgagcgggcccctggtgggtcccggagctccctcccccgcattccaggtgacagtctccgtcaggcgcggatgatttccgtctgtccggaagcaggcgggcaatcctgggacaaggggtggccggattccgcgcgatgtcgtctatcctgcggttcccccgcgcccgcgcgccgtcgcggctgagccgacatcccgcatgaaatcgctcgcagaactgttgcggcacctgtcgcgtccgggtgtcaccgagttgaccctggccaccggccggccgccgatgatccgcggcgccaatggctatgagccggtggaccccaccaacgccacggccgaggacatcactcgcgccctgcaggccatggtgggcgtggcccgggcctccaccgtcacggagacgccggtccagtggtccgtcaacgccaccggcctgggctcgctgtccatcgccgccatgcggcgaggggacctcatccacctgcgcctcagccgggccgccgacgcgggggccgccgcccaggccgccaccgcgcgtcccgcagcgcctgcgcccgcgcagcccgcgcgtcccgctgccccagcgcccgtgcacgccgcggcaccgtcctaccgcacgcccgagcccgcccctgctccggcataccgcacgcccgagcccgctgcgtcgcagccctaccgcacgcccgagcccgccgtggcccaagtagcccgtgcgcccgagcccgcggcggcccgtccggtggccgcgccggcccggaccttcacgggcgcggggcgcgagctggccgtgttgctggaggaaggccgccggggcctggccagcgacgtgcacatcatcgcggagcgcccgcccctcttccgcttcgcgggcgagctgatggcgcagggcccggtactggacgcgacgacggtggagaagctgctgctgccggtggtgccggagcggctgcggcccgtgctggagcgcgagggcagctgtgacttctccctggagacgccggagatggggcgcttccgggtcaacgtcagccgccagcgcaccggcctcaagggcaccttccggctgattgcgcgggaagtgcccacgctggagtcgctgggcctgcccgcggacatcgccaaggccacgcaccaccaccagggactcatcgtcatcaccggtccatccggccacggaaagacgagcacgctggcggcgctcgtggacctcatcaaccgcgagacgtcccaccacgtgctcaccgtggaggacccggtggagttcgtccacccgcgcaagcgcgcgctcatcagccagcgcgaggtgggctcgcacaccaagacgttcgccagcgcgctcaagggcagcctgcgtgaagacccggatgtcatcgtggtgggcgagctgcgcgacacggagacggtgcgcatggcgctgtccgcagccgagacgggccacctgctcatcagcaccatgaacacgccgagcgcggcgaagaccatcgaccggctcatcgacctcttcccgccgggggaccagcagcaggtgcgcctgtcgctgtccagcggcctgcggctcatcgtcagccagcgcctgatgccaagcgcggacggcaaggggctggtggccgcggcggaggtgctgccgggctcagtgtcgctgggcaacctcatccgcgacaacaagacgttccagattccctcgctccagcagcgcggcaagagcctgggcatcatccgcttcgaagactcgcttgcggacctggtgcgcgccgggaaggtgaagctggaggtcgccaagggcttcgcggacaacccagacgagttggaggcggtggtgacgggcaggcgggccggcgccaccgtggccgcgccggagacgcagcaggatagcgcgaggctgctcagcaagatgggctcgctgatgggaaggaagggctcctgaaatgacgacgccccgtctggcggtcctgttcgatgtgctgctggagcagaagggcagcgacctgcacctgggcatcggctacccgcccatgggccgcatccgcggcgagctggtgccgctgcgcgagcagcccctcaccgcggcggagatgcaggcgctgctcttcgaaatctgctcgccggagcagcagcggcagattgtcgaggacctggacctggacttcgcctacagctacgggacgaaggcccgcttccgcgccaactacttcaacaagatgacgggcctggcggccgtcttccgcaccatccccagcaaggtgctgtcgctggaggacctgaagacgccggaggtggtgcgcaagctgtcggagcgccgcagcgggctggtgctcgtcaccggccccacgggcagcggcaagtccaccacgctggccgcgatgatcaaccacatcaacaagacgcggcccgcgcacgtgctcaccatcgaagacccggtggagttcgtgcacgagtccatgcgggcgcaggtgacgcaccgggaagtgggcccgcatgcgtccagcttcgccaccgccatccgctcagcgggccgcgaggaccccaacgtcatcctcattggcgagctccgcaccaacgagacgatgaagctggcgctccagttggcgagcttcggcgtgctggtgttcgccacggtgcacaccaacagcgcgccggccaccatcgaccgcatcatcaacgccttccccgcggacgagcagcagcaggtgcgcggcatgctggcggagagcctggcgggcatcgtcgcccagcaactcatcaagacggcggacggcaagggccgcgtggccgcgctggaaatcctggtgggtgggcccgccatcgcctccatgattcgcgagggcaaggtgttccagattgcctcgaagatgcaggcgggccagggccagggcatgcagacactggacatgcacctggagcggctggtgaaggatgacgtgattacgcccgaggccgcgctggagaaggcccaggacaaggagaacctggccaagatcatctcccgcctcaagccggactggcaggtgccggagtccctgaagtcgctgggctagcccgccacgggcatttcgaaggacaggaacacggacatgaagaagccagcggtggggagcgtgggttggatggacctcacggtgaaggacgccgtggcggtgagggacttctacaaggacgtggcgggctggtccgccaccggcctggacatgggcggctacgaggacttcgtcatgatgcccccgggcggcggcgagacgcccgccggaggcatctgccacgcgcgaggcaagaacgcggacatccccagtgggtggatgatgtacatcaccgtggcggacctggagcagagcctggagcgcgtcactgcgatggggggccgggtgctcgggacgattcgcggctccgccaagacgggccgcttctgcttcatcgaagacccgtccggcacggcgtgcgcgctctaccagtcagggagcgactgacaggccgcacgctcctcctcgcgttccttccgggtgtcggacctgggtggtagacccaggcccgtgatggatgaggcgcggggaggacccgacaagaagaaggagcgcggcccgaagcggccccggaaggtgtcccccacctacctggagaacgcggcgctgcactacctgaagcgttacgcggcgacgaagagccagttgcagcgcgtgctgctgcgccgggtggaccgctccatcaagttccacggaggtgagcgcggcgaggcgctggcctgggtggaggcgctggtcgcgaagctggtgcgcaacggcctgctcaacgacgaggcctatgcccagatgaaggcgcactcactgcgcgcctcgggccgtagcacgcgggtgattgcccagaagctgcgcctcaagggcgtccccgcggaagtcgtggcgaagaaggtcgccgacgccacccacgaggtgtccgaggaagatgccgcgcgaatctgggcgcggaagaagcggctgggtcccttccgcacgcagcccggcacccgggaggagaatcggaagcgggacctggccgcgctggccccgggcgggcttctccttcggcatcgcgaagaaggtcatcgactccaacccggcctgagccaggccggtgaaacagcggcggcccgcccgctaccgggcgcggtaggccttcatgcgggcatcgctcgcctcgcggcgccgcagggcatccatccccgtcgggagctgcaccggggcgtccgcccactccgacaggcgcccgagcaggaagctccgctgcggctccggcagcgcgctcagcgtgccgaagaagccgatgctgtcatcggcgatgacgcggtacgcgtcgttgcccgtcgtggtgctgaaggcgctggcggaccaggggctcaggtctccatagacgagcagcacccgcttggcctcgaagcgggtccacgcctccagcaggcccaccgtccacggctcgtactgcttgcgcacgcccgtgggcgggaagcgcgtggggaggtgctcaccggcgtagcgcagcaacggccgcaggtgaacctccgggtaccccgggccgcccagctgcgtggcgccctggtagtagagcggcgccgactcctccagcgcctggtcggagaaggtgaactccagcgtggagacgtagctgaagaaggcgaagagctcctccgcgctcgcctccggcgagggcagcccctcacacgtccccgccatgccgtagtactgccagaagatgaagggcacctcgatgacggcgaactcgaaggcgcggtccttccccagcgtgttgaaggtgaagccctgggcgtcgtagccatccatgaagggcagcagctcgtcgcggcgggtcagcgcggcgtactggagggacgcgagctgctggcggcaggccgcgtcgcccaccttggtgaggatgaagcgcccgtgtcgcgcgtcatggaggccccggttgtgctgcgccgaataggtcaccgtggcgtggacgtcgttcgggaaatagaagcggtgggccagggcggcggtgccgcccttgaagacgccggtggacagccagcgcccgccgtacagcggcttgaaggcttcgacgagccggtgggcgtccgccgccgcctgccacatcgtcagcttccgccagtccatgtcggccggcttggacgcgccgtagaagcggtgctccacggtgagctggttgccctggagcaggtccgtgggctcggcggggatgggctcctcgaagatggcggtgccttccgtgtccagcaccatgggcgccgtctccgagcggtgcatcagcgtcacccgctgctggaagcgcgtgccccagggacgcaggtggtccacgggctgctcgtagtccatcgtgaagaagcggaagccgttgacctcgacatcggtcagcaccgtgaggccggcgatggactccagccgggtgcggaggtccacgctcgacaggtccacggagacggacgggggcggcgcggtcccctgctccaacgactccagcccctccgtcgtcgagccgccacagccgagcacccatgcgccgagcaggccgcccaccgcgaacgccgcccagttccgcttcagcccgcttcgcatggtgtcgtccctcaggtgtccgttgaagcccgcgaagatagcaggcctgggcccacgccacgcatgaagcgcctgggcgcggcatgcctacataccggtcccgcacaacgagcggtaaggcagactatttccaggaacggcatccagcgccgtgattcagggtccggactgcccctgttcgagcaggccctcgcgcatcagcgtgaagacagcctgcccacaccggccctgcatgtccgccgtggcacgcgccacccgaacgacatagcgcacaccgtccagggtcagcggggccggctgtcctacctcggccgtcacggtggtccccgggccttgcgaacgattcgcgtgcgtcacacggagttggacgtccagcgcatgcgtcccatccgccagcgtgcagcccgcgtcctcccactggaagctcaactccgggacgagccctggaggaagcagcacattcttcccgcgatggtggtgggagcactacgcaccgtgagcagcaacagccggtcctacgcgtgccgacaggtgtctactgacaacagcacgggaacctcaccatcctccttcgtaggacaggacgcgggctcgcgatggctggtccactcaacgacctgccccgtcaggtccgacagcacgtccggcacttggaggctgtagctcacgccgccgcgcaccggccccgcctcgtactccagcaccgaggcccaccggtcctggtgccggtacgcaccgcgcaactgccgggcgacggtgaagcgacgctccagccgcgtgtccgtgcgctgctgcacggcgtcctcgggctcttccttgaacgccacgtccacctgggccgcgcgccagacctggacacacgggctctcgcgttgaagcgatgccaaggcatgcccggcgtcggggaccggctcggagcacttcatctggcagcccatcaggcccgtcaggaggagcccagcggccccacgcgtccatctcgccggggcgcgacaacgtcccggacgagggcgcaggctcatgggcactcagcgtacagcgtcgtgccgtcggtcgacacgaagaagtcctgcccctccacctgcccccgcgcccgcagccgctcccgcgtgcgctccaccttcaggcgacgcgccgcgacgggtggctccgcgtggggcacgcgcggctggaaccgcaccggccctcccttgtcgtccagagcgtacttcgccagcagcacgcggtgagtgccgtcgtccgcgtcgccgtcgtccaggaagtccagctccacggcaccccactcattcacatcgcagtcgcacgagccgcacccagggaagccgcatcccaagaagccgttccggcaggagacacacttgctcttgggggacgcgctacacgccgcgcacgcattacctccaaacgagtacgtgtgcgagcccggcgagcccacgccgagcatctggtagcggtagttcatcacgctggcgtgcaccacgctggtctgccccgccacgtcgttgccgttgtggcccagcgccaggttgtggcccagctcgtggatgaaggtgccacgctgttcctggatgctcgggctgctccagcagcccaggctgatgatgaggtcattgcccagcacctccgccttgccggatgagcacgacgtgctgctgccctgccggtaggcccacaccgcgtagtggaagtagggccgccgctccgggtacccgatggagaacccgccctgcttcaacgaatagaagtccacgccgccgctgcacgcgccgaagcacaccacttcatgccagggcagcgcgctgtcgacgaaggcatgcagccgcacgcccgcgtcccgcgcgaacaccgccgccgcgtccgccaccagcccggcatagggcttccgcgtgagatagggattggtggggtgctccatccaatccacctccacgtagaggtccttcaccgtggggctgccccactcggagaaggagaagccgtcattgccgaacaactccagcgtgtccggtatcccatctccgtccgagtccttcgagtccgggttcatccccaccagcggctccagggcattggagatgccgtcttcatcctcgtcgttgtcgctgaagatggtggaccacagcgcgtcgtcgtggacgaagctggccgtgcccgtgctcccgggaaagcggcccaccaccacgcgctgggcgcccgcgttctgtgtgctcgccgcgacgaccagcgggtaggagcgaggcccactgtcatcgtcgtgttgcaggtactccgcgttggagcgcagcaggaagaccaggtggtcccccgcgcccggcgtcgtggacgtggcccgaaaggtgtccttcacgttccaggcgaagctgagcggcacgccgccgaagggctggttgctcaggagaagcgctccgttgcgatacaggctggccgtcccgccgcgcccttccgcataggcgcgcacccagacgcggtagagcccggagtccggcgcggtgaacgtcacgcaggaacgcgcctcgcccgcgcagtcgtcgcccatggccacctggctccagccaccccggtcccggagcacgtgaaggacggtgtccggcgcggtgcccgtcaaatcccgcgtctcgaaggtgtacgtctgccccgcgtccagccacgtgctcaaccagatgaaggtgccccagtcacgagaggccacgtagtgcggcccggccagcacccacgcgggcgccagcaacaccagcgcgagaagagtcctcggaagcgtcttcatcgcgtctcctccgcgcggaagaaggcttccttgaaggcgtcgtgctgacgcgacttttcctctggcggaagcgaccgccacttcacctgctccacggtgagcgcctgttggtagcgcgcgtccacttcgcccgcgcggaggtcctcggtcgagggctccggcggcgtggccagcttcgccaccaggttcagcgccgccagatagcgccgttccttctccatgcgtgcttcgggcgtggcgtccatgaaggcgcgctccgtgcgcgtcaccagcaccgccagatcgtccaccggctcttcttgaagcaaggcccgttcgtccggcgtcagcggaaccagcgcgcgcgcagcgaactgctcccattccggcgcttcgtcgcgaaggctcgccacctgcaccgcgcggccggtgtcatccttcgcgggttcgacgtggaagcgcggctcggcggcgaccttgggtggagccgcgggcgtccgggcgacttcgcgcggtgccccttgattgccgagcgcccaccggggggccagcaacgaagcactcgctccgaccagcatgatgcccagcactaccgctgcgacttcccctcgtgtgcgcatgcgtcgtcccccactcgctggcgcggagctctagcgccatttgccggggacggcaaacccaccccgcagcagtcagtgcgggggtatccacgtcacgccgaagtgtcatgacgtggacgccggaagggcgggcactacgcctgaggcatgggacggcccgggccgtggaacacggcgacgggcgagggcaacctgagcgactcgtcctcaggcgccgtgcccgcggcgcccttcgcgagcggacgcccaccggcgagcacctcacgcgcacgcgtcaccagccactgcactccacgaagcgcgtcacgcaccagcagcagcggcgcgtcgcgcgacagcaacgcgggggcgttcgcattgctcattgaagcgggctgtcccacgcccagttcgtagaccatctttccgccgagcgccgccgtgccgagcgccagcccacaggcgcccagccccagcgccacggtggccgcggtgggctcgcgccgcagccgccacaccgtcacccccaaggcgccgagcagcacggaggcgttgcccacgccatgcaggaacgtcatgtcccgggcacgcggcgtctccagccggacctcctggctcgccgccagtcccgacacgcccgcgagcaggccgccaatggagcccaccacccagatgcggcgcgccacccgggcccaggcaccttcgcctgtcgtcactgagatgaggtccgccaccgccgccgtgggaagcaaggccagtggcatgtgcaccagtgccgggtgcagttcgtacaacagcatttccttcttcatcgcgcggcctcctgccctcgtcctccaagggtaggcaccccgaggacccatggcaggcacggctgcctgcccgccctcccagggcggggaatcgttcagcaggcgatttcgagcgagagggcgagctcgggctgggtgagcacctcgcagccgtcaggggtcaccaggatggtgtgctcgaactgcgcggacaggctgccgtcctccgtcaccaccgtccaaccatcggccagcatgcgaatgtccggccgtcccaggttcaccatgggctccacggtgaggaccatgcccgagcgaagcttgatgcccgagcctcgcttgccggtatggggaacggtgggcggcccatgcatctggtggccgatgccatgcccgccgaactcctccaccacgctacagccctccttcttcgccagttcctcgatggcagcgccgatgtcccccagccgcgcgccatggcgaacgacggcgatgcccgcgtcacggcaccggcgcgccacgtccacgatgcgacgagcgtcttcggacacctcgccaatgaggaaggtcgcggaggtgtccccgtggaagccgtccaggcacgtcgtcacgtccacgttgatgatgtccccacggaccagttgctcgccttcgttcgggatgccgtgacagacgatgtggttgcggctggtacagacggtggccgggtagcccttgaaccccagttggctgggcttgccaccccggcgcgccgtgtcctcgcgaacccactggtcgatgtccgccgtggtgacaccgggggtcagcttcgaggcaacgaaagccagcgtaccggcggcggcctgactcgctcggcgcagacgttcgacgtccgtgcccttgaacaagggaatgctcatggccggcaaggtgagggtccagggtgcctggcgtccaatgctgtttcggtatggccgacagcgctagagtggcggacgtgagccttacgcacatccagtccttcgtcgccgttgccgaggagtgcaacgtgggccgggccgcgcgccgcctgcacctgacgcagccgccgctcagccgtcacatccaggcgctcgaggacgaactcggagcgcgcctcttcgagcgaacccgggctggcatgcgcctgctccccgcgggcgaagccttcctgcggcacgcgcgtcgcatcctcgcggaagtggacgccgccgtgctcaccgtgcgggacgtagcgggcaaccgcgccggcggatgacgcagccgggcttggtgcgtgcgttcagcatcggacggacagtcgccaccttcggcggcgtcatccgcccgacgacctggaaccggggcgtcgggctgctagagcgagcatcgatgcccgacctcctcgtgactcatcggagtcctcacgtgcgccgcatccgggtgctcgcgcccctgctctgggccctcgcctcctccacggtgatggcggcgccggctcctgagacccaggaggttcccgacacgaacgggcagccgccgacggatgcgcccacgcgggagcggacgaaggcagaggacgctgggcggaccgtcgtcacgggctcgcggcgtccccggcccgcgagggacgtgcccgccaccaccacggtcctcccccgtccggaaatcgaccggagccccacgctgacgcaggactcgctggtccgcaccgtgccctccgccgccaccttccgccgcacgcccagcctcgtctccgacccgacggcgcagggactcaacctgcgcgggctcgcgccttcgggcgtggcgcgcagcctcgtgttgctcgacggcattcccgtcaacgacccgttcggtggctggattttctggcgctcgctgccacggctcgggctcgagcgcatcgaggtcgtccccagcggaggctccgccctctacggcagcggcgcgctcggcggcgtcgtacagctcgtgtcgcgcgacatcaccggaacgcagctcgacgcggatgccacctatggcaacgcgcatacgggcatgctcgcggcacgcggggcggagatgtgggggcccgtccgcgcctcgctggaggcagagctgctcgacagcgacggctactccatcgtcagtgccgcccagcgcggcgccatcgacgcggacacgcccagcagccacgccgtcctcaacgggcgcgtcgaagcggatgccaccgattcgctcaccctctccgcccgcgccggtctcttccgcgaggaccagaacggcggcacccggctcaccaccgcgcgcgtggagctggcgcacttcggcgcgggcgcacggctgcgcaccgcgcacggcggcacattcacgctggacctcttcggccgcgtgcaacgcttcgaacaggaccgcgcgcgcatcacccaggaccgctcctccgaggcgctggccgccagccaggatgtgcccgccaacgaccagggcgcgtccctcatctggaccggcccgtcctggacagccctgggcacgcacgtcctcaccgccggcctggatgtgcgccgcatggcgggcacgtcccgggagcagctcttcccgccctcgccctcggagacctcccttcgcctgcgcgacaccggaggcacccaactgtccggcggtgtcttcatcgaggacctctacacgccctcgcccgtcctggagctcagcgccgcgctccggatggacgtgtggcgcaaccagaacggtgagcagcgcctggagcgcgccaacggcgcggtggacacgacgcgcttcgacgaccgcaccgagcagcagctcagcccccgtctgggcctgagagtgcgtccgctggaggggctcaccctgcgcgcctccgcctaccgtgcgttccgcgcccccaccctcaacgagctgtaccgccccttccaggtgggcaccatcctcaccgccgccaacgcccacctgggcgcggagcgactgtggggcgccgaggccggcgtggaagccgagtcctcctcgctgggcctcaccacgcgcgtgacgggcttctggaacgtgctcgacgaccccatcaccaacgtcacgttggagcagccgcttccggatggctccacgcgccagcgggagaacctgggacaggcgcgggtgcgcggcgtggaggcgagcgtggactggaagctggcacgccagtggacggcgctgctcgcgtacaccttcgtggaccctgtcgtgacgcgctcgcccgggcagcccgggctggtgggcaagcagctcgcccaggacccacgacaccggggcaccgccatcctcaccttccacgaccccgacatcgtgacggccacggtgcagcttcgcgtgacgggcgcgcagttcgaggacgacctcaacgagcgccccatgggtggctacgccgtggtggacgtgtccgccagccgccgcctcttctggaagctgcacgtcttcggcgcggtggagaacctcttcgaccgcgagtacctcgcgggccgcgccggagtggacacgttgggcccgcccctgctggcgcgcatcggcctgcggctgcgcgacgcgccctgaggctcagcggatggtgcgcaccggccgcaccgggccgttgaaccaacggctcagcgacaccacgtcctccatgcggcgcgcgggcgggaggctgtcgaggaagacacggccatacgccttcgtcacgattcgccggtccagcatcgcgacgatgccccggtccgactgcgtgcggatgagccggccgaagccctgccgcagcgccagcgccgcgtgcgggagctggtactgctcgaagggctcctcgcctcgctgctggagctgattgatgcgcgcggccaccagcgggtctcctggcgacgcgaagggcagccggtcgatgatgaccaggctcagcgcgtcgcccggcacgtcgacgccctcccagaagctgtgcgccgcgaagaggacgctcggcgtctcgcggaaggcctccagcagttgctgcttggggcgctcgccttgcagcagcgactgatagggcaaacggggcgccaccagctcataggcccgcaccatgttgcgcagggacgtgaagagcacgaaggcgcgcccacccgtgacttcgcagaggcgttcaatctcctccgccgcctcctcgatgaagcccggcgcggacgggtccggcaggtgcgtgggcaggtacagcgccgcctgcgacgggtagtcgaaggggctgggcaccgccagcgtccgcacgcgcgtcaccggctggccgtcctcgccgtacaggcccatgcggttggcgaagaagtcgaagcggctgtcggccgccagcgtcgcggacgtgtacaccaccgtgtccagcgcgccgtacatccgctcgcgcagctccttcgccacgtcgatggggctggcgcgcaggaagaggcccttgccccgctgctccgcccagtagacgtggtccgaggactcggccttctccaggaaggagagctgctcctccatctcgtccgagcggcgggtgatggcggccagctccggttcgcgctcgcccaccgtgaaggcggacaacgcggccagcgcgtcccgcacgccctccagcggcgtggacagcttcgccatgacctccgcgcgcagcgccacggaggcctcgtggccggacagccccagcgcccggggcgcctgcgcgaagagcgcatccgcccccgcgcgcaaccgggccgccagcgcgcgcagcatggcgtggcgggcgtcgtcctccttcagcgacgccaccgcgtcccgcgccaactcctccagccggtagttggacacgctgcaaccgaagtggccgctggccgcgtcttccagcgcatgggcctcgtcgaagatgacggcctcgtaccagggcagcacgccctcggtgcgcttgccggagctgcgcagcgccaggtccgcgaagaagaggtggtgattgaccaccagcaggtccgcctgctccgcgcgcttgcgcatgcgcgtgacgaagcacgtctcgtactgcgggcacctggtgcccacgcacgtctcggacgtggtggacaggcgcgaccaggcgctgaaggactcgggcaggtccagctcgctgcggtcgccggctttagagcaca

SEQ ID NO: 1250 - DNA, 28194 bp, Myxococcus xanthus
tgcccgtcagctcgcccggcaccatgcccaggttgcagacgctggcggccagccggtaggcgtccaggcccgcgccctggatgaagacccagacgaagccgatggtgccgagcagcaggtatgtcacgacgggagtgcggagggtggggttgtcgtcgctgatgggaatcatgtgggggccccatcatgcgcgttcccctggccgggcgcggcggcggagggggcctggatgtgcggcgctggacgcatgggcacccatacggacggagcgggtgggatgcttgcccagggaaaccatccccggggagacttggctgcgggaagaaggttgagggatgttgagccgcctcacactcccgtggagtcctgagaaatgaacctgtcgatgctgtcgcgcggcgccgccgcgctcctcgtggtcgccgcgctgtccctcaccaccactggttgcgccggccgccgccgcgaagccttcctgctggagaaggcgcgcaaccacgtctaccgcaagcccgtggcggaggtgtatccgcaggcgctcgccctgctgaaggagaagggctactccttcaagacgggccagggcggcttcgaggccaccaccgagtggttgatgcagggcgccccgtcgtcgctgggcaccacccaggtgcgttacctggtgcgcggcatcgagaagggcccgggccagtcctcggtggagttcacccggcagctcgtcacgcagtccgcgggcgccgccaacacctccggccgcgcgcctgacgtctccgagcccgccgtacgcgccgacggcggcaacatcacccgggacgaggcgctggagtgggagctggtccagcgcgtggacgccgagtccgcgtcggccctgcgcgccgagtccgagaagattcagtagcctcagtcccggaggggtaattcgacggtgaacccgtcgaaggccacctccaccggcccctggtactcctcgcgcgcctgcgtgagcagtttcgaggggtcggtgtcgtgccggctggagaggtgggtgagcaccagccgccgtgctcccgcctctcgcgccacgcgcgccgcttcccgcgcggtggagtgccgggtctccacggcccgctcctgttcgtcgtcggagaaggtggactcgtggaccagcaggtccgcgtccttcgcggccttcaccagcgccgggcacgggcgcgtgtccccggagatgaccagccggcgccccgggcgtggcgcgccgagcacgtcctccggcttcaccgtccgcccgtcctccagcgtcaccggctcgccccgctggagctttccgaagctggggccctccggcacgcccagtgagcgcgccacgtccaggttgaagcgtccgggccggtcgtcctccaccagcgcgtagcccagggcgttgatgcggtggtccacgcccaccgcgtggaccgcgtagcccttgcgtggcaccacgtcaccgtccttcagttcgtgaatctccactgggaaggacatggactccacgcccaggtggacggcctggtggagcaggcgcttcgcggagggcgggccgtacaggtggatgggctcggagcgccccgtcatgcccagcgtgcgcaggaagccgatgatgcccaggtagtggtccgcgtggaaatgcgtgaagaacaccgcgtccacggtgaagccggtgccgtagcgcaccatctgccgctggctgccctcgccacagtcgaagagcagcaggtctgagtgcgccttcaccgcgagtccggacaggttccggtgcagcgtgggctgcgcggcggatgtaccaaggaacgtgagcctgaggagggacatgccggcacttcccacgcgttgaggacctcccgcgccaggcaaccgccgacgcgagggggccatttaccagggttggaggcacccatgctatgtggccgcccccgacctcggacttcaccatgcctgaatccctgaccttcgcgccgacttcggaccctcgccgcgtgcgcgcgccggatggccgcgtgctcaccgtgccggacggctgggccctgcttccccccggtgacgccggactcacccgccgcgtgaaggcggcggggccctcctggaccgtggcggagaaggtgggccgcaagctcttctcccggggcgtgtgggcgccggaagcgcacatcctccacgcccgcgccgccctcgaggccgagcgcgccacccccgcctacgagaagaagctggccgccggacgcgagcgccgcgcccgcgagcaggaggcctacgaggtcgacttcgccaacgccgtgctgcgcttcctcgccttctccccggcgtggcttccgcacgccaagcgcatggcggtgctcgtcgccgcccatgccacccccgtgggcagcggcaccgtggcccgcacggagcgcatccccctggagcgccgcgccgaggccgccgtcatcgcgtggatgcgacatcagaccacgagctacgacgacatgcgcatcgcccgggtgaagggcgcccggcgggaggtgcgccgggagctggcggacatctcccgcgccgtgctggacctgcaccgccgcgatgtcccccacgggccctccgcgtgcccgctgtgcaccgcgctgtcgcggacctgagcggcggaacgcacccacagtcgcagtccttggattactgacccggtgttcagaaaccttgcgtggttaatgaccggcgggttaggaatccggccagcatggcccgtcccgccgaccctcacgctcgcagtgcgctggtgtccgcggcccggcgggagttcgcgcgccgggggctgaagggggcgcgcatcgaggacatcaccgccgcgtgcgggctgtccaagggcgccttctacctgcacttcccgtccaaggaggcgctgttcggggaggtggtgggcgcgttcgagtccgggctgatggagatgaacgggcgtcgcatggcgcgcatggagggcttcttccagacgcacggcatcccgggagcgcaggaccgcatcgagcgcagcgatcgctacctgcggttcctccaactggagaaagagcacgacctggaggccctggattgggtgtgggagttccgggacgtgtccctggtcctcaccagcggcagccagggcacggagttcgaatccctgctgtggcgcgtgacggatgcccaggtggagcgcatctcccacgacttccggcggctgcaggaggctggcgccatggacccggagttggacgcgcgaatcttcgcctccatcatcgtcgggtccttcctgctgctctccacgcagatggcgcggctggatgagaagccggacctgaacgcgtgggcgaacacgctccagcggctgtgccaggagggcacccgtccggcgtcgcccgccccgtccaagcgtgttgcgcgccggccccgggccgccgccgagaaaccccgaaagaccccgaggaaacgctcgtgaaacccaacctgaagccgtccgctgtccgcgtgttcgccgcggcgggcatggccaccgccgtgctgtcgctgaccgcatgccagaaggcggatgcctcgtcgtcgccgcccgccaaggggtcggcgcaggaggtggtgcccacggtgaaggtcgtctccgcgcggacggtgcgggccgcgccgagcgagtcggtgacggggacgctgttccccgcgcagggattgatggtgggcttcgaggtgggaggccgcctgtcggtcgtccgggtgaagaaggggcagggggtgaagaagggtgacgtgctggcgcaactggacccggagatcgccgacgcgcaggtggcccaggccgaggccgcggtggccgccgcggaggccgcctccaccatggccgccgacgtggccgcccgcaacgagaagctccagcagcagggtggggtgagcgaggtggcccaccgcaccgccagcgccaatgcggcgcaggcgcaggcgcagtggatggccgccaaggcgcagctggctcaggcgcgcgcgtcccgccgccggcacgacctgcgggcgcccttcgacggcaccctcatcgacgcaccggagcagacgggcgcgacggtggcgccgggcacgccgctgttcaacctggagcgcctggacacgctactcttgaagacgacggtgtcggaggccctgcgctcgcagttggagcccggcgccaaggtgcgcgtggagtcggtgggcgcgcgcgtgtcctcggacgaggcggtggtgcgcaccatcctcccctccgcggaccccgccacgcgccgcatcccggtggagctggccgtccccaacgcggatggccgcttcgtggcgcacacgctggcgcgggcggtcctctcgctggggcaggtgcaggacgcccaggtgctgccgggcaccgcgttgtcggccctcaacggggaccatgtctgggtggtggcgtccggtcaggtgcgtcgcgtggacgtgcgggtgttggagcggcgcgagcagggcgaggtggtggtgctggcgtcctcgccgctcgactccgtcgttgaccaccccactccgggcctgtcgcagggcgcccgcgtctccgtgaagtagggagccctccccatgctgctcagcgacgtctccatccgcaggcccgtcttcaccgcgatgttgtcgctgtgcctcgtcgtgctcggcctcatgggcctgggccgcctgggcaccgacctctatccggacgtgtccttcccggtggtggtcatcaacaccgtctacaaaggcgcgggtccgggcgaaatcgaaacgcaggtcatcaagcccctcgaagacgccgtcgctggcatcagcggcgtggacaagattcactcctacagccgggagaacgtgggcatcgtggtggtgcagttcaagatgaccgccccgctggaccgcgcggtgcaggacgtgcgcgacaaggtcgccggcatcgtcagtcgcctgccccaggacgcggacgcgcccgtcatcggccgcgtggacctgggggccacgcccatcctcacctacgccgtctcggcggagctgccctcgcaggagctgcgccggctcatcgatgaccgcgtgaagcccgcgctcgcgcagttggaaggcgcccccgaggtgcgcgtcacggggggagacacgcgcgaggtgcaaatcgacatcgatttggacaaggcgcgcgcggcgggcgtgtccccgctgggcatcgcccagcgcgtggcgtcggagaaccttgacctgcccgcgggccggctccagctgggcgcctccgagatgacggtgcgctcgctggggcagttccagaacgtggatgaaatccgcgacctgccggtggcacgcagcgcgacgggcgcgcaggtgcggctgggcgaaatcgccagcgtgacggacggcgtggcggagcggcgcaccctggcgcgcctcaacgggcaggacgccgtcatcctggaaatcgtcaagcagccgggctccaacaccgtcgcggtgagcgaggcggtgcggcaggtgatggcgcagatgggctcggtggtggggcatggcttccaggccacgctgctcatcaaccagtcggacatcatccaggagaacgcgcacgaggtctgggtggcgctcatcttcggtggcgcgatggcggtgctcatcatcctcatcttcctgctggacgtgcgcggcaccttcatctcggcgctggcgctgcccacctccgtgctgggcaccttcttcgtgatgtacgtgctggactacacgctcaaccagatgacgctgctggccctctcgctggccatcggtctgctcatcgacgacgcggtggtggttcgcgaggcgattacccaccggctggagaagggcgaggacccggtgagcgccgcgtccaacggcaccaaggacgtgggcctggcggtgctcgccaccacgctggcgctggtggcggtgttcgtgccggtggccttcatgcccggcatcgtcggccagttcttccggcagttcggcatcaccatctccgtggcggtgctgatttccctgttcatctccttcacgctggacccgatgatgtcagcgcggctggcgaagcggcgcgtgccgggcgaggtccgccaggagaacgcggtggccgcggcgctgcgccgcttcctggacggcaccgagcgcgtctacgagtccatcctccgctgggtgctggcgcacaagtggacgacggtgggcctcacgctggtgctgctggtggtgtccttcggaggcgccagccgcctgggcatggagttcatgcccgcggaggaccgctcacagttcttcgtggacctgacgctgccggactcggccagcatccgggagacggaggcccgcaccgccgacgcggaggtgttgctgcgccagcttccggaggtgacggacgtctactccatcgtcggcaaggacggcgatgtgaacaagtcccgcatgcgcgtgctgacggtgggcaaggacgcgcgcaccaagggcatccaggtgctgaaggaggacgcgcgagcgctgctggagccagggctggtgggcacgcgggtgaacctgagcgacccgcccatcctggagggcatgggcgactactaccccatcatggtgcgcatcaccggaccggacctggcgcgcgtcaacgaggaggctgagcgcgtcgcgggcatcctccgcgagctgccgggcaccgcggacgtgcgcgtggagtccaacccgcccaagccggagatgcaggtgctcatcgaccgcgcgcgcgccagcgacgtggacctgcacgcgggcgcgctggccacgcagttgcggctggccattggtggtgacgtggtggcgaagttgcgcgagggcatcaccgagacggacatccgcgtgcgcctgtcggagaaggaccgcgccacgccggagcgcgtgcgccaactggaggtgtacacgcccagcggcctgcgcccgctgacggacgtggcccgggtggagatgaagaacggccccagcctcatcgagcatgagaaccgcgagcggcaaatcgccgtgtactcacagttgggcccgggcgcggcgctgggcgacatcgcccgggagctgaaggcgcgcgtggcggcccagccgctgccaccgggctacgcgctcatctacgacgggcagatgaagaacctggacgagcagaacgacgccttcggcgcggcgttcggtctggccttcgtcttcatctacatggtgctcgccagccagttcgagtcctacaagcacccgctcaccatcatggtgtcgttgccactggccctggtgggcgcgctgctgggactggtggtcacgggcttccacctgtccatgggtgccatgattggcatcatcctgctgatgggcctggtgacgaagaacgcgattctgctcatcgacggcgcgcttcagaacctgcgggaaggcgacacggtggacgaagcgctgctcaaggcgggcccgcgccggctgcggcccatcctgatgacgagcgcggccatggccatcgccatggtgcccacggcggtgggctcgggcacgggttcggagttccgcgcacccatggccatctccgtgattggtggcgtcatcacctccaccttcctcacgctgctggtggtgccggtggtgttcgccggcatggagcgcctgggcttcaagcgccgccttccgcgcgacgatgctgctgcgccgccgcaccaggtggagcccaagcccggtcaggcggcctgaggtccacaggctcggggggcgttcatcccccccgcgtacagcggcgccattgtatccaggatggcgcccatcagccgctggccgtcgggcgtgtccgggcagagtccaccccagacgagcgtgaggcgttcggccaccgggcggaagtacattcgcccgcgcatgcggaccggctcgtagctctcccggccgcccacgaggtagtcctcctctggcacgccgaacacggcgtagtacgtgaggtccggcgcctgcgcgtcctgcacccggtgcagtccgctggggatgatgcagcccacctccgccatgtgccacgggccttcacggccctggcgcacgtccagcacctcgaagcacatcttcgacgcggggcagcccagctccccggccgtgaggaagttgtagtcgagccgcggaatctccagcatctcgtccaggtccgggcggccgtcgcgggtgaatccccacgggctgccatcccgcttgtacgagcggatgccgtaggcgccgtagaagacgttgtaccaggggctgtgcgggttgaagtagttggagcaaccggcccgctccgggaagtctccgatggtgaaggccaccagcaggtccatcagccgcttggtgtcgaaggccatgaagggttcatgcgccaccgcgccaatcgaccctcggatggtgggcaccggtgtggcgataccggcctccgccaggaagttcttcttccccggcagcggcgtggctttcatggccaggatggcgagctctcgttgcagacccatggaattcctaccccctcgccgcacatcctagcggaggaagggtacactgctgaacatgccggagaagctcgtcttcgagcacaccttggagggtctcttcgtgcgaggactgggggcccgcgtcacccccgtgctccgcgagcggctgcgggaggtgggggtggacctggagcgcaagctgcagcccgcctacgcctttgaaacatggtgcttcgccgtgcgcgtggccgcgcgcgagctgcacccggacgtgcccgacgacgtgggctacgcgctgctgggtgagcgcctggtggacggctaccgggagacggtgctgggccgcgcggccttcggtgtgattcagctcctgggcccccgccggtgcgtgagccgggcccggcagatgttccgttccgggaacaactacacggagacacgcctggacgacgtgtcccccaccgaagtggacctgtggatgaacgaggccggggccatccgctacttcacgcaaggcgcgctacgcgcgggcctgcgcgccgtgggagcgccgcatgccgaggttcaggtgcgcgccttcaccgacgaaggcgtcacctaccggctcacgtggcgcaacggccacgaggcctgagcctgctgggattccatgggctggagccgtcctgctccagcctggaggtgtgtctcagcgcgccgcgtgctccaccgcgtcttccggcgtcgcgcccaggaagtagcgcgagcgcgccttggcgagctgcgagtgcgcttcctccagcgacacgcagtccaccgtgatgttgttgtccgccgccgccgccgaggccacccgcgccgtctgcagccgggcgatggtggaatccgagacgtgcgcgcacatgacgcagcccatctgccggccgtaggccaccacctctccgaagaggctggcggactccggctccagggtcctgagcccacgcatgtccgcgagcaccaggtgtcgtcctcctccgtaggagtctgtttcgtgacgataccggctcgcgaagtcccgcatctcgttcggcctgacgaacccactcaaccgcacggtgacggtacggcgattcttgtcattgatgacttcgaacatgcgtgcgccctcctcgcgaggcaaagattaacatgaagacaaacgaggttccatgcagccctccggggcaggttcatggctggaagagtgtgcaagcgtgtctggactgtctggcgccggtggaagtttccgcgcgctggcaccctcaggtggtggcggcgcaatcctccgccaggaggtgaagcccgtctgggaaaggctcaggcgcgctgactgctctgaccggtcacgacggcggagccgatgaggtgtgccagccgcagggcctcggggacgaggccgcggtccgtcacgcgcgccagcgcctccgccacccaggcgggctccgcgccctgcacctggaaggtgaagcctcccaattggtggatgggacccgcgcgcttcagcttcgcccagcgcgcgtccgcgcgaggcagacgccgcagcgcgcgctccaccgcgtccaggtccggtggccgccgcatcaccgccacgcacggccgcttcagccggctggccagcaggggcaggtccacgacgttgaagccgccgaacgcaatgccatccagcagcaccaggtggagctgcgggaggaacttcccgccttccagcagccggcacacctcccgcgtggcattccagccgtcgcggcgcacccgtccccagacgagcccttcgaagcgcgtgcctccacacaccacgcccgccaggggcacggcggcgccggggcggcgcgcgaaggggccgtcgtcgaagccgatgacacgcgggaagcggggcaggcgcatgggccacgcagcctctcagggggcgcccgcaaagagaaagcccggactcgccatccgcgaggccgggctttcatggcttcgccggaccgccgttcaggccgcgcgaacgttctgcgcctgcagacccttggggccccggcctacttcgaactccaccttctggccttcctgcagggtgcggaagccatccatgttgattgcgctgtgatggacgaacacgtcctcaccgccgccgtcctgcacgatgaacccaaagcccttcgcatcgttgaaccacttgacggtaccggttgccatgaatcgcgttctttcgttccaaagcggctggggtggccgcggatatcgccctctcagaaactgaagggccgtgctgcgaggcatagtctgcccggggcgggccaccgagtggaagcccccctggctgcccagccgccaggaattcgcgggtggacaggcttcctgccctcggtgcccgggcaggcgaggggctcatcgccgtgcgtcacgggccgcgtgcctaccgtagtggcgacttcacgacggcaagactggaaggagcgccatatggctgaaccgcagaccctgagcccgtccacccccagactcgtcccctcccaggtgcctcccaaagggcgcttccggcggggtgtgcgccgcgccatggaccggagcgccgccgctggcatcatctcccgtccgctcctggggcggctgccgttgcgccggtgggtgccccaggacctgcactcgctcatggactacaagggcgggacggcctcggtggtggcgggggtgttgtccggagatgccgtggcgaagtccgcgggcattgccctggggtccaccatcctcggtgtgtcattgttgacggactaccgcatcagcttgaccaagctcatccccatcgaagcgcatgaaatcgccgactatgcctttggcgccgcgtccatcctctcgcccttcgtgctgggctatgcgaagcgcagcccgctggccgcggccatccacgtggcggtgggcgtgacgaccgtgctcgcgtcgctggtgacggactaccggtgccagacgggcatgcacctgggcggcgagctggcgacggacccgggggcgattggcgcgtgagtgcccctgttcctccagcgcgcggcagcaccgtgcgcggcgcgctggaggcggcgctgacgtccgccccggagagcggcctcaccgcgaaggacctctccgccctggtgggcatctccgagaaggacgtggccgggcacctggagcacctggagaaatccctcaaggtccagggcgcccgcctggaggtgttacctgcctcatgcctggcgtgtggcttcaccttcaaggaccgcaggcgcttcacgcggcctggtgcctgcccccagtgtcgcgccactcgcatcgatccgccggccttccgcgtcatcggttgaaagcgcctggggcgccgtcccgggcgcggtggagatttcaccattcggttgacaatcgagcggtgattgcagaaatactcaaccaactggatgaatatcgggagtgcgtcatggcgtcgacagggaatgacaagggtgcgccggttgccacggcgatgatgatgattcgccgtcccgtggcggacgtcttcgcggccttcgtggaccccgcaatcaccacgaagttctggttcagccggggcagcgcgcggctccagcccggcggcacggcgcagtggttctgggacacctacggcgtgtcggccaccgtgaacgtgttggacttcgagcccggcgcccgcctgcgcatcgagtggggcgacccgggtgcgatgaccttcgtcgagtggaccttcacggcgctgtcgccggaccgcacgtttgtccgcgtcgtcgagtccggcttccggggtgacgacaaggccgtcgtggcgcgggcgctggacagcaccgggggattcaacctgctcctcgccggggccaaggcctggctggagcacggcatcgagctcgcgctcgttccggaccatgtccccgaggacgcgcggcacctcgtctgacgccgcggttccccccacccccacgcatgaccgaaggcgccatgaaacgaaactcgcacgcccgcctgttgtcctccgacaccgtccgtatcgaacgcctgctgcccggccccatcgagcgcgtgtgggcctttctcaccgaggcggagaagcgccggctgtggctcgcgggcggccccacggagacgaaggttggtggcaaggtggagctgctgttccgccacgccgagctgtcagaggaaggcggcgccccaccgtcgcgccatgcggacatggcacagggccacgtcaatatggggcgcgtgacggcgtgtgagccgccgcacctgtttgcctatacgtgggcggagaaccacggggacccgtcagaggtccgcttcgagctgaccgagcgcgaggacggcgtcctgctgaccgtcacccacgtgcgactcgatggccgggactccctgcgcagcgtggcgggcggctggcatacgcacctcgacctcctggtcgaccggctgaatggacagcgctcgccggacttctgggaagcctacgagcgcgtccacgccgaatacgtcacgcgcccgggctttgagtaacgcggttgccggcgctcccgcggtgcatccgggggcggcccttggaggaccgcacccggaggtccgtgtctacttcggcccttcggggacgaagcggcagtccgggtcgctgatggcgcacagctgattgcagcagccatccgcccggcagctgcagatgggctcctggatgatgggcctgcagctctgggatttgccgttgcaagtcacggtgccgccgttggcgctgttggccgaacaggcgaagcccgtgccggagcacgacttgatattcccgccctcgcactcgatctgcacgaaacagtcaccggtcagcgcggcctcctgcgtgcggaagtggtcctcggcggtgacgtcgttccctccctgggtctgctcctcggtgggcacgggcccgcaggaggtcagcatcaccagcgccatgacgaagattccagccatcgacttcatgagaacctctcttctgttgggggacaccgcgacaggaaatatgagaggaatttcctgtcgtcaatagtgacgctccgtgatgtttgggtgtcttttccgaccgattgagagggatttgtagccttttatgtctcgcccggtgcgtcaccaagcgtagtcctccggggcgggcttgtggcccgggaagatgtcatccaggcgtgacaatgttttcgcatcaagtgtgacaccggccgcgtggacggcggcatcgagctgggcggaggttcgcggtccgatgatgggcgcggtgacagcgggctggtgcagcagccacgccagcgcgacgtcaccgggctcatgcccgagctcgtcggcgagcgcctcgtagcgctcgatgcggtcgcggtgcttctggagggcttccttggcgcgtccttccagccggcgcttgccctcgcgctccttgcggagcacgccgcccagcagtccgccctggaggggagaccaggggaggatgcccacgccatggaactgcgcggagggcaacacctccagctccacggtgcgcgccatcaggttgtagagcgactgttcgctgaccagtccggtgaagttgcgccgtgccgccacggcctgggcctgggcgatgtgccagcccgcgaagttgctgctgccgacgtagagcaccttgccctgcgccacggccacctccatggcctgccagatctcctcccagggcgtggcgcggtcgatgtggtggaactgatagaggtcgacgtagtccgtgcgcagccgcttcaagctggcatccagcgcgcggcggatgttgagcgcggacagcttgccctcgttgggccagtcacccatgggcgcgtagagcttggtcgcgagcacggtgcgctcgcgccgccggtcgcccttggcgaaccagttgccgatgacctcctcggtgcggcccttgttctccccgaagccgtagacgttggcggtgtcgaagaagttgatgccgtggccgagcgcggaatccatgatggcgtgggactccggctcctcggccgtccaaccgaagttcatggtgcccaggcacagccggctgacggagagccccgagcggcccaattgcgtgtacttcatggcgactcctcgatggccggaggcaggctccctccaccgaggacggcccggccgttcaccgtcccgcgggtgccgtgcattcagggcatccgcggcgcatgggggccaggggtttgcggtgacgcccacgccaggtgtcggacagccaacccgggcgcgtgtcgaggtggcggtggtgaaacgaaaaagggccaccgccatgaaggcggtggcccttggggccggcggaagaccgtagggcttacgggtacagcgcgcgggcgccgctgcggtcgttgctggtcagcaccaggtcgcccgtctgggtaccgctgcactgcgggtagtgcatgacggagctggcgtcatacggcgtcagcgcgcgccaggcgttgtcctcgtagcagccggtgctggtgaggcgggtgtgctcgtggcggaagcccagcacgtgacccagctcgtggcgaagcacgccctccagcgtccagggcgagatgttctggaaggacgtggtcgagatgaggacgttggcactgcggcgggcgctgttggggaagaaggcgcgcgccaggtactgggacgtgttggtctggttcacgtcgaacacgacgttgttgttgcggttggtgcacttcgagtcttcagcgctgacgtggacgaacttgacgttggcggccgcctcccactccgccgcggcgctcttcatcgcgttgaccacgcgcgtgtagttgccgccgaacttggtgctcacgcagtacgtgaggttgagggcctggctggcgctccacttgatgtcgcgtccaccgctgtaatacacggccagcgcgccctgctgcgttccaatgccgccgacggactgctcgtagaactcgcgcagctccgactccgtcggcaggaagatgtcaccgtcgacgacgaagccgccggactcgggctcctgatacgcgccggcgcggaactcctcgaacgagacctgctgcgtatcctgcgtctcggactcaggggcgccgcacgcggagccaaggacggagatgcctgccagaagcgcaatggagcgaaacttagccatggtggaccctcggagcggattctcggaattgaaacaaaaagcgagaagaagaccccggccccgggaaaacggacacacaggtccacgcgaattctgaaacggggcttgagtctcactggaagtgagagtgtctgctctgactcagggtgaatcggcccgcatcgacggcgagcaccgggggcgggtaaccgaaaagaaatcccccgtgaaaaggcggtcgattcacggaggtttcgttcgaccacggaagcagggaggctcttctcccgctcacccgtgaggcacggacccatgaagtacctgctgatgatctacgagaacgagaaggccgccgaggcgatgtcggaggcggacgtccagcgcgtgatgggggagtacggcaccttcgaggtggccatccagcagagcgggcacttcatctcgggcgaggaactggagcccacgacggcggccaccacggtgcgcatccgagacggcaagcgactgacgaccgacggcccattcgcggagacgcgggagcaactgggcggcttctttctcgtggaggccagggacctcgacgaggcgattggcatcgcgtctcgcattcccagcgcgcgcagcggctccatcgaggtgcggccggtgcgggaattcgccaggccccaggactgacgccggctcccgcgcggcatgatggacacctcctccattctcgaacgggcgcaccgtgaggattacgggcgcatagtggccacgctcatccgcgtgctggacggcgacttcggcgcggcggaggaggtggtgcaggacgccttcgccgcggccttgaatcagtggccgcgcgagggtgtgccgcgcgagccggccggttggctgatgcgtgtcgcgcgcaacaaggcggtggaccgcatgcggcggtccgctcgcctggaggcgcgcgtgggcgagttggaggcggtggcgccatccgtggacgacgccgaatggcagacgttgccggacgactcgctgcggttgctcttcacctgctgtcaccccgccttgtcacccgaggcccaggtggcgctcgcgcttcgttgtctgtgtgggttgacgacggagcagatcgcccgcgccttcatcgtgtcgcccgccacgctggcccagcggctggtgcgcgcgcagcggaagatacgcaccgcgcgcatcccctacgtcatcccggagcccgaggcgctggcggagcgcaccgagggcgtgctgcacacgctctacctcgtcttctcggagggctacgcggccacggacgggccggcgttgctgcgagtggacctttgcgaagaggccctgcgcctggcccggctggcgcgctcgctgctcccaggcgacgcggaggtggcgtccctgcgggcgttgatgctgcttcaccactcccgccgccgggcacgcgtggcggcggatggcgggctggtgctgctggaccggcaggaccgttcgctctgggatggcgcgcagcgggacgaaggactggcggagctgggagccgcgctcgccatgggggctcgggggccgtacacggtgcaggcggccatcgcggcgctgcatgcccaggctccgcgcgccgaggacaccgactgggcgcagattgccgcgctgtatgcgcggctggtggtgctgacgccggggcccgtggtggcgctcaaccatgctgccgccgtggcgatggcccgcggccccgagcacggattgtccctggtggatgacctggaggcctccggacggctggcggactaccacctgctgccggccgcgcgcgcggacctgctccggcgtctggggcgcaaggacgaggccgcgagtgcctaccggcgggcactggcaatggtccgcaccgcgcccgagcggcgtttcctggaagcgcggcttctcgaactgctggcggagtgaaggcgcccacgctggcttctcggtgggagcgacagcgcctgagtcagtcctctgtcgatgacgaaggaggcacccgttcgatggtggcgagccaggcctgcgcgccctccgggtcggtctgctcgtagtgcgcctcctggatggacttcacgcgccagccttccccgaaggtcgcgttcagtgcctccggtggaacggcgcgcggtccgtcgcggaagtacagcgcatggtagtgcccgccgggccggagcacgctcgcgaggctggcggcgaacgcgggccggtctccaggctcgaagacgtggagcagggccgaatcaaggatggtgtcgaagcgccggcccagcgtggccagctccagggcgttgcccacacgcaggtccacgtcgagcccgcgcagagaggccgtctcgcgtgctcgcaggatggccggctccatcatgtccacgccgcacaccggcaggcccttggccgccagaaagagggcgttctccgcgaagccgcagcccacgtcgagcacctcgccggaaatcgcgccggcctcccacaactggacgaaggcctgttggggccgtccgatgtcccagggtgcgcccagcaggtatgccgagcggaagaactcgcgccggaccgctgccccttcatgctcccgccgcatgccgcacctcgccttcctgtgttgtgtgagagcgatgccgcggaatcagccagaccccgagcggctggagcgcgagcgccggccggggccgcaccacgcagcccggtgccagctccagccggaaccgccgtgccacgcacgcggtgatgagcaccgtctccatcatcgccagcgccgagccgatgcagaaccgggggccgccgccgaacgggaagtagacgtaccggtgcatgcgttgggcgtcctcggacagccagcggtctggacggaaggactcgggggcgtcgaagtagcgcgcgtcgcggtgggtgacccactggctcaccgccagcatcgttcccgctgggacgtggaacccgccgagctcacagtcgcgcagcgcctcccggctggtgatccacgccggtgagtacaggcgcatggcctccttcaccaccgcctccgtgtagcgcaggcgaggaaggtcctcggcgccagggagccggcccccgagcaccgtctccagctccgccaccagccgggcctcggcctccgggtgctgggccagcaggtaccaggcccacacgagcgcgtccgccgtcgtctcgtgcccggacatgatcatcgtcgccagctcatcgcgcagttgattctcggagagggggaccggagcggacagcagcagggcgagcaggtccgtgcgcgactccggttgctcccgatagcggcgcacgagcgtcgcgagcagcgtgttgagccggcccagggcgcggcgcaggcggaggttggtgggcgtgggcacccagatgggcggccgcagggggctgtcggtgtgccgcatgacagcgtccacggcgtcggccacgtggcgggcctcgtcgtcgatgggcgtgtggaagaggaatcggctgacgatgtcgagcgccagcgcggacacgtccgcgtgcacgtcccgcgcgtcgcccgggcgccacgtctggagcatcgtttcggtgagggccaccacggtgtcaccacacgcggccacgtgcttgcgatggaacgcgggctggacgaggcgccgcttgcgcagccagtcctcgccctcgctgttcatcatcgcttcgggaaagccgcctttgtgacgcttgccttggcccactccggcgagcttcacaaagttgccgtcgccgttgaccaggacgcgttcaatcaggtccgggtgattgaggaggaagttgcgcttccccaggcgcaccacgtcgccgtactccctggcgcagcgggtgaggaaccccagcgggtcctcggagaactccaccaggttgccagcaatgaagtggccctggggccccggcggaaggcgcacctgtgacatgaaagggtcctggaggggggaactaccgctggcgcaggtggagcgaaccatgcgctccacccacgtcgaccagctcttgagacccaaccgtcagggctcaatgcctgacggattttgactagtaatagatatacggggcggagagcttgtccgcgcgagcaaaccgcatcagcacagccaaagagtacagggccttcttcatggcgaactcctggtttgaggtggtggcgtcttgctgtctgctgacgtcatggccagcgcggtgaaatgtggcacagcctgagaaggcagtgcaagtgtctgtgattagtggaaaccccttgcatcccaggctggcgcgccgcgccatcaccggtagtgggtggcaatccagtcgccttcaatctgctgcacggagatgtccaactcgtagatggcgcgcaggacgtcggggcgcatgatgtcctccgggcggccctggaacgcgaccttgccgtcgcgcatggcgacgatgtggtcggagtagcaggaggcgaagttgatgtcgtgcagcaccagcacgaagctcttgcccagcgtgtccgcggcgtgccggagccgcttcatcatggacaccgcgtgtttcaggtccaggccgttgagcggctcgtccagcagcacgtggtccgtgtcctggcagagcaccatggccacgaaggcgcgctgacgctggccgccggacatctcatccaggaagcggtcggcgagcgcgctcagccccatgtgctcgatggcccgctccacgtgttcgcggtcctgcacggtggggcggcccttggtgtgcggatagcggccgaaggtcaccagctcacgcaccgtcagccgggcggagatgtggttgtcctgccggaggatggccagccgcttcgcgagcgtgtcccccggcgtggtggtgacgtccagcccgtccacccaaacgttgcccgatgacatgggcatcacccggctcatcatggacagcagggtcgacttgcccgcgccgttggggccgatgatggaggtgacgccgcccacgggcaggctcagggtgacgccatccaccaccagcgtttcaccgtagcgcttgctgacgttcttcgcctcgatcatctcgtggcctttctcatgagcatcgcgatgaacaccatcccgccgacgaactcgatgatgacccgtggattggtgtccaggcggaagacgcgctccagcatgaactgcccggcgatcagggcgatggcggcaataagcgcggcggcggggaggacaaacgcttgctggtacgtccgcatcaccgcgtaggcgatgttggccaccagcaaccccaggaacgtcacgggccccaccagcgcggtggacacggcgaccaggatggccaccagcgccagcacccatgacaccgtccgctggtagtccacgcccaggttgatggcggcctcccggcccagcaccaggacgtcacaggcgcgcagcagccgcaggcccagcacggagacccccagcgtcagcaccgcggagagcagcagcaggtcgtgctccgggtcgttgaagctggcgaagaagcggtcctgcaggaagatgaactcgttgggttcgatgacgcgctggacgaacgacgacaggctccggaacagcacgcccatcaccacgccagtgagcagtagcaggtggacgttgccccgggccatgccgaagagccagccgtgcagcatggcggagaaggccaccatgatgatgacctccgcgccgaacaggaaccgggggtccagccccgccacggtggtggagcccaggaagaacaccaggcacgtctggatgagcacgtacaggtagtcgaaccccatgatggcgggcgtcagcacgcggttgcccgtcaccgtctggaagagcaccgtggagacggcgacggcgtagcccaccagcaacgcggtggcgaccttcttcccgcggaagggcagcacgaagtcccacgggccgctcacgtcgacgagcatgaacagggccatgaaggccacggccacgcagcccagcacgagcaggggccgcagggggctgacgggcggggcgttagccggcacgggcgcctcgcttcagcaggaggtacaggaagagcacgctgccgatgacgccggcgatggtgcctccgggaatctcatacgggtggcgcaccacgcggcccacgatgtcgcagagcagcacgaaggccgcgccgctcaccgcgacccagggaatggacctgcgcgcgttgtcgcccatgaccatgctgaccaggttggggacaatcagtcccaggaacggaatcatgcccaccgtgacgaccaccatcgcggtgaccagggcgacgatgaccagccccagcgcgacgatgcgcgggtagttcagccccaggttggtggtgaacgtctcgcccatgccggccacggtgaagcggtccgcggcagtgtaggcggcgcaggtgaggcccagcgtcacccacagcagctcgtaacggccgcgaagcacggtggagaagtcacccgtggtccacgcgttgaccgtctgaagcaggtcgtaccggtaggcgaagaaggtcgtcgccgaatcgatgatgccgcccagaatcaggcccaccaccgggacgatgagggccgagcgcaggggaatgcgccgcagcaccagcaggaacagcgccgtccccgcgagggcgaagacggtggccaccatcatcttcccgagcaccggaaggccaggcgccagcagggtggcggtcagcaggcccaggctggcggactccgcggtgcccgctgtggtgggctccacgaagcggttgcgggcaatcatctgcatgatgaggcccgcgacgcccagggatgtgcccgccagcatgacggcgaacaggcgcggcagccggctgatgaccagcacctggagggcgcgctcatccggctcgggagcgaagagggcgcgccaggacacgtcactggcgccaatcaggaggctgaccaccgccaacgtgacgaggacggcggcggcggcgaacgcgcgcttcacggtggggagggactactgggcctgcgtgtaggcgctcgcgacctggtcgcggagctgcttgacggactggatgccgccgccggtcaggtaggtgacgccggggtccaggtagatgacctggttcttctgccaggccgtcgtctgccgcaccaattcattgtccagcacctgccgggcattgccttccttctgaccggtggcggcgtcccggtcgatgacgaacagccagtcgggattcttctcccggatgaactccgcgctgatggactcgccgtgcagcgaggtgcgcaggccctcgacggcctcgggcacgccgaagtcaccatggatgacgccaaagcgcgaacccgggccataggcgctcatgcgccctccggtgacgagcacgaccagccccttgccgcgtgtcgccgtcatctgttggaggtccgccaccgacttgcgcaggtcctcaatcaggccgcgcgccttctcctccttgccaaagacgctggctagcatctccgtgttggcaatcaccgaggcgatgaagtccttgccgctcatcggcacgtcgatggtgggcgcgatgcgggagaggttcgagtacttcgcgctggagcggcccccggtgatgatgaggtccggcttcgcggcctggagtgcctcgtagtcaggctcgaacagggtgcccatgcgcgggtacttcgcgtcccggaaccgggtcaggtgctgggggaacatgtcgcccgccacgccgtggacgtccacctccagggcctggaggatgtccagcgccaccaggtcgaacaccaccacccgccgcggcttcagcgggacgacggtggtgccttgtccgtgcgtcaccgtccggccctccggcgcggcagcctccgcggcgggagtggacgcggcggcgtccgggcgctggaacctcacgcccacccacaggacggccagcacgacgacgacggaaagcagggcgaagagcggaagggaacgcctgttggatggactcacggtagtcgttggaaagggtgattttgattctgcgaatcagtttcgcatcatagatgcttacgtccgcaccgtcaaagcctgggtgtttcttctgaagggagagacggctgcccttgagtctgtctcgctccagggcggtccttcgcgccgggcttcggccaccagaccggctgtttgaatccggccattgggccgcgcgctcacggacgtgagtctgttcgacttcttcgcggagcggctcggccgctgcgtgcattggcgcgctggtccgtcatggagatgaggagggcggggccgggcggatgtccgtgttcgcccgcgcatgcaggggcatgaagagcgcgcgggcgccgtccgcgagcactggcagggccaccgaaggctggaggacggcgcccagccccgcctggaggtgcaggagtcggttgaactgccggtgcacggcggcgtcccgggagctgcgctccatcatccgccggatgtaccagtgcagcactcccacgccgggcttccgctggccgacggccttcgggtactgcaggtcgatgttcgtgcccatgaaccagggcaggcggatggtgtcggacaggcgcttgcggaagcgctgggcgagtccgtcgagcgtcgtggggaagcgcctggcctgctcttcgatgcaggcgaggagctgcgccgcgccctgggccgccaccgacatgccttggccgaagacagggttgaaggcacacacggcgtcaccgaggatgatccagttctccgggaagcgcgcgaggcgttcatagtgccgccagcggctctccttcaccttgtgcagggtgagcggccccaacggccgggcctcccgcaggcaggcgtacaggtccggctggggcagtgagcgggcgaacgcgaggaagccttcgtcgtccgcgggcgcgtgctcgccgaagtacccattgagggtgacaatccagcggtccccctctacgcgggagatgaagccggcgcgccagttcacgggcggacacgggtactgcatgagcaccttccagtcctcctggcggtgcgcgggaggttcgtagaggcgggtggtgtacgcgaggtccacccgcacctgttcctcgtcgggacgtgcatggcccagggcctccagccactggggcgcacgcgagccccggcccgtggcatccaccaccagcgcggcctccagcggttcctccacgccggccttcttcaaccgcacgccggtgacgcgctggtgggaggcgtccgtgagcagcccttcgaccgagacgccgccgtgaaactcgacgttgggcagcgccagcacccggcgcagcacgtgccattccaggaagggacgcgtacacaccagcaggggaaggccttgggggacgcgcgacttccagacgccgaagtggtgccacgcgacgtcccggctcgaatcgatgagcgcggccccctggtcctggaggtcctggaggaggccggggaagaagcgctccaggaggcggtgacccgcgtccagcatcacgtggacgtgtgtgccctggggagcacctttgcgcgccgcgtgcatgccggggagcgagtccctctccaggatgacgactttctcgaagtggtccgcgagcgcgcgggcgctcagcagccccgccatgctgccgcccatgaccacggcacgtccaaagcgatgtccaggcacgtccacgtttcaggccccctgcgttccatccgacgtgcccgcttcagaagaaggcaaagccttctcccgaaaccagtcgccgtcagtggggacattccatggcgtgggtctgacgtgtgccgttggaatgcgcacgtgctgcccaggctggacgtcgactcaaagcagttcgcagccggggatgcagtaacgcacgttgatgagcgtgcgcgtgcccgtgatgttggactgacacgccgcgtactgggtcgcgggctggccgttctgacgcgtgtttccgcacttcgccgtacaggcctgcacgttctcgagccagtagatgaggtctccattggggcagtgcggcgggtagcccaggccctgctcgacgctgacgggggcctcaccttcggggacgtccaggttggcctctccgccaccgcaggcgatgagcgacaaggagagacacgcggtcagcgaggcgatgagacgggaggtcttcatggctcggctccttccaggagtggaatccagggatgatgcctcaacctcgtcattcgctgaaagcacgtgccgagtgctgccgcggaggacaaccgcacccgcacttcccatcgggaggtcggatttcctgaagtgacctgccctccagggcaatgggcgttcgccatcctgcttcccaccgtcccccggtttcggaccggagaggagtggtgcacatgcgcattggaagttggtgtgttctcgcggggctggggatgctgggctgtggtggtgtcgaggaggaagtgagcgccgccaccgaggaagcgcgggtccaggcacaagcctgtgctcccgggggcaccgtctacaaggtgaaggacatcctgcctccggacgcgccgctcccgtcccccaacgtgccggtgcccgactcgctgacgaacgtgcagggcacgctctacttcgggtcggacctctacggggaccgcgccaccctgtggcgcagtgatgggacctccgtgggcaccgtgcccgtgaaggagttcatcgcgccgggaccgggctaccggggactgagcgagttcacgccggtgggcgcccgcctcttcttcatggtgaatgcgtcgccatttggaagggagttgtgggtcagtgatgggacgggagcgggcacgcggctcgtcaaggacctcgagccggggacggccagttcctcgctgtcctacctgggacaggcaggggacgtgctgaccttcttccggaacccctccgcgggagccggggtgtcgctgtggcgctccgatgggacggaggcgggtacgttccagctcatggcctacggaccggaccaggaggtgtcgtcacggccactggaggtggcgggggcgcgcttgttcaccatgagcagcacgggggcgggcacctggctgtggcggacggatggaacggccgcgggaaccaggcgggtcaaacgtctggacgcggagcggatctatatctccggctgggagcacaccgagacgggcgtgggggtcttcaccttctgggactcgggggccatcaccgaggtctggaagacggacgggactccgggcggcaccgtgcgcctggagtccttcggtggcgatgtccggctgctgggggccctgggtgggcacgtctatctgtcgtccgtggtcgggggagggacatccttgagggtgtcgagggtgtcgctcgcgggcggtggcaaggagacggtgaccacgctgcccaaccgctacgcgggccagcccggcgcgtggcccttcgcgcagatggcggtgcgcgcgggcgggaagctctatctgtccgtgggcatcggcacgcccgggcccgcgcctcgtgaggtgagcctctgggtgacggatggcacggcggccgggacgcgggagctcagccggggcctgtcgacgtccgatgagtgggcctcgccgctcttcgacaccggcgccgggacgctgctcttcagcacgaatgagggcggcacgggtctggagccctgggtgacggacggcacgcccgagcggacaggtctcgtcgcggacctcagtcccctgggcggctcctcacccgaggacttcacccgcgtgggcagcaccgtgttcttccgcgcctactccaacgcctggggtgacgcgctgtgggccatgccgaccaacgtggcatgccccacccaggagctcctcgcgcgctgacgcgccgtgacggcgtgagacggtggatggcggcgtgcgtccgagcctgcctggagcaaggctcgacgcacgcggtcgtcgccggtgtcgggaaagtcccagttgtgacatgaaatgcaacaaccaggaatccagacatcgatgatggggatggctcttgtcaggaaatacgggaggatccaaacgagaatcctgtcgtttcgcgcctcgtcgtgctggtgcggaatggctgcattcacagatgggttgctgtggtttgaccggtagccgtgattggattatctcttcgtgcgctgctttttgtcgcagccatgaagcctgtcgtccatgctgatggtctgaaacggcagggcctcgctgagccgtgcgagaggcccgggtccggagccgctcctctcgtcgtcccgcagcccacctccacaaggaaggtcgcctgtgaacagtcccatcctgattctgggtttgctcgtggccagcgcagacccgagtcatgccgcgaactcctcgcgtgaaaggtcggccacggtgaactccgccagcaccagtgcctcgagggaccgtgtctccatgcaggccaatggtgcgagcctggtggtcgaactcaagacggtgcgtgacgtcagcgcggtggtcgtcaccgagtcgtctccggtggcgttctggcccttccagaagaacgacgtcatcgtgcgcatcaacacgaagcagatctcccgcccgtcggacatcctcttcgtctggcgcaccggagcgccctcgtccttcgagttcgagggcctccgaggcggaacgcgtctggtgttcactggcacggcggcggagtttccggtgctggccc

SEQ ID NO: 1251 - DNA, 26454 bp, Myxococcus xanthus
gtgctctaaagcatttgaagcaatggcactcacgcgccgactgcaagcaaggccgaaaggccttcgcgcattcatctgggcccttgcagccacgcgtagcggaagccagagggggaagaagacaccatgctgttggtagacgtgctggaggagcatctcgacgaggcggagttccggtggctgcagtgggagaaggcgctgggggcgccagacttctcactgactgagactgcgagacttgaggaacttctcctcgcgcatctggacgggctggtggttggcgcatccaccgctatcgaatccgtgttgcgccccgcatttgaaacagaggacgcctttcgcatctccgcggcgacctacgcgctgctcgccctcggtgaggtggatgaagtcctgctgcgactgcgcggggccgagcccttcgcgcgccccgctattcgacgggccctggcgctcagcgaggccccagggctgggcgcacgcctgctcgatttgttgaaacaggaagacaccgcgctgcaggcggaggtgctggaggcgctggtgttccgccaggaagcaccgcccgaggcgctgttgcgcttcttcacccacgacgagccacgggcccgggtaacagcccttcgtggcgcccttccctttccggacggcgcagcgcgaagcctgcttcccatgctgctggactcctcccaccccggcattcgagcggcggcaatggaggcaggagcggcctccggcgtgaagcaagcctgggagttgtgccgcaccgctgtgcgcgctcaggacgcacacagccttgaagccatggtgctgctcgccatgggcggcggtgtgcaagaactccccttcctcatggcgctgctggatgcggagaagctccgcccccaggccctctgggccctgggcttcagcggctgggtggcagccatggaggcgtgcctcgcctggctggaggtacccagcgttgcacaattggccggggaggccttcgccgccatgacgggtttgcggttggaggggccctacgccctgcctccaggcgagaggcccgaggacgtcccaccgccgccggaactcgaagaggacttggacgcagacttggtgcccaagcccgaagacgacttgccgtggccgaacgtgaccgccgtcaggggctggtgggccgcggagaagaagcgcttcgtgaaggacacgcggtacctcttgggccggcccttcagcggcagcggcttggtggaggcccttgaaaccagtcccatgcgccgccgccacgtcctggcccgcgaattggccctgcgtagccagggcacgctgacggtgcgcactcgggccttcacatacgtccagcgcgcggagcaggccaaagcccgggccgccagcgcccgaatccgcacgcagcccttcgacagcggcctgcgctgacaacaaccccctcgcttcgttgccaaccatgtgggcacttcagaataagacaccctacgcggccgagcggacgtgggtccgcgacaaggacggccaccaccactgggttgtcgccgtcaaggccaccttcgacgtcgacgacgcgggccgcctccgccctgccgacgagcaggagcctccactgcccgcgcccgtctactggggagaggcgggccactccagcttgcgcttcgaggccgagctcgtcgcccccaagccccacacagacgtcctcgtcaacgcgtgcgcccatgcgcccggtgaacggcccgcgcccagcgtcgaggtggccgtccgcatccacgacgtggacaaaatgctcgtggtgcacggggagcgctactacacgcgcggcctgacgggcgtgaagccctcgtcccccaagcccttcgtcacccagcccattctctacgagtgggcctggggcggcaccgacacgcacgacgccgacgcgcgcaagcacgtcagcgacatgcgaaaccctatcggccaaggggtggccagccgcgaggcgcgcctggtggaccagcccgcccaccgtatcgaatacctgcggggccacccggcgaagtccgggccggccgggtttggccccatcgccagctactggtcgccacggctcgagctggccggcaccttcgacgaagcctggaggaagacgcgacacccgctgctgccgcgaaacttcgatgagcgcttcgccctatgcgcccctgctgaccagcgtccctcacgccgcctcgtgggcggagagaaggtggccctggtgcacctcacgccgaagggctcgctccacttcacgttgccccgcctcagcttcggcttcgccacctacttcggcgccgtccgacgcttccacgaggccaccctgggcaccgttgtcatcgagcccgaggtgaagaaggtgcgcatggttctccagacgggattgagcgtcggcccccgggacgtcgaccgcctcgacttcacagccattacggaaaggacggactgacatgagcggtgaggcggtacttgtggcgtcgggagcacgtgctccggtggggacgacagcggagagcgtcgcggcggcggtgcgtgcgggcatcagccgcgtgcgactcctccaggtgccggagctggggcggcaggcggactccttcatcgcgagggacgggctcctggacgcgcaggagtggtgtggcgtgacgcgcatggccgcgctgggggccgcggcgttggacgaagtcctcgccaagctgacacccgccctcccgccgaggagtctcgacgttccggtgctggtgggccttcccgaggagcgcccgggctggagggcatcggacgcctcgcgagtcgcctccgccctctccgccctcggaagtgcgcgcctgaacctccaggtggagccgcggttgacgggccatgcctcggcgctggaggcgctacgagacgccgtgactcgggttggccacacctctcgctgcccactggtgattgtgggaggcatcgacagctaccacgacgtccagacgctggcctggcttcgcgagcggaaccagtggctggaagaagggacgcgcatgggcttcgcccccggcgaggccgcggccttcgtcgcggtgatggccacgccggacacacgtcggtggagactggctccccacgccacggtgcgcgccgccaccacggcccacgagacgaaactcatccacagcgacgacctcaacttgggcgaggggatgacggccgccgtggccgaggcactcgcgccactggaaggcacgcgtgaagtcgtggaggacgtccacagcgacctcaatggcgagcgctaccgcgccgaggagtggggcttcgtcgccctgcgccttggggccgcgttccgcgacgccgccgccgtccacacacctgtgagcagctgcggcgaggtgggtgccgccacaggggcgctgaacctcgtcatctgcgcgcaggcctggcagcgccggtacgcgagcggcccacgtgcgctactctggggcagttcggaagccgggttgcgcgccgccgcactgctggaagagccactttccggaagtgaagaaggagcgaaaccatggccaaggtaacagtcaacttcccgaggacgcccgtcaccaagggcagctcgggcatcgccgcagccacgctgcccaacgtctgcaagatgcccggcccgccggctcccttcgtgcccacgcccttgcccaacatcggcaacagcggtgacgcccccgagggctactggaagacagtcaccatcaacgggcaccccgtcgccatcgccggcgccagcttcggcagcaagggggacatggccagcaaggggacgggcggcgggctcatctcaagtaacactcatggccccacgaagttcatcggccccggctcgatgaacgtcaaaatcgaggggaggaatgtgcagttgctgggcgaccccatgctcaacaactgcggcccctctggcagcccggcgaatgccgccaccatgacgggcatcatccaggcatccggcgtgatgaccgtcatctacggcgacgacatcccgtgctcacgctgcgggaaggaacacccgctgggggcaggcgaagcgacacagaaggcgattgcaacgctgttcaagcggctccaagcggctctcgacaagcagaagcagcagattctcgagtacgccgagttggacaaagaggagtacacaaagaggtcggcgctcgcacagctgaagaagctcaacacaccggaacgacgaacggcagggaaaggcctaagaccagagcagagggcagaattagaaaggctgccgggcgaactcgcagccctgagggccaaactcgcccccctaagggacttcttcaagaacaaggctgtgcttcgctataccccaaacaccaactcatacaccaagggctacatgattggcgccatggtatgcacatgcgcgaccaagaagctcgtggcctgttcaggccatgcgccaccaggcttttggccggccgtaaaagccgcggagtttgagtgtgtaaattctcgcgtcggagcaggggcccgagaagagaaatggatgtgtgccgccaagcagatcatggagaaccacgggggacacaagcccaaacaccttgccgagcgactattttaccccatagtcgagggcatcaagctcgaaaggggtccgaagatcaaattcaagattcgagaagaagacataaacaccaagaagctctctgaacccaaggagcgcgagcaggtattcaagcatggcgaagatgtgccgtcgtgctcagagtgccaagaaaaactccctgccatgtactgcaagacaatctgcaaatagccaggagccccaatgaaaccctttgttgaatttgtcgaaaaataccgcccaggcttttctgagaaaatcactccggcggattgggtcgacatatcaatgctggaggaagacgcgggccctctcccaggggcctaccgtcgcttcctggagacaatgggagcgagcatgggcgaccttgagattgccgatgcccacttctccattcacagcactctcggcgtataccgcaccatgtcctggctgcaggacagccgctacatcttccttgcaggagacaacgggcttgcaagctggcattggttccttgatcgctcaagccctcacgggactgacgactgcttggtcgtcaatcgactattggacgagaactatcctccagagggtagtcaccctatgtacgtggggctggaggaattcctctactacgaagccttcaaggagcttcgcctgccacaactacccttccggcggaagttctcgtcaccggatgacgccgctgccgcagctcgctaccgggccgacgcggtgactgcgctggccgaggagaagggcttcaagcggctccctcctgtcgagcactgcgcgctgtacgagcgaggagacgcagcgctgctgctctaccgacatccgacgcagcccaccttctcgttcatcctgggctgcgaggactcggcggagatggagcgactggcccaggatttcgagacacgaacggggctgaagagcgtcatcacgcggtaggcaaatcctggatgtcttagccctcgtcgagaggtacgggacatgcccggcgccgaccaacgaggtcgtgacggacagcaaagtggtgagctcgcccgcgggccactgcaagagtgtgcaggagtaaggcatcctcaagcggtgcgctcctgcggctgtcacatcccgtgtgcaagtgcgtgcaccgctatcgactacgccgctgccctggggaatggtaatcctctcccagcgttgctttgtcgccgcgtccacagcggcgccgtcggcgcatccggtgcaacgcattttacatatgcctaaatcccatcgtcttcgcgaattgcagcctttccaccacccgaagcagggcctttctggcggcgctcttccagcgcagcttcttgagtccgagtttcgggcggccattcgagaggaggtcgccggccctgtcgctgcgctcgccgcagcgctaagtcgccttgcgcggcggttctccgagaagccgcagcccgtccgggccgtgcgcacggcgagccccgcgcaaccgacagaggcttcccagcccgtccgtgtgaaaccaacgccggccgccgcgcccatggcccgggcctgtgccgtcatcggctgcaagcgcccccaccgcagccagggctactgcgccgcccactaccagaagcggcgcctcatggtggccacgggccgcctgcatgctgcatgggtggaggacgccgcgccccacagcattcccgacgtcattctcccgcgcggacgcaggcccaaggctgacgccgcgcctcccgcgccgacgccgcccgtcagcgccacccctcgcatgtgggtgcgcaagaagggggcagcaggcgcggacggcacctccggccaaggtgcgccaacgcctgccgggcagccgcccctggcctcggagcgcgagcgcgccacggccaccgcccagcgctgggccagcgagttccgctcgcggacgcggcgcgcctgaaaccttcccgcccgacaggccccctcctatcccaggaggggcgccctttctcacgcggtagcgtcagtgccgtccatccggctcgacgggggccaggcgcccgtccctcgtgacgcgcaccacgtgggcgggtgcgaaggtgccagcccggccacacacgaatgcgtcgagtcgctggtccgtcgtccccaccaccaagtcccccgcttcatccagtgcgtatgccatcggcgcgcctgggagagtcacccaaggcgtggcacgccaccgcccctcggaggcgtcgacacgcaccagacgccctgccccgaaatacatgtgtgcgaggccctccacaaccacgagggcgtcgtgcatccgcacgactaccagggggttggcccggggctcctccagcaccgtcacccgcccggcttcatgcacttccagcgtgcccccaaactccccgtcgtcccatccgacgaggcacgcctcccccatagcttcgaggacggatgcggagtccccacccggcacggctgcgcagggactcccctgtgggggcgccttcggcttgtcccagtgcaactggacagaggtgtgtccctcattcagcgtccaccccccgctacgtccaggaataatgcgggcgcagtcgatggactccgcatgctgcacctcctgttcggcgaggccttgcatggccaacctcgcgtggctccgcgccaccggcgaggcgtgcgtcgtccccacccgctggagcagcggccccagctcctccgcatgctcccggaaggcgtagctgcccagcgcatcaaccgccgcggcctggacttcgctgtgcggcgcgtccaccgcctggcgcagcgcctcgaaggcggctgcgtctcccacgcgtccaagggcctctgcggcccgtgcgcgctcccagccctccttccccgtggccagcagccgcagcagcggctccgtcgcggctggccgcgccacgtcccccagggacacgaggctcgcaagggcccgggcgcggcattcaggcacggcgagctgctcaaggacgcccggcaccgcagcaggactcctgaaggccaccagcgcctgcagcgccacgggcgtgaggcgcacgtccgcccgctgtagcgcctgcagcgcctcgggctcgcccttcgccccttcgcgcgcgtgggccgccagcacggacgccacgtacgccgctcgtggggtgcatgcgtcgaaaaccgcctcgcagcctggcgcaggcgccgacgggcaggacgtcccgggtgggcgccgcagcgtggactcctccagctcccgcgcgaggagcgtccgcaggcgcgggacgaaggtctccgtgtgcatggaggctcgccgggagaggacgtggcgcaccagcaccagcgcctcccagctcgactccgggttctccagcgcgtcaaacagcaccggggccaatgtcgggccgaggtgctccagcgccgacgtgggcgactccaggaggtggcgcacaatggctggcgctgctctctcgtcatcaagtgaggagagcgcgtgcagggccagcccaccgggctcccgctcatacgcctcaatgagcgcaggtaaggcgcccgtggccttctcccccatattcgccagcgcctgcgctgcaccgccgcgcacgcgacgctctgggtgccgaagcagcggaatcagccgagggacgacgccctctccctcgcgccccagtttccaggccgcacacgcctgctccggcggcagccacttctcccctgtgtcgggcccgtggagctcctgcagcagcgcaaggcacgcgtcagccccctggcagcaaccctcccacgtcctggagtcttcccgcttccacggccgggaacaccccagtgccagcaccaccgccacgcacacgagcccggtcagccagcggggacgcccagacttcaactctctctccatgtcatcgcctctcattcccccttcactgggaagggactccgaaacaaacgcttcagccagtcacgagccgcgcggcgaacgagcgcggcgaacgaggggctttcacgacgcgggtgccggccagccagtcgtgaagacaccgtcggtcctctccaacgatgaagagggcgtccacgaggctgaaccagccgcagtagccgcagagcgcaatcgggagcgcgttcctcaaaagggcaatgcgccagacttccgccggccgcccgtcccttctgacgacgcggattcccaggagccgcttgccgagactcgcccccgcgcctcgaatcaggctggcctgcacaagcaacacgaggagcgccgggacatagacggcaggagccgtcatcgccgcctcgtccggaagggccaggcaccggaggacacccaggagcagggacgggagcaggagcgccacaccatcgacgaggcttgccgcaagccgggccctgcgcgtcgccagctccggagccgcatgaaggcaccggaagcacaggcccccactggacgaggcacagaaggcacagatgaaggtgccgcaacgaatacaggccagggcggcggagaagccaggatgcttggagcatggggacttcgaaatcgactcaagggcctcgcggaagtcggacatggagggccgcagcacagctaggcccgccccaaggcagcaagttccttcggctagaaaatccggcctgcacccacaaatgcaacccaacaggtttattctactcgacccttccggcagccctcttgccacccactggttgcctcgacacctgaatccgctgcctgggagggcgtcccgctcaagaaacgagcccttggagcgcaccactccagggcggctccaccgaggaggaatcccgcatctggcggatggggtggccaacctcggtcacgactgcttgcgtgcgtcaaggagagtaagcgaggcgtacacgggggcatcgctctgcgtggaatagccgaagcggagtcggaaacaccgagggcgctgcacaactttgaggttcgagctccgggcctccgcccgctcgaacatccgaggcttcgaggaggtggtggaggcgagcgccaagccgcattggacatctgccggggccggccgctcgtcttaatctgccggcacggggcgccggctcgccgtcctcgcagcggaggagggcagccccggcccacgcgacacgtctctcgtaatcaatggtcctaaccgtccaggcacgtcacgccgagcagaccgtcgttggacggagccgcgcagcgtgtgcgaaaacagccgcatgttcgagttaaacgatgcacttgagcgcctgcacctgccgcccgcccgaacccttgtgctgaggaatgccgtctccgaactcggcgaggcgatctactggattgcagacgaacgtccggaactcttctgcgcctatcagcacactcaagggccgcagctcgccgtcgccatgcagcgcgcgcagtacatcgtctcctgcattgggcatgcgccggaccgagccgtcttcgtcggtgtctacgaaatcatgggcggccggctgatcgatgcggctcagttcaacgcccttccggagcatcaagaactcgcccgaaacggctacggaatgctcgccgaccccgacactacttgggccttcgacctgcaggcgcgtcccttcatggaggcgtggaaggggaagctggtgttcggttggcccggcggcacacgcagttggtggcgtcacgccagccggaatcgctttccgattgaagcgctggtcgaggagagcatcatcaagcgaagacttccgccctggcaggagctggtgctgacgtgggcgcagcttgctctgctccccacgtcctggcaaatcccactgtcgcagtggcgcgggatttacttcattcacgacgaacgcaggcgcctgggctacgtgggctccgcggccggggcggagaacttgctcggccgctggcttgactacgccaccagcggccatggcggaaacaaactgctccggcaatcacgaccggccgacctccgattcagcgtgctcgagcgcacttcgcccgacatagcggtgcgggaggtggttctcctcgagcagacgtggaagcgccggctgcacacgcgcacaccctgcggcctgaacgagaactgagccggacgtttacctaagccggttcggaatcgaaggcctgagcgacgagcggaggcgtggagttgcttggatctcgtggcgatcccgctgtcactacccaaaactcggtcgctgcgtcacgggtgcgccaagccggttcggcagcgcgtcgaaaccagtgagcgaggcgtgcgcggtcgtcgctctgcctgagccggcgatgccgagggccagaagctccagggtgctgtgcgaccttcctattcgggcacctcgcctcctcggcaacgaagacaaggtcgagttcgagacagccaataattcccgagttggccatccctacgcgattcgccggcccatgccatctgactattcgcgccgcctcctcgtcctgcggtgctaccgaacacgggagacgtagtccttaatgcagttttccacggccgctgcctcttcatacctgcggcggtcctttagttccctatagcgcgccaacagcatgacgacgaggattcggtggattacgtcgcgcccagtcccgtcgacaaatttaagcacaaccaatcttgggcaatatctgtatgcgttctgatgccgactcgacggttcaagacagtgcatacacttagggtcggatggcatctctcccatgatagtcgctgccaaccacgagcgccacaacgtctaatgtgcacgtcccttcctttgctttcgctcccggccttctccttcgtcgcgacgccttcccccggccgcacgcttccatgcggcgcgggaagtacagcgcgcacaatggaggctcaagatcgcctcgggaagccgtcttggccggccgcgcacaccaagagggacggcgcgaggacacacaataaaccgagaggttggttcagctcacgcaaccaccttgcggtccgccttcgtggaacccgagtcctcgatcacttccaatcgcgggagtgcattgacgagcctgaccgtctcaaggctgacagtgattatgcgtagcaggagcgacagcgaatagcgcgggtctcggactgtctcagccgcccaggcgttcgcgtccttcacgatgccgctcgcgtcgtcggtctttacacactgtcgctccacaacccactcgatcgccgatttgccgtttacgacatactcgtaggcctcgagtgggatgtcgcgaacggtgatgtggtcgttatagtggatgacgctcttatccttaccgttgccgaatctcattttctcgacgcggtaactcgctccgaaaggcttggcgggaccttcgacacgagctggatactcgccgacttgctcgaacccgacatggagatcgccgagcgtgcggccggcgcgactgaatgcccagaagtcctcagccctcttcacgcgcgggatccgagggagctccttaccaagattatctgcgaagcgctcgcggtaatcggcggagtggagcattccgtatacgtagtagaaaatgtcctccttcgtgatggtctctccagggtaggcgtcccggaagtgagcgaggcctacgtcggtgatgccgtcacggcgcccaaggctggcgggcaccttcttcgcagtagcaaagagctggccctgcgactcgtcagctccatccgcgctgttccccccatcgtagaggtagagagggaagcattgcgctccgccgtcgatctgaaactcggagacgacgtccagcatcaacgcaagatgtcccgtgccggaccagcgctgcttgaccatgataacccgattctcggcgctcgcgtgcgggaatagccggggcatctggtagaccatctcgttcagcttgcggtcaaaatagagccactgcttcgtgaaggggcggtagatgctcggcacaattcgccttgcgtcgaactccaaggcgattcctttggccagctcattcttcagggcccggctccaactgatgttgctcggatccgtattgatgaagtcttcgattcgtgcctcgcgccccctcttatcgagctgctggtgcgccttgttgaagcgagtgagttcagcgttatagaactcaatcaaccgcaccatgttctcggcgatgccgcgcctggacgcattaaaggcccaggcgtcccgtgctgtgacgacgccaagcgaaaagttttcgaacagtcgtggcgacgactctttcctgtccttcactccaagagcgatatatttatcaaagctctcatcgcgttgcctaagccagtcaccatgggcatcgggggtgatgcgggtccagccgttcgcctcgttgattccgacgatactgccgaagttcgcaatagcttggagtttctggtcgcgagaaaggtagtcgccgacgtcgtaaaattggatgctgccgtgctccttggcgtccgggttcttcaccagaaatgagattgcaactggtgcgcggctgcccatgtcaaagacatttccaccttccattcggcggcgctcgccggacgaacgtgcgttcccgcgcagatggaagatgtagatgctgctgaattcttctttcaaagaccgacgcagtccgtctgtggtgttcgattcgacgaaacccgccccggtgacgaagccgacgattccacggttgccaacacggtcgctcgcccaccggatggctcggatgtagctgttgtagttattcttcgcgagctttgcatcggagcgcgccacataggttgcggcgattcgtgcgtcgagaagtggataggcgaggttggcgttgttgtcgttctcgctctcttggccctctgagtatgggggattcccgacgaccacccggatatctagcttcttctgcctccttcggcgcgcgctgttgtcgaccagcacgcgcgagatgaggtcgtccttctcgtagagttggaaggtgtcagttaggcaaatgccctcgaaaggcacgtacatcccgcctacgagtccgtggtaggccgcttcgatgttgatcgccgcgatgtagtacgcgagcagggcgatctcgtttgcgtgaatctccttggcgtacttgcgcggcagatcttcctccgcaatcagcccgctctggagcagacgcgtgatgaacgtgccggtaccggtaaacgggtcgattacatgcactccctcgctaccaagcgtttggccgaactcggcgcgtaggagatggtcgacgctcttcaggatgaagtcgacgatttcgaccggcgtgtacacgatgccaaggcgctcggacatcttcgggaacgcgttgcggaagaacttgtcgtagagttcgacgacgatcttctgcttgccttgggcgctctcgacgccctcggcacgcatcttcaccgaggcatagaacttctccaaggtgctcgcttccttgtcgaggcgatgctcctggagtgcatcgaggactccctgcattgcgcgcgacatcgagttctcggcagcgaagctgtggcctgagaagagcgcctcgaaaaccggcctcgtcacgaggtgctgcgcaagcatttcgatgatttcgtcccgggtgatgctgtcgttcaggtcgtcgcgcagttcctctgcgagccgatcgaaggcctcccgctcacgcgtgttcctcgactcatcgaggatgccggtgattcggtcgatgtgtgtgcgggcaatcttggcgatgtccttcgcccagtcctcccagtggtggcggttgccaaccttctggacgagcttcgcgtagatggcgtgttcgatctcaccaatctcgaactccatctcctgctgctcgggcttcgggctgaggttctggggagcaccaatcgtattcccgcccctcgcggttctcttcgcagcctccttcttgccttcggccgacctagtgcgcttcgtaatcttgtcggtaactgcaatgacctccatcttcgtgaggtccttcgcctcaagctcgagcttgttgaccatcgcatcgaagcgatcgtcgtgcgaccgcagagcctgaagcacctgccagacgaccttgtacgtctgattgtcgttcagcgcatcgtggggctcgactcccgcagggatgacaacggggaggacgatgtaccctcgtttcttactgctgtcggccggcttccgcatcacgcgcccgaccgactgcacgacgtcaacctgcgatttgcgaggcgtgagaaagagaactgcgtcaagagcgggtacatcgacgccttcggacaagcaacgcacgttgctcaggatgcggcaggtatcctcgggcgtctccgccttcagccagctaatcttcgcctccttctccgaggcgttcatgctgccgtctacgtgctcggcttggcaccgcagtgccgcggacgttgcggcgttgccgtctgctggctcgctctgctggtaggcttcgaccacagcctggaacatgtcggcgatgttcttcgagccgaccttgtggaccttcgctcccgtcgggcgctcaatgacttggcaaaacgcaaccgcccgcttcatcggagcatggtcgtccgtgattccttcctggagtccctgctttgagagcgccttccagcaacccacgattttcgctgcgtcgtcgacacgcagctcgttgttcgcatccttcagcaggctctggatgcggcggctgacgtgggactcctcgattgcaaggacaatgaccttgtagtcgacgagcagtccgcgcttgaccgcctccgagaacgtgaggacgtgcagagccggcccgtacaggcgctcgtcatccatcgagcagagcgcaacgttgtcccgctcggccgtggctttcgccgcgtcaccgaaaatccgcggcgtcgccgtcatgtagaggcgcttcttgccgcggatgtaatccccatcgtgcacccggacgaagtggctctcctcctccccatcgaacctcgcgccggtggtgcggtgcgcctcgtcgcagatgatgaggtcgaactccgggagcccctgcttcttctgcgcctggtgaattacttcgacggagtggtaggtcgcgtacacgacgctcatgtgctcggcgtcgtggcgcttcttcatcgctgccgccagtcgcgctgcgttggtcgtcgcagggtactgaagttcatggacgaaggtctggacggtgtcatcgtccttcttgcgccgcttgcccacatccgaatcggagcagaccgcaaagctctgaatgcgcgcctcgctctcttgcgtccattcggtgagggtttgcgagagaagtgcgaggctcggaacgaggaacaaaacacgcttgccctcccccgcgaggtgctcggcaatcttgaggcttgtgaaagtttttccggtgccgcaagccatgatgagcttgcctcgctcggacgcgttcagcccttcgaggaccgccttcaatgcggtcttttggtgcggaaggggcgtctttttcttcctgaggacgggcgccttccgcggcgcgaagcgggaccagtcgatggcgctcttctcgagcgccgcgaggtcaatctttgtgacaggggtattctggtctcgaagcgcctcctccgcgtgttcgctccagaggtccgtcgtgcttacgatgatgcggtgggtgaacggcttcttgccggaggccgtgaagaagctgtcgatgtcacccttctgcacgcggtagtcgggcgcgtacagcttgcattggatggcgtggatctcgtcggagaaggactccgccacgaggtcgatgccggcatcccgcttgtcgaggctgtggcgctcggcccatgccgcatatggctcgacgcttcggtacagctctcggtacgcgggctcgttctttaggaaggcgacggttagctcttcgaagtacgtgccctgctcgcgattcgtcgcggcagtggtccgaaagtgctcaagaaggtccaggagagcgctcacttacatttccccacagccaattgttctccgcgtacacatcgccgcgggctgcaggagaatcaggccaagtggccacctgtgtccagcttgcccgcgtatcagaagcaccgaacgcagaggccgtccgcgcgcgctccccgcgatgcctgcgctcatcgatctggccgccgtctcgtgccagccgcgggctgccccgggcacggatcacacaactcctcgacctgcccgtacgcacgtccgacgtgtaaacacgcatcctggagttgttggcgaacgacgggcggatgactctgaaggcgcgccagttcctggtcgtgctcgccgccgggatgtggccgcgcagcgggcggcatgggcgatgctctgcgacgcaaggctcccgaagcgccgctccaagaaggcgcaggacggagggacaacctcgtttctacgagcttgaccgaccctgcccacctgatagtggaccttggcaactacccggatcttgatagattttcagcgcatgcgcgccgcgacgcagcttcagcttcccgaggccagagggtcggtcgacgccgtcgcggctcgcatcggggtccccaaggttcccctgttccgatggttcgatgcgaagaggctccctgcacatcggggagggaagctctggaagttcaagctctcggaggttgacgactgggtgcgcgctggtggagctagcaaagcgcgtacgcgggccatgccagtgcggcgaacgacgacaacaaggaagaagacgaaatgaccgccacgaacacactcaccgcctcgcgcacaacgccgatgctgttctcgcgacagcgtcagctcctgcagctcctcgacgccctcggtgggacggctggcaagctcgacttccagaagctcctgttcctctactgccaggagcagccgacgaacgcaccctacgacttcgtgccctacaagttcggtgcgttctcgttcacgtcgtacgcggactgccgcaagctggtcgcacacggcctcatcgaggacgacgatggatggcggcttaccgacgcaggcaggaaggttatcgggcgcactcccgaccttcaactctccgctttcgcgcgcagtcatcggctacgcggcgacgagttggtcgtcgacacgtaccggcgctacccgttctttgcgacgcgcagcgagatcgctgagcgtgtgctcaagggcgacgaagctgcgctcgctcgcatcgaggtggtccgcgcggcgcgctcaaactccgcgctgcatacgatcggctacgagggccactcagtcgagagctacttgaatgagctgctccagaacggcatcacgatcctctgcgacgtgcgtcgcaaccccatcagtcggaagtacgggttctcgaagaacacgctcgcacgcatctgcgagaacgtcggaatccgctacgagcaccttcctgagctcgggattgcatcggagcagcgccaggggctcgacactcaggcagactacgacgcattgtttgatgactacgagcgtacatggctccccaagcaaggcaccgttcttgagaagatccgcacgtgggtaggcgagaaggagcgcgtagctctcacctgctacgagcacgctccgaaccagtgccaccgccactgcgtggccgaagcgctcgaagacaagttcggcaaggattacaacgccaagcatttgtgagagggcggggccaaaatggaaaagcagcgcgttctcattaccgtcaagacgtaccccacgctctctcggaagtacggcgagacggtgtgcacggcaggcgtccgcaaggatggcacttgggtgcgcatctatccggttcccttccgccgccttgatgagaaggagcagtacagcaaattcgactgggtcgagtgccgccttcagcgaaataccgtcgacgtgcggcccgagacctaccggcccgtggatcagcacgagctcgtgcccgtcggcgagatggacacgagccacaactggagtgagcgtcgggacctcctgctcaaaaagtcccgcgtctacgacaacctcaaggaactgatcgccggcgcgaaggcgaaccagatttctctcgccgtgttcaagcccgcgcgcatccacgactttatcgtcgaagaggacgagcgcgactgggatatcaacaaggtgcgcgagatgcgcgaggcatcgaggcagcacgaactcttcgaagacaacacctggcgcgagaccttcagagtgatcccgaagttgccctacaagttctcgtaccggttcgaggacgcttcggggaaaaagagcgagcagcagatcctcgattgggagatcggcgcactctactggaactgcctcaatcgcgcgaacggcgacgagcgcaccgcaatcgccaaggttcgccagaagtacatggacgaattcctcaagaaggacctccatctattcctcggcaccacgcagcagtggcaccaagtggctccgaatccgtgggttatcatcggcgtcctgccgataccccacgaaaagcagctcggccttttctgaggctccaaaacctagtgcgcctaccccatactcgctcgccgcgtcatgcgcgcgccaaggccccttcaggcagtgcgtcaaggcaggtgagcgaggcgcgcgggattcgcgcgttcctgctcggcgaggcgctccgaaatctccgtcaggctcatggccacgccaggtcgatgtgaagaagcgggtccgcgggcatctccaccttcgaggcacgagccgcccggaaggcctcgcccaacacgccgatgctcgaggccgcgcgcgcctggtcgtccaacaagtagcggctctccgtctccgcacgcaggtggttcagcacttagccggcgagcatcggcatctgctcctcgacgttgaagcgtggcagcttcgcgcagcgcgccagtagcgtgctgaggagtatctgttcgccatgccccgtgtggatgaggagagggagacgcctgccaatccgggtgaccatgcacgagaagccctcgccaacaggtgaccacaccgggcctgagcacccgcatcaggcagctcattctactttgcttcagcgaccgcgcggttggttgcgccgcgcggtcgctcccctcaagtcaagggcctcgggaatctcccccaaggccctctcagcttctaccgactagcttcccttcgtcagcaggctccgccagatgtcccttacaacgagaccaacgaggaccccgagcaggaatgcggagttttccatggctcgttccccctggcttgatctccccagccttctttgcctccttctgcgccgcgtcgtcatccatgaggcggtggagagcagccagcagtccgtcgaagtggtacctgttcgggccaccgaacggactgggctcccgccgcatgtcgccgagatcctcaaggccgcgtatattggttcgccgaactttcacgtccaaccagggagcggaaatgaagtggattgcgatcacggcggcggtgctcgccatggcggcgtgtggtggcggtgatggtgctgagagcgagccccggcagtgctacgagctggttctgaattcgaaggagcggggcaccgtatgcaacaccaatacggattacgagttggcctgtctgaggaagcaatatggtgttacgtgcgacaactacagggggagcgactaccaatgcgtgtacgttcggggccaaagagtcggcgtccagtttcggactagctgcattcctgggcagtgctacatctacgcactggacaatccgacgtgctgcgacgcgaccaatcccggcggcgtggagtcctggtactgccagtagactgctgccgcggacggggcagtcgccgccgcagctggcgctggcgctctgaccgaccgcgcgttcggcgcgggcggaggtggtgccgaagcgctcttccaggtcctggagcacgggccctgtcgtgcgcggcacctgctcatccaccccgaggacggtggcgtggagggcaccatcctcttccgtcaccttgacataggcgtcccgggcacgccgggcactcgcgacgctccgcacgcggtacagccccggcgccgacacccgcaccgtggccgtgccgctgccctggcggttgaggtccgccgtcccatgcaaccaccgcacgcgccactcagcgcctgcaggctagagctcagcaaccccaccctgacgcgccgatgcggacgctgccgcacaggcagccgccggtgaagcgctcgggtccctccacgctcatcccgctttgcgacggaagtggagcgcctgcacgccggacttgaaccgctgcgtcgagaggagctcgagatgccgcgcactcgacaggccatgaaacaacgtcggcccgctgccactgatgatgggatgaacgacgatgcggtactcgtcgatgagccccaactcctcgagcgcagccgcgagcttgggcgctccgacgaggacaccccgctcggtcttcgctttcagcgccgagatcgcctcacgaaggtcaccctccaccttgatcgtgttctgccacggaaagtcgctccgcgagcccgacacgacgtacttcgccttcgcctcgagcttctgtgcccactcgcgcatcgcgcgcggcgccttttcgtcgcgtgccaccgcgggccaggcgccctccatcagctcgtaggtgttgcgcccgaagagcatcgccccgctctgctccatgagttgcctccaatagtcgtgcagctcgtcgtccacgatcccctgggtgtgatcgatgcacccgtccaaagtcacattgagaccgaaggtgaggaggcccatggcgtgcgattctacgaaaagcgcgcccagcgcgcagaaacctgacctgcccctcgccccactccaagccccttcgtccggtggcagtagcggtggcagcgccggaccgagccagtccccggcagctaggcgcggctggcccaacgccacccgcagcggccgtggacgcgggccaggtcggccgcctgggcagagcttcgtcccttcacctgcgcgcgcgtcgaagcatgcgactttcacccacctcagcgcgtcgcccgcgagcccacgagcgtcgccgccacgcactccttgtgaagcgaatgccgaaaggatcaagaccatggacgggggggtcacccaccgtgtagtttgcggacattcaatcggtccccgattgaagggggccccaagccccctctttgaaaccgctggatatcactcggtttttcggccctcagagagtttgagccctctcagagaatcgccgagaacgagttcgcgcagggcttcagtcggggagctgaacgaagggccctaccaaccggtagggcccttttgttttacatgggcctcgcgatgaatatcgcggggccttcgtgcttaatactacccggtcacatgcgtgacggcccccgaggaggtgcgcgggcgccgatgtggcgcaggcaaagtgggcagtggccaatgcggcgcagcagcaggtgctgaaggcggcggcgcacttcgggcagtgtccagcgtgctctcctccggggggaaaagcgcccggcggagcgcaaggaatccgtgagcgaccatgcagagggtggcatggtggtggaagcctcgccaccctcgcccctcgaagtggtcaagccccacctcgcctttgagttcttggtagtcccgctccactctccagcgcagcttggacaagcgcaccaactccttgagcggcgtattcgcgggcagtgagcaaagcgaatacttcgtcggcgccttctcctcctggggccactcgatgagcagccatacctcttcactcggtggagctcgctggacgtgccgctccgccgtccgcactcgcacggcggcgaaccgggaggactgctcgccccgactgccctcgcgccaatagactgtctggaactcctccttgggaagttgaagcgccaactcctcaatggcccatggttgcacgccctcggccacgtagcgcgtgcgcgggcggccgttctggcccggcgccctctggggctgacgcggcttggcaccgggcggccacaccttgtgcgtgccctgcacgcccatcaagtagtgcaggcctcgctcgcgcacgccgtcgcggaactcccgtgcatcgccgtacccagcatcagccaggacgaggtgtcggcgcacgctccacgccattgcgtcatccaattggctcagcgctatctgccacttcttttgaaacttcactccagacgggacaccggcggccttgcagcgcttcctgctgcgcgtccactcctcaggcaggtacagctgcatggcgatgcagccgctgcccttctctccagcaacatgcaggctgacggccacctggcagttctccgtccgccccagggtgcccgagtactggcgcgccacacccaccgaatgcacgcccttcttcggcaagcccgtgtcgtcaatgacgagggcctccaagcccggtagctcgcactcaagctgccgcgccaggcgccgccgcatttcggagtcgtcccaagccgcgcccgacacacactgctgaagccgctggcgcatggcttctgtctgctcgggtgcctcgacgagccgggccgccatgggctcgatgctcttgcgttctccgtcgagcagcagtccggtgaggtagccgccgagggcgcgacgtctctcggtccggcccattccctcggtcatcgagtccaggaactcgctcagctcccggtcaagcttgcgtaactgggcaggcgtcatgctccgtcaacacggggcgcccgcgcccaattcatctgaccgggtagtgttaggagcacctaacgaaagtaagggctgaagtggccgcttgccctgaagtggtcgcctgccctgcgcatgcccacctttcggaaatggtccgagagctcgtccccgacgcattctggcagcgtgtggccccgctgctgccagcaccgaagccgaagaagaaatccggacgccctcgtgcggatgaccgcgcagccctggaggccatcgtcttcgtgcttctcagcggcatcccttgggagatgctgcctcgcaagcaattcggcctctctggaatgactgcctggcgccggctggaggagtggacgcgagcgggcgtgtgggaggaactgcagcgtcggcctggtctgccccccgattttcggaccagttgaagcgtgagagagtcctcgcggccaggaggtagggcggtcgtgagaaagagcaggtttaccgaggagtagatggtccgcatcctgcgggaggcggagacgcctggggccagcgtggtggaggtggcccggaagcacggcgtcgtcgagcagacgctctaccggtggcggcagaagttcggcggcatggaggcaggcgacgcgacgcggctcagggagttggagaaggagaacgcgcgtctgaagaagctgctggccgagagggacctcgaaatcgaggtcatgaaggaaatctccacaaaaaaatggtgagcgcgcctgtccgccgtcggcaggtgcggtacgccatggggaaaggcgtgtcgcagcgccgggcgtgcgcgctactccaggtggcccgcagtagcctgggctacgccagccggaaagaggcaaaggacgcgcctctggtggcgcagttgcgcgacatcgcccgggcacgcccccggttcggctaccgtcgggcctgggccctgctgcggcgcgaggggcccgcggtcaacgtgaagcgagtgcatcggctctgggggaaggagggactggcgctctctcggagacggccaaggaaacggcttcggctggggcagcaacgccaacccaagccggagggcgtcaactcggtatgggcctgggacttcgtgcacgacatgtgcgcaaatgggcagaagctcaagtgcctcactgtcgtggatgaacacagccgagagtgcctggccatcgacgtggccgggcgcatcagtgccaggcgcgtcatcgaggtgctctcgcgcctggtagcagtgcacgggccgccgaagtacctcagaagcgacaacggccccgagttcatcgccaaggccctgcgcaggtggctggaggccaatggcattcagacggcctacatcgctccaggcaagccctggcagaacggtaccaacgaaagcttcaacggccgcttccgggacgagtgcctgtcagcggagtggttttccaccaggaacggcatcagcagcgccgcaggactctcgtaacgcgtggtccgaagaacgggggcagagcacgcctctctctctctctctctctgctttccggtttcgcctcttgcatgtcttgctggtcctggaaggggcaatgcaaggccagcgaggactctccaagctcatactcaaagtgagggctcttttagggggcctctaatccagccgcctcctccgccgtttcacggtggcactcgctcttctcacgaggcgccggctcacccggccagagcctcccgagagactccaatagccccaagactccatagagagagcccccgctcctcgcgcgggcctcgtggcgcaacctggccacacgggaggtcaccgccagcccccagcgccgagcacgccgccgatgaccgcccccgtgaacgggtggccgagaatcgcgcccgccgcgaggccgcccagcccgccgatcgccgcgcccatctccgcacgcccgtgactctggttcacctccggcttcgcctcgaccacctccgcggcgattggctccatgcccgttctcgtggtgagcctgtcgaagttcacccggatcgccgccggcttgtccgcgcgggtcgacggctgcaactcggtcatcgtgccgtccacctccgagcccgcggcaacgagcgtcttgcctgccgcgtcgttgatcggctcgaccatcgtcgcgcgcacctgatcgccaccttgctatcccgggtggagagcgtgtccttcagttgcaccttcagcggagtgcctgtctgcaggctcgtcgagccgctagggatctgctcggtctgggtcacgggcgcggtgcccccgtcacgttcgcggtccggcaggcaccgagaccgaggctcgtcatgagagccagcggcaaggcgattcgtcgcatgccagtgcactccatcaagggcccatcaccccaaatgtgggggcgcccacgagcgaaggccaacgccggggcagggagggcggctcatcctcgggcccctgccccacagactcggatggatgcggacagcgcgcgccacaggcttggacgggcacactggcgcggaggcattccagggagcgagcatggaacagccgaacggaggggagaggtattcgacacatgaggcgcgtccagccgatgtggcgctgccctccgagctgccccccgtactgcccccccgagcggtgccggtgagcggtgctccgcccaccggcgagccggctacgtgctcggcgcctggatttcgcgaacactcccccagcgataccagaggccatcagtgctcacgccatcgctgcggaagtagacggtgatgttcggcttgccgctctccgagcccacccggctcgacccggcggtcaacggcagggcgggatcgatccccgaggcgcaaggcgagccgcccttgccgaactgggtcccgtcgtcgatgaactcgttgatcttggtccactggccgccgttcacgccgtcggtgaggtcgatccacagctcctgcttcaccttgccgcccggcaggtcgtagaccacgtgcttgtggccgatccacgtgttcttcgggagcgaggacgaccagtacttcttctgcacgacgtacttcgagtcgggatggttcgtctccttctcgaagtcgatcttcccgtcgtagcgcatgcgcgcgccgatgccgcgggtatcgcacttgtcgcggttctcggagccggtcgtgccgtggttggtgcgcgcgaaggagaccatcccaccccagttgatccccgagtcgctcacgcgcttgaagtacatggtgatctccacgtt

SEQ ID NO: 1252 - DNA, 28058 bp, Myxococcus xanthus
cgctggcgggtgaaggggtccgggcagtcgcggtccacggaccagtcgatgaggccctcctccggcaacgggtggccgtccatgggctcgccgattccgttgagcacacggcccagcagcgcctctccgcacttgatgctcagcggcttgccggtggggatgacctcgctgtccggaccgatgccgtgcagctcgcccaggggcatgagcatcacctcatccccctggaagcccaccacctccgccttcaccgcgccgcggttgcggctcttgatgagcaccagctcgcccacgcggacgttgggcacgctggccttgatgatgaggcccgtcagctccgtgacgcggccgcgcacgcgcacgacctgcgcttccttgatgaggtcgaagtaccgcgagaggtcaatggccatgggcgagtcccttgacgctccggctcaagccggcccttccttacgcgcggtgtccggcaacaggatgttctggagcatctccaactgcgtgggaagctgtgcgtccaccgtgccgaactccgtctggacgatgcagcccacgggggccacctcggggtcctccttgatggccagatccaccgcgcggccgatgagttccatcaggaccggcttcttcgcgcggagcacggcggccgtcttcgggtggacccgcagaatcatggagcgggcgctgcgcaggttctcgatggcagcggcgcacagctccaccatcagctccgggtccttctccaggctccggccgatgatcttctccgccaccttgagcgacagcgcgatgacgtcctgctcgtggccggtcagcacctcccccgcctgcatcttcgcgcgaaggatgatttcggtggcctgcgccaggccttcttggcggccctgctcacgcgtcttggcgaggaggtcctcgcgctcgcgctgcgcctccgcgaggatgcgctccttctcgcgctgcgcctcctccaggatggccgacgcgccctgtcgggcctcgaagacctcggcgttcatcactcccgcgcggggaggccgcagcacgggacgctcgggcgcgtgcgccggctccgccgtcccatcacctcgaatcacctttccgatcgccatgggccgctccttgcgagccggatgctagcgcgttccgcccttggttccacgtccccctgcacccggaggcacaggacggtcggtacccgacggagagcggggacgacgctggacggacgtgccctccccccggggcttgggcatgggcgccagggccggcgaggtgatggcccgccccaccagcacccgggggggacgctccggctccggctccgcctcggggggcttggcccggccgcctccctggcctccctgggtaccggatgcgcgcgagcggaacacccgggagacctctgagacctcccgctccggttccgcggccccgaacttcatccgagcggcccggggaggctcctccgccggacgctgctgcccccgggacgcgacgcgggagcgctcatccgctgggcgcgcctggacgcgggagccttcggccacccgggaacgctcatctggggctccggattggacgcgggagccttcggccacgcgtgagcgctcgtctggaacgttggcatggacgcgcgagccctccgccacacgggaacgctcatccgcaggtcgggcgtggacccgcgagccctcggccacgcgtgagcgctcgtcctgcgcgccagcctgaacccgcgagcgctcgccctggcctccagcctgaacccgcgagccctctgccacacgggaacgctcgtcgggcggacgcgaatgcacccgggaaccctcggcgacccgcgcgcggtcccgctctgacagcgtgtcggggtcctgggggcgaggccgtgcgccgcgctgccccagccgagaaggcggcggaccgatgcgcgcgccctctggatccgcgcgaggcggacgcgtatcgggcccctcaccctcacggcgagcccccgcgccgccctcgttcgcgggctcacgccgggccggcatccgctgcaccgcggagccatcctgtcgcttcgcgggcgtggccacgcgggacggctcacgcgaggacaacacacccgcgtttcgcgccgctcgctccgccatgaagtcccgccgggccggtgctcccgcgccctggcgagccgcacccggggcctgcccccgcgccggcggtcgtgtcggtacatcccggccagcagctgccgccttggcaggtgccgccccagcagcaggtgcagccttggcaggtgccgccccagcaggcgcagccccaccgggcgccgccgccttggccgcgggtggcgccgccgcggcagccgccttccgggctcccggaggcggaggaagaacggcggactgacgcggaggcggcggtgtcgccaggcgaaccggccgctcaatgaggccacgcgtggccagccgctccaggtccatcacgatgtcggtccggccgccatcgcctcgcgcggtgggacgcacgcgctcctcgcgcacccacttcgccagcaggcttccgaactcaccgcggtacttctccagcatgcgcgcggcgaactccggagactgcgccacgcatgcgcgcgccagccgctgagcccccgcgctgcgcagcgccaccgagggccgcgtcaggccctcgtgcggctccaactgcgcccgggcatcctcctccggcagcttgcgcggagcgttggcggccacggccttggtggccagcagcttcaagtccggcggcagttgctccagcatggcctcgcgctccgcgtccggaaggcccgccagcgccggccccagcacccgcgcgcccaaccggtcgcacatggtgagcagctcccgttgctgaagctgaagcacgtccgcgaacttgaagcccgcggcctgctgcccagcgacctcgcgcgcgagcagttcctccagcttccaccggacgatgtccaggacctgcgggcgcacttcgcgggtcagcttcacgcgcgagggcggcagatgcgcgcgcaccgcctccgccagcgtgcccggcagcgcgcgcagcaccacttccaccaacgcgccccgctcacgttgcagcagcgcagccaaccgctccggttcggcgctccagagctgaccacggcggtccttcaccagccgcttgatttcctgcaccagcgcggggatgcgcttctcgcgcggaacctgaagcagctcctgcgcgcgatgacgcagaagcgccccctcctcttcgggaaggtgctccaaggcgccgaggctctcctggccgcagaacgtcacggccgtcaggagcagcatgctctggcgcttgttgagcgaggtgaagaacgagtccaaacgtcacctcgcgggccccacggacgcccgctgggagaaggagggaagccccaccgtgaggggcggtgacgtcaagcctcgggaggacgaccgcgggtacgcgctccagcgcgcgtggcaggggcgctgctggagccgccgcgcatgaaggtccacatcgtcaggcccagcatcgccagcaccagcacgaaggcgcccgcgaacatcaccttgaactggctggcgctggccgccgtcatgcgcagccccagcacgtcctgcaggcggctctccgcgtccgtctccgccgacggcggcagggcctgcgtcatcagcaccgtcaccgcgctggccttcagctccggcaccgcggtggccgcgaactgctgcaccacggcggtgtcgatgggcggcttgcccccctcgcccgggcggtacttgatgaacaccgacgcggacggcatcggcttgttctccggctgcgtgaggtcattgttctccggaatcatcacgatggcgcgcgcttccagcacgccgtcgatctgattcagcgcattggagacctcgccgcccatcgccttgaggagcatggcgcgctcctccgtcgcggtgggcaccatgctgcccttggcgaaatgggccaggcccttctccaccggccgcggcagcgaattgagcttgagcagctccgccgcctgcgcggcatccgccttgggcacggtgatcatgaaccgcacctcgttgccgccttcttccttttccttcttggcgttgatgccgttcttgctgagcaggacgtagatttcgttggcgtccgcttcgctcagcgcgtgctggagttcaatgtggcagcccgtcaggaagagaagggcgagaagcgaggcggcaaacgcgtgcggtcggcgaatcatgggcgggtcggagcttactaggcccccggaaaacgcggaagggcgccccctcccgctcgtagagggagggaccgcccttcttgaggccgcgccgccgggaaaccggggttgggcctacacctgggtcttgacgacgtccttcaggccggtggtcgccttctccacgaccttgctcgtcaggtccagctgctgcgtgtactggtacatggaggcctggagcgacagcagctccgcgttggagaacgccttgccgctggaggcctgcttgatgatgtgctccaggttgacctggcccttctccaggtcaccgacgatctgcgtcatcatgtcgcccgccttggacgacttggacgcctcggccttggccgtcaccggctccgccgccttggtcgtcaccgactcctgggcgccgtgcaccttgttgagggcggccttctccgtcttgttgacggtctccacctgacgcacggcatccgtgcgctgggtggcctgcgccgcctgggccttgttcacctgctgggcggcgtccacctgaccggcgcccctgcgccttgtcagcgagaactccgtcgaacttcgacgcgccctgcttgttcgtctgctgagcgccctgatcctgcagcttctgctgcgcgacctgcgccgcggagactccggccatcggacccgccatgtgagaccctccttgcatccatcggagaaggagggagctcctcctcctcattcaagagttccttgagccggtcgattgcccgcgcatgcagccgcgaagcccagctcttcgactgccctatctccgctcccgcttcctccagcgtcctgccctggaagtagtaccccatcaggagctttcgctccttctccgggagcttctcgatcgccgcccgcacccgcgtcttcagctgctcctgctccatccggatgtcgacggggagcgactcgtcggtgtaacccgccgtgtccgcgccttcgatgctggtggcgaaaaccatcgccagccccgtcaccgcatccgagatgtcattcacatcatcgtcgaatgagctgccgcggttgcctgctccggcctcacgatccgaaagatttcccagatacgccgccgcccgctctcccacataggcgttgcgggcatcggaaccccgcagcacgcccatcttccgaagcccgtcgaagatggcgcccttgatgcggtagtgcgcgaaggtgaggaagttggccccgaccttcgggtcgaaccgctcggcggcctccagaaggcctatctggccgtaggccagcagctcatccagctccagctgggcgttgaactgcttgcgcacggtcgccgccagcgaccggacgtaggggccgtacttctcgaggatgacctgcctgtcgtcgcccagagccaagcgccgctcactcggccttagaccacagccgctcgaggacctgattcagccgcggatcatcctggagcgcgtctgcaatcttggtggtgagggaggaagacttcatgcggagcttctccttcaggacttcggcgaccagggcctgcgtcgcctcttccttgctcttgaagcccccgttcttcagcttccgggcaatggccaccgcctgggaggccactggatccgcggcctgggggccctggacattgctggagcctaccagacccgagggcccgacaagagactccgtccggtccacccggccaccaaagctggcgccacccgccggagccgcgccggcagggcccttcgcgccacccgcgcggcccttcccaccgcctcgtccgacacctccgacagccatcgccgtgacctccgtcctacgtcttcgccggaggcaggactcccgcctccttggcctggatgagggactgcgccaggcgggcaccgtccccgtccggatccaggtccatggcggccttcagctccttgagcgcctcgggaaccttccccatgaacagcagcgcttcgcccgcatgcgcccgagggagcccggactgcggggccaggcgctgcgcgacgcggtaggcctgcagggccttgtcatgacggccctgcgagaactccacggcgcccagcgccagctggggtacctcgctccggggcatcagcgcggccgccccggagaagatctccttcgccttgtcgaagtggcccatgtcgagccacaggtaaccggcctccagcaggactctggcctgctggcgtccgagcgggacgaggctgttcgaaatctccgaggtgtccgccattgacgctcccttgggcgacaacgcccgcagttagcggacgttgctgatggagttcttgatcgtatcgttccgcgacttcatcacgttcgagatcgcggtgaaagtctgcgattcctgctgaatggcggcctgcaggttcaggagctgggagttctcctcggccatcttgttcagcgagaagttgccgttgacggtgtccgtggtgctgccgctgccctgcgcacccagacccagcggcgagccggagccagccaccgcgccacccagaccgcccgcgacgacaccgccgccggccggcgccaccgcgccgcccaggttgcccgccaccgcggtgttcatcacgcccgcgtacggcgcgcccatgcccgagccacccgtcgaggagaacgtgtgcatcgaggagacggcggcggagacgatctgcccgccggggaccatgcccgccatcgcgcccacacccgtgcccacggcgctggcggcgctgttgagaccattgtgaagccgcgcgccgaaaccggtgtccggcgtctgccgcgccgtcgtgacgttggtcgagagacgaacgttcgggcccatcatgttgtcgatcttcgccattgcttcctccaggcgctgctttcagcggaaaggtcagagatcatcgatgctcaggatgctctcacttgcattatcggcggggggcctcgccggttgcctaaccccggaaaaaaagagtctcccggggaaaaaccaccgtcatttccgacccttgccacccttcgattcggcgatcagccgctcgcgggtctccaccagcatctccagcagctcctccgcgcggccaatggcggcctgggccttcttgccctgctccaccttggggcccttgagttcggtgaggcccgtcttcaccccatcgaagaagccacggacctcttccacggaggccgcctcgagcagtgactcgatggcgggaaacgagggcgcggggaggtcctgcgcggtctgggacggcttggcggtcgggggcattgcggagacggtctcctgtcgggccaccggccgggctggccagtgggcgctgggcccccgacggtaagggaaaagccccgcttcctacaaggcgctcccctcttccccggatgcgcgcggcccccgaaccaccggccggagagcgaacggccattccagcaggggggtgagcaagccctgtccggttccacgcgcgcacctagcttctctccaacgggggacgtcgcgtcgccgcccccgcccactcacaacaaccacaggagaacctccatgaagaagctcgttggcgtcttcgccaccatcgccatgctcggaacgggtaccgccctggccaacaacgacgggaacaagccgaaggactcctcggcggcccagggtggctcgggccaggtggggcagagcgaaatccagcaggacaccaccatcggacgcgggacgaccaccacgcccactgcgccgggccagggcggctccggcaccatgggccagaaggcccccatgggccagaaggagctcaacggccgcgtggtgaaggcggagagcgacaagatcttcgtcgacatgcatggcgcggtggtccccctggaggtcgaccgcagcacccgattcagcgacccgaccctgaagaaggccaaggacctgcgccccggccaggagattcgcgccagctacgaggtgaaggagaccaagaacgtcgccaagagcatctccctctcggggacgggtggcgcgggtgacccgacgctgacgccggactcgtccatcaaccaggacaacaacaagggcggctccggcatggagcagcacgagggcaccggtggcgcgggcgacagcagcaccatgaacccggacacgggctccaatacctcgcccgacacgtactgatgacacacccttgggcatgtcagacctgcaccccatgaaggggatttcggggcccgcagccgcgagtcggctgtgggccccgcgccatgggacgtgcgcatggaggattcgcctcaccctccactccgtacagttcattcagtattgactgaacgaaaccccgccgcctaaaagcctgcccgtcaccccggctgccgtgcgctccgcaccgcgacgcccagccggcgaggcgtggagacaggcatggtggaactggaagccgccgaacgtcgcttcatcgaatcgatggggctgtacttcgagcggcgggggggcacgcgcatcggcgggcgcatctacgcgctgttgatgcttgcgggcaaacccctgtcgaacaagcgcatcgccatgctgctcaacgtgagcgcggcgtcggtgtccaccaacctgcgagcctgcacggacatgggcctggtggaacccgccagcgttccgggggaccggcagcactactacgtcatccattcacagggctgggaaggcaagctgcgcgtcgccgaggagtccctgagcgccttcggccgcctctgctccgaggccctcgcggttccgcgtctcgcaggaaatcgcagcttgcgagaggcttctgctttctgtgatttctacaaggctgagctcacaggcatcgccgagcggtggcgcgcagcgaatgccccccgtccgccacgccccgtcaagacttcgaaaggacgtaccgcatgaatcccaccgcttcgcagtcctccatcgtctccatcacgaacgtgaccaaggactacaccctggggaaggtggtggtcccggcgctccggggcgtggacctggaggtccatgccggtgagttcatctccatcgccggaccctccggcagcggcaagacgacgctgctcaacctcatcgggtgcgtggacaccgccaccggaggtgtggtccgggtggccgggcaggacaccaagcagctcacggagcgccagctcacgaacctgcgcctcaacaccattggcttcatcttccagagcttcaacctggtgcaggtgctcagcgtcttccagaacgtggagtttccgctgctcctccagcgaaagctggacaaggcccagcgccgtgagcgggtgatgcaactcttggagcaggtgggcctggcaagccacgccaagcaccggcccaacgagctgtccggaggccagcgccagcgcgtggccgtggcgcgcgcgctcgttacgcggccccagttggtgctcgcggacgagcccacggccaacctggactcggtgacgggccagaacatcatcgacctgatgaaggaactcaaccagaaggagggcaccaccttcatcttctccactcacgacgcgaaggtgatgagccacgccaacgcggtggtgcggctggcggacggcaagttcctggaccgcatcagcgccgccgaggccagccgcgccatggcctctggaggccactgaccatgggacaactccgtttgctgctgcaggtagccttccgcaacctgttctccagcaagatcaacctgctcatcggcggcatcatcttcttcggcaccctgctcgtggtggtgggcggagcgctgatggacagcatggacagcgcgatgagccgcagcatcatcggcagcgtcgcgggccacatccaggtctactcggatgactccaaggacccgctggccctctacggcagcatgagcggcgagccggacctggccgcgctggacgacttcagccaactccggcccttcctggagaagcaccccaacgtgaagacggtggtgcccctgggcaccagcggcgccatcgtcacctccggcaacacggtggacctgacgctgtcgaacctgcgcgcgctctacaagaagcgcgacgaggccggtgagacgcccgagctgcgggagagcatcgacagcgtcaaggggcacgtgcggcagatggtcgacctgatggccgaccagacggccaagagcgagcaggagctgggcggcgcccagaaggaccccgcggaggtggaagcactcgcccgggcgcgcacggacgcgttctgggacgccttcgaggaggccccgtacaccgcgctggagctgttggagaaccgcatcgccccacagattccggacggggacatgctggagctgcgctacgccggcacggacctggacgcgttccagcgcaccttcgaccgcatggagatcgtggacggacagccggtgcccaccgggcagcgaggcatgctgctgtccaagttcttctacgaagagttcctcaagatgaagtcggcgctccggctggaccacatcaagcaggagcgggacctcaaccagaaggccatcgccaccgacccggacctgcagcgctgggtgaaggagaaccagacgcagacgcgggaaatcatcttccagttggaccccgtcaagacgcggaagatggtggagcggctgcagaagctgctgggcagccaggagcccgcgctggacaagctgctgacgcagttcttcaccaccgacgacgccaacttcgacacccgctacgcccagttctactcggagctggcaccgctgctggagctctaccggctgcgcatgggggacgtgctcaccatcaccgccttcacgcgcaccggctacatgcagagcgtcaacgtgaaggtctacggcacctaccagttcaagggcctggagaagtccgccatggccggcgcgctgagcctgatggacctgatgtcgttccgggacctgtacgggtacctcaccgcggacaagaaggcggagctggcggaaatccagaagcagagcggcctggaagccctcagccgggacgaggccgaggaggccctcttcggtgaggccagcgacaacgagttggtggccgaggccacgtccagcgacgtggacgaccaggccgccttcaccggagaccagggggcgctcacgcgtgagaacctgctccagcgcgtctacacccagcaggaaatcgagcaaggcgtggccctgagcgcggcggtgatgctcaaggacccggagctgctggaacagacgatggtggagctgcggcaggcggcgaaggatgcgggcctgaagctgcgcgtggtgtcctggcaggaggcggcgggcatcatcgggcagttcgtgctgctcgggaagctggtgctctacttcgccgtcttcatcatcttcgtggtggcactggtcatcatcaacaacgccatgatgatggccaccatgcagcgcgtgcgcgaggtgggaacgatgcgggccattggcgcgcagcgctccttcatcctgggcatggtgctggtggagacgctggtgctggggctcgtgttcggctcggccggctcactggtgggcagcggcatcatggccctgctcaacagcgctggcatccccgcgggcaacgaagcgctctacttcttcttctccggcccccggctgttccccacgctgagcgccagcaacctggtggcggcgttcgtgatcgtcctgggcgtctccgccatctccaccctctatcccgcgttcctcgcgacccgggtctcgcccctccaggcgatgcagacggacgagtgagaacatgctccagctcttcctcatcgcattccgcaacctcggcacccaccgcaggcgcaccctgctgctgggcggcgccatcgccagcgtcaccgcgctgctcgtcatcctcatgggcctgtccacgggcatgaaggagtcgatgctccgctccgccaccacgctgtccaccggccacgtcaacgtggccgggttctacaaggtgacggcgggccaggcggcgccggtcgtcaccggctatccggccatcctggagcagatccgcaaggacgtgccggagctggacttcgccgtccagcgcggccggggctggctcaaggtcgtcagtgagacgtcctccattcaggtgggcgtgggcggcatcgacatccagtccgagcccggcctccgtcaggtgctgcagattcgcgcgggctcgctggacggcctggccgagtccggcacggtgctgctcttcgagaagcaggcgaagaagctcaacgtccaggtgggcgagtccgtaacgctggccgcccagacgctgcgaggcgccagcaacacggtggacgcgcgcgtggtggccatcgcggccgacatgggcatgctgagcgacttcggcatcttcgtgccgtcggacacgctgcgctcgctgtaccagttcaagagcgacaccgcgggcgcgctgctgctctacctgaaggacatccagcatgtgccagcggtgcaggcgcggctgcgccagacgctgacggacgcgggccacacggtgatggaccacgacccgcgcgcgttcttcatgaagttcgagaccgtcaaccgtgaggcctggacgggtcagcggctggacatcacgaactgggaggacgaaatctccttcatcacctggacgctcaccgcgctcaacagcctcaccggtgtgctcatcttcgtgctgatggtcatcatcggcgtgggcatcatgaacacgctgtggatcgccatccgggagcgcacccgggagattggcaccctgcgcgccattggcatgcagcgcacccgcgtgctgctgatgttcgtgttcgaggcgctcctgctgggcatgctgggcacgctggcgggcgccagcaccgggttggtgctgtgcctggccgtcaatgccatggccgtgcatgtcccggaggtggtggcggtcttcatcatgtcggacaccttgaatctggccgtgcacccctcgtccatcctgggtgccatggccttcatcaccgcgtgcaccaccgccatctcgctcattccctccttcctcgccgcgcggctcaagccggtgacggcgatgcaccacatcgggtgaccctatgagcctcaagaacatgctgtccgccgcggcgctggccgtggcgctgctgtccgccccggccgccctggccctggagcaggccgagcaggtgaagctcctggccaccatcgacgaccgccagcgaaacggcggcgactacaaggcgatggtgtacctggagcagaaggagaaggggaaggcggacctcgtctacgagctggtcgtctaccgccgcgacgaggacgacaagctgatgatgctgttcaccaagcccaagacggaggcgggcaagggctatctgcgcctggacaagaacctctggaactacgaccccaacgtgggccgctgggagcgccgcaccgagcgcgagcgcatcgcgggtaccgacagccgccgcgcggacttcgacgagtcgcggctggccgaggagtatgacccgtcctacgagggcgaggcgaagctgggcaagtacacggcccacttgatgacgctgaaggtcaagcccggcgtggacgtggcctaccccgtcctcaaggtctgggtggacaaggcctccggcaacatcctcaagcaggaggaatacgccctgtccggccggaagatgcgcacggcgctctacccccgctggaagaagatgttcagcgagtccaagaaggacgacgtctggattccggaggagatgcgcatctacgacgaaatcgagaaggggaactccaccaccatcctcgtcaagacagtggacctgcgtccgctggaagccaacctcttcaccaaggcgtggctcgagagcaagagccgatgaccccgcgcacgctcaccctggccgcggcgctgtccgcggccctcaccggtacgcccacgtgggcccagtccgaggagcggcccgacgaggacgcgctcttcggaggcgggcaggagaagacgcccgcggaggcacccgcgggcgaggaatcgggccggcctgacgaggatgcgctcttcggcggtgacggctcggagccgacggtggacgtggcccctggcaccaccgggggcgccacggagcggcagccgccgctgaccgcgcctgacgaaaaccgggacgcggacgtgttgaacggccctgcgacccggagcgccttcgacaccgaggacgtggtggacgatccgctgaagattggcggtcagttctacctgcgcggcttcatggcgggtagcgagaacacctcgctccgccagacgtccttctccgcccccacgctggtggacggctacctcgacgcgcgcccgtccgaccggatccgtggcttcgtcgtgggacgcttgaactacgaccccgccattccgccccggaccacggcggacgccccggcgaacccgcgcgtgctgctggaccaggcgtggctgcgcttcgacctggagcgcacggtgttcttcaccgtgggcaagcagcacgtgaagtggggcaccgggcagatctggaaccccacggacttcctgtcgccccagcgtagagacccgctggccttcgtggacctgcgcacgggcgtgtccatgttgaaggtgcacgtgccctgggagtccaagggctggaacgtgtacggcatcctcgtcatggatgacctgggcacggacgtgggcgccatcaccgacccgagcggaagtcccacgtcccaggccggcggcagtgacccggtcaaccggctgggccgcctgggcggcgcgctgcgcgcggaagtcctgctggggcccgcggagctgggcgccagcgcggtggcgcagaatggacgcaagccccgcttcgggctcgacgtgtcctcgccgctggggccgctggacgtctacgccgaggttgcgctgaaggaaggcacggaccggccgctgtaccgcattccggaagggacgacgctcgaggacatcgcgcagaacggcgtccaggtggaagcctacattccctcgcggctcacgccgcagatgacggcgggcgcgacctacagcttcccgtatggggagaacgacctggccgtgctgggcgtggagtacttcttcaactccacgggctacaccggctcgttcgggtatccgtacctgctgctgaagggcgccttcaacccgctctacctgggacggcattacggcgccgcgtacctcttcctggaccggcctggtccattggagcggacgtccttcaacctgttcacgctgggcaacctgtcggaccgctcgttcaccacgcggctcaacgtgatgcaccgggcgctcacgtatctcacggtggaggcgtacggctcggtgaactacggacggcgcggcggtgagttccggctcgccgttgatgtgccggaggggctcgtcgtggatgggcagccgattccggccttctccatacccgcgccaacgttccaactgggagcggggctccgcatcagcctctgagtccggcgacgcgtcctgaggtgcccgagggccgtgctcccctgcttccgggagcgcggccctgggtgttttcagggcgcgagcaggcagtttcggggatgcccgccctgcgagcagccagccgggcgccgtacaggcagttggggtgtccgagggcggacggatggacagatttccgccatgcgcctctggattgccatcgctgcagggtggggcctcggccagttgccgaacgcgccggtcatgattcctcccgaggacccttccatccgggacccggccgcagcggcgctccaggacgcgaaccagcaggcggcggaagagattgaagggctgaggcccccggcgggctacgtctatgaggcgccggaggatgcgtcaccgcgcgacttcgtgctgacgcccgtcctgcccgacggcgcgccaccgccgatgccgggacaggtcgccaccgaggaggccgcgcagcgctacgagccagttccctcgcccctggaggcgctgcaacaggaacaggccgcgatgggtgggagcggacagcagacgggggctgacggcacctcgacgggccaggccaccacgggtgggacgacgagcggtgcgggtggttcgggtgtgacggggcaggacgtgagtggatccggcacgagcaccggcaacacaggcacgggtggcgccggcacgacgggcccgcagcaagacggcagcggaacgccccctgaaaacaccgtccccgcggaacagcagaacctcggcaacacgggcgcgaccgccgcccagacggcaccccagcagggaacccccacgggccagagcggcacaggcacgaccagcgcagtcccctcccctgcccccgcgacgccggctttcattggccgctcggaacccatcggccgctccgagcccattggccgctcggaacccatcggccgctccgagcccattggcacgccgcccaccgtagcgcccgcgaacaacccgatgggcactggcggcgcaggaacgccgaacacgaatcagccgacgcccgcgcagcagatggaacaactgaatgagcgggtgaagcagctcgaaacccagctcaacgagcgcgacgccgacctcaccgtgagaaaccaggccgtccagctccaggtggacacctacggcgaccgcgcggtcgacgtggagcaggcacgacaggaccggctgacccagattcagaccgccagtcagtggatgctcgcggcggacacggcgctggaacagggtgagctggacgtcgtcaatgcgctcgacatcgccgacaacgccttcgtcgacttgcgtgacagcgcggaggaggacggccagggcacggtcgtcgtccacgcggagcgcgtgcgtgcgctgctcaatctcgcccgtaacttcgtcaacaaccgcgacggatacaatgcccggctcgccctccaggaggcaggcgtccagctgagcatcctccgcgccgccaacctcgagcgacaggccaccggcaacgtcctgctcaatccgtgaacgacggcgtcgcccccacggggggactctgcggacgggcgatgaggtagccctgcacgaagtccaccccgtgcgagcggacccagcgcagctcctcgtgcgtctcgatgccctccgccaccgtgcggatgcccagcgtccgcgcaatctccaggagcttctccacgatggagcctttgtacgggtccaggtggacgtcacgcaccagctccatgtccagcttgatgatgtcgggacgcagccggtggatgaggttcagtgacgagaagcccgcgcccaggtcgtccagcgccacccggaaacccgacttgcggtagaagtccacgatgccgcgcagatgctccgcgtccgccgtctggtccgtctcgatgatttcgaacaccacccgctccggcgcaatgcccgccgcgtggatggcctccaccgtggagcgaagacagaccgtggcgtcgtagatggccgtgggcgtgaagttgatgaagaggtgcgtgtccagcccgtgcttcaccgcctgccggatggccgtggtacgcgccgccaggtccagttggaacagcaggtccgcctcgcgcgccgtctgcatcatccgtccgggcagcaccagcgtgccgtccggctccaggcctcgcatcaacgcctcgtgcgcgaagatgcagcgggtgtcctgcgcatggacgatgggctggaagtgcgtggtgagccgctcctcggagagcaaatccaccagccaccccgcgcgcgtccgcgtgacgagccgctggagtgagcccacccggggatagtcacccagcccgggctccgccgcccccggcatgaacagcgcccgggtggcccgcgcctcctcctgcgtgagcgcggccaacaggttcgatgccagaggcgacagccccgcctccggcacccacacctcgacgcaatgggcttcggcacgcacctggacctcgtgccgcgcctcccggaggaaggacagcagccggccctggctgtgccccaccgggctccacaggaacagacgcccggcgccctccgcgaggggaggaagcgtctggcacctgccgcaggaccgcgtcggggtgtcgctcatccagacagcctactccgtcgtctcgcggaagatgagcaggcctcgcgaggaatccgtcgcgtacacgaatccgtcgcccggcacgtgcaccttgctcaggccttcgaggaacacgacgccgtggcccgcatgcgtctgccgccaggtgttgtagtaacccacctgctggggcgagccggggacggacacgtgcacgatgcgcaggccatcctgaccataggccaggtagaccttcgtcccggagaacgccaccgagcggatggacacctccgggcgcgtccggaactcacccgtccgggccaccgtggccggcgcgctcacgtccagcacgctcaggtgcgcgccccagtcctcgcccgcgtcgaatgcgtagacgcggtctcccaccatgccgaccgccgtggcggccgacatgccgttggcgaagcggcccaacagcttcgggctcgccgggttggtgacgtccgagacggtcattccgaaggaccagttgctcacgtagagccggccgcccatcgccgcgacgtgcaggggcacctcccccgcccggggctccgcgccctcgacgaagtaccgcctgagctgcttcggctccgcgggcgtggcgacgtcgtagacgtacacctccgcgttgggcgcgggcgacgccgcgtacaggacgtttccgtccagcgcgagggagttcacctccaccacggactcgggcacggagcgcaggcggacaggtaccgccgggttggtgatgtcgaacacggcgatgccgctgcggcggctggccacatagagcgtgttcccgttcaccagcgcgtccgtgtagtagtcgttggacagctcgtactggcggacctggcgcggctgcgaggggtcgctcaggtcgaaggtgatgaggcccttggcccccgccgtcacgtaggcgtggccatgggccaccgcgacattcgtggccgtggcctcggtcagcttcacctcgctgaccagctccacgccggacgcctctgcttcacccgcgcggcggcccagccggatggcctcgaaggtgcccttcatgtccgcggtgccattggcgcaacgccggaagatgcccgacatctgcccgggcccggacgaggaacacccggcgacggcgaagcgcatcgtcacgttgttggagccctggaactcgctggccaggaagaacgactccggggtgctctgccgctccgtggcggcgaggcccatcagcatctgggtgttgctgccccctcccgacaaccgcatggcggccgcggctccggaaccgtcgttgaggttgatgttgaggttccagatgccctcgggttgtacgccggagaggcttgaaagctggcaggccgacacatcgatggcctcgacctgacactccgccttgggaacggacggattgtcattgccgcaagcggtggcgagcgccagggtgctggtgagtgcgaggaggcgtttcatgcccccatgcatatcatccggcgccagcacccgacgaaacagcgcgctcccccggcctccgagggggcgatgcccactgcccgtcaagtaaacggaaagaaatcgtcggggcgcttgtataccgggaccgctgggaggcagcctccccagcaggtgtagtctcgccggtaccccacccacagaggtgccttcagtgaacccccgtcccctcgccgcagccctgctcgtcctgctcttcccggggctcgcgcttgcccagttctacgtcgtgccccgaagacccgggaaaacggcggtgaacagctacgaattcgagtggcgacacacggacatcctcgtcggcccgggggccaccggtctggcggaacctcccgagcggacggcgcacgaacaaccaccggagagtccaggcggcgccaacccgggcgcgcccaccacctcgccggaccagggcgacacgaaggcgcctcccagcggtccgccctcggagacgacgggaggcacgtccgagccccagtcccagacggggctgcccggcagcacgccggtggtgctcgagggtgcgaccgacgcgggcgtgccgcccttgacgatgggtgaagacgggggcgtcccggagagtggcctggcggccgccgacgggggcgcggaggacggcggtgccctggccgcggccgatgcggggacggaggatgggggcacgctcgcggccggtggtaccgacggcggagagcaggacgcgggcgccacctacctgatggccagcgacgccgatgacgacggcgggacggtgctgggcggcggtcagtcggtgttcgcgggcgcggacggcggcttcaactacacctacgcgaagtcgctgggggacaagtcgggcggggtgcgcttctacttctatgagcgtgagcgaatggtggccgagcgcgccgcgccgctcatcgaggaggcctaccggtacttggtggaccagttcaagtacgtccccaccaagacgttcccgtacatcctctacagcagctaccaggagttcctgcagaccaacctcttcgccgtgtccgagggcacgctcggcctcaccagcaccggcgaggacctgaagctgacgctgccgtacctgggcgaccaccgcctcttcgaggaggtcagcacccacgagctggcgcaccagttcaccatccagaaggtccgcaccgtggccgagcaggccaagatgttcggcgatccgctgcaagccattccgctgtggttcatcgaaggcctcgccgagttctacgccaagcgtggcatggacccggaagcggagatgctggtgcgggacctgttggtgaacccggacctcttcaagggctacgccttcctcgacttcttctcccccgggccctacggctacctgtggatctacaaggtgggccaggtccgcgtgtccttcctcgaagaggagtacggcgccggcttcatccagcgcgtcctggaggagtcgccgcggctggcgggtggctcgcgcgattcaccgtcgctcaagttcgaggagttgctggagcggctcaccggcgacaaccccaagcgcatctccgcgcggttcgagaactggctgaagcgccgggccttcaagacgtacctggcgtccgagcagtccgcgccggcgctggacctgctcgacaaggcgcccggctacaccaccgccatggcgtcttccccgtcgggcaacgtgctggggctgcgcaccatcgtcccggagacgggtgagagccggctgtacatcatggatccgcgcgtgccggacaagacggtgaaggtcgcgggtgacggcgtgccaggcgtggagtcgttgcaccccatctccggacgcagcttcgcgctgacgaacgacaagctggccttcatcgccgaaatcaccgggcgcgacgtcatctacgtgcaggactacacgcacaagtcggagcggcgcggcgcggacgtactggtgcgccgcaacgccatccggaccggcatcgaccgggaggtgggcctggtggtcgacctgagcctgggcggacgcaccgcgtaccgcatcgaccggcacgggctgctcgcggcgtactcgccggccttctcgcccgacggccggtgggtggccttcatcggcatcaacgacgcgggtctgcgggacatctacgccatcgacctgcaggcgggcccggacgccccgccgctgcagctcaccgacgacgtgttctccgagcgcgaggtgacgtgggggccctcgggcatcgtcttcacgtcggacgcgacgtcccaccgccagttcaacctcttccgcgtgcggccggacgcgccccggcaggtggagcgcctcaccagcgaggagcgggaccacacggccccggtggccctggcagacggacgcctcttcttcaccgccttcaacaacagcagctccgatttgcacgagctgacgaaggacggccgcatcgtgcggcgcacggacctgacgacgggcgtcttcgagcccggccccggcccggacggcagcctgtggatgctgttccacgtctccggtgagcgccggcccgcggtgctgcgcccgccgcgcatgctggcgctggacgtccccgccgaaccgccgccggagccgcccaacccgctggcggtgcggcccctcacggacgcgcagaactacgagcccttcacccggcagaacctggagttcggtcccttcttcggcttcgcgggcgcgggcggcggcggcttcgtgggccagctcttcgcggcggccagtgaccgcatgaaggaccatcagttcctgctcaccctggcggtgtacggcagcttcgacctgacggacggatacctgctctacgtcaacgacaagtcacgcacgacgtggggtggcggcatcttccagtccctgcgcttccgcgtggaccgcaccttcgaaggtgaagagggcgcgcagaatgccttcttcacgtcgggtgagcgcttcttcggcgcgctcggcagcgtgcgctacccgctgagcaccttcctgttcgtgcagggcgacctggccattggtggtacccggtacttcctggacgactacacggagttcgagctgttcttccccgagcgcaacgcggccaaccgggagctgctgacggcctggaacgcgcgaaaccgcgccatccgcttccagacggagctgagcgggcagattggctacgacagcctgaagtaccactacgccaccggcccgctgtcaggcagcgcggccatgctggagacgacggtgggcgtgcagcccttcgacaaccaggcctacggcaatgtgcgcgtggacgcggagcgctacttccccatctacggccgcgccaacatcttcatccgcggcggcctgggcaccacgttgggaggccggtacgcgcgctcctacttcctgtcttcgttcgacacgctgcgcggcgtgaacttcggcgacatccagtggctgctcggccggcactacgtctactccaccctggaggcgcagctgccgctcaacgacatcatccgggtggccttcctcagcgacctggaagcgattgccgccatcgacgcgggcggcgtcggcgagggccgggatgacttgtggaaccaccgcgtggtgaacggcgtcgtcggtttcaacctcgcgctgggccccctgctgctgcgcctgcacttcgcccgcccgttcgacgtcggcgccgctgccggccggccggacccgggctgggtgacgaacttctcgctgggcatcgccggcctcaatggcttcttcgaccaggcgaacaccgggaagagtgtcggcccatcgccgacgcccatgtccccggccctgatgccctccatgggaggcggctacaccgcgccgcgccgctgaggcggcgtcaggactgcgcggcgacgagggcggcgttggctcgggccatgggcccgccctccatggggatgcgctcgaagtcgccgcgcagcgccttgatggcgaacttctccaggtcgatttcccggcgggtgcgcacgccaagcacgcgcagcagctcagacagggggctgaagccggacacgctgtgctggagcagcatgccccccgctaccgcggtgagcccccgccagcggccgccggcccgccggcccagcagcaggcccagcaggcccagggccgatgtgctcacggcgagggcgcggttgatgtcccactcgcgctccagccgggcgaggtagcgcgtcatctccgcgcggtcccccttctccgccatgtaccggacgcagcgctccacgtgctcgtcgatgcgccggttcaccaccagcggcgtgtggacacggacggtgtctgacgacgtctggttccacgattccatatgaggccctctctccctgacgcggcgcgccccctcttctcttgaagctaggaccgccgccgccccccgtgcacagcccacgcggggaaaggggccccgttccgcccggctgcctgccccgccaggggccccttcgcgtcccattccctccagggtgggacaagcagccaggttgggtaatccgtttcccttgcacgcgacggtgggggcctgaatgccgactcaagcgttcgctctccaccaaaaaggggccctggaggcgggcacaaccgttgctttgcgccgggattgatgactccttctcgattgctgctgtgtctgccgctgctgagcctgtgggcctgtgatggactccaggcggagcggccaccgctcatccaggaccctccgggcgtggagaatccgcaaacgccccctggcgaggaggagccgccgccgacgcagccgccaccggtggacccgcctcccatcgacccgccgccggtggatccacctccggagccgccaccgcccgtgccggagacggagcggccctttgtgatgccgcccgtgcagacgtcggtgccgcagtacgagctcatcatccccgaagagacgatgcggatgttcgaggcggacccttggacgccggagcaggacggcctcttcaaggcgaacgggacgacgtaccgcgtgcaggtgcgcctgcggggcgcctccgcgcgcttcttcccgaagaagagctggaacgtgagcttcgaggacggcgtgcgcttcgaggggaggacgtcactcaacctcgtggccgagtatgcggacgcgacgctgctggcggagaagattgccttcgacctgctggaggccatgcgcgtccccgcgtcgaagggcacgctggtgcggctcaacgtcaacggcgcgtaccagggcgtgttcctggaaatcgagcaggtgaacaaggcgttcctgcgggcgcactcctacgccgacacggatggaaccatctaccggtgtggctggaaggactgcgaattcaagatggcgaaggtgccgtaccagggtgactgggcgaagaagacgaacgagtcccagccggacgacaagctctgggagatggtgggcgccatcaaccacacgcccgagccccagttcgtcagtgaaatggagaagcgcttcgagctggagcactacctgcgcgccatggtgatggacgcgctgatgtccaacaactacgtggaggactcggagagctacttcatctacgaccgcgcggtggccaggtggtcctacgtcccgtgggacctcaacaacgtggactcgcgctggtggtaccccatcagcgtggaggagatgagccagagcacgcgcaacatgcgccatccgctgttcagcttcaccctcaccgacgcctgggtggcgaagatgtacgagcagcgcaagctggagacggcctcgtaccccggctacctgccggtgttctccaacctggccacccgcgtggtgatgaaccccgtgctgcgcgagcggctggaggcgcggctggacaaggcgatggacgagctcttcaccagcgaggtgatgggcgcgcacatcgacaagctgcacgcgctcatcgacccgcacatgcgtgacgaccccttcatggactacggccgcttcaccgcgggccgcgcctatctgaagcgctacgtgcgcgagcgccgcgacttcatcttcaaggagctggagcggctcgcgcagcagcaacccacgttggtgctggaggccgtccacccgcgtgaaggctgggtggaggtgggcaaccgcacctcggcgcccctttccctggcgggcatggtgctgacgacgcaactgcgcatcagcctggcgcagagccccagccacctgcacacgcaggtgcgtgcccccttcggcgcggtgctgccggagctgacggtggcccccaggcagcgcgtccgcctcaacgccgcgcagttgggcatccagatgcccgccaacggcgagattggcctcttcgacgggcgctccgtggtgggcgtgaaggacctgctcttctacggcgacctgggcgcgggcaagcgctacgagcgcggctcgcggggctgggaagtgcgctgagcgcggcggcgagccgcacctgagcgcggcgctcctgtcctccgggggcgccgcgctgcgtttcagggtcgcatgcggacctccagcgtccgcttcgcgctcagtccccggtcatcggtgacgagaatctcgtgggagcccacggacggcgtccaccacacgcgctcatcggcgcgcgccgtccccagcagggccccgtccacgaaccacgtcagtgcccgctcgtgtgaggcctccgcctccagcggcacctcctgttgcgaggccgggacaccgggaatcagcacggccacatgtcccggcgcgggggagacaatggacggggccgcgcgcgcccctccgggctcgcagccaggcgcggcggcgggcggctccggcaggcgccggtgctgctcctccagccagcggcggatggtggccggccaggtcacatacacccgcggctccgtcttccgccccgtccggcacatgggccccaccgacagccccgtggccacgtccacctccacgtgctggtggtacgggcagcgcgcggtgggcaccgccgagcgccgcgcgtagacgtgcttgcgctgcacgcaggcgtccgtcggcaggtggcccgaataggcgcagacctccaccacggccaggtcatcgggcggattcacgctctcatccggcaggttgaggccgcgcgggcccacgccctccaggatgtcgaacagcaccggccccgccgcgtcagcgcccaccaggtgcacgctgggcctgtgattgaaattccccagccagacgaccgccgtgtgccggggccccgagcccgccgcccacgcgtcgcggtggccgaagctggtccctgtcttccagtgcacgcgcgccggcatgcccgtcagccgacggcgtgccgggaaatcgggccggtctctcagcgacagcgcctggcgcgtcagccaggccgcgcccggggacagcacctccaccggcgcggccgccttctcgtccaacaggagccgcagcggcggcgcgcgtccatcccccgccagcgcgacgtagacgcccgcgagctccagcggcgtcagctcgatgccgcccaccgccgcggacaggccgtagtacccgggctcctgcaccaggctcgtgactcccgccgcttgcagggcgcccaggaagcgctccacccccacgcgctccaagagccgcacgaagggcatgttgagcgactgggacagcgcgtactccaggcgcaccagaccttggaagcggccgtcgaagttgcgcggcgcatagccgccgtaggccgtgggcacgtccgccaccaactgctccggtcccaccattcccaggtcgatgcccatggcatacagcaggggcttgagcgccgagcccggcgagcgcggcgtggcgaagccgataatctgcccgccgtgcttctggtcgaagaagtcgaagttgcccaccagcgcgagcacctccgcctgctgccggtccaccaccaccgccgtcccgttgtagatgcctcgcggcgccagccccaccgccgcgtcccgcatcaaccgctccaccatccgctgcgtgcctgcatccagcgtggtgtgcagccgggcattcgccggccgctgcgtgcgcagccacaccgccacgtgtggcgcctcacggggaaagggcttcaggtcggtgggcacaggcgtgtcgcgcacctcacgcagcaccgtctccgccgacacgcgggccgcctcgggccctcggggaagcgcctccacgtccagcagccttcgcgccacgccgtcccgcgccgacttcaaccgggccgtgttctgcgccgtggggaagcgccggttcgggttctgcggcaccgccagcagcgtggcaatctccgcggggctcaggttggccgctgtac

SEQ ID NO: 1253 - DNA, 25621 bp, Myxococcus xanthus
  unsure (1)..(25621): unsure at all n locations
ggcgctctaagccctggtcgaggccgacgcgggccagggccagcacggcctccttcgagtccacgtgcgcaggcaggacgaggaacagcggcgtgcccggctgtaccatctgtccaccgaacacggacaacccctgcatccagacattcagcgagcccgggatgtgccccccagcgaaggactcgggctcacgcacgtccaggacaaggccactgtgactttcccactgaaagcgtttcggctccaggaaggggatggcggatgaatccgcggagagtggcacgccaccgcgtatgttcacctcctccatgcgcgagaaatacgaaggccggtgaagccgctcctgcaccttgcgctggatgaagtcgctccggctggaggtgaacacggggttgtgcaggcgctcgaagcccagtgtcgtcaactccctgtccgcgatgccgctgcgacacaccgagcctgctccgtgggccgggaagaccagtgtctggtcgcccaggggcaggaccttctgatggagcgaatcaaagaggagcgcggcattctcgtagacccgctctggcgcagccaggtccgtgcgccctgtctctccagccaagagcgcgtcgcccgtgaagacgccccaagcctgggcatggtggggatccaggtagacggcccagctcatgctctctggcgtgtggcccggcgtatgaagcgccaccagcgtcaaggcccccaggtgtagccgctctcgctcgcccatccgcacgtcggcatggccggtgatggggtgccggccagccaccacctgcgcgcctgcaaggcgggcaagcgcggaagtaccctcaacgaagtcttcctggcggtgcgtctggagcacgtagcgcagccgcaactcctgccgccgcaacacgtccaggtagacgtcgacatcacgccgggggtcgacgacgagcgcctcgccttcactgcccaggatgtaggtgatttgggcaaggcccgcggtcttgatggcctggaagtacatggcccctcctccgctgaaggtggtcgccatgacgggaaagagcatcacgggcacggcgcgttgccgcctgcatggcccgccgggagtccggccaggagcggagcatccctcccctcctctgagctgctaccgcacgtctgcctgcgtgaatggcgtccgtggaatttcaccgcgccgtccttgaactcgcgcgtgaacttccggcgctgcctccgcgccctcttctgattcgcgccacttgccgacattggacaccctttcccccacatctcaggtgtccacggaacccgggcaggctcaggtggggccgcaccctgccatcgtgcatgcaggtgattcgagagtctctggggctcgaaaggggggcggtccccgcggcagggaccgtcacctggaatgccggcgcgccagcgtcaggagattctgatgctggaggtgttgttgttcatcgcgcccagggtcggggcgtcggaattcacgggcagcgtgtcgccggagaagttgtcgttcttgaataggacgaccgccaggccctgcggcttcaccgagctgatggtgttgttgtcgatgccgtaccgctccagctcggcctgggtgtactggccaggaggcaggtccacctccttgccatcgaactgctctttgtagaagaacctggccctgggctgcacgggcacggatatgacccggatgctggagacgttgttgttcagcgggcccaactcctcggcattggccaccacttcgatctggtcgccggcgaaaccatcgttctggtagaggatagccttcacgccaggcggcaccttcaccgagctgatggtgttgttctcgatgcccagcgccgccaactgggcccgggtgtagttgccaggcggcagatcgacctgtttaccctggaagtcttcgttgtagaaaacggtaatgtttgccattgcagtgctcctccgttgagcggccccggcccattcgttgccagaagccgccggaagcattgggcaccgcgctccggaaatgcaatccgtctacagtaccgtatccgtccggccaaagacgtgctgagaggcgttgagtgaggagtcggcgccgaggccctggcgggaatgtcaaagccggtggagaagcaggagtggttccgggtcgctgaagccttcgaggcgagcggactgacgcagaaggagttttcccagcatcgaggcgtgcggttgagcacgttgcagtcgtgggtgtaccggcgtgatgcggaaggcggccctgggccgtacgaactttctcttcgtcggccacgaggtcgcgggtgaaaacctcgcgggcctctacgcactggtggccacctgcgaggccaaccaggtcaaccccgaggagtacctggccgacgtgctgctgcgtgtacagacgcatcccaactcacgcatcggtgagctgctacctcacgagtggaaacgtcgacgcgtcgccgagccgcctgacacagtcctccagcccagtccctgaacagctcgctcttcgcggcgctcgccgaacagggtcctcgtccgcaatcaagcctcccggcacgacgcccaccggacggtgacacagtaccgcgcgggcgggcctgggagcgccagttcgctcccaggctccagcgctgcaccagctccgtcctgcgggacgggtccttcagcagctggttggcccagtgcagggggccacagggagcctggccgggcgacggcagcgccttcgcgcgggggctcatctctcaacgcgccagagccctccgtcactcttgaccacctgagccggagttgggcccctccgtgtgcctgtccctgtccgagcggcgtgcgcatcgttgctcccagggaggagggccgccgatgccagtcaccggaaaccgaccgtggaacctcgccctcgggctcaacctgggctggatccagcagggtgcggggttcggtggccgacctcgagcggatccgcctgagggcgggtcatgcgggctactcccaaacccggtctcctcgcacatgccgtgggcaaggccaggtgcttcagaattgcccgcaccccgggggccccatcacgtacgccaagtgccttgagcctgcctccacacctcacgcaggcgagcgcgtgcgctcgccgtcttcgactggagggacgagcgcgtgcagacgctcagggcactagctcggccgtgagcgtgaatggggtcaccgagtgggggtggggccgccccctgccgtcgtggatgcaggtgattcgagagtctctggggctcgaaagggtggcggtccccgcggcagcgaccgtcacctggaatgccggcgcgccagcgtcagggggtgattctgatgctggaggtgttgttgttcatcgcgcccaggctcggggcgttggaagtcacggacagcgtgtcgccggcggagaagttgtcgttcttgaataggacgaccttcaggccctccggcttcaccgagctgatggtgttgttgtcgatgccgtaccgctccagctcggcctgggtgtactgaccaggaggcaggtccacctccttgccatcgaactgctctttgtagaagaacctggccctgggttgcacgggcacggacatgaccttgatgctggagacgttgttgttcagcgggcccagctcctcggcattggccaccacttcgatctggtcgccggtgaaatcatcgttcttgtagaggatagccttcacgccaggcggcaccttcaccgagctgatggtgttgttctcgatgcccagcgcctccagcttgtcccgcttgtattcgtcaggcttcagatcgacctgtttacccccgaaatcttcgttgtagaaaacggtaatgtttgccattgcagttctcctcctttgagcggtcccggcccattcgttgccagaagccgccggaagcttgggcaccgcgctccggaggagcaatccgcctacagcaccgcgcgggcgggcctgggagcatcagttcgctcccaggctccagcgctgcaccagctccgtcctgcgggacgggtccttcagcagctggttggcccagtgcagggggccggcccgccgcaccatctcgaactcggccgcgagcagggggatgacccagaacaggttcacgggcgagcctggaggcagcggtacggcgggcccctgtgcgatgacgaagtggcgcagccccaggagcgggtcggagacgacggcgatgtcgcccggcgcccaggctgactggctgccctcgttcgattgcatcagcgtccccagcgccgacagggccagggcgcgctccgggctgtgcgagtccatccacgccgccagctccacatgggcggcacctgaatcccgctttccgctcgcctgcggcacccagccgaagccattggtgacaaccgtgaaaccgctctggcccaggcgcgtgcgcacgagcacctcgtgcggggggagcgcctgcgaggccggaggtgcaacgtgggcgatggtgtcgcccggcaaggcgccctccagggcatggcggaaaagggcctggtacgtattgacgcccacgctcgaggagaacggcttgcccggtgccgacgcccgcgcccagcgggtgaagggctccgcggcatccgagaggcgctcgagcatcaggctggaaggctcaccggcgcggacccggtagctcatggtgtctcctccgaatggctcgggccaggagccgggctgcacgcccagcggcacctccaggacctcatccgcggagagcgggcggttctcgcgaaccatgcgataggcggcgaagtacagggcctcccggccacgcgacgtctcccacgtgtcccactcctccggtgcgagctggagatccggcagcccgaagctctccaggccgcgcagctgaaggtagcggctgccccggcggcgggagagatcgacccaggcgcggaacggacggtagtcggggtgggccagctcccggagcagccgagcgaagatcctggcgtccttcacgagcgagcccgcctggtgcaaaaccaccgccgtgccgttgagggcaaggcgtgagaccaacagcgagaagacgcgcatcacaccgtcctctgcccacgggtccggcctggcgccgcctcgcatcggctgctcctcgccctgacgcgaggagatgccggaagcgagcgtcaggtagcagccctcccgtggaaggttcggaaactgccgcaggtccaggccctcacggggcagggggccgtttcccctgaagacacgcacggtgtgccggccgttcgtgagccggactccctggccgacctccacggtgaagcccagttctgccaggcccaggctcaagagccacgcgcctggagcctccgcgaggccgggcaagggctccgcgaagaggaccgaggcatgagccagcgggcgaggaggcgagagtcccgccgggccctcggcaatggggatggcgtctggagaggagttcacgagagcggatcggggatcgtgcatgagaatggggacacagggagcctggccggacgacggcagcgccttcgcgcggggctcatctctcaacgcgccagagccctccgtcactcctgacctcctgagccggagttgagcccctccgtgtgcctgtccctgtcagagtgcgcctgagtccgccgagcttcgtctatccgcggcccgtggcgacgccgcgggtttcttccatcagtcggagcaggggcgcctcatccagggagtcctttcccagccccttgcagcaaggtctgccccagtcggcgctcttctgacgcatcagagggatgggggccctgttgagggggagggagggtgccgaggggccgaggagggccgctgacggggccgcccgagtgatgctccaggccggtggacaggccgcgcaggacctggacagccagatgttcctgcacgacggcccggagaaggagcggttcctcgcggatccgctcatcacccacgagaagctgcccgcgcgctccgccaaggcgttcatcgcccccttaaaccgcccaaccccagcgcatcatcagtaccgcgagcggctgttgtctttgacctgcgtattgatccaggaacggaactcagagacccgggcatagacaccagggaagcccggcctcgcgcagcccacgccgaagctcgtgattccgtagagcacgtatcggccaccgacctgagcgaccaacggccctccgctgtccccctggcagctatccttcccccctgacatgtacccagccccgagcattacattgggatcgatggtgatgccttctttcttgtacgcagtcttcagggtctcagagttcacggtgggaacccacacctgcatcaagatggaggatgtatcgtatcccccctccctgataagaccccatcctgcggtcaccatcatcgtaccatccgggacatccgcacccaccgacgagagccccacagggctgagcgacgtttcagccaacggggacttcgcgaccaggttggggcgcatgacaacactgctcttgccgcacgaagcaccgctcaccgagaacgaatcctccgggagacacacaggctgtaccgtggaggtgaacttgatgggcttgtcgagcacgacaaccgcgacatcgttcgccgtcgtatccgggttgtactctggatggtagacagtctttctcgcgacgacagcctgctgcgaggacgacgggcgattgaaatcatgagccccagcgacgacagtcaatccggatgttccgtcgtagacgcaatgggcagccgtgaccacgatatcgctctcctccttgttgccaaccctgatgagagaaccaccgcagaagtgatcgttgtattgctgcaggctgacaatccacggatgactcccaggacgtgcctcgacccctcccacaatcgcctggtccatgcgacccgtcgcttcgacgtcctgcctctccagctccggaccaccacatcccaacagactgaccgcgacaatcactccactcacgaagcgcaatgcgccctccttgctcatgagacacatgccaacagcaagccacatgccatgcctcaaccaaaggaatccctagcgcattcgactcacggcgcgccgttgacacgtcagcgagctctcgcagagatgggatgacgcgtcagccgtccccctctctgccaacgtgagtgagacagttcgtacccagcagtttagtgcgcagggcgacccaggcaggaacgatgagcctgccccggctccgtggacacccgagatgtggtggaaagggtgtccgatgtcggcaagtgacgcgagctactacgcgtgggccagccggccggagtccgcgcgcgaggcgaaagacgattcgttgacgaaggtcgtcgccaccgtccacgaggcgagtcgacgccgctacggcagcccgcgcgtgttccaggagttgaaggcccgaggctcccgcctcagcaggaagcgggtggcccgtctgatgcggcagaagcggctgcgcgcccggcctcgacgccgcttcgtgaaaacgacggactcggctcatccgcaccccatcgcccccaacgtgcttgcgcgcgacttcttcgccgacaagcccaacagcaaatgggtgggcgatatcacctatgtctggacggcagagggatggctgtacctggccgtcgtgctggacctcttcagccgcaaggtggtgggctgggcgatgagcgaccccatcgaccgtcagctcgtgctggccgcactgagcatggcactgctcaaccgccccgcgcaggacctccaccactcggaccgaggcagccagggtggattcaacgggtcgtcgcaacactcgacgttgaggagttgcgatggggaacaacaagagtcgacgggctgaccgtgctggacgcccgcctatgtcgtcgcctgggcgtccgccggtgggacggcgtgagcaccgacaatgattctgggaagcaatcgcccgcggactttcgagcgaagatgctggaagggtggccggcgtatctccagtggtgggatgcaggtggttccgagagagtggaggcatgccgtcacgaagtctggccccgttgtcggggcggtacctgtcgtttgccgagcgagaagaagtcgcgattttgcacgcccagcacgttgggattcgcgcgatagctcgccggctccgtcgttcaccctcgaccatctcgagggagttgcgtcgtaatgcggcaactcgtggcggtgccctggagtatcgcgctacgaccgcccagtggcacgcggaccgacgtgcacaacgcccaaaggtcgcgaagctggccgcgaacggcgcgctgcgaaggtacgtgcaggagcgactggccggagtacttaccgctactgacgggacggcagtgcccggcccagaagtgcgatggaaggggcggcgccacgggccacgaaaagaccgacgttgggcgaccgcctggagtccagagcagattgccaacaggcttcgagtggacttccccgtggatgcgtcgatgagggtctcccacgaggccatctaccaggctctctacgtacaaaaccgcggcgcactgcgacggcaggacatggttccgaagcggtccgaggtgccatcacctcctcgctcacaacgttgccggagcggatgcgccggacactcacgtgggaccaaggggccgagatggctcagcatgccctcctgcgcgccgacacgggcttggccatctacttctgtgacccgcacagtccatggcagcgaggcacgaacgagaacaccaacggactgctccgtcagtacttcccgaaagggacggacctgtcccgctactctcgtgcggagttggccactgtcgcccttgccctcaacagccggccacgcaagacgcttggctggaaaacacctgccgaggctctcagttcttatctatacttacttcaaccaaacggcgttgcgacgaccgcttgaatccgagcagtacgcgagcgatgactaccgcgagctgctgaagcagcagggcattacgtgcagcatgtcaaggaaggagtggcccaagaccctgcgcccccgtgtcccgcccattctgttcgccccgtggcggctgggcgtgaagtgggccctgaacttccccaagctgcgcaaggtgctcgaagaggacgtgtacccgcacttcccgcgcaggtgaggcgggtgtgagcgccccgcctcacctcgcttcgcgcgcaacgcctcgacgaggggctgagaaggcaccacagcgttgccgcccgcggcacgacggccagccagccattggaccaggccatccaaacaaagacagccgatctaagtaccatccctgatgggcttttctgaaaatttccaaacaaacaacatacaacaacaccagcgcatgagcggacactcccaggcacaattcctatttactcccagtgaagttcgggattataggatgtgccggtgcttcggcacctaaacaaaggggtgatgctcacgtgagaatcaaattcgcgcatctggtgttcgtcgctctcctatcagcgtcttcgtccgctctcgcgcaagtcgagacccgatgcttcaacgacgaccagatcatcaatccagtcgacgcccagggccgcaacgcctgggcgcgaaagtgcggctatatcgatacccggcgtgaagcgggctacaactcatttggcgactacgtcatctttgccaatggttgccacatgtaccccaatcacccgaccgggactgcatgtaccttccgcgtccctctcaccgagtcggcgccttgcctcaccttcacgccagcgctcctcggaacctgcgtggtgggatgctataccgcccgcgaagagcttcggttcgacgataggtattggcccattgaggatgcaccccaagggggcgtcacgtccgttacggccctcacccagaatgcaaccctattgcggccggagttcgccgagcagcccatccaatcctatgtggcgggcgacaccgtggaagacatcttcgtcctccagacggcggatggccacaaggtggaggtaacgtccgaacaccccatggtgaacggcgatggcgtcatggtccgcgccaacacgctcaaggtgggcgacaccctgctccgggtcgacggccgcaaggtcgatctgacccaggtgtctgtcttccgctacacgggcaaggtctggaacgtcaagccccagagcaaggtcaagatggagaacgttctggacgtggaggggctgatgaccggctccgtccgtttccagaatgagtgggccaatgactacttccggttgacggttcgcgaagcgctcgacgtcgacggactctgacccattcccttctcatcgcatgctgtccgccgtcagcgccgcctgacggcgagacggttgcatgcatgcgttccgcgccggcgtggcgcacgccacccggcgcatttcctggagtacacctgtgcctcagacgctcttcccttcctgcatgactcgcggattgcgtgtcaccctggtggtagccccgctcttcatgaatgtggtgggctgcgatagcgataggaacgccctcgtcccgatccaggattcagggggcagcatcgtcctgcctggcgacattccaacggacgttcaggagtaccactacgccttcaacctcggcacgcgcgaggcgcactccaagctcaatctcaacgtcgcgcccccgggcggggattgcgtcaccctgcatgcccccacgggaatcagcgacctccgctggaacggggcagcgcccgtcgatgccgagcaggatggcggctcgctccgcatctgtggcccctcgctttatgcgggacaaatcattctcgaaggccgattcctcgtcccggagcaaacctacgacttcacaccggtaggcttcacccggacgcaagctcgcgacaacacggtgttctcgtacctgctgggctgggtcgagcagtgtgatcgtttcgggttgtgcgacgactcccccgcgagccaggcgagattcgtgctcgacgtgacccacgcccgcggcgagctcacgctgtgcccgggacaacggacgcaggtgagccaaacccatacgcggtgtgagctcttacagacgccggcgcccacctactcggccttcgccatcgcctcgaaccctggttggaaccgcaccgagtggctcaatgtcgatggaacgaagctcatcttcttcgaaacccagagtgggcggctcgcccggtcactctccaagccggaaatgaccgactttctgaggtgggccaagaatctcctgggaccgcttccgtatggccaggagctgcgcatcgcaggcgcgccgacgcattggctgggaatggaacaccccgccaacatcattctgcgtgacaccctgcccgacctccccaacagggagtacgcaaacatgacgcgtcacgtcctcatgcatgagatcatccatcagtgggcgggcaaccgcatcaccatggcgcatgccacggacttctcctggaaggaaggcatcgccgagtacctcacctacgtctacgagctgtcgaagtggcctgcggatgccgccaagacacgcgcgcactgggatcgcctggcgcgcaccgcgatgtactacccggggacgtctgacaatccggtgccgttcctgacgttcgcgggagagacgtatggcaccggctccatgatcttcttcgttcagctcgaggacctgctgccaggcggtcaggagaccatcgtccgcgccatcacggacttcttgtccgggcccccccgtgcacgcagcgtggcagagctgcaaggcgcgctggagcaggcctccggagaagacctgggcgactacttccaggcctgggtctacggaacgggagacgccgattggcccaccttccagacggatgcagttcgagccaacggagagctgagcctgaccgtgacgcagtccgccctgcaacctgggaagctctacccggcgaaggtggtgatccggctgaagggcgacacccaggagctggacgtgcccatcgactttggtctgcaccccacgacgggcaccatcaccgtgtccgtgccgttcgaggaagacgtcaaatcgattggcgtcgaccctgagaaccgggtcgtgagctggaacgccaatgccagcctgtctccccttgaagccccccctcaacactggatcttctaggccatccgaggagccttcatgcaaagcaatgctcagccccaccgcaaggcgtttgctggccgatgggcggcgcccgccgtggctctcgtcatcctttccgcggcagcgctctacaccgcgctgatgcgaggacggccaggaacaccgcctcccgatgatggcatgccgccgcgccccggcgcctccagcggcgccctggccggggagccggctcgaatcaccgccaaggccacggtgcccaccagcgcgccgccaggccgcgagctgcgtcccctcacgcgaccgcttccaggtgaggcggcgccaccacctgcgcccgataccggtatcgaggagacgcgccgggatgccatccagaaggccgcgcgcagctatcgggagggccgcttcaacgtcttcttccgagaggaagccttcatccaggagctggcgaatcacggggtggaaaatgtcgcggcgctacaggacgcgctcgccgacacccgcagcctctccgcgcttcctgatgacacccgtttcaccgagcaacgtccggagacagtgctggatcgcatggccatgatcgatctgctccacacgctcgcaccggaggacgactcggcccgtgcggcaatgcttgccctcgcgacctcgcccatcgacccttccttgtcggacgtcgccaagaaggggctcgtgggtgagaagtacgacctcttcttcaaactggcccagatcgaccggcaggccgcggtcgacgccttcgggcggctggacaacccgaagcttcgaagcctgctacgcgaagcgctgctcgcggggcttcatgagtcgggcgcttcgtatgaagaggtccagcgactgacgcggcacctctgagcaggaccggttacgagcgttgtccgctcgcgcagcagccgcccgttgagtccgggcggtatccccactcaggccaggtggtgtcttccgtctcggacggaacgcccttcgagtgtactgggctcgagccctagcagagcaggcccaacctgaagcaagggagaacatcctgactaccaactggactcgcagtctggcgggagtgtgcctcgttgccctcggttccgcgtgcggtgagttgcccgacgcggggagcccgggctccgcggatgtgtcggaaatggggcaggcgaacatggagctgggcaatggctccgccatcatccggggacggctcggggccatctccgcaccgcagtccctctccgggctgcgcggccaggacctcaccctcgccgcggaccaggcgctcaagcccgtgctcggaggcgttgcctcgcggttcggactgagccccaaggagctacgcgtccgctccgctcgcgtggatgaggtggggctgactcacgtcaggtatgaccaggtgcgcgagggactgcgcgtggtgggtggagagctcatcgtccacgtcgacacgtccggccagatcttcgcggtgaacggctccgccaggggcgcccaggctccgagctcgctttcgcgcgtctctcccgacgcggcgatggcggcggccgtcaatggattgcctgacatgaagtcgatgggaaccacccagttggtgtacttcctggatgcccagggctcactcttcctggcctacgagctcgtccgcgagggcgagcgtggcgacgcccccgcgcgcgacaccgtctatgtggaccccgccacggggagcgtcctggacgttcatccgcagtaccacgccgcgcagaaccggcggatccactcggcgggcaacggcagcaacctccccggtacgctgcgacgccaggagggcggcgccgccaccggtgatggccacatcgacgacaactacgaccacgtcggcaccacgtaccgctgctactcgaccatcttcgggcgggattccttcgatgacgctggcgcgaccatcaccagcaccgtccactacggcagccgctacgtcaacgccttctgggatggccggcagatcgtcttcggcgacggggacaacttcaactcgggcgagctggggcgcgatctggacgtcgtctcccacgagttcacgcacgcggtcacgcagtacgactccgggctcgtgtaccgcaatgagtccggcgccctcaacgagagcctgtccgacatcgccgcggccatctgcgagagctgggcgcgcggcaccgtggacgcggacgtctggaagattggcgaggacatctggaccccgggcacgtcgggcgacgccctccgctacatggacaaccccacccgggatggctcctcccgggacttctacccagagcgctacgtcgggactgccgacaacggcggcgtgcactggaactccggcatccccaatctcgcgttcaagctgctcgtgacgggcggcacgcaccctcggagcaagacgtccatcaacgtgtcaggcgtggggatgaaccgcgcagcgcagaccttctactacgcgaaccagttctacttcacggccaacaccaccatggcccaggcccgagccctgaccatccaggccgccgcggaccgctaccccactgacacggtcaacgccgtgcgcgatgcctggagcgccgtgggcgtgcagtgagcgccgcgccccatcattcccagaggccgaacaaaggaccgaccatgaaaaagaaccttctgattgcgattgcagtcaccgccgcagccttgtccagcaccgccttcgcacagctcgaaacccgctgcttccaggacgaccagctcctcacgcgggaactggcagccgggcgcaacgcgtgggctcgcaagtgcggcctcatcaccgccgagcgagaggtctacctgaacgagtacgccgagtatcaggtgttcaccaacggctgctactcgtacccggccgtcccggcgggctcgtcgtgcaggttccacgtccccgccaacgaatccgccaactgcatcgccgggctgacgcgactggggacgtgcgtggcggggtgcttcacgccctcgcagcgcgtggacttcggtggccggcaactcccggtgcccgacgcctacgccgcgggcacgacgcacgtgacggcgcttaccgcggacgcgcagctcggcgcgctgaccttcggggaccaggccatccgctcgttcgtggcgggagacacgcaggaggacatcttcctgttgcagtcctcggacggccgcaacctcgaagtgacgtccgagcacccgatgctcctcgccgacggcaccatggtgaaggcccataccctccaggagggagacatgctcctgggctcgaacggcctcaccctcttcctgtctcgcgttaccgtcttcaacttcaagggccaggtgtggaacgtgcggcccgcgagcctcaacaagaccgagaacgtgatgagcgcggaaggcttcctgacggggtccgtgcgcttccagaatgagtgggcggcggacgcctatcgtctgtccatccgcgaggacgtggacgtcagcggtctataggccgagtgtcccggccggnccacncaangnatncntgggccggccgggacgtgtcctcagcctacagcggaatctccggcactggacagatcttcccaacgcagggccgcccacaatcgctcgggcaactccagcggtcttcgcccaagccacagatgccatcgccacagaagcttccgcagtccaggtagcatgtataggcgtcctcaccgccattgcagacgccatctccgcagagggtgccgcagtcggcgggacaggtagagggggtctcgttgttgttgcagacgccatttccacactgcgcgggacagccacaatccatcgggcagcggtcaacgctctcgtcgccgctgcagatgccgtctccgcactggcagtccgccggacacgttgcttcattctcccagaggccacaccaaccattcccgcagtactccgcaactccacaatcctcgggacacgtgaggaagtcttcccccacgccgcagatgaagtccccgcagacgcccagctcaacaggccatttcacgaggcccggcccctgagccgtctcgccggcggcttgcgcgtgagggtccggcggaccgcaggcctgcccagcctcagctcgcgctagcgtcagcgcctccgcgtagcaggtcccgatcttgatgaggccagcgacacagggagagaacgccgaagccgggacgaagttcgcgcagtttgaattgcggcccgcgcaaggatatttgaagcacccgttgctgaagatttgataggagctcatggagttcagcatcgattcgcgcgcggcgtcgatgtatccgcatttgcgagcccatgcattcctgccaaccacctgatccggcagaagcttgtcatcgtctccacagcgtgtggcgacctgcgcatcggtcctgatgggtatgaagatcaggatgcccatcaacacccatatcgttctcttcatcgtctcctcctcgaggcacgtcgaagcggattcacgatgggcgaacacaaccatcacttcaagaaaacgattgcattctcaggcgtcgccgaaggcttgctgaatgactgcgtcgacgatcttggcggagcacagcaccgcgggcagtcctgctccgaggtgcgtccccgccccgaccaggtagaggtggtcgacgtcttcgctccgcgcttgcgcccggaggaacgtggtctgcatcaacgtgggcgcgaagctgaaagccgcccctctgaacgagcgcagctcgtcgcggaagtactcgggcgtcaccatccgggatgtcgccaactgcgcgcgcaagcccggcagcacggtccgacgcataagagagatgggggccctgttgagggggagggagggtgcagaggggccaacctcgcacatcccgtgggcatgcccaggtgctccagaattgcccgcaccccgggggcccccttcacgtacgccaagacccttaagcatgcctccacacctcacgcaggcgaacacctcgaagtcgaacgtcctcctgagcaactctgcccgccaggacatccaggccacgcccgccatctccctgcggcccaggcctggcgtctgggtcacggccacccggcgctgaggctcaatcgttgcagcagacacggtaggcgccctgatagggcggcccgtccgtcgccatgcagtcatcgccaatggacttcacgccgccacgctccgcacagaaccgcggcgcctgctgacgcgacatcgcacaggcctcctcccgcgagttgtacgtcccccgagcctcgacgtaggggcatggcttcgccggcggctgtgccggaacctgctccgatggctgttcagacgccgacggctgtgccagagcctgctcaggcggctgcgcagacaccggcgccgacgtcggctcgggcttgacctcgggggcgacgcttccgcacgccatcatcagcagtcccacggccacgcccccgaataccctgatgcccagcttcatgtgccagccctccctgtgctcacggtggtggaaacgtcggagcatacacgggattcatcgccggtcctgtgctcctggaaacgctggtgcccagtatccgtgcgcatgagtgcggcttggcagccccgtccgcccgaatgcaagacaagcaggcccggtgtgcttcgcgccattcgagttgcatccccctaccctgtccggaacatcgctcgcggggtaagcgaagacaccgtggaacctcgtgaggtttgcccgaggcgaggcggaggcaccagggacgccaagcgacgcagcaactccaacccggtgaagagcaggtgcgtggtgccgtccggctgcgagtgcttcatccgctaggcgatgcggccgtcctccactcgtccgtgagcgggcaggggcacagaccggccaggccgctgcactgcgctctcccgctgccacttcccagcaccctgccggtccgtaacgagcccggcctccatcatccaccgcccacagcaacaccaagaggcctgcatgtggtggccccgcaggtgcggggtgctcctgctgtcgatactgccgatgacgagagcggccacggaaccgcccgtccccgaggcccccccctggcggcctcatgcagcggaagtgacgggggctgatttcagcagagacatgtcgagatgcacggtgcagcgctgcaaccacgcctccgacagggcatggagggcggcgccaacagtccctccttcccgtcgggcgacgcgtgtagcggcccagcactccccccgcgctgccactgcgcctcgtgcgtggaaccaccacgtccacagcccccgctgtcgtcaccaacgtgcgcaggtagttgccattgcgcacgcccacgcgccccaccatcggctggtcggattgcaccgcttcgtgcgcggggggactcacttatcgggacccgatcgcgccacgaggctggcctcgcgagtaggttgtgtgcgttggtactcctagacccaagctccgagacagacatgcaccgaagtcctggctccatcctcccgtcccggggggcctctccgcgtcctttcctccccgtcaacgtcctgctggtgtccgtactgctggcccttggctccggctgtggcgactccgaacccgacaagacgaacgactgtccgaacccgtccgtcggctgcggccagcaagactccgggacgcccgacgcgggcgcccccgacgccggcaatccggacgcgggcatccccgacgcgggcgaccccgacgccggcaatccggacgcggggcatcccgacgcttgcaaccccgacgcgggcaatcctgatggcggaggccccctgcccaccgtccccaccctcatcgaaagctcgcagtccgcccaccaggtatcggccgggcagacggtcaccttccacgtcaccggaagggatgacctggcgtgcccgcttcagttctcctgggacgccagctcgggcaccctggggagtccggagacctccgccgcgacgagtgatgtgacgtggacagctccgcactgcgtgctctggagctccgaggtcaccatcaccctgaccgtcacgaacaacgcccggctctccacctccaagtccttcacggtgtccgccccgcgatgcccgggccccgtggtctcgggtggtgtctcacactcgctggccattcgtggcaatggcaccctatggagctgggggcacaactccttcggccagctcggcgatgagacgaacgccacgcgccacgcccctgtgcaggtgccggggttgaccgacgctacggccgtggcagggggccacgcccactcgctggcctcacgcgccgacggcaccgtctgggcctgggggctcaacggcggcgcgctcggtgatgggacgacctccacccagtacgcccctgtgcaggtatccgggttgaccggcgccatctccgttgccgcgggctccagcttctcgctggccctggacgccgacggcaccgtctgggcctgggggatgaacgggagcggcgagctcggcgacgggacgaccaccgatcgcctgaccccggtgcgggtgtctggcttgagcaacatcaccgcgctcgccgcgggcaccggccattcactggccctcggcgccgacggcaccgtctgggcctggggactcaacttccatggcgagctcggcgacggaacgaccgtcagccgccccctccccgtgcaggtgcccgggctgaccggcgtcatcgccgtggccgcgggcatgtaccattcggtggccttgcgcaacgacggcaccgtctgggcctgggggtggaacctgaaaggtgagctcggtgatgggacgaccacccagcgagagagccccgtgcaggtgcccggagtcacaggtgccatcgccgtggccgcgggtggctaccattcgctggccctgctgagcgacaacaccctccgggcctggggcaagaacgaagatcgccaactcggcgacgggacgaataccgaccgacataccgccgtgcaggtctccgggctgaccggcgtcacgtccgtcttcgcgggcggcggccattcactcatcctgcgtaacgaccaggcagtgtgggcctttggctccgatgtttccggccagctcggagacgggaacacgccgtccggccacggtcccgtccaggtctccctaccgtgacaccgtgagggaagccggtgcccggcggtggaaccgcgagtccgccgccggtgcccctccggcgcgaggtggcgcaccgcatcgtcattcgatgaggcgtggcgggggctcaacgactggcgaaggccttctcgatgaggaagtcgccgcgctcgtgtgagtcgccttcctcgaagccgaagccttcgagaatggtcgcggtctccttgatcatctcgtggctgccgcagatgacgacgcgatcgtgctcgggtgagagcggcttcgcgcgaagcaggtcggtgatacggccctgattgcggaacggctcacgcgtgaccgtcggaaagtacgtcagcctctcgcgcacgagatcacccaggtacgggtcgttcggcagtacctcttcgaagaacttcgagtacgagaggtcgctcacgtggcgacagccgtgcaccacggtgacgcgctcgaagcgctcccaggtctcggggtctttcaccatgctcaggaacggcgcgaggccggtgccggtggcgagcatccacaggtgacgacccggcctgaggttcgcgacggtgagcgtgcccaccgccttcgtgcccacgagcacttgatcgcccggagcgaccttctgcaatcgcgaggtgagcgggccgtcctggagcttgatggagtagaactcgagcgtgtcgtcgtagttcgcgctcgccatcgagtacgcgcgcatgagcgggcgaccttcgacctcgaggcccatcatcacgaactgaccgttctggaatcggaagccgctgtcgcgcgtgcagacgatggagaagagacggtcagaccagtgttgcaccgagagcacacgctcggtcgtaaaaccagtggccatggttcagcctagctccttgtgagtggtgtccccattgccacgtgcccgccagactgtcgtcctttttgccaatgcattggcacaaggccaacaagatggcacacgggtcattcgcggcgccgtgactccgcggaagtcagcccgcgtcccagctcgactgcctccagcaacagtgtggccagattccccctcatggcgccgccctggaaggcaccactgcccggcccacgtgagggaccgggcaatggcggagaaggctagaggccgtcgtggtagcagaagccgtggccgcggtcgaagccgccaccggagagcgcgtagttcatgtaacccagctcatcgcccgggccacactcggagcgggcgcggtggtaggggtagcactcgcccttgccgtcgcggttcaggtcggcacacacaccacgcgcgccctcggtgccacagtaatgcgcgaattccaggctgcagatctcaccagtcagcgcggggtcgaacgtgaagccgttctgctcgaggacggactgctcggtgcacaggccgtacacgccgcacatggtgccggaggggcagccggggttgggcgccatgaagtcacacgtcttgaggcactgggcgttctccgacagcaggtcggtgcaggcgaagccctgctcgcaatccgtcgaggccagttcggactcgctcgccgccgcggtcttcgtgcaggcctctccctggacctgggtccccagcgcgcgctccagcgtgccgtcggaggcgacgtagtcattcgggacgcaggtggtgtccggcaggttcgccgtcagcgagccctggcgagggtcgcacccgtcctggcgcaccgtgttccacgtcgcgaagcgaatccaccggcactcgccgcccggaaccaccgcgctgccccagtacggcgcgttgaggggcggggcatccaccgactcacgcagcgtcacgttcgtcagcgcgccaagggtctgctgcggcgacaccttcacggcgagcaggagcgtgcccgcgtcggcgacgaagaacttctccgcgggcgagccctcatcctggtagccgaagacgcagcgatcacaggtgaaggtgttgcctccacccacggacaggtcatacacgccgggcgccgtgttcacgtccaggcggatgcgcgccgggtccgggaacgccgggtcgccaaagttgttgaagttgccgcggtacgtcggctgcggtgagtacatcgtcggcgtcagcccgatgccgttggccagttcccccatcgtgatttcggtgcagcccgcgggaggttggagctgctgcgcctgcgccttcacggcctcgatggcttcctgttcgggcgccggcttccgcgcctcctgtccacagccaaccagaccggccagcagcaccgcgctccaccccattcccttcacgttcgctgccttgacaacagggaacgacatatcgtgtctccgattcccctcagacgatgtctgagtttctctgcccggacgcgccgggacctggtgaacgccaattcacgtgatgtaggtgaagcagcgctttggccgtcaacgggcgagatggacgttcgaaaagcagggatgccggcctgggcaatagattagcgaacccccttcacaagtcgaaaaccatacgaagcgcaagcaggcggactgttgcaacggtattaaaaaagaccactgaagaatgacatgcgggctgtgcgccgggccggacgcctcttcgcctccgccgcggtgggagcggcggtgggggcgttgccgagctcgcatacgtccgttgtcagcaacgcccgtacgtccgtgcgcagaacgttgcgcccgcgcttgagccgcgaggcgtccttcaccagcagctccttcagcctgcgctcaccatccgcgacttggcgacctggtcatgggcgaggaggcgttcgggagcatccggcagcgtgattcgcagcgccagcatgcggcccactggcggcgcgcggtgcggatgggaatgtcgctccctgttccaggaggatgtctcggagcaagtcgaggcgccgttgctgctcggcactcggggcctgaagccgctgcgccccacgagggcggtgtacgccttgggggtgcgtgcgcccgccgtacccaggagccgaccacgctggagaacggccacgttctcgtcctcccaatgccatttcaagacatagcggatctttagagctagccgcccatgtccacgcttccacgattcaatcaagaaccacgcctgaacgttgaatacacgacgcagcgcgccgcccctgatgcggcggaggcgggacacgtcgcgcaggcgccagacacctcgaagcagccacatgtgcaactggcgatacatttgcaacgcgcattcgccacacaaacagtgcgggccatccgtcggagcagcagttccggtttctcaccgctccgtggcgtgtatcggcccggattcccgttgaaatgcccgttccagcacgagtcagacacctcgggcccgctgccgcgccgcacgctgcgagtgaatcagtttgtaatcaacgacgctcctgctaatcgtgtgtagcaactttgcgaacaggccgtgacgaatgcggccctcgtgacgggcgcggcgcgcccggagcgacggtcccatggggggacggggtcctgcgcgggaaaccggcagtacagccctccatggtggtgggctacctgccttggaaaggtggcacgcatgattcgtggtgcatcgctgaagagcagtcgtcggaccgtcgcccccactcacgaccggaagcgtggcgtgatgctgggtgcgttcctgctggcgggagcagcctcggccgagctaccggactacacgttccagttgcaagcgcgcaccaacctggccgtcaacacggaggagggctcctacaacgtcgaattgggcagcctcacctccgccggcagcttcttcattcccgtcaccgcggaccggcaggtggccttccagctcgccatcacgcgggagggacgtccgggcgtctggtacggccagaacggccagggcggccgcatctacctgctccctgacggcctgggagcggatgcacgccttggcgaggtcagcctcaactcgcaccggcagttggtcttcgccgtcaccgggacgaatgacgcgtcgaagaacggcatctacgtgctgaacgcggacgaaccagacgcgccgccgcagatcgtccgctcgccgctgggctcctccagttggtccagcctggtcatgaacgaggcggggcagatggccgcccgagtcacgctgagcacgggctacgcctacgtgctgtacacgcccaatacgacgggtggcttcgacgcgaaggttctcgctgcggagaagtacgtcgacccgggctacccctacacgttcctctactccccgggcgcgaacgacctggggcagatcgccgcggcggtggacctgcaagcgcccacctccagcgcctggtaccaggagctgcgcatcttcaacccggatgggacgtcgcaggtcatcgcggacacgcgcgggcacaacccggactccaacatcttccgcttcgccgccgtgcagcccgccatcaacaacctgggccaggtggccatccaggccacgctgctggaggcggctgggcggcagagcaccgccatcctcctgtgggatggcaacgagctgaaggtggtcgcgcagaacggaatggacgtgccgggcgagcccggcgaagccatcgggacggtggaggtattcccgcccgacatcaacgaccgcggacacgtggtcttccgggccacgcgcaagtcggacgggttccgcgcggtgtgggtgagtgacggcgagaacttgaagcgcgtggtcaccgagcacgacatcctcccctcggacaagggtgacgcccgggtggatcaggagaccccctccaacccggtgttctccggcatgccgagcatcaaccgccacagcgacatcagcttcggcgtgggcctggccccgccggagacggaccaggtggaatggggcaccgccctctacatcgcccagtcctcgctctggacgccggacgccccggacgcgggcaccgaccccgagcccgacgcgggcaccgagcccgacgcgggcaccgagcccgatgcgggcaccgaccccgagcccgacgcgggcaccgaccccgagcccgacgcgggcaccgagcccgatgcgggcaccacgcccgatgcgggcaccaccccgccggacgcgggcccgggcacccccgagccgcagcccaacccggagtcggacagcggctgcggctgccagtccacctcggccgccggcctctggcccttcgcgctcgcgggcctggcgggcctgacgcgccgccgctcgctgaagcgccgcgagcagcccccgcgcgactgacgccctctccctccctttcgcaggggcgcgcccgaaggcggcgcgaccccgcaaccgcttcgcaacgtcg

SEQ ID NO: 1254 - DNA, 29559 bp, Myxococcus xanthus
cacgcgccgcttcttccaggacatcgacgaggcgcacctgcggcgggcgctgaacgcctttccgggcgagctgctggtgctgcatgcgccggcggaccggtacgtgccgctcgagcacgcccggcggtggatggccatggcccgccgtccggccagtctgatgctgctggagggcgcggaccacttcctgtcccacgacgcggacgcgggccatgccgccgacgtgctgggggtgtgggccgcgcggcaggtgacaccggtgcgggagcgtgaggcgcccctgcccccgggcgtggtggaggtccacgaggcgggggagggccgcttcgcccaggacatccgcgtgggggcgcaccggctgcgctcggatgagccgctgtcggtgggcggcgaggacaccggccccacgccctacgggctgctgacggccgcgctgggggcgtgcaccgcgatgacgctgcggctctacgcggcgcgcaagggctggccgctggagcatgtccacgtgcggctgagccacgagaaggtgcacgcgaaggcgtgcgaggagtgcgagacgaaggacgggaagatggaccggctgcaacgtacggtgaagttggagggcccgctgacggacgcgcagcgcgcgacgctggtggccatcgcggaccgctgcccggtgcaccggacgctggcttcggatgtggatgtccatacggacgtggagcaatgagcgccccgggcacacgcacgggctggtagggtccgccgcatgatttcgagtgagcagcgcttcgtgtggctggacctggagatgaccgggttggacccggagacgtgttccatcatcgaggtgggcgtcatcatcaccggtccggatttgcggcccatcgcggagattgagcgcgtcatctggcagccggaggaggtgctcctgcgcatggagcccgtcgtccgggagatgcacacccgcaacgagctcctggagaaggtgcgtgcctccaacacctcgctgcgcgtggcggagcgggatgtcatggcgctcgtcaccgagcactgcgccctgggcgagggcatcctcgccggcaactccatccacaccgaccggcgcttcctcatccgctacatgccgctgctggagcgctacctgcactaccgcatggtggacgtgacgagcctcaaggtgttgacgcgcgcctggtatccgaacctggtggagccgcgcaaggcgcccagcgggcacaccgccctggcggacgtgcgcgccagcatctcggagttgcagtactaccgcgacaccctctttcgcgggacgccggcctaggcgttgggctggggctcgacgagcagctcggcgatggtgtcgagcagcacgtccagttcgaagggcttggcgaggaagcgcgcgctggagcggcgctcctcgtcggagatgcggccggcgctcatcaccaccacggggatgtctcgcaggccgtcgtcctcgcgcatgcggcgcagcatctcccggccgtccatgacgggcatcatcaagtccagcagcaccaggtccggcttcgcgtccgccatgcggtgcaggccttcggcgccgttgaaggcggtgtcgacgtcgtagccctccacggacaggatgtcctggagcgcctcgacgatggccagctcgtcgtccacgatgagaagccgcttcatacgccacgccccccacgccgggatggcttgccgcgccggaccggtttgctccctgtcttgcgtttcggcttccgcgggggcgccgcgtgggacggggcctgcccgttgaagagggcctccgcgctctcgctgtccgccgcgacttcgatgccccgaggcgtcatggagaacagtcgctgggccgtgtcgtggtcgctctcccgcgccttcaacacggagagcacgcggtagttccgcgagcgcagcgccaccatccgcagcaccaggacgttgtcgacgagcgcctccacgtccggccgcgcgtccgcctccggtgtggcgagcgcgcgcgtctgctggaggaccagcggggtgacgcccaggttgagcagttcgtgcatgagggcggcgaggaattggggcgtgcgctcggagtccgtgagttcctgacagaaggactccagtccgtccagcaccagccgctggatgccgtgttgtttcacccacccgaacagctcctcggccagcgcgtccggttgcgtctccgccgccacgcgcgacaccaggtggacccggcccgcttccacgtgcgcgcccaattccagccccagccgctccgccttgtggaccagccgggccggcggctccacgaagccgaggtacagcccgggctcttgccggcgtgcgccctccgccaggaagtgcagccccaactgcgttttgccgcagccgggcgggcccgccaccagcgtggacgaatcccgcaccaggccgccggagagcatctcgtccagcgcggggatgccgaaggtgagccgcgcgtccgtcgagggcgtgcgcgtgggcagccgcgtgtagagggcttcgatgcggggatggatggacaggccgttgtcggaaatctcgaagccgtgacggccggggacctggggtccgccgcggaacttcgtcacctcggccaggcgcaccgacttcacgcccacgcgctcctgggccagggcgacgacgccgtccaccatggcgtagcgtgggtcggacgggtcgccgcgctgcccggtgagcagcagcgtggtgcagcccgcgagcgcgttgtggacgcagaggccgtggaggaactcccggaagctcagcgggtcctcggagcgctcctccatggccaccaggccgtccaccaccagcaccgtggcgccgtgctcgcgcaccgcgcggaagatgagcttgctgaggcccgccagcccttccgccttgagggcggcggatccgctttcgtagctcagcgcgcggccgacctcttccgcgtggaagaagcgcatgctccgcaagtgcagcatcatccgcgcgtgggattcccccagcaccgtgaggtagatggcacggccaccctgggccacggtggcgaagcagaactggttgccgaggatggtcttccccgtccccggtgcccccgtgatgatgtacgtgcctccgcgaagaaagccgccgcgcaggagcgcgtccagccctggcacgccgctgggaacccgcgcgtcgggttcgtccggccgctcagaggtgtccgtcacacgatgctccttccgtcctgggcgcgaaccctaggccagcaaggtgcccacgccatgcaattgcgcggcgtctgttcggaaccgtgcggtggacgcgcgactcatcgcgtgccaggtggcaccagtgccgcccggaggaggtgcttctgcaccttgcccaacgcattgcgcggcagcgcatccgtgaagacgacctggcgcggcttcttgaagctggcgagccggtccttgcaccagtccaccagggactgggactccggcggggtcgccccggggtgaggcaccaccacggccaccacctgctcgcccaggtccgcgtccggcaggcccagcaccgcgacctccgcgacgcccgggtgcatggcgagcacctcctccacctcgcgcgggtacacgttgaagccgccgctgatgatgagctcgcgcgcccgcccggtgatgcgcaggtagccgtccgcgtccacatcccccaggtcgcccgtgcggaaccacccgtccgcgtcgaaggactcggcggtggcgtcctgacggcgccagtatccggcgaagacgtgagggccccggacctcgatttcccccgtctcaccgcacggttgaggttggcgcgtgcgcacgtccaccacgcgggcctcctggccggggtaggggaagcccaccgttccggagcggcgctcgccctcgtaggggttggtggtgttcatgatggtctccgtcatcccgtagcgctccaggatgcgggcgcccagctccgcttcgatgtccgcgaagagctggggactgagcggcgccgagccggacacccacaggcgcagcgcgcgcggcttcacacgtgacgcgcgggcttcctccagcaggcggctgtacatggtgggcacgccgaagaacatcgtaagcgaggcgtcatcgcgcagcgcggtcagggactcggcggcgttgaagcggcggcgcaggtccgcgctggcgccggtgaacagcgtgccgtgcaggcccaccatcaggccgtgggtgtggaacagcggcagggtgagcagcagccggtcctgctccgtccaccgccacgcctcggtgacggcccgcacgttggccagcaggttgcggtgcagcagcatggcgcccttggagcggccggtggtgccagaggtgtagcccagcaccgccaggtcctccggacgcggcatcaccagcggcgcggtggcggaggtgccctccgcgagcagcgtgtcgaaggggacctccgtgagcgactcgggcagcgcggtggtggggcgctccccggtgatgaaccactggagcgagggcagttgggcccgcagcggcaccagctccgcggcgcccgccgcgccggtgacgcagccgcagacttccgcgtcggacaggatgtgggccagctccacctgccggtaggcggtgttgaccagcaccaccacgccgcccgcggcctgcacacccaggtaggtgatggcgaagcgggcgctgttctccaggaagagcgccacccgctcccccggctggagcccgcgctgcttgaggccccgggcgaaggccgtgacgtgcgtggcgaactgtccgtaggtgaagcgctcctgctcgaacgtcagcaggggccgctcgggcgcgcggtgtgcatggtccaggaacacttcgagaagggaggccgacatgggcgcgcaccttagcgctggcgcccccaggggcctccacccccttcctgccgctgtccgcttctgggacggcactttccgcaagtgggcacggcctccgcgaggcagtccttcatcccgagtaattccagggggttggcgtggatattggctttggcacgagcctcgctctgggcaggggcgtggacattcccaaagccaagaagccgcgtcgcaagccctgggtgctcgccatcggtggagcctgcgtgctcctgctggtgacagtgggcctgtcacggctgcgcccggcggcgcccacggtggagcgggcctcggtgtggttggacacggtgaagcgcggacccatggtgcgccaggtgaagggcgcgggcacgctggtgccggagtacatccgctggctcaccgcggacacggcgggccgggtggagcgcatccacgtgcgacctggggccacggtgacggcggacacgctcctgttggagctgtcgaacccggacgtgcagctccaggccttggaggccgagcgtcaactggccagcgtggaggccgacctcatccaggtgcgcatggagctggagacgcagcggctggcccaggaggccatggtggcggcgctcatcaacgagtccgccgaggcgggacggcgctccgacgcgaacgaggcccttcaccagaaggcacatatcggcgacctggagatgcagcaggcgcgcgagaaggccgcggagctgagccgtcgcctggagctggagcgcaagaagctccaggtggtggcgtccagcatgaaggagcagctcaccgcgcagcagggacaggtggagcgcctgaaggcggtggcccgcttccgccgcgcgcaggtggagtcgatgaaggtgctcgcgggtgaggatggcgtgctccaggacctgccgctggagctggggcagtgggtgacgccgggcgtgctgctggcgaaggtggtgaagccggagcggctgaaggcggagctgcgcatcgcggagacgcaggcgcgcgacatccagcctgggctgaaggcgttggtggacacccgcaacggcgtggtggagggccaggtggcgcgggtggcgcccgcggcgagccagggcacggtgcgcgtggaggtgtcgctgcccgcggagctgccccgcggcgcgcggccggacttgacggtggagggcacggtggagctggagcggctgggcgacgtgctgtccgtggggcgcccggctggcgcgcagcccaatgccaccatggccctcttccgcttgatgccgggcagtgatgaagccgtccgcgtgccggtgcagttgggccggggctcggtgaacgcggtggaggtgctgcagggccttcaagaaggtgaccaggtggtgttgtcggacatggccgcgtgggacgccgtggagcgggtgcggctgcgatgatggacgcacttcgccgtgacgtgcggcacacgctgcgctcgctgcgccagagccccggcttcgcgctggtggcggtgctcgcgctggcgctggggattggcgccaacagcgccgtcttcagcgtggtgaacggagtgctcctcactccgccgcccttctcggagcccgagcgggtggtgcacctccaggggaacatcgcgcaagccgggctcgaggacatctccctgtccgtgccggagtacttcgacctggcgacgctgtcgcgcgccttcgaatcggtggcggcctaccggggcggcaacctgacgctcacgggcagggacatcccccagcagctcgccgcggtggcggccacaccgtccttcttcgccacgctgggcgtgtcgccggtgctcggccgcgccttcacggaggcggaggccgtccaggggcgtgagcgggtggtggtgctcaccgacacggcgtggcgcgtgcacttcgcgcgggacgcgcaggtgctgggccagacgatgcagctcgacggcgagccgtacacggtcgtgggcgtgttgcccgcgggagtggcctaccccgcctgggcggagatgtacgtgcccttcgtgcccaccgagacacagcggcaggaggaccagcgcggcgcccggttcctgtcggtggtgggacggttgaagcccggcgtgacgcaggacgcggcgcgcacggacctggcgcgcgtggcgctggagatggaggaggccgtcccctcgcggtaccggaaggtgggttggtccttctcggtgacgtcgctggacgaaaaggtcgtgggcaacgtgcgcggcacgctgtggctgttgctgggcgcggtgggcttcgtgctgctggcggcgtgcagcagcgtggccaacctgctgttggcccggatggcggcgcgcggacgcgaggtgtccatccgcgccgcgctgggggcgagccggggccggctggtggcgcagttcctcaccgagagcctggtgctgtccctggcgggcggggtgctggggatgctgctggcgttgtggggcacggacgcgttggtggcgctggtgggagaggcgctgcctcgcgcgagccaggtgcggctggatgcgcggccgctggtgttcaccatgggcgtgagcctcctcacgggcgtgctcttcgggctcggtccggcgctgcatggcagccgggaggatttgagcgtcgccatgcgcgagggcagccggggcacggagggccatggttcgggccggatgcgcgcggggctggtggtggggcaggtcgcggtggcgctggtgctcctggtgggggcggggttgttcaccaagagcttcctggccctgcgcgcggtggacgcgggcttcacgcccgagggcgtgctcacgggcaagctcgtgctgccctccgcgcgctacccggacgcggcacacaaggtggccttccagcgggagctgttggggcggctccagtcgctcccgggcgtggaggccgtgggggtcaccaacctgctgccgctgggagggcgctcggacagcagcttcgacatcgagggacggccgcaggcgccggatgaggtctggcccgcggtggagttccgctccgtcagcccgggttatctgcgcacgctgcgcgtcaccccgcgcgaggggcacctcctggagggagacgggacggaggggccggacgcgccctggcaggtggtcatcaacaagaccttcgcggacctctactggccccagggggatgcgctgggccagcggttgaagctgcactgggacacggcgcagtggaccaccgtggtgggcatcgtggacgacgtgcgcgaatggggcctggatacgcccgcgcggcccgccgcgtactacccggcggcgaaggtgcccacgcccttcctggcgctcgcggtccgggcgaagtccggcggcagcccggaggcgctgcgcaccgccatcgaggcggagttgcgcgccgtggatggcaacctggcgttgtacgcggtggcgccgctgacgcgattggtggatgagtccatcagctcccgccaggtgtcggcgctgttgatgggcctgttcgcgggcacggcgctgctgctggcggcgctcggcatctccggcgtcatcggctactcggtggcgcagcgcacgcgggagatgggcatccgcatggcgttgggggcctcgcggacccgcgtgctgacgctggtactggggcagggcctgcggctcaccgcgctgggcgtggtgctgggcctggggctgtcgctgggattggcgcggctgttggatgcaatgctgtatggggtggcggcgtacgacgggtggaccttcgcgggcgtagcgttgctgctgggcacggtggccgtgctggccgcctggcttccggcgcgccgggccacgcgcgtggacccggccatcgccctgcgagcggagtaggccgatggagacttcagacatgaccgcgtggaacgcggtggagcgggtgggtcagcgatgatgacgaacgacacgaagacggctgcttccccggaaggcgcggtggcgcaggaggacgcgggcgcggagcccggcaaggcgctcatccacctggacggactgaccaaggtcttcgagaccgaggacgtggagacgcacgcgctctccaacatccacctcaacgtgcgcaagggcgagtgggtggcgattgtcggcccgtcgggctcgggcaagtccaccttgctggcggtgctggggctgctggacacggcgacgcgcggggcctacctgctggacgggcgcagcgtgttggacctgtccgcgacggaccgggcgctggtgcgcaaccggcacatcggcttcatcttccagagcttcaacctcatcggcgacctgacggtgttcgagaacgtggagctgccgctgacgtaccggggcatgcccgccgccgagcgaaagcagcgggtggagcgcgcgctggagaaggtgggcatggcgcaccgggcccgtcacatgccggggcagctctccggcggtcagcagcagcgcgtggcggtggcgcgcgcggtggcgggcgacccgctcatcctcctggcggacgagcccacgggcaacctggactcgaagaacggcgaggcggtgatgcagctcttgacggaactccacaagggcggcgccaccatctgcatggtgacgcacgacccggcgcacgcgcgcgtggccacccgcacggtgagcctcttcgacggccgcatcgtccaggacgaacagcgccgctgagacggacatgccatctccgctcatctccctgaggaacgtcgagaagtcctaccccctggctggcggccgggcctgggtgctgcgccgcatcgacctggacatccagccgggcgagttcgtcacgctgatggggccgtcgggcgccggcaagtccacgctgctatccatcctgggcatgctggacgtggactggacgggcgagtacctgctggatggccaggcggtacatgccatgaagcccaaggcgcgcggggagctttcccggcgcaccatcggcttcgtgttccagcagtaccacctgctcgacaacctgacggtggcggagaacctggaggtgccgctgtcctaccgcgacctcaagcgcggcgagcgcgatgccctggtgggcgacatgctggaccgcttccagctcgtggggaagaaggacctcttcccctcgcagctctccggtgggcagcagcagctcgtgggcatcgcccgggcgctcatcgccaaccccaagtgctgctggcggacgagcccacgggcaacctccactcacagcaggcgaagcaaatcatggaggtcttccagggcctcaaccgggacggcaccaccatcatccaggtgacgcactcggaggcgaacgccgcctacggccaccgcgtcatccagctcgcggatggttggttgcagggcgcctgaggtccccggccgcctgcaactcccgcgcgaccgtcgccggttgtttctggcacattccccctattggtgtcccccgtgtctgaatccgccccctccctcccgaatccccccagcgccgccgcgcggcctccgtgtgtccttgtcgccgacgaccaggcggacgtcctggaggccctccggctgctcctcaagcgggatggactcaccgtcgtcacctcgcagtcgcccgcgggtgcgctcgccacgctggaggccgaggacgtggacctggtcctgatggacctgaactacgcgcgcgacaccacctccgggcaggagggcatcgacctgcttggccgcatccgcgcgcaggatgcgtccctgccggtggtggtgatgacggcgtggggcagcgtggagggcgcggtggaggccatgcgcgccggtgctcgcgactatgtgcagaagccctgggacaacacgcgcctgctggccacgctgcgcacccagttggagctgcgccgggcgttgaagcgcagccgccggctggaggaggagaaccagcacctgcgccgggggcagggcaatcagctcgccatggtgtccgagtcgcggtccatgcagccggtgcggcggctcatcgagcgggtggcgccgtctggcgccaacgtgctggtgacgggcgagcacggcacgggcaaggaggtggtggcgcggctgattcatgggggctccacgcgctccgagcgggccttcgtggcggtcaactccggcggcctgtccgagggtgtcttcgagagcgagctgttcggccacgtgaagggcgccttcacggacgcgaagtcggaccgcatcggctgcttcgagctggcggacggcggcacgctcttcctggacgagattggcaacatgccgctgtcgcagcaggccaagctgctgcgcgtgctccagacgggcgagctgcatccggtgggctcgtcgaagacgcggcgggtggacgtgcgcgtggtgagcgccaccaacgtggacctgtcgcgggcggtggcggagggccgcttccgggaagatttgctgtaccgcctcaacacggtggaggtgcagcttccgcccctgcgcgagcgtcgcgaggacatcccgctgctggccgcgcacttcctggccgaacagggccggcgctacggcaggcccaacgtccggctgtcctcggaggcgctggaggccctgctggcctatgcgtggccgggcaacgtgcgcgagctggagcacgcggtggagcgcgcgatgctgatggcgtcgggtgacgaggtgacgcaggaggacctgctgctcaagcgggccggccgcgagggcatggcgcggctggaggagatgacgctggaggaggtggagcgctacctcatcgagcgggcgctggcgcggcacgaaggcaacgtgagcgaggcggcgaaggggctggggctgtcgcgcagcgcgctgtaccggcggctccagtactacggcatcaagggcgctcggtgagcgaggagcgcaggccaccgccgcatgacctgcaggtgctcgggctcgcgtggctcgcgggcctgccgggctcggtggccgcgctcgtgctggtgtggttgggggacttctcttccaaggtgcagtggacgctgacctccctggtggtgggcaccttcctgggcgtgggcctgctggtgcgcgaacgggtgatgcggccgctgcacgcggtggccaacctgctggccgccctgcgcgaaggggactactccgtgcgcggccgaggcgcgcgggcgggggatgcgctgggcgaggtgctgctggaggtgaacgcgctgggggacaccctgcgcgagcagcggctgggagtgctggaggcgggcgcgctcctggagcaggtgatggaggagattgacgtcggcgtgctggctttcgacgtggcgggcacgctgcggctggtgaatcgcgcgggcgagcggctgctgggcgcgtcacgctcgcagttggtgggtaagggcgccggagccctgggcctgacggacctgctggagggcgacgtgcctcgcaggctgacgcgctccttcgcggaggagggcggcccctatgagctgcggcgaggctccttccggcagggcggcctgccgcaccagttggtggtgcttgcggacctgcggctggcattgcgtgagcaagagcgcgaggcctggcaacggctggtgcgggtgttgagccacgaaatcaacaactcgctggcgcccatcggctccatcgcggaggcgctgcgcgacacgttgctcatggcgccgcgtccgtccgattgggaagaggacgcgaagagcggactgggcatcgtcgcccgtcgctcccaatcactggcgcgcttcatgtccgcctacgccagcctcgcgcggttgccgcctccgacgccaggcgccgtggaggtggacgcgtgggtgcgccgggtggccgcgctggagaagcgccggaaggtgggtgtgcgcgtgggccccggtttggtgctgcgcggcgacgtggaccagttggagcagctgctcatcaacctggtgcgcaacgcggtggacgcggtgctgtccgctccggaggccgcaggggatgtctgggtgtcgtgggccgtgttgtcgccgggcgcggtggaggtctgggtggaggacgagggccccggcatgacggacacgggcaacctcttcgtgcccttcttcaccaccaagccgcagggcagcggcatcggcctggcgctcagccggcaaatcgcggaggcccacgggggcagcctgcgcctggagaatcgccccgagggcaagggctgccgcgcgcgcttgaagctgcctcagggcgcgtgagtctcaggccacctgggcgcggcgcgtcgtcgtcggaggcgcgtcgtattcgggcgtgaggtccaccacgtcgttggtgagcaggtgatagacgatgcagttgctcacccagaagaacagggcgctgtagtggacgtagacgagcggtgagccgggccacacctggagcggatggttgaagacattggccgcgacgtagccgcccacccattcgcctgcccagcacaccccggcgccaatggccagccgcggccagaccttcacgcggcgtgggtagaaccagaagaagtgcaggctccacaggagcgccacgcagccggcccacaggatgaggctcccgaaggagaaccagtggtacggcgacttggggaacacccaaccccagtccccattcatccaccgccaggccacgttctgcgccagctccatgaaccagaagagcggggcgacgtagagcacctgcgtcagcaggacgcgaaggaaggtgccgccgttctgccaggtcagcctcgcgggccgggcgagcgaagtcatgaggtcccctgcggcggtgggtcgtccggtgccgcgtcaccagtcagtacgtgatgagtcccatttcttggggagagggtggcgacaggtggttgcgcggaggcgccagagtccgggctgaacccccatttgaaacagccatttccgggaaggtcagcaagaccgttggcctgagacgggaagggtcccagaatccgccggatgattcccaccccccgcctgtatcgccgacctggccagccgcccgtgctgctcctcgcgctgctgtgcaccgtgggcgctggcgcccgcgcggaggtccccatccagcgctccttcctgcgcctgccgtcgtccaacgggcatggcgcggtgatgttggacgtggagcagcgcaaggtgacgcacttccgcgagcacctgttcgccaccgaggagcccgtcatcgacgcggcgggcaatgacatcttcgagaatggccagccgaaggtgattcacgcccgcgacctgctcttcgacgcgttcttcgggctgcgctccgggggcacgcagcgctggctcagcacgcaggaggcggaccgggacgccagcggctacgcggcatgggcgccggagaagacgggtggtacggggctgggcgcgctggtgcagcgggtgggaacgctggaggcgacgacgttcgtcttcgcgccgcagggcctgccgcacgcgtccttcgtcatggcgctgcgcgtgcgcaacaccggcacgtcggccgtcacgggcgtgagtgccttctcgctccacaacttccacctgggcttcggccgtccgggcgtgatggcggacgtggatgagaatggcgagacggtggagttgagcggcgacgacttcgtggagaagggcttcgcgggtgtgttggtggcgcggccgctgggcgcggtggcccggaagtcggcgtggctgtccacgacgacgggcccgcagaatgcctacgcggtggtgaatgggggcggcgggcaggacctgcaggacttcacggcgcagccctcggcgggcacgggctgggcgacggcgtaccagttcaacctgggagacatcccggcgggcgcggagcggtgtgtgggtgtggccttcgcgcgccacggtgaccccgcggccggggccacggtgcggcagtggctgacggagtacgcgggcgcgtccagcgcccaggcgctggtggacgcggaagtggcgcggtgggcggcattccagacggacacggtgaaggtgcccgcgggcatgtcggcggacgaggagtccctgttgcggcactcggcggtggtgctgcacatggcgcaggtgcgttcgcgcgacgtgtacctgcgcgagttcctgtcgcgggatggcgagccgcgccgcacgcgcttcaaggcgcctgacggaacgccggcgtcgctgccaggcgtggttcgccacgcgggctacggcgcggtgctggcgagcctgccgcccgggcagtggacgtacgcctggattcgggacggggcctacgcggtggcggccatggccacgttgggcatgcagagcgatgcgcgcgacgcgctgtcctattacctcaacgcggacagtggccgcttccagcactggcgtgagctggagccgtattcgatgccgccgtacatcatcaccctcacgcgctaccacggcttcggcgtggaggagacggacttcaacgaggcggggccgaacatcgagttcgacggcttcggtctcttcctgtgggcgctgcggcactacgagcggacgacgggcgacaccacgctggtggaccagacttggcccacggtgtccacgaaggtgggggacgcactggtggcgctcatcaacccggtgacggggctcatccgtccggactcgtccatctgggaaacgcactggaaggggcggcagcggtcgtggacgtacaccagcctcacggcggcgcgcggcctgtgtgacgcggcagagctggcgcagcgggtgggcgacacggagcgcgcgcagcgctaccggcaggcgggcgagtccttgcgccgggcgatggcggagaagctgacggacagcaagttcgcgctggcctcgaacctggaggaactgaggaagggcaggggctactgggacgcggcggtgttcgacgcgttcgccttcgagctgttcgacccggcggggaagattgcccaggcgacctatcatggactggacctgcgcctgtcctcaccggcgggggcgggctggcagcgcaacgatgaccggtatgaccacccggatggcgcggatatgagcccttggggtggcgagtacgacagcgcggagtgggtcatcgtcagcctgcgcggcgcgatggccaagcgcatgggcggcgatgcggcgcgtgctgaccgcgtgctgaagtgggtgacggaccagtcgctgaagaactacctggccgtggcggagacgtatgacgagctgaacggcacgtataagtacaacgcgcccatggcgggcttcggcgcgggcgcctatgcactggcgctggaccaccgcgcggccggtgtgagtgacccggcgtgtggcgcgtacttcgatgagagcacgctgacgaagcagccggacgcgggcacgggcacgctggatgcgggcactcagcagccggacgcggggccgcagacgcccgatgcgggcactccgccggatagcggcgcggacgtgggcggtggcggctgcaacgcgacggggccgggcgcggtggcgctgtgggtggtgttggcgttcgcgggactggccgtggcgctgcgtcgtcgcggagcctgagcaccggcggcgcgcggcgggaggaacgccgcgcgctagggccttgcgtggtgctgcgtcgttgcggagcctgtgtgtgaaagagcgctcgcgtgcgttacagcgcaccagcgaacttcgcggcgatgggcgctgcaacgcgcccgcccacgccaccgccttccaccaggacggcgaatcccacgccctttcgaaacccgatgaaccacgcgtgcgtgggcagcggcgccacggtgccgaactcggcggtgcctgtcttgccgccgagcccgggcacctgccggccggccttcccggagccttccatcacgacggcgcgcatcagcgcggacaaaggcgcccggacgccgttcgagagcaagctgctcggtccgccgtccagcccctccacgagatagggcgcgcgccactcgccggactccgcagccgccgcgaccgaggccatgtgcaagggcgtcgcaagcacccgtccctgaccgatggcggcggccgccagctcaatcgcatccgcgggcgcggggaacgatgcaccggcggatgtcagcccggggaagtagggcacatcaaagccgaagcggcgagccgcggcactcagcgcatcaccgccgattcccgtcgcgagcgtcacgaacgcggtgttgcacgagtgggcgaacacctgcctcaacgtggtgtcacccatggactccccttcaaagttccggaagggcttggtgcgcaccatcgtcatcggtgggcacgcgacaggtggagtccacccgcatgcctatgggcgagcagcgcctccgtggtgacgaccttgaacgtggacccgggcgggtagcggccggtgagggcacggtgcaccggctgcgagagcggccggctggccacagcgaggatggcccccgtggcgctgtccacggggactagggccgcggggtgggccacaccgtcgagcgcggactccgcgggggcctgaacctcgcggcgcaccgtggtggacaggggcgctcccggatcaccctcgaagtggaagaggacctgcgtcttgcccgaggggcgcatgagcaggacgtcaccggaggggctgcccgctagctggacctcttatgcccgctccagaccggacaggcccacgaggtctccaggcagataggtggggcctatctggggcagcagctcggccgtcacctcgccaacgcggcccagggtgtgcgccgcgaagccgtccgccggggtgcgggcgctcttgcggcggaagaagatgccgggcacgggggccagcgccgggcgcacctgttggtagcgcgcggggggcaggtcgatgatgggcacgaagcggctcgtcgccgtgcccgccgcgctcagcgccgcgtcgaactgtgcggtgctcacgccggcgtgtgcctggagcgccgccgccacgtccgcgcggctccggacgcgggtggggtcgacgccgatggtgatgacctcgccttgcagggtgagcggtgtcccctgcgcgtcgaggatatccgcccgcagcggggccgtgcgggtgcgggagaagaggtcaccctcgcgggcctcggggtgcagcgcggcgggagtccactgaacgcgccactggccctggtgacggacgaagcgcagcgctccgtccagctcccattccccgagcccgcgcagcaggtgcacggcgcggtaggtggccaccctggcgtcgccatcgcgctggaacggcccgagctcgaactgggaggagacgatgcgcagcccgtcgcggaactgctggtgcatcacctcgaagtacgcgggcgggttgacgacggcgcgccgcatggaggcgacatcccccgcggcccaggcgcgcagataggcctcggcctcggcgaccgggcccatgacgaccggttctgctgggactggcaaagggacaggggccgccggcctggacgcacaggccgccaggaacgcggccatcagggccaggactccaaccttccacgctcgccaggacacgggcggcactctgttgcgcacaggcgcggatgggtcaaggaatccgccgccgagggcacccggagtgcggccaggggatgtcggtcaacggactgcgcgaccgtggacggtgtcctcgccccggtgcggccacggggccccacgtccggctgctacggcggcctcggacgcggcgccccgagcgaggaaactgccgggaccgcatggcgcgaccgtccttgggcgtgcaggtccgcctcggatgggatggagtggggcgcatgacggaagcatccctggaggacttggcgcgacaggcgctggagcggtgtcgtgcggcgggcgttcgcctggcgttggtggaggcctgcacgggaggactgctgggcgcgacgttgacggaggtgcccggcgcctccgcggtagtcgagcgtggcttcattccctactcgtatgagtccaaggtggagcagctcggcgtcccgttggcgttgctgcaagcacatggctccgtcagcgctgaagccgtggaggccatggcccatggtgctttggcgcgctccacggcggactgggttctggtggagacaggcatcgcggggcccggaggcggcacgccgcagaagcccgtgggcctggcctacctcgcggtgctccagcggggtggacaggccacggtggaacgacacgtcttcactggggaccgaggtcagatccggcgcgccatcgtgggccggagtctggcgctgctggtggagcggctgggcgtgggtgacctgccgcccacggtgtcagcaggcggctgatggatgcctccgtgacatgagcggatgcgcactggggagacgctaggacggtagcgcttcgttcggtgtcttccacgcgtccggaggcaatgccagcttggatacgggcagccgggcaaatctggggatgttggggtactcccgctgagtagcgagtccgcccagttccgccaaccgccatagcgctaaaccattcatgaagagcgcgcgatccgtgcgtcttgcctcctccggctaggcacctttctctttgacagccgcgtactggggaagcccataccgctaggcagtctcgcggagcggctcatggcccgctgttgaacgggatgcgcctcctcccgcccatgacgcgcgcctcagcttcggagtgcctcggcaaaagggcggttgaaggtcgatgttggcgccccctgggccttcttccacgcctcgacttgctgtgccacgaacatgcgtgtcggcactcggagggcgccccggctgcgcaactccaaatccagtgcaagcgcatgccgccgtcgcatgggcgcgctgatgagtgcatcgagcaggacttggggctgatggggctgacccgaaaggtagcgctgtctggcgtccagtttcggccgggtttgctgccaccatgccgtcactgtcatcgcgttgggagtgggcagtgaatcctcgggtttcggcttgaggtccgcgtccaagtcatcgttttccagcggcacgggttcttccgcctcttgctcgtccttcggtatcgcgaagtctccctcaatgcgcaatccggtgatggcgctgaaggcctcgcccgcgagcgcggcgatggggccctgtcccagcagctccacgcaggcattggcagcatccaatcggccggagaaccccaatgcccagagcacgtctgcttgaagtgatttgtcggagagccgctcgaggaggcgtttcagatcccgttcgtcgccgttcagtcccagcaggagcaagggcagtctcccaccggtgccgcccggtgccgcaacggcctggcaggcagtccacgcagcgctgtgcccggatagcagtcccgcgacgatggcggcatcgcgcaggtcggatgaggctgagttcatcgcgcgctgaatgtgggcgggctccagtggcagtcgggagcggctggcggcgcgaagcgcagcggcggctacttgtggcacgggatgcgtgatccagggcaagcactgttggtgtgtggcgactccgtgctggccgagtgtatcgagcacaagcgcctgcagttccgggagcgcgtcatccttctgcagcagggcgggaaggctcgaaagaagtgctggaaagggggcgagtcctaatgcgcgctggagagcggcgagcgcgggcggttcggccgactcaagcgcgctgagcaccgctgtggtaccggagggggctgcgcccttgaggagggacagcgcggccacggtgatgtgttctggctctgcggcggccagcgagggctccagcagctgaatagcgacgggctgcccgcccaagacgagtccgtcgatatgcgcagcgagctgttcctccagctccgcggcttcctccaagatgaagtcgggcgcgtcgagtgctgcctcccactggctcaagcggaacgctgcctcatcgaggtgcgtctcgtagttgctccagtggggaggtcgccaggtcagcatgttcgtcacgtcagttgctctccacgaggctagtttggacgaggaggggcatgaacgactctgcgctcctgcaaaggagcggcattcattttctcagtccacccaatcaggctgaggaaccagccatgcggccccagtgggtgcccgctgccctgcaggaattcgggacagtgacggaatcgatatgtactcggatcgcgtttgcattccttgaagctccgcgaggcgcagcatggcgaggccgttcatgaacagggcgccctcggtcttccgtagctcctcttcaggtcccgagctacggctcatcttctggaacgtcagaagccgtgcgtcgataattgcctgtagggcttcatcaaaagccaggggctgcttttcgagcagggcacgacaggcttcgagatagttgtcttctccatcctctaggacggtcttccaccggtcgagcaacgcggagagcgaagtcggacttgcctccgttgccccgatggtcttcagaaagaactgctgaaggaagtggtgtaggaggaaatcatcctcatactcatgcgccgggtcatgatgtcttgcggaaagcttcgcgatatccacggacaatgcatactgcccggcagcaatcgcgtcgatgaatgaaaactctttgcttgcgcatatgtactgaggctctgcggcgtggccgcccgcgaccagtcgcagaaaatacaggcgcgcgtgagcggaatggcaaaggtgcgcaaggaaacggtcaggtcgggcatccaagagcactgcgcagattgcgagtcggcggtggcatagcgcggctattgtgtaagcctgccccgagcgctcgctggcatcctggcgttggatgctgcgggccgcttcttcaatcccgaaaagtgaatcgtcctggatgtttctcagagtgtcggagaacatgtttacggatggactcagtagatgcggcagcgctcgcccatgccaatgtacttcactccggtgaggccagcgacgtcgacggtcgcgcgtaggtcgtcgcggatgaggattgcggagggcatggacttaaggcggaagagctttgcctcgtgaggaacccggtcttcggtgatgtggagacggaacaggccagaaaggaactctggctccatgccaagttgctctacttcgctgcgctccatgtcaatacagtcatggtgatcgagtaggttcgcgatatagtagtcatttcccgagactcgccccttgtgatttgcgatcgagatgggaaggtactcgatgttagccgctgcgtgctcgtctagagtctgtttgaattttcgggatacaattgccagttggacggtgtttgaaacgaaatcagggagcgtgattcccttggtcccgccatccacctgaagaaccacgtctgagggaaaccgctcgtccacgggcaatccacggctcatgcgccagctcatgtcgcggatcgaggttggttcctcatggatgacgcagttcttgggctcccgaactgtcgaaaggatgaagtaggagtggcatacggtgttcatcggggaccgaggatttcaaaaggggacgtggagttgcgcgccagattccatggtttcagcatcaatcccttaaggacaaagccgttgtgaaagaatccgcttccgattcaatagatagcgcattcttcgcccattgcgatgtagttcacgccggtgatgtgtcctgcatctatcgcggctcgtagatcctcgcggacgatgattgcagggggcatggtcttgagtctgaacagcttggcatttgaaggaatgcgctctggaaagacctgaagccggaacaaccccgagagtaaggtaggatctgggttcagttcctccacctcgctgcgctccttgtccacacagtcgacatggtcgagtagattggcaatgaaatagtcttttgcggctactcggcccttgtgattcgcaattgtgactggcaggaattcgatccgggcgcccgcctgctgttctagcagggccttgagcttttctgacacaatggaaattcgctcggtgttgttcaccaagtctggtatctgcacacccttgtgacttccatccatcttgagtacgacatcggatggaaaccgatgttccatggggagccctgcgctgatccgccatttcttcggcttcaatgcgtctgggacctcattgatgatgcagtgcttcggttcgttcgcttcggtgaggaggaagtatgagttcatggacggcacctaccggatggtcacgagacttgccagttcgttgaggtgggctccagggcttttgacgcctgcctcgcggatcttcttgcgcattctcaaggagaaggcatcgagttgtgcgccaagcaggggaaccgttttctcattgagtttcggatgtccagcctcgtcctcatcggtggcctgagtgagttggtccctgatggcattcacgcgcgttcggacatccttgctatacgtgctgtggtatttggggtgcttgagcaactggaaaagctgggcgtgacgtgtgctgttgggtagatagatgatgtttacgcccttgttgacgttgtatttcgcttgttgaagtagtttgagttggtcgaagttgagaactttgctcaggacgtcgtcgaccggaatgatgtggtgggcgttattgctccaaggccagcgtccactggcaatgaagttgatgtgcccataggggcccgagcccatatgccacgcgtccgctcgtttgctcgggtcacgccaagcctgcttgaagctcgtgacgaagatgctatcaaagcgtttgcgggcttcgctgccatcctcatggatgggcaggttgtaccaattcacctcatctgagctcttctggaagttgaatccattctccttgtagtcatggcctgcgaacttgcattttctcttgccgccctgagtctcgtagacgcaccgagtgacacagccattgctctcgccggccacatgggatttgtcgttggagagtgcttcgaaatgctcttcagtgctcatgactgtctcacatgcagtgacgtcggatcgttggaatgaccttcaagagtgagcttgtagtaggaacgcgcctcgggagggctcgtcatcaagcaatgctaccagggcttttcggcttcgggcataacctctggcgaaccctctcaccgctaagcacgtagctacggttgaagtcgccgcgccaatttctccgaaatgctcaggtacgtgccagcgcggagttgaggagggaagttccgcttccttgaggtgaacgaggcaatgaccgaattcgcgagcacgttgttcatccccattgagattggcgatgagcaactcaacatcggttgcctgtcgggcccctcccggaaaacaagcctcaatggccttgaatagggccttgccggagggggcctggcctgagaaccggtggctggtgtcgctcgtaaacgcgactgggccaaggagaccctcgatgcgtgcgccacgggaccgggcggcatcaatccgttccaggagaatgaaggcccccgcttcgcccggaaagcgtccgatcgggcggttcggggttcgcagcagccccaagtcgaaagcctgggtaaggggttctccatcgacccaggagtcgatgccgccgatgatgcatcggtccattgttcggcttcggagtccttctatcgcccgcagcagcagttggcaggaagcggcagctccgccaaatgcataggactgtgcttgcggctcgattcgtatgttattcagcgctaacaactcgggaatgagcctacgggtcaggctgtttcttgcttcagtacgctctgcatcgatttcgcgttggatgcgagcgcgctcgttttcaggtagacgctcaagcaggcttgtttttaggtggatgtcgttgatgaagctgcccggtagctggagaaggaaacccgtctgcgcatagtctgctcgagtcagtcctgagtacgccacgaggtcccgcagggcggcgtcacccaggcgcagccaacgcgcgaaaccctcgaatcctagggtgagccatgggatctcatggccctttagcgatactgcctccagggtgtgctcgtctgtaacctggaggtccagctccgtccactgcgtgagtcctgctcgggcggcggcacagcttgagacaacgtcccctcctatgggagagaccatgcccaggccggtgatgacaattgcgtcgccagccaccgacgcgctcttgggctgttctcgaaaagtggagacagggtggggcattgacaagtcccgtcaagagtgcgtctggttgaacgcgagagggtggcttgtgtgttcaggcgaggtccagagcagagccgggcggccgatgcctgtgcgtgtacctgcatgatgaatgaccggcgcagcgtagggtgttgcgcgtgatggaggggctatccgcggagtgttggacctataggtctttgtcgcacaccgcgcacttgggtgcttcatcgctcttccccatggcaatgacgggcccctgcatgacggggaacggcggcgtgttcttgtcgttgtggagcatcaggtcgaaggcgcgcgccacgttcttcccttcgaacttcacgtcgaaggagaagttgacgaactccgccttgcccttggtcttgctggaggccacgccaccgcccgcggtgccggcttcgtcgccggtgctcgtcttgaagttggagtccttcacgcacaccgggttgccagcgacggagaccttcttcgtgcccttgtcggtgtcggaggactgggccacgttggggtaggggatgggcacgggcccggccgggctgggcgtcttgcacacgtccgggaaggcaacggtgacgccgccgctgtccttcgtcaccacggacatcttgttcacaccggtattgaccgccatgccagccacctccaggggaacagaataccccggcggggccacgcggtgcgaggcacgccaccgcgaagctggagcgcggctgcgccgctggatacatgcccctacgcaggccccgctcaggccgccttgggcgcggtcactccctgggcggtgaccttcaggccccgcacatcgtggaggccctctcccagggcgacatgtccgcgccagaggagcgtcaccttctcttcgtcggtatccagggtcacggtgtccaggtgcatggggggcgtcgcgtcctcgcctcctgcgagcgccacggtgacgatcggagcggcctggcccggaagcgcgaaggacagacggcccttgggggaagcgccggcgatgatgaccggctcgtcccccttcaggtacccgggagcgatgaggcccggcgcggcggcgttgaagaaccgccggtcgaagtccttgggcagcaagggcttgcgcgacttgttccaggactcgtcgtaggtgccgccatacctggcgcgcggctgccagtgcggggaggtgaagccgaagccagcaggcaccaccttctggccgaagtcgcgcaggggctccgtggcgggatcctccaggttgggcagcttcagtccctcctcgaagtggcgaggactggcgcggaagcccactcccacggggttgcgcggctcgaaggccggcttcacggtgtccgtccggtcccagccgccgaatgcgcgctcccacgtgagcggaattttgtcgaaggggagcggcttggtggccgcgacatgtcccatgctcttgaaccaggtccgctcacccacgacgcgcacggccttcttcagcggcccgacctgaagagccaccagtgcctcggtggcgcccttctgtggcgggtaggcatgtccaatcagcgctacgtccgtggccagcttgatgaaggcgctctcgggttcgtacttgtcgctggactctccgggcttgccccaggactcgccgccccacgtcacgggcaactgttcgcccgcgagcttgagcccagacgttccgaagtcgtacgtggccttcacgacgagtagaagcagtggcctcccgtcctcgtcggcgaggcccatcatatcgaaggcgaagggggtttcgttctcgatggtagggtggcccatgaagtgctcgtgtctgtcggggcagatcgccaccggaaccgaggggcgcagtgtagcagtcccatgggataaggtcctggactcacgatgacggatggggcggctggttcgtgagcgagggatagtgagatacttcgagattgagacgctgggagacatcaacaactcggagttgctctttctggaccaagagcccgaggtgctggggctggatggttactgcctggcggcaggcgaacccattgggacggactatccgtctgaggtgaaggtcaagccaagcgaggagcatgccggaatccaactgtcttccttgctgggtaataacttcaactacctcattgcttctgcggcagtgaaggaggctgtctcagagcactgtgtggaggcggccatcgagtacctgccgttcacgctactcgaccaccgcgagcgcgtccgcagccaggattacttcttcatcaatccgctggggagcatcgatgccgtggatgcggctgccagtgatatcaagtaccaccgcagcggtgccgtcgttgcgatccggaagctggtgctggatccgcagaagttgattggggcaccgggactgttccgcctgaagcaagacccgcagcgctacatcgtgagcgagccgttggttcgtgcgttcaaggagcgtggcttcacaaacctggtactgcgggagattgcagtctcggctgtgaaggcttgagccttcccctcgaaaggacgctcctttggcttcgaagttcctgcccgtttttattggcaatgctcttggcgacaatgaagagttgcttccggcatttgcggctggaaaaggaggcctgaaggaggccttgcgattttgtcagaactttcgcgtggctggtattggttcactcctgctttctggtacgtctgcgcgcctgcacgaatgccttcacgcgagcgcccgtgccttcgtgttcttctcccgggcttcggaagaaacaaagaagttgaccagccgggcggcgcccttctttgacgccgtggcgtgtggtgacgatgaatccgcacgggaactcagccggttttctcccgcgagtcccgacaaggatcgtgagtacgaggaggacttcctcttcgtgcgcttcctgatggaccacttcttcttggagagaaccgcgcaggatggccaggtgcttctctctcgctacgagaagtgcctggaggggacgacagacgcgaggctcctggtgtgtcaggcgctgcttgctgcggatggagacgcgttcgacgccgcgctgacgcagatgatggaggagcgcgaagtccgctaccggaggctggctgagaaggagaccgaagcggaagaggtgctcgcgaccgaggcctatgtgtccattgaaggccttgcgctggtccgccttgcggtccgagctggactgaagccgcaagaggactacctcttcattccatccaccgcgctggagttaccgcgtctgcgttacagggccgattcctggaagcacctgatgctctagcaagtgcgccgcctaccacgcccccaccgccagcaggcccaccagtcccgcgtacaggggcacgttgagcgccagtgtcagccggttgatgcggcggaaccgggcctgctcttcgtccgcgaaccagatgccgtcctcgcccgtggtgcggccctccacggcgtggaagaacagggccgcgtaggcgacctcgacgaacaggctcacgagcaccaggcccaggaaggccagggcccacaggtcctcggggccgagcacgcccagccaccgcgcccggccccagaacaggccgccgagcaccagggcgatgcacgccacgtcatgggccacgccatacggaggccgccagcgcttcacgccgtagagcaggtacagctccgccacgcctcgcagccacatgaaggcggcgaacgcgcccagcacgcctcgcgcctcctccggcaccgccacgtccagcgccaccagcgggcacgcgaggaaccacaggaacaccgcgtagaagagccacgccagcttggggccggagatgcgtccgcctcgtgagcccttcacattctgcgcgtgacggaacccggccgccgccacgatgcagacagcggccaggatggcgagaagggctcgggtgtgcggagagggcatcggaaaccgcgcgtgctgaaggacctgtgcccggagtttgcaatgtcccgggcatggcatggatgcatggacaggaggggctcttgcaagcccttgacctgattggacagggcgcgctccacggggcacgctccgcacgcgcgcggcgacgcgcttcggcgggaggcgggcttccatgagcgttggtcccggggtgagcccggctgcacaggtgtacatcccgcaacacacggcgccgcgcgtcgagcgctggggttgggtctggcctcgttggaacgacccgcgcctgcccttcgccttcctgctgacgctctacggcgtgctcggcttcacctttttcggcttcaaccgcagcccgtggcagatggccgccatcgtggtgacgggcagcgtgctggacgtcgcgctgggttgggggctgaagcggcagaaggtcgtccccctgagcgcgtacatctcctgctgctcgctggcgctgctgctcaactactcgcattcgagctggctgctcctgctcccg

SEQ ID NO: 1255 - DNA, 34199 bp, Myxococcus xanthus
gggggagggagactggtggacttcccggaggtgaaggaggtgctcgtcgagcaggggcgcccggaggacggcacggacaacgaggccgtcaacatgggcaagacgttcgtccgcttcacgcccgaggagacgtggcgcaagggctgggacaaggagcggctggtgcgggagatgcgcgcctcgctgctggagattccgggcgtcagcttcaacttctcgcagcccatcaaggacagcgtggaggaggccatcagcggcgtgcgcggcaaggtggtgctgaagattttcggcacggacctggcggccatgcgcggcacgctggagcaggccgtcacgtcgctgcagaacgtggagggtgtggtggacctggggctctaccgcgactccagcgtgccgcagctccaggtggtgctggaccgtcccgcgctggcgcgtgccggcatcgacgtgtccaccgcgcaggacctggtggagacggccctgggcggccgggtggtgacggagctgtgggagcaggagcggcccgtcccggtgcgcgtcatcctgccgggcacggagcgtgacgacgaggcgcgcatcggcggcatcctggtgcccacctccagtggcggacacgtcccgctgcgcgaggtggcgcggctggagaaggcgctgggccgcgcgagcatcaaccgcgaggcgaacagccgcaccctggcgctgaagttcaacgtggaggggcgcgacatgggctccatcatccaggaggccatggccaccgtggagcgcgaggtgacggtgccggagggcacgttcctcaagtggggcggcgagttcgagaaccaggagcgcgcactgggccggctggcggtcatcgtgcccatctccttcctggtggtgttcgcgttgctctacgcggcgctgggctccatgcggagcgcgagcgcggtgctggcgggggcgcccttcgccatgtgcggcggcgtgctggcgctggccgtcacgggcatcccgttgtcggtgagcgcggcggtgggcttcatcacgctgctggggcaggtgtgtctggcgtcgttgctggtggtgagcgcggtggatgaccggcggaaggcgggtgagtccctggaggcagcgctgccggcgggcgcgtccagtcgcttccgtgcggtgctgatgacggcgctgctggcgatgctggggttgatgccggcggcgctctccagcggagcgggcagcgagacgcagcggcccttcgcggtggtcatcatcggtggactggtgacggcggtgctggtgtcgctgttcgcgttgccggccttctactccgtcatcgtggggaagcacgtcgcgtccacgggctcgcgcgacgacgaggacgaggacctggactccggtgtggagcacatcgggccgaaggggcacggcccggagcagggcaccgcgggggtggcggcgtgaggtgcttcaatgggacgggcgcccagcgggcgtcagtggcgtggcagccaggcgcgcgcggtggtgaggcgcggttcggaggactcgccggtggtcactggcgtcagggggaggtggcggcatgaggcgcttcattgggacgagagtccggaggtttcctccgggcgtggtgtccgcgggtggtggtgcacggcgcggcatggcgggccgaaaggcccggcaccgctggagcatcgatgctcttcggcgcgacaccgtctttggacccgttctgcgaagcggtgtgcgttcagcgaacggaggcctgaagcgcttcatgccggtgcgtgcccactgggcggtgccggagacggagccatgcggcgccaagcgaggtttcagcacagagggagatccatggctgtcgttggtgtcggaaggcgatcagggcgaggcggaggtgacggaatgaggcacttcaccgcatggggtgtgttgtgtctgttgatggccgggcctgctcgggccgtgcaggccgatacgccgtcgccggagcgactcacgcaggagcggacgcggtccgaggcgacatcaccggacctgctcactcaggagcagcggcggtctgaggtggcgcctccggagcacatcacgctggagcaggcgctgtcgttgctggacgagcgcagcccgtgggccgcggcggagcgctcgcgcattgacgtggcggcggcggaccgcgtcgaggcgagcatcctgcccaacccctcgttcagctacggcacgcagctcctggctgcgggcgtgaacaccggttcgtcggtggtgcacgagctgtcgctggagcagcccctgatgattttcgggcagcgcggcgtgcgccgcgagctggcggagcgcaacgtgtccgccgagcaggcgcgcgtgaaagcctcactggcggagcgcgcgctggccgtgcgcgaggccttcgcggcgctgctgacgaaccaggaggaactgcgcgtgctggaggagacggcggtggacctggggcgcgtggagaaggtggtgaagggccgggcggcggcgggtgactccagccggtatgacgtggagcgcatcgaggtggagagccgcgcgctggaggtggaggtgctgaacgctcgcgtcaacgtggccgacgcctccggacggctggccgcgttgctcggcatggaagggtggcacccgaaggcgcagggctcgttgcggaccaccgaatccctgccggacctgccactcctgtgggagtccgcccagcagcgtcggccgtcgctggtggcggcgcgcgcgcggcaggccgtggcacgaggcggtctggacgtggcccgcagggagcggctgccagtgccgtccgtggcggcgggtgtcatgttcacccggaacgagcagagcaccatcgccctggtgggcgtgggactgccgttgccgctcttcgaccggaaccagggcgccgtcgcccgcgcgtccgcggagatgcaggccgaggcccgcgcactggaagcggagctggccgaggcccgcgcggagctgtcccgggctcacgccgtcctggagggtcgcaagggcgcgttggcgcggctggagcacgacgtggtggagcggctgcccacggtgcgccggatggccgaggacgcctaccgcgaggggcgcggaggcatcctggagttactggacgcgttccgctcgctcaaggacatgcgcgtgcttcacctgaagcagcaggagacggtgaagctcgctgaagcctcggtgctcttcgcggcggggctggatacagcgccctgacgggagcttgcgttcgcgcctggcggaggtgccccggcatggcggggcatcacgccaggcgcgggcgcggggctcagggcagggtgggcacgcggtcgaagtccatggtgctcatgggcgcgaaggcctcgaagcggtcctcgcggtgctcttaagtaggtcgccagaagcatgcacaacttctgggggatgcgaccggcaaggagccctgccgaactggggctgacggcagacgacaggcggaagctggagtgggcgctgcggcagacacgcgacgctcgccacttccgtcgccttctggccatcacgctcatcgccgagggcaagggccctggcgaagctgcgcacctggcggccgctggacctctcgccacaggaagccctctgcaaggcaggctgcctcgccgagggcttctggctgcgcgattggttggagaatttctttagggcagctcgcgcaagaactgcacgaccacggctcccagtcgctcgggttggtcaaacggaagaccgtgggcggcgttctgtacctgttcgattcgcacacgtgggttgaggctccgcagtcccattgccatctcgagcgtgacgacggggctgcggtctccaatgacgaggagggtcgggacgccaatcgcgctcatcacgtcgcgatactcggggttgggcggcgtgagaacgtcgaaggcgcccaggcgggtgttcagtctcgcctcggcaagaaggtcgatgatttcgggcgagcgatgcgggttgcgggctcgggcctgtgcaacgaggtcagacttgtgcaagccgagggcccagcggtgttggtcggcgacgtcgctgtcgcgcacctcgcgttgacgctcggggctcaagaatgtcgggtcgaccaggatgaggccgcggaggccccccgtccctcgactcgccaccactgcggcggtcattccgcccatcgagtggccaagcagcaccggacgagagagctccagaccgcggatgatgcccacgacgtcgttcgcgtggtcgtcgtaccggtagccgtggtgcggcgtgctcgaaccgccgtgccctctggcgtcgggcatgacgacgtcgaattgaccttcgagcacacgcgccaggggagtccagcaggcgccgttccccatcagtccatggagcagaacgacgggagggttggcacctccggtccggaggtagtggatgttgatgccgttcgtttcgcagactccactcatccaggtcgtcatggagctgttcctacctgatcgcgaggccagctcgcagcgagccagcgccctgggtgccccgctggcggaggcctcggtgctgttcgctgccggcttggactcagtgccctgaggaatgggagccgctcgcgcctggcgaaaggaccgcgccaggcgcgggcgcggggctcagggcagggtgggcacgcggtcgaagtccatggtgctcacgggcgcgaaggcctcgaagcggtcctcgcggtggtccagggcgcgggccttctggatgagggcgcccagctccgccacgtcatcgcgggccttcagcggctgaccgatttcctcccagaaggagaacagggcgtcataggtcagcgggcgcacccagtaggaaccgcgcagcttctccgcgaaggcggcggccacataggacagccgcgtgggcggcgctgcgcggccgtaggcgggacggaggacgctcgacggcaggggcttctcgatgagcttcgagtccccaccctccggcgccttgtagcggatgcgcagcgtgccgaaggacgcggagggctcggtcagcttcacctcgtagagcgcggtgacggcgtggcccgcgccgatttcacccgcgtccacgcggtcatcggcgaactgctccttggtgagcatgcggttctcgtagccaagcaggcggtagtgggacacggccttcgggtcgaactccatctggagcttcacgtccttggccaccacctggagcgtgccggtgaggtcgcgcacgaagatgcggtgcgcctcttcaatccggtccacataggcgtagttgccctcacccacctgggacaggcgctccatcagcacgtcgttgtagttgcccatgccgaagccgacggtggacagggtgatgcccttcgccgcgcgcgcacggatgcgctcccagatgctgttggcatccgtgagcccggtgttggccacgccgtccgagcagaggatgacgcggttgatgccgccctccacgaggtgggaggccgcgagcgaatagcccatctccaggcccgcctgggcgttggtggagccctcggtgtgcaggctgtcgatggctgcgcggatgatgtgtgcgtgcacggcgctggtgggctccagcaccaggcgcgcggtggagccgtacacgacgatggagacctggtcgcgctcatccagctcgttcacgagcaggtgcagtgcgcgcttcaccaggcccagccggttctccaggttcatggagccggacacgtcgatgacgaagacgaggtggctcggcttgcgctgcgggcggctgacctcccgcgctttcacgccgacgtggaccacgtggtagcccttgcgaacgggagacgggaagccttcgacctggacgctgaagggcgcgctgccctggtgcgcgtagccgtagtcgaaggtgttgacgaactcctccacccggacggcctgctcgttgggaaggctgccgcgctccaggtaggcccgcgtcagcgtgtacgacgcggaatccgtgtcgacggagaaggtggagaagcgctcctcctccgtgttgatggtgggattgacgccgtacccctggaagtacatgtggaagggggagaccggcgcgggcgccactgcgggtgcaggaggctcgacgtccctgccgacgaaccgaggcgcgctctgaggcttcggggggcccggacggcccagtggctgcgagggcagggtggacgccggtggaccgttgagggacacaccgtgggggcggctcatcgcgttggggggctcgtagacgcgggtcgcgccagtccggccgcccggacgggcgacggcgatgcgcttgatgaactcctgatccacgttcacgcccatggtcgtggagcccacgtcgatggtcggtggagcgccgacgacacctaccagctccgcgggtagagctgagaggagttccacgtcgacccggatggtccggtcgagacgcagttggatggccgagcgtgtgtagggcttgaacccttccttctcgaacgtgagcgtgtactcacccggtgggagctgcgggatgcggtagctcccttgtgcattggtcgagactctcaattccccctggaggttgggggaactcgcggtcacgacagcattggcgacgggaacgcgccgatatgcgttacgcaccgtcccgatgatggtgctggtgttcggatgtccgccggcatcgggttgggcccgggagggatgggcgaacaacagcaggaagacgcacagcacactgcgagcgacggaatgcatcgtgggccacctcggaggaacaagaggtggccatcttccagagagcgctcgtggcgaacgtcatgggcgcctcgcctcttcatcacggttccagcatcaatcgcgcaccaggatgccggggctaggggctgtccctgatctcgtgttcgagagtcgacccggcgtgccggcctttctggcacgttggggcagggcctcaatcggagttgctgcctggcgctaggcatgatcaacgcgggctgtgcgccgacatgaactgagcgatgtcgagtggagccgcatcgagcccctgctgggctccaggacgggccctcgctcgaagcgaggggaccgtgacttcatcaacgccgtggtgtggcgggtgaagaccggggtgcaatggcgggatttgcccgagcggttcggtcactggaagacggtctacaatcggttccatcgctggacgaagactgggcgctgggaagccatcttcaaggcgctgcggctcgatgtggatgagcttggctcccttgctgacgcatcggtcgtccgggcgcatcaggacgccgcgggcggaaaagggggatccgaagcaatgctttggggcgttctcgaggaggtttttcaacgaaagttcacgccgtcactacgacgggaggtaagccgctccacgtcgcgctgacgcccggccagcagcacgagtccacaatggccgaagaacttatggtgcacgccgagggcgccgctttcattgcggataccggctatgacgccgaccgcatccgcgccaacgttcgaaagctcgggatgaagcctgtcatccattcaaacccgagccgtaagcgggcgttgccgttagaccgcaccctgtaccggatgcgctaccgggtggagtgcttcttccacgatctcaagcgctttcgggccgtcgccacccgctatgacaagacggcgacgagctacctcgccgtcctgcacgtcgcatccatgcttctttggctgcgctaatcagggacagcccctagtccacggtctccacggtcaggcacttcgccgggccgaacgtggccgcgtagtacggcgtgtagaggtcgggcccgagcgtgaagttgcaggtgttcaccgcgtccggcgacagcccctggttctcctgcaggtagcgcgcgacgtagtcccgcacgccatccgcggacgtccacagcacgcggccttccttgaacatgctgtacccgccaccaccgcccgcgcggtagttgttgatggcgacgatgaagacctggtcgtcagtgacttcattgcccttgaagcgcaggtgcgtggtccgcgaacccgcgggcttcgtcaggtcatagccgtattcgatgtgcgagtagaggtcccagttgtagtccgcgatggagggcgaggtggccttcgcctccgcgggcgtctggggcaggttggccgggtcaatggtggtgaagtagttggcgttcatctccaccgcgcgccggaggatggagccgttgatttccatgacgtacagcgtgttgtcgtagatgtagacgctgtaggcatcgcgcagggtgacgtctccctcgggcagcgagacatcgttggtgaagatggcgcccagggacaggtccacggcgaaaccggcttcgagcgcggcctgctcctgcacgatgttgatgaggtcccccagcgggccgtccacgtagcgtccggcgaagccgcccgggaacacgccggtggtggtgccaatcttctggttcacgtaggcgaccgtcgtgtcgtggtggacctgggtgctctgggtgacggcggcatccgccgccaccgtgtcgtccacgacgtggagttgggcgtcatgggtgttcacgccccatcgctcgccatcccaggtgacctggagctggacgtcggccaggtggctcccccagcggttgggctgcgtgaggaggacctcgccaccgtccacgttccgcagcagcatcttcggaatgggctggtgcgtgtggcccgtgaggaggacatccacgccggggacctgctgggcaatctggacggcctggttctctccagggaggttgccccggtccgcccacttcgaatcatccgcgtagtcggccagccacgattcggggttgctcgcgctgccggtcggctgccggtcgggaccgctgtggatggccaccaccaccacgtccgcgccggcttccttcatccgcggcacgtagtccttcgccgtctgcagcgggtcatcgaagcgcaggccggcgatgttctccgcgcgctcccacgtcgtcacgccaggcgtcaccagtccgaggatgccgaccttcacgtcacacaccgtcttgatgatgtagggcgtgaaggcctcggagccgtccgcgctgttgcgcacgttggcaccaagcagcgggaagttgacctcgttcttgaacttgttgaggacgtcctggccgaagttgaactcgtggttgcccagggccatggcggcatagcccatctcgttcatggcggcggccatgggatgctggggcgtgttgtccaccagggaatagtaggtgcccaacggtgagccctggatggtgtcgcccgtgtcgacgagcagcgtgcagtccgggttcttctcccgctcctgcttgacgagcgtggccaccttggcgacgccgcgcttcgcgtcgggcttcccggagaagtagtcccacgggaagatgttcgtgtgcaggtcgctcgtctgcagcagcgtcagcgtacgaggggtggtgtcgggcgggggctcgttgccgggccctggatcttcgctggagtcgcaagccgtcaacagcgagcaggcacccacgaggcaaaatgaagtcgtgcgcaacgcgcgcgcccaggtaggaaaacgcatcaggaaacctctacaaagttgaatgccgggaagaatctcccagcagggcgagaccctaactcatgcctctgtcatccccggcgaggggaggtttcgccaggcgctcgctcgagcggcggctctcaaagtcccgccagtgtctctgggattctcgggctgcgggcgcgctgcgttgcagagtgccatgctcgttgagttgaaaatctcatgggatgagaattgacgcaggccgtctttgaggcagtcgaacaggatccgggcaccccaggccgcacctcagaccagggccgccccactcgcgcggacacgcaccgggtttcgagccagcggccggcgtccgtgaattccatttgaattcacagcgctttgttagccattggttcaagcactttctgaaggactcggcagacgacttgtcggcgtgtcatgtcgggtctgaaatgacattgttttttgtgcgccgagaagcgtccccttgaagcgcgctgctgtcagggaggtacgttcggtcctggaaggtctggtcgttccgggtggggcgttcgtagaatcttgctgcctgaggctgacatggcgggggactgacatggccgacgaggtgcgcaccacgcagtgctgtgtcgtgggaggaggcccggcggggatgatgctgggcttgttgctggcacgggcgggagtggaggtgacggtgctggagaagcacgcggacttcttgcgtgacttccgcggcgacaccatccacccctccaccttggaactgatgcacgagctggggtggctggatgagctcctggccctgccgcatcagaaggcgccggtgttgcgcctccagcgcggtgcccatgacgtgatcgtcggagacttctctcacctgcccacgcgcgcgcgttacatcgcgttcatgccgcagtgggacctgctcgacttcctcgcgcggaaggccgccgagtacccgggcttccacctgcgccggtgtgccgaagtgacggaggtgttgcgtgagaaggggtgtgtcgtcggcgtccaggctcggacgccggagggctcattggaggttcgtgcgtcgctggtggtggcggcggatggccggaattccatcatgcgtcagcgcgccggcctggaggtggaggtcctgggcgcgcccatggacgtcctctggttccgtgtctcgcgcaagcccgaagaccccgaggaccccatgggccgcttcgagcagggacagattttcgtcctcatcaaccggggcgactcgtggcaatgcgggcgtgtcatcgcgaagggcagcttcgacgccttgcgcgaggccgggctggtgtccttccgcgaggacttcgcccggctggcgccctttctggcggaccgggcccacgaactggcgacgtgggacgacgtgaagctgctcaccgtgcgggtggatcggctgcgcacctggtaccaggcgggcctgctctgcattggcgacgcggcgcatgccatgtcaccggtgggcggggtcggcatcaacctggcggtgcaggacgcggtggccgccgccaacatcctcgcggggccactgctggcccggcacgtgacgcccatggacctgcggcgcgtccaggagcgccgggagtggcccacgcgtgtcacccagcgggcccaggtcctcatccagaatcgcgtgctcgggcccgcgctgcgaagcccggcggcgtccaccgcgcttcccttgccgctgtggctggtccagcacgtccccttcctgcggcgcattccggcgcgcctggtgggcatgggcgtacggcccgaacacgtgcgcacgccagcggcgccccccagggcctgagcgattcaggcgggcgtcaagccttgcccgccaccttcgcggcccaccaccgcaggcccacgaagagaaagcgccagtccttgaggaactcagggggcttgcgctcgaaggcatggcccacgaactggaagctccacccgacgacgaagagggctgcgggcactttccagaggcgagggacgaacggggatgcggcggccaggggcaccgaggccgcaatcatcggaatgcccaccgtgtgacacagacggttgacagcatgggtgtggcttttcgagtactccgaaatccactcctcccaggaacggtcgccgagcatgacgccacggtatgcaccgtgcgccccaggacgaaggtgccgggtggatgctcgcctggccagggaggcgtcacgggcgtgtgatgctggacgtcacaaaccctcgcgcggcgtgacgtgaatggcgactcgctttgcgtgggtgtgaagctttgcatgaccgcttcggccgatgagccggatgccaggcgtctgacgctgacgttggccatccggatccgcgtccgcttcaaagggcattcgcccggggcgggaggccagccactggggcctcccgccgcgtgcggctacgactacgcggacggctcctcccacgggaagtgggtggcgcccatcgcgggcttgaggtcgaacagccaggatgccttctcgtcgtacttcgcgaagaagggccggccgacgagctccgggtcgcgagactggatgaagtggaggacgaagaccttctcgccggcaatctccgccacaccgtccacacacaccttgccgggcgtggcggacatcgacgggccgcgcaccgtgcgcgccagtccagacacgctctggaaggcgttgcggaagatgtcgtaggcctcggcgagcggtaccgcgaagtagtcctggggccccgtatcccgctcgacgaacatgtaatacggcaccatgccgtggcgcaggtgcgtgcgccacatgctctcccaggtgcccggggtgtcgttgatggtgcggatgagcggcgcctgggtgcggatgaccgcgccggtgccccggatgcggcgcaccgcctcctggacaatctcggggaccatctcgttgggatgagagaaatgcgccatgaaggccaggctcttgccggaggcgaccaccttctcgaacaggcgcaggatgtcgtccgcgtccgaatccgtgacgaagcgctgcggccagtaggccagcgccttggtgccgatgcggatggcctccaggtgctcgatgtccagcagcggctcgatgtacttggccagcacggcctcggtcatgatcatcgggtcgccaccggtgaacagcacgttggtgacctcggggtgcgcgcggatgtagttcaccagcggctcgatttcccgcgaggcgaacttcaggtccgcgtccccgacgaactgcgcccagcggaagcagtacgtgcagtacgcgtggcacgtctgaccctgcttggggaagatgagcaccgtctccttgtacttgtgctggagacccgggacgggctcttcgttggccagcttgggaacgttgagctgcatctgcccagcggggtgcggattgagccgcgcgcgaatctcgttggcggccgcgttcagctccaggggggatgcaccggagctcagcaggtccaccatgcgagccacgtcctccgtgggcagcatgtccgcctgcgggaagacgagccggtagatggggtcggcgggcgcggcggcccagtcgatcagctcgtccacgacgtagctgttggtccggaagggcagcacgtgcgccaccgcttgcaccgcgagccgttcatccgctgagagcccagcccgagtcgtcagttcgtccaggtgtcgtgtggtataggcacggtaccggcgacccgtggacagagccagtgctgcgtttgacataacgctcatgtctcgtttctcctgcggtagtcagggcggccacgaggtccacagcggccaccctggctggtggccgggcgtgagcgcacaccgtttgaccaccaacgagggagagtccggttaccacgccgaggtgcgaagtgtcatccctcaggggtgatcgggcaggcccaattccgtcatgagcggtaatttacggcgacgctgcgtctttggggcatgacgcaaggtgtcgaagtctggggactctgctgtccccgccggtacatccgcggcagggggcttcgattggcagatgtgcgcggcgggccggtagatacctgacatacccctgtcatgcgggctgtctaagtcaagggcgtcgtttcactcgctcgaggagatgccgtcatgtcgaaggacagcaagctgaagcagtacaccggaggatgtctttgcggagcggtgcgtttcgaggccgagatggatctgtcggagcccgtgagccgctgcaattgcagcatctgcaccaaggtcggcggcacgcaggcctacccgaagccgagcgccttccgcgtcaccgcgggcgcggagcacctgggtgagttccggaagggctcgagcccgaacttccgctcgttctgcaagcactgcggcatccattgcttctccgccgggttcgtcgaggagctcggtggagagttccggtccgtcaacatccagtgcctggacgacgtcgaccccggtgagctcaaggtcgtgtactgggacggccgccatgacaactgggaggccgggacgcgtgacaggccctggcccatccggagctgagccctcgctcacgtcccgcgcggcttgcgccggcgagcgagccgctccgcctgctccgggttgagcatcttcacgtaggccaggaggccgtcgaggtgcgcgcggtgtgcctcgacgtcctccgaccgcccctcctggtgcagcatcgcccggagccgccgccgctcctcgcgtgacaagcccagcgtcgtattcacggtgacgccagtgacgcgctgggcaccgccccggcgctgcacgcgggtcttctcgcggttgacctcgaagccttcctcctgcacgtaccgcgcggccagcgcgcggactcgctccagcgccgtgacgtcgtcgccggagaaggtgaggtcatccgcgtagcgcgtgtacgtgtagccgtaccgacgcgccagtcccgccagccgccggtccagtcgcagcagcaccgcgttgcacagggcggggctcgtgggggcgccctgcacgcagacgcgtgggcccacgggaacgtggaagaggatgccctccagctccacgggctggcgctcggactccgtcatcagcaccgcgagcgtggccgccacgggatagccgtagcccagggcgatgagcagccctcgcacccgcgcgaaggtgacggaggggaagaagtccttcaggtccagcttcaggaccacccgccggcccacgtgcggcgcggcgcccgtcttgatggagcggccgggcacgaagccatgggcctgtggactcacggggagcttcgacaccaggagcgccagcatccggcgttgcagggccttcaggcgccgcttgggcgcatgcagcagccggacgcctccggagcgcttgggcacggcgaaggtcacgtagtgccgcacccgctcgcgcgggcggtggatgctgtagtggcggagcacgcccaccgagacgcccagggccgctgccacgtcctcttccgtgcgccagaccggcaggccgtagcgcgccagctgtgcctcgtcgggcagcaagtccctcaggttccggttccgcgtgcgcagcgtggcggagaacagccgccgggcctcggcggcctccatccacttcttccggcccggggtgtagcggcggacgcccttggggagcagccgcgcatcccggcggacctgtcgcaggtgccctggcttcagggggcccgacgtggagaccgtctccgtcacgacgtcctggggacgtccgtgggcatccagcggcacgtccagcccggtggtgcttcgtgtcacgggacggctgaacaaccccttgagccgggagagggtggtgtcgaaccagctcatggtgctccggaagaggccaggggacgacctgcgaggcgttggacccggggctccctgcgttgcgtacgctgggaccctggcgaagagatggggacagaacacccccgcggcgaaacaccgcggtactcatggctcatctgcgagccctggcctctcccgagagcacctgccgttatcgtcattcgtcgtctcccgggtcaagcgtctccgtgggccgccgccgcgcgtccgcccccgccgcccgggccgcgagcgcgtcctcggaggcgggctcggagctgcggagttcgcggcgctgcgctcgcgccaggcggctgagcgcgagcaggtgtgcgcaggggccctggttcagcaggtgctcgccgaagtactcgcatccgcaccggccgaagaggacacggtcctcgtcgttcatcaccaactcgacgcccgactgcgggcccgcgcggccatggaccacccagtcccggtgaaccacctcgcgcgtgacgggcccctccggcgtgggcagcgtgcgtaccttgcgcttctctcgcggcgccgcggaggtcacctccacctcgcccgcggcctccaggcgctccgcttcctcacggcgggcgtcaggcgggtacagacggcccaggtccaccggcgtggcgaacagctcgcggtggcgccagcgccgcgcctccacgtcgaagatggcgcgcccggccgcgcattgcgccgccagggcgcccgcggcccgcgccgtgtccacgcccagggcggtggccacgtcctcggtcgaggcatgaaagcgctcgcgcagcacgccgagcacacgctccgccagcgcgctgtcgcgcgccggctccagcagcaggtccatgcccgcggtgttcgtccagtgattcgccgtccacccggacaggcccagcaggaagcgcacgccgccgggcaggtgcgcgacgtagaagtgcggcagcgcgcggcccttcaggtagatgtccacccgctccgcgtagggcagcagcggctccagcagccgcagccgccggcggccccaggtccggatgatgcgaggcgccgtgtagccgtgggccgcgcccttcaagggcacggggtgctcccaaggctccagcatcagccgcgcgtcctcgcccgggtggagttcgtagcgcagcgcgcgcggtgacaccttggccttggtgtggctgaggaagcgcaccgcggcgagcaggtccaccggccgcgccgtcaggcgggtgccgggcatcgccattccgccctggagttggagcaggcctcgcacccagggctccgggacgtccaccttctgctcgaagcgaccgcccgcgccggtggtgcgcacgtcgagtccctccgggccgatgcgcaggtgtgtctcccgggtggagcgcatctcggccagcgccgcccacagccaggcggtgaagtccacgttggtggtgccgcagcgcaccgcgccctcgggctcgaagaggccgcggtccacgatgacgagcccgtaggcgctctggtcctggctgaaggcctcgaagaagacgcggtcggggtgcacggtgatgagcgggtccagcagcccgccgccccacgtctcgttccacgcgtccgattgccagatgagcccgccgagcgcctggagcgccatccggagagacaggacgtcccgggccacgcgcgcgtggaaacgcacggggcggtgcgtgtccgcggacaggctgagctgcgagcgctcccgggtggactcgaatacggagggcgtggcgtagaggaagctggaggccgtcacgcgccgtctcctttcgcgggcaggccgaagacgtgggggacttccgctgtgtctcgcagctcgggccagcgcgccagcatgcgggccagcagcgccatcagcgactccttgggatagcgcgagtccggcagcgcgaaggcgtcacgcacgcgcggcaccagcacgcgggcggcctccacgccgtgggcggcggcgttggccagtgcgtcgaaggcggcgtgacgcgtgcgccggtgcaggggtctcagcagggtggcctggagcaggtccaggttctgcgcggccacctcgcgggccttcgcggagttgcggccgagcagccggaaggccagcgcctggacgtgaatctgcggcgcctccagcaggtcgcgcacggcgcggggctcggccaggtagaagtcgtccgagcggaggaagaacagccgcgccagccggttcttctccatcagcgcgtcgaaggtccagatggaatgggcgggcagggcgcccagcgcgttggcggcgcggcgggcgaagacgcccccctcctttggcaggggctcgtagtgcgcggccagcgcgtcgagcaccttctcccactccttcgcgctccccgtcgccgggaggtgcatggcggcgcggctggcgaggtagtccagcaggtcctcgtcgttcgcttccagcgcgcgcatcaccagcttggggtacgcggcgcgccagcccgaagcgacgtgcatgcggaaggggccgcgtaccagctccggaaagcgcgcgtacagggcggtggcggtggcgtccgtcagcggctgcacccgggccaggcccaggccggggagattccattcgccgcccgcgcccgccagttggagcagccggcgccgagtccgggccgggagcgatgcgtcgtcctgcaccagccgcagcacctccgcgtcatacgtctccgccatggccgaggtgcgcaggagcgcgccccatacatcgtcccagtcccgcgcccgcgcgagcgccagcagctccgggaagcccttcgcgtcctttcgtcccagcgcgctccagcgaggagccaccgcctgcaggtggccgaggaggtagggcaccacgtcacgtccgcgcgcctccgccagctccacgaagagccgcgccgcgccgggcatgggcgcctccgggtggtgcgccttcagcgcggcgaccagttcggccggggactggacggtgcgtgcgagcgccagggcatcacggcaccatgtgggctcatccacgcatcgccggtagagcgcggaggccagggccgcatcaccccgcgcctgggcccgctcgcgcagcgtgttccacatgggctggcgctcgcggggccctctccacggcagatgctccaggatgaaggggcgggcggcctccgcgtccagcgcgtccagggccagggcggtgggctcgtccagccggccccagccgatgtccatcttggcaagctcggtgtgccgcgccgcgcgcgtgggcgctttctggacacgccgcaccacctcggtccgccagaactccgcctgccggggggcgcgcaggcccgcgagcttccagtccaggaggcggcggaacatctccacgtcgtcggcccggtccgcgtcgaagagccagacctccagcgcggaggaattctccccgagccaggggttctgccacttcccgtcggcggtgacgctgccgggcgagaagcaggacagcatgagggggcggaagcggacgcggtccctggcgtggagggcgggcccccacagccaggtgaaggaccggaaggcggggcggcgcgccagttcctcgagggcggcacggagctcttcgtcagactgtgtccgggacaggacgccacgcagggcggcgtccatctctttgacctctcggcggaatcgccgctcccagctttcgttcacgctccccggtttacaccggccgctccgggagacccagcggcgaagcggtcaacccatgtaggaaggcgggtcgctggcgggaaacgaagacatggagccttcgtcgacgatgtcgcgattgcccgccgcgtcgcgtgactcgccggggaggatgttccaccgtccgtgctcgcccgcaccgtaccgcgacgggtcgcgaaggctggaggcgcgtgcgtcgatgaccaccggcatgcggctgcgcgcgcgccactgcgccgcgagcagcgcggcctgaatggccgcgtcggccaggaagacgggggagcgccgcttccggttcgtggtgtacgtggagacgtcgaccaccaggagcgtgagcgcgctccagatgcccagcttcctgagctccggcgtgacgcggccatggcggtgcgcggacaggagcgtcgcgcccaccgtgccggcgagtccgcccaccgtcttcatcaaccagccttcgcggatgggcccggtgaaccgggtgacccgcttcggctggagccagggcaacaggcccttcagcaggaaatacgcgccctggacttcggccgggtctcttcggaaaaacgaagcgagtcgtctgttcatccgctctctgcctcccgcgctcaaggtgcttcctggcgcgaggaagggcacctgggccgggcgggcaggcaggcgtcaccccggagggcaggcgggcgggcactggcgctcagacagttcggggcagggacgtcagtccaactgggtggagacgatggggtcctgcgccgccgtgttccacggcagcgagggccaccagcgttcgagggaggacggcgcaccgggttcgacgcgctcacccggcttcgggacgatgacgctcacgcccgtggcctcacccgccgcgagcacgcgttcaatgggctccgtccatccgtggagcgcgagggtgaacaggccccagtgtaccggcagcagcacgcgcccccggacccactgatgcgcggtgatggcctgctcggggccgatgtgccagtcgggccacgcgctgtggtactggcccacctcaatcatcgtcaggtcgaagggccccagccgctcgccaatgtccttcattgcggggaacaggcccgtgtcgcccgagtagtacacgcggtgcttggggcccaggaacgcgaagcccgcccacagcgtcgcgtccttgtcgatgcccgtccggcccgaggcatgccgggcgggggtgcagacgacctccagcgctcccacgcgcgcacgctcccaccagtcgagctcgatgatgcgcgactcggggataccccagcccaccaggtgtgcaccgacgccgagcggcacgatgaaggacgtgtcccagtccttcatcgccaacagcgttcgatggtccaagtggtcgtagtggtcatgggagatggcgaccgcgtcgacggcgggcaactccgtcagcgccaggggcggggcgtaccagcggcgcggtcctatccagctcaggggcgacgcgcgctcactccacaccgggtcgatgagaatccgctgaccgtccagctccacgagcgacgtcgagtgcccgaaccatgtgacgcgaaggccggtggcgggcggcgcgccgaacgcgctcccgtccagcgtcaccgagggcagcgctccctgggcagggctcacgtcgggactggcgctgaacatgctcgcgatggagccccaggtgtcgttgcgcaggggctgcgggttgtcgaagtgcccgtcctgccactggggcgagcgctccatgcgtgcccgccgcgcgccgtccgcggcctgacccagcgccggccaggcctggatggtgaccaccgtcagcagcagggccagcagcgccgccgttcccattgccgcatacgccagcctccttcgccacgtcatgccgtccacccgcgctcgtcgttaggcggtgatgaattgacgaaataggacattcttgtcaatttgttccgcatggcgggcaccaggagcgaagagcgtgatgcgttgcgccggacggcgattctcgacgcggccctggagtgcttcctgcgcttcggctacgcgaagacgtccctggatgacatcgcgaagcgggcgaacctgtcgcggccgctcctgtatctgaagttcaagaacaaggaggacatcttcgcggccgtcttcgaatccctgttcgaagcgcgctacccgcgcgtggagcaggtgctggcgcggccgggcgccgcgggcgacaaactgctccaggtgtacgaaatcatcctcctggagccgtgggagttgatggccggggcgcccatggcctccgagttctacaccgcctgcgagcggctgttgccggaggtggaggcgagacatcgccgacgctggctcaagtacacgcaggccgttctggagtcgcggccgctcgccgaggtgttcatgctggccgtcgacgggctccagtccgacctgcccacgacgcgggtgttgcgtcagcgcctggagttgctcgtcgagcgcttcacgggctgagggcggcggagccgcacttggcgcgcagctcccgctgttgtcgggtgaggcatggctggagaccgaggacctgctcgcgcgtgtctccgcggcagtgtcaccctgctaccactggccgggcgcccccggtatctccccaggggcgttccgacgtggcgccgtgccagccttcatgccggcgcggtgccaggtttctcgctacgcccgtgcgggggccagcgccgcgcgcttgctgtaggtgtcgcagagctccaggtattcgtcgctgtcgatgtcgagcgccgccacccgcatcttcttcgtcttgggcttgtccagcgtggtcttgatttgaatcatcttgagcgtggggatgcccatgtaggactggctgtaataggtattctcggtcatgtcggcccattcaatcagcaggccatcctcgaagcggatgccatcccgaccgatgatcagcgcgggcttgtccaggttgcccagcggcctgatgcagccgtagagcatccagaccatgcagaggttgaccgccccgcagagcgccatcgcgccgagactgttcgccagccggaaggtgaggatgccacagaggcccgaggccaccgtccagatgaccacaccgatgatgagcttcgtgcgcgagtaatagacctcgcgcggcttcagcgtcttctgcttgttctgcgaggaactgtagatttccatgacgtgcgacctgtgaggggaaagggagtcagctggccagccgttgcgacaggtaggccaggaggacgggcgcgttgacgatgcgggcctcgtcaatcttgagcggcttgccctgggcggcgatgatcagctcgcgggtggagacaccgtcgccgaactcgtcctggaagcggatgctctcgatgtcgtcccagcgcatcagccgcttcttgtgcgtcagcccggcgccactgagcgagaggggcccgaactgcaccgtcttgccggcgttgacctgccggtgcacgccgtcaatcagcgcatcgacgacatggtccgtgacgtgggcgtacagctcgtccgcgtcgctccacaggttcaacctcagccggtaggtgcccccgcggtggcgcaggacgagccggtcgtggttctgcaccgtgatgatggcgctcacgttccgccatgcgatgcgcgtgtcacccgcgcgcaggcactcctcatccaccaccagcttgggcggcgcggccagccatgagaacaagtcgctggcccgccagaagatgaaatagaggccgcaggggatgcccgccagcaggacgatttgcgcggagtggtagcggaagagccctttgatgaagtcctgcgggagcaggtaaatcttgccgaacgagagaaacgccgcggccaccacgtaaatcagggcgaagccagcggcgagccagtacaggacgtgcgtggggaattcccgggtgtgcgagcgcttcagtgaagcctccagagccgtatcgaaaagtacacgcacctataaacaatcgcatgtgtcttttcgatgagattcgccaccgcgctcagggtgaaaccggcgtggcgcatttcgccagggtctcataccccgtgtgatgtttcagggttgctcaggtgcggcgaattcgagaaacaatcggtgttctcaagtcgtgagaagtcattggatgaggttgcgtgaaacacagcctttccgtgtctgtcgtgcctgcggcatggcggagcgcattctccggacggcgccgggccctggcgggtggatggggggcgggggcatcaggtggcacggcgccatccgccgcgcgcggtgtcctggccagcgtcgatgcggatgtcgctggccgagggggcgtggcctcacgcgcaccgggtgggcctggcgtccccgcgttggtgcgtacccgtcaggtcgtgcgactcgtcaaggcgaacccggttactcctggctccgtgaacaggattggggtttcgtgcaggggcggcgccgcaagtcgacgcatacgccaatcgtacacagcggagcagccccacttcttcaacccctactggcgtctccgtctggcgtcggtgtaccaggggcgccacgcgctgccctcgctgggggcatgctggacgcgctgccagggccgctgcgcgggattgcgcccaagatcgtcacgcgctgggcctggggccggtccatgctccggcgccatggcggagcgtcgtggcgccgggtcctggtaccgccgcggcacctggccgtccgcgccggtgccgtggatggcgtgcgcctcgaccaggatgtcgaggcacagcagacctcccaagcccatgcgcaaggtgtgcaagggtcgggcttgggatgagcgtctgacaaccgacagtgcaaacgcgggaactccggccaaaaggccactattcactgtgagtagtgggcaggtgctattgcgagtgaattggctgccatgcagcatgcgggcgtttctgtatgggattgttttggctgagttccattttgaggcctgtctggggtgatgggcgggatgttcgtgtcgttttgatgcgggggcatccgtctggaaccaccgtcgcggcgctgccgcgtgcggaacgggttcgcgcgggttcgtgagcgtatttcaagagtctttgtctgggatgccctttgccgggtgtcgtatgtgcgcaaaggagaggacatgcatcggaagactgggatgtggaagcgattggctcaggtggttcctgtcgcgggtctcatgttgatgaacctgggttggagtaatgcgctcaaggcgcccgaggcgaacctggcggagtccgggcggctgacgcggaagttcgacgaaatcagccagcggacggggcagttccaaatcaatctggacctgtcggacgagcgcgactggaagttcctgcaggggcgcctgcgctccgcagggaaggacgcgaagaactcccctgaactcttccgccggctggacgcaggccgtgagcgggcgctggcgcgtcaaggcgtcgccaatcaggtggagacggagcgggcctggtgcaaccacttcctcaagtacagccagccgcacgtcgccaccaacaatggctacaccaccttcttccccgtggtggaggtggtgtgcaaggacggcgcggattacatctacgccgacctcttcaactacgacgtcaacgaggatgagacccagacggtgctcgtctcctctgatgcgggagaagagtacggcggtggaatgggcttcgatgacgtgaaggctcccgccacgattgccacgggcaaggggcgcacgctccgcatggagtccctggtaatggccatggggcccaacatcgaccagacctcgtacatcgtcgagcgcgcggcggcgctgaacgcgcccacgacgttgaccttcacgcacccgcgcaaggtgttggagcaggcgtcccgcgccgaaatcgtggcctgtcaactccgtggtggcgcggactgcgactacgcggtcgccggctaccagaacggcacgctggcgccctatcctccgtcgcccaccggcgtggcggcgtcctattccaaccagccgggcgtgctgaacgcctcggacttctgggccttcaatgcgccctacaactaccagaacctctacgtcccggtgcgcggcacgctgagcgctggcgcggaaggcggcttccagtgcgtagtggcgcagattgaccgggcgcgtgtccagctcatcgccgcgcagacggggcgcacgtgcctcaatgagacgttcttcgccaactccatccccattggcgggaaccagagctacatcaacgtgctgacgaacgtgaactggctgttcaacctcccgggacagggctcgggcaccagtccggattcgtgcgcggcggagaccatcatcaatgagctgacgcgcttcaacatccacgtcgccggcaaggtgcgctgcaacaccaaggtgaagtccttcttcgtcacctacccgatgccgaccacgggcgtcacgccgaacatctacttctggaatagctgcatggcggagggcacccaggtgaagctggcggacggcacgctcgccccggtggagagcgtcaagctgggtgacaaggtcatcgccgacgccaagggcacggtgctgaccgtcaccgacgtggcgcggggtaacgaggccaagccgctcttccgtctgcgcgacagcgtggggcatgacgtgacgctcaccgagatgcaccccgtcatcatgagcaccggcaaggtggtggcggccaagaacctgaaggtgaaggaccaggttcgcaccgtgaagggtgtctccaccctgacgtccatcacccccgtgtcgcctgacaagatgcgcgtctacaacctgcggctgggcacggacccggagctgctggcggtgggcaagaatggccgcaccctctacgcgggcggcttcctggtgggggacatgaccatgcaggacgaactgcaggcgccgaagcgcgagccgcaggtgtcgctcctcaatcgcctgcccaaggcctggcacacggacttccgcaacggcgtccgctccacccagtcgcgctgagactcgcgtctggccaggccgggagccgcgcgtccacgcggctttcgggccccggccgtcacccgacgggaagcgcgctggcctcgtactgcttcgcgaagtcctcgctcggcggaatgggcttgatgacgtcgatgagcaccccgttggggtccgcggtgatgaagtgccgctggccaaacgcctcgtccctcagcgggaggtggatgggcaggccggcggcctgcacgtcccggtagacggcgtccgggtcttccacttcgaagttcaggatggtccccgccaccgtgccccgggccaccgccggcaccgtttcgtgccggccgtcgaggatggccagcgcgacatgctctgcatcgtccgactggaggtggacgtaccagtcgctggtgaagcgcgggctgaagccgaagtgcgccgtgtagaacgccgccgtacccgcgacgtcgttcgtcatgatgaccgggtagtaactggtgattttcatgggcttccgctctccttcgggcttgtttttcaatgaggtaacatacaggctgcatgtatgcaatcgagggcacgacgaagcaacgatgagcgcagcgcgacgacgcggcaggcgctcgtgagcgcgagccgggcgctgttcgtggagaaggggtacgcgcagacgtcgacgccggaggtggtggccgccgccgccgtgacgcgcggggcgctctaccaccacttcgaggacaagcaggcgctgctgcgggcggtgctcgagcgggaattcgccgagctgcgcagggccatcgaccaggcgacgccgccggctttgggcgcgcgggaggcgctcatcgctggaagtctggcctacctcgacgcgatggccatcccgggccgcacgcgcctgctcctcgtggaagggccagcggtgttcggccatgcggagatgatggcactcgacgagtcctccgccgcgggttcgctgcgagaagggctcgccgccttgctgggggacgggtcgctggtgccagcgctcgccagcctgctgtccgccgccttcgaccgcgcggccctggccatcagcaccggcggcgatgcgaaggcctaccgcgaggcgatgctcgcgctcatcgagcgcgtcaccgctggcgccggttgttgagcggcagcggctccagcgtgttcgactccgtgtcgtccgacagggccgaggccagatggaccaggttggttccgctcaggtaggaggcgatgatggcggagatgcgcagcacgagcagcgtgggctcgaaagggaggatgtcgcgttcctggagccaggcgagcgtctgcggcgcgtaggcggcgttgcaggccgccaccacgcccaggagcaggaacatctggacgatgcccaagaaggtgttggcccgggagcggaccaggccggcgagcccgcccagccgttccatgagcagcggcctgacgaacttcatcaccaggatgccctggaggatgcccacggccagcggaacgaagatttcggccagggccatgactgtctgggtttgttcgctcgaactcatggccgcggacgatgctccgccacgcaaagcgaatcaacccggcccgccggttgacggatgcggcacgcgagcgtttcaggcggcacagcgggtccaggcattgcgcctggacccgccgtgtcactttccgaaaaatcagccgccaagctccacgttctccagcacgcccagcgcatcggggatgagcagcgccgcggagaagtaggtgctgaccaggtagttcgtgatggctttgtccgtcacatccatgcggcgcacggagaggccgggctcgacttcgtccggcaggccggtgcggcgcaggccgatgacgccctggtcctcctggccggtgcgcagcacgaggatggagctggtgcgctgctcggtgatgggaatcttgtcacacggcagcagggggaccccgcgccaggccatgcacggcgtgccctggacctcgatgggtgtcgggtagatgccccggcgggtgcattcccggccgaacgccgcgatggtgcgcgggtgcgccaggaagaagcgcgacttgcggcgccggctgagcagctcgtccaggtcatcgggcgtgggcggcccgttgcgggtgtggacgcgctgcttgaggtcggcgttgtggagcaggccgaagtcccggttgttgatgagctcgtgctcctgccgctcccgcagcgcttcgatggtcagccgaagctgctgctccgtctggtccatggggtcgctgaacacgtcggagacgcgcgtgtggacccggagcaccgtctgggccacgctcagctcgtactcgcggggcgtgagctcgtagtccacgtagccgccctggatgtccggctcaccggagtggccggcggccagggggatggcggcctgccccagcttgtcctggggcttcttcaggcgctcccggtaccgctccacctgggcgcgcagcgtggcggaccgggcaatcaggccctcgaacacctgctgcggcagggacagcaccgtgcatggcgtggtggccttgacggtgaaggtccagacgtcatccgactccaccaccgcctggtcgccgaagtggtcgccgtccgccagcacgtccagggtgacgggcgcgccatacgggcctgcgcggagcttgcgcgccttgccgtgggccagcaggaacacgtgctcggcgggagcgcccgcctcgacgatgacgtcgcccgccttgtactccgcctgggtgaactggctggccagggccgcaatcacctcgtcgtcgccgctcaggccccgcagcagcggcagcttgagcagctcctgcgggatgacctgcaccttcgcgccgatgttgctgaacacgaggcggtcatccgccaccgcgtagctcagccgacggttgacccggtacgtgccgcccgtcacctctacccagggcagcatgcgcagcagccaccgcggggtgatgccctgcatctgcgggacggtcttcgtcgtcgtcgcgagttgacgcgccgcggccgtgcccaggctcagccgcggggtgtcgtcgcccgtcttcacgaatttcgtcatgtggattccctcaggtcatccgagcggaaggagggctagtcgccgcggccgatttcgacgctctccaggatgcccagcgcgtcgggcacgaggacggccgcggagaagtagctggtgaccaggtagttgatgatggccttctcgttgatgcccatgaaccggacgttgaggccggcctcgatttcgtcggggatggtgcccgggtgcaggccgatgacaccctggttcttctcacccgcgcgcatcagcatgatggacgtggtgcgcgagtcgctgacgggaatcttgctgcacgggaagatggggacgccgcgccaggcgggcaccatgttgccgttgaagtccacgctggtggggtagatgcccttgcggctgcactcctggccgaaggcggcgatggcgcgcgggtgggccaggaagaaggacggctccttccacacggtggccagcagctcgtccatgtcgtcgggcgtgggcgggccgcgccgggtgtggatgcgctgcttgaggtcggcgttgtgcagcaggccgaactcgcggttgttgatgagctcgtgctccttgcgctccttcagcgcctccaccgtcagccggagctgctgctccgtctggttcatgggctcgttgaagaggtccgccacgcgggtgtgaatctggagcaccgtctgcgccacgctcagctcgtactcgcggggcgacgtctcgtagtccacgtaggtgccgggcagcaccggctcgccggtgtggcccgcggccagctcgatttcggcctggcccgtggtgtcctgcttcttcttcgagcgcgccttgaactgctcgacgtgcttgtgcagcgagggcgactgggccatcacggcctcgaagtcggactgctgcagcaccagcacggtggaggccgtggcggccttggccgtgaacttccagtagtcctgcgactccagcagcgcctcgtagctgtagtggtcgccgtccgccagcaccccgagcacggtggcgtcaccgtacttgccggcgccaatcttgttcaccttgccgtgggcgatgaggacgatgcagtccgcttccttgcccacctcggtgatgacatcgccggccttgtacgtcttctgctcgaagcggttggccagcgccgtcagcacctcgacgtcgtcgtagctgcgcagcagggggagctcacacagctcctgcgggatgacctgcaccttggcgccggtggtggtgaacgtcacgcggccatcgcccaccgcgtagctcagccggcggttgacgcggtatacgccaccggacacctgcacccagggcagcagcttgagcagccaccgggaggagatgccctgcatctgcgggacggacttggtcgtcgtggccagctggcgcgcggcggccgtgcccaagctcaactgggacttctcggcgtcactgcccggcttgatgatgttcgacatgatgggcctttcgagtgagatggaagatcaggcgccggagcgcaggttggcgaacagggaggtgatgcgtgcggcggaggtacccaggccggtggggcccgacgagagccgcggcgccagcttgcgggacgcgcgcagctcgaactccttgtagcggtccaccgtctggtgccagatgagcacaccgctcatccaccactgcagcttctggacgtactgcttcagcttgtcctgggccttgccgtccaggttgaagttgcgcgccagcggctccagctcgttggcgatgatgtattcgaactgctgcatccgcgcggtcatcaagtcgttgacgacggagacggcccgcgccgggtccaggtcaaggaagcgctggacgaccaacacgccgttgttgagctcaccttcgaactcaatctccttctggtaggagaagacgtcgttgatgaggcaggcgtaatccgccgcggagttctccaggctgcggatgggacgggtgtggaagacctcgggcggcagcgcgtcgccatgggccaggcgggacaggctcatggtgaggtccgagccgaacgtctggcgccgcatctccacgtagtcgatggggtccgggatgcggttctggatttggttggccagctcccacacccagctctccgtcatgtccaggatggccttgcggaacaggctccgtgaggcgggcgtcacgccttcggtggtgcgggcccacaggtccgccagcccgcgctccaccgggttggtggggggcggaaccaccgcgccggcgtcctccggcacgaacagcgccagccgggcgttgaacaccttggcgccggccatgtccttggtgtgaccgtagaaggccgggaagtagtcgtccgcgtaggtgccccagacgagccagcaggaggacaggttgagctgcgcggcggtggcgtggggatgaatcaacgcgccgcagagcgccacgtccgccacgtcgaacttgtggtcgtcccagatgtagccgccggggactccggggagcacgtccagcatgcccatgcgccgcgcccacgccttggagtcgcgccgcgcggcgtccaggtgggggctcggcttcgtggaatacggcatgtagaacttcggcagcttcaccgggcccacgggctggtacggcacatgggagaagttcttgaggcgggtgagccccagggccgtgggcgactgtggcagccgcgccgcggaggtgcccaggccgttggggcccaggaagaagccgcccgcgccgccggagcccttgttcatgtagcggctggagcgcatgtgccactcgtggccgccggactgccagtcctggagcccccggacgtaggtgagcacctgggcctgctccaccgggttcaggccgaactcgacgaacagggacggcagctccgtcaggacggtgttctcgaactgctggaggcgcgaggtgaggacctcgttgacgaggtgcgcggcgctgggcggggagatgttcaggaacttctccatcaccaggacgccgttggagagctcgccttcctccagaatctcccgctcgtaggagaacaggtcgttgcgcaggtggaccgcgtcggagaacgtgtccttcagcacccgcatcgggcggctggccgcgacccggtccgggacttcggcgaagacggcgtgctccaccaggttcgcggaccagggcgcaccgccgaccttgcggcgcatctcgatgtattcgatggggttggagacgcggcggtcgctgatgttggacagctcccagctcgactcgtccagcaggtgcttggtgctctcgaagaaccggcgccgccatgccatggagcggctggggacggtccggttccacaaatccagcagcccggcctctaccgggttggtcggcggcggaggcgtggccgccgggtcgaccggcatgaacaatggcagacggtccaggtaggccttcgcgccgacctggtcctgggggcgcttgtagagctccaggaagtggtcatcgaagtagaagacccagacgtaccagtcggtgacgaggtccagctccgggcccggcgcctccggatgcgtgtaggcgcagagcagggcgtagtccatggcatcgaacttcgcctcgctccagatttccggagcgctgccatccttcgggcggccaatgattcccagctcgcgtgcccaggccttcgaatgcacccgggcgccttcgaggttcggattcaagcgcgccggccagggaacgtagaagtctggcagttcgaatggctgcttgtttttcgccgtactcatggacgcccctcgttgaactcaggggggcgttatagttaggcgctgaacacttatccaagtgtttcttgcataaaagattctctggagaagtcgcgatttgcctgctggcgcacggatttagctccatccgtgcgccgtattgctcccgcgataagtcgtgttttcattcaccagtagtactggtgacgaactccacgcggcggttggcgctccgtccctcgggcgtatcattggacgcaatgggttgggcggggccgtagcccttcgcagtcagccgcgaactctcaattccttgctggatgagatattgccgcactgcgtctgcgcggtcctggctcagtgtgcgattgagctcctcggggccggtgttgtccgtgtgtccttcgatgcgcagcgacacgcccgggttggccttcaggtagtccgcgatggcgtccaggttccgacgctccgagtcggagagcgtcgactgacccaccgggaactgaacgtggtgctcggtcggcagccgcgtcggcgcttcggtggtgggcgcctggggcgcgagctcgggagcgggcgcctggggcgcgggctcgggagcgggcggcggcggcgtgggctcctgcttgggttcggggcagccacggtgggcggcgacaccggcctcgttcgggcatgcgtcctcgcggtccacgacgccgtcgccatccgcgtcggtgtccgggcagccgtcgttctctggcgggccggcttcgagcgggcagcggtcttgcccgttgggaaccgtgtcgccgtcgtcatccagcgcggggcactgttccggcgtgtggctccggccgctccggcacacgtcctcccgtgcgggcggctgatgggcccaggcgatgcccgcggccgcgcggatggacggcgtgcccgggatgtccgtgaagccatgtccggcgatggcgaaggcctcgaagccgccgcccacgggcagccgcacgccgcccagcagctccagcgcgaagtccggctccaccagcgactccgcggcttgcagcgcgatttcgccgcgcaggcccttgccgcgcgtggacacgacgatgccttgctccagctcggtgccgtagtcgcgcccgggctcgttctccgtggagcggatgcgcacgcccgcgctggcgccgagcacgacggggcccactccggctaccggaccggggcgcgactgagccgcc

SEQ ID NO: 1256 - DNA, 31826 bp, Myxococcus xanthus
gatccggccaccaccggggaagaagcctgtgcccggcagatggtggagtcgctcgcgaaccgcgcctggcggcgtcccgcgaagccggacgaggtcgcggagttgatgagcgtctacacgctcgtgcgggagtcgggggacggcttcgagctggcggcgaagttcgcgctccgttcggtgctgctgtcgccgcacttcctcttccaggtcgtggagacgcaggcgccagggacgggcaagagcgagctgtccgcgcgcgagcttgcatcgcgcctgtcgtacttcctctggagcagccagcccgacgcggagctgacgtcactggcggacgcaggccggttggccgaccccgaggtactggaggcgcaggtgcgccggatgctgaaggacccgcggtccgaagcgctggtgcagaacttcgccggccagtggctgggcctgcggaaggtggacggcatcaccgcggacccggcgctgttccccggcatggattccgagctcaagcgcgccatgcgcgaggaaggggagagcttcttccgcgccttcctcaacgaggaccgcagcgcgctggagttgctggacgcggacttcacctacgtcaacgaccggctcgcggactactacggcctgcctcgcccgggctccacctccgtcacgcgcgtgagcacgggcgacggacggcgcggcggtgtgctgggccaggcaggtgtgctggcgcaggcgtcgctggccacgcgcacctcgccggtgcttcgcggcaagtgggtgctgggcaagctgctgtgccaggagcctcctcctccgcctccgggtgtggaggcgctgcccacgcaggtgccgccgggctccacgctgcggcagatcaccgagctgcatcgcgcgaacccccgcctgcgcgggctgccacgacacgctggaccccatcggtttcagcctggagaactacgacgcggccgggggccctggcgggagacggacaacggctctccggtgcacgccacgggcaacttcaagggcgtgtcgtttcagggtccgcgtgagctggcgaccatcctcaagggcgacccggccttcgcgacgtgcatgacgcggcaggcgctggcctatggcttggcccgcgcgctcacgtacgagtacgaggccaccgtgcgctacgtgcacacgcgcttctcggcgggtggacaccggctccccgagatgctggtggccgtggcgctcagcgacagtttccgcaaccgctgcccggtaccggccgcggagtagaacggcgcacgggccgtgaatacggcgctcggacggccgtcgggagcaagcgggcatcctccgcttgctcccgaaaggtatttcgatgcgtacccgtctctggcccgctgtcattgccctgctcgcactgggaagcagcgcctgtgtcatggcgccccttcagcccgggtacaccgagtgcggggatttcatgggcgatgacccctgccagccggggcagtactgcgcggacgccacgctcagctattgcgagcccggctgtaccagcgacgtgaactgcgcctccaaccaggagtgtgtgaaggagtacagagagcaggtggggacctgcctcaacatctgcacgtcgtgcgcatacgattgagccggcgggcagggcgcccgcggctttggaggtgacgtcgatgcgcgcggtggtgttccagcacgaggagcacgaagggcccggcctgctggggccggtgttgcaagcggcgggcttcacgctggtgaaccgcttccgcaccgtgcgccgggaggacgtggacgcggaactgctggtcgtcatgggcggtcgcatggccgtctacgaatccgagcagcatcccttcctgcggcaggagttgggcatcctcatggagcggctcgcctatgagcgcccgtgcctgggcttctgcctgggcgcccagatgctcgctgcagcggcgggcgcggacgtgttccccgggaagaatggcttcgaggtgggcgtgggcccggtgcgatggacgccggaggcgcagaaggaccccgtgctgtccggggcccgtccgcgcacggtggtggcgcactggcacggtgattcctatgcgcccgtcccggacgccacgttgctggcgtccacggaccggtacacccagcaggccttccggttgggcacgtcctacggcttccagttccacctggagctgaccgccagcgagctggggcgatggattgacatcgaggcggacagcctccagcaacgcggaaagaacctccaggagctgaaggcgcagttgcccaagctcaaggcggccgaggccgacaacacggaggtgctgcaccgcctcgcgcaccacttcgcgcgcgtggcggcgggccgctgacgtgctcgatggcttggactaacggagccccttggggcggcgggccgcgctcgcggacggtgacgccacctgggaggagatgtccgcgtcgctgccgtcgccccctgggacaccgtccgcgccgtacgacaggatgacagggttgccgccctcattcatgtacacgtagtcgcggttccacgggtcctggggcagtcgctccagcgagcgcgcctggaggagttcttccaggccggcctgggtctccgggaagctgccggtcttcatgtagtggagcttgagccccgtctccaatgtcttgatgtccagggcggcggtcttctgcttggcctcctccaggttcgacatcacggagacgcccaccgccgcggcgatgagtccgaggatggtgatgacgaccatgatttcaatcagcgtaaatccgcgaacgtgacgacgccgagcgttcagcttctgctgggttggattcatctttgagttgtgacctcgtgtgacgttgtgtctggcgcgtgcgtgcccgacgtgtcgccatgtctgccggtgcaagggcgttgcacatgccgcgggttgcgtgcgcctggagcaggacttcgacgccaggcgcggacgttcgtcagtgcagtcgccgtgcctgaccgggcgcgccctgtccccgtttgcgcagcgtgagcgactgtcgctttccacccgcggagtgccactcctgcgcaggtggatgcgggtacgcatgactctcaccctccggattcggcgcggatggaccgcgcactcaacggaggccgtcatgaagccccatctcccactgctcatgctcctgggcgccgcaggttgtggcaccgaagtcgaggatgctgacttcacgagtcaggagtccgccctgagtcagaagtgggagttgtgcgggaaggaggccgttcgattggcggacatccaccctggccccgtggggtccaatccggccgatctgatccacggcgaccgagtcctcttcttcacggcggacgacgggacacatggacgcgagttgtggcgaagcagcggaacggaaggaagcggcacgtcgctggtgaaggacatctacccagggctggcggggtcggagatctcgaatctcactcgggtggggaaccgggtgttcttcgccgcggatgacggcgtccacggctacgagttgtgggtgaccgacgggacgtcggccggcacgtacctggtgaaggacatctacccggggccggaggatgggattcgccgtccggaccccttctactggataaacgatcccatgctggttgagttcggtggtgtcctgtacttcggcgcgaacgacggcgtgcacggatacgagctgtggcgcagtgatggaacagacgcggggacgtacctcgtcgaggacatcgagcccggacccgctaactccttcccgcgaaggctcgttcgcgtgggtaacgaggccttctatttcgtcgcgtccaagcggggcccctggagcgatgagattcatctctggcgtagcaccggagtgccaggggccattcccgtcctcagcctggtaggagataacgtcatcttcgacttgctggctgtgaagtcgcgcctctatttcctcgtggataacgacgagggcgaagccagcttgtggaagacggatggggccgcctcgaacacgcacgagctgcggtacttctacggagagtatccgcacgacctggtcgcactgggctcgcgtgtcgtcttcagcgccggggcaggtgagccagagggtgaggagctctggagcagcaacggctcgacctcaagcacgaagctggtgaaggacatctggccagggcccatgagctcctcaccgagctctctggcggttctgaagtcgcgagtcttcttcgccgcgaatgatggctccggagagggacgtgaactctgggtgagcaacggtaccggttcggggaccaggctcttcaaggctctggcgcccggtggtggctcatcggatcccgaagcgctggcctccattgaaggcacgctgttcttctccgcgagcgatggggtgcatggacacgagccctgggtgagcgatggcacccgttcgggcacgaaggcgctgcgaggtctggcgcacgggagcgcttcctcgtcgccgcgcgacttcgtgcgctcaggctgggacgtgttcttctcggcggatgacgggaagactggacgcgagctgtgggccttgccgttccgtccgaagggggagtgcaagcagcaccacgcctactgagcttcggcgcccacgcccagccccttttggtaacaacgattccaaggggttgggttccccggatgggtggaggtcgaaggatcagaccctcgtgcgttaataaggtgtcagttgaaacctgccgcggggacaggtctcgacgagggggaacatggcgccgacgtacgacgcgctggtcattggcaccggctttgggggagcggtggcggcttgccggctggcacaggcgggcttgaccgtgcgcgtcctggagcggggcctgcgctaccagaaggggagctttccccgcgactggagcaacccgctcaacggctggctgtggcggtacgaccagggcctcttcgacgtgaagctgctgccggggatgagcattgtccaggccgcgggctacggcggcggctcgctcatctacgccaacgtccacctgcgcccgcccgcggagaccttcgacgccgactggccggagggctacagccgcgccgcgttggatccgtactacgacctggtcgcgtacatgctggacctccagcccatcaccgcgtccgcacgtggcctgcccaccaaggcgaagcggatgcgggaggtcgcgcgcaaactcggccgcgagcagcagttcttctacccggaccttgccgtgcgcttcgcccccgccggcgagccgatgcccaacaagttcggcgtcgcccaggagggctgcaactactgcggcgaatgcgacatcggatgcaacgtccgcgcgaagaacacgctggacctgaactacctggccgtcgctgaacagcagggcgcggagatgaccacccaggcggaggccacgcgcatcgagccgctgtctcccatgggctatcgcgtcacctataccgaccatgccgcgggcggcgccgagcgcaccgtggaggcccgccgcgtgttcctgtgcgccggcacggtgaacaccacggagctgctgctgcgctgccgcgaccagtggggaacgctcccgcgcatcagcgaccggctggggtgccgctattcggccaacggcgacttcctggccttcgccttcgagacgcgcgaggtgtgggacccgtccgagggccccaccatcaccaccagtctggtggtggaccaggggcagggcgcggacaagacgtggttcctcttccaggagggcgggcaccccgggaaggcggcggggctgcttcaggtgctggacatgggccgggacttccgtgtccccgcggacctgctccagaagcaactcgtccgcgccctgcgccggcgctcccagcctgaaaccgtcatgggcaaggagcgcgggcgtttccaggccgtgttcctggccatggggagggatcgcgccaacgggcggctcgcgctgcggcctttgactcgggacatggaggtgcgctgggacgtgccttccaacctgccgctgtaccggacgcaggagcagatctgccaggacatcgctcgggcgctcggggcgcgcgccgtcttcaaccccctgtgggatcggcttcacatccccgtgtcagtccacaacctgggcggctgcaccatggcggaggagccggcctacggtgtgctgaacccggacggtgaggtgcacggccaccctgggctgtacgtgctggatggcgccgcgctgcccgcgagcaccggggtgaacccttcatccaccatcgccgcggtggcggagcgcaacgtcgaggccgccatccggcaggtgctggggaaccccacctggaccgcacctgagcgggccggaacggcttcgggccgggcgtcggcggaaccgttccgcgcgtcgatgcggatgagcacgagtgtggcacccacgcgggtggtgccaagagaggatccgatgcggagcgtggtgattccagagggaggcacagtgctgtcgccaacgcccgtggtggggctgcgcttcaccgagcggatgcgcggcttcatcaaccacggccacctgccggacacggattacgcgggcgccgaggaggagggcaagtcagagggcagggtggccgagttcatcctcaccatcaccttgcccaatctggaccgcttcctcgcggagaaggcccattcaggcatcgcgcaaggcaccgtccacgtccacggcctcacacctcctggcggagcgaaggtggaccacggcgtcttcaacctcttcgtggacacggacagctactacgagcgtcggatgctctacctgctgcccttcaccggcatggacggccagcagtacctgctggatggctacaagcatgtccgggacgacgacggcttcgacatgtggtccgacacgtccacgctctacaccgtcattcgccggggcagcgaccggcacgcgcccgtggtcgccagcggcatcatccgtctgggcatgccggacttcctgcagcagctcacgaccttcgccgtgctgggaacgacgtcaccgctggcgaaggcccaggccctgaagcgttttggcagcatgttcatgggcaacctctgggacgtcttcgcgcgaaccaagctggaataagagaggcgcatcgtggcgaaggcatcgcggtacgacgtggtcgtcgtgggctccggctttgggggctccatcagcgcgctgcgcctggcccaggcaggcaagtccgtgctggtcctggagcgcggcaaacgttaccggcccggtgactttccccgggacgtgacgcgaacggacgaggtgctctggcgccatgccacgcggcgcaaggcgcagggcctctatgacgtgcgcttcctgtccggcatcggcacggtgacggccagcggcgtcggcggcggctcgctcatctacgccaacgtccacgtgcggccggacgccgaggtgttcgaggacccgcgctggccccggacgtaccgccgggactcgctggagccttacttcgacaaggtggcgcgggagctgcggttgaatccggtgccgccctcgattccgctgcgcaagcgtgacctcttccagcgcgcggcccggggcatggggcgcgagacattcgacccgcccgtggccgtggccttctcggagccgccgggaccgggccggcgcgtgtgccagctctgcgccgagtgcgagttcggctgccagcacggcgcgaagaacaccatggacctgacgtacctggcgcgggcggaggcgctgggggcgctggtcctggcccgcacgctcgtctcccacgtggagccggtgcgggatgggtaccgcgtgcactgccaggacctggtgtcgggggcgcggcacaccgtggagagctcgcgggtggtgttggccgcggggacgctgggcacggtggagatattgctgcgcagccgggacgtcgcgcggacgctgcctcgggtgagccggcggctgggccatggctattcgggcaacggggacttcctggcgtcgatgcagggcgcgcgcgaggacatccagccctgggtgggccccgacgtgtccaccgtgatgcgcttcaccgaccggcagccgcgcttcacgctggtgacggccacgttcaaccagcccgccacggaggtcctcgcgggcctggggcagccgaacctcggacggctccagggcctgggggcgccgctgtggacctgcctgggcccagccgttcacgcggcgctcaagaaggggctgatgagccggcccctgcgtgccgacgtggatgcggcccgcacgtccaacctgtttggcatcggccaggacaacgccaacggccggatgcacctcgatgacgggcagctcgacgtgtcgtgggacttcgccggggagaacgcggagttggtgcggcggatgacggacgcgatgcgggacctggcggcccagtacggtgccagcttcgcgccgctgatcacctggcagctcttcaagcggcctttcacggtgcattcgcttggcggtgcccatctggcggaagctcccgagcgcggcgtggtgtccaccgagggagaggtcttccactatcccgggctgcacgtggcggacggctccgtcatcccgacagccatcggcttccaccccgtgatgaccatcagcgcggtggccgagcgcatcgccgaggccgtggtgcacggattctcatcccattcgaggagcgcttcatgaacacgcttccctccgccgaaaggcacgactttcccgcgggcgacggcgtgccgttgcagctcacgcgttaccagggcggcgcgaaggggcctgtcctcctcgtccatggcgcgggggtgtggagcggcatgttcatgcttcccacggtgcgggagaacttcgtgcagcacctggtgcgccacggctacgacacctggcttctggactggcgcgccagcgtggagctgccgctgcggcagttcacgctggatgaggccgcccgccacgacatgcccgccgccgtccgactggtccgcgagcacagcggcgcggactccgtgcaggcggtggtgcactgcgcgggctcggcgacgttcttcatggcgatggcggcggggctgcttccggacgtccagagcgtggtcgcctcgcaggtggcgctgcatcacatcgtcccgccttcaacgcagctcaaggcgatgctgcggttgccggacgtgctggacatcacccgcgactacctgacgccggacgaggacccgagcagccccttgttccaggccgccttcggcgccttcgtggacctgtggcgtcatgaatgcgacagcaccgtctgccgccgtctgacgttcatgtacgggcagctcttccggcacgcgcgcatcaatcgggagacgcatgaccggctcgacgagcagttcggcccttgcaacatgctgacgttccgtcatctggcgcagatggcccgctcgggctacgcggtgggcttcgaccatggccgggaggagaacctccggcgctatggccgtgagcggccgccgtcgtacctgcgcgcggagcacctcaagcgtcccatcaccttcgtgtccggagagcagaatggcacgtacatgcccgcgtccacggagctcacctacgagtggctgcgcgaagagaacggtgcgtcgtattaccggcggaaggttctggcggggtacggccacctggacaccttcatgggaagcactgcgtcgcaggatacgtatccggtgatacgcgacgcgctggaggccatggcctgagcggatacggcgccctgcgcactcgcgccgctacgcgccttcggccaccgcgggcggtgcctcgcccggtgcatccgagacagacgtctcatcccatccgatgtagcgcacgccctccaggggctcgggcgcgtggaactccagggcgcccacggtggacgtgagccgtccgtccggtctccacgccgcgaagggatgggggcgggtgaagcgctccagctcacaggtggccacgtcgctctgggccacgtggacgtcccagcccgtcgggtcccggtagacgtagcccaccagtgtcttgggatcgcaccacgcgcggcccttcacggccacggtggccgagcgggcctggaagcacaactcacccggccgaggcgattgcaggcgtgtgagcagcatgtccggggcctcgtggaaccggtgttcccgccgcgcggtgcgcaggtagatgggcgacagccggggactgagcggatgctggcgggagcgcacggacagcacctccaggcgggcctccaggtcctcctggaagcgtggcacgtagagccacgtcagctcctccagccgacggtgtccccacaggtgtttctggagccccggtgcgccctggacgtcatatcggcgcccgtccacggtgacggcgccggtgaaggcgatgtcgtcatgggcatgggccacgtgcgtcgtgagtggaagcaggtcggcgccccgaggagcgcgtcgcaccgcctccgcagtctccggcgtgtagcgcaaatcccattcgatggaatggcctcccgaggcgacgcggccatggcaccggcccggcgcgagcttcgcgtcaccaatccggatgccgaagcggcccggggcctcgatggagaagcgggagaggggatggatggccttcagccccaacgcgggcgtggcggtggcgcagtcgaaggccgccgcccacagcagggcgcgaggctcaccgggtgctcccggcgcgggggtaaaaatcgtgtagcggaaccaccaggcgcgctcgcccccagggtcgagcacacacaggaaccagatttcgaagaagccttgctgccccttccagcgcggaagattggcgcgctcgctcgacggcatatcgtcccccctcaccaacggcgccggagcgccatcgcgggactaccgtcgcagaggggcggctcccagggcaagccgcctcagcggcccgagtccttccaggagacgcggtacgtgacgcagtgttcgtcgaaggcgcggacatccaccgacgcggccacgccaccggcggcccgggacatggcgagcatgacgccctgcttgaagtagcgcagcatcccgggctcgttgagccagacctcggcctccgtcgggcccgtctccgtgatgcggacctcggtgtagttgttgctcgtccggaatccgtgctgtgccttcgacagcatccgccagggccccagcagcttcatcaccccgagcagggcgcggcccatcagcgtgtctcggtaaccgtcaatcatccgctcgccgagcatccgccacgccacctcgtcgggctcctgggggtgcagcgcctctcgctgtcagcgtgacgcagcgaatccacgcctccagggagtaggcggggaggagtggccggtccaggtccagtccctcgcttcgcaactgctccttgagcagaggcgtcacccgcccggagagcccccggacgaagagcccttccacgatgggcgggaagacgagtcgttcggccatgaagtgcattccagcccgggctgtaccggctgggtcaagccaggcccctgacgttctgtgcggctctgacatacgtggtttgcgcacctatcacagtgccggtccgccggggatgcgcaccgaggcctacgcggaaggttgtcccgccgggcgcttcgcgtagcgttccgccaggagcgagcacacgaggagctgggcctggtgatagaacatcaacggtaggacgatgagccccagtgcgggattggcgccgaagagcagccgcgccatgggcacccctgaggccagtgtcttcttcgacccacagaagaccaccgtgatttcgtcctccttggagaaacccagcgcccgagccgtccgcgtggtcagcatcagcacgatggccaggatgagcaccgcgcccgcgaaggcaatgccgagcaccgccgcgccgtagtcggagaacaggcccgaggcgatcgagtcacaaaacgacgaatagacgaggaccaggatcaccacccggtcgaaggcattcgtgtaaggccggtagcgggcgaaccagccgcccaccagcgggcgcagcaattgccccagtgccagggggagcagcaggagggccgatagcttgaggatggcctggcccatggacagggagtgcccggtggcgctggcgaacaggccgatgatgagcggcgtcaacacgatgcccagcaggctggacaggctggcgttgaagatggcggcgggcacgttgcctcgggcgacgcctgtcatcgcgaccgaggaggagatggtcgacggcaccgcgcagagatagagcagccccagcgacaggtccgctggcatccagcggcccaccaacacgtcgcccagccaccacagcagcggaaacaccacgaatgtgaaggcctggaccaccacgtggacgcgccacgtcaccacgcccgcgcggagctgagccgcgggcaggcccaggccgtggagcaggaacaccgcgaagatgcccacgtcggcgacgacgtccgcgtgcatcggtccgcccgacgtaccgaactccgggaagagcgcggccaggatgacggccgcgaacatccccggcaggaaccagtcccgggcaagtcgtttcacgagacgaaggggcatgcttgcccccccttactccgggcatcggcggacctccaccgcggagtgcgcggggcgggctcgtggagacattgccggcgccggcgccatgtttgaccattccgatatgaacatgaagccgcattcatgtcggtgcccgctggtcacgggtgtggctcacggaatcggcctcgcggtgacgggaatccccacggcgtagggagtgcgggcgccagcggcctgctagacgtgcccaggacagtctgcacgccagcacgcctggccggctgcttgcggcgacgcgcgactgcgttacctgaaatacatgaccgaagtgaacgcaacctcgcgtgactacacgcttcccgaggggtgccccgtctgcgcggcggacctgcccgtgcgcgtcaccgccgccggtcccagcgccgtgtgccgccattgtggctggctgggccgtcccctcatcaccgtgacccatcgcggcctgcgcgtcagctacgacggcgcgcaggcttgagcatcgcgggacatcaactcgcgggcgtcgctggaggctccttcgtcctcgcgaaggactccaggcggtccacccgccgcagttcgggaaaggcccacgcccagagcgcgaccaccgccagcgtgcccaccgcgcccgcgaccaccgcgggtacggcgcccaagtactcggcgaacccgcccgctcggaactcgcccagttcgttggaggcgccaatggccatcatgttcaccgcgcccacgcggccgcgcatgtcgtccggggtggccatcagctccagcgtgtggcggaccacgacgctgatcatgtccgcggcgcctgctatcgccagcgccgccagcgacaggggcaacgagcggctcatcccgaagacgagcgtggccgcgccgaagatggcgaccgcgatgaacatcttccggccggtgttgccgcccatgggccgcatggccaggaagacggccaccaccgcggcgccgaacgcgggcgcacagcgcagcagccccaggccccatggccccgtgtgcaggatgtcccgcgcatagatgggcaggagcgccaccgcgccaccgaagagcacggcgaacaggtccagggtgatgctgcccagcagcaggcgctgccgtcgaacgaatccgagtcccgcgaccagggtcgacagggagaggggctcggcggacgcgcgcccggtccgcaccttgaggatgagaatccagatgacggagagggcgcacaacgtggcggaggccgtgtaggcccccgcggcgccgatccagccataaaggatgccgcccacggccgggccgccaatggtggccacctgccacgtggtggagttgatggccacggcgcgggtcaggtgctcgggcggcaccagatgcggagtgagcgcggagcccgccggggcatggaacgcgcgcgccgcgccgaagagcaccaggacgccatagacgaatcgcacgtcgcggatatggcccaaggtgaaggcgagcagcagcaggctgcagaccagcatcaccgtctgacacaccgccaggatggtccgccggtccacgcggtccgccacctgaccgcccaccagacacagcgacaggaacggcaggaactgcgccagacccgtgtatccgagcgcgagcgcgctgcccgtgagctcgtagacctgccagccaatggccaccgactcaatctggacggccagcaccgcgcacaggcgcgccagcagatagaagcggaagtctcgatgttggaagatggagagcccggaagccgcagcctgatgagtcatgctggcggcgctgtaatccacgggcccgtcgcgcgccaccgtctgactgtgtcgcctcccaaagggcggcaggggcatgggtacgccaaggtcgccgtgataccttcctttcccgatgaacaaggacgcgaaggacggggtgaaccaggtctccacaccacgctcggcttcacgcctcttggtacgcgtcatcgccgtgatgctgctgacggtcctggtgcggctgccgcaagtccgatgtgggagcgatccgcacaggagcgggaggaaatcgaagcgcgcattcgcgacgcctactcgctggtcccgtaccgggcgctcaagctgacgatgcgcgcgtaaggtcaaccgaacgctcccgcagagatcgccgcgctctggcagacgctggcggacacgcgggatctgccggcgaaggctgcctccgaggaagaagcgctccgtgtggcgaaggcgtacctggacctgggcgtcgcgttctacaaggccaagaaaacactggagcagcgtgacgaagacgagttccccctcctgtggaaccgctttcagccggaccagcagcctccgctgccgggctacgacgcgggccaggagcacgcgttcctctccgcgctatggttcgtgctggatgcggcggactcgggcaaccgtgtccccgcgaccgacctggtgctctatgagctgtcgcgcgccacgcttcagcccgcgtggccgccagggcttcgcgtgtcggttcgcggcagccggggaatggccttctgcggcgcgggctatcactacgcggccgaggaggagctgaatgcgttcctgtccgaagccgaggcgatgcccgccagcgactttccagcgatgcgggaggccgcgccggcacaggttcgcgagacgctgctcgccacgggctacttcctgcgggcctggaaccgcatgggtctcaagcgcgagcgtgcggcggaggacgacctcgagcggggcctgggctccctggagaagcttggcatcgagaatgagctgacgtggtggggctgggccttcatccacttccgccgggagcgctacgacgaatccgcgcgctacctcgacaccctggcgaagagtccgtacctgggcgagaccgagcggcgtgacctccaggccagcgcggacgcgatgcgcaagcacggcgaacggctccccatcttcctccaggcgcgggccgccgccatcctgggacaggcgctcgtggcgagggcagggggcccggagaagatcctcgtcacgctcctgggaccggagcgggcagggcaggtcctggcgcccatcctgtggatggaccgggtccgtcaaggcctcgcgcagcgctccatggacgacatcgcccgcgcggcgggggattccttcgagggcgttcgggccgccggtagcaagggcctgagcgcattgaaggagaagctgctgggcggtggaggcgacacgaagaccgcggcggagagtcctccgtaggttgttggcggggcgctggcggcccgtgctatccgctgacgccgccatgagtccgacgaagaaggccgccgcgaagaaggcccccaccgctgagctccccacgattgccttcgcgtcgcccgcggaatgggcgtcctggctcgaagcgaaccatgcctcgtcgcgcggcctctggttgaagctggcgaagaagggctcgggcatcgaatccgtcacctacgccgaagcggtcgacgtcgcgctcgagtggggctggattgacggtcagaagaacgccttcgatgacaccgcgtggctccagaagttcactccccggggcgcgaagagcgtctggtccaagatcaactgcgagaaggtagaagcgctcatcgccgcaggccgaatgaagccgtcgggcatggaggtcgtggcgctcgccaggcaggatggccgctgggacgccgcctacgagtccccgagcaaggccaccgtgcccgaggacctggcccgcgccctggccgcgaatgcgaaggcggccgcgttcttcgccacgctcaacgcggcgaaccggtacgccatcctatggcgcgtccacaccgcgaagaaggcggagacgcgggctcggcgaatcgaacagttcgtcgagatgctggcccggcacgaatcgctgcacgcatgaacggggacgagccccggcaagtcccatgccgatacccggcgccgcccgtgtgccggagggccgtgcggcggacctgccggaaatccggcaccctgccggaaccccggcggtgacctgaccccgcggggtggtttcacgcgcacgtcacctccgcgcttgcctcacgcaacttcatcctttttcacgaaagagcgtctggagcccatggcacggtgcgtttcgccgcttcctcgtgaagtggcgcgccccggtgaacggccggacagccggtggcatcaccattgctccaggccggatgcgtttcagcgtccacgcatccgccaaggggaagtcaatccatgttgctcgacatgtacctgtacttcggcttgccactgcggcccgcgccgcgccgcgctgcgtcccaggccagccaaccccgcacgtcctcctccgagcgcacggcgacgggagggcagagcgtgtccggggcccgcgccccggagcgaaaggcggcgccccagttgacggtcatcgaggggggcgcggctgacatacgatgagcggggaggcgtgagcgggagaggccccatggactcgcggacccagcgctacttcgaggacatccagctcaagcacttcgggcgcctcttcggccggctcgttcgtgtccgcctgttcctgtcgctattgctgctgctgtccgccgtgtgtgtcgccgtcatcgacggcgcgccctggcgatgcgtgttcatgagcgtggtgggggtgggcgcctttacctacttcttccatgagttccgccgctttcagcgcgacggcgttgacgcgcgcagcgtgccgctcaatctgtggatggggcagatcatcctgacgagcatcatcgtggggacaggcggcatcgccagccccgtgctgcccgccgcgctgcccctgggcttcttgtcgagcctcgcggcgacgccccgggatcgctcgcggctgttgatggcgcagttgtccacgctgatggccgtctccttcttccagatttccgggctggttcaggggctgcccctgtggttcctcggcgcgccgtcggccgtcctgctcgtcgcgggcgccctcgtcaccgccatcatgctctgcgtgtgcagcgccgcgggcggcgccatccggacgaccttcgacaacatgctgagcgaggcgctcgccagccgcgacgaactgctggccacgcatcgctcgtatgcgggcgccctggaggccatgtccggagagattgcccacgagctgaagaacccgctggccacggtgaagggcctcacccagctcatggcacgcgaagcaggtcgcgcccagcccgccgaacgcctgcaggtgctgtcgggcgaggtggtgcggatgcagggcatcctggaggagttcctcaacttcactcggccgctggtgcctttgacggtgagccccgtggacctgggcgcgttgtgcgacgaagccctggtgctgcacgaaggactggcggcgggccacggcgtgcggctggagcgcaagggcacggagggcgtggaggcggtgtgtgactcgcgcaaggtgaagcaggtgttgatgaacctgctgcacaacgccatcgaggcctgtcccacgggcgggcgtgtcaccgtggaggtccgcgcgctgcccgtgggcgaggcccgcgtcttcgtgcgcgactcagggcctggactggcctccgatctcgaggcccgtgtgttcgacgcgggcgtgacgaccaaggccaagggctccgggttgggcctgacggtggcgcgagccctggcgcgacagcacggcggagacgtcacgctggcgaatgcggtaggaggcggatgcgaggcggcgttgacgcttccgcgagagctgccagcggagatcctgcggccactgcacggagtcgcgaatgtgggatgaggccaaggagggtggcaccacgcgcgtcctggtggtggatgacgacgcgggcgttcgcttcacgctgcgggagatgctcaagagcctctccggcgtcgaggtggatgaagccgtggatggcgaggacgcgctggagaagctgtcggccaggccctacgagttggtcatctccgacctgcgcatgcctcggatggatggcatggaactggtgcgccggctgagtctgttctcccggtcacctcgtgtcatcgtcatcaccgcgcatggttccgagcgcttcgcggtggaggccatgaaggcgggggcctacgactacttccgcaagcccttcgatgtggatgagctgctggcggtcgtctcccgcgcgctggagtcggtacggctccgcgaggagaacgcacggctttcaggtgagctgaacctgtcccgctcgttggtgttcgtctcggagcccatggcccggctcgcgcagctcgtgcaacgggcgggctcacgggatgtgacggtgctcatcaccggcgagagcggcacgggcaaggagcgggtggcggatgcgctcgtccgcgcctcgccgcgcgcgaaccggcccttcctgcgcttcaactgcgccgcactcaccgaggaactggcggaggccgagctgttcggccacgcccggggcgccttcactggagcccaccgcgcgcggcctgggctcttccgtgaggcggatggcggcacgctgctgttggacgaggtgggcgagctggcgcccacgctccaggcccggctccttcgcgtgcttcaggagggcgaggtgcgcccggtgggggaggaccggccggtgacggtggacgtgcgcatcatcgccgccacccacagggacttgcgccgcctggccctggagggggcgttccgcgaggacctctactaccggctcaacgtcgtccagctccgggtgccgccgctgcgcgagcgccccgaggacatccccgtgctggcgcgggtgttcctggaccgcttcatcgaccggttccacaccggcccgctgaaaatccccgacggcttcttcgagcagctccgtgccttgccgtggccgggtaacgtgcgcgaactggagaacacgctggagagcctggtcgcgctgtccagcgaggggcggctggacctgggtcagttgccttccgccgagccggcaggagcggatagtggtttcccgggggcgtcatcggacccggtccgtccagggccgcaggacggggctcccggcgcggggctcaaggagcgcgtggaggcgtacgagcgcggcctggtcctggacgcgctgcgcatcgcgggcggaaaccgcagtgaagcggcgcggcggctgggcattggccgggccaccctgcatgacaagctgcgcaagtacgggctggacgacggcggggaagagcggagctgattccgggaacaagcgggccgctcgcggtgttgcgggccggccttccagcgtcatcgttccaggagcgtgcatgcatcccgtgacccgatgcctcgcggctgtcctgctggccaccgtcgcaggcccggcgcaggcgcagtccaccccgccagccccgaagcgcccttacagcatctctcccgagcgcaccgaacgcgtccgctcgcagtacaccaagttcgagtaccgcattcccatgcgggacgggacgcgcctgttcacctccgtctacgtccccgcggacgcgtcaccggggaagcgctatcccatcatcctggtgcgcacgccgtacagcgtcgcaccctatggcgtggaccggtatccccccgcgctggcccccaccgaggcgttcgagaaggacggcttcatctttgccttccaggacgtgcgcggccgaaacatgtccgaaggcgagttcgtcaacgtacgcccctacaagccgaagaaggccgggcccaaggactttgacgagagcaccgacacgtacgacaccatcgagtggctggtgaagcgcgtggcgaacaacaacggccgcgtgggccagtgggggatttcgtaccccggcttctacgcgtcggcgggcgccattgattcgcacccggcgctcaaggcggtgtcaccgcaggcccccatcgccgactggttctgggatgacatgcaccgccacggcgccttcaacctggcgctggcgttcaacttcttctccacgttcggcaagccccggccccaccccacggacaacgaggagtggcagcgcttcgagcacggcacgccggacggctaccagttcttcctggacctgggccccctgggcaacgcggacgcgaagcacatgaagggggacgtcgccttctggaaggacgtcaccgcgcatcccaactacgacagcttctggcaggcgcggaacctgctcccgcacctgaagaacatcaaggcggcggtgctcacggtgggcggctggtacgacaccgaggacctctacggccccctgcggacctacgccgccatcgagaagcagaaccccggcatctccaacagcctcatcatgggcccgtggccgcacggcggctggcagcgcggcggtggcgagtccctgggcgacgcggacttcggcttcgccaccagcgagacctaccagacgttggcgctggacttcttcaagcaccacctcaagggcggcgcgaagccggacgtgccggaggccatggtgttcgagacgggcgccaaccgctggcgccgcttcgacacgtggccgcccaaggggctgcgcgagacgcggctgtacttccagcccaagggtggcttggccacgacggcgccgaagacgacgggcgcatccttcgccgagtacgtgagcgaccccgccaagcccgtgccgtacacgcaggagatgatgacgggctggagcaaggactacatgacggaggaccagcgcttcgccgcgcgccggccggacgtgctggtgttcgagacggagccactggagcgcgacctcacgctggcgggaccgctggaggcggagttgtgggtttccacgacgggcaccgacgcggactgggtggtgaagctggtggacgtcaacccgggcaaggtgcgcgggtggcgcaagggcgatgaagagaaggggcagaagaaccggggccatcagcagacgctggtgcgtggcgagcccttccgcggccggttccgcgacagctatagcgagcccaagcccttcaagcccaacgaggtgacgaaggtgcgcttcgtcatcaatgacgtgttccacaccttccagcgtgggcaccgcgtgatgattcaggtccagtcgagctggttcccgttcatcgaccgcaatccgcagacctacgtgcccaacatcttcgaggcgaaggaggagcacttcacgcgcgccttccatcgcgtctaccactccgcggcgaaccctagtttcatccaggtgggcgtgctgccctcgttggacgagtagcgcgagggcccccacgcggagccctccgttcgccgccatcagggctgcttctgtgcagcggcgaagggaagggtgttctcgtgggggtgccagccttgcgttcctgttaccctgggccttcattcacgcggtggcacctgaaacgggagggacatgaccggcacccaggggcccgacaccgggctggtgcggctggatgggagtgagggcgaagggggcggccagattctccgctccgcgctgtcgctgtcgctcatcaccggccgcccgttccacatcacgcgcctgcgcgagcgacgtgatccgcccggtctgcgtccccagcacctggcctgcgtacgcggcgccgatgccctgtgtggcggtgccgctttttccgagggcgccaccgtcggcgcctccgagctctccttcaccccggcccccgtgcgcgccggcgactacctgctggaggtgggcaccgcgggcagcacgccgttgctcttccagtgcctcgtctatccgctggccctggccggcggaggacggctgaccttgcgaggcggcacgcacctgccccatagccccagcttccactatgtggccaccgtctggcagccggtggcgcatgcgtatggcctgccggtgctgctgtccctggtgcacgccggcttctacccggagggcgcgggggagattgtcgcggaggtggggccaccgcaggagccgccccggctggtggagctgcccgcgcgaggcatgttgcgcgaggtccgcgtgtcgtccttcaccggcgggctgccgttcaccatcgccgagcgtcaatccagggccgccgtgggggcgctgcgtgagcgcggcatcctggcggaggcggacaaccgcccgctggcggtgacgcgctcggtggggaccgtcactttcgtcctggcccagttcgagcacaccatcgcgggcttcaccgcgctgggagagcggggccgccccgccgaggacgtgggtcgcgagggcggagaagccctggcgcggttcatggagacgggtggggcgctcgacgagcaccttgccgatcagattctcctgcccgccgcactgctggccgccggacgcctggggccggcgtcaccgggcaccacgcgcttcacggcggcgcgaatcaccgaccacctcaccacccacgcccgtgtcgtggagcgcttcctgcccgtgcgcgtcacggtggatgcgggaggctccgtggaggtccggcccgcctgaagtccgggccggaacccgctcaggccacttcgtcgtcgccgcggttggctccgaaggtgttctgcccggcgatgtccttggacgtgttccggtaggcgcggatgccgaaaggcacggcgaccacgaacacgagccccgcgaggccgatggccatccacggaatcggcttctgcttgagctggacgtccttgccgtaggagttgaggttgttgcccatggcgcgctgcttggcggcctcacgctcctcggcggtcatctcgcggggggcctggaaatcctggacctgcttgcgaggctgggccagcgcggcaccacccgagctgagcgcgaggacgaggaacatccggggaacaaggtatcgcatatggcgggggaggctatcacgacccaacggatggactgaacagggcttgcacgctgagtgagcgtccattacgggccggggacccacatttccattccggacgccatgctgcgcctgcccttcatcgccctcgccaacctgtacctcctcctggtctccctgctgggcgcgcccttccggatgatggccgccagccaccggcccgcctacgtccgcttccggctgacgggggatccgccgtaccgcgagcgacgccggcgccggttgcagttggggggcagccgccccgagccgtcggatgtcacgtccgtggagcgcctccgcgagtcgttggagctcctggccaaggacggccgggtgaagggcatcctcctggaggtggaggacctggccgtgcccgcggcgaagcgggatgcgctggtggcggtgttgagggccttccgagcccaggggaagcgggtggtgggctgggcggtccacgtggacaacgagggatatgccctcctgtgctcggcggacgaggtgctcctgccccccatgggccgcgtggagctggtgggctacgccgccgagtccaccgccctgggcgtgggcctgtcgcgcgtgggcatccggccgcaattcatccggcgcggggattacaagacggcgccggagctcttcaccaggcccgtcgtgtcggacatccagacgcggacggtggagtcgttcctggatgagcgctacgcggacctgttggacgtagtggctcgggggcggcgcaagacgccggaggaggtccgggcgctgatcgaccaggggcccttcagtgctcgccgggcggtggacgcggggctggcggacgcactggtgagcgaggcgaacctgcccgcgtacctcgggctggcgaagccgggggacggggaggaggagacggagctggagccgatggagacctatctctccacgattccgttcccgccggtccgttggaagcggctgcggcggaacccgcgcgtcgcggtggtgcccgtgtctggaatcatcatcccgggcaagggggccagcgggaagatggcgacctcggagacggtggtgaaggcgctgcgcgccgcggggcgggacaaacggtcgaaggcggtggtcgtctacatcagcagtccgggcgggacgccgctggcgtcggaacagatgctggaggcagtgcaacgcgtggcgcggaagaaacccgtcatcgcgtacatggaccgggtgtgtgccagcgcggggtacatggtggcggtgggcgcgaaggagatctggtccgcgccgcacgccatggtgggctcgattggtgtcttcgcgggcaagttcgacatgtccgggctgatggagaagctcggggtgcacaagacggtgctggtccgggggcagaacgcggccatgctctcgttctcgcgtggcttcacgccgcaagaggaggccacgctggaggccgaggtggaggagatgtaccaggccttcctcgacatcgtcgcgaaggggcggggacggacgaaggaggagatccaccagttggcggaaggccgcgtgtactcgggcgtgcgaggcaaggccgtggggctggtggaccaggtcgcgggcttcgaggaggcctgccgccacgcgctgtcgctggcgaaggtgccggcggcggagcggttcgaaatcatgacctatggtgcgcccaagcagcgggtgaacctgctgaagctgttgatgggggcatcccatgcgcagacgtatgcgctgtgccccacggccttgagcctgaatgggttgggcggcacggaggcgtttgaagatgccgcgcgcttcggggtggccgacgtggtgggtagagtgtttcctgatgaccagtggccattcgggggctgacgggcgcgagcggtagactggagggatgctgaaggcactcgcgctgctgaccgcatcctgtctggcccaggcggaggcttcttccgccgcgaaggtggaggagaagctgccgttcgtcacgagccttcacttcgagaatgacgtgttggccaagagcgaccggctctacacgaacggcgtccgcatcgagcacttcggggagtacgacgggtgccgttccatcgcgcggacgctgcgacttccggacggcgtgcagcaccggtacctctgtggcggctcgctggcgcagaacatgtacacgcccagccgcatcgttccgctgccggagcaggaggtgttcccggacccgaacgaccggccctacgggggctggctgcacgggggcatcttcttccagcacatctatgcggggagggcgcccgcggattcgtcgaggctgacgctccaagccacggtgggcgtcacgggcccggcgtccggggcggcacagacgcagcgctggctgcaccggacgctgaacgacatcttcgggcacacggttgcaaggattccggtgggttgggagaagcagttgcccaccgagcccgcattccacttctccgcgctccgcgagcagccgctgctctggagccccgtggtggacgtgacatggtccgccggggcgatgctgggcacggtcttcgtgaacgcgagcctgggaggaacggtccgtgtgggctatctggcccggccgtatggcctggcgcccatcatgccgtctgtggtcaaggaactggaggctcaacggactccaggggaggcctcctcggagctgatggccattcgagatgaacgcgcctgggaggcctacctgtacgcccgggggcaggtgagggtggtcgcgaggaacctgttcctggatggcacgctcttccggccgagcatcagcgtccggaaggcgcccatcgtcggggacagcgagttcggcgcggccttccgcacgggcgggttccaattcggcttgagcatggtcttccgctctcaggaaatggccgacccgccgaacccgctcctgtcaggccatcggttcacccagattcagctttcgtatctccactgaagtctgggtgccccatatcccatgttgccctcaacaaggcttcatctggtgtatttcacaggtgacgttcgcggaaatgcacggactgattcgggtgggcaagtcatgcttcgagtaatgatcctcataccactgctgctggtgggggcagcatgccagcgcccgttgacgccagaagaggatcgggcgcaggcgctcgaaatcgtgaggagccgcgcgagcgtcgccgaacgtgaggggtgccctgcggaggccatccctgagcggcaggcgcagctcgagaacttcttcatctactgcgatgcgcgactctcgtggtgtgcaaaacagtgtttcaagtcggatgccacggcctgctatgccctcgccgtcatcttccagaatgacgacgccacggaccaattggcggagccgctcttttatcgctcctgtactcagggcgtgatttcgggctgctcgaaccgggccgcagggctccagatccagcaacaaaccgacgacactgcgatgacatgtgcagtacgtacgttcgagaagacgtgtgcgttgagagatccatggggatgcgccatgcatggcttcaatctcgtgcagggcacgcacacgccgcgagacctgaagaaggcacgcgaggtgctggggcaatcttgcagagatggggaggatgaccccgcgtgtcaggcggcgaggggcctgcagtcgcaactcgatgccttcgacctggagcaagcgacagagccgcgcccgaagtgaggatgggttcccctttagactcaaccagtccaggttctccgcgacgaacatcaggctcaccgaggagtagatggtccgcatcctgcgcgaggcagcgtacgaagcccactacgctggaaagctgacccgagaatgggtagggacagctcggaatggagttcggttccgcaggtatctaaaccaccgctcgtgattctcgatcggggttggtgagcgggcgggcgcgcggggcgacaggaagaggcaggggcacatcccgttcggctctgtgtgcgcagaagaccaggaatcagaaaggccccgcccagggacaaaggtagtccccgtctttcgcggctgcagcgccgctctctcatccgctggggtgaaaggagcggctgcccgctcaccctgcggcggtgcatggcggtggtgggagtgtcgcgcggcgaatcgtgcaggcaggtagcgcgtgctctggcgtgcgccacctccacggtcgtctccgcggtcaatcgctaccagacgggacggcgtaaagccctgttggaccgcagggcggccaatggcgaggcgaaggtggatgagcgcttcctcgccattctctcgcgcgtgctggcaggtactcccgaagaagtgggctggtgccgcccgacgtggacacgggagttgcctcgcgatagaaatggagcgcctgggcctggcccgggtgttggttcccacgattgtccgtgtgcttctcacccacgttgcaagccctaagctggccaaactcgtggtagactgactatgcccgggtcgcaatgggcgatggcgtgtgttccaattccggggcctggaagcctgtgcccggtccgacgagccggtcctctacgtggacgaggtggacatccatctcaatccgaaggtgggacgcgactggtgcctgcccggccagcgccgggtggtgctcacgccaggcaacaacaagaagcgatacctggccggcgccctggactcgaagacgggccgcctcatctgggtggaggacaagtcgaaggccagctcactcttcatccaactgctttggcgcatcgccggtgagtaccctggcgccccacgaatccacctcatcctggacaacgcctccatccacagcagccagaagacgagaaaggcgctcgagaaactcggcggccggattgtcctccacttcctgccgccttactgcccggacgccaatcgcattgagcgcgtctggctggacctccacgccaacgtcactcgcaaccatcgctgccgcaccctccagaagctcatgcggcgcgtccatgcctacctgcacgctcgcaacgtccagcggcgtgccagtcctatcctccgcatggtccatctgcgacacgccgcctgagcgcgtgcgagattcatgatcgggcgtttagatacgtcaggcgcagtaagaagctttttcccgaaattttaggtgccaccattccgaagagacttaatctcgttggggatgacgacccattgttcccagtccaagcattcttcaactcaataagtgagcgtggatttgttgagaagattcgacaactcgtagcgagggtgggggcggggattgatggcgctcaatgtgaattcccgggaggtttagagccctgggagcaagagttcgaaggcgtccggttttcgttgtatgaggatgttgtggtggtggaggagcccgtgtttcaaatgttcctgctggaggcgtgcagaatgtatgtgaaagaccatccagaagatagggcacgcctagcgcagatccttggcgagggggccgattccttgtagggctcacatctcccctccgaagaggtttcggacggaggatggccgtgtttagcgaacgtcgcgagaagcgagctgttcagtggctgggctggagggttgaatcggacggggcgtcgacgcgtcgccgcttcctctcgtggggcagcagctaaccgatgcgcgagttggggtgcgtctgcacccgcagcggcatgttggccaggtacgccccgggattgacgccgttggcctcgcaagtggccaccagcgcgtagaggccgaccaggttctccccggcagcctcgtggcctacgaaaagaaagtcttttgcggcccaaggccgccgccctcaacgcgcacgtccgcgtagacacaacaggaagcgtgcttttatgtgggcaacgaccgtgcggttcggcgcgcgatcgaagacgtgatggccgcaactcagcaatcgagaagccctcagtgccctcgtccctccgtctgggccccgcaccagccctcctgataggcccgttcagcgggctgacagtcggcctccgttcccgagacctacagggtgcgctgggcgtacagccccgttaaacgacgttgacagccccccctgggctggcagattccgcgcccgttggcggctgacaaccgcccgttttccaaaggtttcaggtgtcctgatgagcgttacccaggccgacatcctcgctgcgatgtcgaaggtgatggatcccgagcttcacatcgatctggtgaaggcgggaatggtgaaggacatccacgtcagtggggacaccgcgaaactcaagatcgagctcaccacgcctgcctgccccatgaaggggaagatccaggccgactccgaggccgccctcaaggccgtccccggcctcaagtccttcgacatcgagtggggcgcccgggtccgcccggccggcgggggcatgcccgctggcgcgctgcttccccaggtcaagaacatcatcctcgtcggcgcggggaagggcggggtgggcaagtccaccgtcgccctcaacctcgccacggccctggcccagcacggcgccaaggtgggcctgctcgacgcggacttctacggcccctccgtccccctgatgaccggcctgggcgacaagcgccccgtcagcccggacggcaagtcgctcaacccgcttgaggcccacggcctcaaggtcatgtccatcggcttcctcgtggaggccgaccaggcgctcatctggcgcggccccatgctccacggcgcgctgatgcagctcgtccgggacgtgaactggggcgagctcgactacctcgtcctcgacctgccgcccggcaccggtgacgtggccctcacgctgtcccagtccgtccgggccgcggggcgcggtgctcgtcacgacgccgcaggacgtggcgctcgccgacgtggttcgcgccaagcagatgttcgacaaggtccacatccccgtgctgggcatcgtggagaacatgagccagttcgtctgcccgaactgctcgcacaccacggccatcttcaaccacggcggcggccgcaaggccgcgcagatgttcgggattccattcctcggtgaaatcccgctggacctgaaggtgcgggagtctggagactccggcgttccggtggtcgtgggggccaaggacagcccggaggcgaaggccttccaggaagtcgcgcggaacgtcgcagggcgcgtgtctgcccagagcatcaagagcgttccgctgccggtgatgcaggcccgctaactatcgaggagacatcatggccccggccggcaacgacgacttcccgcccgatccgctgctcgacgaagatgaacggcaggaccgatccagtggctccaacgggcccgcgggcttcgttccggagttcgtccgccgcatggccgtggccggcctgggtgccctcttcatgacggaagagggcatccgcaacctcgcaggccagctcaaactccccaaggaagccctgggcttcatcctcggtcaggccgagaagaccaaggacgaggtgacgcgcgccgtcaccgaggagctccgccgcttcctccagtccgagaagctccgcgacgagttcctcaagctcatgtccggcatgacggtggagatcaaggcgcagatccgcctggtgcctcccgagaaggaggagaagccctccgggtcggaagcccccgccgagcccaccaggtcccgccggtccgctacgcccagcgtcgtcatctccgagctcaacgcgaagcgccccagcgcgaagcgcaccaagaaggagtaacggtggcggacacgccccctcccgctgagtccccctcgagcgccgcgccgcctccgcgtccgaacgaacgcaagagcgcgctggccaagcggctgccgctgctcctgctcgtcgccctcggcctctacctgtggcaggtgacgggcacccccgagcgcgacgtcgccttccaactcgcgggcccgggctgggcctccgtgcgcgccgtggacctgcagatctccgacccggaaggccagctcatcaagcgcgaggagcggttcttcccctcggggccaccgcctgagctcacgtacaaggtggacctgcccgagggcacctgggacgcgtcgctcttcgtgaaacgtgagggcaccgacgcccgggtgcgcctggagacggagctcgtcgtcggcgaagggcagtacatcgtccagcagcttcagttgcccgccgcagttcgttgaccgacctgggggcgtgggctaaggccgcccgcacgccgtacttcacgctttccgacccaagaggtgcgtacacgtcatggcaacggaacacattgtc

SEQ ID NO: 1257 - DNA, 34316 bp, Myxococcus xanthus
ggatgcgcccgtgctgctgttcgccaacaagagcgtgctggagttctacccgcgcttcggcttcgagcctcggcgccagacgctgttctccgcctcccacgtggcgcggccgggagagacggcggcgccgcagctcgacgtggcggaggcggacgtgcgggcgcggctccggatgctctctgacgaggggctgccggtgacggagcgcttcggcgcgcgggggacggccgccattgccagttggtatgcggcgaacgggttcgctcggccgctgcgagccctgagtgacgatgcctgggtgttcacggaggtggagggcgagacgctgttcatcgacgacatcttcgcgcgtgcgccctttgatttacgggcggcgctgccgcggctcatcgaccggccgatttcgtccatccagttcggcttcacgccggagcgctggtggcccggcgcggtggaggcgggcgaggacatggaggccgacctgttcgtgcggggagtgccgtccccacgtgaggcgaacctctttcccgtcatggcgcggacctgagcccggggccgattgtcagccgttcgcgagtccccctgcccgcgaacccacggacggcgccacctattcgtgcgccggacgtgatggggcttgctcccggcggcgcgtgcgcccgccttcgctcccgtgcgattcgtgcgcccgcccttgtctggaggcagtggcagccgccaggagttggcgaaacctgggacatgccatgtggctcggcgcggggcagttcgccgcgtgccgcaggccatcgcgcatggcgctcagccgccggatggtgctgtcgagttcctccgccttcgccgtcagcagctcccggtcgatgcgcggttgtccgtccggcgcgaacatccgagccagctcatccagtgagaagccggcttcgcgtcccagggcgatgagtgcgagccgctccagcacgtcgggattgaacaggcggcgcaggcctcgcctgcccgtcgaggagagcaggccctttgcttcatagaaacgcagcgtcgaggcaggaacgcccgtgcgccgggccacctcggtgatgtccaggtctctcaccctgttgacctcaagtcgacttgaactggcactgtacggccttcacattttgaaggcatgtgaagggagacgcgcgatggcatctggtcaccaacccccggaggggcaggcagcgctttggaatggccccgcgggacaggcctgggtcgatagtcgggacctgcttgaagggatgttcaagccgttcgaggacctgctcgtcgaagctgtccaagcccgcggcgcgcgtcaggtgctcgacgtgggctgtgggacgggcagcacgacgctcgccgtcgcgcggcggctcggtgcccaggggcactgcgtcggcatcgacatctccgcgcccatgctcgcggcggcgcgggcccgggccgaagcggagcatgtggccgccagcttcatcgaggccaacgcggagcatcacgctttcgagcgagggcgcttcgacatggtgatttcacgcttcggcgtgatgttcttcgacgatgccgtccaggccttcgtgaacctgagacgttccgcaagggagaatgccgggctgagcttcgtcgtctggcgaagcccctcggagaacccgttcatgacgaccgccgagcgggccgcggcgcccctccttccaaacatgcccgcccgccagccgaacgcgccgggccagttcgccttcgcggatggggaccgggtccatcgcatcctggagcagagcgggtggatggacatcggcatccaccccattgatgccacctgcaccctgcccgagcaggggttgctgcagtacgtgacccggcttgggcccgtcggccgcgttcttcacgaagccgacgagaggacccggactcgcgtcatcgaaaccgtccgcgccgccttcaacccctatgtgcacggcgacgaggtgcggttcaccgccgcttgctggcgggtcgaagcgcgcgctcccgctgaggccctctcggcgtgacgtgacgggcggctccctgtgggccgccgtcacccgtctgggagaaggtttggggactactgctgccggccctcgatggcgcacatgagcaccgccgccgcgatgccgaaccgccggtccagctgacggtgggtgtccatggagaagtccaaatcaatcttctggatgaacgggttgaagcgctggtggaaggcgagcacctggttgaggcccatcgtcccggtgaaggactggggaatcagcgcggtcagcaagcggcgcaccagcgccaacatcatgctgtcctcttcaatcttccccacctcctggtcattcgcgtccagcaccagccactggtcgcggaggatggagcgcaggcccttgcggcgcagcgcgcccacgcgctcgcccgtggtggcatccgtcacgtcgtacgtcatgccgaagtcgaggatgccgcgcgccttgatggtgagcagctcctcacgcatctcctcgtcgctgtagatgcggatgtcctccttcaacttgaaggccttcagcttcgagtagaaggcgaggttgcccgcctcgtcatagatgtggaacgcgtcgccgaacagcttgaagaacttgcggcgaatcatgtagcgcgtctggccgaagcggccgggggccaggtgactggggggacgggtctggagtgcggtcgacattccggcacccatagcaaaggtcgccagtgactggcacggggcactcgctcattgcgagcccggtaattcccgcgaggtgtgagcgcttcaacgggaaggcgggtacttctgtagcttgcgctggagcgagcgccggtggatgcccagcttgcgcgccgcctcggagatgttgccgccgcagtccgccagcacgcggttgatgtgctcccactcggcgcgcgccagggacggggcctcgaagcgctccgatgtcgcgacggagggctcgccggacgcacgcgcgaaggccgcgagcaggtcatccgcgtccgcgggcttcgggaggtagttcaccgcgcccagccggatggcatccaccgtggtggcgatgctcccgtaacccgtgaggacgacgacgcgcgtggaggcatccaccgtgagcaaatccctcaccacctccaggccgctgcggcccggcatgcgcaggtccaccaccgcgtactcgggcgactcgcggcgcgcggcggcaagggcttcgtcgtagtcccccgcggtggtgacgtcccagccgcgctcgcggaaggcgcgggccagccgctcgcgcagggtggaatcgtcatccaccagcaacaggctggggcgctgctccgtgcccgcgctcgcgatgctcatggcgcgccctccgtcaccggcagcgagaggctcgccgtggtgccccggcccggcgtcgagcgcagctccagggagccgcccaactgctccaccagcgtgcgcgccaggaagagccccaggcccattccttcgcccggtggcttggtggtgaagaagggctcgcccgcccgggacaacacgtccgccgccatccccgtgcccgcgtcgcgcacctccagcagggcaccttcgccgcgcgcttgcacgcgcagctccacgggacgtgacacctgggacgcctggagcgcgttcttcaccagcccgcgcagcacccgggccagtgcccggggtgggccgtggacgcgccagtcgcgggcctcggtgggcagttcgaccgtcacccgctccgcgccgggaagctccgccagcatgtcctccacgagccggcccaggggcacggggtggaagggctcacccgtcgtctgcccggcgtccgcggacatctgcaccaggacgtcgcggcagcggtccacctgctggcggatgaggcgcaaatcttcgcgaacggactcggaggtgcccgcggtggccagcgcgcgctccacctccttggtcaccacggcgatggtggacagcggcgtggacagctcgtgcgcggcgcccgcggcgagcgtcgccagcgaggccaccttctcccgccgcgcgtgcagcgcgcgcgcctgcgccagctcctgctcccgcgccccgagcgcccgcgtgacgcgctggacgaagtagacaatgaagcccgcggccacggcgaaggccacccacatgccgttgatgtgcagccgcatcagctccgcgtggtccggccgcgacaggcccgctggcagctccacgtcctgcaacacgaacagcgagccgaaggccgtcagcgtgaagccgagcagaccccacatccaccgcgagggcagcagcacggtgcccagcgccacgttcaccaggtagagcgtggtgaaggggttgtgcgtgccgccgctgagggccagcaagccggtgagcaccagcgtgtcccacagcatcagcttgccaagggtgccctccgtcacccggaggccgcgcgccagccacgcccgcaccgacacgttggtcagcgcctccaggcccagcagcgcggccagctccggtatcggcagcgccagctccaacccgaaggccgccacgccgatgacgagcgtctggcccaatagcaggccccatcgcaagcgcagcagccactccaggttgatgcgggcccgggagtcgggctctgggagcggcggggcggcttggggcggaggcgtcatggtgcgacggaggagggaggcaccaccgagcgggccacgttgcccaccaggtccacgttggcgggtggctgctcggcgctgacgccatccagccacgtatcccacgagagcgcaaagacgagctgcgtgtgaggattggcttccgacagcgtcacccactccagtagcacgtccaccgaggcgcgcgtctggaagctcacctcgaagggctggggctcgctgtcctgtccggtgcccagggtgccgcgcaggtgcaggtagcgccccagcaggtggatgccgtgctccaggccgagtcctccgaggatggcgcccaggaagcccgtcaggagattgacctcgccgaagacgagcgccaccaggccatacgtccacgccaggcccgcgcccacgggcgtcagcaccaaccccaccgccagcgcgctgcggaagtggaagaggaggtagagcagcatcagcgcggtggccaccgccgatgccacgccgatgtcgcgcgcaatctgcttctgctggtccagcttcttctggaaggtgccagtgatgtctaccttgaagccgggcccgtacttcgacaggtcctgcgcggcgagcagcccgcgcacctcatcggtgaccttgcgcgagaaacccaggtccgcggacgtggtgtccggcttggccaggagcacgatgcggcgctggccctcatccaggtagtagtcaccgttgctggtggccagccgctgtccggctccgcccgtgtacttcgcctccaggtcggagaagtccagggacggcggctcctcctccaccagcggcacgtagagcgggttggcctgctgctgttcccactggagccgcgcctccaagcggcggtgcacctcccgcaggtcctcttccgacaggaagtacagggcccggtcgcggaagaaggcgccggggcgctgcgcctcgacgaagcggatgccgggcagggcttccagcttgggcgccaggtcgtccgcgaagcgcttcagggacgcggggtccgcgccttcccccaccaccgccacccagccgagcgcgccgaagcggcgctccaactcccgcaggtcctgcacgctctcgaaggaggacgggagcaggtccacgaggttggcgttgaggtgcagtcctcgcgcgaggaagccacccagggcggccagcaccagcaccagcagcaacgccaacaccggacgccggtggttgtgcgcggccatcgcgcccagtgcgcgctccacgcgccccatccaccgcggctcgcccggaggtgtcgtgtcgttcggatgcggttccatcatcggcccgcggccaccacccgcggccccggacctcccggtcgcgcggagggcggagcggcctcccctccctcgtgtgctcgcatgcgcgagcccgtgtcgccggggaacgtggccacggtgggggtgcgatgcaggcgtccacgtccgcttgtctgcccaccaggtagggacagccaacagcgcggatgggggccatccaacccgtcacatcctccagggcggcggcgtgtcgggtgtcacaagcaggcgggcattcgctccaggggggcgttacatgaggcaggtgattcgcagccttactttccgcctcacggcataaacgcgttgactctcccgttagcgcgtgcccaaggtgtccggcgattcggccagtcaacagatgcaggtgtcgcaagcatgagtgagaagcgttggtcggagcggttcgagggcgtcatgggccgcctggcggtgcggaaccaccggaagcccttccaggcgctgctcctggctctggtgctcaccgtgctcggcgcgtacttcgccaggacgctgacgctcaacgcggacttcgtgggactgctgccgaagaacttccccagcgttcaggacatcgagaagctgcgcaagcgcttcggcggtcagggcaacgtggtggtggtggggatgcgcgcggatccggaggtgctcaagcgcttcgcggacgacatggcgccgaagctcggggcgctgtcggagattcgctacgtctcccaccagcggccccggtccttcttcgacgagcattcgctctactacgtggacgtcgacgacctggagaccatccaggagcgcatcgacgcgcgcatcctctgggagaagcagcaggccaatccgctcttcgtctcgctggtggaggaggaccctccgtcagtggacttcgctgacatcgagcagaagtacaccggccgcgccaaccagcgcctctccgggcagggcgacctctattacatcaaccccaccgagcgcatggtggtgctgatggcgaagccccggggcagcgccgcggacctgaactactcgaagaaggtcgtgggccaggtggaggacttcctggcgcagcaggacctgtcgaagtacgggcccggcttcaagacggccgtcaccggcaccttcaagaagaagattgatcagcagcgcgtcatcgttggcgacctggcgagcgcgtccacgctggccatggtgttgctgctggcgtacctggccttccacttccgcagcgcgttgtcggtgggcctcaccatggcgccggtgatggcgggcctgggctggacgtacggcttcgtggggctggcctacgggcaggtgaacctcctgacgggcttcctggcggcggtgctgggcggcctgggcgtggagcacggcatccacctgctggggcgctacacgacgctgcgctcggaggggatgaactccgaggaagcggtggatgagtccttccggcacaccggcttctcctcgctcatcgcggcgctggtggcggcgctgaccttcctcagcctggccatgtcggagttcagggcgttccgcgagttcggcatcatcgccgcggtgggcatgctggtgagcatcttctcctacgtgctgctgctgcccgcgctgctggggctggccacgcgcttcggctggtcgccgcgggtgcagcaagagggggcggctgggccgctgagcctgctggcgcgctggttgccgcgctcctaccggggcgtgggcatcgtggtgggcgtgggcgtgctggcgctggtgtcacaggcgtaccgcatctcgttcaactacgactcgcgcacgctggaggactacaagcaggcgtcggcggtgctggaccagaaggtgaacgacatcctgggctactcgcagacgccggtggtggtgctcaccgattcgcaggagatggagcgcgaggtggtgcgccagttggaggcgcgcaaggtggcgcggggcaaggagtccaccatcgacttcgtgggcgcgctggatgacctggtccccaagcggcaggacgagaagcaggccatcctccaggccatctccgcgaagttggagaagctggacccggagcggctgcccgaggacacgcgcaacacgctggtgcgcgcgctgaacatggcgaaggcgaagcccttcacccaggaggccctgcccaccagcgtgcggcaccagttcgaaagtctggatggcagcacgggcggcgtggtgctggtgtacgccggtggcgtcagtctgtcggatggtgagggcacgcggaagttcgccaaggaagtgcgtggcctccagatgccggacggcagtcaggtgtcggcggcgggggaggcgctcatcctggcggacatcctggacatggtgtcgcgcgaggggccgcgcatcctcgcggcggcggtgctgagcgtgctggtggccatgtggctgacgctgggcaagctgcgcaccgcgctcatctgcatgttgcccacgctgctgtccgtcgtcggcctggtggggctgatgtcgctgctggggctgcagttcaactacctcaacatcatggtgctgccggtgctggtgggcaccacggtggacgcgggggtgcacctggtgcagcggctgggcgagcgcggcgcggacttcgtctccgtgtacgcggagacaggccgggcgatcatgggcggcctgctgacgagcgccatcggcttcgtcgcgctcatcctggcgaagcatccgggcctcaactccattggtgacctggccaacctgggcttcggcatcaacatggtcatcgtgctgctgggcttcccgtcgctgctgctgctggtggagcgctggcgccgcaagcacagcacgtcctcggaagagcagaccgagcagcccgcgccggaggcgtgagggccgctggccgctggctgcttcgctcgatatgagtgcctcgaggtggcgatgacgcggatgtggatgcggagcagtgggcagcggtggctgatgctggcgaccgtcggggcggcggccctggccggctgccgtcacggttcggagcgcgaggagaagaggggcgagacgcgctgtgccgagtctcggaacctcacgtgtgtcaccggggtgaattgcaccatggaccgcgagcgcggctgtgaggtgtgccggtgctccacggcgagcgggctggagcccaccgataatcgcaggcccgcggccatggagccggagcggcgctggtagtcgccgcgtgcttcagcacccgatgacgggatagtccgcggggcgcaggaggaggcgccatgcgttcccctcgcggaagagcagcccggtgacggcctgccccttgagtcccacgtggaccaggtactgcgtgtcgccgccgacgcgcagtgaggcgacgagctccgtgctggcctcgccgtagtccgcgaagctgacgacgagtggccgccggtcgacgtagagcagggatgcgccaggggagtcgcccggcgcgatgtgcggcgcgcccgggaagcactccagccgggtgaaggggccctgtcgttcctgcgtgcacgagtccagcgggacgcgtgtgtcgtcgctctggccatcgcggctggactccagcgtcacatgcccttcgggcgaggtcttccaccggtagccaggggcggggatgcccgcgggcgtgaaggggtcggcgccttcgtccacgggacgctcgaacgcgtccgaggtccactgccccgggacaggacgctcccgctccgtcttgggcgcgggcatgctcaccgtgccggtgacggtgcccgccagggccacgatgtgctcaccgatgtccggcgtccccttcgcctgtgtgtagacgcccacggtgtggcagacgggcggcaggtccacgtcctcttcgaccgtgcacacggactccgtccgctggaagcgcgccaccgccatgccttgcgtgccgacgagcgtcatgacctggagccgtgaggccacgtcctccggcgcatgctcgcccaggacgacgcgggcggtgcggccggagaccgcttcaatttgatacggcgcggtccaccgctcctcggcggcggccccgagcgaggccagcgtgactcccagcaccatggcgtagcgcatgacgtcctcctgatgagggctgggttagcaatgcgcgtaccagggcctggaggctcggactgcggcccgccagccacaccttggtgccaggccgcccgccgtggcgccgcccgagggagtgccgcaacgaacgcgcgaatccgccgattcggcgtgaagccgcgccctcccggggccgggggccgccggttagcacttctccatgacgaatcgggcggcgtggacgcgccgtgaggccctggccctcgccgggctgggactggccggtgccgcgctgcccctgggctgcagacacgcaatggacgcgacgaggacggatgacatggagcgcaaggacgtgaaggacgtggtggtggtgggtggtggcccaggcggtttgagcgcggcgctggcgctggggcgtggccgcaagaaggtcctggtgtgcgacggggggacgcctcggaacgcagcagcagaggaggtgcacacctacctcacgcgggatggcatcccaccccgggagttccggcgtgtcgcctgggagcagatgcgcccctatgacgtggagctgcgcgaggcgcgggtgctggacgtcgagcgtgcggggacggtgttccgcgtggcgctcgaagggggcgacgtggtggaggcccgccgggtgctgctggccacggggatggtggacgtgatgcgcgagctgcccggttacagcgacttgtggggcaaggccatcttccagtgcccgttctgccatggttgggaaatccaggaccgggcctggggcgtgctggccacgaacgcggtgtcgctcgacttcgccgtgatgttgacggggtggacccgcgacctggtggtgttcgccatggacggtttcgaggtgccctccgacaagcgtgcgctgctggagaaggcgggggttcggctcgagacgcggcgtattcgcggcctcatcgcggcaggggagaagctggatgcggtggagctggaggacggtacccgggtgccccgggagattctcttcgaccgtccaccccagcggcagtcgtcgctcgtgcagcggctggggctcgagctgaacgaggagggcttcgtgaagctgaagggcccgggcgagacgtcggtgccgggcatctacgcggcgggggacctcggcacccgggcgcaggcggccatcgtggccgcgtccgcggggatgctggcggcgggcatgttgaaccatgacctgaacctggaacgggcgggcgccgcgcatggacctgctcagggttgagcccggcggcttcgctcgctacgaaggggcgatgccgtccgagccacaaccgccgtcctgggggcctgattcgtcgtcgcgcctggacttcgaaaaagggcggctgccgatatgggcggggcgccttcaggtccaccctcggggcgggcgcgccaccgccgtgcacgcctacgccgtggtgatgctggtgacgcgaggcgagtcgaagatgcggcacgcgggggacctggtggtccgggcgggagacgtccacctgattccgcccggagatgcacacggcgccggcgcttcgaacgcggaagggtggggcgtggccttccatccggatgccttgggcgaggacggtggggccgcgaaccgcctggggccgttgctgcgggtgcgcaagggctgtcaccccgtgctgcggcccacgctgccgcagcgccggaggctggcgcggtggatgcgcctgctgtcggaggaggtggcccggaacgagccggggggggaggaagccgcgcgctcgctgctgcggctggtcctcatcgaactggagcgcatgacggcccaaacggggacgagcgagccgccgtccctggggctgagccgcaaggcgctcacgtacatcgagacgcactgtctggagccgctgtcgctcgcgcaggtggcgaaggcgctggggcgctcctccgcgcacgtcgcgggcgtggtgcggcaggagacgggccgcacggtgggcgagtggattctggagtgccggatggcggaggcacgccgccggctgcgtggcacggacgagcgcgtggacatcatcgcggagcgcgtgggctacgcggacgtgacgcacttcatccgtcagttccgccgcgtccacggggtgactccggccgcgtggcggcgcaaggcgacggctggggctccatgagctgtcccctccgaaagtcacggagggggatgccgagacgtgcgggggtgaagtaagggttctctctgggcccggagccgagggagagccatgaagaaggcgctggtcatcgtggttggcgcagccgtgctgctgctcgtgttcatgttcgtcgccggtgagcagccgccggggcagccggaagccagcggtggtggacgccagttggacctgtcgggcttcgacccggcccgagtctccgggctggagctctcgggcgtccgccgcgccacgctgcagcgggacggcagtgggtggacggtcgcggacccgggctcgccggagagccgcttcctggcggacgaggcgatggtgaagggcgcgctggagtccctgacccgggtggccggggcgaagttcgtcaccggcgaggccggccggctgaacgagttctggctggatgacgcgcgcgggctgaaggtccgcatcctccaggagggccgccctccgctggagctggtgctcgggaaggatggggcgccgaacggtggaacctacgtgcgcaaggcggccaacgcggacgtcttcgagcaccccacgttgttgggctggttgtggcgtcggcgcgtcatggattggcgtgacgcgcggctggtgcggggggcgcccggggacatcacgcagttggtgtttcgagtcggggacgaagcgccggtgacggtgacgtcgaatggcgcgcccggcggctggcggctcgcggaggggacgcaggtgccggagggcttccggttcagcgcgcacgtggtcgaacaggttgtgcgggacttgttggaggtcgaggcgcaggacgtgctcgcgggggaggccgccacggaggcgaaggccgcgctcgcccaggcgcatgacacggtggaggcgcgcctcaagaatgggaagtcggtggtgctgcggctgagccgtgcgtcggagtccaaggacaccgtcttcgtccagttggagggagatgcgcggatgtacgaggtgtccgcggtggcggcatcgcaggtgcgaaagcggctggtggacttccgcgacctgctcctgctgcggttcgcgttggagcaggtgagccaggtgcgcatccaggccggtgacacgacggtggtggtggcgaaggaagcgcacggctgggtgctgattgagccgcagtcgccgccggagtccttccggttcgacgcgtcacaggtggaggcgcatctcatctggcttcagcggctcgaggcctcgcgcctcctcgacgcggcggtgcaggacgtacaggcgggcctgtctccgcccgtggcctccgtggaggtgagcgaggagggcggcgccgtgcagacgctgcggctcgggaatgcggtgccggacgcaccggcgggctaccaggaggtgtacgcccgaggctcgcgcgacggctttacgtatgccgtggaggacagggctcgcgcctggttgtcgcgtggcctcgcgctctttagcgggccgtaggttccaccgcgggctgccttcgaggcgctgagcgttcgtgtgtggcaatctcccttttgatggaggctctgagaagagccttctctggggaggaacagccatggcttcgttgaagctgcgttgtgcgttgctggtggcgtttcttcaaagcggttgtgttggcaccgtggcgcagaagtattggcgggacgccggcgggcacattgtcgtggcgggccccatgctgggccccttcgacaacttgccggcgttggctcccaggctgtgtgaggcgattcgggtgatgccaggggcaacggttggcaacagacgagaaggacaggaatactgcggcctcatctatcagcggaatttcgaagcggctttcttcgccagctacccgtcctcgatcagttcccccgtgcagctcccaggaggaagaaagtcctgttccgtcccgagcgcggtgagcgaccccgacgcttacaacatcagcatctacgccgactttcacagtcacccatcggtgacgaccttctccaacgaagacctgcaagcgcagcgacagcggtactattttcgcgtcatgttcaatccgctctgtgaggtctacctttacgattttcaggagcggactgtgtaccggctgatggatggtgagtttcatccgacgaagcgagtcacggatgatatccgtggcgagtaggccgaaactcaggctggcatcgacagcagtcgaactggaggatacgtagatgaaaccagtcggcttcatcatcctcatgagcctcatgagtgggtgcatgcacctgcggtccaagacgccagttgctccgcccgaggtctccgccggtatccagttcccggagtggacgaaggaggcttcgaccaccgtggatggcgctcagttgaaggcgctccagctcgcgatggaggacttcctgcctcccggaacgaagccccccaagaatgcggatgccatgacgcagtgtctctatcgcatcgagacgtatgacgcctggctccagcggggagagaagatgaccttcgttcacttcacgcccagggagcaggaacgctgtggcctgcggccggaagtcatggaccctggcgcgagctatgccatcagcgatgacggcgtcatcttgaagcgggactgagctgggcgcggcctacgccgcccgctcggacgtccttgcctgccacgcggcgacgaagtccgcgagcccgttcaactgccggtcattcagcgtggactgccaccgcgcctgccgcagctcgcggtacgcggtcggcgcctgccagccgcgcgccaccatgaccggcagccccaccagggggccccggcccacgccgtgctcgcagtgggtatacagcgtgccgccctgctccagccggggcaaggcccattccacgccccgcatcagctgctccaccgatggcggatagcggtccgtcaccggcaggttcagcagttcgatgcccagcgccttcatcgcctccgcgtcgtcacagcgctcaccccgcacgtcaatcaccgcggtgatgccacgcgccttcagctccgcgtaccgcgagcgaggcaccgcgccacccacgtacagccagtcgttcacctgagacacgttcagcccgcgccccggcagcttcgtggtccactccacgcagcgcgccactgagcgcagcacctgcttgcgcacccagccgcgcacacccggcacgtggtgcacttcccgcagcaaagcaaaactcacaggtcgccctcgagcgtcacttccatcagccccgtcaccggtgccttgccctcacgctccagcaccgcccggtgcaggtacgtcaccggcgagcccaccaccgaacgcaccagcccgcccagcaccgcgcccaaatcctccactggcgcgctgcgctgcatcagcgaggtggagcgcagcaccatggcagaggagccatccgtgaacagctccaccgtccacgagctccgctccttcacgccttcccgcgcgagcgtgaagtgctccagcgagcgggccttggcgccttcctcccacgcgtacacggggccgtattcaccgtcctgcccctcacgcgccagcagcaccagcttctcgccgccgagcagcgcccggaagcgcacccaccgcttcgcaagcttcgctggcgcaatggtggagcgcgtgtggtccgcgtacccgccacccgtgtagacgacgtcctcgcccttgggccgcttcaccgtcgccttcaacgcgctgaaggccagcgtcacctcgtggtggtagcggtccttgcccacctccacttcggtgccttcctggccctggggcgtcatgggcgcggcgtactccagcagcacccgcccgccatccagcgggacttccacgcgcgtggccccatccgtggagcgggccgagcacggccccatcttcagcgtcgagctctccgcgtcatagcgccagtcgcgcgccttgaccttcgtctgcgccgaccaggccttcttccccggcgtcagcaccgtggtccggcacagtccggtgcgcgagccgggaccgatgttcgtcaccgttagctgcacgaagatgaaggtgccgccgtccaggtcgccgatgaaggtgaagttctccccgtagttgtcactgggggacagcttcggctccagcaccgcgcccgccgccgccaccgagggcagcacgagcgcggtggccacagccaggcccttcagcgcctggaagcgcccttcaggccgcatgggggcgctgctccatgagcgcgtcctcggaagccgccgcgtcgttgttgaagacgtagtcacgctgcagcggcaggttccacgcgaagtacaccacgccgcgcaccagccaccaccccagcgcataggccagctgcgggtgcagcgtcagtagcgccacgccgcccgcgttgagcagcgcgctggttccactcaccaccgagtagcgcgccagctgccgccccaccgcgccggtgctcttgaaggtgagcacccggttgatggagtagttcaccaccgcgcccaggccgcagcccagcaccgtggcccaggcgggcagcacgcccgcccactccaccagcgccagcaccagcgcgaagtccaccgccgtggccaccgcgcccgccagggcgttgagcccgatgatggccttgccggagcgcgcctcctgacgcttgggcgccagcgccttcaccagattgcggaagcgggagagcgccgtgacgttgctcatgacggccacgaagacgagccccaccaccgcgagccagtgcatggggtgcttctcctcgggccagaagacggcctccaggatgggcgacagcgccgtgcccgcgcccatgaagagcacccgctccagccgctgcatggcgccgtcgcgcacattgacgcccaggccttcgcccttggcgcgcacgtagggcaccagcgaggagccgagcagcgccatcagcgcgggcagcagcacccaggtgtcccggtagtaccaggccaggcccatgagcatcgccgagtccacgtaccggtccagcaccgagtccagcgccgcgcccgcggggttggcctccttgcgcgtgcgggcgatgcgcccgtccatcacgtccaggatgcccgcgaacaggaagagccacccgcccagcgcgaagcggcccgccgccaccgccacgccggaagagatgcccagcaggcccgacagcatggacagcgcgttggccggcagacccgagcgcagaatcaccgcccacagcggctggatgacccagaagaagtagtgccgcaggaagaagcccaccagcccgttgctgccgcgcttgagcgtctcctcgtcgcggggaatgcccttgaaggcgcagcggatacagaagaggagcaagccgccgatgaagtacgtgcaggcgacgatggccggtgccagcgccgtccagatgcgggcggacggagacaggtttccggtcaaccacgccatcaggttctcaagcacgggtgtctcctcttgtagtcaacgacacggcccacggtgtggtggccgtccaacgggcgtagacgctttcgaccgccaggaatgcaaccgccgccacgcccaggcccgcgagcacgtccaggatgtagtggtgcgtcaggtatacggcggagaaggcgacgagcaacgcgaacagcccggtggagatgcgccacgcccagccgcgcgaccacacgaacagcgtcaccaggaaggggtacgccgcgtgcagtgagggcatggccccgaacacgttggtgctgcgcgagtagaagctcgcgaaataactgatgcccagcaactcgtcgaaacgggcggtccccgcggggttggggggcgcggccaggtcggccggtcccgggccgtactggagcacgtaccagggcggcgcggcggggtagagcacgtagatgacgacgccaatggcgttcgccgccaggaagccccagcacagcctttcgaagagcgagtccttcttcacgaagaagaagatggccaggatgaagacctcgtacaggtacgccgcgtaggcgaagccgcacagcaggtccatggccggggtgaagcgcgtggcccaccattcgggccagtgggtgcctccgggcgccgggaaccactggcgctccaactcccacaggtcgcccgtgtggatggggccccgcaggaacagccagagaccctggctgtccagcagcatcccggtcagccaaagcgcgagcccaccgcggaggaagcgctgaaggcgggggcccgaccaggccacccccagaatcagcgcgtccgccgcgacgtggtcccaccgcagccggccggtggcgtacaccagcgtcaagtggctcaaccccaggacggtggagagccacgtgagcgcggtgaccttatttggagagcgggaggtcatctccgtaatagtcgagcccgaggtgggtgatggggtcctcgcccgcgacgacgcgcagcgtgttcttcagcttggtgagctggatgaagaggtcgtgctccaccggcagacccggctgcgccatgggggtcttgaagtagaaggacatccactcctggatgccgcgccactccagccgcttggccaggtccaggaacagcgcgatgtccagcaccagcggggcggccaggatggagtcgcggcagaggaagttgaccttgatctgcatcggatagccgagccatccggtgatgtcgatgttgtcccaaccctccttcgcgtcgccgcggggcgggtagtagtggatggccaccttgtgcgcgtacttcttgtacagctccgggtacaggtcgggctgcaggatggtgtccagcacgctcgacttggtgacttccttggccttgaaggccgcggggtcgtccagcacctcgccgtcgcggttgcccaggatgttggtggagaaccagccatccagacccagcatgcgggccttgagcgcgggcgcgatgaccgtcttcatcatcgtctggccgctcttgaggtcgcggccggcgacggccaccgactcctgcttggccatctcctggagcgccggcgtgtccacgctggcgttgggcgtggcgttcgcgaagggcacgccctccttgatggccgcgtaggtgtacagcgcggtggggttgatgtccgggctgttctcgtccagcgccttctcgaaggcggccagcgtcttgaaggactcgggcagcggacggaaggtctccacgctgctgcacaccaccatcacggcgcgcgtcgcgttgagctccttcttgaagtcgcggatgtcctggcgcagcgcttcgatgctctcgcggtgcgtcttggtggccttgatgtggttggcctcgatgcggcgcacgaactcagggtcgtgcacgccctgcttcggcttgatgctctggaggaacggcttcacctcctccaggtgcttgtcgctgagcacgcccgagcgcacggccacttcgtatgcgtcctcacggatgatgtcccaggcgccgaaggcaacgtccttcagctccgccagaggcaccagctcgttgagcttcacggtgcgcccgtcggtccgcttccccaggcgggcggtgcccatctgcgtgagcgacccaatggggtgacccttgcccttgcgcgccagctcgacacccgccatcagcgtggtggacacagcgcccagacccggaatcaggaccgcgagcttgccgtccggcttcgcgaccgacctcttgttttccatcgtgatgttccttcgttagacgtattcgagtcggccgtatgcgggtcggtacgataccggtcgtgcatgcggaaaatctcgaaagcggatggttgatactctaaagcgttcatcacttcaacttcatgagcgtggcggctcttaccacccgagggtgccgcactcatggatcaggccagcccgaggtacaaggcgaggcgatcgacgctgtcagagaaacaccaggtcgtcagaaggacgacatccacggcacactcctcggacaggatcgccatgggttgatggtgacccgccctgcttgaaggatgaagaaggtgtcagtgggacagggggaggcggagccgtcgcgaggcgccgtcctaccttgataactggcccattccggtgggcccgtccggctcaatggggcagtggggcgctgtcgtccaggtcgagcttctggtggtcgcccggtgcgtagggctgtccggtgaaggcggccttcaccatgccggtgagctggaccatgcggctgctgggcgtgtcccaatactcggccttctccacgcggacgcagagcagggcgagctcggggtcgtccaggccgtcggggaaccaggccttgagggtggggttccacagcgcgcgggccttctccttgtcgagcaccagccggcaacggccgctcacggagacgtagcggtcccgggtcgggtccgagtacgcgaggttgacgtggtggtcgtgcgtcacctcgtcgaccttgggggaatgctcgcgggtgaagaaccagagctctccgtcgaagtcacgcgcgtgcgtccacatggggcggctgcgcaggctgccatccgcttccacggtggtcatcatcgcgaccttgatgtccttgatgaggtcatcgaagtgctcggtgacgtcttgggtgtcctttttcttcctggccatcgctgcctcccttgggagcacaaggtaggcagcgtggaggtcggcgggcacatggcggtgggttggccgccgccagggcaggcgggcctgtggtaggtggccgagcaggaaagcgagggttcggatgctgaagacggcgtggaacgagtggagcctcaaggcgctgcagttggagacggcggtgctggcgctggaggagatcgacctgcccgaggagatgcacgcgctccaagaggcggcggaggagaagctgctggcgctggcgcgcgcgtggaaggcccgtcagccgcagcgcgagccgcgcacgtgggagcgccagacgctgcccgacggcatgcctcgcgacgccgagctcaaggacctggtggagggcttcaaggaagacggcaagtcgtggacgctgcttcgcgccaccagcgacctcaaggaagtggtggagacggtggtgtcggaaggccgcgcctgcatggccgcgggcggcgagtactacctgggccagtgggacgcgaaggagtccgtgctggaggtgggccgcgacgacgacgcggacgagcccggcacgggcctggtgctggagcccacgggcgagctccagtacacgccggacccggagctgtagccgccgctcggccctccagcgccttcacgatgcgggcgcggagcttctcgtcgggcatccggccgaagcccgcgcgcacgttgtcggcggcgtgcgagggcttgcgggtggccggcagggggcgggctgtgaggcgccgacgccgggcaggagcaggccccccagggccgcggtgagcacgtcgcggcgggacggggcacgggaggacagggcggccgatggcaacggctgcgctgaagtggacaggtgacagttccgcgcggtgccggtgttctcttgcacgagcggggcggcgacgcctcccgatgattcctcctggcccgggtgcccgcgcgatgcgggccgggcctcattcaaaacagtccaggaaggtccaggcgatgaatcgcaaggtctcggtgtgcgcggggatgatggcggcggtggtggcgttctcggcctccgccgaggagacggcgggcgggccgtcctcgagcgccgcgagcggagcggcgtctgtcgattggccgggcgtggcgcgcgagctgtccgcaccgccgctggtggccgcggcggagcagccggtgaaccacgccttggccgccggggcgcccgcggggagcgcgccagcgtccgacgctgtgaaccctgtggcatcgtcgaatggcgcgtcctccatgcccgtcgtgcctgacggtgccaatgcgccttcggcaggcgcgcccgaggcgaaggcggaggccgacgcgaacgaagtgcacattccgttcagcctcaccctggtgccggggctgagtacgtcgggtttccacaccggcaacgtggtcaacaacgtgtccatcggcctggtggcgacgcatgcgaagcgggtggacggcctggcgatgtcgctggcaggcaactgggtgggggagggcgggctgagcggcgcgcagctcgcggtgggcgccaacctggcccaggggccggtgacgggcgcccagctctccgtgggcgccaacgtggccggcgcggacctgctgggcctccagtccacggtgggcgtcaacgtggtgcgcgggaacgcggaaggcgcgcagctcgcggtggggggcaacatcgcgtcgggcgaggtgaatggcacgcagatggccgtggccgtcaacgtcgcggggaagagcctgctgggcgcgcagctcggcgtgggcgccaacgtgtcgggcggcccggtgcgcgggttccaggctgcggtgggcgccaacatcgcgacagggcgggtccacgggctccaggccgccgcgggcctcaacgtggcggggcagatgacggggctccagatgtcctcgggtgtcagctacgtgcggaatctctccggcgcccagctctccatcatcaacgtgggcggcgaggtggatggcgcgcaggtgggcatcgtcaacatcgccagcaacgtgacgggcgcgcaggtgggcatcctcaacgtggcccgtgagttggacggcgaggcggtaggcatcctcagcttcgttggtggcggtcaggcgcatgtgcaggcctggaccagtgacgtggcgctcaccaacgtgggcgtgaagctgggcggccgtcacatctactcgctgttcacggtgggctacagcccctccatcgacgaggaccgccgccgcttcgtcatgggcgcgggcctgggcggccacatccccgcgggccgcttcttcttcgacatcgacgcggtgagcagcaccgtccacacgaagcgactcttcgacgactcgaagcatgtcctggcgcagctccggttgacggcgggctggcaggtggcgcggcacttcgcggtgttcggtggcgtcagcgccaacacgctcgtcacctgggatgacagcgacccgtggaaggagctgggcatcgggccgcagtggcgccacgtcgcggacgagggccgcaccaccgtgcgcatgtggccgggcctgctcgcgggggtgcagatttgaggggcccctcccatcttcctcccgggtgcgctgctctggagagcgcggcgccagggggtgaagcatggaaggaagcatgcgcgcgatggtgctgcgcgaggtcgggcagcccctgcatgagacgcggctgcccattcctcgccccggcccggaggagctgttgcttcgcgtgcgcgcctgcgcggtctgccgcaccgacctgcacgtcgtggacggtgagctgccgaagcccaagctgccgctggtcccaggccatgaaatcgtggccacggtggaggcggcgggcgagcgggcgacggccattcccgtgggcacgcgagtgggcgtcccctggctcggctggagctgcggccactgccgcttctgtctggccggccaggagaacctctgcgagcaggcacgcttcacggggtaccaactggatggtggctacgcggagttcacggtggcccaccagcgcttctgcttccccctgccgcccgagtacaccgacgtccacgccgcgccgttgatgtgcgcgggcctcatcggctttcgcagcctccgcatggcggggagggagcgtcgtctgttgggtttctacggcttcggcgccgcggcccacctgctcatccaggtcgcgcgccaccaaggccggcgtgtcttcgccttcacccggccgggggacgtggagggccaacggttcgcgcgggagctgggcgcggagtgggccggggattcggacaccgtgcctccggagcggctggacgcggccatcctcttcgcgccggtgggcgcgctggtgcccgccgcgctccgggcggtggacaaggccggcgtggtggtgtgcggcggcatccacatgagcgacatccccgcgttcccctatgcgctgctgtgggaggagcgggtggtgcgctcggtggcgaacctcacccgggcggatgcgctggacttcctcgcgctcgcgcccaaggtgccggtgcgcaccctggtgcaaaccttcccactgtccgccgccaacgacgccctcaccgcgctgaggcgaggccaggtgcacggcgcggcggtgctggaggtggcggccctgggttgagcgcggagtcgggcgggcctacatccgcctctcagggtgggcggggcaaatcgccccgcagagactgcgcggtgtcccatttcgccgcaaacgcagcgtgtggcttgcgtggcgtttgatggaatttcgcggacctggcgcgctggccgcgcaaatgcatccggaagggaaggcaacccgatgcccccttcccgggggcaccaccacgcgagtcggacgatgaaccgagcgctgcaaatcacctatcggggcatggagacgagcgaggccctgagcgagcacatccgcgaccacgccggcaagctggagcagttctacgacggcatcgtggggtgccacgtggtggtggaggagccgcaccggcacaagcagcacggcaggcatttccacgtgcgcgtggatgtgagtgtgccaggaaggaacatcgtcgccagccgggatccgcaggcgcgcaccgggcacgaggatgcctatcaagcggtgacggaggcgttcgacgccgccaggcgccagctccaacactacgcggacgcgctcaacacgcaccacgggtgacggtgtcgctcgcgcggcgcttcattcccattacagacatccagctgggcggtcgcgcgacgcacattccgaacatttgccattcaaacccctgacagacctggggggctgggcgttatcgtgtggcttgtcacgccatgaaagcccagcgcctccaggtgctgcgggtcgacgccgaggccccccacctcgtcaccaccgccgccgtccactcgacagcctcacttgccaagtccgccacggttccgtgcgcagggcgcctgcatgggtcgcgggtgaacccggggggtgagcgatgaggcgccccgggggcaagcgtgggtggtgggtggtgaccggcgtcgtctggctcggcggcatcgtggcgggttcgctcgccatggctcgctattccctcacgcccggcgagtccctggcggcacccgcgcgctggcccggggactccaccgtgccacgcgtggagggccgtcccacgctggtgatgttggcgcacccgctctgtccctgcacgcgcgcgagcatgggagagctctcgttggtgatggcgaaggcgcaggggcggctcgacgccttcgtgctcttcctcaagcccgagggcaccggcgaggattgggagcagggcgagctgtggcgttccgcggcggcgattccgggcgtcaccgccctgcgcgacgagggcggcgtccaggcggagcgcttcggcgccgtcacctccggccaggtgctcttctacgacgcgggtggagcgttgcgcttcagcggcggcatcaccacggcccggggccacgtgggcgacaacgccgggcgcgccgcggtggaggcgctgctgggtgacgcgccggcggaagcgctggccgggcacgccgtctacggctgtgagctggaagacccccgcgggagcgtgccatgagcccagcgcgcgacgagccgtccagcccgcccagcccgcccatggcgctcaaggagcgcgccgcgcggctgttccgcgagcacctgtccgcggtgcgggtccgcacggaccggctcttcgcggggctgatgctgggccagtgggcggtgggcatcgtcatcgcgctgtttggtccgcggggcagcggcgcgcagctccaggcggccgtgctggtggggacgctgctcagcgccttcccgatggtgatggcccgctggcgcccgggctccatgcccacccgtcacgtggtggccgtatgccaggcgctctggtcctcgctgctcatctacctgacggacggccgggtggagacgcacttccacatcttcggctcgctggccttcctggcgctgtaccgcgacccgtgggtgctgctctccgcgagcatcaccaccgtcgtggaccacgtgatgcgcggcaccctgtggtcacactcgctctacggcgggcttccgccggagctgtggcggttcgtggagcacgccttctgggtggccttcatcgacgtggtgctggtgtattcgtgccggggcatgttgcgcgagctgcgcgaggtggcggtgcgccgggcggagctggagctggcccgcgaacgggagcacgcgaaggcgcgcgagctggaccgcgccctgcgcgagctcagcggcttccaggagcacctcatccgcgtggagaagctggccgcggtgggacagttggccgccagcgtggggcacgagctgcgaaacccgctggccgccgtgcgcaactcccacgcctatctctcccggaagctcacgagggacccagcaggggccgcggatgacccacgggtcccccagttcctggggctgatggagcgcgagctgaacgcctgcgcgaaaatcatctccgacctgctcgacttcgctcgcgagcgtccgcccgcgctccagccgtgtccgctgcgtccgttggtggacgaggccattggcgtggtgccgcagcgggaaggggtgcgaatcgtcaatgacgtgccggagtcgttgccggtgccgcacctggacaaggagcagttccgtcaggttctggtgaacctggtgcagaacgcagtggaggccatgcccgtggggcgcaatggagtggtttcagtcgtagcggaaggtggagacgcgagtccctggcgcatccgggtcatggatgacggcgcggggattcctccggaggtgttgcccaagattttcgaaccgctcttcaccacgaagacgcgtggcaccggcttgggactggccattgtcgccaacatggtgcaacgtcatggcggcacaatctctgtgcgcagcgaagcggagcggggtagtgagttcctcatcgagctccccgcggcagcggcggcccaggccgcatgatggaggacgtcgcagtggcccccgcgcgcatcctgctggtcgacgacgaggagtcgcttcgcatcaccttggccgcgaacctggagctggagggccacacggtcctcgaggcggccaatggtgaggaggccttgcgcctcctggagaagcaatccgtggacgtggtgctcacggacatccgcatgcccggcctgcacggcgtggagctcttgcgccgcatcaagcaggagcgccccgacatgccggtggtgctgatgacggccttcacggcggaggagctggtggatgacgcgctcgccgagggcgccttcaccgtgctgcccaagcccttcgacgtgacgcacgcgctggacacggtgctgcgcgcggcggcggcgccgcaggtcctggtggtggacgacaccgaacaggtggcgcgcggcatggtgcgcgccctgagcacggtggggctgcgcgcgcgcgccgtgtacagcggcgaggaggcgttggcctcgttgcgttcgggggaatacgacgtctgcgtgctggacctggtgatgccggagatgagcgggccggagctggtgtccaaggtgcgcgcggcgaacctgtccgtcgccatcatcgccgtgtctggccacgtggtgccggagatgctccgcagggtggcggcgcaaggcgcggtggtgtgcatgaccaagccggtaccgttgcgcgagctggtgcaggcgattgcacgggtgcgaggccggcctcaacaagggctgcaaggcgcgaggatttgacccatggcaggcagagacctccaggcgcgtgagcgggcggcggtggcggacgtggtggcctccaccctgcggcacgacctgcgcaacaagctggccagcatccgcaacgcctcgttctacttgatgcggcaggtgaagaagacggacctctggagcgcggacccgcgcgtggagaccttcttccagctcatcgaaaaagagctgacgtccgccgaggacgtgctctccaagcgcgcgccgccgcccaccggtggcacgcgtccccggtgcagtgcccgcgaaggcgtggagcgcgcgctcgccgaggcccaggtgccgccgtcggtggaggtggtgcgcgacctgaaggagcagggcggcgtcccgttggaggtggaggacctggcgctgctggtgcgctgcctcgtggacaacgcgctggaggccatgccgcgcggcgggacgctcacggtgcgcacgcgcgacgccgaaagcggcgtgtgcctgcgtgtggaggacaccggagagggcctggcggcggaggcgtactcgcgcgccctggagcccttcttcaccacgcggccccaccacgccgggctggggctgagcatcgtccaccggacggccgtgcggcacggctggcagttggacctgggcgcgggcccctccgggggcacctacgtggaaatccaattcacgggcctggaggcgggggcccatgaccggaatgacgtgactcgggggagcaagtgatggagacgaactggacgttcgggcgttgcctgctgctcgtggaagacgacccttccaaccggatgacgctgtccgcgcttttggaggatgcgggcttcgcggtcgtcaccgccggctcctattcggaggccgcgggattattgaaccggcctcgggcgtatgacgccgtgctgttggaccagagcctgggtgacggctttgggacggggctgattccgctggtgcgccaccacatgccgaagaccaaggtcgtcttcgtcaccggtcatgacgggaaaatcgacatgccggtggacgccgtcttccgcaagggcggccacttcgacgacctgctggccttccttttcaagctgttgccccagcgcccgctgggtgcctgaacgcgaggttccagaatgctgctcccttccgtttccgagcgctccgctctcacccgacggcgggagcagctggcgaaagccctggggagcgcggccgcgctgctggcgtcgagccgcccccgtgctcgcaactacgccgccgaccagttcccttttcgggcgtcgagccacttcctctacctcttcaggctcgcgacgccggacggcgtgggtctgtatgacggccagggctggacgctgtacctgcccgagcccggtcccgacgacgcgctgtgggacggcgcggtgcccggcttcgctgaaatcgcggagcggacgggctgcaccgtgcgttcgcgcgccgagctgcccgcggcgctgaagggccgcgacgtggcggcgctgcccacgccggacctggagacgtgcctggacgtggccgcgctgctgggccgcgaggtgcgtcccggccacctggcggcggtggacgtgccgctggcggacgcgatgattgcgctgcggcttcgccatgacgacgccgcgcaggcgcagcttcgtcaggccgcggaagtcacggtgctggcccacatggcgggcatgcgcgccacgcggccgggcatcctggaggccgcggtgcgcgccgcgatggaggcggagttcgtctcgcgcgacgtgcggccggcgtatcagcccatcgtcaccgtgcacggcgaggtgctgcacaacctgcgctatgaccacacgctgcgcgagggagacctgctgctggcggacgtgggtggtgaaagcccggccggcttcgcctgtgacgtgacgcgcacgtggccggtgacgggccgcttcagcacgacgcagcgcgagctgtacgacgtcgtgctgcgcatgcagaaagccagcatcgacgcggtccagccggggacgcgctaccgcgacgtgcacctggccgcgcaccgggagatggcgcgaggcctggtggcgttgggcatcctccgtggggacccggaggagttggtggtggacggcgtcaccgcgctcttcttcccgcacggcgtgggccacctgctggggctggacgtgcatgacatggaggacctgggggaccgggcgggctatgcgccgggccgcacgcgctcgccggagttcggtcaccgctcgctgcggttggaccgcgatttggagcccggcatggcggtgacgattgagccgggcatgtaccaggtgcccgccatcctgtcggacgcgcggctcatggcgcgcgcgaaggacaggctccagcgcgacgtgctggcgcgctacgcggacgtgcgcggcatccgcatcgaggacgacgtgctcgtcacttcggatggcaacgaggtgcttaccgccgccatccccaaggaggcctcaaacatcgaggccgtcatgaccaactctgcccgtccagctccgggaaggtgacctggcactggccgggattcacgccgtccacgcgcgcgtagccattcttgttgagggtgccctcgcgcgtactcccatccgggagcgtcaccaggtagcgcgcgtgggggatggggttgccctcctcgtccttcagctcgatggccagccacgtctgttcctcgacgggggtttcctcggacgtcagcggcggtggttccggccagggcgtgggcagcagcaccggacgcgccatggggagcgccaccagctccccatgcacgaaggcctcggtgagccgctgctgaaggcgctgctcgtaccggccgcgctccagtccggacagccctagcgggcggctgcctccgagcgcttcgtacatcgcatacaacgtgtgcgcggcggaggtggccagccagcgcttcaaggcggagctgacgaagacgtcagggaccggtgcctgcgggtgcttcagccgctccaggtcgacggacggtacgatgagccagtcttccccctgggccggcaggcgccaccggcgctcaccgtgcaagagctgcatcatgacggcctcccggtctcggagtgtatcaggatgcgcgctccgcgtaggaggcgctgcgatgtggggtgcgcggcgcctgacgccgtgcatcggggtgtggggtgcgcaacgtcctcgtgggacggaggggcagggttattgctgctgcggtgcgccttcgggcgcctgctgagcctcggtgggcgcggccgggctgctgtgcgcgaacaccatgagccacgttccgtcgcggcgctgccacacgtcggtgaagtacacggcgtcggtgacctcgctgccgtccgtcatgcgcacccgcgagcgctggacgccagccagcacgcccgtgtcaccgaagacgtgagacttcattttttcggcttcgacggacgtgatgtcaccggggatttcggcgatgcccacgatgaacgcgtcacggttcatctccgcgccgtccgcgccgcggaagtcgtgctcatgggtgactgactccgggtggaaacagggccgcacgcagagacggccagcagggtggatgcaggcgtggttgatacatgaggtgtcgtgagtacggcgcgcatgcgcgcgtgcggaatgaatttccagagcgcgaagttgcggggccgcgtgcgccatccgccgtgagttgacccggtgaagcagtggacaggcgcggtgcctccagggggcacagcgttctaggacgaacagtggggggtggcgcgacgaggaccggttcctacgttgcacgctctgtcgaagtcagggccggtgagtgcagcgcgggcgagggagggcgtgtggacgagcttctttccggagctgaagggcagttccgtactcagggcaaaggcactccaggtgcgttggagccgcgcggcacggtgagcgtgagcgaggcgctcgagggagacctcgacgcgtatctcgaccgtgagcttctcgaggcatgtgaagacgacgcggccgtggaagaccctgcacccgtgacggatgtttccgcgagaatgcgcgcgctgctcgcactcgcggaggaggagacggaatggctggagcgcctgccgctgtccacctcgcgcgcgctggacgtgttgcccgagcccacggtggagattcccgagtggatgcgcacttcgcctggagcgaagaaggtgacgtccctgggcgccttgttgccgccgcgtgcggagaatgtgctggcgcgtgcgccggatgcgcccatgtggggtgatgcgccgccgcatgcgcacttggaatccgcgcggtggcgcgctgcgagcgcgaccgagacagtcagtgtcctgggacttcgccccggggagttgatgggcgcggcggccgtgggcgcgttggcggcgggcctgctgctggtcgcgggactctacgtgcgtggtggtgactccacggggacgcaggcgagcgtcgatgatgccatccggcgcacggcgcacggcgctgtccttggcacgagcggtgacgcccaggcgggcctgtcgtcggctggcgccggcgccgcgatgcgcaccgccgcttcgtctgggcacgccattggagcgagcacgtccacgcaggccgccgtgagcggttcatcgccggacgcggcgctcgctgcctcgtcgcacgtctcgggtgccgcgtcgtccatggctgtctccagcacgcagccgggcattggttcggcgcttcttcgggatgcggcgaagggactgcgcgcctccgtgcctgcctcggagccggcgcgaagcccgggcacgcccgtggcggagtcgctcgcggtggtgagccccgcgcccttcaagcgcaaggccccggcgaagccagacgaggcggcggctctgcctcccgcgcccgtcgagctcgacttcggagacacgggtgcggcaggcgccgcgtcccaggacgccatcgcgacgtcaccgggtgatgtcgccgcggaggccgtggaggaggacacgtcggagaaggggccgtacgcggacctcgatgaggccttcgcgcgcgagctgggcttcacggaagacgcggacgcggagctctcgaaggcggaggcgcccgcgcgcaccgtctacgtgccgccggcggtggacgtgaaggagcacctcacgccggaggacgtgaagcaggtggtgctgacgaaccagcccgccatcaccgcgtgcctgcgttcacacgcgcagggcacgccgatggaggccggtggccgcttcatggtgcagtggtcggtgctccccagcggtgagacgctcaacgtgtccatggacaccgccgcgctgcgcgccacgctgctgtcgcgctgcatcgaggacgtggtgcgccgctggaagttcccggtgcatcaggtgcggatgcaggagcccatccgcttccccttcatcttctgaggtacgcgcggaccactggcttctatgcttccacttggaatgccagcgaccgagccgccggagcccacggagttgcacgtctgccaccgctgcctcgtgcggttggaggccagcgccggtggcgtggacctgccacgccggctgcgggaggccctggcgggacggggcctcgccgagcggacgcgggtgatggcgtcaggctgtctgggggagtgtccccggggcctcgtgagcgtgctggtggtcccggacagtggctccggggcacacgttcagctcatcgacccggcgaaggacggagcggacctggccgagcacgtcgcccggttgcctggtgtgcaagacgggcccccgcgagctgggcggccttgagcagtgcttccaccatgggcacgcagctcgcctcacccttgccggcgatggcgtaggccgtgccgtggtcgggagacgtgcgcggcacgggcaggcccagcgtcacgttcaccgtgcgctcgaagtccagcgccttggccgggatgagcccctggtcgtggtacatggccagcaccgcgtcgtagcgcgcgcccacctcgtcgggcttcgcgaagagcccgtccgcggggatgggcccattcgcgtccacccgggccgcgcgggccttgcggatggcggggccaatcacctccacctcttcgcgtcccaggagcccaccttcgcccgcgtgcgggttgagccccagcacggcgatgcgcggcttgtggcccaccaccggctcccagctgcgcgacagcagcttgag

SEQ ID NO: 1258 - DNA, 30783 bp, Myxococcus xanthus
gcggttggcactgagcccgccaccaactcccattgaaggggagggcgcccaccggtggcgaccaggacgtgctcgtagttgtcccccgccgtggcggcggggagcccgtcactggtgacctcagggcgtggatagattttcagcgcgtacgtgcgcacgttctccaggccgtccgcgtcccgcaccgtcacggtgatggagaagtcaccggcctcgctgcccgggcccagcagccgcccctctcccgtatagaaggagaaacccgccggcggcggtgacaccgtgtagcgcaggggcggctcgcccccggacgcggtgaacatggcttcgtaggcaaggcccaccgtcgtcggagacagctcgaccgcgggcagacggggcgctccggaggttccacgtccatcggagcaggcgcacagcagggtgaggacggcgagcatccccgccattcggaaaagcggcatgtcggcgggctccagcgcgggcctcgaggagtggggcacgcgacgcgcccactctagcctcgacggacgcccgcatgcacgaggcgcgtggcacgaaaggcaatggccgccgacatcgttcgtgtttcaagcaagcgctggaaggttttgcgctccgggcagccgtggagtggaatggttttcggggggatgactgccccatggaggagacagcacatggccagcaagtgggacaagcagctgatggacttcctcaagcgcaccggtgacgagctcaagcgcaccaccgatgacctgcgcggcgaggctgagcgcctcctcaaggaagtgaaggaccctcagaaccaggccaaggtgaaggaaggcctggagcagctgcgcacctgggccgccagcaccagcaaggtggcggcggagaagattgaagtcgctgtgcgtcaggtcgagggcgccgtcgagcgcgccttcacgaacgaggagggcggcgagcggacccctccctcgcgccccgccaaggcgccagccgagcccgcggccgaggccaaggcccccaaggccagcgcctcccgccccgccgcgaagaaggccgggggaaagtccattggccgcaagaagcccgccgccaagggcgccgccacgaagacggcgaagaaggctgtttcgggttccaagaagacgattggccggcccaagaagcccgtcgccaagaccaccgccggagcgtgaagttccgctgggtgtgaagcctgcctgcccgggggcaggccggtttcctttgtccttctcgccatttggaaggtcccgcggcgcgtgagatagtgcgcgccgtggccggctcgaacgacaagagcagaatccagacagacatcgggcaggacgtcattgacgcggcggttcgcagcgtcgagcgtcacatggacgaagaggacgaggtgaccgtcatcgaggtggaggcttcaggcccgtccaccccggtggaggccgaagcgtccgcgtcccccgccgacacgacttctccgccgtctgacgccgaggcgaccccgtccgaggacgtggcggcgctccgccaggaggtggagtccctcaaggcccagctcgaattcagccaggccaaggggcgcgagacgatggagcgcctgcgcgaggcccacgagcgtgcgaaggaggcgcaggagcgcaccgtgcgtcacgccgcggacctggagaactaccgcaagcgcgcgcagaaggagaaggaggaggtccagcgcttcggctcggagaagctgctcaaggacctgctcccggtgatggacaacctggaccgcgcgattgacgccgcggccaagtcgccggacctggacagcttcgagaagggcgtggccatgacgcgcaagtccttcgaggacgcgctgggccgccacggggtgaagggcttcagcgccaaggggcaggtgttcgacccgcgcgtgcacgaggccatccagcaggtggagacggcggacgtccccgccggccacgttgcctacgaagtcgtgcgcggcttctacctcaatgaacggctggtgcgtccggccatggtcgtcgtcgcgcgtgcacccgccgagcctgtggccgccgcggagccgccggccgtcgccgagcccgccaccgccacgaccgacaccgaggcgcccgccgcgcccgcgcagtccgagaactcttccggggggagtcagtaaccaacatgggcaaggtgattggaatcgaccttgggacgaccaactcgtgcgtcgccgtcatggagggcggcgagccggtggtcatccccaacagcgaaggcagccggaccacgccttccatggtgggcttcactgactccggcgagcgcctggtggggcagattgccaagcggcaggccatcaccaacccggagaacaccgtcttcgcggcgaagcggctcatcggccgcaagttcgactcgcccgaaggcaagaaggccattggcgtgtcgcccttcaaggtggcctccagccccaacggcgacgcgtgggtggagattcgcggcaagggctacagcccgccggaggtctccgccatcgtcctgatgaagatgaagcagacggcggaggactatctcggtgagcaggtctccgaggcggtcatcaccgtccccgcctacttcaacgacagccagcgtcaggccaccaaggacgccggccgcatcgccgggctcagtgtcctgcgcatcatcaacgagcccaccgccgcggccctggcctacggcctggacaaggtgcaggacggtggcaccgagcgcatcgccgtctacgacctgggcggcggcaccttcgatatctccatcctggagctgaacgccggcgtgttcgaagtgaagagcaccaacggcgacacgttcctgggcggcgaggacttcgaccagcgcctcatcgactacctggccaagcgcttcgcggaatccaacaacgggctggacctgcgcaaggaccgcatggcgctgcagcgcctgaaggaagccgccgagcgcgccaagcacgagctgtccagcgcgcccgagacggaggtgaacctgccgttcatcaccgccgatgcctccggtcccaagcacctcacggagaccgtggaccgcgccaccttcgaggcgctggtgacggacctcatcgaccgcaccatcgagccgtgccggattgccctgaaggacgcgggcattcccgcgcagcagatcaaccaggtgctgctggtgggcggcatgacgcgcatgccgcgcgtgcagcagaaggtgaaggagttcttcggcagggagcctcacaagggcatcaacccggacgaggtcgtcgccgtgggcgcggccatccagggcggtgtgctcaagggcgaggtgaaggacgtcctcctgctggacgtgacgccgctgtcgctcggtgtcgagacggccggcggtgtcttcacgaaaatcatcgacaagaacaccaccatcccctgcaagaagagccaggtgttctccaccgccgtggacaaccagccgctggtgagcgtgcacgtgctccagggcgagcgtgagatggcggcggacaacaagacgctggcgcgcttcgaactggtgggcattcccccggcgccgcgcggcgtgccgcaaatcgaggtgtcgttcgacatcgacgccaacggcatcgtccacgtcagcgccaaggacctgggcaccggcaaggttcagcaggtgcgcgtggtgagcaactccggcctgtccgaggcggaaatccaggcgatgatttccgacgcccagtcgcacgcctccgacgacaagaagaagaaggagctggcggagctgcgcaacaacgccgacggcctcatctacacgacggagaagagcctggaggagtacgcgagcctcctgtcggagaaggaccgcgaggaaatcaaggcggacctggagcgcctcaaggaggtgctcaacacctccgacgcggcggtgctcaaggaatccttccagcgcctggaaggcagcgcctaccgcatcgcggacgccatctacacgggccaggcgagctgaacgctcgcaatcgcctccgcgctccagcgtagactgcctgccgcgcagtcagtccccctggagcgcatacatggacgtcaccgaaggcatcgtcatctccctcatcaccgccatggtggtgggggtgcccctgttcgggctcacgcttcgcttctccctcaagcccctggtggaagccttcatccggctgaaggaaacccagcacggcggcatggaggtgcggctgctccgcgagcgcatcgcgcacctggagcgcgtgctggaggcgcacggcctcatggatgaccacctgtccctgtcccttcgccccggcgcgcccgagcgccttccggccgtggcgccgctgaaggatcgggagcgcgtgtagtcgtcccggcggctcagggtttcgtgaaaagggcgtcccgggtattgaatgggcccgtggattttccctctttagaggaagaggtcgtttttctccggggtctggtctccgtgcatcggatggccgacgtcatcctggaggactgcctggagcggggcctgtccctggactccgggctcgacgtgtttctcacgcagtgtgcccggctggtgcatgcgcgcgcgggcttcgtgtccctgcgagggacgcgaggcccagtgctgacgcgggtgctgggcgagcccggggtggacgtcctggaggcggcgcactggcaaggtgtccgcaagctggatgacggccggacgctcttctgcacgcggctggccctgggcagcctggagctggggggcctggggctggtggtggagggcgccttcgacggcggcggcgggctggtgatgcagctggtggaggccattggcgagcagctcgacagcgccgtgctgggcttcctcgcgctgacggacggcaagggcgcgctggagcgactggacgcgctcagcggggagccgcctgcggcctcgcggggccacattggccgctatgaggtggtgacgcccctgggcaccgggggcatggcgcaggtgctggtggcgcggacccgaggcccggagggcctggggcggctggtggccctcaagcgcatcctcccgcacctgtcctcggacccttccatcgtccagcagttcctggacgaggcccgcatcggcctgcggctctcccaccccaacctggtgcacttctacgacttcggcgaggcggagggcgcgtactacatcgccatggagttggtgcgcggcgtggacctggagcggctcctccgcgcggccaagggcccgctggagacggcgcacgcggtggccatggtgtgccagggcctggcggggctgcatgcggcgcacgtgctgcagggcgaggacggcgcgccgctcgagctggtgcaccgggatttgtccccgcacaacctcatggtggggttcgacgggcgggtgaaggtgctggacttcggggtggccaaggcccgcgcccagcgcacggtgacgctgccgggcatcgtgaagggcaagccgctgtacatgtcccccgagcaggcgcgcggcatgcggctggatgcgcgcagcgacctgttcgccatggggctcgtcctctaccagtcgctcatcggcgcgcgggccttcgagaaacccgaagaactggccaccatgcacgccatctgcgacgaggcccttccgccgcggccttcgcacatctcccgggcgctctgggacgtgctggagacggcactggccaagcgccccgaggcacgcttcggcagcgcgcgggagatggcggaccggctggcggatgcctgccgtccggcgaacgactcggagctggtgcggctcatggcgaagcacttccctgaccggcatcgcgagttcatgcagttggaccgctctgcctccgcgggagggcgggccctggacgaaacgcccatcatgcgaccgcggctccggaagtcctcaccctgacgaagcggggaggagacccggtccctcccgggaggagagaggggccgggaaggcgcgctcagtacccgcgcttgagcgggtcgtcggagggcgcgttcagcgtacgcgcccgctcgtcgctgccctcggtgcggatgtccacctcttcccggcgtacgtgctcggagatgtggcgctcctcgtccacctcgtccttgtggatgacgacctcctcgtcgacgacggcgcgcttctggacttcgacttcctcggcgcgcagcgggacgacgacggtctcctcctggaacgaggcattcatcgccgggcggcccgggctcacgtcccggcgctccacgcggacgcgctcgcggcgcaccggcacgtccatctcccggtcctcctccaccacgtccttgtggacgcggacctcaccggcctggacgtcccgcttgagcacgtccacctcctccttgtgcagggggatggtgatgtcctcctcgcggccgtggatgtcccgcgcgcccaccgtggtgtccgtggctttcagtcccgcggtgtccgtgtccacgccggtgccgtggcgggcgtccgcgcccaggcgtgtgtcgtagcccgtgtcgtaggtgcccttgcggcccaccgtgtccgtggtggcgtccatgcccgtgctggcgcgggccgcggcctggtcggcgcccagtcccaccgcgcccggacccacgcccgcgccgccacccgtgccggcgacggcgcccgtgcggtcctcacccgtcagccggctcagcatctccttgccgtggctgaggatgatttccgagccgtcgatgcgactgatttccgagtaccggaccaggtagtccttcgggaagaagaggcccttctcgatgtggaattcgccgtcgccgatggcgaagaccttgccgagcttctcgccgtcgatgctgcggacgaccatcccttcgttgacgtcgctgcgttggtacatggctggctcctcgtgaccggggcgggctgacctgctggccacaccttggaccccggcgctggtggaggccccgcgtgcgagcgcgaggccctggggtttccaccccggtcatcatggaaggtgtgagcgttcggtcttggtgtcaggggccgaggacgcagtgccagttggcttggcaccgtgcctgcccgcccgaacgcccgcctgtcctttcgcctgctctggcgacaccgcgccggcggccatggtccggggcttctcagggcgcggcggtccaccccatcttcaaacgaggtgcgtccggaccgcgtgccgtgagcacccaacgggagaccgtcatgagaagcaggcagggaacctgggagccgtggcgctggagtgactcgtgggtgggcggcgcggccgcgggtgtgggggcgcacctggtggtgcgtggcatccaccggctgctccgcccggacctgcgaggccccgtggtgggcgtggcctgcgcctccgggatgctgggcgccctggtggcgggccggctcgcgcgccatcggctccggccgcttcctggcctggccctggtgcccgccccgccgcccgctgcccgcgagcccgcggcgctggagacggacacggacccggagcgccccagcacgcccctggagcgggtgcgccggcgcgggccgaatggccgggagcatccctggagcgagcccggattgcccacgctggcgtgagcctcgaaccacaccacaggagaggagtcctccgatgcgcacggacgtacgggaagggatgcgggtcttcacggcggatgggacccggttgggcaccgtggtggggtgtggcggggagaccttcgccatcgaaggagggctgctgcggctgaagtccttcaccgcgcgctacggtgacgtggtggacgtgcgcggagaagacgtgcacctggggctgacgcgggacgaggtgtcaccggagcacgacagcccgacgcaggcgcggtcaggtcaccccgagtccgtgctctccgccgggttcgcgacgcccggcgaactcgtggtgcccctggcccgcgaggaggcccatcctcacctggtggtgcgcgaggcgggacaggtgcgcatccacaaggtggtgcggacggaggtgcggcacttctccgtgcccgtgcgccgcgaggagctggtggtggagcgggtgtccgaacagaccgtggacgccgagggcccgccggcgccggaggccatggcctccgcccggccggtgctggaggggctggtacccttcgaggcgggcaccttcgtcatccccctgcgcgaggagcgggtggaggtcaccaggtccgtgcatgtctggcaggaggttgcggtttcccggtacaccgacgaggtgctccggcaggttcacgccaccgttcggaaagagacggcggaggtggaggagcggggcgaggtgctccacgacggcccgttggacgggctgcactcctgactgacgcgccgcacagggggtgtgtgacgggggctcgggacggctgcacgcttgacccatggagaggtgtcccctagaaaaccagggctttgccgtgtcagtttccgagaagggaagccctgcatgcgacgacttgccccgatgctcctcgccgcgctcgccgtcatggtggccgcttgcgagaagaagacgcagccagctccttcgggtgaaggaggtactcaggccgcgcaggggcagggggcggcgcccgggggcgctccggtggacgcgaacaccatcctgctgggccaggtgggttcgctcaccggtggccaggccaccttcggcatctccacgcgcaacggcatcgagctggccctcaaggaggccaacgccgccggcggggtgaagggcaagaagctgtccatccgcgtctacgacaaccagagcaagcccgaggaggccgcccaggccgccacgcggctgattacgcaggacaaggtcgcgctcatcctcggggacgtggcgtcgtccaactcgctggccatggcggagaaggcgcaggcggcgggcgtgccgatgattacgccgtcctccaccaaccccaccgtcaccgacaagggtgactacatcttccgcgtctgcttcatcgatccgttccagggcttcgtgatggcgaagttcgcgcgggagaacctgaagctgaacacggtggcggtgctccaggacaacaagagcgcgtactccattggcctggcggacgtcttcacgcgcaagttcacggagatgggcggcaaggtgacggccgtggagagctacagccagggcgacacggattaccgcgcccagctcaccgccatccgcaagtcgcagccggaaggcatctacgtgccgggctactacagcgaggtgggcatcatcgcccgccaggcgcgcgaggtgggcctcaaggttccgctgatgggcggcgacggctgggactccgagaagctcttcgagctgggcggcagcgccatcgagggcagctacttctccaaccactactcgccggacaacccggatccgcgcgtgcagaagttcatcgcggactacaaggccgcgtacggcgcggtgccggacgccctggccgcgctgggctacgattcggcccgcgtggcggtggacgccctggagcgcgccaaggacctgagcggcccgtccgtgcgtgacgccattgcccagacgaaggacttcccgggcgtggcgggcaccgtgacactggatgcccagcgcaatgccgtgaagtccgccgtcgtcctcaaggtcgaggatggcaagacgcagtacgtcacgaccatcaatccctaatggcgcagctcctccagcacctcatcaacggcctggccgccggcaccatctacgcgctcgtcgcgcttggctacacgatggtgtacggcgtcctgaagctcatcaacttcgcccacggcgacgtcatgatggtcggcgtctacatgggctacgccaccgcgttcgcgctcgggcgcgacatgcgcagctccctgctgggcgtggccgtcgtgttcgcggtggccatgctgggctgcgcgctgctcgggttcctcatcgagcgcttcgcgtaccgccccctgcgggagaagccgcgcctcaccgcgctcatcaccgccatcggcatctccttcgcgctgtcctacggcttccaactggacctcggcttcttgccgggcgcggcgccgcgggccttcccggaggtcatcgagccggtggagtggctcgtcatcggtgaccgggacgtggtggtgtggaactggcaggtcatcagcttcggcatcgccgtggcgctgatggtgggcctgcagtacctggtgttccgcacgcgcttcggccgggccatgcgcgcggtgtcctgggaccaccgcgtggcggcgctgatgggcatccccaccgaccgcgtcatcgcgctgacgttcatgctgagcagcgcgctggcggcgggcgccggcctgctctacgccatcaaggacacgtcggtgagcccgctgatgggcctgtacgtgggcctcaaggccttcgtggcggcggtgattggtggcatcggccatgtgccgggcgccgtggtgggcggcctggtgctgggcctggtggaggagttcgtggtgggctacgcggccagcacctggcgtgacgcggtggccttcggcttcctcatcctggtgctgctggtgaagccgggcggcctcttcggccgcgtcgccgcggagaaggtctgatggagacgccggcgattcccgcccccgaggcccgctccgccgtccccgcgtcgctgcgcggcctgctgcccgtgctgctggcgctgccagtgctggtgctgttccagtggctgatgagcgacgcgcccttcgcctcctacctgctgtcggtggtgggggtgaacatcatcctcgcggtcagcctcaacatcgtgaacgggatgacggggcagttctccatcggccatgcgggcttcatggcggtgggggcctacatctccggcgtcctgtcgctgaacctcaaggacgtggcgctctccttcctgccggtggcggtcagcgaccaggtgttcttcgtcgtgtcgctgctggtgggcggcctggcggcggcgctgtgcggcttcctggtgggcctgccctcgctgcggctgcgcggggactacctggccatcgtcacgctgggcttcggcgaaatcatccgcgtggtggtgcagaacacggacgcgttcggccgggcgctgggcctgtccggcatcccccagacgtcgtcgccggccatggtgtacttcttcgtgttcctcacggtgctggtggcccggcgcatcaccggctccagccacggccgcagcctgtgggccatccgcgaggacgaggtggccgccgaggccatgggcgtggacaccacgggctacaaggtccgcgcctttgtcatctcgtcgttcttcgcgggcatcgccggcgcactgtttgcgcacttcgttcccatcatcaaccccggctccttcaccttcgtgaagtcgatggaaatcgtcgtcatggtggtgctgggcggcctgggctccacgacgggcgccatcgtcgcggccacgttcctcacgctgctgcccgaaggcatgcgctcgctgttcaccctgctgggggccgaaggcagcctggcgcagaaggtggaccagattcgcatgcccgtttacggcctgctgctggtggcgctgatgctggcgcggccccagggcttgttcgggacgaaggagatctgggacgtgctgccgcggtggattccgcgcaagcgcagggggctggcgtgagcgcggccgtacaggagacgaaggcggaggccggagcgccattgctccaggcggacggggtgagcatccagttcggcggcctcaaggcgctgacggacttcaacctctccgtgcggcagggcgacctgcaggggctcatcggccccaacggcgccggcaagtccacggcgttcaacgtgctgaccggcgtgtaccagcccacccagggcgaggtccgcgtgggcgggcagcgggtgaacgggtggctgccgcatcaaatcaaccacctggggctggcgcgcaccttccagaacatccgcctgttccgcgcgctcaccgcgttggacaacgtgaaggtggcgtgccgggcgcaaggcgcgctgcaccctgaaggcgtggggttgggcgcgaagatgaagggcgccttcatcaactaccgcgactggtggcgcgcgctgctgctgacgccgcgcttccagcaggaggagcgggagttgacgcagcaggcggagcacctgctggaggtcatgggcctgtcgcaccgccgcgacgaggaggctcgcaacctgccttatggtgagcagcgtcggctggaaatcgcgcgcgcgctgggcacgcagcccaaggtgctgctgctggacgagcccgcggcgggcatgaacacccgtgagaaggcggacctgatggtgctcatccgcaagctccgggacgacttcaagctgggggtgctcgtcatcgagcacgacatgaagctggtcatgggcatctgcgaatgcatcaccgtgctggaccacggcgagacgattgcccggggcgcgccggcgcaggtgcgcagcgaccggaaggttatcgaggcgtacctgggcgacagctatctggagagccagggaggggcggcgtgagcgacgcgcaggtgaagacgctgggggagcgccaggccttcccgccgctgctgtcggtggacggcatcaaggtgcactacggcgccatccaggcgctgaagggtgtgtcgctgacggtgggcaagggcgaggtggtggccctcatcggcgccaacggtgcgggcaagacgagcaccctgcgcgcggtgagcggcatgctcaagcccagcgccggacgcatccagttcaacgggcacgacaccacgagcatgaaggcgcaccagttggtgccgcgcggcatggcgcacgcgccggaaggccggggcgtgttccccaacatgtccgtccaggagaacctggagctgggcgcgtacctgcgcacggacacctccggcatccagcaggacctggagaagagcttcacgctcttcccggtgctcaaggagcgtcgcaagcagatggccgggacgctgtcgggcggcgagcagcagatgctggccattgctcgcgcgctgctgagcaagccgcagttgctgctgttggatgagccttcgctggggctggctccgcaggtgacggaggccatcttccgcaccctgcgcgaggtgaatgccacgggcgtgagcgtgctgttggtggagcagaacgcccatctggcgctcaacgccgcgcactacggctatgtgttggagacgggcgaggtcgtgatggcggggccgggcaaggcgctcctggagagcgcggaggtccggcgtgcgtatctcggcgagtagtggagggtgctacgtcctctcgccgacgctccggtagagtccggcgcgcaatgaaactggctcccctcccaaagtcgggtagtcagcaaccaggaagttcgtctagcgtccgtcgacgcactgcgttcaaccacactcaggaagtgtgcccatgtccccgttgtcccgtcttgtcgccagcctcgccaccctgtcgctgattgccgccgcgtgcgccggtcagcagaagcccgataaccgggaagcctcctcgaccatcgaggaggtcgccaacgagggtggagaggagacccccaccgtcgcgttcaacgtcctggatgctcccgagggcttcaccgtgaagctgccggggcccccgccgcaggcgcagcgcagcgaggccgccctgccgaagcggacggacaaggccacgctcgtcacgtacgcggccaatgagggcggtgtcagctacatcgtcaacgcggtggactacccggaggcgttcgtcgccacggtgcccgccgaggcgctcatcaacggcggcatccagggcattgccgggcaggtgggtggcgagctgaagagctccgaggacatcaccctggatggctacccgggcaaggcgtacatgctggcgtcgcccagcggcgaggtgaagggccgcagcttcctggtggggccgcgcgtctacaacctcatcaccgtctacaacgcgggcatcggcgcgccgggtgcggacgagttcctcacctcgctcacgctggtgaacccgccgccgaagattgagatcccggaggccgacgcgggcacggacgccgggacggccggtgcggccgacggcaccgcggccgccgtggagggtggcgaggacgctgggagcgcgccggacgcgggcgcccgtcgccgccgcgccaagtagaccgttgtccctgggacacgcttccttcctggggagcgtgtcccgcgatgccgcgctgaaggaccctgggcgttaggctctcccgtgacaggaggccgccatgtgggacccggcgcagtactcacgctttcgcgacgagcgaaagcgtccctttttcgatttgctgtcgcgggtggacgcggcgtcgccctcccaggtcgcggacctggggtgtggcaccggggacctcacgcgcgtgttggccgagcgctggccgtccgcccaggtgtccggtgtggatgcgtcctcggagatgattgaggcggcccgtcgcggtgcgcccgtgggctcggtgcgcttcgaggtggcggacctcgcggactgggcgccctccgcgccgctggacgtgctcgtgtccaatgcggcgctgcattggctgccggaccatgaggtgttgctcgggcggttggtggcgaagctggcgcccggcggggtgctggccttccaggtgccggccaacttcgatgcgccttcgcatcggcgtgtcgacgaggtgcgagccttgccacgcttcgcttctgtcctggcgcccgtgcggcgcaggccggtggagtccctgcctgtgtacgcgtcctggctgttcggcctggggctgacggtggaggcctgggagacgacgtacctgcacgtgctcccgggcgaggacgcggtgctggagtggctgctggggacgacgctgcggcccgtgctcgcggcgctcggggaggaggaggcgcgcgccttcgttgagacgctgcgcccgttgctgcgcgagtcctatcccgcgcagccgtacgggacgccgttcccgttcacccgccgcttcgtggtggcgcggcgggtggcgtgagccggtttactggggccagtggagaatcttgccgttgtcgcccgccacccagaggtccgcgggactggtgccggcgatgtcgttgaaggcaaaggcagagttgtcgaagaggatctgccaccccgtgccgtcgtaccggtaaatgcgaccgctcttcgcggtgacgtagacggacctggcaccaaaggcgacgacagaagtcagcgtctcactgtttgtgttggggaagggcatcctgctccaggtgcttccgttccactggaggacggtgttcgcaccgcccattctttcgcccacggcgaaggcgaccttgtcgttcactacccagacgccgcggaggcggcccatgcctgggatggaggtttccacgctttctgattgccactgcccggaggaggggttgaaccggtggatgcgtcccctgttgcctccattgtcggtgccgcctaccgcgaacatcactgcacgggaacggccgtggatgtcgaatagcggcgcgactgctgcggggccgaagctcaacgcgctggggccgatacctccagtccacttgaacgtcagtccctgatttaccgttccggagttctgggtgactccatgaagctccagggttccttcgtgtcggaaaccgacgagcccttgtgtagagcggaccaggttgccgtgggtttcggtgcacgcaacctgagatctgtccacgaacgagaggtggcctccggaggagccgagatagccgcggccctggttggccatgtccgcccagacggcgttccagcctctgctgaggtcgccgcaattggtcgcgttggtctggaatgtggttgagcccacggtgagtatcgcgacgcctccctgattgcccacgacagtcacatcaccggggacctcagtgaagatggagcgccactcctgatccattgcgcccacgtcctgcgctacccagttggcaccgccgctcgggcagacctcggggccttcgacattcccgtcgcagttgttgtccaggccgtcgcacagctccgtcgcgccagggtaggtgaacgggtttccgtcattgcagtcaccaccagcctggacgtagcccgcgccgggcgagacgcaggacgtcacggccgtgccatcaccaaaggtgtctccgtcgccgtccaagaaccagtcgttgggcgtcgtcgtggcctggcaggtggtggcgatgcccgaggcgtcgcagacgtagacgccggcacactgggcctccgcggtgcacgccgtgccgaggtcggtgaacgtctcgtcaatctcgtcgttgcagttgtcgtcgacgccgttgcagagctccgtcgcacctggccggatgctggcgttgttgtcgttgcagtcgctcgcgggacccgtgacatagccctgcgggataccggcgcagaaggcgacgggagcggcgttccggtcgccgtgtccgtcctggtccacgtcaggataggcatacacagccagcggcatgttgcagaggacctcgccgttcccaccgcacgcacggacgccctcgcagccttcgccctccgtgcagctctggcccaggcgcagctccaccgtgtccgactgcccgttgcagttgtcgtcgacgtcgttgcagagctccgtcgcgcccgggtggatgtccgggttgttgtcttggcagtccgtgccgcccgtgagcacggagacgtacccgtcgccgtccccatccgtggcctggagggacagggccaccgggacgggggttcctggcgtcagcgtcaccgacgtggaccgcgtcaccacggggctcgcagcctcacatgtctgctcgaaggcgcgcgcctccacctggatggtcgagccccagccgctgggcgcaatcaccgcgaccgtcagcgagcctccggtgcgctcgcccttgccggcaacggtggtggagagctccttgccgctgccctcgtcgcgtgcgttcacctgcacgcagccaggcagaaagcccgagtagtccaccgtgactttggccgcgccagggctttcgtccttcttacaactggccagcgcgaggagagggagaagcaccagaacgcgtcgcatgcggacattctatcgcgtccgtgccccgccgctgcatcctctcgagcccgcacctacctcacggacgggaagtcggagtggaccacttccaggcgtacatccgcggcgatgctagcgggcgtcaccagctccaaatccaggggaacccgcttcccgtaacgttcgcggagctgctgctccaggcctttcacgcggagcgagtccagccgctccattttcccatattccaagcccgcaccctgggcgtaggccttgcgcaccagctccgagcagtacatcgcgtcgtccccccaaccgaagagccagtcatacggcttgcccagatgcgccttggccgccgccaccgcctgctggcgctgcgcatcgctcagttcacgagggcgtaggacgaggatgccgcccttcgcgcctcgggccttccacttcgagaaccggattcgctgcaccggctgcacggcctccacgacccacgcgccctgttcggtcacctccaccatgcccacatgggacagggggctctgcgtggccttctggatggcctgtgactgcgaggagcgcgaggtgtgcaggacgatgtctcccgtctgcaaccgggcctccagtccttcatgcggcgccgcgaccgcgttgtgggcgccgaaccacaccatcagcatgaccatccaccgcattgacgagtcctttcaggtgcttggctgcttccggagtgcggagagtgcagccgggatgccagccgtcacgagggtgtcgctaccccagcgtgcgggtgaggggcacctccactcggggcaggtaatggccgcccttgctctcgaaaagcaccagttggtccacgcgcccctcgcccagtgacgtgtccttcagcgcctggacgcatgcgaggagggcggcgtctccgcgcgggtgtttcgcgcgggccagcgtgaggtgcgcggtgtactcgcgatgctcgggctcgaagccgagcggccggagcacctgggcggcatccgcctgcaaggccttcagcgcgtccgtggcgccgcacacatccgcccagagcacgcgtgggtgggtgggcgcgccaaaagcgccgccaccaacgacagacagcacgaagggggagtgccgagctccaatcggcgccagggcttcgcgaatggcgggcaggcgtgcgtcatccacgtcccccaggaacacgagcgtgaggtggaggccctccagcttcacccagcgggcctgaggggccagggggcgcagccggtgcaactcctcggtggtgcgcgcttcaatggcgggccccagggtgacggcggtgaacaggcgcatggctcacggctcctgacctcatgagggagacacagtccttcgattcccttcagcatcggagccggtgggtgtcgccctgctcgtgaccggtgccaccaggcgcgctgcgggggcgcctgccagttcgagccggcggcgggcggtgtcgtgccctgccgccggccctgacgtgactggggctcagtacgccttggagaacacgatgcggcccggcgaaggctcgccggtgacgacgcacttgcccggctcctgcttgaggtcgaagggacggcagcgcgtcgtcaggcccgtctcttccttgatgcgcgcctccaccttggggtccaggttccagtgcgccagcaggaagccctggtccgccttctccttcagctcctcgtaggagttgacctcgaaggtgtgcgagtcgcggaaggacttcgctttggtgaacaggtccttctgcatcgcgtccagcatggcctgcgccttggacacggcctcgtccagcgacacgaactccttctggcgcacgtcacggcggaccatgacgcaggagttcttggccaggtccttgggtcccagctcgatgcgcagacacgtgccgatgagctcgtgctcgttgtacttgaagcccgggctcttggtgtcgtcgtcgtccagcaccacgcccaggcccgccttgcgcaggtccgcggccagcgcgttcgtcttctccagcacctgcgccttctccgcgtcggaggccttgccgaagatggggatgatgaccacgtgcgtggccgccagcttcggcgggacgatgaggccggcgtcatccgagtgggtcatgatgaggccgccgatgaggcgcgtggacacgccccaggacgtctgccacacgtggtgcatcttgccgtcgcggccctggaactgggtgtcgaaggccttggcgaagttctgtcccaggttgtggctggtgcccgcctggagcgccttcttgtcctgcatcatcgcttcgatgctgtaggtgcgcagcgcgccggcgaagcgctcggactccgacttctggccggtcatcaccggcatcgccatgtagtcctcggcgaaggtccggtagacctccagcatctgccgggtctccttctccgcgtcctcctccgtctcgtgacaggtgtggccctcctgccagaggaactcggtggtgcgcaggaacaggcgcgtgcgcatctcccagcgcatcacgttcgcccactggttcagcagcagcgggaggtcccggtagctctggatccacttggcgaagctgcggttgatgatggtctcactggtgggccggatgacgtagggctcctccagcttggacccacccgcgtgggtgacgacggccagctgcgggttgaagccctcgacgtgctcggcttccttcttcaggtagctctcggggatgagcagcgggaagtaggcgttcttgtggcccaggtccttgaacatcttgtccaggacgcgctgcatgttctcccacagcgcatagccattgggccggatgaccatgcagcccttcacgtccgagtagtcggcgagcttcgccttctggaccaggtcgacgtaccactcggaaaagcccttctcgcggggcgtgagcttctcggccatgtgcggagcacccttcaaaagtcgtggaaagaggacggttgcctacgccgggcccacccggaaatcaacggccccgtcgcccggacgggcgctgggtcccttcctggacgggattgtgtttttcgaccaacggtcagaataatgagcaccggttgaatccgcatccaggaggcagtcatgtttcgccaggtggctgacgacgtgcacgtgctcgcggtggagttccgcatcgggggaatggatttggggggccggatgacggctgtccgcctgccggatggggggctatggctccactcgcccgtccgcttcagtccggaggtacgggcggcggtggatgcgctcgggccagtgcgcttcctggtggcgcccaacttgatgcaccacctgtacgtgcaggagtgggctgcggcctatcccgacgcgaaggtggccgcgcccgctgcgctgcggcgcaagcggccggacctgcgcatcgacctggagttgggtgacacggccgaggccggctgggccggcgtcctggaccaggtgctcgtccaggggatgcccaaggtggacgagctgctcttcttccaccgccccagtcagacgctgttcgtcaccgacctggcgttcaacgtgcaccggacgggttcgtggttcacccgcatgtacttgaagctgagcggcgcgtggcagcggctcgcgccgaccatgctggttcgctccgtcatcaaggaccgggaggccgtgcgcgcgtcgctggcgcggacccaggcctgggacgtggagcgagtggtggtgtgccacggtgacgtggtggagcagggcggccgggaggcggtgcggaatgccttcgcccggttctagcggcggtggccgcaagcccgcgccgggccgccgtcgcggcgccgcgtcactggccgcgcccacccctgcgtcggctcccaccgcggagccctccgagcgcgaggcacgcaaggcgcggcgtcaggaggggcgccgtcaggccatcctcgtcgccgcacgggcggtgctggttcggggcggggtgttgggactgaccctggaggccgtagcggcggaggcggacctgagcaagccttccttgttctactacttccgctccaaggaggacctcgtgggggcgctggcggtggagggactggagcgcgaggtgaaggtgctggaggcggcggtgacggccgcggccagcggcgtggaggccctggccgcgctggttcgtgcccgggtggatttgtacgcggaggacctggacggctttcgcgtcgtctatctgtggccgcagttgaccgggcggcaatccgaggcgcaccaatcgcgggtgctggcgctgagtggacagctgaatgacgtgctggaggcgcggctccaggcggatgcgcgcgcgggccggctggccccagggctccagccgcgtcggctggccaacctggcctggaccgtggcgcacggggtgctttccctgggggctgggctggagcactctggtgtgggaacgcgcttcaccttgtctcaacttcgtgacgaggcctgtgcggtattgctgcgcagtagcggccgttagggtggctgtgaagggtgggaggggcgcgctatgtagagagcctccttcccgtcgttcctttttggaggcttcatgcggtcgtaccttgcatcactcggagttgccggcgttgtgtcggcgtgccttgtctccggttccgcgttcgccaattccatgggcatcagtggccgaagcggcaagcagggctcgggcttcacttgtgcagagtgccactccggcggcagcacgcccacggtgaccatcgaagggcccaccacgctggcgccgggcgccaccggcaactacacgctcgtcatccggggcggtccggccgccggcgcgggctacaacgtggcggtgagcgacaacggcggcacgctcaacccgggttcggcctcgtacaagctgagcggggaagtcacccacaagaacatccaggcgttctccggcggcgcggcccgcttcgacttcaccctggtggcgccgtccactcccggcactgtcaccctgtacggcgcgggcaactcggtgaacgagaacggcaccgaccagggagacgcctccgcggccaccacgctcaacgtcaccgtggcgactggcggcggcaacggcggtgacggcgatggtgatgacggcggtggctgcgccgccgcgggcggtatcccgttgctgggcgcggccctggtgctgctcggcacccgcctgcgccgtcgtcgctaggcctcgttgaaaggaggcctccgtgcgcgacagcgccgtcagtgaccggaggccaccgaggcggtgaactcgtcgggcaggaaggcggagaaggacggcacccgtcgaaccttccgccgggagttgcccgccagccgcaggatggccagggacaccagccccaggcccacggcgctgcgcaggggcgccggacgacgtgaccggcgccgggcgcggtagtgcaggagtcccacgggcagcagggcggcgggaatggccatcagcgcccatgagcgccagcgggtccggccagacgaatcggatgccagtgtcgttttcatgaagaaacaggttgggcgtgggatggagcagggggaagggtggcccgaaccggacgcaggtcggcccctgggtcgggcccctcccgtggagggcggacacggcctcgccaggctgcttgctgatggcccgccaggccggccgccttccggacgagcctggggggcagggcgacaggtccgcggagggggcttaacatcgcgccccttccgcccatgagccttcgccgcctcctccccatcctgttcctgatggggccgctcgcgtgtgcgaccggccctggctacctcgcctccaccgagtccgtcgccgccgtgcggcgcgccccgggagagctgcgggtgatgaccttcaacattcaatccggcgcccgcgggttggagcgcgtggcgcacgtgattcgcgccgcggtgccggacgtcgtcgccttgcaggaggtggacgcgaagtccacccgcgcgcgcggcctggaccagacggaggagttgtcccgcctcaccggcctgaagtaccgcgcccactttcgcaccacggatttgttcggcggggcctacggcatcgccgtgctgtcgcgtttcccgctggaggcactggcgcagtatccgctgccggggccgcgcggcgcggagcctcgcaccgtggcgcatgcggtggtggacgtggatgggcgcgaggtgagcgtctacctcacgcacctcgtccgccggcccttcaacagcgacacccgcgtgcggcagagcgcgtacgtggcgcggctgatggcgcaggattcgcggcccaaggtgttgatgggggacctcaacgacggaccggattcacgctccacgcggctgctgcggcgggccctgcatgacgtcgccgcggcgaccggaggcacggggggcacgtatccgctgccgctcttcctgcccacgctgcgcatcgactacgtgctggcgtgtgatgccttcacgttcgtggcgagccgggtgctgcgcgtggacgtgtccgaccactaccccgtggtggcggacctgcggctgaagccggaagccgtgaccgtggtcgccgagcgcgcggccaccggcaccgcgccttgaacgaggcgcgggccagcgcgggcatcagccgacgttgaagcggtacagcacttcgttgtcgttgcgcgtgaagcccttgagtacctggtgcttgaggttctgcgcgcccaggtacgccagtccgccggaggcgaagcccatgacggacagctcgaagtaggggtgcggccggggaacgtgggtgatgtgcaggtcggtgtggtcctgaccggggagcacgttgaggtcgccctcggtgaagtagcccttccagatgccgggggtgaacagcaggaagcgccggaagtcaccctggctgaacatcgccttgagctggccctggcccagggcgtactcggcggacttcacgccgaactgccaataggcgctcgggttgttgttgtagaagcgcgccagcagttcgtcgttgagccggaggaaagcatccgccggcatgcgcgacaccggcatcacgggcttggagaagaagggctccttcttcgcgaagtcggtgaggaacgccttccaggccgcctccccatgagtctgcaccatcaactgttgccgggccaggaaagcgacgcctttgacttccattcacgctctccgcgggggcgcggacgccccgtgtttgggtttgcaggcaacagtgtgctgtagatgtttcatgagacgaagcggtgatgtgacaaccgctcgcgtccgcccgtccctcaatcgagctggagtccgcagtcgctacaggcgccttccagcagcggcgcggcggtgccacaggccgggcagggcggctcgccgtcctcggagaggggggctgccggagcggcggtgcgtcccatgggcaccaggccttcgcgctcgatgctgtccatccaccgctgctggagcagggcggccacgcgagggccgtcctcggggcgcaccagcacctggaacttcgggctgcatcccggtttgctgcaggcctcgcgatgcacgagcgccggcacgtcagcgcccaggcaggcgtccaccagccgccgcgcgtccatcagcgccatctccgcgcagggcaccagctccacttccgacagggccttcgttgcgtcttcaggagtcatcacccgggggattggagcgcacccatggggccacgtccagtccgcccgggcccgcgtgtcatgccgcgcacgcgccgggtcacgacgcgccgcggccgagaggcggttcattccccgggccttcccatttcccgttgggacatgcgctcaggcgacgcgccagcgctggcagggctcgccaccccggcagttcttgccagccgtcgcagcaacgcgcgccggtgtgcggcctccaggcatcggcgtggattgcgcggtggcggagggacgacttcaggctagcgtgcggagggtgccgcccacgtcactcacgccgcgcaccgcgcgcctcttccggctcctgatggtgggcgcgggcgtgctgacgtgtggcgtcttcggcctcgcctgggtggtggaccgcttcggtcagcgcgagcaggccgtgcccgcggacgtgctggttgtgctgggcgcgcgcgtgatgaccgggggcgcgccttccggggcactgcgcgcgcgcaccgagcacgcggtggcgctgtaccaccgcggcgtggctccccggctcgtcttctccggcggcgtgggcgtgaatccaccctccgaggcgcgcgccatgctggcgctggcgacgcggatgggcgtcccggcggaggcgtgtgtcctggaggagggcagtcactccaccgacgacaacgcccggctcacggccgaggtgctacgcgggctgggggctcggcgcgtggtggtggtgtcggacccgtatcacctgctgcgcgcgcgcaactacttccggctgtatggctgggaggtggccaccagtccggcgctggagaccgagcgcaacctggacacgttcgaccgcatctattggacggtgcgcgaggccgtcgcgctgctcctgcatccccgcgtgctgctggcgcgcgcacctactccttcggcaccgtgagcgcgcgcagctccagcgcgcctcccggcagggccacgcggagcagcacggactcgccgggcttcgtcttccgcagcgccgtcaccacatccttcgcgccgcgcacgggcttgttcgcggcctccaccaccaccatgcccggcagcaggccggcgtgttcggccatggaggcgggggccacctccgtcaccaaggcgccggagggtggaagctcctgggactccgccagcgccgggtccatgtccatcaggctcagccccacgcgatgctcggcggggcgctgcgagccgccgacggccggctccttctcggcgacgccttccaggtcgggccgcgtgcccagcttcgccttcacgtcgcgcttcttcgcgtcccggtagagggcgagcgtgagctccgcgcccggtggcttctgcgccaccagccgcgtgagcgcgcccgcagagtcgatgggctgcccatccgcggcgacgatgatgtcgtccggccgcagcccggctcgggccgccgcagtctccgccgtgacgtcggtgacgaccgcgccctccttcacgggcgcgcccagcgcctcgcccaaatcgggcgtcatgtcctgcaccatcagccccagccagccccgggtgacggcgcccttcttctccaactggggcagcagcgatttgacgaggttgctgggcaccgcgaagccaatgcccgagccctcgccggcgatggcggtattgatgcccaccacctcgccattcaggttgaacagcggaccgccggagttgcccgggttgatggcggcgtccgtctggaggaagtcgtcgaaggggcccgccgcgatgtcgcgctccttcgcggcgaggatgcccaggctggtgctcgacgtcaggccgaagggattgccaatggccagcacccagtcccccacacgcagcgcatccgagtctcccagccgcaccaccggcaagggcttgccgccgtccaggcgttcgagctggagcaccgccacgtcggtgagcgggtccgagcccagcacgcgcgcctccaggtcgcgcccgtcggcgagctgtacctgaatcgcctccgcgtcttccacgaggtggtggttggtcagcaccagtcccctggcgtcgatgatgaagccggagccgatgccctcgcgcaccggcggggcgaagggcgagggagcctcgaagggagacagcgggtcctcgggggcgtcgtcgaacgggggaccgtcgaacggcaagcctccgaaaggcgagggaccgtcaccaccccagggcgtgtccttcgtctcgccgggcgtgggcgcgcccagccgcacctccacgttgacgacggccggactcacggaggccaccaggggcgcgacggaggcgagcgccacggcgcgtccggtgggcagcgggggaggctcggtcggcttcggtgcggaggtcgccgtggaaggaggcggctcctccgcgtccttccggcaggccatcaggcccagcagcacccctaccgccaccccgcgcgcgtgtaccctcatcgccttcctcccctgtcgcaagctgcgaccgccgcgcgacgcaggggggctgaccacccgggcatgaagcctgtcaggccgcctggaggactggggccccgtcgggggcctggctgtcagcccgcgcgctcacgcggcgtgggcgtggccggggcgctcatgcgcttcaccaacttctccaggatgcggaagagggccttgcggtctcccacgtcgaggatgcccaggaactggtgcatgccatggacgaccacgcggttgagccgctcccaggtcgactggccgtcctccgtcaggcggcagtgcacgacgcggcggtcggtggcgctgcgctcgcgcagcaggtgcccctggcgctccagccggtccaccacacccgtgacggtcttctccgtgacacccagccggcgcgccagctcacccatggtgagcggaccgtcctgacccagccagaggatggcgtgaacctgaggtggcgtgaactggagctgctcgcacatgctggcgatggggtcacggagcgaactgcgccggcccagcgcgaggagcaggttctggagcttctccaggtcctcggtaacgtcttcatcctctttgtggaatttccgtgacacggagtatcccatagcggccccgcatgggcgggtcaatctgttgtccagatgggcgctgacctgacgacaatgcaacgcgggttgtccggatatgcgaggtgctacgccatgcgtcatctgttcctgctttgtgccgtctccacgctgttgtcgggggtgtctgcccaggccgacacggtactggtgttcgcggccgtgagcacctcggacgcgctccaggagctggcgccggccttcacccggaccacgggccacgcggtggagttctccctgggggcctcgagcgacctcgcacgtcaggccgtggccggagcgcccgcggacgtcttcctctccgccgacacggcgcagatggacgcggtggagaaggcgggcctggtcgcgccctcgacgcgcgtggacctgctgtccaaccggctggtggtggtggtgccggtggacgcgaagtcggcgccgtcctcacccgctgggttgcgtgggttgaagcggctgtcgctggcggacccggaggcggtgcccgcgggcgtgtatgcgaaagcgtggctggtgaaggcggggctctggaaggcgctggcgccgaatctcgtgccggcgctcaatgtgcgcgccgcgctggcggcggtggagacggggcgcgtggacgcaggcgtcgtgtattccacggatgcggcacattcgaagcgcgtgcgcgtcgccttccaggtgcctgagcaggacgtgccgcgcatcgtgtatccggcggcggcgctgacgaagggcgccgcgccagaggccgggcgggcattcgtgcgcttccttcagtccgacgcggctcggaaggtcttcacacgccacggcttcggcgttcccagcgcgcgggctccctgatggagggcgtcgcggcattggtgtccttcacaatctgggtggcgacgctggccacgctgctcatcctgccaccagggctcgcggtggcgtacgcactggcgcggtgggagggtccaggcaagggcgtggtggagacggtgctgacgctgccactggtgctgccgcccacggcggtgggactggtgctgctggagttgctcgggcgcaacggcccgttggggcgcgtgctggacgcgtggggcatggaggtcgtcttcacgcccaaggccgtggtgctggcgagcgcggtgatggcgttcccgctgctggtgcgctcggcgcgctcgggcttcgaggaggtggacccgcggctggtggcggtggcgcgcacgctgggcgattcgcgcacgcgcgccttcttccgggtgacgttgccgctggcctggcgcggtgtgctggtgggcacgctgctggcgttctcccgcgcgctgggtgagttcggcgccacggtgctggtggcgggcaacattccaggccgtacacagacgctctccctggccatcttccagcgcacgcagctcgggcgggacgcggaggcgctgcggctggcgggcgtggcggcgctgctcgccttcgtggcggtgttcgcgaccgaggcggtgacgcggcggcgtgggcggagggtgcgcgcgtgagcctggagctggacatccggttgccactggcgcgcttcacgctggaggtgggcacgcggctggatggcgcgtcagtggcggtgatggggcgctcgggctccgggaagacgtcgctgctggaggtgctcgcgggactgcggcgcggcgcccggggccgggtggtactggatggccgcgtgttgttggacagcgttgcccgaagcgacgtgccgcccgaacagcgccgcatgggctacgtgccccaggatgcgctgctcttcccgcatctcacggcggagcagaacgtgcgctatggcgtgcggccggggcgggcctctcgcgtggacgaggccgtggagattctggagctggcgccgctgctgcgccgctacccggccacgctgtccgggggcgagaagcagcgcgtggcgttggcgcgcgcgctggccacggacccggcgttgttgttgctcgatgagccgctcgccgcgctggacgtggcgctgaaggaacgcgtgctgccgtacctgctgcgcgtgcgcgacgaggcccgggttccgatgctgtacgtgacgcatcagttgggcgaggcgcgcgtgctggcgcgagaggcgctgctgctggaccaggggcaggtccgcgcggccgggcctgcggccgaagtgctgggcgcggcggcgcgaggcctgctcgccggtgaaggggatggggaggagaacatcctcgaaggagtcctggagcgtccggacgacggcgggttgcggcttcggatgcagggcgggttgtcgttgtgggtgccggactcgcccgcgttggcgccgggcacgcgcgcggcctatgccgtgccggccgcggacatcctgctgtccatccaaccgctgacgggggtctccgcgcgcaacgtcatgacgggcacggtggtgaacgtggagtccgtggcgacgggcgaggacgcggccaccgtggatgtggcgggtgtgcgctgggtggtgtggctcacgtccgcgtcggtgcgtgagttgggcgtggtgcccggcgcgcgggtgtccctggcggtgaagacgtccgcgtgccggcggctgcgctgactcatcgcgcagctcagatgagctgcgcgacggagccgccgcgatgggcgaaccctccgcgacgtgtcgtccatggaccgcgcgagcgccaggcagagcaggacgagcgacagcaggacggagcggttcgcgcaaggagtggtgcatgcgcggggacgcctcgtgagcgcacggcgcgcgcggatgccatcacctccgtggtggatttcatgctgaacggaccgcgcgctcccccggaggcccctcgcgccggggggagccggagtcactcccgtagctcgctgttcggaaatctttagagca

SEQ ID NO: 1259 - DNA, 35614 bp, Myxococcus xanthus
gcgcgattttcccgtgagatccggtggtcaacctgggctgggtggagcgcaaaggcttcgatgcccacatggagaagtgtcacgtccgagggtcgcttttcgggtggcatctccagaatccaccgcaggatgacttccttccggctgtcccccacgttctccatgcgcagcgcggcctgctgctcggcccctgccgcctcctcgttgctcagccaccagtcctcgccctggtggaagcgcacgacggcttcggcccagatttggtcgcggtcgcgcttgagggcgtcggtgtcgatgcgggagcacttcaccggccagaagcgcctctgtcccgtggggtcgcgcaggtagtcgtcatcgttggttgtgccgacgaagacgcagcggcgcggggcctgcacgttggagcgtccgtagggcggccggtaggtgtcctccgtccgggtgatgaacgccttgagcgcctggtcctccgacttccggaaggtgctcagctcggccagttcgatgaaccagaactgagaggccagcatggcgctgtccctgctggtgacgtcgatgggcgcgtcgctgaagtgccgacctcccaagatgctgaacgccgtcgacttccgcaggccctggggcccctccaaaatcatgaccgtgtcgaccttgcatccgggacgcagggcacgcgcaaccgctgagatggcgaacttcgcgccgacggcctggaggtatcgagcatccccttgcgcgccgaagtatgtcgcgagcatcccgtcgaggcgtggcgttccatcccagaccagtcctcccaggtagtcggcgaccgggtcatagctgttgcgcttcgcgacggcgaggatctgctgcgcgacgacgtgcgccttcggcatcagcccaagccgcccgtacttgctgagctgaatccagttagctaccaggacgtcgagcgtctcaatgtccacgctggggccgagggggccgccctccacctccaacttcttcgtgacttcgttgaaacggaagacgccgcgccactcgggcgacttgctgagcacgatggcgacgttcgcttcgcaatttcgaatctgccgtcgggtgtccttcgtgatgtcgaggaagagttccttcatccacgcgtcggggtcgggagcgtcctcctcgattcccgggccgtcgctcgccgcggattcaggtgcgtgactgcccagggtttcccaaatggccgtgttgtccgcgagccgtgaggcatcccgcgccttcctccgctcgcggtggcgccgcagcttgaggacggcctgctcgcacaggtgttcggtgccctcgcgccagtccgtggccgcgaaggacgcgcggaacagctcgatgacgacggcctcgggcgtggacagcggcaagacaaaggcggcgcatgacatgagcgtgttcagcgtcgtgtcctgctcgccgacggcagccaggggctcaccggcaagggcgcggcggacgatggcgaggtgctcgggcttgcggatgcgacgcaagagggcccgcagctcgtacaggtcggcgggttcctcgggcttcggggaaggcaccggggctgccaccgtggggagtccagcccgggacatggcgagcagcgcgtcgacgtcgaggggcgctccgtctccactggccgtgtagggctccgcacccacgggcgcatctggcaggtagtagatgcgcgccaggtccttcgttgccgggtcggcggggagtccgagcatgcggattgcggcctcgcgcacggacggccactcgcgcgggggcacaggccgggacaacggcatcaccagccgcaggcagtagtcctcgggcgggcggttgctgtgcgtcgagtggacggcgaaggcgagtccatggcgctcgacggcgtcgaggcacgcgagctgcgccgccgtcaggtggtccaggtcgaagacggccaccgtgacggcgcgcacgttctccgagcgacgccgctcgacgatgttcacgggactccaggcggggccattcttggcggggcagccacggacgcatggcgacgtggggcactgactccgacggtgagtgatgagtttcgctgacagttcgggccacgacagctcagcggcttgggggatgttgtcctgggcggacgcgtagaaggcgaccttcagccgaagggcgcgcaggcgcgtggtgtcgggcgcgtggctcatgcctgggtaaatgggtgcggattctgcgaatggctcagcgaggagtgcgacaggggcgggatgcgtgtggggtacgtgcatggcatccggtaaatgggtgcggattttccgagtggcccacggaatcgtcagccgggcgtatgcggcaggtggtgcgcgtcgccactggtacatgcgtgcggattccgcgaatggctcggccgtcgcggcgaggcgtccggcgtcatgcggcactggagcgcgttcccccaaatccttagccttctctattacctatcctcctttctactactccatcttttctaaagagaagaaggagagaggataggaagagagcttgattgatgacgggcgttgatgccctgagttgtttgcggaagtcgcacgcatctactcgggacatgccgactcgccttcgtcgctgcctttcgagcgtgcgtgagccgttgacgaaatccacacgcatttacgcggggaacgactgcgtgccgatggagcgtcgacgcgcagcccaaccgcgagagcgtagaggcgccgtggctgagactgtctgtgaatcgagcgtagtcggcatgcggcatgcttctgttggggcgatgtctcacgcagcgatttgtcgcagggggagtgcgaagaagcatgtttcacacagtgagtatggccttcgggcggctcggcaatccgaactcgtgtcccgcatcctggcggcccgcgcgagcggcaacgccgtgctggagcgacggttgtccgctgagttgctcgactccgtgaggcccctcatccggtgcatcgtcggggccctcttgcccatcgcgggctcgttgtcgcctgatgacctcgcgcaagttgccgccatggcgatgcttcgcgcggtgtccaagtacgacgccacgagggggcgccagtcgttcggccaggttgcctacttccgggctcgggctgcctgcgaacagtacgcgcgcttgcacggcaccgacgttcacctgagcgacggcgagcacaagcgtcgcaccgtgcgttcaatccgtagcaacgaacgcaacgtcgtccgcgtccaccgcatggacataccgtctcatttctcggacggtgcttctgccgatgactcgtgggtcgacgagttggaatccgcactccgcgagatgtcgtgcctggacgccgacgaagagacgccagaggcaaagttgctggcggctgagcggcgcgccctcgtgttcgatgccgtgcgccgactggcccctgaacagcgcgagcttgtctcacgcgtcttcggaatcaaccgtccggcgcagtcggtgcgctccgttgctgaggcgtggaaagcgccaaagagccgcatcgaccggatgctcgcgcgtgcgttggctgagctgcgcgaggcgctcgtcagacaggacctgtaacgtgcccgtcatgctggcttcgcgacgcgccccatgtgccgtgtgcgccctgcccattgcgcagggcgaggtcatcgcttacgagcgtgccgttggcgctcgtcacatggcgtgcgcggacttggaagccacgcgtcggcgaaactcctatggcgcccgttgcgacctgtgcggcgtgcatctcctgcggggtgaaggaaggctagccgttgtcgagcgacaggcacccgatggtgggtggcgccgtagctggaatgcgcggtgtatcgttgtgcctgcgtgtgacgcgcgaattcgtgccaagtaatgacgatcactggcagtgaatctgtgtttcagtcggagtgaaatgacctgggaggggccccccggctcggattttctgtctgcggcggaattctggcttgctcggagcgcccccactttcaaaaaattctgagaaaaaccgtggggtcgatgcgttttgttgagcgctcccccgaaaaacttcgcgaaaccgcacgcatttaccgggtgtggcgcgaccaaccaaactcactcctgagcttcaacagcagatctgcgagcacttgcgctcgggcctcttccgtcgagcggctgcgggcctcgtaggcgtcgacgagcagaccgtttcccgctggttccaccggggcgcgagcgaggcgcgcgggctctaccgagagttcttcgtcgcggtgaaccgggccgaagcggagttcatgcagggggcgacagagactctccaggccgccgcgacgacgaacccgaagcacgtccagtggctcttgagccgccgcttcccggagctgtacggccgacgcgacaacgtcgaggcgaagagtcccgaggaccaggctgccgacactgccgcgcttcgcgagctgctgattgaccggctcgggaagttcctcccggacgagctgcccgcgtccgtccctgccgaagctgccccgtccgagcagttcgaagacaagggggcgagcgatgcgtagcctcctgtcgaaaggcgcctgggggaagttcgccgagaggctcgcgccgcacgagtcccccgcgtcccggatggtgcaaacggccggctcccgcgctcagctcgcgaagctcttcggcgggctcgacgacaaggaagtcgagctgctcgtttacgacctcgacttctgggcgcgtcgcgagcagtcgcccccggacaagttctcgacgtgcttcgtcatggccgggcgcggcttcgggaagacgtggtgcggcgcgcgctgggtcatcaaaaaggcgtggcaggcgaagagcgtcggggccctcatcggcccgactgcggcggacgtgcgcgacacgatgattcgcggcgcgtccggcatcctcgccctgtcgcccccctggtttacccccaagtacgagcccagcaagcgccgggtgacgtggcccaacggcgtctatgccatctgctactcggcggataagcccgaccggctgcgcggcccgaatgccgggtggggctggggggacgaacccgcttcgtggaaacacgacatggcggccgtcgatcagctcccgctcgtgttgcgcatcggctcgcgagaggacccgccgcagcttctgctcaccgggacgccgcgcccgctgaagaagattgaagagctgctcttcgccaacgcggagacgcaggaactcaagccgggcgtggtgcttcgaacgggctcttcgctgagcaacttcgcgaacctggcgccgtcggccgtggcgaacatgcgggcgctggcgaacacccgctggggacagcaagaggttctaggccgcctgctcttcgacgtgcccggggcaatttttggctcggcgaagtggggccgcgtggaggccgacgcgcacgagtatgcccagcagttggacaggcgcatcgtcagcgtggacccgagccccacgagcgaaaccggctcggacgaaacgggcatcatcgtccaggggtgcaagtcgagcgcgctcttcggtgccgacggagtgccgctcaagcgcgtctctgtgctggcggacctgtcgcgccgagcgagcccccgtgagtgggcgacgacggccatccgggcctatctcgaatggggatgtgacgcgctcgtcgtcgaagtgaacacgggcggggagatggtggaaacgctcatcagcaccgtcgcgggcgagatgggcgtcagtgtcaacgtgaagccggtgcgggcgacgagcgcgaagagcaagcgcgctgagccggtgtccgccctggccgaagcgggccgcgtcgagttcgtcgggacgttcccgaagctcgaagcgcagctcagcaagttcaccggcatcaacgggcgtcgcgacgacagggccgacgccttctgttggggcgttcatgacttggtcttcgtcgaacagttcttcgcggtgtgaggttctccatggggatgttggacaggatgcgcgccgcgtttcgcgggagcagcaagcgcaagggaacggggctggagctgagccgctgggcttcggccccgccgcgtcgcgaggtgcccgcgctgctcgcggcctacgccgagatgccgtggctgggaaccatcgtcgatacggtgggcgatgccttcgcggacgtgacgtggcgggccttcacccggcaggacccaacgacgcggaagtcgctggtcgacgtgtcgctgcggcgggcctgtggcgacgtgcgccgggagcggttgaagtcgctcgtcgagacgggggacgcggtggagctgcccgaccatccgctgctgcggctgctggcggacccgaacgactacatgacgggccgcgacttcgcgaagctcttctgtctgcactatgacttgacgggcgagttcttcgctgtcgtcgaagagctggcgggcgtgcccgtaggcctgtggccggtgccgcccgattgcgtcctcgcgctgccggacctgagcaagccgaagtcggagcgcacttacacggtggccgctggcgggcggacattcctcctgcctgcggcgagcgtcatctacgtgaagcgattgaatccggctgacccgcttggccgcggtatcggcatcgcctactcgctgggcgacgaagtcgacacggacgagcacgcggcgcgcttcacgaagaacgccttcttcaacaacatgcttccgggcgccgtcatcgcgattgagggcttcaacgagtcgcaggccgggcccgcgagggccttcaaagagtcgctcgcgcgtgagtccgggggccccggcaacgcaggacgggtgacgattacgagcggccggacaaccgtttgctccggctcgacacgccctttggcgacatgcatcgtcgaccacactgctccgcttcctcatggacattcgtgcggatggtgtaccgggtgccgccggagattgtgggcgacgtgacgagcagcaataaggcgaccagctacgcggcgcgagagcaccttgccgaacaggcgacgaagccgcgcgccgaagtctttctcgcgtcgatgcagaagcacctggcaccccgcttcgaagacgacgtgcttctctcctacgactcccccgtgcctgccgaccgtgagcaccggctgcgggtgatggggacgctcccgagcgccttcaccttcgacgagtggcgagtcgaagcgggcttcaagcctcacccggagcggcaaggtttcgcggagctgcttccgggtcagaagcccaacgagcccggcgagacgccgacgcccgtcgaaggcagctcggcggaagcgcatgccgaggcgacgaaggacggctgagccattcgcagaagtcacacgcatttaccgggtgcatgactggccccattacacgctccctgcggctgagcgccgttcgaaaggacgcggcgacgttgagcgccgtcgagtccattggcggacggcgcgtcttcaagttcaaagcgagtgacggcgacttcgaccgctactcggaccggctgaacgtcaaaggctggcgggtggacggctacaacgcgaatggcgtcgtcctctacaaccacgacgacggggcgagcgcctcgttgactggggctgaacctcagttgcctatcgggaaggggcgcgtctacgtctaatgcgatgccctgatggtggacatcgaattcgacgacgaagacgagttcgcgaagaaggtcgaacgcaaagtttcaaagggcatcctgaatgccgtctccgtccgctacctcatgctccctggccagtaccggcagaacgagcggggcggctacgactgcgacgcgcaagagttgctcgaagtctccgtcgtgacgattccggggaactcgcgggccgtgcgctcgaagtccctggacgaagcgcccgaagacatcgtcgagcggattgccgcgcgcgttgtcgagttgctcgacgcgcgggccgaagtgaagtcgacggacgaggacgagcagaagagcgagcccgacgaagaagacatcgaggacgaagcgaagtcgacggacgaggaagacgtcgaggacgagcagaagagcgagcccgacgaggacgagacgaagggtttcaacgccgccgacgccgcgaagagcttcgtcgaggcattcaagggctacatccggggagtgaaggaatgactcgcgagcaaatcgcacagatggtgaaggcgctcggccccgaggtcgcgcgcgagctgatggacgccgccgctcgaagtgccccgggccgggctgagccgggcaacgcgccgcgcgggactggcgtctacgcgagcgcggagaacttcggcggcttcgcgaagagcgtcatcgcggccggacgccgcaccggagccggcgagttggtcgacgccgcgaagcgctttggcaacgccgatgtccagaaggccgttcagctcagcaagttcgactcggcgggtgtgctggtgcccatccagcagagcggcgaagtgattgagttcctgcggcccgacgcggcgatgctcaagctgggcgtgcgaacccagacgttcaagggggagctgcacatgggcaagcaaaccgggacgtccgtcttcaagtgggtaggggagggcgagacggtcccgaagagcgcgccgaagtacgggaagattgtcctcaaggcgcacaagggcatggtgctgaccgacatcagcaacgacttgctgcgcacgccgggcgtgggtgacgcgggcgtcggcgaggacatccgggcgacggtggccgatggcctggacgacgcgggcttcaacggggacgggacgggcgccgcgccgaaggggctcttcgctcagctcgacgccgctcacaccttcgcttccactgggacgacggcagccgcctacctgtccgacgtcgacaaggccgttgagctgccgctgacggcgcatgtccgcatgggcaacgcggcgtgggtgcttcacccgacgcgggcgacggcgctgcttcagcttcagaattccggcgtctgggtgttccggcaggaaatgctcgaccgggggacgattcgcggcttccccttcgtgatgacgacccgcgtgccggtgtcgcgcatcaccttctcggcggactggcgccagttcatctacggcatcgacgaggacttgattctgtccgagcacgacgttcgcgccgagtacgacgagacgaccgtgcgcgccatcgtgaagggcgacttcaaggttcgccagccgaaggcgttcagctccatcacctacacctgagaggccccaccatgaacgccaattccaccgacgcgggcgtgctcgtcggcatccgccctgggactgtgcccgctgctgtgagcgtggggacgcggaacagcgccgccgtcgaccgcttcggcttcgactcgtgcgtgctgacggctttgacggggaccgccactggtgccccgacggcgctgtcgctggccgcgaagctccaggagagcgccgacggccagaacggatggacggacctgcctgatgccgcagtcgtccccctcactgcccccaacgcggtggcccggctcaatgtccggctgcccactgcgcagagctacctccgagtcgtggagacggtggccctcacggggggcacatctcccaccctgggcgcgtccagcctgattgtcctgtgcgggccggacgagattcccgccacctagcgccgcgccaggacgcatttcccgggccggggctccccatttccccagggggccccggcttcgtcgttcctacgccctcctgagccccttccatggcctgcccgactgacctctgccttgccgccaccgtggccgccgacctgggcgtgccctccgactcgcacgtcgagcgctgcgtcacttccgccagcagtgcaatcgcgaggctgtgcagccgggccttcgagcgggccacggtgacggagtacccggacagctacggccgcccctacgtcctcctgagccgcccgccgctcgtcgaagtcctcagcgttgcggaagggggcgagctgctcgacgcggggagctacacccttgccggggaccttgctgcggggggccttctctaccgcctcgctggcctctggccggtaacggcgcgcgtcggcgggctcgtcaccctgacagtcgagatgcggcaggggcgccccgatgcgctggccgtgacgtacacgggcggctacgtgacgccggggcaagtggccctcgacgcgtcccaggggcccgttaccctgcccgccgaagtggaagaggccgccatcctcgaagcctgcgcgctctaccggggccggggccgggatgcggacgtgtccagcgagagtctcggcgattggtccgtgagctaccgggagcggagcgcgggccagcgccttgcgagcccccgcgccgagctgctcgtagcgcctcacgtcctgtggagggccagttgatgagcgggcccgcttctctcttccgccagcgagtgagctacgccgaagtcgtcggccgggacgcctgggggactcctctgctggggcccatccaggaagctcccgcgcgcatccaaccgagtcgaaagctgattcgcgatgccaacggcgccgaattcgtcgcctccttcgtcgtctacaccgaagcgcccgtcaccctgcgccaccgactttggttcaagggcgacgacatcaccgacttcaaccacgcccgtcgccctgccgccgttgacgagcacgtcgacggggcgggcgtcctgcgctaccggaaggtttggctctaatggcccgcgacactgctgccgacctcgcgacgattctcgccggtgggggcctcaacctgagcgccggggccaacctgtttctcggcccgacgctcgaagacgacgacgccaccgtgccggacgttgcgtgcttcgtgttgcaaaccggaggggagccgccgcagagctacatcggcgggggacgcaagacgtaccggactgtcacctgtcaggtccgcgtgcgctccgcccgtgagcgcttccgggagggacaggcgctcgcgctcgcggccctcgacgtgctccacctcgcgagcgccgcgccctacgtgctgattgaggtggacgaaggcagccccaactacatcggcaccgatggaagcgaccgccactggtggaccttcaccgtggatgcctccttcatcgacctgggcgcgtgagccactcgcgaaagtcacacgcatttaccgggggcaatgccactcaaagttgctcttgatttcagactgctcgacaagctgcggaaggtggagcggcccgtactcgccgacctggcgcctttgactcgcgaacacgcgtcgacggtgctccaggcgagccgcgccctggtgcctgtgggcgctcgggacacggacggcaagccgccgcttagcacgtccgggtttgtcgacggcccggagctgaacgacgcgaaggcgagcgtcagcgcaacggctgggtatgcccacgacgctgcgggcgccattcacgaagggtttcactggggcgagcaacgcttcgccacgccggtccacttcctgcgcaagcccgcccgtcgggggcgcgcgaagttccgcaagacggttgccgcccagattcttgccacgctttcgcgactctttccgagtcggtagggaaactaccaatggcgacccctgttgctgctcacctcgacagtgtttcggtgcgctcagacgcgaatgccacgcaggccgctgaccgcgtcgacggtttgacggatgcgtcgctcagcgagacgggcgacttcgttgagacgaattacctcggcggctcgggctacaagtcccgcgtccagacgctgaaggacaccagcgcggacctgtcgggccacttcatggaaggcgacgcgccgcagtccgtgctgcgtgacgcgcgcgacgacggaaacaccgtctacgtgacgttcatcttcgaccccagcgcctcggccggctccaagggcaagcgcatcccgatggtcgtcaacagctacgacgagaagctgaccccgggtggcgtcgtggagttcacctgcaagcttttgggcaatggcgccccggtggccgtctgatggccgccatcgctgcgcatgtcggctcgctgtctgtcgctggtgagcctgccgagttcctcgaagccgaagccgtgcccatgcccgcgcccgacttcacggggaccgagtttcgaatcgcggaccccgagcttcgccgactcaatccgggagcgcccgtgttcgtcgaggtttcccccagcggggatgccgacgcctggacacctgctgacgcctacgtcgacccgctcttcggcgacgtccacctcgccagcgctcccggcccgtcggccctcgtgcgcgtctcgggctacgcgttgcccgtccatccgctcgccctggtgcgctccatctccctcacggtgacgaacgacgtcgtcgagctgcaagtcatgggggacgcctacaagcggcgttcggtgtcgctccgggacttctcgggggagctgacggggctggccctcacggagctcgaggttgaagcgctggctgaagggattccgctgctcatcgaagttggcaaggcatccggggctcaagtcttccgcgcgtgggtcaaggtgcctgagctgtctcacaagctgacgcccggggccctgtacgagcacacgatgaagttcctcggcttcgccttccagtccgaggacggcgccgctttcgcctggggctacggctcgccctgagctgtctcgtttcacacccaaaggagagtccatgtcgaacaagcacaagctgcttgcgaagaatcgtcgcgtcctgaagtcggtggaggtggacggcgtcaaggtgaacatcatcaagccgacgatgggggacaggctgcggctgattgagcaggcccgcgaggctggcgagatgacggagaagaacgagccgacgggggaccgggccggagcgcggatgctggggcgcatcgccgtctgcgtgcttcacgatgcggagacgggccgcccgatgttctccgtcaacgacatcgacgagctgctcgatgagtcgtggcttgaagacctcgcgacggacctgaccgacgccttcaacgtcagcgaagagaagatgcggggaaaatagacagcgaccccgaagcgagcctgctctacggggttgcctctctcctgaagctgccgcccgacgcagtccgtgaaatgccttacgaggatgtcgtcgggctcgtcgcctatgcgcgaagagaggctgacgaactcgaaaggcgctcttccaaccaacaggccccaagcgtgtcgcagccgggccagcagtccattcggcgtttgcgcaagaggtgattcgtcatggctggcggcggtttgaaagttggcgacttgtatgtcgtcgtcacggccgccgttggcgagttctccaagtccatgcgacgcattgtcgcggacgttgcgcagacggccgacaaaatcgagaagctcgggaagaagattggcgcaatcggcgggctgttcagcgtgggcctgtatggcgcgcttgccgccgtggctgagttcgacagcggcgtcaccgagcggctcgacagaatcaagctcatcttcaccaacgtcttcgctgaaatcggcgaagccgtcctgccgcacattgagagactctccgaagtccttgaacacgcgctcgggtggttccaacgacttgagccttcggtcaagcagtccgttgggacaatgctggtatgggggactgcggcggcgctcgcgggtggcgcgctggggactgccgctggcgtcgttaagagcactgccgaaattgtgggtacggttgtcgcccctgcgctggacggcgcgggaaaggccgtcgtgcgcttctccggcttcgtccgtggggagactcccgttgttgagggcaacctgaagaaagtcgcgaagggggctgagcaggtcgacgcgagctttgctgcggccttccgcaatgccgccgcgcgaatcctcgtggtggcggcgcctctggccgctgtcgcgctcgccgttgcaggcgtcgtgcttctggcgggcacgctttacaaggcgtggaacgacgcgagcaccggcatgcgcgatgcgttcgtgtctgcttggcggggcgtcaccgaagtcgctgggcgcgcggtggccttcttccgggaactcttcacggggcttggggccattgtcgggacgtgggcacgcgggcagctcgaaacgttcgccttcgtcgtgcgcaacctggcacgcatggcggcgcctctcgcccgcgcgctcaacctcgacggcgtcgcggcctcgctcgaagggttgaaggacctgaacggcgacgcgcttctcggcgggctgaaggggttcgccgacggcgcactcggcaagttgaaggacggcttcgcttccgtttgggcggacgtctcctatggcgcgggctacgccttcgatggcgtgaagctgatcggcggtgacgctgcggcattcctccgtgagaagttcggcggcgtcttcgacgacatgctcagcgggccgaagggcaagctgcgcacgccgtccgctggaccggaaatcgaagcgggccgcgtccagattgggaacttcaacgcgaaggagttcctgacgagcgtcggcaacgtcgcggccgtcattgagcaggtggcccggaagaaggcgaaggaactcgcggacgcgctggctcgcgctgtcgacgaagcgaagcgcacccttacgagccgcttcacgcaggccctgggcgggctctacgagctgttcgagcgcttcgagcaagggatgctcgtggggggcgtgtggggcggcgtcatcgccgtggtcgccgagctgctcgcgcaaagctcgacgttcgccacgctgattcagatgacggcgggcttcatccagttcgttgccgatgccctcggacgcgtgctggcccccgtgctgccgctcctcgcgtccgccttcaacatggtggcgccgctgctcgacgccatcgtgccggtgctcgaaatgctgctcgcgccgctccaggcgattgccccggtgctggaggtgcttggcacgctcttccagggactcgccccgctcatcagcgtgttgggacagattctcgtcgcgctgactcagccgctggcgttgctcgcgggccccatcatgaaggcgttcttcgccgtcgtgcgaatcgtggcgatggggattctctacgtcgtgaagggcgtcggcacggtgtggaacggcatcatcggtttcattgccggggtcttccgtgcgctcagcaagattccggttgtcggtggcgccttcgagaagatggcgcggggactcgacagcatgaaagtcccgatggaccaagtcgacggggcgttgaacacgctgcgagatacgacttacgagtcagccgccgcgaactcagccgccgctgtcgctcagtgggagaacgccaacgccacgaagaaggcaaccgaggcgctcagcaacgttccttccggcttcaaggtggcgctcgcacggttcaacgcacaggacccgattactgggcagtcacaaactgtgcatggcgcatcgcccgttacgtcgagccctgctgtccctgtgagtggcggcaacgtcagcgttgggcagattgtgattcaggcggcgcacgaccccgctgagacagcacgtcaggtctacatcgaaatgaagcgcgaagcgggccgacgtcgcggcaacggcgagtggctgaacgggagatattgagatgcccttcctgagcttgaatggcatcaccgtgcccgttgtcgagggacggcgaagacaggtgagcatcggcgtcgactcgcgctccttcagcggcgtctaccggcttgggcgccgcgcgacgcgccaagagtgggagttcaagacggggcctctgtcatccgttgaggcgttggccttccgtgggctgattgccggggacggtcatgcactcgcattcgacggcgacaccttcacgagtcggggccttgccccatcgattgcgacggggagcctctttcaaggcgcgcgcttcggtggcggcttcgaactgcccctgggcgtgtcttgctcctgggcgatgcagctcgggccccgctggacgacgctgcatcacctcttcgatgccacgggaggcgtttggctccaggtcatcaaccggagcgatggggcgcgctggatgcaggggacggctgcggcgagcgcgggcgggttgatcgtctccagtggctcactgtctttgactggggcgctcaacctgcggcgcttcgacgacgttgtcggcctgccgttcatggctccggactcgtgggttccggaggtggccgcgtggcactcggctcgtgcctggagcgcgttgccgtacctgtcggcgggcggggccttttcggtcggtgagacgaaggtgcttggcgaagtgcgggacggcgagttcgtcgaattcatccaccaaggggcgcgcgtcatcggcgagcgactcgaattcaccttgcgagaggtttaggaatccatgcgcagcatgtcgtctcagggattggcggcgctcacgagcccggccggacacgcttcccatgttcgcgtgaaggtgctcgatgacgcgggggcgtggcggaatctgagccagcttgaaggtcgcgactttctcgacgccgtcgaggtggacgaggacgttgaccagcccgtttcagccgcgacggtgacgctcaagcggcaaatcgaactcttcagcgtggccccgctccgggccgactcgaagctgaatgccgcaaacgggcagctcatccggccggggagagagttcatcgtcgaagctgcggtttcgcccatcggcatgtcgcccagcgagagtgagtggcagacgctgtttcatggcgacatcgacgaagtcgacttcgcaggcgaacagctcgtcttccgtgggcgtgacttgggcggccggctccaggacacgttcattgaagttgagcgcgcctatggtgacgatgcgcagggcgttgccgtggaggtggtgatgcaggccatcctgacggacaacgggacgggcgtgctgctccataccccagtgtccccaggatggaggcttcgtcagtacgcgcagaagaaggcgagtgttctcgatgccgttcgcgacctggctcaacagattggctgggaggcgcgctatcgctggcgcgagtcgagcgggacattcgctttgacgtactccgagcccactcgcacgaatccacccctggcgtgggcctttggtccggacgactaccgcgacgttgcgaagctcgtcgtcagcaggacggacgtccgcaacagggtggaggtcgtcttctcggacgcgggcgacttggacgtcgcggggcacgcgaagacgaagagtgtcgtcgtcgaggatgccgcgagtcaggccgcttacggcgtgcggtacatgcagattgccgaggatgcttcgagcaacatcgaccgcgaagttgaagcgcggaggatggcggaagcggccctgtccgacttgtgcgagccgctcgccgaccaggaaatcgacctcgacttcttcctgccggtggagctgggcgacctctttcggtttcaccccaacggcgttcactactcggacgcgcagaacctggcagtcaccgggttccgccacgtcttcacggcagagggcgacgcacgcacgacgcttacaacgcgcgggaagccctccttcggcgtctccatgtggctggagatggacacgcgtcccggcctgggcgagcccgcgcacacgtccccgccgcttgtcccactcgacatcaacgtgacggccgtggtgaacggcttctcgctgtccctcaccccggcttcgagtggcccagttgcgtcggggtacgagctgcacgtttcgacgtcgagcggctttacgccgagcagctccaccctgcgcgggactttcgacacgacggcattcggtgtggctgacctgatgccgggggcgacctactacgtgcgcgtggtgcccagggatagctacggcaaccggggggacccatcgccccaattcaccgtcacgccgaagcagctcgaaggcgcgtcgctgagcgactccgcagtcggtttccagcacctgctgtacccgcccaccgacaacctcattccgaacggctacaacgaagcgggcattcgcgccgtggggaagtctcccgacggtgacaggcttgtcgaggaccctgtgaatgcccgggttggccgctgggtgcgccgggtggagctggcgaacacgggggcatggccggggctgagctggacgggcgggtatggctcggatgtcccaggcgggcggctcaagtgctcccctggagacgagttcttcgccgaggtttacgtcaaggcgtcctcagcgactgtggggggcatgggaacccttcatttgctgtgggaggacgggagcggcgtctacgcgggccagaatacgggcgtctttctggggcaggtgggaacgacgtaccggcgtgtcaccgtgaaggggacgtgcccagccggttgcacgggggttcagctcttctgggaaacccaggtggcggcggcggacgtgggcaagcggctctacttcgatgccgtctccatgcggaagatggtcaccttcgacttgctcgcggcgaacaccctcaagacgtccaactacgccgaggacggcagcggcatccctacggccggggcgaagctcgacaacgtaggaacgacgctcaaggtggcctcgaacaacgtccaggtggggcgctactacctgagcgacggcttcttccgttccgtgcaagccctcgcggacacgggaagccgcatctactaccgaggcaacaacgagggcgtgccgaacatcgaccggctcaacatccaggtgattgagggttactccattgccggggctgctggtggagcggcgaacttcacctgggcgcactaccatgccgtcatccagccccaggcggtgagcgacaacctggatgcgctgcgcttcctggaggtgggtttctactgggcgtatagcgacagcaacgcgccccagtggctttacgggacgtcggtgccgctggccgaccgcaagtatcagaacggcgcggtcgacggcgacgccagcaacgcgacgagcgcgggcttcaccttcatgtatggcgacaggttcaaccggctgcgggactcgctttcgaacaggatgctttacctgaaggtgcggcttcacaatgcaagcggctacagcgccgagcggtggttcttccctccgagcagctacaacgtcaacatggtgaggagtgcgacagggcccgcgtcaacgcccactggcggcggtggaggtggcgggggctcgcacggaacctgtgtcgcgccgtgggagccggtgttgctcagcgatggttcggaagtgcctgccgagatgctccggcctgggatgaaggtgctcaccatgcacgagcacgagagagacggcggcatcttcgaggtgacgcacgtcagcaggcatcaggcggcgcgttgcacgctcacgatgacggatgggcgcgctgtcgtcgtgacgccggaccatcgctggcggacgttcgagcgcggatggattcgcaccgacgaactgcgccccggagagaccatcgatggtgtcgctccggggcgagtggcgcgcgttgagccttcggcggctggcgacgtgatgaagatctccgttcggttcgcgaagacctacgttgtgcagggactacttgcccataatctgaagccgagagactaaaggagctccaatagaggtgaaatggttggcgattccgagggtgcggttgccgcccctggatttgctcggtccgtagctcaagcgacgcagagcttcctattggtgatacgtctagattgaatcaatttgcggactcttgagtcaattaaatgcatccctgctgaaaatgcgtctgccctggagttggtggtgggtcgcaagtgactcgggttggtcagtttgtctttcgcatgatgctcgtgtatttcgacgccatgggcttggtcgcagcatggcttgttcttgtgggaatccttggagttccgctttggctgtttttgtctggcgttatgcgcggctattacggggaggcccgctggaacgcttcgaatgggctcctgcggcggaggtggtcaatgaagtactcggctgtcgcgctcctgattgcgttagggggaagcctggttgccgaaattgacaagcgccgggaacgtaaggaactggaagctagcgacccatgtcgttatttaagggcagaaatgcagcgtaagcatccgggcctggatgacttagcaatccgccatgttcgcgaaatgatggcgcttgagaagagagagcgtcggcggcagttgtttttggagttgcagtcactgagtgagccggacctgcttgaagatccggacagggcgacagagtatgcgttgcgccaagttgagcgtgagcatgtgatgaatcgtcagaatgcagaggcttggcgtgagctatctgaacggcatgaatgggaatgggcgaaggcatgtgaattggcagagagcgctccaggcagtcggtgaggcgcgagtgatgtgctgagatggatggcgtgctgactttggtgcggcggttaagatttggatgtccagttcggtgtctgtgtgagccctgagagttcgcgctgtttttcagctagtttttggcgaatgcgtttggcgaacgaactgtttcgaattgaaggcacggccagtgctgtatgtgggttgttttctgtgttgtagaattcgattggaaggtgtgcgcttccaaggccggtgaattcaatcttgtttctgtccatgtcctttgtgtgcgagaggacatctgcttgatcgtcttcatcaagccacgcccacccggagtgtagtagcttgatggtttcgcttcctgtgtcaagggcgagtgtgtagaatttgtcttgaacttcgtatgcctttttgcttatgggagatcggtccgtcccaggaggtgccttgtcttgatcttgttgcgcgttcgcgactgtccagagttcgtcggcgcattcgactcgggcgtttgttgtctctagtaagaatgagaggggaccgtagagtttctctatttggtttcttaagtagtcggcacgtcgcgcgcggctcgccagtgagtcctgtaaatcgcgctttgtgtgctctagcatattgttgaagcgcagcgagaaccttccgacaatgattgcagttgcgacggcaggtccgagaatctgtattagaagcttgatccattcgggcattgtttgttttctccggtaggaagggcgacaaggatgaacaatgtagggatggggggaagctaaatgctgcgagcttagcagaacttgtactgtcggggtgtattcctagcccgagccacttccagaatccgcacgcatttaccgggggcaccctttgacccggtggcgctgtgaccgcagaagagactcagtccgtgcagctcgtcgtcggttccctgcttggaacggcgggaatcggtgtccttacctgggccgcgaagtccctggtcggggagattcgcgccctcgttgagaaggtcgcgcggcaggacgagcgcatcaacgcccttgcggtagagctgggggccttgcggcgctggcgcgacgagttcgccgtcggccttcctgtccaggtccggcagacggtggagctggagcttcttcgcaggacccaggccgcgtcgggggattcccgatgacccgggccaacttccatcgcgtcgaccttgaccgtgtcttcctgccattcgtcgccgtgtccctagaggtcatcacgcgctgtgcggctcggggcgtccgctacgtcgcgacccacggcttccgtgacctgccggagcaggcagagctgcgtcggctgtacgtggcgggcaagggcggcaaggcatcgcccgcaggcctgtccgcgcacaactacggcctcgccttcgacttcgtctgtgacgcgagcccgcgacctggcgtgcagccggattggcgcgagtcggcttaccgcgtgctgggtgacgaatccacgaaggcgggactcgtctggggcggcaggttcggcgactccccccatgtgcagtggccgggctacgtgagcgcgcttcagctcacgccgcttcgtaccctggtccagcagagttccctcgccgacgtgtgggctcgcctcgatgccgagcgcctgtcgccgaagtggcgtgcagcaaacccgaagctcgcggccgaactggagcggctgggcttctaacccggaggcaacatggttgacgctggtgtagtcgggccgaaccccgagcagttcgaggagttcgcgcgccttcttctcaatgccgtgacgagcaggaactacgcgctgctcgccgccctggtggtggtggtgctcgtctacctgctgcggaggttcggtggcgggttcgtcccgttcttcaataccgacaggggcggcgccgttctcgtgctgggcgtctccctcgccggagcggtagcgaacgcgcttgctgctggggctccgttctcgttggcgctgatgctgaccgcgctgcaagtcgccctgacggctgctggtggcttcaccatcatcaagcggattctgttcgggagcgccgccatggcccgcgctgagctggcgggggcgcttgccgctgggcaggtcgcggagaaggccgcagcgattgccgtgctggaacagctcgactcccggggcggcaagtgaagctcggcgcgctcgtgctggccgtgctgctcgcgcttcccgcgtcgggctcggaggtcgtcagcgtcgagcgcgctcagctcttcccggatggaggttcggcagccgttgaggtggagggcggctgctggctggcggaaagccgctgcattcgaaccgcttcggagattgcgcggctgcgcgccgagaacgagtcgttacgccagcaggccggggacgtgtccttcacggtcgccgttgtggccctgcttgccgggcttggggccgggttcgccgttgcgaggctcgcgaattgatagtgggcggctacggaatcggcgcggttggtctgggacctcgcgacgccgtgaactacgtacacaccgcagccgcccagccgccttcatacagaagcgacactgaatggtaaagtgggcccgccgaaatgccccacggcccagagggaggggacggcctagcggtcgccgattgtgctcttcggcggtgaccatcggcgcgctgctcgtcgggctgcttcgttagtctgtcctgggcgcggtagaggccggtgatgcagtagaccttcaaggtttccatcgtctcgtaggaccatggagattgtcagactcggctggtatgtggccccttgcttgccgatgtgctggcggctgacccgggggctacatgagagctttaggaattgctgcactgttgctgcttgcgagcgggtgcgcgtcgactcgtgtcgtgcatctgcacactgggggcggagagccaatcgccttcactccagttgagtccgaccctgtcgagataggcaaagacgagttcaagcgtgccgttgcgcagctcgtgctcgacatgcggctcgacgtcgccttcagggaagttgaggaggacggtcgccgctcgttgctcgcatcgtccgagggcttcgttgacggcgcgcaaggcagatcggtcccttcggcatacgagcgcatttgccagcggcaggacgagccccatagctgcctgagcatgctgtccggtgggttctcgctgggcccctctgaacggcgaatgctcgcgctctacttcgcgctcgacacggtgtgggtcggcgtcgaggacgcgattcgggacatggtgaaccctgccgccctgcgggcgatggtcacgacgataatcggaacggcgctcgtgatgctggtcgcgcctgagcccattacgaaggtcatcgcgattgcccttacggcctctctcatcgcctaccttgggaccgggccggtgtggaatctcgggcaggggtttctgcgcttgcttgacgagtcccgggacgcggcgggcttcgcggacctggagcgggctgggcatcgcttcgggaaagtgctgggcgacaacggggcccgtgtcctggtgatcgtcgcgctgtccgcgctgggcgggaagagcgcgatggcggcacagggaccgaagatgccgggctttgcccaggcttcttcccgggcgcagcttgaagggggcttccagctagcgggcgcgctggccggggaggttcaggcaatctcgatttcgtcggccggggtgctgaacgtgacgctcgcaccgacagcggttgccgcggtcgcgatgggcgcaggcgaaggcgctggggctgtggtgggcgctgttggaggcattcagggcgaccccgacggcaaggtgcatcacatctgcactgataagaacaccgtttccgatgtgaccggtggcccctggactcagaggttcgagcgaatctttagacgggctgaaatgaagctgagtgattcagagaaccttgtgaaaatccgagggcataaggggccgcaccctcgagagtatcatgaggcggtttttgaacggctggagttcgcgactcagggatgtcgtgggaccgctagatgccgggctcggttggtggaagagcttgccaagattgctcgggaactcataaaggaagggtcggaactgcgctcccttatcaccaaaggggcccgggaatagagcatggaacggcgctacttcagtctgaaaatggatgtatacgtgaagggcgatcattggagccttgacgatccaatcgacgcgcaggggcggcagcttgatgatctgtggctgttcagggacgggaagcctgttgaacttcacgaaaagctcagagttccaatcgagcgaccaggagagcccctggatattgagttcgcgggaaccgcgttcacgcctgtcgttagtgagcgggtcgcgtctgtttttcgcgagatggctgccgatgacactcagctctttcctgtggagattgaggggcaggtaaggccattttttgttttgaatgtggcgcgggagattcgttgtattgacgatggtgcatgcagggaggttcagttttttactgccgatgaggaattgcatgcagaccgtgccggacagtacaggtccgttatgggcctgcgcatcgacaagtccaaagtgggcaacgtcagggtgttccgtctgtggggctggaacatgccgatcatcgttgacgaagagatcaaggatgccctcgaagcgaacggcatcttcggcggcaagttcgaggaggtctgaaccgccccaccgcagtccctgacctcgccccggcgtcgctcacagttgcgccggggcgagctgctttgcgcgaggggcgttccgttgggcacaaggaggcgcctgactctcccgggagcggggcgcggtagatggtcccactgcgcgcggcttcctggtggtagcttctggcaccgggaggtcatgcgcccttgagccaaccggccagattggtccttactcttgttctcgtgtgggggactgcgacgccagtcgcggcggcgcaagtggagcgcgctgtacgcaagcgctcagtggtcgtcgccactaaccccaccgatgccctccctgtcgtccgggtggcgcgcgacacaccgacggtcctcctgttcccggcccccatcaaccggaagaccctcaccttcgacgagtcgaggattcacgtcctggatgccggtgagcggtcggtcatcgttcagccggtggccgaccttgccgaaggcgagcgctacgaagttggggtcttctttgcggatggcagggcgcccgcgcgagctgctttctcgctggtgacagacccggccgaagtggacattcagatcaatgttcagcgcccagaattggcgggtgcgacatgccccgttgatgagccgcgagcgcccagccccgaagacttcgtgttgctgggacttgttgataaggaaggtgtctcagctacgcccattaaaaggtcccgagatgcaacgcaggggatttcagttgtctctgcgattgcctatcgtggaaacggttgggtgcttgtagatgcagatatacgtaatgaggccggacattcgccgtggacgccaagagtcgccacattgaccggccgcgttggactgcctctaaaggctcggattgtccaagttgattcgggggcaattccagcagggggatacgggagagttctcatagctactgagacatcgcagttgagtgcgagcccagtgtttactctggagattgttggagacgggcgcacactgacgcttcccaatgtgcgtttgccgaaggccgcttctgcgagggctccatgaacgtgatttcgatattcccgcgtgctgggatgtccgttgatggttggcgtgtcatcagggagcttgggaacggtggttttgcagtcgttttcctagttgagaaacacggccgcagaagtgcgctcaaggtggcgcgccaccgagattcaagcggggacgaaaagcaaactcacgcaaggacgctccgggagctagcggcgctccttctcctggaccatccgaacatcgtcaagcatcgtgggtatgggtactccgagcatgggaacgtctatctcgcgcttgaatatattgatggttggacgctagcggagtgggcggaacgaaaacaccccacggtgcgggaggtcttgcaagtcttcgacaagctttgctccgcactgtcatacatgcacagtcgcggcgtcctgcatcgggatttgaagctgtccaacgttctgattcgaaagagcgatggagagccaatcatcatcgactttagttgtgcgaactactcattggccgaagagcttacggatgcgggcttgcccccaggcacggaccgctttcgcgcgcctgagcaattccaatggctccgagagcacaaggcggagcaccgcgcgaagtacgcctttcaagtcgcggacgagattttcgcgattggtgcgatgctctatgagttgctgaccgacccccgcccgaccgagattcaagcgcgcttttcgctcaacagtacagtcgcattgcccccgcccgcgcgtgcgttgaacgtgcgcgtgccggaagcgttgaacgacctcgtcgcgagcgtcctatcgcgggaccctgcaaagcgccccgtcgacaccgaggcactacgtcgcgaactaggcgaactcctggcctattcgagcgcggagtacctgaccccggtgcatccaccgtccgagcagcggcaggaggaaccatctgaacagcgggtgcccccagttgcggacccaagccttcctggggcgcctacgcgttctgtccggggatggcgcgggctcctagggggcctagcggccctcatcgtgctcgtcgtggcagggggcttctggctcagccagggggaacctccgcagccacgagagccgcaggttgctagtgcgccaccggctcctagttccccacattccgcgccgctcacatcggccgcccctgctatgtcaccagttagccccccgcctgtgccatcgacgggcctcgcgactgccgcaccgaaggaaggttcaaccgtgaagacgactccgtcacccgaggtcccaccccaaggccgccagccacgcggtagggcgaaggccaccgctgttgccgactgcgcgacgatgacgctcgttgcggcgctcgcggcgggctgccccggagcccagatgcgtcccgagtcgttcacctgcccggctgatgcggaagaggtaatgcgggaggatcttcgttggagggtgaaccagcgtttcgtgctcaccttaaatgcccggcatggcccggacgatgacgtgtggttcacggctggttcggaagtggtgggagtggttccgaagggcgtcccctcggaccagcgagcggttaccccaccagggacacgcttctacggcaaggcttacttcctatcggaccgaatgggccgctcggaggggcctgcattggtcatccgctatgaccgcgtgaagctgccggggcaggatgaacgtcccatctgcttcgtcgtcgagtctcactctgaggtttacgaagacggtcgggtgaagtcgtacaattcgggagggggttacgtcgttgaccgctggccctgagatcccggacaggacgtaataggtaggaggccgaaattgggccgaccaagccgttttgtcctggtgacctgtgaaggcgttccctcggctggatgcggcaggtagcttcctttgccgcgttggtcgcgagtctgcgcacgaggggaaacggcatgtcgcaagcaatcgagttcaagatcccgccaggggcgattctcttctcggcggatggcgtcggctacgagttccgcgaggacttggggccgacgcaccatgggatgtccctcttcgtggcgcggcttcgaaactcctcgggggagcctcggggaaaggtgctgctgaaggcggtccctgcgccatcggtgaaggagggggggcgggttcggcgggcacgagcaaagcttgatgagcaggttcgtcttgccacctccctcgcgcacccggcaatcctcaaggttcacgggctccacaaggtagagggctactggtacgtcagcgctgagcatccatccgggaactccctgaatgagttgctgacgctcgcggtcgagtgccgtcgatggttctcgcccctcttcgtgatgttcgtaggctcgcaggtggcggcagctcttgagcacgcgcacacggcgaaggatgccagcggacgcccattgaacatcgttcaccgagccatcgacgtcgcgcacatcttcatcgactgggacgggacggttcggctcggcgacttcggtctcgcgctgtccaacttgccggggcgcgtggcttcctctgttcgcggcccgcgaggagactacttctattcgtcgcctgagatgctgcttggcgggcccgtagacgcgcgctcggacctcttcatgttgggggtggtgctgctcgaaatggcgacgggaaagaatctgctcttccacccggacgacatcacgcaaaaggtcatgggctctttgtctgtgaagagtcgtcggcgagtcattcaggccatcaagcgggccacgctggccggggcgtcacccatggtggaggacgcgatttggcgtgccgcgacgctgacggatgcggacgtggacgcgatgacggaggggcttccccaggggcttcgcgtgacgctgaaccggcttcttcgggtctcccctcgcgagcgctaccagtccgccggagagctggccaaagacctagcgggctgggttgggggcaccttcacgaaggctgatgccgctgcggaactcagggcgcgtgcagctcaggcagaagagatgttggatgcgctggggctcacgccgcctcgcggtcgcggcaagcgccacccggatgacgtgacgacgtcctgaccggcagacggggcgggaggggagccgtaacaacgaaatgacaacgagaagcggtcgggggcgaactcgggcggacacttaccgcactgcaacccttcgaaagtacatgcgcccgacggaacaaggggcctttacatcgcatacttgaaccggtggatggcgcgcgccaggggcccctcgtgcgcgaagggcgcccaggcgcgagtgaagggcggcggggtggcgcggcatcgggggcacgtctccccgggaaacgcaccgggctccgcgcaggtgcggcagcacgcgggaggaagccgctccaccgcggtgtcgcacgtctcgcagaagaagccctctgggcccggcagcaccttcgtgcacgcgaggcacgaagggggatagagcacgtccagcagggctttcagcacgggccgtgccccacgcgcatcacggcagcaggccctggcggttcatctccttggactgcggcaatcccatcaccttgcacagggtgggcgcgatgtccgcgaggatgcccgggcgcagcttctgcccgcggaagtccgggtggatgaggtggaagggcaccgggttgagcgtgtgcgcggtgtggggctcgcccgtctccaggtccaccatctgctcgcagttgccgtggtcggcggagatggccagcacccagccgttgcgctcgcacgccttgcccagcgcgcccaggcattcatccaccgccttcaccgccttcatcgccgcgtccagccgcccgctgtggcccaccatgtccgggttggcgaagttcaccagcgcgaagtcgtacttcccggagtcgagccgcttcaccaactcggccgtgacttcgtaggcggacatctccggcttcaagtcgtacgtcttcacgtcgcgcgggctgggcaccaggtgccggtcctcgcccgcgtagacgacctcgcggccgccgttgaagaagaacgtgacgtgcgcgtacttctccgtctccgccgtgcggaactggcgcagcccctggcgtgacagcagctccgggaagatgtcctgcggctggtccggctcgaagagcgccggcagcttgaaggtctcgtcgtactgggtcatgcacacgtagcgccccagccgcagcccgccccggtcgaactccttgaactccgggaacgccagggcctgcgtcagctcccgcgcccggtctgcgcggaagttgaagaagatcaccgcatcgccatcctggatgcggcccaccggcgtgccgtcaccggcggccagcaccgtgggcttcacgaactcgtcggtgaccttctccgcgtaggacgcacggatggcgctcagcgcgtccggcgccttgggcccgcggccgaacaccagcgcctcgtaggcctggtgcacccggtcccagcgcttgtcgcggtccatggcgtagaagcgcccggtcacggtggcgatgcggccggtgtgcgtctcatggaggaagcgctccagctcctccacgtagcccagcgcgctctgcggcggcgtgtcacgcccgtccaggaaggcgtgcacgtagacatgggccacgttgcgttccttcgcggccttgagcagcgcgaacaggtggtccatggaggaatggacgccgccgggcgacaccagccccagcaggtgcagggccttgccgtccgccttcactccgtcgagggccgcgcgaagcacggggttctgcgccagctctccggactccgcggcgcgattgatgcgcaccaggtcctggtagacgattcgcccggcgccgatgttggtgtggcccacctcggagttgcccatctgcccctcgggcaggcccacggccagacccgccgtctgcagctcggtgaaggggtaggggctcgccagcttgtcgaggtgcggcgtgccggccaggacgatggcgttgttgtcacgctcctggcgaataccccaaccatccaggatgcagagcaggaccttgtgcgcgggcgtcatgctccgaaccctaaccatgcaggcgccagacgggagaggacaaaaagcgagcgcgtctattgatactcgcggaaggtcccctggggtacgaaacccagccgggaatagacgccctggccctgcgcggacgcctggagggtggctgtccggtagcccgcctcccgggcatccagcaggggtgccagcgtgagcgccgcgccaatgcctcgtcgccgagcgtgccgcacggtggccaccgagtagaggcccgcgaccccccacgcccggtggcactcactggcggcgaccgcctcgccgtccaggtagcccacgaagaagcggatggggctgtcgggtgcgagcgccacgtgcgccgtcctcgcgtagaagtccagcacgtgtgggtcggcgggctcccagttcgccgcgacgacgcgggcgaagtccgtcagggtgtgttcgtcctctgcgcggcggatgcacagccccgaaggcagcgcgagtcctggcaggcgggagaggtccatggacatgcccaactcctgctcggcgttcaccagaccgtgcgccgacaggcgggcgtccaggtcctcgggcgcggcgtccggtcccacccaccatgcgaagggaaaggccttgtcacggaagtgggagacggcggcggcgatgcgcgcgtccgcttcgtggcgctcgagccgggcccggcacaccacgttgaaggtgttgcagggcaacccggagtcgacgagcagcagcccgggagtgtccttcacgatggcgccggggaggcttcgcgccagataggtcatgtgctccacctgattggcttccatggcggagcgcactcgcggggagtctggttcgaggaaaggctgcatacggggaccctactccggccgggcgcgcgtcttgtacgtgaggacgggcgccagggtggccaccactcggaccagccccgcttccaccaggtccgtcaccacgcggtcgatgggcttgtacgcgggcggcgcctcctcgaagaggaggtccttgttctcacacaccacgtggctcttgaaggcggtgcgggtgagtgattccgccgtgaagcgttcgcgcatccgttcccgggcggccgtgcgtgtccacttgcggcccgcgccgtgcgccaggctgtgcgcgctggcgtggctctccccggttggaatcaccaggtagctcagtgcgccgcggctgccgggaatcaccaccggcccttcgtcggacggcgccgcgcccttgcggtgcagccactgcgtccgtcccgtgtcacgccgaggggtgacactgttgtggcacacgtcgaggactcgctggcccatcgcgccgatgccgtccagcatccgccgcgccaccagggcccgattggcccggccccaggccaccgcgtggtcatggcgcgtgaggtaggtctgcgcctcggatgagtcgtccgcgaggccgcccgccgcgtgccggtccacatgggcccggagaatcgcttcacccaggccgcgcgagccggagtgcaccaggagcagcaagcggtccgcctccaggcccagggcgctgaagaccttcgcgtcatggaccgcgtccacccgctgcaactccgcgaagtggttgccgccgcccaccgtgcccagcgcggcctcgtagcccgaggacttcacgccgtgctcctggaggaagccttccgtgtcacctgtccacgggccttccaggtccaacttgcctgcccaacgctcgggcttggctttacgtgccagcaggtccacgttccacaggcccatgccacagccgatgtcactgccgaccagatagggatagagaaagccttcggaggtgaaggccgcgcccaccggagcacccttgccgggatgcaggtccgggaggcccaccgccagcttcattcctggcaagcgggccatggcttcgagttgccgcaccgcctcgccttccacccaggactgggcggaggcgatgacacgcacgggcgcctgcggcgcggaagtggggagatgttcagaggaggcgtcagtgcgcatgcccgggctgacggcacccgcgcgccacgcctgacggtggcgccgggccccgtgcccggccgcctacttgtggtacggctcgcccttgaggatggtgaacgcgcggtagagctgttcgatgagcaccacgcgcgccagccggtgaggcagcgtcatcttcgacagggacagcgtgaggttcgccgcgtcccgcacgcgcgcgtcgagcccttcgtccccgccaatgatgaacagcaggtccttggcgcccgtctgcgccttgccgacgtagcggctcagctcgacggagtcgagcagtgagccgcgctcgtccagggccaccagccagtcctgcggcttgcgcttggagagaatcgcctcggcttcggcggccttcgcgtcgccgggcttgagccgcttgccgctggcctccgccatctccaccaactcgaagcgggtgtagtggcccaggcgcttggcgtactcctggaccgcgggctcatacaggcccgagcggtccttgccgatggagaggagccggaccttcacctcaggccagcttctcccgagacgcgtcggcccagagtccctcgaggtcgtagtgcgcgcgcaggtcggtgaggaacaggtgcgccaccacctcgccgtagtcgagcagcacccactggcccgtctggaagccctcggtgccgatgggacgcatgggctcgtcacccgtcttgagctgcacctggacgttctccgccatggcgctcacctgacggtcggtctccgcggaggcgatgacgaagtagtccgcgtaggacgtcatcccgcgcacgtcgaggatgacgacgtcctgcgccttcttgtccaccagcaggttgccgatgcggtgcgccagcgccttggcggccgggttctccgcggggcccaccttctggggcggggcaactgggagcttcgccttcttcttcttcgcgggggccttggcggccgccttggcgggggccttcgccgccgacttcttggctgcggggaccttcttcttcgcgggcgtcttgcccgataccgtcttcttccgggccgccggggcccgggtggtggtctttttcgcggtcgtcttcttcttcgtggccatgtgcggtgcaccctaccgcacccttggcaacacggaagcggccctctatctgttggtgtccatgagcgacgcccggctggaacagttcaagaagatggtggtggacttcccggactcccccatgagccatttctcccttgggaagctgtacctggagcggcggcagtaccccgaggccgcccaagccctggagtcggccgtccggctggaccccacctatgcggccgccatggtggccctgggggatgcctgggccggggcgggggagtccgacaaggcgcgcgaggtgctgggccgggcccgggagcacgccctggcccaggggcacccggggctcgccgaggaaatcgacgagcgcatcgccgacctgtcgtaggccgcgccctcagtagcgccaggtgaagccggtgctgaagacctggcgcgtgtaggtgagcgagttgcggggcaaacgggtgctccagatgccccaggccacctccaggtccagcgactccgtcagcggccgggccagcttcaccgacagcgagttctgcccttcgtcctcttccaccaggatgatttccggggagaggtagatgccgtccggatactggatgatgcccagcgagccctgcgccagcagggtcacccgccagggcagccggacgccggcgttggccgacacccggtgccggcgaatcgtctcgccgtagctgttggaggagctctcctggaaggcgtacgtcagccccagggccagcgggccccggtaggtgtacgacgctcccgccgtcagggctgcatcctgacgccggccggcgaggaatcccgagccgccccccgtctccggcgggcgtgcccggggtggggtgccgaagcgccgggagttccagtcaccgaagacggacaggctgtgccgccggtcgaagcggtagcggcccagcacacccacctcggggccgccgaagttggcggtggggtctggccggtacacgaatcgccgggcgcctgcccgcactcgcagcgccagtcgcacgtccggggcgtattccaggaacgcggtggtccccaggtccgagtacgagcgcgagccaccccgccggtcctttcgcat

SEQ ID NO: 1260 - DNA, 35399 bp, Myxococcus xanthus
cggcgctgctgcacgagacgaaattgatggacaaggagagcgccgcggacgcctggcgcgtcatcgcggagcgcgacccggcgagccgtgaagccgcggcgaccctggaccggctctacaccgagagtggccgtcacgccgacctggcctgggcgctggcgctgcgccgcaaccaggaagggcagagcccgcaggggcgtgaagtctccttccgtctggcggaactccagcgcacggtcctggatgacccgaacgcggcgctgggcctctaccggaagatcctggccgaggattcgggccatccaggtgcgcgcgcggcgctcgaggcctgggtgaaggcagcagtgcccgcgagcggcgcggcgctggatgtgctcgacccggtgctggtgcaggtgggcgaccacgcccgccgtgtggcgctgcgtgaagcgcggatgacttccgcgctcaccgtggagaagatcctcctctcgggagaggttcgccgcatctacgagcgcgacatgctccagccctcgctggcgttcatgtccgcggtgaagtccttcgcgcaggggctggaccgggaaggcgtgcagccggacctggagcggctggcgcgcgagacgggctctcacgaggtgctggccgaaatctacgagacggcggcgacggagctgaacgcgggggaccccgcggcgctggagctgctgcggcgctcggcggagctgcgcgagtcgttggaccagcccgaagaggctgcgcggctgtggaagagcctgctggcggacgcgcctcaggaccggcaggcgctggaggccctctcccgtctgtacgagaagggggagaacgccaagagcctgtcggaggtctacacgcgtcaggcgcagctcgccaccgacccggaggagcgcgtggggctgctcctcaaggcgggcgaggcgtacgcgaacgcgggtgaagacgcgaaggccatcgagacgtatcgctccgcgctggcgctccggaaggtgcccgagggcctgctcgcgctggaaaagctctacgcgaagtcccggcgcttcgtggagcaggcggacgtgctggaccagctcgcggatggcgccgcggatgaaggcgcacggcgcaactggctgctgaagcgcgcccagctcctggagaaggaggtggggccggcggagtcgctgccggtgtaccggcgtctgctggagctggcgcctggagacggacaggtggtggcgggcctggagcggctgatggcgcacgaggcgcctcgctccgaagcggcgcgcctgctggagcctgtctaccggggcgtcaacgacacccggaagctggtggacgtgctcgaggtgctgctgccgggcgtggcgcccgagcggcggctggagcacctccaggagatcgccaccctgcgcgaggcgctggggcagacgtcgctcgccttcgtcgcacgcctgcgcgccttcaacgaggcgccgcaggaagccgcggtgcgcgacgaactggagcggctcgcggccgactccggtgcgttcgaggaggtggcggcggcctacgaagaccagctggagctcggcgcgcaggatccgctcgccggtgacttgtggcggcgcctggcgggcatctacgacaaccgcctcaagcgttatgacctggccgtccgtgcgatggaggagatgtcgcgcagggacccgaagaacaagtcggtgttggacgccatcgcccgggtccaccgccgcacgggcgcgcaccgcgagctggcgctcgtcatgcgccgtcaggtggcggccgaggcgaacgcgtcctcgcaggtgaacctgctcttcgagctggcgcacctggccgaggagacgctggcggacaagtcgctggcggcgcagtcgtaccgggaaatcctcggactgcggccggagaacgccaacgcgctgaagctgctggggcgggtgctcgcggagatggagcgctggccggagctggcgcagcacatcgagcgggaaatccagctcgcggacgagcgtggcgcccaggaagaggcgtccgaccttcgagtgcgcttgggccggctgaaggtgtcgcgtctggacgacccgcgcggcgcactggagctgtaccaggccgtgctggagcgccgggcggggcatgccggtgcggtgggcgcgctggaggagatggcgcgctcggagagcccgctgcgtggcgccgcggccagcgcgctggagcccgtcttcgcctcggtgggcaaccacctgaagcaggtggagatgctggagtcccgtgcctcggcggaggccgtgccgcaggagcgcgcagcgctgctgcgccgcatcgcggaaatctacgccggctcgctggagaacgcggagatgggcttcctggccgccacgcgcgcgctgcgcgagctgccagatgatctgcgttcgttggagctgtgcgtcgcgctggtggacaaggccgaggcgcccgaggaactggccgccatcctgacggaggtggtgggcaaggcaggggatgcgtcacgcgccgagctgtaccgcgcgctggcccgcatccagacggacctgggcgagccctccgaggcgctggtgtcgtggaagcgcgtgctggagctgcggcccacggacaccgaagcgctggatggcacggtgcggctggtggcgtcgcagggcaagcctacggagctgctggaggtgctgcgccggcagctcgcggtggcggaggacccggcgcgtcgcgccacggtgctcttccagatgggcacgctgcaggaggagcagctcaatgatgcgctgggcgcgctggccaccttccggcgcctgctggaactcaagccggacgacctgcccacgctggagcgcatggaggcgctctgccagaagcaggagcgttggccggagctggcggacgcactggctcgccgcatcgcgctgatttccgcggaggagggactggaactgaagttccgtctggccatcgtgcgcgagtcgcggctgctggaccgcacaggcgcgctggcgctgtacggcgaggtgctgtccgtgcaggccaaccatgcgggcgcggtgggccgcatggaggcgctggtggcccgcgagccgcagaacctgctcgcggtggagacgttgctgcgtgcccttcgcatcagcggcgacatcacgcgcctggcgcaggtcatcgagacgcgcgtgggcgtgtcgggcgacgcattcgagcgcaaggcgctcctgggcgagctggccacgctgcgggagtcccaggaggagtcggagctggccttcctggccctcttccgcgccttcaaggaagacccgaacgacgccgccgtccgtgctcggttggagaacgcggcagatgcgtccgccagctatgacgagctgctggccgcgtacgaggaggctctgccgcgcgtggccgaggccgcggatgccgcgcaggtctgcctccggttgggacagatgctggagacgaagctgcgcgactcggaccgcgccatctgctactacgagcgtgcgcgcacgctgcaccccacggtgcaggagccgtcgctggtggcgttggacaggctgtacctccaactggaggcctggccggagctggcgggcatcttggaggcactggtcgctggcgtgacggagccctcggaccgggtgggctacttgttccgcctgggccagctctaccaggagcggctggacagcccggaccgcgcggcgggtgcctacgaaggcatcctggcgttggacccggagcacctcgcgtcggcgcggctgttggagggcatctacgagtcggcgggcgcgtcggagaagctctacggcatcctgaagctccaggcggagaaggtgtctggcgccgagcgcgaccgcgtgctggcgaagatggcgcaggtctccgccgaaggactggcggacctgggcgggtccatcgacctgtaccgcgagctgctggcgaagaacgcgcgcaacgagcaggctttctccgcgctggagtctctctacgagcgcgccgaccggccgcaggacctgcgtgagctgctggagggccggctggcggtgacgctggacccccgcgaggtcgtgcggctcaatgagcgcctgggccgcgtcgtgtaccgcctgctgaagcagccggaacaggccgtgccgtacttcaaggccgcgctggaccgggatgcacgtcaccgtggcgtgctcgacacgctgcgcgagctgtacgacgagacgggccagcgtgaagagttggtgggcgtgctgcgccggctgattcctcttcaggagagcagtgacggcgtgaaggcgctgcgtctgcgcctggcggaagtcctggccggcatgggccgccgcgaggagtccctggacgccgcccggcgcgcgctggaagtggagccgcaccaggttcccgagctggaccgcgtgcacgagctcttcgtctcattgcgtgcgtggaacgacgcggtgcgcgcgctggagttgaaggtgcaggtgcacctcctgacggaggagcgtgagcaggctgtcgctgcttacttcgcggtggcggacctgtgggtggggcagggcggcaagcccgagctgtcctcgggcgcgctggagaaggtgctcgagctggaccccgccaaccgcaccgcctacgagcgcgcgtgcgacctgtaccggacgcacaacgactggcgtgcgtacgcccaggtgatggaccgctacatgccccacctcgtcacggacgaggagaagctggccgcgctgcgcgagctggcccgggtgcaggaagcgcggctgggacagaaggacgtggccttcctggcgctgtgccgtgcgctccagttggacgcgtcggacgacacgctgcgcgaggaggtggagcggctggccgacgagacgggcagccacgaggagctggccgccgtctacgaggaggtcgccgacgagctgccgcgtggcgcactggccgagcggctctacgcgacgctggcgcgtgtccacgacacgcacctggatgacccgcaggcggcggaagcggcgttccggaagattctcgagttcgacccgaccaacgccaccgcgctggatgggctcgccgcggtgttccagcggcgtggccgtcagcgtgagtacgtggtggcgctggagcagaagctggaggccgccggctccatcgagcagcgcaagggcatcctccgcgagattgcccgcgtctgggacgagcagttggaggaccccgtcgagtccgccagcgcgctgctgcgtgcgttggagctcgagcccgacgcggagacgctcggcgtgctcaccgcgctgtaccgtcgtcagcggtcgtggccggacgtcgcgtccacgctgcttcgggccagggacctggcggacagcatcgaggagcgcgcgcgcatccaggtggaggtggcgggcgtctacgagcgtgacatcggcgacgacgagtcggcggtggccgcgtaccggcaggcgctggagctggaccccgtcaaccgcgaggcgctggactcgctggagcggctccacacgcggttggaccacccggcggacctgctcgccatctacgagcggatgttggagctgagcgaggactggcgcgagaagattcgcgtcctcttccgcagcgcgaccatctgggaggacaagtaccagaacccggcgaacgcggacgtctgcgtggagagcgtgctcgccatcgatccgcagaacgtccaggccatcaagacgctcatccggctgcgccgggcgcaggcgcggtgggaggacctcatcgcggcgtacgagcggcagctcgcgctggccgtcagcccgcaggagcaggccgagctctacgtggacatcggcaacgtccagtaccagcagctcaaggcgctggaccgcgcggtgaacaactaccacgcggcgctcgcggtggacgctgagtgccgtccggcgttgcacgcgctgggcacgatgtacgagcgcagcggcaactggcccttcgcgctggagatgctgtcgaaggaggcggagctcgccgggcagtcaaaggacgcggtggagctgtactaccgcctgggcaagatcaacgaggacatgctgatggacacgggcagcgcccggaccgcctatcagcaggcgctcgcggtggaccccggccacctgcccagcatccgcgccctcaagggcatccaggagcaggagaaggactggagcggctacgagcagaccctgcgtcaggaggcggagcagaccgaggacccggccgccaagggccgcgcgttgctggacgtcgcgcgctaccacgcggagacgcgcgaggaccgggacaccgccaccggctactggcaggaagcgctgaagcacatcccggacagcctggaggccgcgcgcccgctgtcggacgtgtacatcgcgcatgaggactgggcctccggcgagcggatgctggacatcgtcacgcggaagatggcggagatggcggtggcggacaaggactccgtctccgccgcggacctctgccgtcagctctaccgcctgggctacgtggcggagaagctgggcaagcgtgacaaggcgctgggctgctacgagaaggcctacgagctggacgcgacgtacctgcccgcgctggagggctacggcaacctgctggtgcagacgcgccgctacgaaggcgcgctcaaggtcttccagaccatcctcatccaccaccgcgaggagctgacggacctggaggtggtggaggtgtactggcagctcggcgacatccacgccgcgctgaaccagacggaccgcgcgcagaaccacttcgagaaggcgctggccatcgatccgggccacgagccgacgctgcgcgcgttggtggcgctcctggagaagcagggccagtacgagaagtccgccgagctgcggcagcagttggtgggtgtgctggagggcgaggcccgcgcgaaggtgtgcctggagctgggccgcatcgcgcgtgacgagctgcacgacccgtacatggccattgacgccttcaccaacgcgctcaagtcccagccggacgcgccggaggtgatggaccagctctacgtcctgctgcgcgagacgcgtcagggccagaaggcggcggacgtgctggcgcgcatgttggcgctccccgcgctgggcctggagccgcacaaggccaagcgcgtctggttcgcgctgggcgagctgcgccgcgatgacctgaaggacgtggagggcgccaccgaggccttcaacgccgccctggacctggacccgcgcttcgtggaggccttcagcgcgctggaggcgatgctcggcgcggcgcgccagtggaagcaactggaggagaactacacgaagatgctgggccggctgcccaagacgccggagacgcacgtggcgcgcatggcgctgtggcgcgcgctcggcgacctgtacctccaggtgctgaagcacccggaaggcgcggtggccgcgtacggcgtggccgccaagggcctgcccgaagacgcggcggtgcaggaggccttcgcggacctcgccggacagatgccgggccgggaggacgaggccatcgccgcgctccgccgcgcgctgccgaacacgacggacccgcgcaaggtggtgggcgcgctggtgcgtttgtccgcgctgcgcaagaactacgatggcgcctggctcgccgcgcaggcggtgtccggtctgctgggcgaggcaggggaggacgagcaggagatcctcaccaagttggggccctacgcgaagaacaaggagaaggtggagccgcgtccgctgaacgaccagctgtggcacaaccacctgttccatccgaaggcgcgcggcccgctagcggagctgctgggcctcctcttcgcgaaggtggggcacctgtacgcggtgccgtcccagcagtaccaactggtgcccaagcgccaccgcatcgacgtggccagtgcgcccgagtaccacgtccaccactatcggtacgtggcgcgcgtgctgggcatggaggcggtggagctgtattcgcccttcctcgtggcgacgcgcgagcggatggcgaagcgctccaacgagccggcgcccgagccgctcatcaacgtggagttgctccagacgcacccggcctcgctgcgcgtgggcggcaagtacttcgcggagcagggccagaaggaggtctattacctcctgggccgcaccctggcgctggcgcgctccgagctggccttcagccagcgcgtggcccccgagcggctggaggccatcctccaggcggcgctgagcctcgttgtgggcaacgtgcgcatcgcggaagcgcagcacctggtggagccggagcgtcggctgctggagcggagcctcaacgagccggaccgcgcggtgctggcgaaggcggcgcgtgcctggttgcccaccgcgacgccgcaggcagtgcggcagtacctggagggcgcggagctcaccgcggcgcgggcgggtctgctcgctgcgggagagatggagccggtgcgccgcatggtgcagggcgagacgggctccgccttccgcgtcccggtgcgtaacaagctgcgagaactgttggtgttcgccacctccgaggacctgcacgagctgcgcgtcgccgtgggtacgcacgtggaggtacaggtgcgcaggtagggacagaccccgacgtggggtcgtacgttaaaaggcaggcgggcggacttggctccgaaccttgacccctccgtctgccacttctacgattcaggcgggatttctcccgtcatttccgaggcttacgggaacgatgcgtttcgtctgcgacagctgccgcgcgcagtacatgatcagcgacgacaagattggccccaaaggggtcaaggttcgttgcaagaagtgcggccacaccatcaccgtgcgtcccgctggcgcgacggccgcgaaggactccgcgtctgagtcttcgacctccgaggcttccgcctcgactgacgtgggcaaggggagtgacgcgtccgccgccacgatgccggcgacgctgggcacgccgcccgaaggcggtctcttcaccgacgtggaagaggacgagattggcgccgtcttcgaccaggtgctgagttccggcacgcagaagattcccaccgaggccgcgaacgaagccgccgcgcgcgaagcgtccgcggagaacgtgcgcaagctggccgaagcggaggccgagccggacaaggaagaagccaaggccaacgcggcggcgcacgagtggtacgtggccatcgacgagaagcaggtcggccccttcaacgtcgagaaggtcaaggacctgtgggaccgcggcgaggtgggcccggacagcctctgctggcgctcgggcttcagtgattggattccgttgtcggagacggcggagctggcgtcggtgttggcgccgcggccctccaagcccgtcatcgtcgcgccagagcctgtgtccggctcgacgcccgcggtgtcctcgggccccgtgcagtccgccttcagcgcgggcaagggggcgcgtggtgattccgggcccgcgggcgcttccgaggaggccgtgggctggaagccgtccgcggccagcgtgctggcctcgctggtgaaggaagagaacgacgcgctgtcgaagccgcctccgacgcccgcgcccgcgctgggccgggagccagtgtcgcagtcgcgactgctggacgtgcccatgccgccgccggagccggtgtcctcgccgtctctgcggggcgcggaagtgccgatggcgcaacccatggcctcgcccatgccgtatgggcagcagcccatgcagcagtatccgcagccggcgcccatgccgtatgggcatcagccggggccgcagtatgcgcagcccatgcccgcgccgtacccgccgcagccgagctacccggctccctatccgccgcagggtgggggcaagggcaagacggggctcttcgttggcattgccgcggggctgctcctggtcggaggtggcgccgcggcgctcttcctgaagggcgggtctggcgcggacgcggcacaggcgaatcccccggtcgtcgcggcgacgcccgtggccacgccgtcgccgacacccagcagccctccgcctcctcaggcgaacacggctcccgtggcggccgctcagccacccgtgaattccgcgacggcgcctccgcccccgcccacggaggtcgctgcggcgccggtgaacacgcctccgccggagacgccgcccacggccgtcgcggcggcgcccgtggccacgccgacgccgcctccggttgaaacgccgaagcccgcggagacggcggtggcgaaggccgagcggcccaccaatcgacgcacctcgtcgtcgtcgcgccgggaggactcggagccgcgcgcgtccgcgccggcgcgtgcggagcggccctcgtcgagcgattcggatgatgacttcgacgagctcttcggcacgaagaagtcggcgccggaggcgaagccgtcgtcggcgcgtccgacggcctacgtccctcctgagcctgggggcggggttccggaccggctgcagcagtcggacatcatggcggtggtgctggccaacaagccggccatcatcaagtgcgtcaacgagcagaagaagaaggatccgtcgttgagcggcaagctggtgatgcgctggaccatccagacgagtggcaagacgagcgcggtgtcgtcccgcacggatgagttccgcaccacctacatggcgagctgcatttccgggctcatcaagagctggtccttcccgcgtcacaagcggcagggcgagcccatcgacttcccgttcaccttctgagcggtggggagcgtccactgaggctatcgcgacatgaacgtcgcgatggcctccgctcccgctgtctgcttgcgcgaagggtgaatttcgtggccgagcagccgtccaggtggcgtcgacactcgttgacacgtctggacgggcgggactaagcctcacttgctcgcatggttgttggggcctgtagtcagtggccggaggccccccgggcggcgttccaaacaagaggaaatctcaacatgcagcttcgcaagatgatgttggtgctcactgcgcttggcgcgatgagcggtctcatggctggttgcggtgacgactcaacgtccccgggcgcgtgcaccagcaacgacgagtgcggcgagtcggagatctgtcacccgaccgcccaagtctgcgtgcagacctgtaactctggttcggactgcccctccacggcgaagacctgcgccccgctgggcggcacgtcgaccacgagcatctgccagtgctccacggacgtgctctgcaacggtggcacggactctgagtccacgggcctggtctgctccaacctggacaacgtctgcgtgacggcctgcacgtccgacactgagtgcaccggcgaccggacctgtaatgtcagcaccggccagtgcgaagagggtgacaccgggcccgcgagctgcaccggcgagggcctgtccacctgcgcttacggccagatctgctccagtggcacctgctccgcgccgcccgcgccgacgtgccagaactacaaggacttcccgaacaaggcggacctcggcaccacgggcccgatcatctacaaggtgggcttcgtcaatgcgacgacggacactgcgttctgtcctgctaacctgcccaagcgtctgcgcatccgcatcaacgcgtactccaacacgccgttcccggacacctccacggagctgagccgcttcttctacgtccagacggacggtggtcgtctcaacgcgtccatcagccgctcggagggcaactacattgtcactggcgccaaccgcagcaacgcggagatcatcgtcaacctctgcgtcgccgcgactagcaccaccaactcggctggcttctacttcagcgacggcaacttcgtctgccatcagtcgaactaccagtaatcgattgagcaggtgagtcatcgagccccgctccggttgtaggggcggggctcgctcattccgacgagaggtacgctgaatttcggccgggcctatgcgtcccattcatgccgcggaaatcccggcgtcttgaaaaggagaatcgatgctgtctaccaagctgatgcgaacgctgaccctcggtctgaccctggttgctccggcggcaatggctgaaggcgcttcggagcggctgaactgcgcggagggcacggttcagctcggttccaaggaggagggcttgtcgtgtgtgaagtccggcacgaaggcaggcgcccgcacctcacacggtgcgtacgttgagtaccatccgaatggcgtgaaggcggcacaggggcagttcgagaacggtctcaaggttggcacctggaccttctacgatgcgtcaggcaacaagcgcggcactgcggagttcaaggatggcggctggcatggccagcgcgtcatgtacttccccagcggcaagccccagagaatcgaggagtacaagaacggccgtaaaaatggcgtggtcaaggatctcgctgaagacggccgggtattgagccaagtccggtacgaaaacaaccgcgaggttgctgcccagtagctggttggccgtttggtcgtaatgagggtcctctcccgatgggggagggccctcgttcgtttgagaagacttccccatccgagtgggctcggctaggaagctcaagtgtgaaggtgccttcgcttatacctgttttgccggacatccccatctgcacggtgggtcggatggggctgcgtgaactggagcgtatccggttgattctccgcggagggtcggtaatcgactggcggcgaatgcacttccagtcccgtggggaggtggacaacttcctcaggttgctccagttggatgtgtctcgtccctacgatgatgagtgggcacgtgccgttttggctgaagctgttgagtaccttcggaagacgttcaactaccgcgtcgcagatgcggtggcgaggccagaggaaatccatgacttgttcctctacgcgtctggtgtcaagggggcgccccgtcaccgacggattgcgtgtgtcgttctgaaggtgatgcacgtcattcagcacattgaagggcgagacctgctcttccggctacctgtgtcagaggcggagttggcagaactcatcatggagcgggtgatgggagttgccgccgagatgcagtccaaagggctgcccattgcggagttcgcgcactccatcaagacccaggactcgcttgtcaccaagttgctggcgaagaaggagaccgttgccgcccaagtctacgacaggacccggttccgggtggtgaccaagaggcgggaggacttgctgccggttctctactacctctcccagcgcctcttcccctttcacttggttgtcccggggcaaactgaaaacacgctgatgccgttcaaggctgtgctcgctgagaaccctcacttcgagcagtacatcccacgactccatctggatcgtgactacgaagatcgagagaacactggggggaacactttttcgggcaatacctaccgcgcgctcaacttcgtggtagacctccccatgcgaatggatgcctatctgcccactccggaagaagacacccggcagcgaaaggggagaatcatcatctcgcttgtcgaattccagattgtcgatgaagaaaccgcgcgacttaatgagcgtggagacaatgcgcacgaggcctacaaacggcgccagaaacagcgagtgttgaagcgtctgagccagggactcgttgtgcccaagcgacaagaataagagttcctccaggaactgggaggcgaaccgagcgccaatggttcgcctcgcgatctatgtcaaggatactcgtaaatgacttcaagatcggccagcgtaggatgtgtagttgggcttgaacgcagttcgtcagtgtctctgtcgttatctgtttccgaggtgaaccggatgcggaactgggacctgtagtttgcttcgtcccggcgtgaccagttcgtggtcacgtacgacgttacgtcgaactgccctggggttcccgtgtctgcctcggcgatggtgaagcccggggcaagggggcgggcggtgtaggctgcggtgagtactgggttctcggtctcttctgcatgcgattgggggagcgattcacccacgtctacgggttccaacaggaggggcccaagcttttcgaagggattgcccagtcgaagtgacaaccaccacctgacggtcgctcgattgattcggatggtgtccaaaggcaatgtgtcgagcttgaatgcaaggaacagccgactgccctgttgggcaccattatcgccgatgcgctcaagttcgtacgtgttgtaggaccggtagtggcgtacggatgaccctgctgtgatggttccgcttgccgagtagatgagtggcatggtcatcgtagcctggcggacgatgcggaattcctgtttggcgagatcctgtaacgcattcccatttttgtccttggcaaaggtggagatctgccaagcaatggtggcgccatatgcagcgcttgcaggtgacgtgtaggtcatcaccgtctctgcctcgttccacgagaagctccctgagttgagtcccgcaggcgaggtgatggcgaacgccgcctggacggaattcttgtccatgggttctgaaaagagaacctcgatgactgtgtctcgagctacgccgatggcggcctgtcccggcgtcgtgttgaggagggtaggcgcagtggtgtcgggggctgggcccgtcgtcgtgaatgtgaacgagcgcgttcctgtcaatgattggccagcgccgttctctgcattcacggtgactgtataggtcgtgttctcagccaatgctgccgctggatgcacgatggccgttgctccctgatgggcccattcggtgcgggccagcgtcacttggggttgaatcgtcacgttcagcgagtcctcttcgatgggactcgaaaacgtcaggacgaattgggtgtcgatggggacttgcgtcgacccacctgctggcagggtattgagcaaggtcagcgttcgcggctcctcggagcctgcgtcgggctgtgtgccggcatccgcttcgggcccgttcgggagcggttcaacctccggaacgttgatgcaggccgtcgctgtggagaagacgaacaacagggaaaagaagcgtcgtcggtagtgcatgctgttgctcatcgcaagaactgttccgggcatggtcgctcggaatgctggccgagatgtgcggcggccacgtctcttctgcctcttcctacgagacgagggcaagccaccgcaggcgtccacgctgaccgtggaccagttgagacgggcgtctcaccttctggacagctccctctaaaaacacgaacgcccgccctcccagcacggatgcggggaggcgggcgtgggcaccggggccgcgagcggcctacttcttcttccggttcttcttcttgttctccttctcccgcttgcggcgctccttgatggcgtcgcggtcctcgctcttgcctgcggcggagggcggcgcgtagcccatcaaccgggccttggccatggcggcctggcccatgggcggcgtgtagccgggtgcaatctgcggcagctgcatgggcatgcccatgccgggcatgccgccgctcatcatcttctccatcatcttcgggtcgccgccgaacatgctggagaggtccatgttcttcatctgcgacagctgacccagctgcttgaagccggggatgcggcccaagaggcccggattctggccgatggtgcccattacctgctgcatcattccgaacttctggagcagctccttgacctcttcgaccttgcggccgctgcccttggcgatgcggttgatgcggctgttgttgacggtatctggccgcaggcgctccttcgccgtcatcgagtcgtacatcgactcgatcttcgtgagttccttctcgtccggattgaggtgctcggtgaggtcgccgaagagggggaacttctccagcaggtccttgagcggtcccatcttccggaccatgcggatctgctcgacgaagtccttcatcgtgaactggccggacaggagcttcttggcatcctcctcggccttcttctcgtcgacgaccttctcgaagtccttcatcaggccgacgatgtcgccgaacccgaggatgcggcccgcgaggccggctgggcggaactcctccagcttgtccatggactcgcccatgccgaggaacttgatgggcttgcccgtgacttccttgatggacagcgcggcgccgccgcgggcgtcaccgtccagcttggtgaggatgaatccgtcccgcgtcagccgccggtcgaactcccccgccgtgcgcacggcgtcctgaccaatcatcgcgtcgcacaccagcaggatgttgtccggctggacgttgcccttgatggactccagttcggccatcagggactcgccgatggcgagccgggcggcggtgtcgatgagcaccacgtcgcacttctgctcgcgcgcggcggggtagccccgcttggcgagctcgggcggctggatgccgggctcgtggtagacggggaccttgagccgctcgcccaggaccttgagttgatccacggcggcggggcggtagatgtcggctgcgacgagcaggggcttgcgcccttcctggaggagccggctggcgagctttccggtcgtggtcgtcttaccggagccctggaggcccaccatcatgatgccggacagctggcccttgggcttcagcttcaagctggtgtcgacgggccccatgagggcctccagctcgtcgtggcagatcttgatgaagtggtccatcgggctgaccttgcgcttctggccagccgtgtcggtgatggtcgtctgcaccaactcgcccacggacttctcgcggacgcgggcgacaaacttcttcacgacgtcgaaggcgacgtcagcctcgagcagggagacgcggatgtcgcgcagcgactcgtcgaccagctccggggtgagctcgctcttgccggcgaggcggttcttggcggcgcggaagcccttggttacggtctcgagcatggggggcgctttataacagggtcaggcgagatgcgacggtggagcacacccggccgtcgaactgtgaagagaagggggcccgaaaccggcctccctggcggcgaatccgacccggggccctggattcttcaacgctcttgaggggttggcgcatccctgggcaccccggcgcgggccacgaggcatcgccgggcgcgaaatgaggcgctcaggcctgcctggagccccagcggagaaggaagagcgcctgaggctgcacgaggcctttgccggaggtaggacaggccctgtagggtgctgcccgcagcaaggcacgagtggcggaactggcagacgcagcggacttaaaatccgctggcccgtaagggccgtccgggttcgatccccggctcgtgcattgaactgttcagtgattacgtgcggttaggagcggcctccttccatgttgcacgtatgtcgcacggcagagcgagaggccggtccaaaacggcgactgcctctctccgagtgtcggggctcaggtgggcgtagcgattcgtcatctcgatggtcgcgtgccctatcagctcctgaatcaccttcagcgggatacccctcatcgcgagatggctgccgtaggtatggcgcaggtcgtgccagccgatttgccccacttcgcgggtgatgcccgccgcccggagggcgcgacccagcggtgccgccatcttgcccttggtgagtggctgcccgtcctcctgacagaagacgaaccgcccccgacggtgccggtgggcgttgagcgcatcaaccacggaggcgggcaagtcgaccgtccgttcacgcccacccttcggcaaaccctctatcccgcgccaaatggtcctgcgaacgtgaagcaggccccgcgtcagggtcaggtcgtgccaccggagcccgatcagctccccctgccgaagccccgtcttgatggcgacgcgcagcaacgtgcgccattcgggctcagcgacggcgagaagctgatccgcttcctcaaagctcaggaagtcgaagggaggcttcggtagcttcccaaagggctttacgcgcggcgcctgccggatgaccccatgctcttctgcgagcgtcaggagcttgtgaagcacggtcagcacgttgttgatggtcttcaggctcaggggcttgggctcgctacgctgccgcttccggatggctcgctttgacgcggagtccttccgcttgtgagctgccgacttcttcttgcgcatgtgcgccttgaagtcttcgatttcggccaagccgatgttcgcgagcgccaccttcccgaagaatgggaggatatgatctctgagaatctgtcgtttgctgtcgacgcttgagtgcttgttgtgaagttgccccggtttcgtggagttccacccgctgtgcgaaaagggtcccacgatgccgaagtcacgtcccccatacccgccggagttccgtgagcgggtcgtcgagctgttgaaagccggccgctccggaaaaagcctcgcacgagagttcggctgcaccgagcagagcatccgcaactggaagaagcagttggagggtcgtggcagtagcgctcccagcagcaacggcgagagcaggccagctccgagggcgagcagggccgcctcggacgagcgcgccgaactcgagcggctgcggcgcgaggtgcgggtgctgcgtgaggagcgtgacatcctaaaaaagctgcggcctggttcgcgcaggaatccgtggcgacgcccaagcggcgtaccgactcgtgaaggcgaaccaggccgtccacagcatcacgacgctctgccgtgtcctggaggtgtccgagagcggctaccacgcatggcggacgcgccttccctcgaagcgcgcggtcgcggacgcgggcctcagcaagcgcattcgcgccatccacgcgatgagcgacggcacctacggcgtgccgcgcatccacgccgaactcgcggcagagggcgtgcacatcggccgcaagcgtgtcgcccgtctcatgcgggcagcgcaccttgagggcgtcagtcgccgcaggtggtgcgtcaccacgacgcgcgacgagcgcgcacgccctgcgcccgacctggtcgaccggaaattcgtagcccctggacccgaccacctctgggtggctgacatcacgtacattccgacgcacgccggtttcctctacctcgccgtcgtgcttgacgcatggagccgtaaagtcgtcggctgggccatggctggccacctcaagacggagctcgtcgtgcaggcactcgacatggctgtggggcagcgtcagccccaaagcgtcgtgcaccacagcgaccaagggacgcagtacacctcgattggcttcgggcttcggtgcaaggaagctggcgtgcgcccatccatgggcagcgtcggcgacgcgtacgacaacgcgatgtgtgaaagcttcttcgccacgctcgagtgcgaactgctcgcacgccgccgcttcacgtctcacgccgaggcgcggatggccgtcttccgcttcatcgagggctggtacaatccgctccggcgccactccgcgctcgactacgagtcacccgctggttacgagaagaagcaccgcgctgccgcttgagggcgaaagcgcggaacgctctgcggaaccggagcaacttcagttgttgttctcgctgtaggtgaggagccgcggggtgaagtccgcaagcgtgatggggctttcctcgccgcactgctcctttccgaatgtcccgttgagcaaggcgctgcgcagctcgcgttcgtattgctcagcaccccgacgggtctggacgggcgagaacttcacgactcgctgtttccgtccgtccgcatgctgaaacacgaagtccacttgccacgcctcctcagactttccttccttcgtcgtccacttccgcaacctggcgctcatcgtcgactccaaagcgcagaatcgcggcccttcccggcgggggactctaccagcgcggcatgccggattcgcagcgctttcccgatgcggacgactcccggcacaattgatggcgttgctcccgggcgagtggcgcgcgtcgagccaagggacttcggcgacgtgatgaaggtcaccgttcgcttcgcgatgacctatgttgtgcgcgggttgctggctcataacctcaagccacgtaactgaaaatgcatagcaaggagagggatgatgtctgggaacgattgtagggacttcttttgcctgatgaagcccaacagccgtgaggctgctgggcttcatttgcctaagtggctccatatcctctttgcatgctccctttactggagccacggaccctcggcgtcatatcaaccgctcaccacgacccgttgttgtacaaagaatgccgtagtgtcccgtcagtggcggtgtagacgacatccacaaggccaccgggcctgctcgccgcatctggtgcatgggccaactcaccgccgagccactgccagccggtccagctagcaccagtccaactgttgagccacaagctgttgtccgcggtccgggcgaacacatccagccggttcgcgcctcgcgaagccaccgcaggagacgagatgaattgacctcccagagaagcccagttggtccacgcggttcccgtccaagccttctgaatgatagagttgtcgtccgccgatcgggcgaacacgtcgatgcggccagaaccccagctcactgctgccgggtcgcctgccaggttgccgccaagcgagccccacgcgctccacgcgcttcctgtccaatatgcttggtacaactggttgtccgtaccccggatgaaaacgtccatccggctcgcgccccacgaggcagcagcgggtccagaggctgcgttgcctcccatagaagcccagttggtccaagcagttccagtccaggttttctgataaatggtgttgtcccctccccggacaaacacgtccatggtgctagaggttcgcctcactgccgccgggtccgaagtcagggttccgccgagcgtgtcccatgggccccatgcgtttccggtccaatacttttgccacagctggttgtccgtgccacgggcgaatatgtcgatccggcctgtgccttgagtgattatcgccggcccggaggtgaaattaccgcctagcgactcccagtatactccgtacgtctgctgcgctcccagttggtccgtggcgctgaggttgccgttcccgttgtactgcggattgcagtagttcatcaccgaggccagatcccacgccccaatggtcaagtcaccattggccccctgccggggctcagtacaagtgcctggagtgtccggacggttttgctcatgggcataacccattgcgtggccgaactcatgcacggcgatggtttcgatgcagtactggagcgtgttgcggcagctcgggccccagttgttgaacgtgaagttcagcaccattccctgggctcttccattgagcgcgttgcccagcgccttcacatgcgggccttcgtcgctgatgttgatgcggatgcccgaggcccccgctgtgcaggttccccagccggagaagcggataccggaacgggtctcccacgtacgagccacagcgtcgcgtacccactgccgctgcgtgccatcatttggccctggattctcccagcatacaggcactgtcattggtcgccacagtcgtgcggaggctacatagagttcggcctcgctgtttcgcatttcctctgcgggcaacattccggggtcagcaatttctgagccgttgccacagccgatcagcgttcctaatcccaatgcagcgagcagcaccgccttctggcggcatgcaatttcaatcaacatgttgtctgtctccatgcttcattgccaggccgggccgacttggtccgtttattctgacaaggaagtggagtggctcttttgcacagttaattgtcagactgctagtgaattgtgcgtggcatggctgttctggctggagtgaaggtttctttgcttgatgtggcacgcacgggagtcacggacctttggaggacagaggatgtagttaagcaatgaaccaccagaagtcttgcccgcacgggccattcccagaagtcgcacgcatttgccgggagcaccctttgacccggtggcgctgtgaccgcagaagagactcaatccgtgcagcttgtagtcggctccctgcttggaacggccggcgtcggcgtcctcgcctgggccgcgaagtccctcgtcggggagattcgcgcactcgttgagaaggtcgcgcggcaggacgagcgcatcaatgccgtggcggtggagctgggcgcgctgcgtcggtggcgcgacgagttcgccgtcggccttcccgcccaggtccggcagaccgtggagctggagcttctccgcatgtcccagtcgggcgggcggggctcgtgatgacccatgcgaacttcgagcgggtcgaccttgacctcgtctatccgtcgttcgtcgtggtggccctggaggtcatcgcgcgctgtgcggcccggggcgttcgctacgtcgcgacgcatggcttccgtgacctgacggaacaggccgagctgcgtcggttgtacttggcggggaagggcggcaaggcggcgcccgctggcttgtccgcgcacaactacggcctcgccttcgactttgtctgtgacgcgagcccgcaacctggcgttcagccggattggtgcgagtcggcttacctcgtgctgggggaggaatcggcgaaggcggggctcgtctggggcggcaggttcggcgactccccccatgtgcagtggccgggctacgtgagcgcgcttcagctcacgccgcttcgcaccctggtccaacagagttccctcgccggcgtgtgggctcgcctcaatgccgagcgcctgtcgccgaagtggcgtgcagcaaacccgaagctcgcggccgaactggagcggctgggcttctaacccggaggcaacatggttgacgttggtgtagtcgggccgaaccccgagcagttcgaggagttcgcgcgccttcttctcgatgccgtgacgagccggaactacgcgctgctcgccgccctggtggtggtggtgctcgtctacctgctgcggaagttcggtggcgggttcattccgttcttcaataccgacaggggcggcgcggtcctcgtgctgggagtctccctcgctggagcggtagcgaacgcgcttgctgctggggcgccgttctcgttggcgctgatgctgacggcgctgcaagtcgccctgacggccgctggtggcttcaccatcatcaagcggattctattcgggagcgccgccattgcccgcgccgaactggcgggcgcgattgccgctgggcaggtcgcggagaaagccgcagcgattgctgtgctggagcagctcgactcccggggagacaagtgatgctcggcgcgctcgtgctggttgtgctgctcgcgcttcccgcgtcgggctcggaggttgtcagcgtcgagcgcgctcagctcttccccgatggaggcgcggtagccgtagaggttgagggcggctgctggctgtcggagcgccgctgcattcgaaccgcgtcggagattgagcggctgcgcgccgagaacgaatcgttacgccagcaggtgggggacgtgtccttttcggtcgccgtcgtggccctgcttgccgggcttggggccgggttcgccgttgcgaggctcgcgaactgatagcgggcggctgtggaatcggcgcggtcggtctgggaccttgcgacgccgtgaactacgtactcaccgcagccgcttggccgccttcatacagaagcgacagtgaatggtaaagtgggtccgccgaagtgcccggggcccgtagggaggggacggcctggcagtcgccggttgcgctcttcggcggtgctcatcggcgcgctgctcgccgggctatcatgctgcccagtcctggacggcgtagatgccggtgatgcagtagaccttcaaggtttccatggtctcgtaggaccatagagattgtcagacttggctggtatgtggcctctcgcttgccgatgtgctggcggctgacccgggggctacatgagagctttaggaattgctgcactattgctgcttgcgagcgggtgcgcgtcgactcgtgtcgtgcatctgaacactgggctcggagagccaatcgccttcactccagttgagtccgaccctgtcgagataggcaaagacgagttcaagcgtgctgtcgcgcagctcgtgctcgacttgaggctcgacgtcgccttcagggaggttgaagaggacggtcgccgctcgttgctcgcatcatctgaggggctcgttgacggcgcgcaaggcaggtcggtcccttcggcatacgagcgcatttgccagcggcaggacgagccccatagctgtctgagcatgctttccggtgggttttcgctggggccctcagagcggcggatgctcgcgctctacttcgcgctcgatacggtgtggtccggcgtcgaggacgcgattcgcgacatggtgaaccccgccgccctgcgagcgatggtgacaagcatgattggggtggcgctcgtgatgttggtcgcgcctgagccgattacgaaggtcatcgcgattgccctgacggcatcgctgattgcctaccttgggacggggccggtgtggaatctcgggcaggggtttctgcgcttgctcgacgagtcccgggacgcagcgggttttgcggacttggagagggccgggcatcgctttgggaaggtgctgggggacaacggggcccgcgtcctggtgatcgtcgcgctgtccgcgctgggggggaagagtgcgatggcgtcacagggaccgaagatgccgggcttcgctcaggcggcttcccgagcccaactggagggcggattccagctatcgggcgcactggccggagaggttcaggcaatctctctttcatcggctggggtgctgaacgtgacgctcgcaccgacagcagtcgccgcagtcgcgatgggcgcaggtgagggcactggggttgcggtgggcgctgttagggggattcagggtgatcccgagggcgagattcaccatatctgcactaacaaaaatgacaaatctgacaggacaggtggtccgtggacgccacgcttcagggagattttcgacaaggcgggcatgagtctgaacgatccagcgaacctaattcgtatcaagggacatcaaggctcccaccctcgtgagtaccatgagatcgtgcatggacgtctcctggaggtcgtgcaggggtgccgaggagtggcgatgtgccggagggccttggaaagagagcttgcggctatcgcacgagagcttgtaagagacgggtcgaagttgcgcggtctcttgaggaaaggttcaggagaatagagaatgaaacggcgcttttttaatctcaagatggatgtctatgtaaagggacgttggtatctggcggacccaaccgagccggacggtcgtgagatagaggatttctggcggttcaggcaggggaagcctgtcgaggtaggcaggagacttcgggttccgatctctcggcctggagagtcgcttgatatcgagttcgcaggggcgggtgcgacccccattctaagtgaacgtgcggcatctgtgtttaggcgcttggcgcctggagatattcagctcttccccgtggatgtggagggcgattcgaggccctattttctgcttaatgtcgcacgtcagatttgctgcattgacgaggcggcgtccgaagaggttcaggtccgtactgcggaggagtttgaggaccgcgttggcgaataccggtctgtgatcggtttgaggattgataagtcaaaagttggggatgcgcgagtgtttcgcacctgggggtggagcctgcccatcatcgtcgacgaggagatcaaagatgccctcgaagcgaacggtatctttggcggcaagttcgacgaggtctgaatcacctcaacgcagtccctgaattcgcccccggctatgaaagacctgggagtatgactcatggaacgacgattcttcggcctcgacttcgatgtgtgtgtgccggggcgttggtatctctccgaacccaccagtccagcggggcagacggttccaaatatctgggcgttcgtcgaaggaaggccagtggccccccctgagttgctgcgagtcccattgtcccgaccgggaaggccgctcgacttcgacaagacgaccgttggaggaacgccgattgttggcgcgcgtgtggcctacgtgttccgtgagatggcgcccgatgacgttcagctattccccgtcgtggttgaggggcaacgcgagccgtaatacctgctgaacgtagctcgcaccgttcgctgtatcgacgacgcggcatgtgaagaggttcagctcttcacggaagaggacggagagccggaacgacttggcgaataccgttccgtttcggggctgcggatcgataaggcgaaggtccgcgacgcccgcgtcttccggctctggggctatcacatccccatcatcgtcgacgaagagatcaaggctgctctcgaagcgaacggcattgtcgggggcaagttcgaagaggtctgaacgaccccatcgcagcctttggactcgccccggcgctaccttgaacgacgctggggcgagctgctcttaaggggggccattggaagaggactgctgcccgtggcaggtagaggcttcgctagatggtcccactgcgcgcggcttcctggtggtagcttctggcactgggaggtcatgcgcctttgagccaaccggtcagattggcccttgcgctcgttctcgcgtggggagctgcgacgccagccatggcggcacaagcggaacgcgcgaagcgggaccgagcggtgtccgttgcaaacggccctgccgattcacttcctgtcgtccgggttgcgcacggcacgccgacgctcttcctgttcccggctcccatcaaccgtaagacccttaccttcgacgagtcgcggattcgcgttctagacgccggggagcggtcggtcatcgttcagccggtggtcgacttttccgaaggcgagcgctacgaagttggagtcttcttcgcggatggtcgggcgcccgcgcgtgctgctttctcgctggtcacagacccggccgaagtggacattcaaatcaacgttcagcgcccgcagttggcgggtgccgcatgccccgttgatgatccgcgagcaccccagcccgaagacttcgtgttgctgggacttgtcgataaggaaggtgtctcggctacgcccgtcaaggattataacgacgcagggcgaggctttttcgtgcagtcagcgatagcctatcgggggaagggatgggcgctgatagatgcgagagtgattaactttgctgggcagttgccatggcttccaagggtggccatgttgacgggccgagttgggttgccgctccgcgcccggattgtgatggtagatacgacagcgatccagccaggagaggaacgacaggtgttggtggtggctgacctgccgcaattgcctgctagcccggtttttactttggagttggttggggatgggcgcacgctcaagattcccaatgtgcgctttctgaagacggcctctggggcaaccccatgaaggtgatttcgctatttccgcgtgccgggatgttcgttgatggctggcgcgtcattaaagagattgggaatggtggttttgccgtcgttttcctcgttgagaagaacggccgcaggagcgcgctcaagctggctcgtcaccgggattcaagcggggacgacaagcaaactcatgcaaggacgctccgggagctttcggcacttttactcctgggccatccgaacatcgtcaagcatcgcgggtatgggtactccgagcatgggaatgtctatctcgcgcttgagtacattgatggttggacgctagcggagtgggcggagcggaaacacccaacggtgcgggaggtcttgcaggttttcgacaagctctgctctgcactgtcatacatgcacagtcgcggcgtcctgcatcgggatttgaagctatccaacgttctgattcgaaagagcgatggagagccaatcatcatcgactttagctgtgcgaactactcattggccgaagagcttacggatgctggcttgcccccgggcacggaccgttttcgcgcgcctgagcaattcaaatggctccgggagcacaaggcagagcaccgcgcgaagtacgcatttcgtgtcgcggacgagatcttcgcggtcggagcgatgctctatgagctgctgacagacccccgcccgaccgagattcaagcgcgcttttcgctcaacagtacggtcatattgcccccacccgcgcgtgcgttgaacggacgcgtgccggaagcgttaaatgacctcgtggcgagcatcctgtcgcgggagcctgcaaagcgccccgtcgataccgaggcgctacgtcgcgaactgggcgaactcctggcctattcgagcgcggagtacctgtccccggtgcatccaccatctgagcagaggcaggggggaacatcggaacagcagacgcccgcagttgcgaactcaagccttcctggggggcctacgcataccgtccggggatggcgcgggctcgtggggggcctcgctgccctcatcgcgcttgtcatggccgggagcttctggctcagccggggggaaccgccgcagccacgagagccgcaggttgccagtgcgccacctcctcccagttccccacattccgcgccgctcgtatcggccgcccctgctatgtcaccacctagccctccgcctgtgctgctgacgggccctgagactgccgctccgaaggaaggttcaaccgtgaagacgactccgtcacccaaggccccgacccaaggacgcccgtcgggcgggaggacgaaggccaccgctgttgccgactgcgcgacgatgacgctcgtcgcggcgctcgcggcaggctgccccggggctcagattcggcccgagtcgttcacctgcccgtctggtgcggaagagacgatgcgggaagaccttcgctgggagattaacgagccattccgcctcactctcgatagtcgccagggcccattcgaacaagtttggttcaccgcaggggctgacgtggtgggggttgttcccaagggagttgaacgacggcaacgagcagtcgcgccgcccgggacaatcttctacgggaaggcgtatttcctctctgaccgcatggggcgctcggaggggcctgcgctagtcatccgctacgaccgtgtgaagctgccgggacaggacgaacgccccgtctgcttcgtggtcgagaagcctgccgatggctacgaagacggccgagtgaaggcgttcaacaccggaggcggttacgtcgtggaccgctggccatgagagccccgaaaggacgtagcaggtaggaggccgaaattgggccgaccaagccgttttgtcctcatgacctgtgaaggcgttccctcggctggatgcggcaggtagcttctttcgccgcgttggtcgcgagtctgcgcacgaggggaaacggcatgtcgaaagcaatcgagttcaagatcccgccaggggcgattctcttctcggcggatggcgtcggctacgagttccgcgaggacttggggccgacgaaccatgggatgtccctcttcgtggctcggctgcgaaccgcgtcgggggagcctcgtggaaaggtgctgctcaaggcggttcctgcgccatcggagaaggaaggggggcgggttcggcgggcgcgagcaaagctggatgagcaggttcgtcttgccgcctctctttctcatcccgcgatcctcaaggtccatgggctccataaggttgagggctactggtacgtcagcgccgagcatccatccgggaattcgctgaacgaactgctgacgcttgttgtcgagtgccgtcgatggttctcgcccctcttcgtgatgttcgtaggctcgcaggtggcggcagctctagagcacgcgcacacggcgaaggatgccagcgggcgccccttgaacatcgttcaccgagctatcgatgtcgcgcacatctttatcgactgggacgggacggttcggctcggcgacttcggtctcgcgctgtccaacttgccggggcgcgtggcttcctcggttcgcagcccgcgaggggactacttctattcgtcgcctgagatgctgcttggcgggcccgttgacgcgcgctcggacctcttcatgttgggggtggtgctgctcgaaatggcgacggggaagaatctgctcttctgcccggatgccatcacgcccgaggtcatgggctcgttgtccgtgaagcggcgtcggcgagtcgttcaggcaatcaagcgggccacgctggccggggcgtcatccatggtagaggacgcgatttggcgtgccgcgacgctggcggatgctgacgtggacgcgatgacggaggggcttccccaggggcttcgcgtaacgctgaaccggcttcttcgggtctccccccgcgagcgctaccagtctgccggtgagctggccgcagacctggctgcctggattgggggcaccttcacgaagactgatgccgctgcggaactcagggcacgtgcagctcaggcagaagaggcgctggatgcgatggggctcacgccgcctcgcggtcgcggcaagcgcaagtcggatgatgtgacgacggcgtgaccgactgggggcggcatttgggccgtttccatgttgcacgtatgtcgcatgaggctgcggaatcggccggtacagggtgggacagcagggcacgagacgggaagtcgaagctgagtcattccgggtggttgcgaagtaagggcgcgattctgctgggagtttcgcaacgcccggcgcgagttcgatccccggctcgtgcatggactccgggcggctcccggaggaggctcgggggacgcacacccggtttccggcaaggtcttcatgaacgccacctcgcgccgccgtttcctccttcagtcgggtcttctcgtggccgcctcggccatcgggtgtcggcgctcggatgctcccgcggtcatcctgaagtcgcagcgcaacgtaatgcagacgcttgagggcatccccgcgacggacggagccggcgttcgcttgacgcgggtcatcgggcagccctcgctgcggaacctcgacccgttcctcatgctcgaccggttccactccgatgaccccggcgcctacatcaacggcttcccgaatcacccccaccggggcttcgagaccgtcacggtcatgctcgatgggcgaatgcgccaccgggacagccgtggcaacagcgggctcatcgccggaggtggctcgcagtggatgaccgcgggccgtggcctcatccactcggagatgccggagcaggtgcaggggttgatgtccggcttccagctctggctcaacctccccgcgaaggagaagatgtgcccgccggcctaccaggaccacacgccagcgcaactcgcggaggagcgcctgtctccctcggggagccgcgcgcgtgtcatcgcgggccacatgaacgggctccagggccccgtgcgtgagcgccccacgcagccgctcttgctgaccctggcgctcgaggacgaccgtcctttcgaactcgacacaccgtcggaccacactgccttcgccttcgtgtccacgggcgaggtcgacctgggtcctgaagacacgtcgaagccggtgcgcgagggctcgctggcattgctcggcccggggagtcggcttcgcgtgcgcgcgaggaatcgccggagcgagttgctcatcgccgcggcgatgcccctgcgtgagcccatcgtccagtacggcccgttcgtcatgaacacccgcgaggagatccagcaggcctttgacgactatcgcgcgggcgtgctcgaccaggggtgatggtcgtcaatccacggccgaccggccacagaagtccagcacctcctcgaagggccagccctccagtgcgccaaacaacttgtggccgccgagcttcgcccgcgtgagggcggggctgctcaatccgcagaggaacctcgcggcctgcctcgggtgcccgagcgactcgggatgtttcgcggccagggctcggaagcccgccgcgtcgaggcccgcgggcagtgccggcctctggcgcaccgcgggaagcacctgggccgccccggtccggcagaaggtgcagtgcccacacggctgctcccgccgctgaccgaagtgggcgaccagcgcattgctctggcaccccgcatgggtgacgagcttcagtacgtcccggacacgcgtgacctcctgggcctcgcgctgctgaaaccgctgatggaggagtgcggtgagcgctgctgcgtcctcctgggggcgcagccgtgtgaagcgctgacgcggctcggagacctggagcaacacgagcccttgctcctcgagatattcgatggcccggaccacgcgctcgcggggctgccgaagcgaactcgccacctcggccgggtcgagcgagtaccaggtgcgtcccttcttcgcctgggaaaacacgtcgcgcaggaactgcacccgttctccttggaagcgccccacgagcgcgtcaatgggcatgagcggctgcaccttgtagcccgcgtagtacggcgtgccttgcctcaacacgccttcgagctccaggtacgtcagcgccgtgcgcagcacgagcggccgcacatcatgccgggtggacagagcgaacatgtcgacgctcagttcgggacccaggccgagcaactcggtcaccagactttgaattgcttcccgcgtgggtgtgtccccgagcgcgaagttctccaggctggggacgtcgtccggacacgcgaagagctccaccaccgatggcgctccatcgcgcccggctcggccgatttcctggctgtagctctccagtcccttgggcaggttgtagtgatacacggcccgtacatccgccttgtcgatgcccatcccgaacgcgatggtcgccacgacgatgccattcgcggaggccatccaggattcctgcacccgctcacggacctcgggctccaggcccgcgtggtaggcgctggcggggagaccttccgtggcgaggaacgcggccactcgctcggcggtcttctgctgcgtgacgtagacgatggtggggccaggcgctcgggaaccgagccgccccaggaggaaggcgtcgcgggcctcggcgtgaaccggggtcgtctccagcgtgaggttctgccggtagaaacccgtgacgaccgcgttctcctcggggatgccgaagccctggcagatgtctcgcacgacggagggtgtcgccgtggcggtgagtgcgaggattcgctctgccgacagatcccgcgcggccttcgccagcttcagatagtccggtcggaagttgtggccccattccgagacacagtgcgcctcatccaccgcgaacaaggaaatgcgcagctcgcggagcagggcggtgaagcgctcgttgttgaagcgctcgggcgccacgtacaagagcttgagcgaaccatcgcgcagcgcctgcgtgacttcgcgtgagtcgtccaccgacagcgaggcgtccagccgcgcggcacgaatgccctgtcgggccagggcgtcaatctggtccttcatcagcgcgatcagcggggagaccactaccgtgatgccctccagcagcagcgccggaagctgatagcagagcgactttccgccacctgtggggaacaccgcgagcgccgcggcgttcggaccgagcagcgcatcgaggacctcacgctggccagggcggaagtccgtcagtccgaaccgctcgcgcagaacggtatcgagtgagctgtgtcgtgcgccatctgccctatccatgaagctcctccaactcgcgaactccggcaacccacgccctccatgggccctgaccagcgactccgtccctgctcaccgagggaagagcgtagccacgaagtccacgaagacgcgaacgatgcgtgctgctgaattggccaccatcgcccatgcggtatcgccggctcggggataggctgcggcgccatgacctaccaacgcaatcccgtgaaggcgccccgtgtgtcgggcctggcgctcaaggctttcgtgaacgcgctcgagagcggcgtcgggtcggtgatgctggacaagctgacgcgggacagcggcatcgagcgatggcgtgagctcccggcgggggacgcgccgccgctccagtttccgttggcccagggaactgccgccacggagtcgcagacacccacggagcaggccgcgcgcgccatcgccgcgtccgccagtccaccggagcgtgagagcgttgcggcctatgtccgcgcctaccgcgagggcgccacggacccggtggccgtggtgaatcgaattcatgaatccattgcccggatggacagtgggaagcagcgcctgggcttgttcatcgcccgcaagccggacgacgtgcaccgggccgcggaggcttcctccgagcggctgcgcgagggccgtccgctgagcgtgctcgacgggattcccgtcgtgctgaaggacgaggtcgacctggccgggttccccaccacgctgggcacgcggtttcgcacgcaggtggccgccgcggactcgacggtggcggcccggctcaaggccgcgggcgccatcatcctcggcaaggccaacatgaatgagattggcatcaaccccatcgggttgaatccccatcacggcgccgctcgcaacccctgggacacgggccgcatcaccggtggcagttccagtgcctccgccgccgccgtggccgccggcctgtgccccttgagcatcggtgccgacggcggcggttccatccgcatccccgcggccctttgcggcatcgtgggcctcaaggcgacgtggggccgcatcccggagacgggcgtaccgccgctgtgctggaacgtgggccacgtggggcccatgggcctcaccgtggacgatgtcgccgcggcgtatgcggtgctcgcggggccggatgggcatgacctcgtctcgcaggggcagtcaccgcatcacctgtctggctacgaggatgaaggcctgagcggcgtgcggctgggcatctgctgggactacttcgaggacgccgacgcggacgtcgtcgcccgctgcaaggaggccgtggccgcgctgtcggccgcgggcgcgcgcgtggtggagattccgcctcccgacctcaacaccgtgctgtggacgcacagttgcatcatcctgagcaaaatgtcggaggtgatgctcccc

SEQ ID NO: 1261 - DNA, 34662 bp, Myxococcus xanthus
tgctctccgcatgcgcgccccccgtggacgaaacggacacggcgctgacccagcaatccttcgcgggtgacgaggacgaccccgactcccactcccaaggtacccagcttcacgcaactcccgtgcgcaccgtgatgtacgacgaagcactcgtgcagcacgacggtgcgctccgggtcgccaacctgaaactgacgcgcggggaaatcgtggccaacatgcccctctccgtggatggcaccacgccgagcctgatgttttgcggcgggggagcgcccgcgaacgagaagcgaagctgtggcttcgtcgtggacggacaaggcgtctgttcgccaggaagtctcgtcacgctcatgggtggcgacagcggctcccctcgaaaccggtgcacgggggcccccgtggtccgcgtctgcgcgggcgaagccccgtgcgagcaccaggggccgggctatctcgcctccgccaacagcagcttctccctcaacaactgccccgccgtcacgttcacctgtccctccagcggcgtgtacaccgcgctcgcgggaccgggcacgcccaacaccacctggctgatgcagctcacgagccggtcgagcacctaccccacgacacgcaagatcctccgaggcgaggagctgattggcgcgcggctccgtcagccgtccatgggccccgccctggtggtcgaggacgtcatcaacgcgaacgcgctccccaacaccgaaggctccggcatgtgggagccgagcgggcacaccttcctctaccaggtgcgctacacgacggcgtccgtgcccctgtgcccgactggggcgaactgggccgtgccagtgaagggactcttcgacctgcagggcgaccggtacgagagcccccgggccttcacgctgggctgtgacgcgggcgtcatcgccaagtgctaccgctggggctaccacccgtggctggacggcgcgacatccgggcccatcaccgaggctcactggtcctgcacccgcatggcgcgcgccgactactgcggccagggaacgtccttcaccctggacggcacccgcatccgtccctgggacgccctgacgccggccatcatctccgcgccctcgccggactccagctcgaatgacctgaccttcgaggcgggttggaacaccgcgggccccgcgtgcctcagccacctgcgctggaagcacctgaccgcgccctgcgtgccgctcaatccccccatctacgatgcgaacggcaacatcgtgaacgattgcagggacccgaacacgccctacgccccgggcaagtgcgcggagatttgcgacaacgcagaggaggccgcccagtactacggcagccgcgtcttcaatcactccgccatcaacacgccctgactcacgtacccgcgaggcggtcccagtcctcctcgccctggaagacgtgcaccgccaaccgctcgcacacggcctggtgcgagcgcgcggcggcgccgcccacccagacgggcagccccctgggcagcgcctgcctcaaacgcgtcagggtgtcctcgaagtcctctgcgctccggctggccaccgtggacagccccacgaagtcgggccgcagcgccaataccgcgcggcccaggtcctccgcgggaacgcgctgccccagcagcgtcacccgcacgcccaggtgccgcagccgcagcgccgctcccagcaggcccatctcgtgctcctcttccggaaagcacgccaggacaccatgccggtgccgccccaggggcgccgcgtgcagcaggctcaccagccgcgcccgcaccatctgcgacaccaggtgctcctgcgccactgtcagcgtgcccgactcccagcgctcgcccacgtcgcagagaaggggcgccagcacctcatcgaaggccttgagcgggggcagcgcggccaacacctcgtcgagcacgtccgacacgcgcggctggtcatacgcctgggtggcggcgagcatggactcccgccacgtctccgcatgcggccgcgcgtcctggctggcaccccgccccgcgacttccgcctccagcccctccatcaactgaggcagcagcttcgccgcttcgctgatggccacgccttcgtcggtcaaccgcttgagctgcttgagcaccgccacgtcccggtccgtataggcgcggtagcccgcgggggtgcggcgcggcgtgagcacgccgtagcggcgctcccaggcccggatgagctccacccggactcctgccaactccgcggcgatgttgattcgataggtgcgctcagccatgtcgctacggcaagactacgggcgattctgagcgttgcgcacctggttccagatggccaccagctcttccgatgactccgcgtactgcgcgccgagcgagaaaatggccttcaggtgctcgcgagcccccagcccgccgacgaccacgggaaagggcgcgcaggcccggagcgcgtcttccaggacggacgcgaactcctccggcgcacgggcgcgcacgaaggacagcgccaccacgtccggccgaacctgcacgcaagccccctgcagcgccgccgccggggtgtccgcgcccagcatcgtcacccgccaccccttgcgcttgaggtggatgcccagcaccagcaggccgccttcatggtggtcccctgacggacaggcgagcagcgcacgggggccggcaggcgcgggggacagtgcgtcatacacctgccgcaggcgctggcggatgagggcggaggccaggtgctcccgcgcgacgtccagccgcacgcccatctcccgcagcaggggcagcaggaagccgtcacagtaggcctccacgtccatgacggtctgtgcgtcatccagcacgcgcgtcacctcgtccccttccagggcccccacggaggaccagaagcgctcgcgcaggcgctcggcttcgggctgctcacgcggcggctccgtcttcacctgggcgatggcctcgctcaccgacaggccttcctcctggatgagccgggccacacggcggacggcctccacctcctcgcgcgaatagacgcggtagttgttgccttcgctgcgcagcggacgcgggaaaccgtagcgccgctcccaggcgcgcagcgtcgcctcgcggatgcccgtcatgcgcgcgatggtgcggatgcgcaacgtcatgacgccagcccccgggccgcgtcccagcgctccgccacgcctcgcgcaccggacaccctgcgcgtgaagccctccatggacgtcaccgccgccagtcgccgcaccaccgtctccaatccctcctggaagacggacatgtcaccgggcggatgcggggtgcccacctccagcaacacgtctggacgctcgtgttcgaagaagccgtagcgcaccgcgatgggcaggcactccaccttcgacacccgcgccagtagctccacgccccgctccagtcgcagtgggagcacgccgaaggggcggtgctcgccctccgggaagacgaacaccaccgcgcggggctttcgcagcaactccttcgcgtagcgcagcgacgccaccggcgacgtcgcgtccttgcgccggatgctgaaggcgccaatgcgcgtgaggaagcggtagcggcgcaggttctcctcatccatgaggcagtagccgtcccaacccgccgtctggcagagctggttgagcacgaagccgtcccaccagttggagtggttcaggtacaccagccggcccggccctcccggcggaagcgccccacgcacccacaatccccggaacgccgagcggaacttccatccgatgtaccggtcccacgcccagcccagcgggcctcctttcgccgcgtgaatcacgacgcccgggcctcccccagcagcgccaccaacccggtgaacagcgccaggcccagcgacaccaacacgctggtaatcaggaagaagaccacctcttccagcggcaccacgcccaggtacacgcccaggtgcttgccttcaccaaagttccagatgccggtggagatggccaggtggtccgcgatggacaggtacagccccatgatgaaggccggcggcagcaccgccttgagcaccgcgccggagcgttccttgtagtggcgcaccagcaccaccaactggaaggcgatgaccggcagcgtccagcccaacaggtggatgaggtatgcccacttcgtctccatcatggcgccacctcccgagccgtcagcgcgccttcgcggcgctcacccgtctccgccgcgggccgagacgcctgggcatccggcgccagcgcacgcgccagccgggcctgggcccacagccccaccaacagcgtctgcaggccgaagaagaggtactcctccagaggcaggtaccccagcttgatgccccagatgcgctcggggtcgaaaccccacaggcccctcttcaccgccaggttgtcccagggcgacgtcgccgcgtacacgacgatgagcaggagccccatgggcgccaggctcctgcccgtgaaggtgcggcggtagcgccacgccaggaagagtatgggcaccaccacgaacagcccgaggaatcgcgcgtacgtcatccgggtcctccactcagctccggagccacccgtatcattcggcccccgggtcgcaacacataggtctgcccccgccacgtcaccgttccctgccgccacagcgagcgcaggaaggccgcaagcaagagcgcttcgcccaacaaccagtccgtcaccgcataggccctccccgcgtccgccaccggcgcgtggagcccggccaatcgaagcgccagcaaggttcgcacggcaaccaatcccaccaccgagcccgccaacacgggcgaccccagcgccgcggccagcaccgtcagcggcagcgtcggcgtgaagagcagcggcaccgtgggatacagcgcgggccggtgactggccagtacctgcatccagcgcgtgaagcgcgacaggggcgccgcccagagcacctcggcgtccagggggaccaccgccggggcgctgctcagcaccacgcccagtccctgggcgtgaagacgcttggccagctccaggtcctcgccgatgtggtccgcgagccgccgcagcgactccacggccacgggagacaagcccaaagccttgccacacacggccttggcgcccgcgctcatcgcatccagggcccggaagctgtggtgggtgtaacgcagcaggcccgccatggcccggctcgcgccgtcccgaggccctactggcagcggcgccgcggtgctcagcgcggcgcccgcggccactggcacggccaggccttccaccagcgcgcccgtcaccgccacgtccgcgtccaccgacagcaccacccggtcgcccacgggcaacacatccagcgcataaagcaggtgtcccaccttccggttgggcgtcagcggctcgctcggaagccaccgcacgcccggggcgagccggggacggtagggcgacaccaccacctgctccaacggcccggcgtagtcgatggactgcgccagattctccagctctcgaggcgtgggcgcgtccaccgggcgcagcagcaacactggcggcagcgcgccgggctggggagcagcgccagcccgcgcgcgcgacagacgcacgcacgccaccgcgctgaagcccgtggccacggcgcaccacgccagggacgcgaggacgagcgcgctcatgccgcccgtcccatgcgcgtgcggaagtgcgccatccagcggatgaagggcgagtggaagcgacggaagtccgccacctcgcccagggagtccagaggcccctggcgcgcctccagtcgtgcatagaaaggcgacgactccagcagcttcggctgtcccaccaccacgtttcccgcgtgcaggcgtgacggcacgcgcaggccccagccggtgatgtgggtgggccgcgactccaccaacgtggggccccgttcgcagcgcactccgcgcgcgccggccaccactcgcagcggcgcgacaccttcaggcaggtggtagtccaccaccgtctcgtcctcgcggtgcgtgcgagcccagtgccaccccgacaaccgcgcgcccagcagctctccgccgtggttggtgtcgtggtagcccaggccgctcgcctcgatgcccagcgaggacacctccagccgtgcctgcgaacgaggcgccagcgcctgccagtagtgcggcagccccggcatgagctgcaccacctcgcccacgggcgtcatcggctccagcgtcaggctcgcgcgcacgggccggccccacggcgccgtcccgtcgtccacggccatccgcaccgtgccgtccccctcgtacgacagcgtggagcgaccgatgcgcagccggcccggagcatccaactccgcgcgcgcgtactcgctgaggacccacagccgccgcacccccgcgtggtacagcgcgaagttcaccgcgctgtgctccagcggccgtccgccccgccgcgccgccaccgagtaccggggcgagaacagcgagcccagcatgaagatgcacaccgcgctgtagggtcccgcggtgacgtccgcatagaaccagcggtaggtgcccgccgcgtccggcagggcggggagtttcgccaggcgcatcatgcatccctccggaggtgctgcgaagccagctccgcggcgaagcgaccggacaacatcaccagcggcacgccgccgcctggatgcgtgccaccgcccgcgaagaacaggcccggcgtgttgccgcggatgcgcggtcggcggaaggggccgaacttcccgtgcggcaggaagccgtagatggagccgcccggagcgccctgcgcggccaggtccaccggcgagcgctggccgatgacacgcacgcgccccttgagcgccgggtagtgccggcacaggcgctccagcatctgcgccttcacgcgctcggcgcctgcttcccagtcgcgggtggcctgctccgcgccgcgcgcatccacgggcagcgcgggcgcgttcaccatgacgaacaacccggtgcggcccggaggcaccatgctctcgtcggtggcggaggggttgcagaagtacaccgtcgggtcggacgcgagctgcccgccgaacagctcgtcgaactcgcgccggtagtcaccgccgaagagcaccgtgtggtgcggtagagccatgcggccctccacctccaacagcaacacgaagccagacagcgccagcggctcctccgcgcgagcgagccgctccagcgggtccgcgttcaccaccacactgtcgaagcgctccgtgccctcctgcgggcccacctggtagccctcgcgcgtgcgctcgaagcgaacccgcgtgtccaggtggatgcgcatgcccagccggcgcacggcctgccccagcgcgtccaccagcgcaccgatgccgccgcggacgtggtgcacgccataggcatgctcgatgtggggaatcagcgcgaaggccgcgctggcctcgtagggggacgcgcccgtgtacgtggcgaagcggcccacgtactgccgcaggtggtccgtcttgaagtgccgggccgccagctcgtgcagcgtgcccatcttcatccccgccatgacggcccccacgccacgcttcgccacgcgcgtcatgaagcccgccatgccctcgaagggggcctccaggtatggctcgcccgcggcccgccagatggccgcggcctccgtgtagaagccgcggatgccgtcgcgctcacccgggcggacacccgccgcgctctccgccatccgctccacgtccttgtaggccgtgaagtcacacccgtcctcgaagcggtaggcacactgcggctccagctccgtgaagcgcggcagcaggtcctcggcgcccagttgctggaaggtgccacgcaccaggtgcggcagcgtcagcaacgtgggccccgtgtccagggtgatgccattcacgatgacggcctgggccttgccgcccagcgaggcgccccgctcgaacagcgtcacctcatgcccgtccttcgccaacagcccggcggccgtcagtccaccgatgccgccgcctaccaccgcgacgcgggtgcgcttcatgctccacctcccatgcgccgccgaagctccgtcttcattccctcgccacgcatgacgccctcaccctcccgccccggtgggaagcagcggcatgcgcacctcgccctggggggcgggcagcaccgcggcgggccgcaccatggccgcggaagccagcgcgagcttgcggcgcgtcgtcacgtgggcccgggcgctgaacacgtcgtagtcgcgcgcttcgatgtcgcgcaggatgtcgccgtagatggcgcccatcagccgcaccatccgctgactgccgaagcccgtcaggtagcgcaccccggccgccgcccgcgcgtagtacgcccgcgagcgctccacctggaagcgcatgaaggaccgccagcgcgcgcccacctgtccgcgccgcaagtcgtcctccgacaatccgaaggcggccaactcctccgcgggcaggtacacccggccgcgctccaggtcctcgcgcacgtcgcggaggatgttggtgagctgcatggcccggcccaggtcggccgcgggctccaccgccgccgcgtccgagcaccccagcaccggcgtcagcatcagccccaccacgcccgccacccggtagcagtagaggtccagctcctcccaggtggcgtagcggtgcttcgtcaggtccatctccatgccggagatgaggtcctggaagggctgctccggaatccggaagtggcgcaccgtgtgctcgagcgcagcgaactcccgcgcgtcccacggcgtcgcggcctcgctgcccttcacccggtccgcgggcggccccagctcgcgcgaggccagctccggcatgggcaggtacagctccgccacgcgctgccgcgcccgcgccagccgcaccggcaacgcatcggccgcgctcgccgcgtcgtccccgtccaccatgtcgtccaggcgccggcagaaggcgtagagcgcgaacgccgccctccggcgcaggccgaagagcaggtacgaggcgaagaagaagctcttggcgtgatggcgcgtcacctgcttcgccagcacatagccgcgcgccaccagcgccttgtcgacaggcgggctcacgcggccaccccttccagtggcgtggcggcggccgtccgaggcgacaacgaaacgccctgcgcgtgggcccacgtcatcagccgctccgtcaccagccgcgcggagatgagcaccgtgggcagccccgttcccggctgcgtggaagcaccgacgaagaagaggttcttcacccgcgcgtcctggttggacggacggaaggggccaatctgcgtgaagttctgggacagaccgaaggcgctgccacgcgccaggttgaaggtgccggcccagtcatccggggtgaagacgcgctccacctcgatgtccgactccagcgacgggaagcccagctccgccatgcgcgcgaagaacttcgcgcgcaccttcggcccctccaccttccagtccaggtccgggtgctggtgcggcacgggcaccagcacatagagcgcatccttgccctcgggcgccagggacgcgtcggtgcgcgtgggcgcgttgacgtagaagctggggtcctctggcacgcggaagcgctcgaagatgtcgtcgaaggagcccttgtagtcccggccgaacaccacgttgtggtgcaagagctccgggtagcgccgcttcatgcccagatagagcatgtagccgctggacgtgtagcgcagcttctccttgcgcttgagcgtcgtcgccttcgggtccagcagcttctcgtacgcgtagggcaggtccgcgttgcacagcaccgcgtccgcctccaccacctcgccgccctccagccgcacgcctcgagtccggccgccatcggtgaggatgcgctccacgggcgcgccgtagtggaagcgcacaccctcctcgcgcgccagccgctccagggcctggggaatggcatacaggccgcccttcgggaaccagatgcccacacccagctcggtgaagggcagcaggccgtacaccgcgggcgacgcgtagggtgacacgcccaggtacatcgtctggaaggtcatcgccgcgcgcagccgctcgtcctggaagaagcggctgacgtccgcgtacattcggcggtgagcgcggacctggaagatgcgcgcgagcacgcgcggcgagaggtagtcacgcaggcccgcgtagttgcgccccaccaggtggtccaggctcgttcgatactggacgcggccctgggccaggaaggcgaggtagcgcgcgtaactgccgggctccacgcgctccaactctcggcccatggcgcacaactctgacgtgaaggtgacatccgaaccgtcccggaagtggacccgatagttcgggtcgcacctgagcagcgtcaggtagtcctcgatgcggcggcccaccgcgcggaaggtctcctcgaacacctccggcatcagcacgatggtggggcccaggtcccacgtgaagccatccacctgcaatcggttgcagcgcccacccggtccctgcgtcttctcgaagacctggacgtcgaagccctggtgcgccagccgggcagcggcggccagcccgcccacgcccgcgcccaccaccacgatgcgcctgccctgtgtcgatgcactcatggcgtcctcaggcggcgcggtgggccagccgggcgatgagcgcgtcgagcagctctctcacaccgttgggattgggcagcgactgcaacgagcggcgggcggccctggaggcacgcaccaccatgcgctcacacgcggcccggcctccgcaggactccaccagcgcgcgggcccgcgccagcgcggcggcgtccttctgctccaccggcagcgcccacagcgcctccagctccgtgcgctcggcctcggtggcgcgcgcgaaggcggccagcactggaaaggttcgcttgccttggaggaagtcgccgtcagcggccttgccagcgacgttcgaatcaccaaaaaggcccagcaaatcgtcccgaagctggtaggcaagaccgacgtgacggcccacgcgctccaactcctccaccaagccgctgctggcaccgccgagcatggccccgcacaccagcggggcgcagaagccgtagcgcgccgtcttgagatgcgccacgcgcagcgtctggaagagcgtcacctccgccagcggcgcgcggcccaggtccaggtccaggtactgcccggccgccgtgtgacggcacacgcccaggtagtactgcaccacgcccgcgacgcacgtcagccccgagcccagcatgacctccagggcgcgcgcgaagaggtggtcccccaccaccacggccaggtcctcgcccgcgcgtcctggcgccagcatccggtggaggggcgcggcgccccgccgcagctccgcctgatccgccacgtcgtcatggatgaggaggaaggtgtgcagcagctccagccccgcggcgaagcgccacaacccggagggcaccaccgcgctcccacgcgccaggcagtgtccggccatcaccagcgcggggcggagccgcttggcgggccgcaaggtatacgcccgggcctgcgtcagtgcctgtgtccaacgaacgtccaggccggcctcgtcggggagctcgaacaactccgccagcgaggtctccacctccgtctggaccagttgcagccaggcctgctccagaggaagcaggcccgtcggcggctgcgcatcgggaagcgtgagtgccatgcttctttcctccgaagaacccgttcctttgtttcctagaggtagcgtttgcgtccagagcttgtcaagggtatgtctaaggtttgcgataaccttgtacacagaggtcccctcatgaaggcgtggatcgcaggtgcgctctccatctctctggcagcgggaagcgccctgggcgcggcgccggccccggagccggtggacgcgacgttacgcacctccgcgggaaaggaggtccggctctccaagtggcgcggaaagccggtcatcctgttctatgaggacaaggactcgaccaagctcaattcgaccctgaagaaggagctgttcgcccgggggcaggagcgcggaatcctggacgcggcctgggtgctggcggtcgcaaaccttcagaatttcgacttttttccggcccggcagattgccctctccttcgtccgggacgaggagaagaaggtgggcgtgcctatcctggtggatatggatggagcactgggaaaggcgccgtggaagctgccgctgaaaacgtccaacatcgtgctgctggacgccgaaggggccctggtctaccggcactccggccggatgaagccggatgagctgatgaccttcttcgccgtcctgagccgcctggtgggcgtggacctgaacagcccggcgccctcggagccctccccgtgaaggtggccgtcaccggtgcgaccggcttcctgggtccagggcttgtccaaggtttgctggagcgtggacaccaggtccacgtcctggcccggaacgttgaacacgccctggcccgcctgcccgccggcgtgacgggggcgccctttaccgccggctcgtccctgcccccggaggcgctggcggacgcggaggccgtcgtgcacctggcgggcgagccggtggcccagcgctggacgcacgaaggcaagcaccgcatccacgacagccgggtgctgggcacgcgcgcgctggtggcggcgatgcggggcgcgggcacggtgcggcgcttcgtatcggcgtccgccattggatactacggcggaacgcgcggcgcggatccactgacggaggagagcccttcgggtgacgacttcctggcccgcgtgtgcgtggactgggaggctgatgcgatgcaggcacacgagtccagcatccccacggccgcggtgcgcatgggcgtggtgctgcacccggaggggggcgccctccacaagatgctgccccccttccgcgtgtgcgctggcagaccggtgggcaccggcgagcaattcgaaagctgggtgcaccgcgaggactccagggatttgctccccttcctgctggcccatccccagtggagggcatggtgaacgccaccgcgcccacgccggtgacgaacgccttcttcgcgcacacgctgggccacgttctgggccggccgtccctggtgcggatgcccgcgttcatgctcaaggcggcgctgggagagatggcgaaggtggtgctggagggccagcgcgtgctgccccagcgcgcccatgaggcgggcttcgtattccggtacccggagttggagggcgcgctgcgcgacctgctggcctagggtgcgcggatggacgcgaagacactggaggcgcgggcccgcgccgagggaacgcccgtcatcgaatcggacaccgccaccttcgtgtggcgaggccggggccccatctgcctccaaggtgacttccaggactggcgcggcaagccgctgcccttcaagcgcgtggcgcccggactgtgggctcgcacgctgacgctgcccgcggatgcctacgtcgaatacgcgctggaggacccgcgcggccagcgcgtggaggacccgctcaaccgccacccttccgacaacggctttggcggcatcaaccactcgttccacatgccccaggcccgctcgtccctgcccgcccggcacccgcgcggcgcgcctcggggccgcgtcacccggcacgtggtggacacaggagacgtggacctgccgggccaacgccgggtgtacctgtacgcgccgcccacggacgcgtcggtgcccttggtggtggtgtacgacggcgaggactatctgcgccgcgtccgcctgccggagctggtggacaccctggtggccgaaggccgcatgcgcccggtggccctggcgctcgtgtgcaacggcggtgagacacgcagcatggagtacgcctgcagcgagtacacggtggggctgttgaagtggaaggtgctgccgctggcgcgacagaaactgtcgctagtggacgagcggcgcagccccggtgcccacgcggtgctgggggcctcgctgggcgggttgatggcgctctacaccggcctgcgcatgccggacgtcttcggccgggtgctgtcgcagtccggggccttcgcggtggagggccatgacttcgtcgtcttcgacctggcgcggcccccaccccgccgcccgctggacatctggctggactgcggccgctttgaaggcttgctggagggcaaccgccgcatcgctcccgtactctcagaagccgggcatcaggtggaacttcgggagtacagcggtgggcacaactaccctgcgtggcgtgaggacctggtacacggcctggagcgccacttccctcccccgccccgccaagcgccgggagtcattgcgtttttccgggcggtgacgcgggcgcgcccgccgtgcggggacactccggaggacgcacgttagaggtgggacgcaactggagacacaccgcgcccgataacctacatgggaattcccggagctctgtccgcaccgggccccatccctggagcccccatgtctcgcattgatggtggtaaccgcccgtcctcgcccaagggcccggcgcatgagcgcgccagcgctccggagcagcggccggcctccggcaccgccacccaggggacgaagggcgtccaggcacaccgcacggtgcagacgttccagggccgcagcgacttcgagcccgaccggcgtcccgcccagcgcgccgtgacggcgccgcctccggacgccaccgccatcgcgggtgctgacgcggagttggagctgctttccgagtttcccgaccaggcggatgcccagggcgggctcgcctccgccatgctgcacgcgcacgcgaacgagcccgcctcgcaggcccgcatcgtcgagcgcctgaagcaggacggccgcctggagtcgctcttcggcgaggtgttccgcgagggcaatccctatgtcgagcagccgcaccgcaacgccgtcgtgcgcgcgctggggaccgccatggcgcggggcacggtgacgtccgacgacctgcgcgccttcgctcgcggcgcctatgcgcaggagtggcggcagatcggctccgagctgacgacgccccgcccgctcacggagaagccatagcgcacgcgccggatgcacccatgaaagctcttcgtcgacgcacccccggcgcgggccgcaggaaaaccatcagccgacgcttccgctcggcccggcgcgcgcatggcacgtaccgggcccggctcaggacgcgcccgcccaagaagtaccgggtgcggctgcggaccgcccgccgcaccctctgaacaggccctgctgcccggctcagggcagcgccacctgcccgggtgacgagcggtgccccgtggcgcccaggcccaacgagccgtagaggctggagccccagctcagcaccgtgccgtcgcgcttcatggccagggagaaatccgccccgcccgacaccacggtgacgtccgacagctcccgcacgcgcaggggctccgtccggttcgtgttgtcccccagccccagttggccgtgcgaattgcgtccccacgtccacaccgtgcccttgagcgccacggcgaacgtgtggcgagcccccgcgcccacggcggacaccgaggacaggttcggcaccggccggggcaccaggcgcatccgcgtgccgctggcgccgtcccccagctgaccgaacgcgttgtcgccccacgtccacacggtgccgtcgccccgcagcgccaccgtgtgcgtcgcgcccgcgcgcacgtccaccacgccgtccacgcccttcaccgccacgcgcgaatagcgggtggtgcctgtgccgtctcccaactggcccgacgcgttgttgccccacgcggacagggtgccgtccgagtgcagcgctagcgagtagtggtctccgcccgccacggccaccacgccctccagcccctccacccgggtgggcagggagcgcgactccgcggtgccgtcacccagttggccgaacgcgttgtagccccacgtccacaccgagccgtccgagcacaccgccagcgcgtggtagccccccgagccaatggccaccacatcccccagcccggccacctgcaccggcctggtgcgcggagtggacgtgccatccccgagctgaccgaagccattggcgccccacgcccagacggtgccgtcactgagcagcgccagcgagtgccaggcgcccgaggacacggccaccacgctcgccaatccatacaccgtcaagggcaccgcgcgtcgcgtggtggtgccgtctcccagttggccgaacgtgttgtcgccccacgtctgcacggtgccgtctgacatctgcaccaccgcgtgctggccccaggcgcgcacggtgcgcacgggcgggcggattttcggtccttcgattttcaccgccatcggcgtcagctgcgggcccgtcttcccatcaccgagctggccgtactcgttgctgccccaggcgcgggcggtaccgtccagcagcacggccacggtgaactgctctcccgcggccaccgcctccacgcctcgcagctccggcacctgccggggccacatccccgtcggcgaggacgagccatctcccaactgccccagcgtgttgtcgccccacgtccacaccgtgccgtcggcgctcagcgccaccacgtggtgggcccccgcagacatggcgcggatgcccttcaaggaggtcacctgattcggcacgctccgcgcgtggttggtgccatcgcccaactggccggacgggttcgtgccccaggcccacgcggtgccgtcgtcgcgcaccgccaccgagaaggcacgtccggccgccacggacgccacacgctccagccccttcacacgcaccggcgtcaggctcggcgcggtgccaccatctcccagttggcccgagccattcgcgccccaggcccacagcgcgccgtcctcgcccaccgccagggcatgcgtttcgcccacaggcacaggcaccgcgttggagaggtgctcgacgtgggccggcagggcgcggtccgtgagggtaccgtcacccagttggccgctggcgttgccgccccaactccacacggagccatccgcgcgcagcgccaccgacgcgtctccacccgccgccagcgccaccacgccccgaagcccctccaccagtcccggcgtcacgcgcggggtggtggtgccatctcccaactgcccccgcgcgttcgcgccccaagcccagacggtgccgtcacacgccagcgccagcgagtgctgtatgccactggcgacagagcggacacagggcacgccgggcacggacaccggccccgtgcggtgggtggaggtgccgtcgcccagttggcccgaaccattctcgccccaggccatcaccgtgccatcggcgcgcaccatcagcgtgtgcgcgcggccgacggacaacctgtccacgcggccaatgccacgcacctgcactggcacggcgctccaacccgcggcgcccaggcccaactggccgaagcggttgtagccccacccgcgcaacgtcccatccgcgtgcagcgcgagcacgtgcaggtggctggggtggagcgcctggatgccagtcaggccggggatgagggcgggccgcacgcgcgaggtgagcgttccgtcgccgagctggccgtaaccgttgtagccccacgcgcgcaccgtgccatcaccttgcaacgccatggagtgggagcggccaccgctgacggcggtgatgccctgcagtcccggcacctgcaccggacggaagcggtccgcccaagagccgtccccgagctgcccttccccattgtcgccccaggcccacaccgtgccgtcgccgcgcacggccagcgcatgcgcggagcccgccgccacgcgggtgatgttcgccaatccctccacacgcaccggactcagtcgctgcacgccaccgccgtcccccaactgtccctcgaagccctcgccccacgtccacaccgtgccgtcggactgcagggccatggagaagtacgaaccggctgccaccgccaccaccgcaccgagccccgacactcgcaccggcgtcaaccggtccaccgtcgtgccgtcccccaactgtcccagcgcgttgtagccccaggcccacacgctgccgtcgctgcgcagcgccaggacgtgactgccgcccgcggccaccgccgtcaccgacgtcaggcccggcaccgccacgggccgggcgcggtcgagcgtggtgccatcccccaactgtccggcggcgttgcgcccccacgcccagaccgtcccatccatgcccacggcgagcgaatggtgggcggccgaggcgacgctgcgaacgccgccgagcccctccacgcgcaccgcggcgtggcgctcggcggtgctgccatcacccaactgtccataggtgttgcggccccaggcccagacggagccatcccccagcgcggccagggagtggaaactgcccgtcgccatcgacgtcacgcccgccaggcgcatcaccggagcgggcaccacgtggcgctcggagccgccgtggcccagttggcccgacaggcctccgccccaggcccagagcgtgccgtcttttcgcaggaccagcgcgtgctgcgcgccgcccaccaccgaggccaccgcattcagccccggcaccggtcccggcgtggcgcggtcggtggtgtctccatcgcccagttggccggagccattggcaccccacgcgaacacggcgcccgtgtcgagcagcgccagcgaatccgagtccatggaagccacggccttcacccgctcgagccccggcacctgcatgggtacggcgcggtcattccaagtgccatcaccgagctgtccggaggcattgctaccccacgtccacacgccgccgtccttgcccagcgccagcgcgtggtaggtgcccgccctcacctcggtgatgccgctgagctcggagaccttcacgggagacaggcgctgggtggaggtaccgtcacccagttggccagagccgttggagccccacgcgcgcaccgtgccgtcctccagcacggccagggtgaagtcgaagcccgcggcgagcgcgaccacgccattcaacccgggaacctgttcgggcgtgagccccggctgcgtgtgtccccggccgagctgtccgtggaagttcgtcccccacgcccacaccgtgccgtcctcgcgcagcgccaacgagtggaagtctccggcggccaccgccaccacgctgtccaggccggccacccgcatcggcgtcgcgcgatcggtggtggtgccatcaccgagctgcccggagctgttgccgccccacgtccacaccgagccatccgcgcccagtgcgagcgagtgggcgtctccggacaccaccgacacgatgttctccagcgccgccagccgcactggagccagtccctggagggacgtctccgccccgccaagctggccggagccattgccgccccaggcccacacgtcgcctccgggtgacagatacagcgagtgctgggtacccgcggcgatgcgcatcggcggggccgtgacgaccactcgctgggtgcgcgtggcgtgtggagtctccggcttggcgagcgcccccgagggctcgcagccaaccatcagcaaggcgctcaacaggcacgtcaacaggcggcgcgttcccgccatcatgtcagggggcatgggggtctcctcgaggaggtggtgcatgcgcgtcagccaggcggttcgccgtcacacacgcggcgccccttcagtggctttcgggcaggccggtgtatacggccaacacgctgtcgcttgtatcgcgagaacggcgcagtcgctctcttggctgcatgctgcaatcgcatgcgacgtgggttcgggtcgcgattgccccagctgcgaacaccccgcgcggattgatgcgatgtccgtgtacgcggtgttcacatttcttcacgcggattgcattgcagcgcgtcgcgcacgggtcaggatggcgcactgcatggacaccgcgcgcttcatcctcttcgccctcgtcaccggcatcgccacggtcgccgtccacgtctacttgtaccggcgcctcttcacggccacgtcggagcaccgcgcatggcggcgcgtgggcatgggcgtcatgacggtgctgggcacactgctagtgctgtcatggtcggtgacgcgcttccttcccatggactccaccttcgccgtggccacggcggtgtggacgtggatgggcatggccatctacctgttgctcgcgctcggagtgttgggcgcggtgcgcaaggtggcggcgcgaatgcagcgctcaagcggcgagccggcggtggtggagctgcgcggtggcgagacagcctcggtgtcccatgcgcatgcggtggatggctcggcacaggctggcggcacgctggcggcgacgggcacggagtccgtgtcagtgactccggaagccctggcgaccagtggacatggcgcggcggcgacgcacgccgaagctgctccggtggcgatggcggaaaggcccggcggcgccacgtccgaggctccagcaccggtggatgtggaacgccgacgcttccttgctcgggcgacagccggcggagcagtgctggccgcaggtggcgtgacgggcttcgggatgtggagcgccttccatccgcccgtggtgaacgaggtggcggtgaagctgccggggctgcccaaggcgctggatggcttcagcatcgtccacttgagtgacatccacgtggggccggtcatccggcgccggttcatggacgagctggtgcgccgctgcaacgcgttgcgctccgacctggtgtgcatcactggcgacctggtggacggacacgtcgcgtcgctggccccagcggtctcggcgctgtccgagctgaagtcacgccacggcacctacttcgtcacgggaaaccacgagtactactggagcgacgctgcctgggcggaagcgctggagcgtatggatgtgcacgttctgcgcaaccgtcacgtgcgcattggcgacacggccgcgtcattcgacctggtgggtgtggacgactggtcggcgggcaagatggggttctcgcaaggctatgacctggcggcggcgacggcgggccgggattccgagcgggcctcggtgctactcgcgcatcagccgtcgaactggaaggtggcggcgcgggaaggaatgggcttgcagctctccggacacacacatgggggacagttcttccccttcacgctggcggtctccgccatctgggagcacgacgcgggcttgtttcacgaaggagaccggcacctgtatgtcagccggggaacaggtttctggggtccgccgctccgcgtcggagcgccgccggagatcgtccgggtgacactcctggcgtgatgcatagattcggcgggtatggccagggaacccgcccaacgagagctgaaacaagagcgtgccgcgcgcacgcgcatggacattctggaagcggccatccacctcttcgcgaggcgaggcttcctcgccacgacgatggcggacttatcccgcgccatccggatgacgcccggagcgctgtactggcacttccccaccaaggaagacctgctgctggctgcgattgaggaattacaccagcgctgtctgagagcctttcagctacctggagacgaccgcgagcttccggcgcgggagcaattccaagccatctgcgagcggacgcacctcctccttcgcgagcaccgcgaatacggaatcttcttcgcgatgctcgcggccgaggccgccgactccaatgaccaggtagcggaggccatccgagacaagctggccctctacgcgacgacgctggagcgcctcatccgtcacgggcagcagatgggggagttccggcaggacgtggacgcactcgccgccgcgcacagcctcctgggcgggctcctgggcatgctcgtgcaccagaacctcttccgcgcctccgtggattacgacccgctgtaccgcgccgtcatgcggatacacctggcgggactcgtgcaggccacaggcttcgactgcgtcaatgccagccagtcctgacatccctgacgcggcaacgccagccagcgcccggatacatgccagctcaaaatgaaacgggcggaaccccatgtcagggttccgcccgcttgaagccttacggagacagggccggcacttcagccctgtctccatgatgcctgacggctacggctgctccgccgggctcagctcaactacggcgtcttcgtgatgacgttcgccgcgccaggggtgacggtcgtggtgaaggagaagtccgccgcgttcacgtccgtgtcggtcgagtccgcgtcccggcacagcgagccctgagcggtgttgctgtccgccagggtcttcgtgtccgcgtcaccctcccgcaggtcgaacttcgtgtccgtcccggcgatggtggcgttcaccacgtgcccctcgtaggagagggagtcaatcaacgcatccgtggcctcgtcgtacagggccaccgcgtccggctcaccgttctggatgaagtcggtggtcccccgctgcagcgtgtgcacgccggcacgccccgcgagcggcccgacgacggtggcagcgcccacgaccagatactcccggggtcccaggacgccgccgttgacttccgccaaggcaatcttctggtagctcgacatgttgctgccgttgacgaacaccaggaacacgctgctcagcgacgcgggcgtagaggagttgttgtagatctccacgaactccagcgagtcacccgcgccgggcatgtcgtagtccacctcgttgatgaccagtccgccttccgcggtcaggatgacggacacctgagcggtccggtccaccccgccgaagctcgccgtgagcagcgcctccgcggggctcgagacctcgtccgccgtgaaggtgaaggtcgccgtcgtcgcatcccgagccacccggaccgaggccggaatgagcccgacgcccgtcgccggctccagcgtcagcgcaacgtccgtctcgtccgtctgcgccggacggtccagcgtcaccgtgaaggtgaacgtccggcccgtcaacaccgctgcggtggacggagacagcgcgctgagcacgggcggaggcggaagcaccgtgagcgcggtggtctgggtgatgccgtacagcgaggcgtacaccgtgcccgtgccctcgccctgcgcgtccgccgtgaaggtgaaggtcacctccgtggcgcccgccggaatcgtggccgaggccggcaccgtgccgtagttctgcacgcccgcccccggcaccaccgccagctcaacaaccgtgtcctgcgcggccgcacggtccaccgtcagggtgaacgtctgcgtcccgcccgccggaatcgtcaccgccgaggacggcgacagggccgtcagccgcggcgcattctggtccagcgtcacagtggcgctcgcgctggtcgcaccgatgctcgccgtcaccgtgccgggctcggtggccgtggccgccgcgtccgtgatgaaggagaacacggcctccgtggcgttctccgtcacggtgagcgtgccgttcgccggaacgaaggtgccgaagcccgtcgccggattcacgctcagcgccacagtggcgttggcgggcgccggacggtccagttgcacggtgaagaccacctcgccgccgggcaccatcgtcacgtcacccggggtgacgcctaccacctcgggctgctcgtcggcacccagcacccggatggtggccgtctgcgtggagccgcccagcgtggccgtcagcgtcacgctctgcgcgggcgccaccgcgttcacctgcaccgtcgcggacgtctgacccgcggggatggtgatgcggccgtcctgcacgctcagcgcgctctcgttggaggaggtgatgacgacgtcgagcgcctccgcgtaggcggacgacagcgacagcgtcagcgcctgcgggaaggtgttcaccgggcccgtgccacccacgcgcgcatagccgtccggaccaaagcccgtcagcgacggcggcggcagcggcatgtccgcctggaagcgcggcaccagcttggagtcattgaagttgtacgtcagcacgccgcgcagcgcgccgaagcgcgtgccaatggacgggacctggaaggcataggcctggtcgtcaatcatcagacccggctgaccggcgtcacccgcctcgttcaccaggaactggccgaactcgtccacccccgtgttgaccgccacgtcgcggacctccacgagcacaccttccagcgcggcggcacgcgggcccccggtgcgaatgtcggccgtcgtcaccaccaccggcgcgggaacctcgttgccggagctgcgcttgacgtacttgacctcggtcagctcgggcaggccgaagtagacggtcagcacgcccgtggtgatgtcgatgcgatcacccgcggcgaggtcgcccttgggcgagtacacatagagaccggagttatccacgctcgtgcccgaaggcagcggatacgtctgcacccagtagccctgggagctcgcgccgcccttcaccacaccggtgacgacgacgtccaggatggacaccggcttgcccaccagcggcaggctgccgcccacgggcgtcttcagctcgtgaatggtggcggggcagcccaggtcgcccggattcggaacgctggagcacgcgtcacacgcatcacccttgccgtcgccgtccgcgtccgcctggtccgggttggcaacgaacgggcagttgtccagccacgtcacgatgccgtcgtggtcatcgtcgcccacggtgaacgacgtgcaggcgttacccgcctccagcgggcaggggtcgcacgcgtcgccaatcccgtcgccatccgagtccgcctgcttgccattgtccatggggcggatggggttgaagatggcagggcagttgtcgacggagtccaccagcccgtccccgtccttgtccgcggcgcgaacctcaccggtgtagctggtggagctgttcacgacggccggccagcgcgagtccagcgaggcacggcggggcgagcacgtcggctcgttctccggcgtaccgcacgcgaacagcgggtacttcgccgtggcgcccgacgtcagcgcctccaggttcttgccaatctcggactggaggcagacttccttcgaggcgccgcacacgtccagcgtgtcgcaggtgtccgcgccgcggagcccggccatcagcgcctggtcaccgtagagcgccttgccaccccgcatcgtgagcaccacgtgctcggggttcgaggtgatgaccgcgcggtgcggcgagcgggtgaaggtccgcagctggaagatggccaggtcggccaccttgccctcggcgatgcggcccgtcttctcgaacgtgtccaccaggtccgacgcgttcgacgtcaccatgcgccagaggtcctcgtcgctgaaggtccgcgcgtagtgcgaggtgttgaggtagtccgcgcactggagctcgcgcagcaggttcatggagccggagcgcagccagtcggtgcccagcgcgatggtgacaccctggttcttgtaggccgacaccatggccgtatcgccgtacagcgagatgttcgagcggggcgaccagataaggccggtgccgttctccgccatgacgcgaatctccttcgccgtcaggccgatgccgtggatgacggcggtgcgcggctgcatcacgttgttcgtgcccgtggacaggcagaggaactcgttgagcgccgccgcggagataccctcggagacgtgcggcaggtacgcggccgagcgcggcagcgagctcgtggacggcatcgaggtgtaggtacagcccgaggcaaccatgttgccattggtgtcgcccagcgggaacgtgtccgagttcaccacaccctcgcccaggccctcctggagcgcggtgttgttcacgtccacgttgcgcagcaggccagcctggccacccgcgcccgccatggaggtggcgcccgccatcatctgccgcagctcgccccagcgaacgttgtccgcggcgctggccgcggggctgttgatgcgcgtgtggccgttgcggcccgtgcgccactcgtggcggtgctcgtagcgctcctcggtgccgacgtacggctccatcggatacgtgatgtgctcgtgcggattcaccaggcccggggagatgacaccaccggggcaggacacctgcgtggcatcggcggcgcccgccgcggcggagcagtcacaggcggcgcactggatgatgccctgcgcgtccaccagcacctggccgcccaccagcgtctcgccgtccttcagcaccacgcccgtgaagaggcgcgcggcggagcccggctgcgtcaccgcgcaggtggccccgtcgggaagcgcgggcgcgttggccgcggggcatagggtcagcgtcggcgtgcagtccgcctgacagccatcaccgtccaccgtgttgccgtcgtcacagacctcttcgccttccagcttgccgttgccacataccgcggccggcgcgggcgtccgcgtacagtcggactcacagccgtcgccgtccaccttgttgccgtcgtcgcactgctcgccctgctccacggtgttgttgccgcagaccgcttgcgggttgcagctcgcaccctcacagccaggctcgtcgccgcatccggcgtggaagaggaggaccgcgcctagcgcggcgagtaataaacgtggggacattcgcatctcgtgggtctcccggcggagccggccggagggaaggtggcaggtccttggcacgcgaagagcgtaccccttgaaacatttcagcgacacctgaccgcacaggtccagttcccaagcgtccgcgctcgcgaatgtgccgtggagtacgccgctcacctcacctcaagtacggggtgttcaacgcctacctgtcggactggcccgcaccctgctcttgacgcaccgcgagagccctgcgcgcaggtgccgcacgcgctacaagccgctgcacgtttcaacaccgggagcccgcgtcatggacgtcgccgtcctcaccttcgaaggcctgcctcaactcgatgcctttgacgcatcgctgctgcccgcgctcgcggccctgggcgtggaggcccggcccgtcgtctgggatgacccggccatggactggaagacggtgcggctggccctggtgcgcaacacgtgggacagccacctgcgccgcgacgccttcgtcgcctgggcggacaaggtgggccgcctcacgcagctccacaatcccgcgcccgtgctgcgctggaacacgcacaagcactacctgcgcgaactagaggagaagggcgtgttggtgacgcccaccacctgggtgcgcaagggcgacacgctcgatgtgggcgagctggcgctcaggcacagctgggacgcggtggtgctcaagcccgccgtgtccgcgggagcgctcaagacgcacgtcttcccacgcgcggaggcccccgccgccaccgcccggctggccgagctgacccgcgagggcgacgtcatggtgcagccctacctcaccgccttcgaaacggagggcgagcgcagctacgtcttcttcgacggcgtcctcagccacgcggtgcgccggccccccacgctgctggacgcaccgcgcggcttctccgagcccaccgccttcacgcccgaggacgcagccgagctgcggctggcggagtccgtgctggaagcagtgggacgtcccctgctctacgcccgcgtggacgtggccaccgacaacgcgggccagtcgcggctgcaagagctggaggccaccgagccgcgcctgttcctgtcgctcgacgccggggccgcggaccggctggcccgcgccatcgtcgcgaagctgtgaggccggactacaggccgcacaccgccgggccatgcgttgcggaagttgcacagcagcttcggcaagcgccgcttccagaaggcccagtcgtgctcggcgccgggctcgttccagtgggccacgccgtagccacggccgcgcagcgcctccacgaactccaggttggactggcagtcgtccccaccctcctcgccgtcccgcgtgcagcccgccacgggcgagccgtggtccacgtagaagcgcaccggcaccaccggctcctggctcgcgcggacaatcatcgcgttgccgtcgtcgcggtccaccacgccgtcatggggccagaacagcgtgccggactgggatcccacgaagccgaacttctccggcatctggaagcccgcgtacacggagatgaggccgcccagcgacgcgcccgcgatgcccgtctcctgggggcccgtcttcacgcggtaggacgcctccactcgcggcatcaggtcgtcgcggatgaaggccaggtagtcatccccgcgcggcgtgggccagcccggcgcgcgcgcgggcgggaaggtgtactgcgccaggcgcacggactggtccggcagcgccacgaagacgagcaccgccgagtccgccggccgcgccgcgtagtgcgagtccgccgcttccgcgaaggactcgcgcgtcaggctctcgttgccgtcgtggaggtacatcaccggcagggacgggcactccggcccgtcatactccgccggcgtgtagacgaagacgtcgcgcgcatcccccaacaccgtggcgggcacgccgtaccacgcggtgagccggcccttcgcggcgtcctggagctccgggtagatgagcgagttgaaccgccccacgtcgtgccggttgaagtcgtcccacgcgacgtggcgcgcgcccgggtccgcgatgaagtcgccgtccttcaccagcttgtagggctgcgggccggtgcgcggcacctccacctccgccacgtacaggtcggtgtccctcacctgcaccagcggcgtggccgtagcggaccatccgttgaagtcgccggcgacgaaggtgtcccggccggcctcacctcgcacgaagaaggccacgcgaggatgacccgccttgacgtcactcaccaggggccggccgccctgctcctccacctccgccacgaagcggtcgatggcctccgtgcgctgcgcggaggacgtggcgcggctcatctccagttgcagccgggtgagcagcctcatgggcgcgttgtgcaccgtcgtgctccgctggcaggcccagggctcctgggtgcccgcgtccgggcgcgtgccggcgtccgggtacgtctccgtggagggaggcggcggcgtgggaggcggtggggaatcgtcttcacaagccgccagcacgacggcggcgcagaacacggcggcgagcaggcgacgcatcgaatcttccaggaggcggggatgccttgtccgggggacaggaggcggtcgcgggtgtactacaggggtcagcccgggcgcgagtggggcatcccacccgcatctggccattcgttgacatcccatggccccccacgcgcaccttctcgggccgcgacgggggaggaaggttattcaacccgcatggctcgcgcactgctgctctcgctgctcgtgaggcagcacatggctctcaaggagaagtttcgcgccaagtacccacacccatggctggtgtgggaggcgggcgcttggaatgtccccgaagtggtggagggcaacgtggccgccacgcggctgccgctgacggacctgcgggactgcctgcccgctggagacgccctgtgcttcgaactggtgggccagacggacggcagcccgctgcggctgggccgggcctcgaacaacgcgctggtcgtcaatgacgccaccgtgtcgcgcgagcagctccacctgtcccccaccctggaaggacgctggacggtgacacgcgtggccgcttcccggacggtgacgctgggcggcacggccctggagccggagcagcccaccgtgctccagcccggcgtgcagcttcacgtgggtgatgtgcgcctcaccttccacgcggcggaggacttcgacgagcgcattggccgcatcgccgctcaggtgctcgcccagacagcggcgccccgctgagcgctcaggccccgcctcccagggcggggccaccgcgacacctactgcgcgacagggcgctcgcggctcttcttgcctgtgtctcgctgcgtcccagccgcaggcttctgccggggcgaaggcagcgccttcaccaacggcacctccagctcggcgtgcttgtccaggtccaccatccgctccagcggggcatagccggccagctccacgcgcaggcgcagcggcgcggcctcaccagacacctgcttcaccagcggcgtcacacccagcagctcgcccgtgtccaggcgcagcacctgcgcgccctccgggaaggagcgcaccgtgagcgtgacgggcggaagcagttggggcgcggctgcgggccggcccacgacgtcggccacctgggccactggagcctcggcgggggcgggctccggctgcatgccggaccaggtgaccaccgcggccaccaccaccaacgccgcggtccccaccgtcaccaccgcccggcggtgccagcgccccgtcaccgccacctgcaccttgtgcgtgggccgctcggaggcctccagcgccagctcggcgggcgcgggcgtcagcgcctgggcggacgcgggcaacaggaggagcgacgtcgtcacctccgtcaggctctgcggccgggcctcgggctccttcgacaggcagcgcatcaccagctccgccagctgcggtggaacgggctcgccggacggcaggtgcgagggcaacggcggcggcggctgggtgatgatctgcaccaccagatggccgaaggccggcgcctggaagggcggcttgccggagatgagctcgtagaggatgttgcccaccgcgtagatgtcggagcgcgcatccaccggcaggcccgcggcctgctccggcgccatgtacgcgggcgtcccgatgatggtgccgtccaccgtcccggtggtgctcccctcggcggtgagcaacttcgccacaccgaagtccaacaccttcacgaagtccggctggcccgcgcggtggatgacgaagaggttgtccggcttcacgtcccggtgcaccacgcccacctggtgggccgcgccgagcgccgcgcacacctgcaccacgaagcgctggatgcgcgccagcgtcagcggctccgcctgcgccagcgagctcaggctctgcccgcgcagcagctccatcacgcagtagacgtgcccgcccatcgcgctctcgtcgacgaagtcgaaaatctccacgatgtgctcgtggttgatttgattgacggtgcgggcctcctggaagaagcgccgcacgaagccgccgtcccgcgcgtgctccggccgcaggaccttgagcgccacctggcgccccagccgcgtgtgccgcgcctggaacacccggcccatggacccttcgcccaggagttgctccaactggtagttccccagcgtggagccctcctggagctcctcgtcactggctcggggccccgcgtcactcacgggggcctcggcactggactgcatggtctgcatgaaggcgtcatcggagcccatgatgagaagaaatttccatgtccgaggcaaacagcaaccctggatctgcactctgtcttcccagggacgccacccaccctcggtgagtgcgggatggcggacattgacgcacggaagccgacttcatcacagacagaccccgttcacctggcagcgcggataatcgttttcgcgatccgacctgaggggcccgcactgcgtttccgtggggcagtccgcgcggtccgcgcagtccaccaagccatccccatcatcatcctcgccgttggtgcagctcacctccgtcttcgagcccccctcgcacacgcactccggaccacacgacttgccgtcgcagtccgcgcggtcctggcagtccgggaagccgtccccgtcgtcgtcctggccgttggcgcagtctagctcctgacggcgcacgcactcgccattcacgcagtcctggaggaaggaacaatcattgttgcaggcgccgcagtggcccgggtccgtcttcaggtcgaagtcctcgtccgccgtcccgtcgcagtcgtcatccaggccattgcagatttcagtgccaggcagcacctgccccacgcacgcgatgctcgcatcccgggtacagatggactcaccggcgtgacagagacccacgtcgagcgtcccttccggccccgtgtagcaggcggtctccaggttatcgaccaggccgtcgcagtcgtcgtccaggccgttgcagacctccgtggggtccggcaggcagcagtaccgaggcccgttgtccggcagggacgtgcagacgtagccgtcaccgccgcagtcagcggtctccgtgcacgtgtagggcacgtcgtccgggaaattcaccgtacagcccaccgcgcccgcgacgagcaacaggccacaccacacgcgcagccgggattcgaaggtcttcataggatctagaaactcccgccgaccatgatgtgcagggacgtggaggcgccaccgccgcttccgggcgccacggacgtcgatgcgggcgcgctgcgcgcgggcaccagcaccagccacgccacgctgcccgccgtcaccgcgccgccgcccaccaacaaaaccgtggccagattggcctgggactgcgcgtccagccgctccttgcgagtgacgtcgaacatgccgtccccatccgcgtcgcccccgcgcttctccacgtccttggcggccatgcccatcaccacacccgccccgaccgcggccagtcccaccagcacggtgtagagcgcgggccgcttgaagagggacttctgaggcgccttccgggaagacgccacgccgaccacggaatcatcgggaggtccatccggcgccggaccggaaatctccagcatgacgtccacggtctcgcgcgcgccgggcatgaggtccagggtacgcgtctgcgtgccgtactcgtctgcggacacctctaccgccaccgcgccgggtgcctggcgcacctccacgctgcccacgcccacgatgcgctcgcccaccttcaccaccgcctgcggcacgttgacattcaccgtcagcatcgcgcgcgggcgggccaacgccgtcaggcgcttggacagcatcgcggcggcttcgttcgcgaagtcctcgtcgcgcgggttgcgccccgtcacgaagtcctcgtgcaccacgcggaggtccctgtcgtaggtccacgtccgcagcgtccagcccgcatcctccaaagacagacgcccggtggtcagcaggtccgcgtccagcaactccgcgggctcggcgaagcacgcggcctccgcgcatcgcaccgccgcgtcgtgaccctccgccagccgctcacgcgtctccaccaggtccgacgcctgcgccaccatggcggaggacaacgccccgcgcgccagggcctccaaccagctcgacgcctgctgcgcacccgcgcgctccgtcgcgtacagccccaccaacgcgaagcgaggcaggaggtccgcgttgggattgctgggacgcaggtccaaccccatgtccattccctgctgctcggcgggggcgtccgaggtgaggtccagacccagcccaccctgttcctgagcccacgagggagcagccagcagcacgagcgccagcagggcggtgacgggagcaacaggaatacgcatggccccctcttgtatcgcgacgctccgcgcaacggaatgaggcgcccggggcgcccccagtccccgcaaaacccgtcaacgatgcgcggcctggctgcctgccctgcgctcggcgtgcgtgcggctcgtctggggaagcttgccttggcccggaggggtccgcatctcccactctatagcgcaaggagacgcacgacatggcgaatgggacgctctggattctggtggggaacgcaagccgggcccgcctcttcgcgacggacgcgaaggcggaagaggactggcggctggtggaggagttccaccacgacgagagtcgggcccgtcaggcagagctgattgagcaggcggacaaccccaatgccggcaccctgcacggcccgccggcggagaacgagcccaatggacgaagggagctggagcacgaccgcttcgcccgcgagctgtccgtgttcctggacaaggcacatgaccggcgcgacttcgacaagctggtcatcgccgcgccgccgggattcctggggaggattcgccgcttgctgagcgcccgggtccggcagcgcgtcctcctggacgtggactcggactactccaacgtcccggcgaaggagctgcccaaccgggtgcctgtcatctgagcaggcaggcgcgggggtgccctggagacgcggggctctggtataggacgagggccgacctttctgggaggcccccgcacgctgcccgccgcgccacatggccctttctcttcctggaaccaagtcccttcgtggacgcctcacgctctacgcgacgctgctgtcggtcgtcccgctgctgacgctgacctggctccaggcccgcagcgcgcggcaggtgatggaag
